United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 51

SEQ ID NO: 2293085 - RNA, 15 nt, Human
aucucagucaugcau

SEQ ID NO: 2293086 - RNA, 16 nt, Human
aucucagucaugcaua

SEQ ID NO: 2293087 - RNA, 18 nt, Human
aucucagucaugcauaaa

SEQ ID NO: 2293088 - RNA, 20 nt, Human
aucucagucaugcauaaaua

SEQ ID NO: 2293089 - RNA, 23 nt, Human
aucucaugccccuggcugggacg

SEQ ID NO: 2293090 - RNA, 22 nt, Human
aucucauggagaagcagaaaua

SEQ ID NO: 2293091 - RNA, 24 nt, Human
aucucauggagaagcagaaauaca

SEQ ID NO: 2293092 - RNA, 21 nt, Human
aucucaugccccuggcuggga

SEQ ID NO: 2293093 - RNA, 21 nt, Human
aucucagucaugcauaaauau

SEQ ID NO: 2293094 - RNA, 22 nt, Human
aucucagucaugcauaaauaug

SEQ ID NO: 2293095 - RNA, 16 nt, Human
aucucagggccugguc

SEQ ID NO: 2293096 - RNA, 20 nt, Human
aucuagagcuugaugccagu

SEQ ID NO: 2293097 - RNA, 15 nt, Human
aucucaggggccaga

SEQ ID NO: 2293098 - RNA, 16 nt, Human
aucucaggggccagag

SEQ ID NO: 2293099 - RNA, 17 nt, Human
aucucaggggccagagg

SEQ ID NO: 2293100 - RNA, 23 nt, Human
aucucaggggccagaggaacugu

SEQ ID NO: 2293101 - RNA, 17 nt, Human
aucucaggggcuguuug

SEQ ID NO: 2293102 - RNA, 20 nt, Human
aucucaggggcuguuugagg

SEQ ID NO: 2293103 - RNA, 21 nt, Human
aucucaggggcuguuugagga

SEQ ID NO: 2293104 - RNA, 13 nt, Human
aucuccaagaaug

SEQ ID NO: 2293105 - RNA, 14 nt, Human
aucuccaagaaugc

SEQ ID NO: 2293106 - RNA, 21 nt, Human
aucuccaaaauaaaacuuuuu

SEQ ID NO: 2293107 - RNA, 20 nt, Human
aucuccaaaauaaaacuuuu

SEQ ID NO: 2293108 - RNA, 17 nt, Human
aucuccaaaauaaaacu

SEQ ID NO: 2293109 - RNA, 14 nt, Human
aucuccaaaauaaa

SEQ ID NO: 2293110 - RNA, 14 nt, Human
aucucauuuccaag

SEQ ID NO: 2293111 - RNA, 20 nt, Human
aucucauuggacccuuccau

SEQ ID NO: 2293112 - RNA, 19 nt, Human
aucucauuggacccuucca

SEQ ID NO: 2293113 - RNA, 15 nt, Human
aucucauuggacccu

SEQ ID NO: 2293114 - RNA, 14 nt, Human
aucucauuggaccc

SEQ ID NO: 2293115 - RNA, 17 nt, Human
aucucauugcuuacaag

SEQ ID NO: 2293116 - RNA, 16 nt, Human
aucucauugcuuacaa

SEQ ID NO: 2293117 - RNA, 16 nt, Human
aucucauguaucaucu

SEQ ID NO: 2293118 - RNA, 19 nt, Human
aucucauguaucaucugga

SEQ ID NO: 2293119 - RNA, 18 nt, Human
aucuccaagaccagagau

SEQ ID NO: 2293120 - RNA, 20 nt, Human
aucuccaagaaugcugaaac

SEQ ID NO: 2293121 - RNA, 22 nt, Human
aucuccaagaaugcugaaacca

SEQ ID NO: 2293122 - RNA, 15 nt, Human
aucuccaagaaugcu

SEQ ID NO: 2293123 - RNA, 16 nt, Human
aucuccaagaaugcug

SEQ ID NO: 2293124 - RNA, 17 nt, Human
aucuccaagaaugcuga

SEQ ID NO: 2293125 - RNA, 18 nt, Human
aucuccaagaaugcugaa

SEQ ID NO: 2293126 - RNA, 19 nt, Human
aucuccacagucaaagaag

SEQ ID NO: 2293127 - RNA, 16 nt, Human
aucuccaaggaccagg

SEQ ID NO: 2293128 - RNA, 12 nt, Human
aucuccaaggac

SEQ ID NO: 2293129 - RNA, 15 nt, Human
aucuccacccccagc

SEQ ID NO: 2293130 - RNA, 19 nt, Human
aucuccacccccagcugcu

SEQ ID NO: 2293131 - RNA, 21 nt, Human
aucuccacccccagcugcuug

SEQ ID NO: 2293132 - RNA, 22 nt, Human
aucuccacccccagcugcuugu

SEQ ID NO: 2293133 - RNA, 13 nt, Human
aucuccaccugcu

SEQ ID NO: 2293134 - RNA, 15 nt, Human
aucuccaccugcucc

SEQ ID NO: 2293135 - RNA, 15 nt, Human
aucucccccagcccc

SEQ ID NO: 2293136 - RNA, 19 nt, Human
aucuccaccugcucccagg

SEQ ID NO: 2293137 - RNA, 21 nt, Human
aucucuucuggguuccuuccu

SEQ ID NO: 2293138 - RNA, 16 nt, Human
aucucccccagcccca

SEQ ID NO: 2293139 - RNA, 17 nt, Human
aucucccccagccccau

SEQ ID NO: 2293140 - RNA, 15 nt, Human
aucucuugagccugg

SEQ ID NO: 2293141 - RNA, 20 nt, Human
aucucuucuuuuggcuucca

SEQ ID NO: 2293142 - RNA, 14 nt, Human
aucucuucuuuuaa

SEQ ID NO: 2293143 - RNA, 14 nt, Human
aucugaaaauguau

SEQ ID NO: 2293144 - RNA, 18 nt, Human
aucucuugagccugggag

SEQ ID NO: 2293145 - RNA, 22 nt, Human
aucugaaaauguauguguaagu

SEQ ID NO: 2293146 - RNA, 20 nt, Human
aucugaaaauguauguguaa

SEQ ID NO: 2293147 - RNA, 19 nt, Human
aucugaaaauguaugugua

SEQ ID NO: 2293148 - RNA, 16 nt, Human
aucugaaaauguaugu

SEQ ID NO: 2293149 - RNA, 14 nt, Human
uugagugacucgag

SEQ ID NO: 2293150 - RNA, 20 nt, Human
uugagugacucgaggguugg

SEQ ID NO: 2293151 - RNA, 20 nt, Human
uugagugaagcugggagaac

SEQ ID NO: 2293152 - RNA, 20 nt, Human
uugaguugauucagcucugc

SEQ ID NO: 2293153 - RNA, 16 nt, Human
uugaguucagguagcu

SEQ ID NO: 2293154 - RNA, 19 nt, Human
uugaguuuccucaggcugc

SEQ ID NO: 2293155 - RNA, 12 nt, Human
uugagugauuau

SEQ ID NO: 2293156 - RNA, 22 nt, Human
uugaguuuccucaggcugcugg

SEQ ID NO: 2293157 - RNA, 11 nt, Human
uugaguuuguc

SEQ ID NO: 2293158 - RNA, 23 nt, Human
uugaguuugucgcucaugugugc

SEQ ID NO: 2293159 - RNA, 16 nt, Human
uugaguuuuauuuauu

SEQ ID NO: 2293160 - RNA, 20 nt, Human
uugaguuuuauuuauuuuau

SEQ ID NO: 2293161 - RNA, 19 nt, Human
uugaguuuucaguggggca

SEQ ID NO: 2293162 - RNA, 14 nt, Human
uugaguuuucagug

SEQ ID NO: 2293163 - RNA, 19 nt, Human
uugaguuuucuucugugau

SEQ ID NO: 2293164 - RNA, 18 nt, Human
uugaguuuucuucuguga

SEQ ID NO: 2293165 - RNA, 13 nt, Human
uugauaauguuaa

SEQ ID NO: 2293166 - RNA, 15 nt, Human
uugauaauugcauuc

SEQ ID NO: 2293167 - RNA, 23 nt, Human
uugauaauugcauucaucuugug

SEQ ID NO: 2293168 - RNA, 14 nt, Human
uugauaauguuaaa

SEQ ID NO: 2293169 - RNA, 15 nt, Human
uugauaauguuaaau

SEQ ID NO: 2293170 - RNA, 18 nt, Human
uugauaauguuaaauuug

SEQ ID NO: 2293171 - RNA, 19 nt, Human
uugauaauguuaaauuugu

SEQ ID NO: 2293172 - RNA, 20 nt, Human
uugauaauguuaaauuugua

SEQ ID NO: 2293173 - RNA, 21 nt, Human
uugauaauguuaaauuuguaa

SEQ ID NO: 2293174 - RNA, 22 nt, Human
uugauaauguuaaauuuguaag

SEQ ID NO: 2293175 - RNA, 18 nt, Human
aucuaauauguaacaagc

SEQ ID NO: 2293176 - RNA, 16 nt, Human
aucuaauauggccaca

SEQ ID NO: 2293177 - RNA, 22 nt, Human
aucuaauagcggguuacuuuca

SEQ ID NO: 2293178 - RNA, 22 nt, Human
aucuaauaccucugugugcucc

SEQ ID NO: 2293179 - RNA, 21 nt, Human
aucuaauagcggguuacuuuc

SEQ ID NO: 2293180 - RNA, 13 nt, Human
uugauaccccccu

SEQ ID NO: 2293181 - RNA, 15 nt, Human
uugauaccccccucu

SEQ ID NO: 2293182 - RNA, 23 nt, Human
aucuaauauggccacaguagucu

SEQ ID NO: 2293183 - RNA, 18 nt, Human
aucuacacuccagugaga

SEQ ID NO: 2293184 - RNA, 21 nt, Human
aucuacaucuuuuuucacaaa

SEQ ID NO: 2293185 - RNA, 14 nt, Human
aucuacaucuuuuu

SEQ ID NO: 2293186 - RNA, 17 nt, Human
aucuacaucuuuuuuca

SEQ ID NO: 2293187 - RNA, 20 nt, Human
aucuacaucuuuuuucacaa

SEQ ID NO: 2293188 - RNA, 19 nt, Human
aucuacacuccagugagac

SEQ ID NO: 2293189 - RNA, 17 nt, Human
uugagaccucagccaug

SEQ ID NO: 2293190 - RNA, 16 nt, Human
uugagaucagccuggg

SEQ ID NO: 2293191 - RNA, 15 nt, Human
uugagaucagccugg

SEQ ID NO: 2293192 - RNA, 14 nt, Human
uugagacuaguuuu

SEQ ID NO: 2293193 - RNA, 15 nt, Human
uugagaccucagcca

SEQ ID NO: 2293194 - RNA, 14 nt, Human
uugagaccucagcc

SEQ ID NO: 2293195 - RNA, 22 nt, Human
uugagacaguuucuuagcuuuu

SEQ ID NO: 2293196 - RNA, 14 nt, Human
uugagucugugcca

SEQ ID NO: 2293197 - RNA, 22 nt, Human
uugagucauuauccuugcuaug

SEQ ID NO: 2293198 - RNA, 16 nt, Human
uugagucaaaaaaucu

SEQ ID NO: 2293199 - RNA, 12 nt, Human
uugagauuagag

SEQ ID NO: 2293200 - RNA, 13 nt, Human
uugaguagaggcu

SEQ ID NO: 2293201 - RNA, 16 nt, Human
uugagauguguucaca

SEQ ID NO: 2293202 - RNA, 23 nt, Human
uugagagaaauaugaagaacuga

SEQ ID NO: 2293203 - RNA, 17 nt, Human
uugagauguauuucaac

SEQ ID NO: 2293204 - RNA, 17 nt, Human
uugagauuagagggagg

SEQ ID NO: 2293205 - RNA, 12 nt, Human
uugacuuugucu

SEQ ID NO: 2293206 - RNA, 11 nt, Human
uugacuuuguc

SEQ ID NO: 2293207 - RNA, 15 nt, Human
uugagaccagccugg

SEQ ID NO: 2293208 - RNA, 13 nt, Human
uugagaccagccu

SEQ ID NO: 2293209 - RNA, 12 nt, Human
uugagacaguuu

SEQ ID NO: 2293210 - RNA, 13 nt, Human
uugagacaguuuc

SEQ ID NO: 2293211 - RNA, 17 nt, Human
uugagacaguuucuuag

SEQ ID NO: 2293212 - RNA, 19 nt, Human
uugagacaguuucuuagcu

SEQ ID NO: 2293213 - RNA, 21 nt, Human
uugacuuucagguacuaaaua

SEQ ID NO: 2293214 - RNA, 15 nt, Human
uugacuuucagguac

SEQ ID NO: 2293215 - RNA, 14 nt, Human
uugacuuucaggua

SEQ ID NO: 2293216 - RNA, 13 nt, Human
uugacuuucaggu

SEQ ID NO: 2293217 - RNA, 12 nt, Human
uugagacagagu

SEQ ID NO: 2293218 - RNA, 19 nt, Human
uugacuugacagaacacug

SEQ ID NO: 2293219 - RNA, 20 nt, Human
uugacuugacagaacacugu

SEQ ID NO: 2293220 - RNA, 23 nt, Human
uugacuguuuuuacccauauccc

SEQ ID NO: 2293221 - RNA, 15 nt, Human
uugacuuauuuucuc

SEQ ID NO: 2293222 - RNA, 21 nt, Human
uugacuugacagaacacuguc

SEQ ID NO: 2293223 - RNA, 12 nt, Human
uugacuuucagg

SEQ ID NO: 2293224 - RNA, 16 nt, Human
uugacuuauuuucucu

SEQ ID NO: 2293225 - RNA, 19 nt, Human
uugacagaucaagcuguga

SEQ ID NO: 2293226 - RNA, 17 nt, Human
uugacagaucaagcugu

SEQ ID NO: 2293227 - RNA, 18 nt, Human
uugacagaucaagcugug

SEQ ID NO: 2293228 - RNA, 18 nt, Human
uugacagcuuugcugcug

SEQ ID NO: 2293229 - RNA, 17 nt, Human
uugacagcuuugcugcu

SEQ ID NO: 2293230 - RNA, 14 nt, Human
uugacagcuuugcu

SEQ ID NO: 2293231 - RNA, 21 nt, Human
uugaauaaaaacuuugcuaaa

SEQ ID NO: 2293232 - RNA, 20 nt, Human
uugaauaaaaauauguacaa

SEQ ID NO: 2293233 - RNA, 16 nt, Human
uugaauaaaaaugcac

SEQ ID NO: 2293234 - RNA, 21 nt, Human
uugaauaaagccugcuuuuua

SEQ ID NO: 2293235 - RNA, 19 nt, Human
uugaauaaaguugaagcua

SEQ ID NO: 2293236 - RNA, 12 nt, Human
uugaauaaacua

SEQ ID NO: 2293237 - RNA, 17 nt, Human
uugaagggaaauuucag

SEQ ID NO: 2293238 - RNA, 23 nt, Human
uugaagcucuggugacaccagcc

SEQ ID NO: 2293239 - RNA, 15 nt, Human
uugaaggcaaaauug

SEQ ID NO: 2293240 - RNA, 12 nt, Human
uugaaggcaaaa

SEQ ID NO: 2293241 - RNA, 17 nt, Human
uugaaggcagaaagcaa

SEQ ID NO: 2293242 - RNA, 15 nt, Human
uugaaggcagaaagc

SEQ ID NO: 2293243 - RNA, 17 nt, Human
uugaaggcaaaauugca

SEQ ID NO: 2293244 - RNA, 13 nt, Human
uugaagcucuggu

SEQ ID NO: 2293245 - RNA, 14 nt, Human
uugaagcuaagauu

SEQ ID NO: 2293246 - RNA, 13 nt, Human
uugaagccuuugu

SEQ ID NO: 2293247 - RNA, 21 nt, Human
uugaagccugcccuugucuga

SEQ ID NO: 2293248 - RNA, 13 nt, Human
uugaagccugccc

SEQ ID NO: 2293249 - RNA, 15 nt, Human
uugaaucuauuuaag

SEQ ID NO: 2293250 - RNA, 15 nt, Human
uugaauccucucucu

SEQ ID NO: 2293251 - RNA, 17 nt, Human
uugaaucuauuuaagua

SEQ ID NO: 2293252 - RNA, 19 nt, Human
uugaauccaugcuugggug

SEQ ID NO: 2293253 - RNA, 17 nt, Human
uugaauccaugcuuggg

SEQ ID NO: 2293254 - RNA, 22 nt, Human
uugaaucauguaguaucaaaua

SEQ ID NO: 2293255 - RNA, 23 nt, Human
uugaaucauguaguaucaaauau

SEQ ID NO: 2293256 - RNA, 17 nt, Human
uugaaucaguauaaaca

SEQ ID NO: 2293257 - RNA, 23 nt, Human
uugaaucaauaauauauuuucug

SEQ ID NO: 2293258 - RNA, 14 nt, Human
uugacagaacacug

SEQ ID NO: 2293259 - RNA, 15 nt, Human
uugacagaacacugu

SEQ ID NO: 2293260 - RNA, 16 nt, Human
uugacagaacacuguc

SEQ ID NO: 2293261 - RNA, 17 nt, Human
uugacagaacacugucu

SEQ ID NO: 2293262 - RNA, 12 nt, Human
uugaauaaauaa

SEQ ID NO: 2293263 - RNA, 12 nt, Human
uugaauaauggu

SEQ ID NO: 2293264 - RNA, 19 nt, Human
uugaauaaugguaccagau

SEQ ID NO: 2293265 - RNA, 22 nt, Human
uugaauaaugguaccagauaaa

SEQ ID NO: 2293266 - RNA, 13 nt, Human
uugaaucacagua

SEQ ID NO: 2293267 - RNA, 14 nt, Human
uugaaucaauaaua

SEQ ID NO: 2293268 - RNA, 22 nt, Human
uugaaucaauaauauauuuucu

SEQ ID NO: 2293269 - RNA, 10 nt, Human
uugaaucaau

SEQ ID NO: 2293270 - RNA, 14 nt, Human
aucguucucugccu

SEQ ID NO: 2293271 - RNA, 18 nt, Human
aucguuauguguguauau

SEQ ID NO: 2293272 - RNA, 16 nt, Human
aucguuauguguguau

SEQ ID NO: 2293273 - RNA, 15 nt, Human
aucguuaugugugua

SEQ ID NO: 2293274 - RNA, 14 nt, Human
aucguuaugugugu

SEQ ID NO: 2293275 - RNA, 15 nt, Human
aucguuccaguuccc

SEQ ID NO: 2293276 - RNA, 21 nt, Human
aucguuauguguguauaugua

SEQ ID NO: 2293277 - RNA, 19 nt, Human
aucuaaaaauagacuuaaa

SEQ ID NO: 2293278 - RNA, 13 nt, Human
aucuaaauggaac

SEQ ID NO: 2293279 - RNA, 21 nt, Human
uugaagccacugaagcuggga

SEQ ID NO: 2293280 - RNA, 17 nt, Human
uugaagccacugaagcu

SEQ ID NO: 2293281 - RNA, 13 nt, Human
uugaagccacuga

SEQ ID NO: 2293282 - RNA, 23 nt, Human
uugaagccaagucagcuuugccu

SEQ ID NO: 2293283 - RNA, 20 nt, Human
uugaagccaaguggggugcu

SEQ ID NO: 2293284 - RNA, 23 nt, Human
uugaagcauuuuauaaaucgcuu

SEQ ID NO: 2293285 - RNA, 11 nt, Human
uugaagccaaa

SEQ ID NO: 2293286 - RNA, 14 nt, Human
uugaagccaaagaa

SEQ ID NO: 2293287 - RNA, 15 nt, Human
uugaagccaaagaaa

SEQ ID NO: 2293288 - RNA, 18 nt, Human
aucuaaauggaaccacuc

SEQ ID NO: 2293289 - RNA, 17 nt, Human
aucuaaauggaaccacu

SEQ ID NO: 2293290 - RNA, 22 nt, Human
aucguuaguaucuaacauguau

SEQ ID NO: 2293291 - RNA, 16 nt, Human
aucgugcuaaauuuuc

SEQ ID NO: 2293292 - RNA, 12 nt, Human
aucguggagaca

SEQ ID NO: 2293293 - RNA, 17 nt, Human
aucgugcuaaauuuuca

SEQ ID NO: 2293294 - RNA, 15 nt, Human
aucgugcuaaauuuu

SEQ ID NO: 2293295 - RNA, 12 nt, Human
aucgugcuaaau

SEQ ID NO: 2293296 - RNA, 23 nt, Human
aucgugccguuacucuccaaccu

SEQ ID NO: 2293297 - RNA, 14 nt, Human
auccucuggcuggc

SEQ ID NO: 2293298 - RNA, 19 nt, Human
aucgugccguuacucucca

SEQ ID NO: 2293299 - RNA, 20 nt, Human
auccucuguaaacuuuuugu

SEQ ID NO: 2293300 - RNA, 16 nt, Human
auccucuguacagagc

SEQ ID NO: 2293301 - RNA, 17 nt, Human
auccucuguacagagcc

SEQ ID NO: 2293302 - RNA, 10 nt, Human
auccucuggc

SEQ ID NO: 2293303 - RNA, 12 nt, Human
auccucugaucu

SEQ ID NO: 2293304 - RNA, 18 nt, Human
auccucugagugugacca

SEQ ID NO: 2293305 - RNA, 20 nt, Human
auccucucaaccaccuuuca

SEQ ID NO: 2293306 - RNA, 23 nt, Human
auccuagccuuauccucugaucu

SEQ ID NO: 2293307 - RNA, 14 nt, Human
auccuccucccacc

SEQ ID NO: 2293308 - RNA, 11 nt, Human
auccuccugca

SEQ ID NO: 2293309 - RNA, 22 nt, Human
uugcuucuucuccuauguguaa

SEQ ID NO: 2293310 - RNA, 20 nt, Human
uugcucugccaacuucuuca

SEQ ID NO: 2293311 - RNA, 13 nt, Human
uugcuugaaacca

SEQ ID NO: 2293312 - RNA, 20 nt, Human
uugcucucuggccuuuuccu

SEQ ID NO: 2293313 - RNA, 18 nt, Human
uugcucucccucuucuca

SEQ ID NO: 2293314 - RNA, 23 nt, Human
uugcucucccucuucucaagugc

SEQ ID NO: 2293315 - RNA, 12 nt, Human
uugcucugcacc

SEQ ID NO: 2293316 - RNA, 13 nt, Human
uugcucugcaccc

SEQ ID NO: 2293317 - RNA, 15 nt, Human
uugcucugcaggcac

SEQ ID NO: 2293318 - RNA, 17 nt, Human
uugcucugcaggcaccu

SEQ ID NO: 2293319 - RNA, 13 nt, Human
uugcucucccggu

SEQ ID NO: 2293320 - RNA, 20 nt, Human
uugcucucccgguucuucca

SEQ ID NO: 2293321 - RNA, 21 nt, Human
uugcucucccgguucuuccag

SEQ ID NO: 2293322 - RNA, 22 nt, Human
uugcucucccgguucuuccagu

SEQ ID NO: 2293323 - RNA, 23 nt, Human
uugcucucccgguucuuccagug

SEQ ID NO: 2293324 - RNA, 13 nt, Human
uugcucucccucu

SEQ ID NO: 2293325 - RNA, 16 nt, Human
uugcucucccucuucu

SEQ ID NO: 2293326 - RNA, 12 nt, Human
uugcuccuugac

SEQ ID NO: 2293327 - RNA, 13 nt, Human
uugcucagucucc

SEQ ID NO: 2293328 - RNA, 21 nt, Human
uugcucuccccugcccugcug

SEQ ID NO: 2293329 - RNA, 15 nt, Human
uugcucaccuggggu

SEQ ID NO: 2293330 - RNA, 13 nt, Human
uugcucaccuggg

SEQ ID NO: 2293331 - RNA, 18 nt, Human
uugcucaaaaaaugagcu

SEQ ID NO: 2293332 - RNA, 16 nt, Human
uugcucaaaaaucugu

SEQ ID NO: 2293333 - RNA, 19 nt, Human
uugcucaaaucuauucaga

SEQ ID NO: 2293334 - RNA, 13 nt, Human
aucuugucucaau

SEQ ID NO: 2293335 - RNA, 14 nt, Human
aucuugucucaaug

SEQ ID NO: 2293336 - RNA, 15 nt, Human
aucuugucucaaugc

SEQ ID NO: 2293337 - RNA, 16 nt, Human
aucuugucucaaugcu

SEQ ID NO: 2293338 - RNA, 20 nt, Human
aucuugucucaaugcucaua

SEQ ID NO: 2293339 - RNA, 14 nt, Human
aucuugucucuggg

SEQ ID NO: 2293340 - RNA, 23 nt, Human
aucuugucucaaugcucauaacg

SEQ ID NO: 2293341 - RNA, 15 nt, Human
aucuugucucugggc

SEQ ID NO: 2293342 - RNA, 17 nt, Human
uugcucaaaaaaugagc

SEQ ID NO: 2293343 - RNA, 15 nt, Human
uugcuauuguaaaua

SEQ ID NO: 2293344 - RNA, 19 nt, Human
uugcuauuguaaauauguu

SEQ ID NO: 2293345 - RNA, 12 nt, Human
uugcuauuguaa

SEQ ID NO: 2293346 - RNA, 22 nt, Human
uugcuauuagacuguaggaaga

SEQ ID NO: 2293347 - RNA, 14 nt, Human
uugcuauuagagca

SEQ ID NO: 2293348 - RNA, 17 nt, Human
uugcuauuagagcauug

SEQ ID NO: 2293349 - RNA, 21 nt, Human
aucuuagugccugagaguauu

SEQ ID NO: 2293350 - RNA, 12 nt, Human
aucuuagugguu

SEQ ID NO: 2293351 - RNA, 18 nt, Human
aucuuagugccugagagu

SEQ ID NO: 2293352 - RNA, 16 nt, Human
aucuuaguauuugcau

SEQ ID NO: 2293353 - RNA, 14 nt, Human
aucuuaguuuggau

SEQ ID NO: 2293354 - RNA, 22 nt, Human
aucuuaguuuggauucuuaugu

SEQ ID NO: 2293355 - RNA, 20 nt, Human
aucuguuuuuaaaaaucaua

SEQ ID NO: 2293356 - RNA, 19 nt, Human
aucuguuuuuaaaaaucau

SEQ ID NO: 2293357 - RNA, 18 nt, Human
aucuguuuuuaaaaauca

SEQ ID NO: 2293358 - RNA, 19 nt, Human
aucuguuuugaaggcaaaa

SEQ ID NO: 2293359 - RNA, 22 nt, Human
aucuguuuuaaauuuauuucaa

SEQ ID NO: 2293360 - RNA, 18 nt, Human
aucuguuuugaaggcaaa

SEQ ID NO: 2293361 - RNA, 17 nt, Human
aucuguuuugaaggcaa

SEQ ID NO: 2293362 - RNA, 14 nt, Human
aucuguuuuaaauu

SEQ ID NO: 2293363 - RNA, 13 nt, Human
aucuguuucccag

SEQ ID NO: 2293364 - RNA, 14 nt, Human
aucuguuucccagc

SEQ ID NO: 2293365 - RNA, 17 nt, Human
aucuguuuacaguguuc

SEQ ID NO: 2293366 - RNA, 15 nt, Human
aucuguuuacagugu

SEQ ID NO: 2293367 - RNA, 18 nt, Human
aucugugaaaggaaagag

SEQ ID NO: 2293368 - RNA, 20 nt, Human
aucuuggucagauuugaacu

SEQ ID NO: 2293369 - RNA, 13 nt, Human
aucuugcucugcu

SEQ ID NO: 2293370 - RNA, 23 nt, Human
aucuugguccaggaaaugugcac

SEQ ID NO: 2293371 - RNA, 22 nt, Human
aucuugguacuacuagaugucu

SEQ ID NO: 2293372 - RNA, 19 nt, Human
aucuugguccaggaaaugu

SEQ ID NO: 2293373 - RNA, 23 nt, Human
aucuugguaaauuuccccaacag

SEQ ID NO: 2293374 - RNA, 23 nt, Human
aucuugaucugcucagcccugga

SEQ ID NO: 2293375 - RNA, 24 nt, Human
aucuugcaccccaaagcuuuccug

SEQ ID NO: 2293376 - RNA, 23 nt, Human
aucuuaguuuggauucuuaugua

SEQ ID NO: 2293377 - RNA, 14 nt, Human
aucuuauaauuuaa

SEQ ID NO: 2293378 - RNA, 19 nt, Human
aucugcucagcccuggagg

SEQ ID NO: 2293379 - RNA, 17 nt, Human
aucugcucagcccugga

SEQ ID NO: 2293380 - RNA, 18 nt, Human
aucugcucagcccuggag

SEQ ID NO: 2293381 - RNA, 14 nt, Human
aucugguuuugcua

SEQ ID NO: 2293382 - RNA, 22 nt, Human
aucugguuugacuccgcuggag

SEQ ID NO: 2293383 - RNA, 15 nt, Human
aucuguagggcugga

SEQ ID NO: 2293384 - RNA, 17 nt, Human
aucuguagggcuggacc

SEQ ID NO: 2293385 - RNA, 18 nt, Human
aucuguagggcuggaccu

SEQ ID NO: 2293386 - RNA, 17 nt, Human
aucuguauaaguaagaa

SEQ ID NO: 2293387 - RNA, 20 nt, Human
aucuguauauacaauaacau

SEQ ID NO: 2293388 - RNA, 14 nt, Human
aucuguauauacaa

SEQ ID NO: 2293389 - RNA, 21 nt, Human
aucuguauaaguaagaaaaua

SEQ ID NO: 2293390 - RNA, 16 nt, Human
aucuguauauaaaaua

SEQ ID NO: 2293391 - RNA, 17 nt, Human
aucuguauauaaaauau

SEQ ID NO: 2293392 - RNA, 19 nt, Human
aucuguauauaaaauauuu

SEQ ID NO: 2293393 - RNA, 18 nt, Human
aucuguauacccucuguu

SEQ ID NO: 2293394 - RNA, 19 nt, Human
aucuguauaaguaagaaaa

SEQ ID NO: 2293395 - RNA, 20 nt, Human
aucuguauaaguaagaaaau

SEQ ID NO: 2293396 - RNA, 23 nt, Human
aucuguauaaguaagaaaauauu

SEQ ID NO: 2293397 - RNA, 14 nt, Human
aucugcucagcagc

SEQ ID NO: 2293398 - RNA, 15 nt, Human
aucugcucagcagcu

SEQ ID NO: 2293399 - RNA, 13 nt, Human
aucugcucagccc

SEQ ID NO: 2293400 - RNA, 14 nt, Human
aucugcucagcccu

SEQ ID NO: 2293401 - RNA, 15 nt, Human
aucugcucagcccug

SEQ ID NO: 2293402 - RNA, 16 nt, Human
aucugcucagcccugg

SEQ ID NO: 2293403 - RNA, 10 nt, Human
aucuggugac

SEQ ID NO: 2293404 - RNA, 16 nt, Human
aucuggugacuuuccu

SEQ ID NO: 2293405 - RNA, 17 nt, Human
aucuggugacuuuccuc

SEQ ID NO: 2293406 - RNA, 14 nt, Human
aucuguaucucucu

SEQ ID NO: 2293407 - RNA, 15 nt, Human
aucuguaucucucuc

SEQ ID NO: 2293408 - RNA, 21 nt, Human
aucuguauauacaauaacaua

SEQ ID NO: 2293409 - RNA, 22 nt, Human
aucuguauauaaaauauuuuca

SEQ ID NO: 2293410 - RNA, 13 nt, Human
aucuguaucucuc

SEQ ID NO: 2293411 - RNA, 15 nt, Human
aucuguauuuaauuu

SEQ ID NO: 2293412 - RNA, 18 nt, Human
aucuguauuuaauuuuga

SEQ ID NO: 2293413 - RNA, 23 nt, Human
aucuguccaaaggaggcuggcag

SEQ ID NO: 2293414 - RNA, 21 nt, Human
aucuguccaaaggaggcuggc

SEQ ID NO: 2293415 - RNA, 19 nt, Human
aucuguccaaaggaggcug

SEQ ID NO: 2293416 - RNA, 18 nt, Human
aucuguccaaaggaggcu

SEQ ID NO: 2293417 - RNA, 14 nt, Human
aucuguccucagcc

SEQ ID NO: 2293418 - RNA, 16 nt, Human
aucugucccugccuca

SEQ ID NO: 2293419 - RNA, 14 nt, Human
aucuguccaaggaa

SEQ ID NO: 2293420 - RNA, 17 nt, Human
aucuguauuuaauuuug

SEQ ID NO: 2293421 - RNA, 13 nt, Human
aucuguccaagga

SEQ ID NO: 2293422 - RNA, 14 nt, Human
aucugucugguggc

SEQ ID NO: 2293423 - RNA, 16 nt, Human
aucugucugguggccc

SEQ ID NO: 2293424 - RNA, 17 nt, Human
aucugugaaaggaaaga

SEQ ID NO: 2293425 - RNA, 21 nt, Human
aucuguccucagccuugccag

SEQ ID NO: 2293426 - RNA, 18 nt, Human
aucuguccucagccuugc

SEQ ID NO: 2293427 - RNA, 17 nt, Human
aucuguccucagccuug

SEQ ID NO: 2293428 - RNA, 16 nt, Human
aucuguccucagccuu

SEQ ID NO: 2293429 - RNA, 15 nt, Human
aucuguccucagccu

SEQ ID NO: 2293430 - RNA, 20 nt, Human
aucugcuagggaauaucaau

SEQ ID NO: 2293431 - RNA, 14 nt, Human
aucugcuaauaaaa

SEQ ID NO: 2293432 - RNA, 17 nt, Human
aucugcgugacaauaaa

SEQ ID NO: 2293433 - RNA, 21 nt, Human
aucugcgugacaauaaaacau

SEQ ID NO: 2293434 - RNA, 22 nt, Human
aucugcgugacaauaaaacauu

SEQ ID NO: 2293435 - RNA, 23 nt, Human
aucugcgugacaauaaaacauua

SEQ ID NO: 2293436 - RNA, 19 nt, Human
aucugccuuuauuguguuu

SEQ ID NO: 2293437 - RNA, 21 nt, Human
aucugccuuuauuguguuugu

SEQ ID NO: 2293438 - RNA, 22 nt, Human
aucugccuuuauuguguuuguc

SEQ ID NO: 2293439 - RNA, 21 nt, Human
aucugccuuaaaaccaaagag

SEQ ID NO: 2293440 - RNA, 16 nt, Human
aucugcgugacaauaa

SEQ ID NO: 2293441 - RNA, 17 nt, Human
aucugccccucccccaa

SEQ ID NO: 2293442 - RNA, 14 nt, Human
aucugccccucccu

SEQ ID NO: 2293443 - RNA, 16 nt, Human
aucugccccucccugc

SEQ ID NO: 2293444 - RNA, 16 nt, Human
aucugccuuuauugug

SEQ ID NO: 2293445 - RNA, 18 nt, Human
aucugccuuaaaaccaaa

SEQ ID NO: 2293446 - RNA, 19 nt, Human
aucugccuuaaaaccaaag

SEQ ID NO: 2293447 - RNA, 17 nt, Human
aucugccuuaaaaccaa

SEQ ID NO: 2293448 - RNA, 15 nt, Human
uugcauuuggucaag

SEQ ID NO: 2293449 - RNA, 21 nt, Human
uugcauuuggauugggguccc

SEQ ID NO: 2293450 - RNA, 15 nt, Human
uugcauuugcucuuu

SEQ ID NO: 2293451 - RNA, 15 nt, Human
uugcauuuaugguca

SEQ ID NO: 2293452 - RNA, 22 nt, Human
uugcauuuaaaacagacacugg

SEQ ID NO: 2293453 - RNA, 12 nt, Human
uugcauuuuugc

SEQ ID NO: 2293454 - RNA, 17 nt, Human
uugcauuuuaaaaauga

SEQ ID NO: 2293455 - RNA, 16 nt, Human
aucugccccuccccca

SEQ ID NO: 2293456 - RNA, 15 nt, Human
aucugccccuccccc

SEQ ID NO: 2293457 - RNA, 12 nt, Human
aucugccccucc

SEQ ID NO: 2293458 - RNA, 11 nt, Human
aucugccccuc

SEQ ID NO: 2293459 - RNA, 13 nt, Human
aucugcccaggac

SEQ ID NO: 2293460 - RNA, 13 nt, Human
aucugcccagggg

SEQ ID NO: 2293461 - RNA, 15 nt, Human
aucugcccaggggug

SEQ ID NO: 2293462 - RNA, 16 nt, Human
aucugcccaggggugc

SEQ ID NO: 2293463 - RNA, 19 nt, Human
aucugcccaggggugcccc

SEQ ID NO: 2293464 - RNA, 21 nt, Human
aucugcccaggggugcccccu

SEQ ID NO: 2293465 - RNA, 22 nt, Human
aucugcccaggggugcccccuc

SEQ ID NO: 2293466 - RNA, 23 nt, Human
aucugcccaggggugcccccucc

SEQ ID NO: 2293467 - RNA, 12 nt, Human
aucugcccagga

SEQ ID NO: 2293468 - RNA, 16 nt, Human
uuggcccccgagcugg

SEQ ID NO: 2293469 - RNA, 15 nt, Human
uuggcccccgagcug

SEQ ID NO: 2293470 - RNA, 20 nt, Human
uuggagugaguguggcuccc

SEQ ID NO: 2293471 - RNA, 15 nt, Human
uuggagucuuccaaa

SEQ ID NO: 2293472 - RNA, 18 nt, Human
uuggccccugcccggcug

SEQ ID NO: 2293473 - RNA, 16 nt, Human
uuggagggugucccaa

SEQ ID NO: 2293474 - RNA, 23 nt, Human
uuggaggugcuuaagcagaagca

SEQ ID NO: 2293475 - RNA, 23 nt, Human
uuggagggucccaagcugggccc

SEQ ID NO: 2293476 - RNA, 18 nt, Human
uuggaggugcuuaagcag

SEQ ID NO: 2293477 - RNA, 23 nt, Human
uuggaguccccucaccuccucua

SEQ ID NO: 2293478 - RNA, 14 nt, Human
uuggcucaauccuc

SEQ ID NO: 2293479 - RNA, 13 nt, Human
uuggcucaauccu

SEQ ID NO: 2293480 - RNA, 16 nt, Human
uuggcuauuuaaaacu

SEQ ID NO: 2293481 - RNA, 17 nt, Human
uuggcuauuuaaaacuu

SEQ ID NO: 2293482 - RNA, 23 nt, Human
uuggcuauuagagaucaaccccu

SEQ ID NO: 2293483 - RNA, 17 nt, Human
uuggccugaucagacca

SEQ ID NO: 2293484 - RNA, 19 nt, Human
uuggcccccgagcuggggg

SEQ ID NO: 2293485 - RNA, 22 nt, Human
uuggccgggugcgguggcucac

SEQ ID NO: 2293486 - RNA, 12 nt, Human
uuggccucagaa

SEQ ID NO: 2293487 - RNA, 17 nt, Human
uuggccuccccugcuga

SEQ ID NO: 2293488 - RNA, 22 nt, Human
uuggccucugcaaaggaaauac

SEQ ID NO: 2293489 - RNA, 13 nt, Human
uuggccuccggcc

SEQ ID NO: 2293490 - RNA, 19 nt, Human
uuggccuccggccuccccu

SEQ ID NO: 2293491 - RNA, 15 nt, Human
uuggagacucugugg

SEQ ID NO: 2293492 - RNA, 13 nt, Human
uuggagacucugu

SEQ ID NO: 2293493 - RNA, 20 nt, Human
uuggagacucuguggggccu

SEQ ID NO: 2293494 - RNA, 17 nt, Human
uuggagaguaaaaacug

SEQ ID NO: 2293495 - RNA, 13 nt, Human
uuggagaguaaaa

SEQ ID NO: 2293496 - RNA, 22 nt, Human
uuggagagcuagaaccuggaga

SEQ ID NO: 2293497 - RNA, 20 nt, Human
uuggagaguaaaaacugaau

SEQ ID NO: 2293498 - RNA, 18 nt, Human
uuggagaguaaaaacuga

SEQ ID NO: 2293499 - RNA, 15 nt, Human
uuggagaguuuccug

SEQ ID NO: 2293500 - RNA, 23 nt, Human
uuggagggugggagagcccagcc

SEQ ID NO: 2293501 - RNA, 22 nt, Human
uuggagggugggagagcccagc

SEQ ID NO: 2293502 - RNA, 19 nt, Human
uuggagggguuuaugcuca

SEQ ID NO: 2293503 - RNA, 17 nt, Human
uuggagggucccaagcu

SEQ ID NO: 2293504 - RNA, 21 nt, Human
uuggagggucccaagcugggc

SEQ ID NO: 2293505 - RNA, 22 nt, Human
uuggagggucccaagcugggcc

SEQ ID NO: 2293506 - RNA, 17 nt, Human
uuggaggccuuucaucc

SEQ ID NO: 2293507 - RNA, 16 nt, Human
uuggagaguuuccuga

SEQ ID NO: 2293508 - RNA, 15 nt, Human
uuggaggggggagcc

SEQ ID NO: 2293509 - RNA, 15 nt, Human
uugcuugaaagaaaa

SEQ ID NO: 2293510 - RNA, 12 nt, Human
uugcuugaaaga

SEQ ID NO: 2293511 - RNA, 14 nt, Human
uugcuugagcccag

SEQ ID NO: 2293512 - RNA, 22 nt, Human
uugcuugaaagaaaauaugcau

SEQ ID NO: 2293513 - RNA, 14 nt, Human
uugcuugaaagaaa

SEQ ID NO: 2293514 - RNA, 17 nt, Human
uugcuugagcccaggag

SEQ ID NO: 2293515 - RNA, 16 nt, Human
uugcuugagcccagga

SEQ ID NO: 2293516 - RNA, 20 nt, Human
uuggagacacaacuauuuuu

SEQ ID NO: 2293517 - RNA, 18 nt, Human
uugcuugagcccaggagu

SEQ ID NO: 2293518 - RNA, 17 nt, Human
uuggagacauuccuggg

SEQ ID NO: 2293519 - RNA, 11 nt, Human
uuggagacaga

SEQ ID NO: 2293520 - RNA, 13 nt, Human
aucuuuucuauuu

SEQ ID NO: 2293521 - RNA, 11 nt, Human
aucuuuugaac

SEQ ID NO: 2293522 - RNA, 14 nt, Human
aucuuuucuugccu

SEQ ID NO: 2293523 - RNA, 23 nt, Human
aucuuuucuugccucuguccccu

SEQ ID NO: 2293524 - RNA, 18 nt, Human
augaaagggcccagagag

SEQ ID NO: 2293525 - RNA, 15 nt, Human
aucuuuuguauaguu

SEQ ID NO: 2293526 - RNA, 19 nt, Human
aucuuuugaccuguggugc

SEQ ID NO: 2293527 - RNA, 17 nt, Human
aucuuugcagacaggca

SEQ ID NO: 2293528 - RNA, 16 nt, Human
aucuuugauucuccuu

SEQ ID NO: 2293529 - RNA, 17 nt, Human
aucuuugauucuccuuc

SEQ ID NO: 2293530 - RNA, 18 nt, Human
aucuuugauucuccuuca

SEQ ID NO: 2293531 - RNA, 19 nt, Human
aucuuugauucuccuucag

SEQ ID NO: 2293532 - RNA, 22 nt, Human
aucuuuucauuuaggugaggaa

SEQ ID NO: 2293533 - RNA, 20 nt, Human
aucuuugauucuccuucagc

SEQ ID NO: 2293534 - RNA, 17 nt, Human
aucuuuucacaaauaaa

SEQ ID NO: 2293535 - RNA, 21 nt, Human
aucuuucuuuugauucuuccu

SEQ ID NO: 2293536 - RNA, 21 nt, Human
aucuuucuuucuuagaaauuu

SEQ ID NO: 2293537 - RNA, 17 nt, Human
aucuuucuuucuuagaa

SEQ ID NO: 2293538 - RNA, 20 nt, Human
aucuuucuuucuuagaaauu

SEQ ID NO: 2293539 - RNA, 15 nt, Human
aucuuucuuucuuag

SEQ ID NO: 2293540 - RNA, 21 nt, Human
aucuuucuuuaccugagacca

SEQ ID NO: 2293541 - RNA, 22 nt, Human
aucuuucuuuaccugagaccag

SEQ ID NO: 2293542 - RNA, 14 nt, Human
aucuuucuuuaccu

SEQ ID NO: 2293543 - RNA, 17 nt, Human
aucuuucuuuaccugag

SEQ ID NO: 2293544 - RNA, 18 nt, Human
aucuuucuuuaccugaga

SEQ ID NO: 2293545 - RNA, 20 nt, Human
aucuuucuuuaccugagacc

SEQ ID NO: 2293546 - RNA, 14 nt, Human
aucuuugauucucc

SEQ ID NO: 2293547 - RNA, 15 nt, Human
aucuuugauucuccu

SEQ ID NO: 2293548 - RNA, 13 nt, Human
aucuuucugcaga

SEQ ID NO: 2293549 - RNA, 11 nt, Human
aucuuucuucu

SEQ ID NO: 2293550 - RNA, 20 nt, Human
uuggcucgaaucucugugcc

SEQ ID NO: 2293551 - RNA, 21 nt, Human
uuggcucgaaucucugugccu

SEQ ID NO: 2293552 - RNA, 22 nt, Human
aucuuucuucuauuuuauuccc

SEQ ID NO: 2293553 - RNA, 19 nt, Human
aucuuucuucuauuuuauu

SEQ ID NO: 2293554 - RNA, 13 nt, Human
aucuuucuugauc

SEQ ID NO: 2293555 - RNA, 18 nt, Human
aucuuucuugaucaacau

SEQ ID NO: 2293556 - RNA, 22 nt, Human
uuggcucccauucacucuucca

SEQ ID NO: 2293557 - RNA, 17 nt, Human
uuggcucgaaucucugu

SEQ ID NO: 2293558 - RNA, 14 nt, Human
uuggcucagacaug

SEQ ID NO: 2293559 - RNA, 13 nt, Human
uuggcucagacau

SEQ ID NO: 2293560 - RNA, 12 nt, Human
uuggcucaccca

SEQ ID NO: 2293561 - RNA, 22 nt, Human
uuggcucacccaagcaaggcca

SEQ ID NO: 2293562 - RNA, 16 nt, Human
uuggcucacacugaga

SEQ ID NO: 2293563 - RNA, 17 nt, Human
uuggcucacacugagaa

SEQ ID NO: 2293564 - RNA, 21 nt, Human
uuggggaguuaagaccuggca

SEQ ID NO: 2293565 - RNA, 20 nt, Human
uuggggaguuaagaccuggc

SEQ ID NO: 2293566 - RNA, 19 nt, Human
uuggggaguuaagaccugg

SEQ ID NO: 2293567 - RNA, 17 nt, Human
uuggggaguuaagaccu

SEQ ID NO: 2293568 - RNA, 21 nt, Human
uuggugcaacccuuaccccuu

SEQ ID NO: 2293569 - RNA, 15 nt, Human
uuggugcacagugau

SEQ ID NO: 2293570 - RNA, 16 nt, Human
uuggugcaacccuuac

SEQ ID NO: 2293571 - RNA, 12 nt, Human
uuggugccuggc

SEQ ID NO: 2293572 - RNA, 13 nt, Human
uuggugccuggcc

SEQ ID NO: 2293573 - RNA, 17 nt, Human
uuggugcacagugauuu

SEQ ID NO: 2293574 - RNA, 18 nt, Human
uuggugcacagugauuuu

SEQ ID NO: 2293575 - RNA, 18 nt, Human
uuggggaccagagcugcc

SEQ ID NO: 2293576 - RNA, 23 nt, Human
uuggggacaggggcaggaggaag

SEQ ID NO: 2293577 - RNA, 19 nt, Human
uuggggacaucucuuugaa

SEQ ID NO: 2293578 - RNA, 15 nt, Human
uuggggaauuuccuc

SEQ ID NO: 2293579 - RNA, 16 nt, Human
augaauuacauuugua

SEQ ID NO: 2293580 - RNA, 17 nt, Human
augaauuacauuuguau

SEQ ID NO: 2293581 - RNA, 13 nt, Human
augaauguaucag

SEQ ID NO: 2293582 - RNA, 15 nt, Human
augaauuaaguuuuu

SEQ ID NO: 2293583 - RNA, 15 nt, Human
augaauuacauuugu

SEQ ID NO: 2293584 - RNA, 21 nt, Human
augaaugguauggaacucucu

SEQ ID NO: 2293585 - RNA, 21 nt, Human
augaaugggcugagcugccug

SEQ ID NO: 2293586 - RNA, 21 nt, Human
augaaugggcaaaacugaauu

SEQ ID NO: 2293587 - RNA, 23 nt, Human
augaauggacucaaacugccuug

SEQ ID NO: 2293588 - RNA, 23 nt, Human
augaauggagauuugaaggucug

SEQ ID NO: 2293589 - RNA, 23 nt, Human
augaauggcucacuauggugcca

SEQ ID NO: 2293590 - RNA, 17 nt, Human
augaaugggcaaaacug

SEQ ID NO: 2293591 - RNA, 18 nt, Human
augaaugggcaaaacuga

SEQ ID NO: 2293592 - RNA, 21 nt, Human
augaauauuuaguguucauaa

SEQ ID NO: 2293593 - RNA, 23 nt, Human
augaauggcuaagcaaaauguga

SEQ ID NO: 2293594 - RNA, 14 nt, Human
augaaucaaagaca

SEQ ID NO: 2293595 - RNA, 12 nt, Human
augaaucaaugg

SEQ ID NO: 2293596 - RNA, 17 nt, Human
augaaauuuaauauagc

SEQ ID NO: 2293597 - RNA, 17 nt, Human
augaacuuauucuguag

SEQ ID NO: 2293598 - RNA, 18 nt, Human
augaacuuauucuguaga

SEQ ID NO: 2293599 - RNA, 23 nt, Human
augaaauugucuagcagagcagg

SEQ ID NO: 2293600 - RNA, 13 nt, Human
augaacuucgcau

SEQ ID NO: 2293601 - RNA, 17 nt, Human
augaacuucgcaucaaa

SEQ ID NO: 2293602 - RNA, 20 nt, Human
augaacuucgcaucaaaaga

SEQ ID NO: 2293603 - RNA, 22 nt, Human
augaacuucgcaucaaaagaca

SEQ ID NO: 2293604 - RNA, 16 nt, Human
augaaauuacuuauca

SEQ ID NO: 2293605 - RNA, 23 nt, Human
augaaauuacuuaucauccacau

SEQ ID NO: 2293606 - RNA, 22 nt, Human
augaaauugucuagcagagcag

SEQ ID NO: 2293607 - RNA, 20 nt, Human
augaaauugucuagcagagc

SEQ ID NO: 2293608 - RNA, 16 nt, Human
augaaagguuuacauu

SEQ ID NO: 2293609 - RNA, 19 nt, Human
augaaagggcccagagagg

SEQ ID NO: 2293610 - RNA, 16 nt, Human
augaaaugguuaagaa

SEQ ID NO: 2293611 - RNA, 21 nt, Human
augaaagguuuacauugucaa

SEQ ID NO: 2293612 - RNA, 21 nt, Human
augaagacaggacagugcuuc

SEQ ID NO: 2293613 - RNA, 16 nt, Human
augaagacaggacagu

SEQ ID NO: 2293614 - RNA, 23 nt, Human
augaacuucgcaucaaaagacaa

SEQ ID NO: 2293615 - RNA, 15 nt, Human
augaagaacugagga

SEQ ID NO: 2293616 - RNA, 19 nt, Human
augaagagugagagggcau

SEQ ID NO: 2293617 - RNA, 18 nt, Human
augaagagugagagggca

SEQ ID NO: 2293618 - RNA, 16 nt, Human
augaagagauuuuuca

SEQ ID NO: 2293619 - RNA, 16 nt, Human
augaauauuuaguguu

SEQ ID NO: 2293620 - RNA, 11 nt, Human
augaagaggag

SEQ ID NO: 2293621 - RNA, 20 nt, Human
augaagagauuuuucaugau

SEQ ID NO: 2293622 - RNA, 21 nt, Human
augaagacuguuaaaugaaac

SEQ ID NO: 2293623 - RNA, 22 nt, Human
augaagacuguuaaaugaaacc

SEQ ID NO: 2293624 - RNA, 14 nt, Human
auaauauauuugug

SEQ ID NO: 2293625 - RNA, 19 nt, Human
auaauauauuuuaaauauu

SEQ ID NO: 2293626 - RNA, 13 nt, Human
auaauauauuuuc

SEQ ID NO: 2293627 - RNA, 13 nt, Human
auaauauacuugu

SEQ ID NO: 2293628 - RNA, 14 nt, Human
auaauauacuugug

SEQ ID NO: 2293629 - RNA, 20 nt, Human
auaauauacuuguggacuaa

SEQ ID NO: 2293630 - RNA, 14 nt, Human
auaagccaauuuuu

SEQ ID NO: 2293631 - RNA, 18 nt, Human
auaagccaauuuuucugc

SEQ ID NO: 2293632 - RNA, 19 nt, Human
auaagccaauuuuucugca

SEQ ID NO: 2293633 - RNA, 22 nt, Human
auaagccaauuuuucugcacug

SEQ ID NO: 2293634 - RNA, 23 nt, Human
auaagccaauuuuucugcacuga

SEQ ID NO: 2293635 - RNA, 18 nt, Human
auaauauaccaaugcuuu

SEQ ID NO: 2293636 - RNA, 14 nt, Human
auaagccagacauc

SEQ ID NO: 2293637 - RNA, 17 nt, Human
auaagcaucaaacucuu

SEQ ID NO: 2293638 - RNA, 16 nt, Human
auaagcaucaaacucu

SEQ ID NO: 2293639 - RNA, 22 nt, Human
auaagccaaaaaaugcuugcuu

SEQ ID NO: 2293640 - RNA, 21 nt, Human
auaagauucauauuuacuucu

SEQ ID NO: 2293641 - RNA, 20 nt, Human
auaagauuagaaugaaaauu

SEQ ID NO: 2293642 - RNA, 20 nt, Human
auaauauuuuuaauuaaaua

SEQ ID NO: 2293643 - RNA, 22 nt, Human
auaaucuggacuccucugucca

SEQ ID NO: 2293644 - RNA, 18 nt, Human
auaaucacaacccuucag

SEQ ID NO: 2293645 - RNA, 14 nt, Human
auaaucuguacaau

SEQ ID NO: 2293646 - RNA, 17 nt, Human
auaaucuguacaaugaa

SEQ ID NO: 2293647 - RNA, 15 nt, Human
auaaucuuauuaggg

SEQ ID NO: 2293648 - RNA, 14 nt, Human
auaaucuucugccu

SEQ ID NO: 2293649 - RNA, 17 nt, Human
auaaucuucugccuucu

SEQ ID NO: 2293650 - RNA, 15 nt, Human
auaaucuucugccuu

SEQ ID NO: 2293651 - RNA, 14 nt, Human
auaauauuuuuaau

SEQ ID NO: 2293652 - RNA, 18 nt, Human
auaauauuuuuaauauau

SEQ ID NO: 2293653 - RNA, 21 nt, Human
auaauaugcugccaaauuuug

SEQ ID NO: 2293654 - RNA, 20 nt, Human
auaauaugcacacagugcuu

SEQ ID NO: 2293655 - RNA, 12 nt, Human
auaauaugcaca

SEQ ID NO: 2293656 - RNA, 15 nt, Human
auaauaugagaauca

SEQ ID NO: 2293657 - RNA, 12 nt, Human
auaauaugagaa

SEQ ID NO: 2293658 - RNA, 22 nt, Human
auaauauauguuuaccuuuuaa

SEQ ID NO: 2293659 - RNA, 15 nt, Human
auaauauauuuucug

SEQ ID NO: 2293660 - RNA, 22 nt, Human
auaauuucccaauuaggaagug

SEQ ID NO: 2293661 - RNA, 18 nt, Human
auaauuucccaauuagga

SEQ ID NO: 2293662 - RNA, 11 nt, Human
auaauuuccca

SEQ ID NO: 2293663 - RNA, 21 nt, Human
auaauuucccaauuaggaagu

SEQ ID NO: 2293664 - RNA, 18 nt, Human
auaauuucuuacuaaaca

SEQ ID NO: 2293665 - RNA, 22 nt, Human
auaauuuguacauauguaaaau

SEQ ID NO: 2293666 - RNA, 19 nt, Human
auaauuuguacauauguaa

SEQ ID NO: 2293667 - RNA, 15 nt, Human
auaauuuuaaacaaa

SEQ ID NO: 2293668 - RNA, 12 nt, Human
auaauuuuaaau

SEQ ID NO: 2293669 - RNA, 13 nt, Human
auaauuuuaaaug

SEQ ID NO: 2293670 - RNA, 21 nt, Human
uuagaugugauuuaauagugu

SEQ ID NO: 2293671 - RNA, 20 nt, Human
uuagaugugauuuaauagug

SEQ ID NO: 2293672 - RNA, 14 nt, Human
auaauuuuaaaugu

SEQ ID NO: 2293673 - RNA, 22 nt, Human
uuagauguuccaguaaucuaau

SEQ ID NO: 2293674 - RNA, 21 nt, Human
uuagauguuccaguaaucuaa

SEQ ID NO: 2293675 - RNA, 20 nt, Human
uuagauguucuaagucuuuc

SEQ ID NO: 2293676 - RNA, 13 nt, Human
uuagauguucuaa

SEQ ID NO: 2293677 - RNA, 22 nt, Human
uuagauguucuaagucuuucca

SEQ ID NO: 2293678 - RNA, 15 nt, Human
uuagauguucucuau

SEQ ID NO: 2293679 - RNA, 19 nt, Human
uuagauguucucuaucauu

SEQ ID NO: 2293680 - RNA, 20 nt, Human
uuagauguucucuaucauuu

SEQ ID NO: 2293681 - RNA, 18 nt, Human
auaauuaugacaguuaua

SEQ ID NO: 2293682 - RNA, 20 nt, Human
auaaucuucugccuucucau

SEQ ID NO: 2293683 - RNA, 20 nt, Human
auaauuaugacaguuauacu

SEQ ID NO: 2293684 - RNA, 21 nt, Human
auaauuaugaguuugcuuaug

SEQ ID NO: 2293685 - RNA, 19 nt, Human
auaauuaugacaguuauac

SEQ ID NO: 2293686 - RNA, 23 nt, Human
auaaucuuauuagggagaaaauu

SEQ ID NO: 2293687 - RNA, 14 nt, Human
auaaucuuucacag

SEQ ID NO: 2293688 - RNA, 16 nt, Human
auaauuauuuauuuaa

SEQ ID NO: 2293689 - RNA, 17 nt, Human
auaauuauuuauuuaau

SEQ ID NO: 2293690 - RNA, 18 nt, Human
auaauuauuuauuuaaua

SEQ ID NO: 2293691 - RNA, 21 nt, Human
auaauuauuuauuuaauaaca

SEQ ID NO: 2293692 - RNA, 23 nt, Human
auaauucacauuguauucagagu

SEQ ID NO: 2293693 - RNA, 20 nt, Human
auaauucaggaagcagcuuu

SEQ ID NO: 2293694 - RNA, 20 nt, Human
uuauaaaaaauggugccuga

SEQ ID NO: 2293695 - RNA, 22 nt, Human
uuauaaaaccaucaaaaauauu

SEQ ID NO: 2293696 - RNA, 12 nt, Human
uuauaaaacuuc

SEQ ID NO: 2293697 - RNA, 23 nt, Human
uuauaaaagaauaaaauugcacu

SEQ ID NO: 2293698 - RNA, 21 nt, Human
uuauaaaaauaaaaaacacug

SEQ ID NO: 2293699 - RNA, 22 nt, Human
uuauaaaaauaaaaaacacugg

SEQ ID NO: 2293700 - RNA, 16 nt, Human
uuauaaaauuaagcaa

SEQ ID NO: 2293701 - RNA, 13 nt, Human
uuauaaaacuucu

SEQ ID NO: 2293702 - RNA, 13 nt, Human
uuauaaaagugau

SEQ ID NO: 2293703 - RNA, 23 nt, Human
uuauaaaccucuaauuuauuuug

SEQ ID NO: 2293704 - RNA, 16 nt, Human
uuauaaaccucuaauu

SEQ ID NO: 2293705 - RNA, 17 nt, Human
uuauaaaccucuaauuu

SEQ ID NO: 2293706 - RNA, 13 nt, Human
uuauaaacuuuac

SEQ ID NO: 2293707 - RNA, 18 nt, Human
uuaguuuuugugaaguuu

SEQ ID NO: 2293708 - RNA, 14 nt, Human
uuaguagagacagg

SEQ ID NO: 2293709 - RNA, 21 nt, Human
uuaguuuuugugaaguuuaau

SEQ ID NO: 2293710 - RNA, 19 nt, Human
uuauaaaaaauggugccug

SEQ ID NO: 2293711 - RNA, 15 nt, Human
uuauaaaaauaaaaa

SEQ ID NO: 2293712 - RNA, 12 nt, Human
uuaguaaugcua

SEQ ID NO: 2293713 - RNA, 19 nt, Human
uuaguacuccccuccuuga

SEQ ID NO: 2293714 - RNA, 13 nt, Human
uuaguagagacag

SEQ ID NO: 2293715 - RNA, 22 nt, Human
uuaguaaugcuacgugugauuu

SEQ ID NO: 2293716 - RNA, 20 nt, Human
uuaguaaugcuacgugugau

SEQ ID NO: 2293717 - RNA, 21 nt, Human
uuaguaaugcuacgugugauu

SEQ ID NO: 2293718 - RNA, 18 nt, Human
uuagguuggcaaaaaggc

SEQ ID NO: 2293719 - RNA, 13 nt, Human
uuaguaaucauau

SEQ ID NO: 2293720 - RNA, 20 nt, Human
uuaguaaggcuguguacacu

SEQ ID NO: 2293721 - RNA, 14 nt, Human
uuaguaaggcugug

SEQ ID NO: 2293722 - RNA, 14 nt, Human
uuaguaaucauauu

SEQ ID NO: 2293723 - RNA, 14 nt, Human
uuaggucucuuccc

SEQ ID NO: 2293724 - RNA, 19 nt, Human
uuagguguugauuuucugu

SEQ ID NO: 2293725 - RNA, 20 nt, Human
uuagguuaaaaaaaggcauu

SEQ ID NO: 2293726 - RNA, 13 nt, Human
uuaggucaagaag

SEQ ID NO: 2293727 - RNA, 19 nt, Human
uuaggugugggggaagcac

SEQ ID NO: 2293728 - RNA, 12 nt, Human
uuagggaggggu

SEQ ID NO: 2293729 - RNA, 21 nt, Human
uuagggagagucauauuuuga

SEQ ID NO: 2293730 - RNA, 23 nt, Human
uuagggagagucauauuuugauu

SEQ ID NO: 2293731 - RNA, 18 nt, Human
uuagggagagucauauuu

SEQ ID NO: 2293732 - RNA, 15 nt, Human
uuagggagagaagau

SEQ ID NO: 2293733 - RNA, 23 nt, Human
uuagauguucucuaucauuuaau

SEQ ID NO: 2293734 - RNA, 21 nt, Human
uuagauguucucuaucauuua

SEQ ID NO: 2293735 - RNA, 22 nt, Human
uuagauguucucuaucauuuaa

SEQ ID NO: 2293736 - RNA, 14 nt, Human
uuagggcagcuugc

SEQ ID NO: 2293737 - RNA, 15 nt, Human
uuagggccaggcagg

SEQ ID NO: 2293738 - RNA, 15 nt, Human
uuaggggaacugggu

SEQ ID NO: 2293739 - RNA, 17 nt, Human
uuagggcaccagggguu

SEQ ID NO: 2293740 - RNA, 12 nt, Human
uuagggcagcuu

SEQ ID NO: 2293741 - RNA, 14 nt, Human
uuaggguuaugauu

SEQ ID NO: 2293742 - RNA, 16 nt, Human
uuaggguuaugauuaa

SEQ ID NO: 2293743 - RNA, 15 nt, Human
uuagaauaaaauugu

SEQ ID NO: 2293744 - RNA, 13 nt, Human
uuagaaguguuaa

SEQ ID NO: 2293745 - RNA, 14 nt, Human
uuagaauaaaauug

SEQ ID NO: 2293746 - RNA, 16 nt, Human
uuagaagucacacagu

SEQ ID NO: 2293747 - RNA, 13 nt, Human
uuacuguaccugu

SEQ ID NO: 2293748 - RNA, 22 nt, Human
uuacugucugguuuuaacaauu

SEQ ID NO: 2293749 - RNA, 15 nt, Human
uuacuguaauuccuc

SEQ ID NO: 2293750 - RNA, 23 nt, Human
uuacugucaaggcugcuuagaau

SEQ ID NO: 2293751 - RNA, 18 nt, Human
uuagaagguucucuccuc

SEQ ID NO: 2293752 - RNA, 23 nt, Human
uuacugucugguuuuaacaauuu

SEQ ID NO: 2293753 - RNA, 21 nt, Human
uuagaaucagccuugaaacau

SEQ ID NO: 2293754 - RNA, 18 nt, Human
uuagaauccaaacuugga

SEQ ID NO: 2293755 - RNA, 12 nt, Human
uuagaaugaaaa

SEQ ID NO: 2293756 - RNA, 22 nt, Human
uuagaauccaaacuuggauuuu

SEQ ID NO: 2293757 - RNA, 12 nt, Human
uuagaauuauuu

SEQ ID NO: 2293758 - RNA, 13 nt, Human
uuagaaugaaaau

SEQ ID NO: 2293759 - RNA, 13 nt, Human
uuagaauuauuua

SEQ ID NO: 2293760 - RNA, 15 nt, Human
uuagaauuauuuaaa

SEQ ID NO: 2293761 - RNA, 16 nt, Human
uuagaauuauuuaaac

SEQ ID NO: 2293762 - RNA, 16 nt, Human
uuagaauuaaaaguug

SEQ ID NO: 2293763 - RNA, 18 nt, Human
uuagaauuccuucagggu

SEQ ID NO: 2293764 - RNA, 18 nt, Human
auaacuuuuuuuuaaguu

SEQ ID NO: 2293765 - RNA, 21 nt, Human
auaagaaaagauguagauuua

SEQ ID NO: 2293766 - RNA, 18 nt, Human
auaagaaaagauguagau

SEQ ID NO: 2293767 - RNA, 12 nt, Human
auaagaaaagau

SEQ ID NO: 2293768 - RNA, 11 nt, Human
auaagaaaaga

SEQ ID NO: 2293769 - RNA, 15 nt, Human
auaagaaaaaucaug

SEQ ID NO: 2293770 - RNA, 17 nt, Human
auaagaaaaaucauguu

SEQ ID NO: 2293771 - RNA, 14 nt, Human
auaagauucauauu

SEQ ID NO: 2293772 - RNA, 13 nt, Human
auaagauuagaau

SEQ ID NO: 2293773 - RNA, 17 nt, Human
auaagauuagaaugaaa

SEQ ID NO: 2293774 - RNA, 22 nt, Human
auaagaaaagauguagauuuau

SEQ ID NO: 2293775 - RNA, 16 nt, Human
auaagaaaaaucaugu

SEQ ID NO: 2293776 - RNA, 18 nt, Human
auaagauauuuuucauga

SEQ ID NO: 2293777 - RNA, 22 nt, Human
auaagaaagugcgaguccucca

SEQ ID NO: 2293778 - RNA, 22 nt, Human
uuacugcuaaguauuucccagc

SEQ ID NO: 2293779 - RNA, 23 nt, Human
uuacugcuaaguauuucccagca

SEQ ID NO: 2293780 - RNA, 23 nt, Human
uuacuguacagacagaaaaaacu

SEQ ID NO: 2293781 - RNA, 12 nt, Human
uuacuguacaug

SEQ ID NO: 2293782 - RNA, 23 nt, Human
uuacuguacaugaaaacacauuu

SEQ ID NO: 2293783 - RNA, 22 nt, Human
uuacuguacaugaaaacacauu

SEQ ID NO: 2293784 - RNA, 14 nt, Human
uuacuguacaugaa

SEQ ID NO: 2293785 - RNA, 13 nt, Human
uuacuguacauga

SEQ ID NO: 2293786 - RNA, 17 nt, Human
uuacucaugaucuugug

SEQ ID NO: 2293787 - RNA, 21 nt, Human
uuacucauuuuuuuaauuuau

SEQ ID NO: 2293788 - RNA, 17 nt, Human
uuacucaggaagaacac

SEQ ID NO: 2293789 - RNA, 14 nt, Human
uuacucaggaagaa

SEQ ID NO: 2293790 - RNA, 18 nt, Human
uuacucauagcacuuccc

SEQ ID NO: 2293791 - RNA, 22 nt, Human
uuacucagcccugggccccacc

SEQ ID NO: 2293792 - RNA, 14 nt, Human
uuacucagcccugg

SEQ ID NO: 2293793 - RNA, 13 nt, Human
uuacucagcccug

SEQ ID NO: 2293794 - RNA, 15 nt, Human
uuaccauaugugcuu

SEQ ID NO: 2293795 - RNA, 11 nt, Human
uuaccaugaga

SEQ ID NO: 2293796 - RNA, 20 nt, Human
uuaccaugagaagagggccu

SEQ ID NO: 2293797 - RNA, 21 nt, Human
uuacugccaaagggaaauauc

SEQ ID NO: 2293798 - RNA, 11 nt, Human
uuacugccacu

SEQ ID NO: 2293799 - RNA, 17 nt, Human
uuacugcuaaguauuuc

SEQ ID NO: 2293800 - RNA, 20 nt, Human
uuacugcuaaguauuuccca

SEQ ID NO: 2293801 - RNA, 21 nt, Human
uuacugcuaaguauuucccag

SEQ ID NO: 2293802 - RNA, 22 nt, Human
uuacugcagccuuugccucccc

SEQ ID NO: 2293803 - RNA, 15 nt, Human
uuacugcagcuuugu

SEQ ID NO: 2293804 - RNA, 20 nt, Human
uuacuccccuugagcugaga

SEQ ID NO: 2293805 - RNA, 11 nt, Human
uuacuccccuu

SEQ ID NO: 2293806 - RNA, 15 nt, Human
uuacaaacauguggu

SEQ ID NO: 2293807 - RNA, 13 nt, Human
uuaauuuuuccua

SEQ ID NO: 2293808 - RNA, 12 nt, Human
uuacaaacaugu

SEQ ID NO: 2293809 - RNA, 13 nt, Human
uuacaaagugugu

SEQ ID NO: 2293810 - RNA, 14 nt, Human
uuacaaagugugua

SEQ ID NO: 2293811 - RNA, 15 nt, Human
uuacaaaguguguau

SEQ ID NO: 2293812 - RNA, 16 nt, Human
uuacaaaguguguauu

SEQ ID NO: 2293813 - RNA, 17 nt, Human
uuacaaaguguguauua

SEQ ID NO: 2293814 - RNA, 18 nt, Human
uuacaaaguguguauuaa

SEQ ID NO: 2293815 - RNA, 22 nt, Human
uuacaaaguguguauuaaaaaa

SEQ ID NO: 2293816 - RNA, 14 nt, Human
auaaaucgcuuuug

SEQ ID NO: 2293817 - RNA, 21 nt, Human
auaaaucgcuuuugauaauca

SEQ ID NO: 2293818 - RNA, 19 nt, Human
auaaaucgcuuuugauaau

SEQ ID NO: 2293819 - RNA, 16 nt, Human
auaaaucgcuuuugau

SEQ ID NO: 2293820 - RNA, 19 nt, Human
auaaaucugacccagugcc

SEQ ID NO: 2293821 - RNA, 18 nt, Human
auaaaucugacccagugc

SEQ ID NO: 2293822 - RNA, 16 nt, Human
auaaaucugacccagu

SEQ ID NO: 2293823 - RNA, 15 nt, Human
auaaaucugacccag

SEQ ID NO: 2293824 - RNA, 21 nt, Human
auaaauucuauaggaacauau

SEQ ID NO: 2293825 - RNA, 16 nt, Human
auaaauucuauaggaa

SEQ ID NO: 2293826 - RNA, 13 nt, Human
auaaaugcuuuua

SEQ ID NO: 2293827 - RNA, 13 nt, Human
auaaauggcuggu

SEQ ID NO: 2293828 - RNA, 16 nt, Human
auaaauggcugguuuu

SEQ ID NO: 2293829 - RNA, 23 nt, Human
auaaaugcaauauuaaugccuuu

SEQ ID NO: 2293830 - RNA, 15 nt, Human
auaaaugcaauauua

SEQ ID NO: 2293831 - RNA, 19 nt, Human
auaaaugcuauuuuuuauu

SEQ ID NO: 2293832 - RNA, 21 nt, Human
auaaaugcuauuuuuuauuuu

SEQ ID NO: 2293833 - RNA, 23 nt, Human
auaaaugcuauuuuuuauuuuac

SEQ ID NO: 2293834 - RNA, 21 nt, Human
auaaaugcuuuuaaaaaucua

SEQ ID NO: 2293835 - RNA, 21 nt, Human
auaaauuccucuuugcuuugc

SEQ ID NO: 2293836 - RNA, 13 nt, Human
auaaauugcuccu

SEQ ID NO: 2293837 - RNA, 16 nt, Human
auaaauugcuccuuga

SEQ ID NO: 2293838 - RNA, 22 nt, Human
auaaaugcaauauguauuaaua

SEQ ID NO: 2293839 - RNA, 20 nt, Human
auaaaugcaauauguauuaa

SEQ ID NO: 2293840 - RNA, 18 nt, Human
auaaaugcaauauguauu

SEQ ID NO: 2293841 - RNA, 17 nt, Human
auaaaugcaauauguau

SEQ ID NO: 2293842 - RNA, 16 nt, Human
auaaaugauucuuagu

SEQ ID NO: 2293843 - RNA, 18 nt, Human
auaaaugauucuuaguga

SEQ ID NO: 2293844 - RNA, 13 nt, Human
uuacaguguuccg

SEQ ID NO: 2293845 - RNA, 13 nt, Human
uuacaguaaauaa

SEQ ID NO: 2293846 - RNA, 15 nt, Human
uuacaguaaauaaau

SEQ ID NO: 2293847 - RNA, 16 nt, Human
uuacaguaaauaaauu

SEQ ID NO: 2293848 - RNA, 17 nt, Human
uuacaguaaauaaauug

SEQ ID NO: 2293849 - RNA, 18 nt, Human
uuacaguaaauaaauugu

SEQ ID NO: 2293850 - RNA, 22 nt, Human
uuacaguaaauaaauuguuuga

SEQ ID NO: 2293851 - RNA, 17 nt, Human
uuacaguaggagcccag

SEQ ID NO: 2293852 - RNA, 23 nt, Human
uuaccagccuccguauuucagac

SEQ ID NO: 2293853 - RNA, 21 nt, Human
uuaccagccuccguauuucag

SEQ ID NO: 2293854 - RNA, 20 nt, Human
uuaccagccuccguauuuca

SEQ ID NO: 2293855 - RNA, 22 nt, Human
uuaccagccuccguauuucaga

SEQ ID NO: 2293856 - RNA, 19 nt, Human
uuaccagcagagcaccuua

SEQ ID NO: 2293857 - RNA, 18 nt, Human
uuacaguuucaaaaacug

SEQ ID NO: 2293858 - RNA, 18 nt, Human
uuacagggagcugggaca

SEQ ID NO: 2293859 - RNA, 21 nt, Human
uuacagggagccuccugccca

SEQ ID NO: 2293860 - RNA, 18 nt, Human
uuacagguggacacacaa

SEQ ID NO: 2293861 - RNA, 14 nt, Human
uuacaggugugaac

SEQ ID NO: 2293862 - RNA, 20 nt, Human
uuacagggaugagccaccgc

SEQ ID NO: 2293863 - RNA, 21 nt, Human
auaacucugcacuacuccucu

SEQ ID NO: 2293864 - RNA, 19 nt, Human
auaacucugcacuacuccu

SEQ ID NO: 2293865 - RNA, 20 nt, Human
uuacagggagccuccugccc

SEQ ID NO: 2293866 - RNA, 12 nt, Human
auaacuccuucu

SEQ ID NO: 2293867 - RNA, 20 nt, Human
auaacuccuucuuguaguag

SEQ ID NO: 2293868 - RNA, 11 nt, Human
auaacucugca

SEQ ID NO: 2293869 - RNA, 19 nt, Human
auaacucaucauaaaauaa

SEQ ID NO: 2293870 - RNA, 18 nt, Human
auaacucaucauaaaaua

SEQ ID NO: 2293871 - RNA, 17 nt, Human
auaacucaucauaaaau

SEQ ID NO: 2293872 - RNA, 16 nt, Human
auaacucaucauaaaa

SEQ ID NO: 2293873 - RNA, 15 nt, Human
auaacucaucauaaa

SEQ ID NO: 2293874 - RNA, 18 nt, Human
auaaauugcuccuugaca

SEQ ID NO: 2293875 - RNA, 19 nt, Human
auaaauuguaauuguaaag

SEQ ID NO: 2293876 - RNA, 13 nt, Human
auaaauuguauau

SEQ ID NO: 2293877 - RNA, 19 nt, Human
auaacuaguguugcuugga

SEQ ID NO: 2293878 - RNA, 16 nt, Human
auaacuaguguugcuu

SEQ ID NO: 2293879 - RNA, 15 nt, Human
auaacuauguugaua

SEQ ID NO: 2293880 - RNA, 21 nt, Human
aguuuaugucuaaagagcuuu

SEQ ID NO: 2293881 - RNA, 15 nt, Human
aguuuaugucuaaag

SEQ ID NO: 2293882 - RNA, 16 nt, Human
aguuuaugucuaaaga

SEQ ID NO: 2293883 - RNA, 14 nt, Human
aguuuaucauucaa

SEQ ID NO: 2293884 - RNA, 15 nt, Human
aguuuaucauucaag

SEQ ID NO: 2293885 - RNA, 16 nt, Human
aguuuaucauucaagu

SEQ ID NO: 2293886 - RNA, 17 nt, Human
aguuuaucauucaagug

SEQ ID NO: 2293887 - RNA, 19 nt, Human
uuaacacugcuuguguuuu

SEQ ID NO: 2293888 - RNA, 16 nt, Human
uuaacagaaauguaca

SEQ ID NO: 2293889 - RNA, 12 nt, Human
uuaacagaaaug

SEQ ID NO: 2293890 - RNA, 14 nt, Human
uuaacagaaaugua

SEQ ID NO: 2293891 - RNA, 13 nt, Human
uuaacagaaaugu

SEQ ID NO: 2293892 - RNA, 15 nt, Human
uuaaaguucuguaaa

SEQ ID NO: 2293893 - RNA, 23 nt, Human
uuaaauuuuacccuuuagacugu

SEQ ID NO: 2293894 - RNA, 16 nt, Human
uuaaauuuuacccuuu

SEQ ID NO: 2293895 - RNA, 20 nt, Human
uuaaauuuuacccuuuagac

SEQ ID NO: 2293896 - RNA, 15 nt, Human
uuaaauuuugaguuc

SEQ ID NO: 2293897 - RNA, 14 nt, Human
uuaaauuuuguguc

SEQ ID NO: 2293898 - RNA, 16 nt, Human
uuaaauuuugugucuc

SEQ ID NO: 2293899 - RNA, 20 nt, Human
uuaaauuuugaguucuacau

SEQ ID NO: 2293900 - RNA, 11 nt, Human
uuaaauaaaag

SEQ ID NO: 2293901 - RNA, 13 nt, Human
uuaaauaaaagaa

SEQ ID NO: 2293902 - RNA, 18 nt, Human
aguuuuaacuagaauuua

SEQ ID NO: 2293903 - RNA, 16 nt, Human
aguuuuaauccagaau

SEQ ID NO: 2293904 - RNA, 16 nt, Human
aguuuuaaaaaaauaa

SEQ ID NO: 2293905 - RNA, 22 nt, Human
aguuuuaaaaaaauaaaacauu

SEQ ID NO: 2293906 - RNA, 23 nt, Human
aguuuuaaaaaaauaaaacauuu

SEQ ID NO: 2293907 - RNA, 19 nt, Human
aguuuguguguugucuuga

SEQ ID NO: 2293908 - RNA, 20 nt, Human
aguuuguguguugucuugaa

SEQ ID NO: 2293909 - RNA, 14 nt, Human
aguuuguuuacaca

SEQ ID NO: 2293910 - RNA, 15 nt, Human
aguuuguugaaacac

SEQ ID NO: 2293911 - RNA, 22 nt, Human
aguuuguuaguaugaggcauuu

SEQ ID NO: 2293912 - RNA, 22 nt, Human
aguuugugugucuuaauuauua

SEQ ID NO: 2293913 - RNA, 14 nt, Human
aguuuguguguugu

SEQ ID NO: 2293914 - RNA, 21 nt, Human
aguuuguguguugucucuuga

SEQ ID NO: 2293915 - RNA, 16 nt, Human
aguuuguguguugucu

SEQ ID NO: 2293916 - RNA, 18 nt, Human
aguuuguguguugucuug

SEQ ID NO: 2293917 - RNA, 19 nt, Human
aguuucugccgcagcccug

SEQ ID NO: 2293918 - RNA, 14 nt, Human
aguuugugugucuu

SEQ ID NO: 2293919 - RNA, 15 nt, Human
aguuugugugucuua

SEQ ID NO: 2293920 - RNA, 16 nt, Human
aguuugugugucuuaa

SEQ ID NO: 2293921 - RNA, 14 nt, Human
aguuucucuuuuca

SEQ ID NO: 2293922 - RNA, 13 nt, Human
aguuucucagcuc

SEQ ID NO: 2293923 - RNA, 15 nt, Human
aguuucugccgcagc

SEQ ID NO: 2293924 - RNA, 12 nt, Human
aguuucucagcu

SEQ ID NO: 2293925 - RNA, 14 nt, Human
aguuucucagcucc

SEQ ID NO: 2293926 - RNA, 22 nt, Human
aguuuauugacaauaauuucag

SEQ ID NO: 2293927 - RNA, 22 nt, Human
aguuuauuuccaaauaaaauga

SEQ ID NO: 2293928 - RNA, 16 nt, Human
aguuucuagcuagaaa

SEQ ID NO: 2293929 - RNA, 21 nt, Human
aguuucuagcuagaaauauga

SEQ ID NO: 2293930 - RNA, 15 nt, Human
aguuucucagauccu

SEQ ID NO: 2293931 - RNA, 18 nt, Human
aguuucucagauccuugu

SEQ ID NO: 2293932 - RNA, 22 nt, Human
aguuucucagauccuuguuuca

SEQ ID NO: 2293933 - RNA, 23 nt, Human
aguuucucagauccuuguuucaa

SEQ ID NO: 2293934 - RNA, 11 nt, Human
aguuucucagc

SEQ ID NO: 2293935 - RNA, 23 nt, Human
uuaaaauguauucuuaaauucau

SEQ ID NO: 2293936 - RNA, 20 nt, Human
uuaaacauugguucuuguau

SEQ ID NO: 2293937 - RNA, 18 nt, Human
uuaaacauugguucuugu

SEQ ID NO: 2293938 - RNA, 22 nt, Human
uuaaacauugguucuuguauua

SEQ ID NO: 2293939 - RNA, 19 nt, Human
uuaaaccauaaaaagcuga

SEQ ID NO: 2293940 - RNA, 18 nt, Human
uuaaaaugauuguaaaau

SEQ ID NO: 2293941 - RNA, 16 nt, Human
uuaaaaugauuguaaa

SEQ ID NO: 2293942 - RNA, 16 nt, Human
uuaaaaugcaacaugu

SEQ ID NO: 2293943 - RNA, 12 nt, Human
uuaaaaugagaa

SEQ ID NO: 2293944 - RNA, 19 nt, Human
uuaaaaugagaaaucuaaa

SEQ ID NO: 2293945 - RNA, 15 nt, Human
uuaaaaaugcaaauc

SEQ ID NO: 2293946 - RNA, 12 nt, Human
uuaaaauccuca

SEQ ID NO: 2293947 - RNA, 14 nt, Human
uuaaaaucuuaaac

SEQ ID NO: 2293948 - RNA, 11 nt, Human
uuaaaaucuua

SEQ ID NO: 2293949 - RNA, 13 nt, Human
uuaaaauccucaa

SEQ ID NO: 2293950 - RNA, 22 nt, Human
uuaaaaucauuucugcaucagc

SEQ ID NO: 2293951 - RNA, 12 nt, Human
uuaaaaaugcaa

SEQ ID NO: 2293952 - RNA, 20 nt, Human
uuaaaaaucucaaauuucua

SEQ ID NO: 2293953 - RNA, 19 nt, Human
uuaaaaaucucaaauuucu

SEQ ID NO: 2293954 - RNA, 16 nt, Human
uuaaaaaauggaacau

SEQ ID NO: 2293955 - RNA, 15 nt, Human
aguuaggaaauaaaa

SEQ ID NO: 2293956 - RNA, 15 nt, Human
aguuuacauuguaaa

SEQ ID NO: 2293957 - RNA, 17 nt, Human
aguuuacauuguaaaua

SEQ ID NO: 2293958 - RNA, 22 nt, Human
aguuagcucaggaggcuuggaa

SEQ ID NO: 2293959 - RNA, 19 nt, Human
aguuagcucaggaggcuug

SEQ ID NO: 2293960 - RNA, 12 nt, Human
aguuaggaaaua

SEQ ID NO: 2293961 - RNA, 14 nt, Human
aguuaggaaauaaa

SEQ ID NO: 2293962 - RNA, 13 nt, Human
aguuaggaaauaa

SEQ ID NO: 2293963 - RNA, 13 nt, Human
aguuuacauugua

SEQ ID NO: 2293964 - RNA, 20 nt, Human
aguuuaaauuguaauaggcg

SEQ ID NO: 2293965 - RNA, 17 nt, Human
aguuuaaauuguaauag

SEQ ID NO: 2293966 - RNA, 19 nt, Human
aguuuagaggaaaaaaaug

SEQ ID NO: 2293967 - RNA, 21 nt, Human
aguuuagaggaaaaaaaugac

SEQ ID NO: 2293968 - RNA, 16 nt, Human
aguuuagcuggaaaag

SEQ ID NO: 2293969 - RNA, 19 nt, Human
uuaaaaaagaaacauuugg

SEQ ID NO: 2293970 - RNA, 14 nt, Human
aguuuaccuuguau

SEQ ID NO: 2293971 - RNA, 20 nt, Human
aguuuaccuuguauacugua

SEQ ID NO: 2293972 - RNA, 12 nt, Human
aguuuaacacaa

SEQ ID NO: 2293973 - RNA, 16 nt, Human
aguuuaccucuuuaaa

SEQ ID NO: 2293974 - RNA, 20 nt, Human
aguuuaccucuuuaaaaaca

SEQ ID NO: 2293975 - RNA, 15 nt, Human
aguuuacuauuuuac

SEQ ID NO: 2293976 - RNA, 14 nt, Human
aguuuacuauuuua

SEQ ID NO: 2293977 - RNA, 16 nt, Human
aguuuacuauuuuacu

SEQ ID NO: 2293978 - RNA, 14 nt, Human
aguuuagaggaaaa

SEQ ID NO: 2293979 - RNA, 15 nt, Human
aguuuagcuggaaaa

SEQ ID NO: 2293980 - RNA, 17 nt, Human
uuaaucuucaguuuuau

SEQ ID NO: 2293981 - RNA, 15 nt, Human
uuaaucuucaguuuu

SEQ ID NO: 2293982 - RNA, 13 nt, Human
uuaaucuuuaauu

SEQ ID NO: 2293983 - RNA, 22 nt, Human
uuaaucuucaguuuuaucuuua

SEQ ID NO: 2293984 - RNA, 14 nt, Human
uuaaucuuuccuga

SEQ ID NO: 2293985 - RNA, 17 nt, Human
uuaaucuuucuuuaccu

SEQ ID NO: 2293986 - RNA, 16 nt, Human
uuaaucuuuucacaaa

SEQ ID NO: 2293987 - RNA, 21 nt, Human
uuaaucuuucuuuaccugaga

SEQ ID NO: 2293988 - RNA, 23 nt, Human
uuaaucuuucuuuaccugagacc

SEQ ID NO: 2293989 - RNA, 17 nt, Human
uuaaucuuuaauuuuac

SEQ ID NO: 2293990 - RNA, 18 nt, Human
uuaauuuaugaguuuuug

SEQ ID NO: 2293991 - RNA, 15 nt, Human
uuaauuuaugaguuu

SEQ ID NO: 2293992 - RNA, 24 nt, Human
uuaaucuuucuuuaccugagacca

SEQ ID NO: 2293993 - RNA, 20 nt, Human
uuaauuuaugaguuuuugau

SEQ ID NO: 2293994 - RNA, 19 nt, Human
uuaauuuauuauugaaauu

SEQ ID NO: 2293995 - RNA, 14 nt, Human
uuaauuuauuuuug

SEQ ID NO: 2293996 - RNA, 20 nt, Human
uuaauuugauaucacagucu

SEQ ID NO: 2293997 - RNA, 13 nt, Human
uuaauuuuccugg

SEQ ID NO: 2293998 - RNA, 13 nt, Human
uuaauuuuguauu

SEQ ID NO: 2293999 - RNA, 23 nt, Human
uuaauuuugguuguauucuuuga

SEQ ID NO: 2294000 - RNA, 18 nt, Human
uuaauuuugguuguauuc

SEQ ID NO: 2294001 - RNA, 20 nt, Human
uuaauuuugguuguauucuu

SEQ ID NO: 2294002 - RNA, 13 nt, Human
uuaauuuucagua

SEQ ID NO: 2294003 - RNA, 17 nt, Human
uuaauuuugguuguauu

SEQ ID NO: 2294004 - RNA, 22 nt, Human
uuaauuuugacacuauaucugu

SEQ ID NO: 2294005 - RNA, 18 nt, Human
uuaauuuuguauuuucca

SEQ ID NO: 2294006 - RNA, 14 nt, Human
uuaauuuuguauuu

SEQ ID NO: 2294007 - RNA, 15 nt, Human
uuaauuuuguauuuu

SEQ ID NO: 2294008 - RNA, 16 nt, Human
uuaauuuuguauuuuc

SEQ ID NO: 2294009 - RNA, 17 nt, Human
uuaauuuuguauuuucc

SEQ ID NO: 2294010 - RNA, 13 nt, Human
uuaagacguguuu

SEQ ID NO: 2294011 - RNA, 16 nt, Human
uuaagacguguuugug

SEQ ID NO: 2294012 - RNA, 17 nt, Human
uuaagacguguuugugu

SEQ ID NO: 2294013 - RNA, 21 nt, Human
uuaagacugagcaccugcuuc

SEQ ID NO: 2294014 - RNA, 22 nt, Human
uuaagacgaaacauuuguucua

SEQ ID NO: 2294015 - RNA, 16 nt, Human
uuaaguuguuugcaug

SEQ ID NO: 2294016 - RNA, 15 nt, Human
uuaaguuucaggaua

SEQ ID NO: 2294017 - RNA, 22 nt, Human
uuaagagccauauaaguuugaa

SEQ ID NO: 2294018 - RNA, 19 nt, Human
uuaaguuguuugcauguga

SEQ ID NO: 2294019 - RNA, 11 nt, Human
uuaaguuucuc

SEQ ID NO: 2294020 - RNA, 12 nt, Human
uuaaguuucuca

SEQ ID NO: 2294021 - RNA, 15 nt, Human
uuaaguuucucagcu

SEQ ID NO: 2294022 - RNA, 20 nt, Human
uuaauaaaaaaacaaucauu

SEQ ID NO: 2294023 - RNA, 16 nt, Human
uuaauaaaaguacaug

SEQ ID NO: 2294024 - RNA, 15 nt, Human
uuaauaaaaaggcac

SEQ ID NO: 2294025 - RNA, 14 nt, Human
uuaauaaaaaggca

SEQ ID NO: 2294026 - RNA, 11 nt, Human
uuaauaaaaag

SEQ ID NO: 2294027 - RNA, 14 nt, Human
uuaauccuucuagu

SEQ ID NO: 2294028 - RNA, 20 nt, Human
uuaauccuucuaguuuccca

SEQ ID NO: 2294029 - RNA, 15 nt, Human
uuaaucuaaauggaa

SEQ ID NO: 2294030 - RNA, 18 nt, Human
uuaauccagaauaacuag

SEQ ID NO: 2294031 - RNA, 20 nt, Human
uuaauccagaauaacuagca

SEQ ID NO: 2294032 - RNA, 12 nt, Human
uuaauccaaugg

SEQ ID NO: 2294033 - RNA, 18 nt, Human
uuaaucaucuauaaagaa

SEQ ID NO: 2294034 - RNA, 21 nt, Human
uuaaucaucuauaaagaagaa

SEQ ID NO: 2294035 - RNA, 22 nt, Human
uuaaucauuuugccucuuuucu

SEQ ID NO: 2294036 - RNA, 17 nt, Human
uuaauccccaguaaaau

SEQ ID NO: 2294037 - RNA, 23 nt, Human
uuaauccagaauaacuagcacca

SEQ ID NO: 2294038 - RNA, 18 nt, Human
uuaauccccaguaaaauu

SEQ ID NO: 2294039 - RNA, 21 nt, Human
uuaauccccaguaaaauugcc

SEQ ID NO: 2294040 - RNA, 16 nt, Human
uuaaucagacaaagua

SEQ ID NO: 2294041 - RNA, 20 nt, Human
uuaaucagguccucagagaa

SEQ ID NO: 2294042 - RNA, 15 nt, Human
uuaaucaucuauaaa

SEQ ID NO: 2294043 - RNA, 17 nt, Human
uuaaucacuauuguucc

SEQ ID NO: 2294044 - RNA, 16 nt, Human
uuaauaaaauaauucu

SEQ ID NO: 2294045 - RNA, 20 nt, Human
uuaauaaaauaauucuaaag

SEQ ID NO: 2294046 - RNA, 16 nt, Human
uuaaucaauuaauuuu

SEQ ID NO: 2294047 - RNA, 17 nt, Human
uuaaucaauuaauuuuu

SEQ ID NO: 2294048 - RNA, 18 nt, Human
uuaaucaauuuaaaccca

SEQ ID NO: 2294049 - RNA, 20 nt, Human
uuaaucaauuuaaacccauu

SEQ ID NO: 2294050 - RNA, 13 nt, Human
auaaaaaaaagaa

SEQ ID NO: 2294051 - RNA, 19 nt, Human
auaaaagccuguuuaagag

SEQ ID NO: 2294052 - RNA, 23 nt, Human
aguuuuuuuuuauacacuguaau

SEQ ID NO: 2294053 - RNA, 20 nt, Human
auaaaagccuguuuaagaga

SEQ ID NO: 2294054 - RNA, 17 nt, Human
auaaaaggaagccaaag

SEQ ID NO: 2294055 - RNA, 15 nt, Human
auaaaaggaagccaa

SEQ ID NO: 2294056 - RNA, 12 nt, Human
auaaaaggaaaa

SEQ ID NO: 2294057 - RNA, 15 nt, Human
auaaaagcuauggug

SEQ ID NO: 2294058 - RNA, 22 nt, Human
uuaacuuuuauaaacuuuaccu

SEQ ID NO: 2294059 - RNA, 23 nt, Human
uuaacuuuuauaaacuuuaccuu

SEQ ID NO: 2294060 - RNA, 20 nt, Human
auaaaaggaagccaaagagu

SEQ ID NO: 2294061 - RNA, 19 nt, Human
auaaaaggaagccaaagag

SEQ ID NO: 2294062 - RNA, 19 nt, Human
auaaaaggcaaauguguac

SEQ ID NO: 2294063 - RNA, 20 nt, Human
auaaaaggcaaauguguaca

SEQ ID NO: 2294064 - RNA, 18 nt, Human
uuaagacaugauuuccuu

SEQ ID NO: 2294065 - RNA, 23 nt, Human
uuaagacauuuuuggaaggggac

SEQ ID NO: 2294066 - RNA, 18 nt, Human
uuaagacauuuuuggaag

SEQ ID NO: 2294067 - RNA, 16 nt, Human
uuaagacaugauuucc

SEQ ID NO: 2294068 - RNA, 19 nt, Human
uuaagacgaaacauuuguu

SEQ ID NO: 2294069 - RNA, 18 nt, Human
uuaagaccuggcagcucu

SEQ ID NO: 2294070 - RNA, 14 nt, Human
uuaagaccuggcag

SEQ ID NO: 2294071 - RNA, 11 nt, Human
uuaagaccugg

SEQ ID NO: 2294072 - RNA, 20 nt, Human
uuaagaaaaaauaacacaca

SEQ ID NO: 2294073 - RNA, 21 nt, Human
uuaagaaaaaauaacacacau

SEQ ID NO: 2294074 - RNA, 18 nt, Human
uuaagaaggcaaaaaugu

SEQ ID NO: 2294075 - RNA, 22 nt, Human
uuaagaaugaaauacuguuuga

SEQ ID NO: 2294076 - RNA, 20 nt, Human
uuaagaaugaaauacuguuu

SEQ ID NO: 2294077 - RNA, 14 nt, Human
uuaagaaugaaaua

SEQ ID NO: 2294078 - RNA, 20 nt, Human
uuaagacacugaaaaaucua

SEQ ID NO: 2294079 - RNA, 22 nt, Human
aguuuuucccagcuacaccuuu

SEQ ID NO: 2294080 - RNA, 23 nt, Human
aguuuuucccagcuacaccuuuc

SEQ ID NO: 2294081 - RNA, 16 nt, Human
aguuuuugauagcuuu

SEQ ID NO: 2294082 - RNA, 16 nt, Human
aguuuuucuguauuuu

SEQ ID NO: 2294083 - RNA, 12 nt, Human
aguuuuucuguc

SEQ ID NO: 2294084 - RNA, 13 nt, Human
aguuuuucuguca

SEQ ID NO: 2294085 - RNA, 20 nt, Human
aguuuuuauugcuuguugga

SEQ ID NO: 2294086 - RNA, 17 nt, Human
aguuuuucagaaagcau

SEQ ID NO: 2294087 - RNA, 22 nt, Human
aguuuuucagaguggaaugcuu

SEQ ID NO: 2294088 - RNA, 17 nt, Human
aguuuuuaaaauaucuu

SEQ ID NO: 2294089 - RNA, 18 nt, Human
aguuuuguuuuaaaauua

SEQ ID NO: 2294090 - RNA, 18 nt, Human
aguuuuuucucuugggcu

SEQ ID NO: 2294091 - RNA, 17 nt, Human
aguuuuuucucuugggc

SEQ ID NO: 2294092 - RNA, 15 nt, Human
aguuuuuuuuauaca

SEQ ID NO: 2294093 - RNA, 16 nt, Human
aguuuuuguaauuuau

SEQ ID NO: 2294094 - RNA, 12 nt, Human
aguuuuuguacu

SEQ ID NO: 2294095 - RNA, 18 nt, Human
aguuuuuguacuguaaag

SEQ ID NO: 2294096 - RNA, 19 nt, Human
aguuuuuguacuguaaaga

SEQ ID NO: 2294097 - RNA, 12 nt, Human
aguuuuuguucu

SEQ ID NO: 2294098 - RNA, 20 nt, Human
aguuuuuguucuuaauugca

SEQ ID NO: 2294099 - RNA, 15 nt, Human
aguuuuaguugcaga

SEQ ID NO: 2294100 - RNA, 21 nt, Human
aguuuuaguugcagaaacauu

SEQ ID NO: 2294101 - RNA, 20 nt, Human
aguuuuacucugcugcaaaa

SEQ ID NO: 2294102 - RNA, 16 nt, Human
aguuuuaccagaugau

SEQ ID NO: 2294103 - RNA, 20 nt, Human
aguuuuacuuuuaaacugug

SEQ ID NO: 2294104 - RNA, 19 nt, Human
aguuuuacuuuuaaacugu

SEQ ID NO: 2294105 - RNA, 16 nt, Human
aguuuuauaugcuucu

SEQ ID NO: 2294106 - RNA, 13 nt, Human
aguuuuaucacau

SEQ ID NO: 2294107 - RNA, 17 nt, Human
aguuuuaucacauguau

SEQ ID NO: 2294108 - RNA, 19 nt, Human
aguuuuaucacauguaugu

SEQ ID NO: 2294109 - RNA, 13 nt, Human
aguuuuaucauuu

SEQ ID NO: 2294110 - RNA, 12 nt, Human
aguuuuaucauu

SEQ ID NO: 2294111 - RNA, 20 nt, Human
aguuuuaucacauguauguu

SEQ ID NO: 2294112 - RNA, 21 nt, Human
aguuuuaucacauguauguuu

SEQ ID NO: 2294113 - RNA, 20 nt, Human
uuaugaugugggucaaggaa

SEQ ID NO: 2294114 - RNA, 21 nt, Human
uuaugaugugggucaaggaau

SEQ ID NO: 2294115 - RNA, 23 nt, Human
uuaugggaaccccuucauccucu

SEQ ID NO: 2294116 - RNA, 17 nt, Human
uuaugggaaucaagauu

SEQ ID NO: 2294117 - RNA, 13 nt, Human
uuaugggcugggu

SEQ ID NO: 2294118 - RNA, 19 nt, Human
uuauggcuuuugugcauua

SEQ ID NO: 2294119 - RNA, 22 nt, Human
uuaugauuaaguaaugauaacu

SEQ ID NO: 2294120 - RNA, 16 nt, Human
uuaugauguauauuua

SEQ ID NO: 2294121 - RNA, 19 nt, Human
uuaugauuaaguaaugaua

SEQ ID NO: 2294122 - RNA, 17 nt, Human
uuaugguuuugugaugu

SEQ ID NO: 2294123 - RNA, 22 nt, Human
uuauguaaaaggccaaaccucu

SEQ ID NO: 2294124 - RNA, 20 nt, Human
uuauguaaaaggccaaaccu

SEQ ID NO: 2294125 - RNA, 16 nt, Human
uuauguaaaauguuuu

SEQ ID NO: 2294126 - RNA, 20 nt, Human
uuauguaaaauguuuuagca

SEQ ID NO: 2294127 - RNA, 11 nt, Human
uuaugguuuug

SEQ ID NO: 2294128 - RNA, 20 nt, Human
uuaugguguuucucccucuc

SEQ ID NO: 2294129 - RNA, 13 nt, Human
uuaugguguuucu

SEQ ID NO: 2294130 - RNA, 22 nt, Human
uuaugggcuggguucuacccag

SEQ ID NO: 2294131 - RNA, 22 nt, Human
uuauguguguauauguaugugu

SEQ ID NO: 2294132 - RNA, 18 nt, Human
uuauguguguauauguau

SEQ ID NO: 2294133 - RNA, 12 nt, Human
uuauguguguau

SEQ ID NO: 2294134 - RNA, 10 nt, Human
uuaugugugu

SEQ ID NO: 2294135 - RNA, 14 nt, Human
uuaugugugugugu

SEQ ID NO: 2294136 - RNA, 12 nt, Human
uuaugugugugu

SEQ ID NO: 2294137 - RNA, 18 nt, Human
uuaugugccguguuauug

SEQ ID NO: 2294138 - RNA, 15 nt, Human
uuauguguaaauaca

SEQ ID NO: 2294139 - RNA, 19 nt, Human
uuaugugugaggagcugcu

SEQ ID NO: 2294140 - RNA, 13 nt, Human
uuaugugagagaa

SEQ ID NO: 2294141 - RNA, 22 nt, Human
uuaugugccagauuuaugcaua

SEQ ID NO: 2294142 - RNA, 23 nt, Human
uuaugugaaugaucucucugaau

SEQ ID NO: 2294143 - RNA, 15 nt, Human
uuaugugaaacaugu

SEQ ID NO: 2294144 - RNA, 16 nt, Human
uuauguagaugugcau

SEQ ID NO: 2294145 - RNA, 16 nt, Human
uuauguaguaauugac

SEQ ID NO: 2294146 - RNA, 15 nt, Human
uuauguaguaauuga

SEQ ID NO: 2294147 - RNA, 21 nt, Human
uuauguauauuuaaaagaaag

SEQ ID NO: 2294148 - RNA, 19 nt, Human
uuauguaguaauugacaug

SEQ ID NO: 2294149 - RNA, 21 nt, Human
uuauguaauaaugugaaucau

SEQ ID NO: 2294150 - RNA, 15 nt, Human
uuauguaaucuaugu

SEQ ID NO: 2294151 - RNA, 15 nt, Human
uuauguagaugugca

SEQ ID NO: 2294152 - RNA, 17 nt, Human
uuauguaauaaugugaa

SEQ ID NO: 2294153 - RNA, 16 nt, Human
uuauguaauaauguga

SEQ ID NO: 2294154 - RNA, 18 nt, Human
uuauguaagagcaccuuc

SEQ ID NO: 2294155 - RNA, 21 nt, Human
uuaugucugcugaauaauaaa

SEQ ID NO: 2294156 - RNA, 19 nt, Human
uuaugucugcugaauaaua

SEQ ID NO: 2294157 - RNA, 13 nt, Human
uuaugugaaacau

SEQ ID NO: 2294158 - RNA, 13 nt, Human
uuaugucuaaaga

SEQ ID NO: 2294159 - RNA, 17 nt, Human
uuaugucuauuuaagcc

SEQ ID NO: 2294160 - RNA, 15 nt, Human
uuaugucucuucuga

SEQ ID NO: 2294161 - RNA, 17 nt, Human
uuaugucccuucacaua

SEQ ID NO: 2294162 - RNA, 18 nt, Human
uuaugucccuucacauag

SEQ ID NO: 2294163 - RNA, 22 nt, Human
uuaugucccuucacauaguuuu

SEQ ID NO: 2294164 - RNA, 15 nt, Human
uuauguccacugugu

SEQ ID NO: 2294165 - RNA, 17 nt, Human
uuauguccacuguguau

SEQ ID NO: 2294166 - RNA, 18 nt, Human
uuauguccacuguguaua

SEQ ID NO: 2294167 - RNA, 17 nt, Human
uuaugucaucauacaug

SEQ ID NO: 2294168 - RNA, 13 nt, Human
uuaugagggccac

SEQ ID NO: 2294169 - RNA, 18 nt, Human
uuaugagggccacggguc

SEQ ID NO: 2294170 - RNA, 18 nt, Human
uuaugagcucuucauguu

SEQ ID NO: 2294171 - RNA, 18 nt, Human
uuaugaccucuuccuuua

SEQ ID NO: 2294172 - RNA, 22 nt, Human
uuaugacuucauuaauaauaaa

SEQ ID NO: 2294173 - RNA, 19 nt, Human
uuaugacuucauuaauaau

SEQ ID NO: 2294174 - RNA, 23 nt, Human
uuaugaguuuuugauagcuuuau

SEQ ID NO: 2294175 - RNA, 21 nt, Human
uuaugaguuuuugauagcuuu

SEQ ID NO: 2294176 - RNA, 15 nt, Human
uuaugaguuuuugau

SEQ ID NO: 2294177 - RNA, 13 nt, Human
uuaugaguuuuug

SEQ ID NO: 2294178 - RNA, 20 nt, Human
uuaugauacuugaaaauuaa

SEQ ID NO: 2294179 - RNA, 15 nt, Human
uuaugaguuugcuua

SEQ ID NO: 2294180 - RNA, 14 nt, Human
uuaugacaguuaua

SEQ ID NO: 2294181 - RNA, 21 nt, Human
uuaugaauuacauuuguauaa

SEQ ID NO: 2294182 - RNA, 11 nt, Human
uuaugacucca

SEQ ID NO: 2294183 - RNA, 23 nt, Human
uuaugacaucacuuguacaaaau

SEQ ID NO: 2294184 - RNA, 21 nt, Human
uuaugacaucacuuguacaaa

SEQ ID NO: 2294185 - RNA, 18 nt, Human
uuaugacaucacuuguac

SEQ ID NO: 2294186 - RNA, 16 nt, Human
uuaugacaucacuugu

SEQ ID NO: 2294187 - RNA, 14 nt, Human
uuaugaaugaaaaa

SEQ ID NO: 2294188 - RNA, 19 nt, Human
uuaugaauauuuacguuuu

SEQ ID NO: 2294189 - RNA, 14 nt, Human
uuaugaauuacauu

SEQ ID NO: 2294190 - RNA, 16 nt, Human
uuaugaauuacauuug

SEQ ID NO: 2294191 - RNA, 17 nt, Human
uuaugaauuacauuugu

SEQ ID NO: 2294192 - RNA, 18 nt, Human
uuaugaaagguuuacauu

SEQ ID NO: 2294193 - RNA, 13 nt, Human
uuaucccucucca

SEQ ID NO: 2294194 - RNA, 14 nt, Human
uuaugaaauaaaga

SEQ ID NO: 2294195 - RNA, 23 nt, Human
uuaugaagaaaaaauacauuuua

SEQ ID NO: 2294196 - RNA, 18 nt, Human
uuaugaagaaaaaauaca

SEQ ID NO: 2294197 - RNA, 20 nt, Human
uuaugaaauaaagaaauugc

SEQ ID NO: 2294198 - RNA, 19 nt, Human
uuaugaaauucacccccuu

SEQ ID NO: 2294199 - RNA, 20 nt, Human
uuaugaagcuuuuaugugaa

SEQ ID NO: 2294200 - RNA, 18 nt, Human
uuauccauggggaaggga

SEQ ID NO: 2294201 - RNA, 19 nt, Human
uuauccauauugagucaaa

SEQ ID NO: 2294202 - RNA, 17 nt, Human
uuauccauauugaguca

SEQ ID NO: 2294203 - RNA, 15 nt, Human
uuaucccucaccugu

SEQ ID NO: 2294204 - RNA, 17 nt, Human
uuaucccucaccuguag

SEQ ID NO: 2294205 - RNA, 20 nt, Human
uuaucccucaccuguagcag

SEQ ID NO: 2294206 - RNA, 22 nt, Human
uuauccaagguguaacucuaau

SEQ ID NO: 2294207 - RNA, 16 nt, Human
uuauccaccuccaucu

SEQ ID NO: 2294208 - RNA, 12 nt, Human
uuauccaggacu

SEQ ID NO: 2294209 - RNA, 18 nt, Human
uuauccaggacucuguca

SEQ ID NO: 2294210 - RNA, 19 nt, Human
uuauccacagaaacauuuu

SEQ ID NO: 2294211 - RNA, 21 nt, Human
uuaucaccagcugccucuucu

SEQ ID NO: 2294212 - RNA, 16 nt, Human
uuaucauuuucaaaau

SEQ ID NO: 2294213 - RNA, 12 nt, Human
uuaucauuuuca

SEQ ID NO: 2294214 - RNA, 18 nt, Human
uuaucaccgugggcuccc

SEQ ID NO: 2294215 - RNA, 21 nt, Human
uuaucacccagaagaaaauag

SEQ ID NO: 2294216 - RNA, 19 nt, Human
uuaucacccagaagaaaau

SEQ ID NO: 2294217 - RNA, 18 nt, Human
uuaucacccagaagaaaa

SEQ ID NO: 2294218 - RNA, 17 nt, Human
uuaucacccagaagaaa

SEQ ID NO: 2294219 - RNA, 16 nt, Human
auacauaucuuuauua

SEQ ID NO: 2294220 - RNA, 14 nt, Human
auacauaucuuuau

SEQ ID NO: 2294221 - RNA, 13 nt, Human
auacauaucuuua

SEQ ID NO: 2294222 - RNA, 20 nt, Human
auacauaucuuuauuaauca

SEQ ID NO: 2294223 - RNA, 17 nt, Human
auacauaucuuuauuaa

SEQ ID NO: 2294224 - RNA, 10 nt, Human
auacaugcca

SEQ ID NO: 2294225 - RNA, 22 nt, Human
auacaugguagccaguugaauu

SEQ ID NO: 2294226 - RNA, 15 nt, Human
auacaugcugcuaau

SEQ ID NO: 2294227 - RNA, 14 nt, Human
auacauggauaaca

SEQ ID NO: 2294228 - RNA, 13 nt, Human
auacaugcugcua

SEQ ID NO: 2294229 - RNA, 15 nt, Human
auacaugcucuuaga

SEQ ID NO: 2294230 - RNA, 21 nt, Human
auacaugugccgaaugugcag

SEQ ID NO: 2294231 - RNA, 23 nt, Human
auacaguguuauuuucuuugaaa

SEQ ID NO: 2294232 - RNA, 21 nt, Human
auacauaagcggcguaaguuu

SEQ ID NO: 2294233 - RNA, 15 nt, Human
auacauacaccagca

SEQ ID NO: 2294234 - RNA, 23 nt, Human
auacauacaccagcauuccuuuu

SEQ ID NO: 2294235 - RNA, 15 nt, Human
auacaguguuauuuu

SEQ ID NO: 2294236 - RNA, 14 nt, Human
auacaguguuauuu

SEQ ID NO: 2294237 - RNA, 20 nt, Human
auacauaaacaagaccacgu

SEQ ID NO: 2294238 - RNA, 20 nt, Human
auacaguuacucagaauucu

SEQ ID NO: 2294239 - RNA, 23 nt, Human
auacagauagauauaugcucugc

SEQ ID NO: 2294240 - RNA, 23 nt, Human
auacaggaaaagcugcugacagu

SEQ ID NO: 2294241 - RNA, 18 nt, Human
auacaguuacucagaauu

SEQ ID NO: 2294242 - RNA, 20 nt, Human
auacagucuuccauuugcaa

SEQ ID NO: 2294243 - RNA, 19 nt, Human
auacagucuuccauuugca

SEQ ID NO: 2294244 - RNA, 21 nt, Human
auacaggaugaugacuaugga

SEQ ID NO: 2294245 - RNA, 21 nt, Human
auacaggauuugaacucagau

SEQ ID NO: 2294246 - RNA, 17 nt, Human
auacaggaaugaagccu

SEQ ID NO: 2294247 - RNA, 16 nt, Human
auacagggaugguguu

SEQ ID NO: 2294248 - RNA, 16 nt, Human
auacaacuuaaauaau

SEQ ID NO: 2294249 - RNA, 18 nt, Human
auacaaccugcuugggug

SEQ ID NO: 2294250 - RNA, 22 nt, Human
auacaagccauucuaaggaaau

SEQ ID NO: 2294251 - RNA, 14 nt, Human
auacaaccugcuug

SEQ ID NO: 2294252 - RNA, 14 nt, Human
auacaauaacauaa

SEQ ID NO: 2294253 - RNA, 14 nt, Human
auacagaacucuuu

SEQ ID NO: 2294254 - RNA, 16 nt, Human
auacagaacucuuuca

SEQ ID NO: 2294255 - RNA, 15 nt, Human
auacagaacucuuuc

SEQ ID NO: 2294256 - RNA, 20 nt, Human
auacagaacucuuucaaaac

SEQ ID NO: 2294257 - RNA, 18 nt, Human
auacagaacucuuucaaa

SEQ ID NO: 2294258 - RNA, 23 nt, Human
auacagaacucuuucaaaaccuu

SEQ ID NO: 2294259 - RNA, 20 nt, Human
auacagaauugugucugcag

SEQ ID NO: 2294260 - RNA, 17 nt, Human
auacagaggcaacugca

SEQ ID NO: 2294261 - RNA, 16 nt, Human
auacagaggcaacugc

SEQ ID NO: 2294262 - RNA, 20 nt, Human
auacagaccgaacuguugua

SEQ ID NO: 2294263 - RNA, 18 nt, Human
auacagaccgaacuguug

SEQ ID NO: 2294264 - RNA, 21 nt, Human
auacagaccgaacuguuguau

SEQ ID NO: 2294265 - RNA, 21 nt, Human
auacagaauugugucugcagg

SEQ ID NO: 2294266 - RNA, 22 nt, Human
auacagaauugugucugcagga

SEQ ID NO: 2294267 - RNA, 12 nt, Human
auacagacacua

SEQ ID NO: 2294268 - RNA, 14 nt, Human
auacagacacuaag

SEQ ID NO: 2294269 - RNA, 15 nt, Human
auacagacacuaagu

SEQ ID NO: 2294270 - RNA, 18 nt, Human
auacagacacuaaguuau

SEQ ID NO: 2294271 - RNA, 19 nt, Human
auacagacacuaaguuaua

SEQ ID NO: 2294272 - RNA, 23 nt, Human
auacagacacuaaguuauaguau

SEQ ID NO: 2294273 - RNA, 22 nt, Human
uuauaaacuuuuuucuuacugu

SEQ ID NO: 2294274 - RNA, 15 nt, Human
uuauaaauauauuua

SEQ ID NO: 2294275 - RNA, 12 nt, Human
auacaacagugc

SEQ ID NO: 2294276 - RNA, 14 nt, Human
auacaacagugcua

SEQ ID NO: 2294277 - RNA, 15 nt, Human
auacaacagugcuaa

SEQ ID NO: 2294278 - RNA, 16 nt, Human
auacaacagugcuaaa

SEQ ID NO: 2294279 - RNA, 18 nt, Human
auacaacagugcuaaaaa

SEQ ID NO: 2294280 - RNA, 20 nt, Human
auacaacagugcuaaaaaug

SEQ ID NO: 2294281 - RNA, 21 nt, Human
auacaacagugcuaaaaaugg

SEQ ID NO: 2294282 - RNA, 20 nt, Human
auacaacauguagcugaguu

SEQ ID NO: 2294283 - RNA, 22 nt, Human
auacaacccuggcauuaugucc

SEQ ID NO: 2294284 - RNA, 12 nt, Human
uuauaaacuuuu

SEQ ID NO: 2294285 - RNA, 16 nt, Human
uuauaaacuuuuuucu

SEQ ID NO: 2294286 - RNA, 18 nt, Human
uuauaaacuuuaccuuuu

SEQ ID NO: 2294287 - RNA, 17 nt, Human
uuauaaacuuuaccuuu

SEQ ID NO: 2294288 - RNA, 15 nt, Human
uuaucacauguaugu

SEQ ID NO: 2294289 - RNA, 16 nt, Human
uuaucacauguauguu

SEQ ID NO: 2294290 - RNA, 17 nt, Human
uuaucacauguauguuu

SEQ ID NO: 2294291 - RNA, 18 nt, Human
uuaucacauuauuugcau

SEQ ID NO: 2294292 - RNA, 18 nt, Human
uuaucaccacaguaaguu

SEQ ID NO: 2294293 - RNA, 18 nt, Human
uuaucacauguauguuuu

SEQ ID NO: 2294294 - RNA, 19 nt, Human
uuaucacauguauguuuug

SEQ ID NO: 2294295 - RNA, 22 nt, Human
uuaucaccacaguaaguuccua

SEQ ID NO: 2294296 - RNA, 20 nt, Human
uuaucaccagagagggacug

SEQ ID NO: 2294297 - RNA, 17 nt, Human
uuaucaccagcugccuc

SEQ ID NO: 2294298 - RNA, 19 nt, Human
uuaucaccagcugccucuu

SEQ ID NO: 2294299 - RNA, 16 nt, Human
uuaucaaaaauuucau

SEQ ID NO: 2294300 - RNA, 17 nt, Human
uuaucaagugucuucca

SEQ ID NO: 2294301 - RNA, 15 nt, Human
uuaucaagugucuuc

SEQ ID NO: 2294302 - RNA, 15 nt, Human
uuauauuuuuauaga

SEQ ID NO: 2294303 - RNA, 13 nt, Human
uuauauuuuuaaa

SEQ ID NO: 2294304 - RNA, 19 nt, Human
uuauauuuuacuacugugg

SEQ ID NO: 2294305 - RNA, 19 nt, Human
uuauauuugaaauauugac

SEQ ID NO: 2294306 - RNA, 18 nt, Human
auacuaaaaaucaugaga

SEQ ID NO: 2294307 - RNA, 13 nt, Human
auacuaaaaauca

SEQ ID NO: 2294308 - RNA, 13 nt, Human
auacuaguuguga

SEQ ID NO: 2294309 - RNA, 21 nt, Human
auacuaaaaguucuucuccaa

SEQ ID NO: 2294310 - RNA, 14 nt, Human
auacuauauuuaug

SEQ ID NO: 2294311 - RNA, 14 nt, Human
auacuaguugugac

SEQ ID NO: 2294312 - RNA, 16 nt, Human
auacuaguugugaccu

SEQ ID NO: 2294313 - RNA, 20 nt, Human
auacuaguugugaccuuagu

SEQ ID NO: 2294314 - RNA, 17 nt, Human
auacuauggaauuucuc

SEQ ID NO: 2294315 - RNA, 15 nt, Human
auacuauauuuuagg

SEQ ID NO: 2294316 - RNA, 20 nt, Human
auacuaaccagcagaaaugc

SEQ ID NO: 2294317 - RNA, 19 nt, Human
auacuaaccagcagaaaug

SEQ ID NO: 2294318 - RNA, 14 nt, Human
auacguccaccaug

SEQ ID NO: 2294319 - RNA, 21 nt, Human
auacgugaaaauuauuugaaa

SEQ ID NO: 2294320 - RNA, 13 nt, Human
auacguguagcua

SEQ ID NO: 2294321 - RNA, 13 nt, Human
auacuaaccagca

SEQ ID NO: 2294322 - RNA, 13 nt, Human
auacgauaaauaa

SEQ ID NO: 2294323 - RNA, 17 nt, Human
auacgacuuuauuuucu

SEQ ID NO: 2294324 - RNA, 21 nt, Human
auacgccuguaguccuagcca

SEQ ID NO: 2294325 - RNA, 16 nt, Human
auacgcacuacaugug

SEQ ID NO: 2294326 - RNA, 23 nt, Human
auacgcaacauaauuaaauuuug

SEQ ID NO: 2294327 - RNA, 13 nt, Human
auacguacacauu

SEQ ID NO: 2294328 - RNA, 17 nt, Human
auacgcacuacaugugg

SEQ ID NO: 2294329 - RNA, 16 nt, Human
auacguacacauuuua

SEQ ID NO: 2294330 - RNA, 15 nt, Human
auacguacacauuuu

SEQ ID NO: 2294331 - RNA, 14 nt, Human
auacguacacauuu

SEQ ID NO: 2294332 - RNA, 20 nt, Human
auacaugguugugaccugag

SEQ ID NO: 2294333 - RNA, 14 nt, Human
auacaugguuguga

SEQ ID NO: 2294334 - RNA, 16 nt, Human
auaccacccaaugcug

SEQ ID NO: 2294335 - RNA, 18 nt, Human
auaccacuuuuguucuug

SEQ ID NO: 2294336 - RNA, 17 nt, Human
auaccacuuuuguucuu

SEQ ID NO: 2294337 - RNA, 13 nt, Human
auacgacuuuauu

SEQ ID NO: 2294338 - RNA, 14 nt, Human
auaccuuuuuuaga

SEQ ID NO: 2294339 - RNA, 15 nt, Human
auaccuuugccuugg

SEQ ID NO: 2294340 - RNA, 15 nt, Human
uuauuaguuuacauc

SEQ ID NO: 2294341 - RNA, 18 nt, Human
uuauuaguuuacaucauu

SEQ ID NO: 2294342 - RNA, 12 nt, Human
uuauuauaauug

SEQ ID NO: 2294343 - RNA, 20 nt, Human
uuauuauaauuguaucagag

SEQ ID NO: 2294344 - RNA, 15 nt, Human
uuauuauaauuguau

SEQ ID NO: 2294345 - RNA, 18 nt, Human
uuauuauaauuguaucag

SEQ ID NO: 2294346 - RNA, 15 nt, Human
uuauuauauuuacaa

SEQ ID NO: 2294347 - RNA, 16 nt, Human
uuauuaucuaaagugu

SEQ ID NO: 2294348 - RNA, 12 nt, Human
uuauuaugcaug

SEQ ID NO: 2294349 - RNA, 20 nt, Human
uuauguuauuuauauauugg

SEQ ID NO: 2294350 - RNA, 15 nt, Human
uuauguuacaucugu

SEQ ID NO: 2294351 - RNA, 22 nt, Human
uuauguuaagggaagaauucca

SEQ ID NO: 2294352 - RNA, 14 nt, Human
uuauguuaaacuag

SEQ ID NO: 2294353 - RNA, 17 nt, Human
uuauguuaaaucaauaa

SEQ ID NO: 2294354 - RNA, 10 nt, Human
uuauguuaaa

SEQ ID NO: 2294355 - RNA, 11 nt, Human
uuauguuaaac

SEQ ID NO: 2294356 - RNA, 12 nt, Human
uuauguuaaacu

SEQ ID NO: 2294357 - RNA, 13 nt, Human
uuauguuaaacua

SEQ ID NO: 2294358 - RNA, 19 nt, Human
uuauguuaaaacugggaca

SEQ ID NO: 2294359 - RNA, 14 nt, Human
uuauuauauuuaca

SEQ ID NO: 2294360 - RNA, 20 nt, Human
uuauuaguaagaaaacauca

SEQ ID NO: 2294361 - RNA, 24 nt, Human
uuauuaguaccauaguaccauuua

SEQ ID NO: 2294362 - RNA, 20 nt, Human
uuauuaguguaugcuuugaa

SEQ ID NO: 2294363 - RNA, 14 nt, Human
uuauuaguuuacau

SEQ ID NO: 2294364 - RNA, 15 nt, Human
uuauuaguuaauaua

SEQ ID NO: 2294365 - RNA, 14 nt, Human
uuauucaauaaagu

SEQ ID NO: 2294366 - RNA, 17 nt, Human
uuauucaauaaaguauu

SEQ ID NO: 2294367 - RNA, 19 nt, Human
uuauucaauaaaguauuua

SEQ ID NO: 2294368 - RNA, 18 nt, Human
uuauucaauuccucuggg

SEQ ID NO: 2294369 - RNA, 19 nt, Human
uuauucaauuccucuggga

SEQ ID NO: 2294370 - RNA, 20 nt, Human
uuauucaauaaaguauuuaa

SEQ ID NO: 2294371 - RNA, 21 nt, Human
uuauucaauaaaguauuuaau

SEQ ID NO: 2294372 - RNA, 15 nt, Human
uuauucagcuucauu

SEQ ID NO: 2294373 - RNA, 20 nt, Human
uuauucagcuucauuugugu

SEQ ID NO: 2294374 - RNA, 20 nt, Human
uuauucacuuuuauuuagca

SEQ ID NO: 2294375 - RNA, 12 nt, Human
uuauucauuuaa

SEQ ID NO: 2294376 - RNA, 13 nt, Human
uuauucauuuaaa

SEQ ID NO: 2294377 - RNA, 16 nt, Human
uuauucauuuaaaaug

SEQ ID NO: 2294378 - RNA, 23 nt, Human
uuauucauaagccaauuuuucug

SEQ ID NO: 2294379 - RNA, 12 nt, Human
uuauucauaauu

SEQ ID NO: 2294380 - RNA, 14 nt, Human
uuauucagugucac

SEQ ID NO: 2294381 - RNA, 13 nt, Human
uuauucaguguca

SEQ ID NO: 2294382 - RNA, 20 nt, Human
uuauucaggaaaagccucug

SEQ ID NO: 2294383 - RNA, 21 nt, Human
uuauucaggaaaagccucugu

SEQ ID NO: 2294384 - RNA, 22 nt, Human
uuauucaggaaaagccucugug

SEQ ID NO: 2294385 - RNA, 23 nt, Human
uuauucaggaaaagccucugugu

SEQ ID NO: 2294386 - RNA, 22 nt, Human
uuauuauuuguguuuuaauuua

SEQ ID NO: 2294387 - RNA, 14 nt, Human
uuauuauuacuguu

SEQ ID NO: 2294388 - RNA, 15 nt, Human
uuauuauugaaauug

SEQ ID NO: 2294389 - RNA, 16 nt, Human
uuauuauugaaauugu

SEQ ID NO: 2294390 - RNA, 16 nt, Human
uuauucaaguuauugu

SEQ ID NO: 2294391 - RNA, 12 nt, Human
uuauucaauaaa

SEQ ID NO: 2294392 - RNA, 16 nt, Human
uuauuauuuucaccug

SEQ ID NO: 2294393 - RNA, 13 nt, Human
uuauuaugcauga

SEQ ID NO: 2294394 - RNA, 16 nt, Human
uuauuauuauuuuuua

SEQ ID NO: 2294395 - RNA, 22 nt, Human
uuauuaucuaaaguguguuguu

SEQ ID NO: 2294396 - RNA, 19 nt, Human
auacugacugagaauauaa

SEQ ID NO: 2294397 - RNA, 22 nt, Human
auacugaaggaaaaacacaagc

SEQ ID NO: 2294398 - RNA, 12 nt, Human
auacugaaggaa

SEQ ID NO: 2294399 - RNA, 13 nt, Human
auacugaaggaaa

SEQ ID NO: 2294400 - RNA, 14 nt, Human
auacugaaggaaaa

SEQ ID NO: 2294401 - RNA, 15 nt, Human
auacugaaggaaaaa

SEQ ID NO: 2294402 - RNA, 11 nt, Human
auacugaagau

SEQ ID NO: 2294403 - RNA, 13 nt, Human
auacugaagaugc

SEQ ID NO: 2294404 - RNA, 14 nt, Human
auacucuuucugua

SEQ ID NO: 2294405 - RNA, 16 nt, Human
auacucuuucuguaua

SEQ ID NO: 2294406 - RNA, 15 nt, Human
auacucuuucuguau

SEQ ID NO: 2294407 - RNA, 23 nt, Human
auacucuuucuguauauacuuuu

SEQ ID NO: 2294408 - RNA, 22 nt, Human
auacucuuucuguauauacuuu

SEQ ID NO: 2294409 - RNA, 17 nt, Human
auacucuuucuguauau

SEQ ID NO: 2294410 - RNA, 22 nt, Human
auacugcccggggcagcugcca

SEQ ID NO: 2294411 - RNA, 21 nt, Human
auacugccagaugcugauguu

SEQ ID NO: 2294412 - RNA, 18 nt, Human
auacugccagaugcugau

SEQ ID NO: 2294413 - RNA, 19 nt, Human
auacugccagaugcugaug

SEQ ID NO: 2294414 - RNA, 15 nt, Human
auacugccagaugcu

SEQ ID NO: 2294415 - RNA, 16 nt, Human
auacugccagaugcug

SEQ ID NO: 2294416 - RNA, 17 nt, Human
auacugccagaugcuga

SEQ ID NO: 2294417 - RNA, 21 nt, Human
auacugcauacuuuuuaaaug

SEQ ID NO: 2294418 - RNA, 15 nt, Human
auacugcauacuuuu

SEQ ID NO: 2294419 - RNA, 14 nt, Human
auacugcagggcca

SEQ ID NO: 2294420 - RNA, 15 nt, Human
auacugcagggccag

SEQ ID NO: 2294421 - RNA, 17 nt, Human
auacugcagggccagga

SEQ ID NO: 2294422 - RNA, 19 nt, Human
auacugcagggccaggacu

SEQ ID NO: 2294423 - RNA, 14 nt, Human
auacugagggacca

SEQ ID NO: 2294424 - RNA, 20 nt, Human
auacugaaggaaaaacacaa

SEQ ID NO: 2294425 - RNA, 22 nt, Human
auacugagggaccaacugggcc

SEQ ID NO: 2294426 - RNA, 16 nt, Human
auacugcaagaaaaug

SEQ ID NO: 2294427 - RNA, 14 nt, Human
auacugcaagaaaa

SEQ ID NO: 2294428 - RNA, 23 nt, Human
auacugcaauuaaagugauacug

SEQ ID NO: 2294429 - RNA, 17 nt, Human
auacuggccucgccugg

SEQ ID NO: 2294430 - RNA, 20 nt, Human
auacuggaaguuuugcauuu

SEQ ID NO: 2294431 - RNA, 19 nt, Human
auacuggaaguuuugcauu

SEQ ID NO: 2294432 - RNA, 18 nt, Human
auacuggaaguuuugcau

SEQ ID NO: 2294433 - RNA, 17 nt, Human
auacuggaaguuuugca

SEQ ID NO: 2294434 - RNA, 16 nt, Human
auacuggaaguuuugc

SEQ ID NO: 2294435 - RNA, 14 nt, Human
auacuggaaguuuu

SEQ ID NO: 2294436 - RNA, 21 nt, Human
auacuggugcagucauuauga

SEQ ID NO: 2294437 - RNA, 14 nt, Human
auacuggcugguga

SEQ ID NO: 2294438 - RNA, 14 nt, Human
auacuggccuggac

SEQ ID NO: 2294439 - RNA, 15 nt, Human
auacuggccuggacu

SEQ ID NO: 2294440 - RNA, 15 nt, Human
auacuguaaagaaag

SEQ ID NO: 2294441 - RNA, 14 nt, Human
auacuguaaagaaa

SEQ ID NO: 2294442 - RNA, 13 nt, Human
auacuguaaagaa

SEQ ID NO: 2294443 - RNA, 12 nt, Human
auacuguaaaga

SEQ ID NO: 2294444 - RNA, 13 nt, Human
auacuggaaguuu

SEQ ID NO: 2294445 - RNA, 22 nt, Human
auacugcuacuguaauuuuaua

SEQ ID NO: 2294446 - RNA, 20 nt, Human
auacugcuacuguaauuuua

SEQ ID NO: 2294447 - RNA, 19 nt, Human
auacugcuacuguaauuuu

SEQ ID NO: 2294448 - RNA, 16 nt, Human
auacugcuacuguaau

SEQ ID NO: 2294449 - RNA, 19 nt, Human
auacugcgacuuucugccu

SEQ ID NO: 2294450 - RNA, 15 nt, Human
auacugcuacuguaa

SEQ ID NO: 2294451 - RNA, 20 nt, Human
auacugcgacuuucugccug

SEQ ID NO: 2294452 - RNA, 22 nt, Human
auacugcgacuuucugccugga

SEQ ID NO: 2294453 - RNA, 23 nt, Human
auacucuagaugaaguuuuacau

SEQ ID NO: 2294454 - RNA, 17 nt, Human
auacucuagaugaaguu

SEQ ID NO: 2294455 - RNA, 15 nt, Human
auacucuagauuuug

SEQ ID NO: 2294456 - RNA, 20 nt, Human
auacucuagauuuuguuuug

SEQ ID NO: 2294457 - RNA, 21 nt, Human
auacucuagauuuuguuuugc

SEQ ID NO: 2294458 - RNA, 22 nt, Human
auacucuagauuuuguuuugcu

SEQ ID NO: 2294459 - RNA, 17 nt, Human
auacuccuccaagguua

SEQ ID NO: 2294460 - RNA, 14 nt, Human
auacucccaucugu

SEQ ID NO: 2294461 - RNA, 14 nt, Human
auacucugucagau

SEQ ID NO: 2294462 - RNA, 13 nt, Human
auacucugucaga

SEQ ID NO: 2294463 - RNA, 12 nt, Human
auacucugucag

SEQ ID NO: 2294464 - RNA, 16 nt, Human
auacucugucagaugg

SEQ ID NO: 2294465 - RNA, 15 nt, Human
auacucugucagaug

SEQ ID NO: 2294466 - RNA, 19 nt, Human
auacucuuaggaagagaaa

SEQ ID NO: 2294467 - RNA, 16 nt, Human
auacucugcuuagaau

SEQ ID NO: 2294468 - RNA, 21 nt, Human
auacucuuaggaagagaaacc

SEQ ID NO: 2294469 - RNA, 22 nt, Human
auacucuuaggaagagaaacca

SEQ ID NO: 2294470 - RNA, 18 nt, Human
auacucuuauagacaaca

SEQ ID NO: 2294471 - RNA, 20 nt, Human
uuauuccuauauaguuuauu

SEQ ID NO: 2294472 - RNA, 19 nt, Human
uuauucccuuucacaaaau

SEQ ID NO: 2294473 - RNA, 16 nt, Human
uuauucccuguacaau

SEQ ID NO: 2294474 - RNA, 20 nt, Human
uuauuccccauucuuccuag

SEQ ID NO: 2294475 - RNA, 19 nt, Human
uuauuccauauucauguaa

SEQ ID NO: 2294476 - RNA, 20 nt, Human
uuauuccauauucauguaaa

SEQ ID NO: 2294477 - RNA, 22 nt, Human
uuauuccagaaugcuguacauc

SEQ ID NO: 2294478 - RNA, 20 nt, Human
uuauuccagaaugcuguaca

SEQ ID NO: 2294479 - RNA, 17 nt, Human
uuauuccagaaugcugu

SEQ ID NO: 2294480 - RNA, 17 nt, Human
uuauucauuuaaaauga

SEQ ID NO: 2294481 - RNA, 18 nt, Human
uuauucauuuaaaaugau

SEQ ID NO: 2294482 - RNA, 20 nt, Human
uuauucauuuaaaaugauua

SEQ ID NO: 2294483 - RNA, 14 nt, Human
uuauucauuugagu

SEQ ID NO: 2294484 - RNA, 12 nt, Human
uuauuccacauc

SEQ ID NO: 2294485 - RNA, 13 nt, Human
uuauuccacaucu

SEQ ID NO: 2294486 - RNA, 19 nt, Human
uuauuccacaucuacguuu

SEQ ID NO: 2294487 - RNA, 22 nt, Human
uuauuccuauauaguuuauuga

SEQ ID NO: 2294488 - RNA, 16 nt, Human
uuauuccuccugcuca

SEQ ID NO: 2294489 - RNA, 20 nt, Human
uuauuccuccugcucauauu

SEQ ID NO: 2294490 - RNA, 17 nt, Human
uuauuccugauaauaau

SEQ ID NO: 2294491 - RNA, 16 nt, Human
auacucauuaggaugg

SEQ ID NO: 2294492 - RNA, 11 nt, Human
auacucccauc

SEQ ID NO: 2294493 - RNA, 14 nt, Human
auacucauguguau

SEQ ID NO: 2294494 - RNA, 20 nt, Human
uuauuccugauaauaauuga

SEQ ID NO: 2294495 - RNA, 21 nt, Human
uuauuccugauaauaauugau

SEQ ID NO: 2294496 - RNA, 15 nt, Human
auacucauguguaug

SEQ ID NO: 2294497 - RNA, 14 nt, Human
auagauguguggac

SEQ ID NO: 2294498 - RNA, 18 nt, Human
auagaugucuagguacuu

SEQ ID NO: 2294499 - RNA, 14 nt, Human
auagauuauaacuu

SEQ ID NO: 2294500 - RNA, 15 nt, Human
auagauuauaacuug

SEQ ID NO: 2294501 - RNA, 21 nt, Human
auagauuauaacuugucuaaa

SEQ ID NO: 2294502 - RNA, 23 nt, Human
auagauuggagccaccaugccca

SEQ ID NO: 2294503 - RNA, 13 nt, Human
auagauuugaccu

SEQ ID NO: 2294504 - RNA, 15 nt, Human
auagaucccccagac

SEQ ID NO: 2294505 - RNA, 14 nt, Human
auagaguguuauca

SEQ ID NO: 2294506 - RNA, 16 nt, Human
auagaguuuaacacaa

SEQ ID NO: 2294507 - RNA, 15 nt, Human
auagaguuugcuauu

SEQ ID NO: 2294508 - RNA, 20 nt, Human
auagauaagaguagaaacug

SEQ ID NO: 2294509 - RNA, 20 nt, Human
auagaugcuggcccagggcc

SEQ ID NO: 2294510 - RNA, 17 nt, Human
auagaugcuggcccagg

SEQ ID NO: 2294511 - RNA, 16 nt, Human
auagaugcuggcccag

SEQ ID NO: 2294512 - RNA, 15 nt, Human
auagaugcuggccca

SEQ ID NO: 2294513 - RNA, 16 nt, Human
auagaucccccagacu

SEQ ID NO: 2294514 - RNA, 16 nt, Human
auagaugcaagauauu

SEQ ID NO: 2294515 - RNA, 19 nt, Human
auagaugcaagauauuuau

SEQ ID NO: 2294516 - RNA, 21 nt, Human
auagaugcaagauauuuauau

SEQ ID NO: 2294517 - RNA, 23 nt, Human
auagaugucccuuucuuggccag

SEQ ID NO: 2294518 - RNA, 22 nt, Human
auagaugucccuuucuuggcca

SEQ ID NO: 2294519 - RNA, 19 nt, Human
auagaugucccuuucuugg

SEQ ID NO: 2294520 - RNA, 23 nt, Human
auagaugggucuggcugagcuga

SEQ ID NO: 2294521 - RNA, 22 nt, Human
auagauguagauaaacucagaa

SEQ ID NO: 2294522 - RNA, 19 nt, Human
auagaugggaaugaagcuu

SEQ ID NO: 2294523 - RNA, 22 nt, Human
auagaugggucuggcugagcug

SEQ ID NO: 2294524 - RNA, 12 nt, Human
auagaugggaau

SEQ ID NO: 2294525 - RNA, 23 nt, Human
auagaugcuggcccagggcccag

SEQ ID NO: 2294526 - RNA, 13 nt, Human
auagaugggucug

SEQ ID NO: 2294527 - RNA, 13 nt, Human
auagaugggaaug

SEQ ID NO: 2294528 - RNA, 15 nt, Human
auagaugggaaugaa

SEQ ID NO: 2294529 - RNA, 11 nt, Human
auagaugugug

SEQ ID NO: 2294530 - RNA, 13 nt, Human
auagaugugugga

SEQ ID NO: 2294531 - RNA, 12 nt, Human
auagaugugugg

SEQ ID NO: 2294532 - RNA, 15 nt, Human
auagacuuaaaucuc

SEQ ID NO: 2294533 - RNA, 16 nt, Human
auagacauuuguaaau

SEQ ID NO: 2294534 - RNA, 15 nt, Human
auagacccucucaag

SEQ ID NO: 2294535 - RNA, 18 nt, Human
auagacccacaagaggca

SEQ ID NO: 2294536 - RNA, 18 nt, Human
auagagagggagaagaag

SEQ ID NO: 2294537 - RNA, 14 nt, Human
auagagaucauccu

SEQ ID NO: 2294538 - RNA, 16 nt, Human
auagagauguuuuuaa

SEQ ID NO: 2294539 - RNA, 14 nt, Human
auagagagagacca

SEQ ID NO: 2294540 - RNA, 21 nt, Human
auagagagggagaagaaguca

SEQ ID NO: 2294541 - RNA, 21 nt, Human
auagagcaccuaguccaguga

SEQ ID NO: 2294542 - RNA, 14 nt, Human
auagagcuguauua

SEQ ID NO: 2294543 - RNA, 15 nt, Human
auagagccugaggga

SEQ ID NO: 2294544 - RNA, 13 nt, Human
auagagccugagg

SEQ ID NO: 2294545 - RNA, 15 nt, Human
auagagcaaaauuga

SEQ ID NO: 2294546 - RNA, 17 nt, Human
auagagcaaaauugaug

SEQ ID NO: 2294547 - RNA, 21 nt, Human
auagagcaaaauugauguguu

SEQ ID NO: 2294548 - RNA, 22 nt, Human
auagagcaaaauugauguguuu

SEQ ID NO: 2294549 - RNA, 22 nt, Human
auagaggugagggaagccugaa

SEQ ID NO: 2294550 - RNA, 15 nt, Human
auagaggugagggaa

SEQ ID NO: 2294551 - RNA, 16 nt, Human
auagagguaccagcaa

SEQ ID NO: 2294552 - RNA, 21 nt, Human
auagaggcuucuccgccagcc

SEQ ID NO: 2294553 - RNA, 22 nt, Human
auagaggcuucuccgccagccu

SEQ ID NO: 2294554 - RNA, 23 nt, Human
auagaggcuucuccgccagccuc

SEQ ID NO: 2294555 - RNA, 14 nt, Human
auagagggccaaga

SEQ ID NO: 2294556 - RNA, 15 nt, Human
auagaguauaugcac

SEQ ID NO: 2294557 - RNA, 13 nt, Human
auagagucuugcu

SEQ ID NO: 2294558 - RNA, 14 nt, Human
auagaguauaugca

SEQ ID NO: 2294559 - RNA, 19 nt, Human
auagaggcuaaauuacuca

SEQ ID NO: 2294560 - RNA, 13 nt, Human
auagagcuguauu

SEQ ID NO: 2294561 - RNA, 12 nt, Human
auagaggcuagc

SEQ ID NO: 2294562 - RNA, 19 nt, Human
auagaggcuagcuucugcu

SEQ ID NO: 2294563 - RNA, 20 nt, Human
auagaggcuagcuucugcuu

SEQ ID NO: 2294564 - RNA, 18 nt, Human
auagaggcuucuccgcca

SEQ ID NO: 2294565 - RNA, 18 nt, Human
auagauaggucagugcaa

SEQ ID NO: 2294566 - RNA, 14 nt, Human
auagaguguacuua

SEQ ID NO: 2294567 - RNA, 19 nt, Human
auagaguguacuuaacuau

SEQ ID NO: 2294568 - RNA, 21 nt, Human
auagaguguacuuaacuauuc

SEQ ID NO: 2294569 - RNA, 20 nt, Human
auagacaguauauuuauagu

SEQ ID NO: 2294570 - RNA, 23 nt, Human
auagacaauuuauuauggcacau

SEQ ID NO: 2294571 - RNA, 22 nt, Human
auagacacuccccgaagucuuu

SEQ ID NO: 2294572 - RNA, 14 nt, Human
auagaauuuccaau

SEQ ID NO: 2294573 - RNA, 22 nt, Human
auagacaauuuauuauggcaca

SEQ ID NO: 2294574 - RNA, 16 nt, Human
auagacaauuuauuau

SEQ ID NO: 2294575 - RNA, 12 nt, Human
auagaauauuua

SEQ ID NO: 2294576 - RNA, 13 nt, Human
auagaauauuuau

SEQ ID NO: 2294577 - RNA, 19 nt, Human
auagaauauuuauuaccuc

SEQ ID NO: 2294578 - RNA, 22 nt, Human
auagaauauuuauuaccucuga

SEQ ID NO: 2294579 - RNA, 19 nt, Human
auagaauauaauuaucgga

SEQ ID NO: 2294580 - RNA, 17 nt, Human
auagaauuaacacauga

SEQ ID NO: 2294581 - RNA, 14 nt, Human
auagaauaaaauuu

SEQ ID NO: 2294582 - RNA, 19 nt, Human
auagaauaaaauuuuuaau

SEQ ID NO: 2294583 - RNA, 22 nt, Human
auagaauaaaauuuuuaaucuu

SEQ ID NO: 2294584 - RNA, 13 nt, Human
auagaaaugcugg

SEQ ID NO: 2294585 - RNA, 13 nt, Human
auacuguauuaag

SEQ ID NO: 2294586 - RNA, 15 nt, Human
auacuguauuaagag

SEQ ID NO: 2294587 - RNA, 16 nt, Human
auacuguauuaagagu

SEQ ID NO: 2294588 - RNA, 17 nt, Human
auacuguacuuaauaaa

SEQ ID NO: 2294589 - RNA, 16 nt, Human
auacuguacuuaauaa

SEQ ID NO: 2294590 - RNA, 20 nt, Human
auacuguacaaugacuuuau

SEQ ID NO: 2294591 - RNA, 22 nt, Human
auacuggccucgccuggccuga

SEQ ID NO: 2294592 - RNA, 23 nt, Human
auacuguaaagaaagagagaaaa

SEQ ID NO: 2294593 - RNA, 12 nt, Human
auacuguaacac

SEQ ID NO: 2294594 - RNA, 22 nt, Human
auacuguaaagaaagagagaaa

SEQ ID NO: 2294595 - RNA, 21 nt, Human
auacuguaaagaaagagagaa

SEQ ID NO: 2294596 - RNA, 20 nt, Human
auacuguaaagaaagagaga

SEQ ID NO: 2294597 - RNA, 19 nt, Human
auacuguaaagaaagagag

SEQ ID NO: 2294598 - RNA, 18 nt, Human
auacuguaaagaaagaga

SEQ ID NO: 2294599 - RNA, 16 nt, Human
auacuguaaagaaaga

SEQ ID NO: 2294600 - RNA, 19 nt, Human
auagaaaugcugguuuuuc

SEQ ID NO: 2294601 - RNA, 15 nt, Human
auagaaauuuccaga

SEQ ID NO: 2294602 - RNA, 20 nt, Human
auacuguauuaagagugaaa

SEQ ID NO: 2294603 - RNA, 22 nt, Human
auacuguauuaagagugaaaau

SEQ ID NO: 2294604 - RNA, 22 nt, Human
auagaaaugcugguuuuucagu

SEQ ID NO: 2294605 - RNA, 21 nt, Human
auagaacucaguuuuaacuag

SEQ ID NO: 2294606 - RNA, 17 nt, Human
auagaacagagaaagag

SEQ ID NO: 2294607 - RNA, 16 nt, Human
auagaaauuuccagag

SEQ ID NO: 2294608 - RNA, 19 nt, Human
auagaaggauguacauuuc

SEQ ID NO: 2294609 - RNA, 19 nt, Human
auagaaggcuauggggaua

SEQ ID NO: 2294610 - RNA, 14 nt, Human
auagaagcuguagu

SEQ ID NO: 2294611 - RNA, 13 nt, Human
auagaagcuguag

SEQ ID NO: 2294612 - RNA, 15 nt, Human
auagaacucugggcu

SEQ ID NO: 2294613 - RNA, 13 nt, Human
auagaacagugcu

SEQ ID NO: 2294614 - RNA, 18 nt, Human
auagaacucugaaaugaa

SEQ ID NO: 2294615 - RNA, 14 nt, Human
auagaacugaauga

SEQ ID NO: 2294616 - RNA, 15 nt, Human
auagaagaacugcaa

SEQ ID NO: 2294617 - RNA, 20 nt, Human
auagaagaauacaaacauau

SEQ ID NO: 2294618 - RNA, 19 nt, Human
auagaagaacugcaaaggu

SEQ ID NO: 2294619 - RNA, 18 nt, Human
auagaauaaaauauaauu

SEQ ID NO: 2294620 - RNA, 16 nt, Human
auagaagcuguaguag

SEQ ID NO: 2294621 - RNA, 13 nt, Human
auagaaggcaggu

SEQ ID NO: 2294622 - RNA, 13 nt, Human
auagaaguaaaaa

SEQ ID NO: 2294623 - RNA, 17 nt, Human
agugcaagccccugcuc

SEQ ID NO: 2294624 - RNA, 15 nt, Human
agugcaagccccugc

SEQ ID NO: 2294625 - RNA, 18 nt, Human
agugcaagccccugcucc

SEQ ID NO: 2294626 - RNA, 20 nt, Human
agugcaauaaaucugaccca

SEQ ID NO: 2294627 - RNA, 23 nt, Human
agugcaauaaaucugacccagug

SEQ ID NO: 2294628 - RNA, 22 nt, Human
agugcaauaaaucugacccagu

SEQ ID NO: 2294629 - RNA, 21 nt, Human
agugcaauaaaucugacccag

SEQ ID NO: 2294630 - RNA, 17 nt, Human
agugcagugagccgaga

SEQ ID NO: 2294631 - RNA, 21 nt, Human
agugcagcccguguggccccu

SEQ ID NO: 2294632 - RNA, 23 nt, Human
agugcaguccugaucagagccgu

SEQ ID NO: 2294633 - RNA, 17 nt, Human
agugcauuuucccagau

SEQ ID NO: 2294634 - RNA, 15 nt, Human
agugcauuuucccag

SEQ ID NO: 2294635 - RNA, 14 nt, Human
agugccaaaaacaa

SEQ ID NO: 2294636 - RNA, 18 nt, Human
agugccaggauggaauga

SEQ ID NO: 2294637 - RNA, 22 nt, Human
agugccagaggugggcaggugg

SEQ ID NO: 2294638 - RNA, 19 nt, Human
agugccaggacuccccagg

SEQ ID NO: 2294639 - RNA, 23 nt, Human
agugccaggacuccccaggccag

SEQ ID NO: 2294640 - RNA, 24 nt, Human
agugccaggacuccccaggccagg

SEQ ID NO: 2294641 - RNA, 13 nt, Human
agugccaggacuc

SEQ ID NO: 2294642 - RNA, 20 nt, Human
agugccagaggugggcaggu

SEQ ID NO: 2294643 - RNA, 21 nt, Human
agugccagaggugggcaggug

SEQ ID NO: 2294644 - RNA, 15 nt, Human
agugccagagguggg

SEQ ID NO: 2294645 - RNA, 16 nt, Human
agugccagaggugggc

SEQ ID NO: 2294646 - RNA, 18 nt, Human
agugccagaggugggcag

SEQ ID NO: 2294647 - RNA, 19 nt, Human
agugccagaggugggcagg

SEQ ID NO: 2294648 - RNA, 16 nt, Human
agugcaugcugucccu

SEQ ID NO: 2294649 - RNA, 22 nt, Human
agugcauuuaugagcucuucau

SEQ ID NO: 2294650 - RNA, 14 nt, Human
agugcaugcugucc

SEQ ID NO: 2294651 - RNA, 14 nt, Human
agugcauauuccuu

SEQ ID NO: 2294652 - RNA, 16 nt, Human
agugcauauuccuuuc

SEQ ID NO: 2294653 - RNA, 18 nt, Human
agugcauauuccuuucua

SEQ ID NO: 2294654 - RNA, 19 nt, Human
agugcauauuccuuucuau

SEQ ID NO: 2294655 - RNA, 20 nt, Human
agugcauauuccuuucuauc

SEQ ID NO: 2294656 - RNA, 14 nt, Human
agugcauccaaagg

SEQ ID NO: 2294657 - RNA, 15 nt, Human
agugcauccaaaggu

SEQ ID NO: 2294658 - RNA, 21 nt, Human
agugcauccaaaggugcucag

SEQ ID NO: 2294659 - RNA, 17 nt, Human
agugcaacacugaagcu

SEQ ID NO: 2294660 - RNA, 18 nt, Human
agugcaaauuugauacau

SEQ ID NO: 2294661 - RNA, 21 nt, Human
agugcaaagauuugcuuuaau

SEQ ID NO: 2294662 - RNA, 17 nt, Human
agugcaaaucauagcug

SEQ ID NO: 2294663 - RNA, 18 nt, Human
agugcaaaucauagcugg

SEQ ID NO: 2294664 - RNA, 15 nt, Human
agugcaacaguagca

SEQ ID NO: 2294665 - RNA, 20 nt, Human
agugcaacagcacuggcucu

SEQ ID NO: 2294666 - RNA, 19 nt, Human
agugauauggcagaagaca

SEQ ID NO: 2294667 - RNA, 14 nt, Human
agugcaaauuguca

SEQ ID NO: 2294668 - RNA, 17 nt, Human
agugauacaacuucaag

SEQ ID NO: 2294669 - RNA, 20 nt, Human
agugauagagcuaacccuua

SEQ ID NO: 2294670 - RNA, 23 nt, Human
agugauacaacuucaagugcaug

SEQ ID NO: 2294671 - RNA, 15 nt, Human
agugauagucuuuug

SEQ ID NO: 2294672 - RNA, 17 nt, Human
agugauagucuuuugcu

SEQ ID NO: 2294673 - RNA, 19 nt, Human
agugauaauuucuggaauu

SEQ ID NO: 2294674 - RNA, 20 nt, Human
agugaguuguugcccugggu

SEQ ID NO: 2294675 - RNA, 18 nt, Human
agugaguuguugcccugg

SEQ ID NO: 2294676 - RNA, 19 nt, Human
agugaguuguugcccuggg

SEQ ID NO: 2294677 - RNA, 20 nt, Human
agugauagucuuuugcuuuu

SEQ ID NO: 2294678 - RNA, 21 nt, Human
agugauagucuuuugcuuuug

SEQ ID NO: 2294679 - RNA, 14 nt, Human
agugauauaaauca

SEQ ID NO: 2294680 - RNA, 14 nt, Human
agugauauggcaga

SEQ ID NO: 2294681 - RNA, 17 nt, Human
agugauauggcagaaga

SEQ ID NO: 2294682 - RNA, 15 nt, Human
agugaggcccaggga

SEQ ID NO: 2294683 - RNA, 13 nt, Human
agugaggcccagg

SEQ ID NO: 2294684 - RNA, 13 nt, Human
agugaggcucugc

SEQ ID NO: 2294685 - RNA, 12 nt, Human
agugaggcucug

SEQ ID NO: 2294686 - RNA, 18 nt, Human
agugaggcauugcacagg

SEQ ID NO: 2294687 - RNA, 22 nt, Human
agugaggcauugcacagggaga

SEQ ID NO: 2294688 - RNA, 14 nt, Human
agugaggaugucug

SEQ ID NO: 2294689 - RNA, 21 nt, Human
agugagcuuggaaaggaccag

SEQ ID NO: 2294690 - RNA, 22 nt, Human
uguggauguuuuaauuccauga

SEQ ID NO: 2294691 - RNA, 15 nt, Human
uguggaugucuuccu

SEQ ID NO: 2294692 - RNA, 19 nt, Human
uguggauguuuuaauucca

SEQ ID NO: 2294693 - RNA, 17 nt, Human
agugagcuguaggugug

SEQ ID NO: 2294694 - RNA, 14 nt, Human
agugagcuuugcug

SEQ ID NO: 2294695 - RNA, 16 nt, Human
agugagcuuugcugcu

SEQ ID NO: 2294696 - RNA, 19 nt, Human
agugagcuuugcugcuaca

SEQ ID NO: 2294697 - RNA, 20 nt, Human
agugagcuuugcugcuacag

SEQ ID NO: 2294698 - RNA, 21 nt, Human
agugaggaauaguugagcccc

SEQ ID NO: 2294699 - RNA, 22 nt, Human
agugaggaaggcaggaagagag

SEQ ID NO: 2294700 - RNA, 20 nt, Human
agugaggaauaguugagccc

SEQ ID NO: 2294701 - RNA, 19 nt, Human
agugaggaagccaggucca

SEQ ID NO: 2294702 - RNA, 14 nt, Human
agugaggaaggcag

SEQ ID NO: 2294703 - RNA, 20 nt, Human
agugaggaaggcaggaagag

SEQ ID NO: 2294704 - RNA, 16 nt, Human
agugaggaugaaaaaa

SEQ ID NO: 2294705 - RNA, 23 nt, Human
ugugcugguguccugaccacccu

SEQ ID NO: 2294706 - RNA, 19 nt, Human
ugugcugguguccugacca

SEQ ID NO: 2294707 - RNA, 14 nt, Human
ugugcuguggaagc

SEQ ID NO: 2294708 - RNA, 17 nt, Human
ugugcugugcccaaguu

SEQ ID NO: 2294709 - RNA, 16 nt, Human
ugugcuguggaagcaa

SEQ ID NO: 2294710 - RNA, 12 nt, Human
ugugcuguguaa

SEQ ID NO: 2294711 - RNA, 17 nt, Human
ugugcuguggaagcaac

SEQ ID NO: 2294712 - RNA, 17 nt, Human
ugugcuguggggcuggu

SEQ ID NO: 2294713 - RNA, 20 nt, Human
ugugcuguggggcugguagc

SEQ ID NO: 2294714 - RNA, 13 nt, Human
ugugcuguguaaa

SEQ ID NO: 2294715 - RNA, 14 nt, Human
ugugcuguguaaag

SEQ ID NO: 2294716 - RNA, 15 nt, Human
ugugcuguguaaagu

SEQ ID NO: 2294717 - RNA, 15 nt, Human
ugugcugugugugac

SEQ ID NO: 2294718 - RNA, 12 nt, Human
ugugcugugugu

SEQ ID NO: 2294719 - RNA, 16 nt, Human
ugugcuguguaaaguu

SEQ ID NO: 2294720 - RNA, 23 nt, Human
ugugcuguguaaaguuagucuac

SEQ ID NO: 2294721 - RNA, 18 nt, Human
ugugcugcccugcccacc

SEQ ID NO: 2294722 - RNA, 19 nt, Human
ugugcugcccugcccaccu

SEQ ID NO: 2294723 - RNA, 20 nt, Human
ugugcugcccugcccaccug

SEQ ID NO: 2294724 - RNA, 21 nt, Human
ugugcugcccugcccaccugg

SEQ ID NO: 2294725 - RNA, 14 nt, Human
uguggaugauaaaa

SEQ ID NO: 2294726 - RNA, 23 nt, Human
uguggaugagcccucagaacccu

SEQ ID NO: 2294727 - RNA, 19 nt, Human
uguggaugagcccucagaa

SEQ ID NO: 2294728 - RNA, 14 nt, Human
uguggaucagagau

SEQ ID NO: 2294729 - RNA, 21 nt, Human
uguggaucaaauccagccugc

SEQ ID NO: 2294730 - RNA, 20 nt, Human
uguggaucaaccaucgcuuu

SEQ ID NO: 2294731 - RNA, 19 nt, Human
uguggaucaaccaucgcuu

SEQ ID NO: 2294732 - RNA, 17 nt, Human
uguggaucagagaugca

SEQ ID NO: 2294733 - RNA, 23 nt, Human
agugagcugguuuuuagcggaga

SEQ ID NO: 2294734 - RNA, 22 nt, Human
uguggauuuaacagaaauguac

SEQ ID NO: 2294735 - RNA, 20 nt, Human
uguggauuuaacagaaaugu

SEQ ID NO: 2294736 - RNA, 19 nt, Human
uguggauuuaacagaaaug

SEQ ID NO: 2294737 - RNA, 20 nt, Human
ugugauugggaauaaauaug

SEQ ID NO: 2294738 - RNA, 17 nt, Human
ugugauugggaauaaau

SEQ ID NO: 2294739 - RNA, 19 nt, Human
ugugauugggaauaaauau

SEQ ID NO: 2294740 - RNA, 15 nt, Human
ugugauugggaauaa

SEQ ID NO: 2294741 - RNA, 23 nt, Human
ugugauugacagcuuugcugcug

SEQ ID NO: 2294742 - RNA, 22 nt, Human
ugugauugacagcuuugcugcu

SEQ ID NO: 2294743 - RNA, 16 nt, Human
ugugauugacagcuuu

SEQ ID NO: 2294744 - RNA, 15 nt, Human
ugugauugaaucuga

SEQ ID NO: 2294745 - RNA, 21 nt, Human
ugugauucuaaugucuucauu

SEQ ID NO: 2294746 - RNA, 17 nt, Human
ugugauucuaaugucuu

SEQ ID NO: 2294747 - RNA, 13 nt, Human
ugugauugaaucu

SEQ ID NO: 2294748 - RNA, 22 nt, Human
ugugauucaaucuguaaacugu

SEQ ID NO: 2294749 - RNA, 20 nt, Human
ugugauucaaucuguaaacu

SEQ ID NO: 2294750 - RNA, 16 nt, Human
ugugauucaaucugua

SEQ ID NO: 2294751 - RNA, 22 nt, Human
ugugauuccacuacaccuggcu

SEQ ID NO: 2294752 - RNA, 19 nt, Human
ugugauuccuuugaagagg

SEQ ID NO: 2294753 - RNA, 20 nt, Human
ugugauuccuuugaagagga

SEQ ID NO: 2294754 - RNA, 21 nt, Human
ugugauuccuuugaagaggaa

SEQ ID NO: 2294755 - RNA, 14 nt, Human
ugugauucuaaugu

SEQ ID NO: 2294756 - RNA, 16 nt, Human
ugugauucuaaugucu

SEQ ID NO: 2294757 - RNA, 15 nt, Human
ugugccuaacaccag

SEQ ID NO: 2294758 - RNA, 15 nt, Human
ugugccgacagaagg

SEQ ID NO: 2294759 - RNA, 20 nt, Human
ugugcucaggagcccuggga

SEQ ID NO: 2294760 - RNA, 14 nt, Human
ugugcccucuugau

SEQ ID NO: 2294761 - RNA, 11 nt, Human
ugugcccuggu

SEQ ID NO: 2294762 - RNA, 13 nt, Human
ugugcccuggugg

SEQ ID NO: 2294763 - RNA, 14 nt, Human
ugugcccuggugga

SEQ ID NO: 2294764 - RNA, 15 nt, Human
ugugccgaaugugca

SEQ ID NO: 2294765 - RNA, 16 nt, Human
ugugccgaaugugcag

SEQ ID NO: 2294766 - RNA, 20 nt, Human
ugugcugcccgucuucagcc

SEQ ID NO: 2294767 - RNA, 19 nt, Human
ugugcugagucugaaggcu

SEQ ID NO: 2294768 - RNA, 18 nt, Human
ugugcugagucugaaggc

SEQ ID NO: 2294769 - RNA, 23 nt, Human
ugugcuccgugccuccaccacca

SEQ ID NO: 2294770 - RNA, 19 nt, Human
ugugcugaauucugcaaug

SEQ ID NO: 2294771 - RNA, 14 nt, Human
ugugcugacccucc

SEQ ID NO: 2294772 - RNA, 17 nt, Human
ugugcugacccuccugu

SEQ ID NO: 2294773 - RNA, 21 nt, Human
ugugcugacggaagccaacuu

SEQ ID NO: 2294774 - RNA, 14 nt, Human
ugugcugaggccuu

SEQ ID NO: 2294775 - RNA, 21 nt, Human
ugugcugaggccuuaucauuc

SEQ ID NO: 2294776 - RNA, 17 nt, Human
ugugcuccccuuugccu

SEQ ID NO: 2294777 - RNA, 21 nt, Human
ugugcucccugguucugauga

SEQ ID NO: 2294778 - RNA, 14 nt, Human
ugugcuccgugccu

SEQ ID NO: 2294779 - RNA, 16 nt, Human
ugugccuaacaccagc

SEQ ID NO: 2294780 - RNA, 21 nt, Human
ugugcucaggagcccugggag

SEQ ID NO: 2294781 - RNA, 14 nt, Human
ugugcucuccaagc

SEQ ID NO: 2294782 - RNA, 16 nt, Human
ugugcuccuccuuggu

SEQ ID NO: 2294783 - RNA, 16 nt, Human
ugugcuccgugccucc

SEQ ID NO: 2294784 - RNA, 20 nt, Human
ugugcuccgugccuccacca

SEQ ID NO: 2294785 - RNA, 19 nt, Human
ugugcucuccaagcccagu

SEQ ID NO: 2294786 - RNA, 22 nt, Human
agugagcggugcuguccucagg

SEQ ID NO: 2294787 - RNA, 14 nt, Human
agugagccuggcuc

SEQ ID NO: 2294788 - RNA, 15 nt, Human
agugagccuggcucu

SEQ ID NO: 2294789 - RNA, 23 nt, Human
agugagcggugcuguccucaggu

SEQ ID NO: 2294790 - RNA, 16 nt, Human
agugagcucuaugggc

SEQ ID NO: 2294791 - RNA, 17 nt, Human
agugagcucuaugggca

SEQ ID NO: 2294792 - RNA, 12 nt, Human
agugagcugguu

SEQ ID NO: 2294793 - RNA, 22 nt, Human
agugagccgcaucuucuccauc

SEQ ID NO: 2294794 - RNA, 20 nt, Human
agugagccgcaucuucucca

SEQ ID NO: 2294795 - RNA, 11 nt, Human
agugagccuga

SEQ ID NO: 2294796 - RNA, 24 nt, Human
agugagccgcaucuucuccaucug

SEQ ID NO: 2294797 - RNA, 13 nt, Human
agugagccuggcu

SEQ ID NO: 2294798 - RNA, 21 nt, Human
agugagccugaauuuuguugc

SEQ ID NO: 2294799 - RNA, 19 nt, Human
agugagccgcaucuucucc

SEQ ID NO: 2294800 - RNA, 16 nt, Human
agugagaugcauucuu

SEQ ID NO: 2294801 - RNA, 19 nt, Human
agugagauagcauugugaa

SEQ ID NO: 2294802 - RNA, 12 nt, Human
agugagaugcau

SEQ ID NO: 2294803 - RNA, 16 nt, Human
agugagauagcauugu

SEQ ID NO: 2294804 - RNA, 22 nt, Human
agugagauagcauugugaacug

SEQ ID NO: 2294805 - RNA, 23 nt, Human
agugagcugagaucgugccguua

SEQ ID NO: 2294806 - RNA, 19 nt, Human
ugugaugagaggaaaucac

SEQ ID NO: 2294807 - RNA, 14 nt, Human
ugugaugaggggag

SEQ ID NO: 2294808 - RNA, 16 nt, Human
ugugaugaggcagagg

SEQ ID NO: 2294809 - RNA, 16 nt, Human
ugugaugaggggaggg

SEQ ID NO: 2294810 - RNA, 17 nt, Human
ugugaugccacacagag

SEQ ID NO: 2294811 - RNA, 15 nt, Human
ugugaugccacacag

SEQ ID NO: 2294812 - RNA, 15 nt, Human
ugugauucaaucugu

SEQ ID NO: 2294813 - RNA, 22 nt, Human
ugugaugaugaaaugaggucag

SEQ ID NO: 2294814 - RNA, 14 nt, Human
agugagcacuaagg

SEQ ID NO: 2294815 - RNA, 22 nt, Human
agugagcacuaaggugugcucu

SEQ ID NO: 2294816 - RNA, 16 nt, Human
agugagaagcuuugcc

SEQ ID NO: 2294817 - RNA, 20 nt, Human
agugagaaaaagcuccuguc

SEQ ID NO: 2294818 - RNA, 17 nt, Human
agugagaauaggcagcc

SEQ ID NO: 2294819 - RNA, 12 nt, Human
agugagacagaa

SEQ ID NO: 2294820 - RNA, 13 nt, Human
agugagagggcau

SEQ ID NO: 2294821 - RNA, 14 nt, Human
agugagagggcaug

SEQ ID NO: 2294822 - RNA, 20 nt, Human
agugagaagcuuugcccucc

SEQ ID NO: 2294823 - RNA, 22 nt, Human
agugagagggcaugcgcacaag

SEQ ID NO: 2294824 - RNA, 17 nt, Human
agugacuguucaagagc

SEQ ID NO: 2294825 - RNA, 19 nt, Human
agugacuguucaagagcac

SEQ ID NO: 2294826 - RNA, 20 nt, Human
agugacuguucaagagcaca

SEQ ID NO: 2294827 - RNA, 21 nt, Human
agugacuuagcagaugcuggu

SEQ ID NO: 2294828 - RNA, 22 nt, Human
agugacucgggcuccugugccc

SEQ ID NO: 2294829 - RNA, 14 nt, Human
agugagaaaaagcu

SEQ ID NO: 2294830 - RNA, 18 nt, Human
agugacuuuggcugcaug

SEQ ID NO: 2294831 - RNA, 18 nt, Human
agugagaaaaagcuccug

SEQ ID NO: 2294832 - RNA, 19 nt, Human
agugagaaaaagcuccugu

SEQ ID NO: 2294833 - RNA, 22 nt, Human
agugagaaaaagcuccuguccu

SEQ ID NO: 2294834 - RNA, 14 nt, Human
agugacuugcccag

SEQ ID NO: 2294835 - RNA, 15 nt, Human
agugacuugcccagu

SEQ ID NO: 2294836 - RNA, 16 nt, Human
agugacuuguguccca

SEQ ID NO: 2294837 - RNA, 18 nt, Human
agugacuugugucccaug

SEQ ID NO: 2294838 - RNA, 16 nt, Human
agugaacuugggccac

SEQ ID NO: 2294839 - RNA, 13 nt, Human
agugaaccaaaga

SEQ ID NO: 2294840 - RNA, 15 nt, Human
agugaaccaaagaga

SEQ ID NO: 2294841 - RNA, 22 nt, Human
agugaaccaaagagacuggagc

SEQ ID NO: 2294842 - RNA, 23 nt, Human
agugaaccaaagagacuggagca

SEQ ID NO: 2294843 - RNA, 16 nt, Human
agugaacacuagccag

SEQ ID NO: 2294844 - RNA, 17 nt, Human
agugaacacuagccaga

SEQ ID NO: 2294845 - RNA, 23 nt, Human
agugaacaaauuuacagagacag

SEQ ID NO: 2294846 - RNA, 22 nt, Human
agugaacaaauuuacagagaca

SEQ ID NO: 2294847 - RNA, 23 nt, Human
agugacucauccucuugaagaug

SEQ ID NO: 2294848 - RNA, 18 nt, Human
agugacucauccucuuga

SEQ ID NO: 2294849 - RNA, 22 nt, Human
agugacuaugaacuucucucag

SEQ ID NO: 2294850 - RNA, 21 nt, Human
agugaaccaucauuauaaacg

SEQ ID NO: 2294851 - RNA, 13 nt, Human
agugaaccaucau

SEQ ID NO: 2294852 - RNA, 15 nt, Human
agugaaccuguauaa

SEQ ID NO: 2294853 - RNA, 17 nt, Human
agugaaccuaccuucau

SEQ ID NO: 2294854 - RNA, 20 nt, Human
agugaacuacgcuugcucau

SEQ ID NO: 2294855 - RNA, 21 nt, Human
agugacugauggcuaauguac

SEQ ID NO: 2294856 - RNA, 13 nt, Human
agugacuccagga

SEQ ID NO: 2294857 - RNA, 17 nt, Human
agugacuccaggagagg

SEQ ID NO: 2294858 - RNA, 14 nt, Human
agugacucgagggu

SEQ ID NO: 2294859 - RNA, 15 nt, Human
agugacucgggcucc

SEQ ID NO: 2294860 - RNA, 17 nt, Human
agugacucgggcuccug

SEQ ID NO: 2294861 - RNA, 19 nt, Human
agugacucgggcuccugug

SEQ ID NO: 2294862 - RNA, 20 nt, Human
agugacucgggcuccugugc

SEQ ID NO: 2294863 - RNA, 21 nt, Human
agugacucgggcuccugugcc

SEQ ID NO: 2294864 - RNA, 15 nt, Human
agucuugugcuuuuc

SEQ ID NO: 2294865 - RNA, 12 nt, Human
agucuugugcuu

SEQ ID NO: 2294866 - RNA, 22 nt, Human
agucuuguauuaaguuguuaau

SEQ ID NO: 2294867 - RNA, 16 nt, Human
agucuuucacauuuaa

SEQ ID NO: 2294868 - RNA, 18 nt, Human
agucuuucacauuuaaau

SEQ ID NO: 2294869 - RNA, 21 nt, Human
agugaacaaauuuacagagac

SEQ ID NO: 2294870 - RNA, 20 nt, Human
agucuugugcuuuuccuauu

SEQ ID NO: 2294871 - RNA, 20 nt, Human
agucuuuacagcugagcaca

SEQ ID NO: 2294872 - RNA, 22 nt, Human
ugugacugauguuacaucacag

SEQ ID NO: 2294873 - RNA, 18 nt, Human
ugugacuucagcucuguu

SEQ ID NO: 2294874 - RNA, 19 nt, Human
ugugacuucagcucuguuu

SEQ ID NO: 2294875 - RNA, 23 nt, Human
ugugacuugcaucguggagacag

SEQ ID NO: 2294876 - RNA, 15 nt, Human
ugugacuucuccagg

SEQ ID NO: 2294877 - RNA, 20 nt, Human
ugucuccagacccccacccc

SEQ ID NO: 2294878 - RNA, 19 nt, Human
ugucuccagacccccaccc

SEQ ID NO: 2294879 - RNA, 17 nt, Human
ugucuccagacccccac

SEQ ID NO: 2294880 - RNA, 16 nt, Human
ugucuccagaccccca

SEQ ID NO: 2294881 - RNA, 14 nt, Human
ugucuccagacccc

SEQ ID NO: 2294882 - RNA, 12 nt, Human
ugucuccagacc

SEQ ID NO: 2294883 - RNA, 11 nt, Human
ugucuccagac

SEQ ID NO: 2294884 - RNA, 14 nt, Human
ugucucccuggccc

SEQ ID NO: 2294885 - RNA, 23 nt, Human
ugucuccagacccccaccccuuc

SEQ ID NO: 2294886 - RNA, 22 nt, Human
ugucuccagacccccaccccuu

SEQ ID NO: 2294887 - RNA, 15 nt, Human
ugucuccauggcccu

SEQ ID NO: 2294888 - RNA, 15 nt, Human
ugucucccuggcccu

SEQ ID NO: 2294889 - RNA, 16 nt, Human
ugucucccuggcccuc

SEQ ID NO: 2294890 - RNA, 16 nt, Human
ugugacugaucucucg

SEQ ID NO: 2294891 - RNA, 21 nt, Human
ugugagccccugguccugagg

SEQ ID NO: 2294892 - RNA, 22 nt, Human
ugugagccccugguccugaggg

SEQ ID NO: 2294893 - RNA, 14 nt, Human
ugugagccuuggcu

SEQ ID NO: 2294894 - RNA, 16 nt, Human
ugugaggaaagucauu

SEQ ID NO: 2294895 - RNA, 22 nt, Human
ugugaggaaagucauuggcuuu

SEQ ID NO: 2294896 - RNA, 23 nt, Human
ugugaggaaagucauuggcuuua

SEQ ID NO: 2294897 - RNA, 14 nt, Human
agucucccuucucc

SEQ ID NO: 2294898 - RNA, 11 nt, Human
ugugaggaagc

SEQ ID NO: 2294899 - RNA, 19 nt, Human
ugugagacccccacaccuc

SEQ ID NO: 2294900 - RNA, 18 nt, Human
ugugagacccccacaccu

SEQ ID NO: 2294901 - RNA, 16 nt, Human
ugugagacccccacac

SEQ ID NO: 2294902 - RNA, 15 nt, Human
ugugagacccccaca

SEQ ID NO: 2294903 - RNA, 13 nt, Human
ugugagagaaagu

SEQ ID NO: 2294904 - RNA, 12 nt, Human
ugugagccccug

SEQ ID NO: 2294905 - RNA, 14 nt, Human
ugugagccccuggu

SEQ ID NO: 2294906 - RNA, 17 nt, Human
ugugagccccugguccu

SEQ ID NO: 2294907 - RNA, 18 nt, Human
ugugagcccagcuggguc

SEQ ID NO: 2294908 - RNA, 19 nt, Human
ugugagacucgagaacuuu

SEQ ID NO: 2294909 - RNA, 14 nt, Human
ugugagacccccac

SEQ ID NO: 2294910 - RNA, 13 nt, Human
ugugagaccccca

SEQ ID NO: 2294911 - RNA, 14 nt, Human
ugugagaaucaaaa

SEQ ID NO: 2294912 - RNA, 18 nt, Human
ugugagacagugggaaau

SEQ ID NO: 2294913 - RNA, 19 nt, Human
ugugagacagugggaaaua

SEQ ID NO: 2294914 - RNA, 21 nt, Human
ugugagaagugaaugcuggga

SEQ ID NO: 2294915 - RNA, 22 nt, Human
ugugagaagugaaugcugggac

SEQ ID NO: 2294916 - RNA, 23 nt, Human
ugugagaagugaaugcugggacu

SEQ ID NO: 2294917 - RNA, 24 nt, Human
ugugagaagugaaugcugggacuc

SEQ ID NO: 2294918 - RNA, 19 nt, Human
agucucgcucuguugccca

SEQ ID NO: 2294919 - RNA, 15 nt, Human
agucucgcucuguca

SEQ ID NO: 2294920 - RNA, 20 nt, Human
agucucgcucugucacccag

SEQ ID NO: 2294921 - RNA, 16 nt, Human
agucucuagguucuga

SEQ ID NO: 2294922 - RNA, 19 nt, Human
agucucuucuccacuggau

SEQ ID NO: 2294923 - RNA, 14 nt, Human
agucuccuuccccu

SEQ ID NO: 2294924 - RNA, 17 nt, Human
agucucccuucucccau

SEQ ID NO: 2294925 - RNA, 17 nt, Human
agucuccuuugcacuga

SEQ ID NO: 2294926 - RNA, 18 nt, Human
agucuccuuugcacugag

SEQ ID NO: 2294927 - RNA, 19 nt, Human
agucuccuuugcacugagg

SEQ ID NO: 2294928 - RNA, 21 nt, Human
agucuccuuugcacugagggc

SEQ ID NO: 2294929 - RNA, 22 nt, Human
agucuccuuugcacugagggcc

SEQ ID NO: 2294930 - RNA, 23 nt, Human
agucuccuuugcacugagggcca

SEQ ID NO: 2294931 - RNA, 17 nt, Human
agucucccuuucccuuc

SEQ ID NO: 2294932 - RNA, 22 nt, Human
agucucuuuaaucuucaguuuu

SEQ ID NO: 2294933 - RNA, 15 nt, Human
agucucuuuucuuua

SEQ ID NO: 2294934 - RNA, 21 nt, Human
agucucuuuucuuuagagcau

SEQ ID NO: 2294935 - RNA, 22 nt, Human
agucucuuuucuuuagagcauu

SEQ ID NO: 2294936 - RNA, 23 nt, Human
agucucuuuaaucuucaguuuua

SEQ ID NO: 2294937 - RNA, 21 nt, Human
agucucuuuaaucuucaguuu

SEQ ID NO: 2294938 - RNA, 17 nt, Human
agucucuuuaaucuuca

SEQ ID NO: 2294939 - RNA, 15 nt, Human
agucucuuuaaucuu

SEQ ID NO: 2294940 - RNA, 17 nt, Human
agucucuuguauuaaac

SEQ ID NO: 2294941 - RNA, 18 nt, Human
agucucuucuccacugga

SEQ ID NO: 2294942 - RNA, 21 nt, Human
agucucuucuccacuggaugg

SEQ ID NO: 2294943 - RNA, 16 nt, Human
agucucuugauucaua

SEQ ID NO: 2294944 - RNA, 17 nt, Human
agucucuugauucauaa

SEQ ID NO: 2294945 - RNA, 23 nt, Human
agucuuagauguauauauuuccu

SEQ ID NO: 2294946 - RNA, 16 nt, Human
agucuuagauguauau

SEQ ID NO: 2294947 - RNA, 14 nt, Human
agucuuagauguau

SEQ ID NO: 2294948 - RNA, 13 nt, Human
agucuuagaugua

SEQ ID NO: 2294949 - RNA, 14 nt, Human
agucugaagcagau

SEQ ID NO: 2294950 - RNA, 21 nt, Human
agucugaagcagaugcaaaga

SEQ ID NO: 2294951 - RNA, 12 nt, Human
agucugaaggcu

SEQ ID NO: 2294952 - RNA, 23 nt, Human
agucucuuuucuuuagagcauug

SEQ ID NO: 2294953 - RNA, 15 nt, Human
agucugaacagcugu

SEQ ID NO: 2294954 - RNA, 16 nt, Human
agucugaacagcugua

SEQ ID NO: 2294955 - RNA, 18 nt, Human
agucugaacagcuguaau

SEQ ID NO: 2294956 - RNA, 20 nt, Human
uguucgcauggucacacacu

SEQ ID NO: 2294957 - RNA, 19 nt, Human
uguuccuuagaccuuccau

SEQ ID NO: 2294958 - RNA, 18 nt, Human
uguuccuucacauccugu

SEQ ID NO: 2294959 - RNA, 21 nt, Human
uguuccuggcaauaguguguu

SEQ ID NO: 2294960 - RNA, 14 nt, Human
uguuccuggcaaua

SEQ ID NO: 2294961 - RNA, 19 nt, Human
uguuccuggcaguuuaaaa

SEQ ID NO: 2294962 - RNA, 15 nt, Human
uguuccuggcaguuu

SEQ ID NO: 2294963 - RNA, 15 nt, Human
uguucgcgugugugg

SEQ ID NO: 2294964 - RNA, 23 nt, Human
uguucgcguguguggguggauau

SEQ ID NO: 2294965 - RNA, 23 nt, Human
uguucgcauggucacacacugau

SEQ ID NO: 2294966 - RNA, 22 nt, Human
uguucgcauggucacacacuga

SEQ ID NO: 2294967 - RNA, 21 nt, Human
uguuccaagacauugucaaua

SEQ ID NO: 2294968 - RNA, 15 nt, Human
uguuccaauaaacag

SEQ ID NO: 2294969 - RNA, 19 nt, Human
uguuccaagacauugucaa

SEQ ID NO: 2294970 - RNA, 18 nt, Human
uguuccaagacauuguca

SEQ ID NO: 2294971 - RNA, 15 nt, Human
uguuccaagacauug

SEQ ID NO: 2294972 - RNA, 14 nt, Human
uguuccaagacauu

SEQ ID NO: 2294973 - RNA, 11 nt, Human
uguuccaagac

SEQ ID NO: 2294974 - RNA, 14 nt, Human
uguuccaacugccc

SEQ ID NO: 2294975 - RNA, 19 nt, Human
uguuccacaaguuaaauaa

SEQ ID NO: 2294976 - RNA, 20 nt, Human
uguuccaagacauugucaau

SEQ ID NO: 2294977 - RNA, 22 nt, Human
uguuccugaauucuauuugcug

SEQ ID NO: 2294978 - RNA, 13 nt, Human
uguuaugaaauaa

SEQ ID NO: 2294979 - RNA, 16 nt, Human
uguuaugaaauaaaga

SEQ ID NO: 2294980 - RNA, 21 nt, Human
uguuaugaaauaaagaaauug

SEQ ID NO: 2294981 - RNA, 14 nt, Human
aguguguauuaaaa

SEQ ID NO: 2294982 - RNA, 19 nt, Human
aguguguauuaaaaaaaac

SEQ ID NO: 2294983 - RNA, 20 nt, Human
aguguguaugugcgugugug

SEQ ID NO: 2294984 - RNA, 11 nt, Human
aguguguauua

SEQ ID NO: 2294985 - RNA, 19 nt, Human
aguguguaugugcgugugu

SEQ ID NO: 2294986 - RNA, 16 nt, Human
aguguguaugugcgug

SEQ ID NO: 2294987 - RNA, 11 nt, Human
aguguguaaag

SEQ ID NO: 2294988 - RNA, 22 nt, Human
agugugguguuuccuggcacug

SEQ ID NO: 2294989 - RNA, 9 nt, Human
aguguguaa

SEQ ID NO: 2294990 - RNA, 17 nt, Human
uguucauuuugagcuga

SEQ ID NO: 2294991 - RNA, 14 nt, Human
uguucauuuccuca

SEQ ID NO: 2294992 - RNA, 17 nt, Human
uguuccaaaugaauguu

SEQ ID NO: 2294993 - RNA, 18 nt, Human
uguucauuuugagcugaa

SEQ ID NO: 2294994 - RNA, 20 nt, Human
uguucauuuugagcugaaau

SEQ ID NO: 2294995 - RNA, 17 nt, Human
uguuaugacuccagaau

SEQ ID NO: 2294996 - RNA, 13 nt, Human
uguuaugacucca

SEQ ID NO: 2294997 - RNA, 20 nt, Human
aguguggaagccggagggug

SEQ ID NO: 2294998 - RNA, 17 nt, Human
aguguggcaguuuggca

SEQ ID NO: 2294999 - RNA, 16 nt, Human
aguguggcaguuuggc

SEQ ID NO: 2295000 - RNA, 14 nt, Human
aguguggcuccccu

SEQ ID NO: 2295001 - RNA, 21 nt, Human
aguguggcuccccucuauuua

SEQ ID NO: 2295002 - RNA, 20 nt, Human
aguguggcugaggaggccuc

SEQ ID NO: 2295003 - RNA, 17 nt, Human
aguguggcuccccucua

SEQ ID NO: 2295004 - RNA, 16 nt, Human
aguguggcuccccucu

SEQ ID NO: 2295005 - RNA, 14 nt, Human
agugugggaaugcg

SEQ ID NO: 2295006 - RNA, 17 nt, Human
agugugggaagggagag

SEQ ID NO: 2295007 - RNA, 15 nt, Human
agugugggaagggag

SEQ ID NO: 2295008 - RNA, 19 nt, Human
agugugaguaagagcuggu

SEQ ID NO: 2295009 - RNA, 18 nt, Human
agugugaguaagagcugg

SEQ ID NO: 2295010 - RNA, 17 nt, Human
agugugaguaagagcug

SEQ ID NO: 2295011 - RNA, 16 nt, Human
agugugaguaagagcu

SEQ ID NO: 2295012 - RNA, 18 nt, Human
agugugaggccagggcag

SEQ ID NO: 2295013 - RNA, 21 nt, Human
agugugccugaagucccagau

SEQ ID NO: 2295014 - RNA, 19 nt, Human
aguguggaaauuaagaaga

SEQ ID NO: 2295015 - RNA, 17 nt, Human
aguguggaaauuaagaa

SEQ ID NO: 2295016 - RNA, 21 nt, Human
agugugcuuuaugcugaaaca

SEQ ID NO: 2295017 - RNA, 18 nt, Human
agugugcuuuaugcugaa

SEQ ID NO: 2295018 - RNA, 12 nt, Human
agugugcuuuau

SEQ ID NO: 2295019 - RNA, 12 nt, Human
agugugcuggag

SEQ ID NO: 2295020 - RNA, 13 nt, Human
agugugcuggagg

SEQ ID NO: 2295021 - RNA, 15 nt, Human
agugugcuggaggac

SEQ ID NO: 2295022 - RNA, 14 nt, Human
agugguauagaaau

SEQ ID NO: 2295023 - RNA, 16 nt, Human
agugguaagcucuggc

SEQ ID NO: 2295024 - RNA, 15 nt, Human
agugguauagaaaug

SEQ ID NO: 2295025 - RNA, 16 nt, Human
agugguauagaaaugc

SEQ ID NO: 2295026 - RNA, 18 nt, Human
agugguauagaaaugcug

SEQ ID NO: 2295027 - RNA, 22 nt, Human
aguggucaaaccgcacucaccc

SEQ ID NO: 2295028 - RNA, 19 nt, Human
agugguaagcucuggcuuu

SEQ ID NO: 2295029 - RNA, 23 nt, Human
aguggucaaaccgcacucaccca

SEQ ID NO: 2295030 - RNA, 15 nt, Human
aguggucccugcccu

SEQ ID NO: 2295031 - RNA, 16 nt, Human
aguggucccugcccuc

SEQ ID NO: 2295032 - RNA, 17 nt, Human
agugguccacaucccgg

SEQ ID NO: 2295033 - RNA, 18 nt, Human
agugguccauggaaugcu

SEQ ID NO: 2295034 - RNA, 19 nt, Human
agugguccauggaaugcuu

SEQ ID NO: 2295035 - RNA, 12 nt, Human
agugugaguaag

SEQ ID NO: 2295036 - RNA, 15 nt, Human
agugugaggccaggg

SEQ ID NO: 2295037 - RNA, 16 nt, Human
agugugagcagugagu

SEQ ID NO: 2295038 - RNA, 21 nt, Human
agugugagcagugaguuacag

SEQ ID NO: 2295039 - RNA, 20 nt, Human
agugugccugaagucccaga

SEQ ID NO: 2295040 - RNA, 12 nt, Human
agugugagaauc

SEQ ID NO: 2295041 - RNA, 14 nt, Human
agugugaccaggca

SEQ ID NO: 2295042 - RNA, 20 nt, Human
agugugacugaucucucgug

SEQ ID NO: 2295043 - RNA, 12 nt, Human
uguugccagaga

SEQ ID NO: 2295044 - RNA, 16 nt, Human
uguugccacaggacac

SEQ ID NO: 2295045 - RNA, 15 nt, Human
uguugccacaggaca

SEQ ID NO: 2295046 - RNA, 14 nt, Human
uguugccacaggac

SEQ ID NO: 2295047 - RNA, 14 nt, Human
uguugccaagcugg

SEQ ID NO: 2295048 - RNA, 22 nt, Human
uguugcccacagcuguaugauu

SEQ ID NO: 2295049 - RNA, 23 nt, Human
uguugcccaggcuggcgugcagu

SEQ ID NO: 2295050 - RNA, 20 nt, Human
uguugcccaggcuggcgugc

SEQ ID NO: 2295051 - RNA, 18 nt, Human
agugugugcaugugugug

SEQ ID NO: 2295052 - RNA, 17 nt, Human
agugugugcaugugugu

SEQ ID NO: 2295053 - RNA, 14 nt, Human
agugugugggucua

SEQ ID NO: 2295054 - RNA, 23 nt, Human
agugugugcaugugugugcucag

SEQ ID NO: 2295055 - RNA, 17 nt, Human
agugugugcaugugugc

SEQ ID NO: 2295056 - RNA, 16 nt, Human
agugugugcaugugug

SEQ ID NO: 2295057 - RNA, 14 nt, Human
agugugugcaugug

SEQ ID NO: 2295058 - RNA, 22 nt, Human
uguugccuugaaccacuucccu

SEQ ID NO: 2295059 - RNA, 20 nt, Human
agugugugcacaugugugcg

SEQ ID NO: 2295060 - RNA, 22 nt, Human
agugugugcacaugugugcgug

SEQ ID NO: 2295061 - RNA, 20 nt, Human
uguugccuugaaccacuucc

SEQ ID NO: 2295062 - RNA, 12 nt, Human
uguugcccuggg

SEQ ID NO: 2295063 - RNA, 13 nt, Human
uguugcccugagu

SEQ ID NO: 2295064 - RNA, 23 nt, Human
uguugccaaauauguccuggggu

SEQ ID NO: 2295065 - RNA, 18 nt, Human
uguugccaagcuccaagc

SEQ ID NO: 2295066 - RNA, 20 nt, Human
uguugccaagcuccaagccc

SEQ ID NO: 2295067 - RNA, 19 nt, Human
uguugccaaauauguccug

SEQ ID NO: 2295068 - RNA, 20 nt, Human
uguugcaugggcuaaugaag

SEQ ID NO: 2295069 - RNA, 20 nt, Human
uguugccaaauauguccugg

SEQ ID NO: 2295070 - RNA, 22 nt, Human
uguugccaaauauguccugggg

SEQ ID NO: 2295071 - RNA, 17 nt, Human
uguugcaugauguauuu

SEQ ID NO: 2295072 - RNA, 14 nt, Human
uguugcauggaugu

SEQ ID NO: 2295073 - RNA, 17 nt, Human
uguugcauggauguuuu

SEQ ID NO: 2295074 - RNA, 14 nt, Human
uguugcaugggcua

SEQ ID NO: 2295075 - RNA, 15 nt, Human
uguugcauagaauaa

SEQ ID NO: 2295076 - RNA, 16 nt, Human
uguugcacccagcccu

SEQ ID NO: 2295077 - RNA, 17 nt, Human
uguugcacccagcccug

SEQ ID NO: 2295078 - RNA, 18 nt, Human
uguugcacccagcccugg

SEQ ID NO: 2295079 - RNA, 19 nt, Human
uguugcacccagcccuggu

SEQ ID NO: 2295080 - RNA, 23 nt, Human
uguugcacacccacucagcuccg

SEQ ID NO: 2295081 - RNA, 14 nt, Human
uguugcacccagcc

SEQ ID NO: 2295082 - RNA, 15 nt, Human
uguugcacccagccc

SEQ ID NO: 2295083 - RNA, 15 nt, Human
uguucuaagaaguga

SEQ ID NO: 2295084 - RNA, 16 nt, Human
aguuacuagguaacuu

SEQ ID NO: 2295085 - RNA, 22 nt, Human
aguuacuagguaacuucauauu

SEQ ID NO: 2295086 - RNA, 19 nt, Human
aguuacuagguaacuucau

SEQ ID NO: 2295087 - RNA, 18 nt, Human
aguuacuagguaacuuca

SEQ ID NO: 2295088 - RNA, 17 nt, Human
aguuacuagguaacuuc

SEQ ID NO: 2295089 - RNA, 13 nt, Human
aguuacucagaau

SEQ ID NO: 2295090 - RNA, 20 nt, Human
aguguuguggauuuaacaga

SEQ ID NO: 2295091 - RNA, 19 nt, Human
aguguuguggauuuaacag

SEQ ID NO: 2295092 - RNA, 18 nt, Human
aguuacucagcccugggc

SEQ ID NO: 2295093 - RNA, 17 nt, Human
aguuacucagcccuggg

SEQ ID NO: 2295094 - RNA, 16 nt, Human
aguuacucagcccugg

SEQ ID NO: 2295095 - RNA, 15 nt, Human
aguuacucagcccug

SEQ ID NO: 2295096 - RNA, 23 nt, Human
aguuacucagcccugggccccac

SEQ ID NO: 2295097 - RNA, 19 nt, Human
aguuacucagcccugggcc

SEQ ID NO: 2295098 - RNA, 13 nt, Human
aguuagacuguug

SEQ ID NO: 2295099 - RNA, 14 nt, Human
aguuacucagcccu

SEQ ID NO: 2295100 - RNA, 13 nt, Human
aguuacucagccc

SEQ ID NO: 2295101 - RNA, 12 nt, Human
aguuacucagcc

SEQ ID NO: 2295102 - RNA, 23 nt, Human
aguuacuaucaugucaaacguga

SEQ ID NO: 2295103 - RNA, 12 nt, Human
aguuagagcuga

SEQ ID NO: 2295104 - RNA, 19 nt, Human
aguuagaggccagccuggc

SEQ ID NO: 2295105 - RNA, 15 nt, Human
aguuagcaaacuuug

SEQ ID NO: 2295106 - RNA, 16 nt, Human
aguuagcaaacuuugu

SEQ ID NO: 2295107 - RNA, 22 nt, Human
aguuagcaaacuuuguauguca

SEQ ID NO: 2295108 - RNA, 16 nt, Human
aguuagcucaggaggc

SEQ ID NO: 2295109 - RNA, 14 nt, Human
aguuagcucaggag

SEQ ID NO: 2295110 - RNA, 11 nt, Human
aguuagcacca

SEQ ID NO: 2295111 - RNA, 18 nt, Human
aguguucccuuuccuacu

SEQ ID NO: 2295112 - RNA, 16 nt, Human
aguguuccuauuuggg

SEQ ID NO: 2295113 - RNA, 17 nt, Human
aguguucugcaaaaaua

SEQ ID NO: 2295114 - RNA, 20 nt, Human
aguguuccuauuuggggcuu

SEQ ID NO: 2295115 - RNA, 15 nt, Human
aguguucuguuuaau

SEQ ID NO: 2295116 - RNA, 16 nt, Human
aguguugaaaauguuc

SEQ ID NO: 2295117 - RNA, 16 nt, Human
aguguuguggauuuaa

SEQ ID NO: 2295118 - RNA, 12 nt, Human
agugugugugcg

SEQ ID NO: 2295119 - RNA, 16 nt, Human
aguguuccccuuccac

SEQ ID NO: 2295120 - RNA, 21 nt, Human
aguguuccgugguuaaacucg

SEQ ID NO: 2295121 - RNA, 21 nt, Human
aguguuccccuuccacugagg

SEQ ID NO: 2295122 - RNA, 18 nt, Human
aguguguguuuuucauaa

SEQ ID NO: 2295123 - RNA, 21 nt, Human
aguguucauaaauaaaguuug

SEQ ID NO: 2295124 - RNA, 12 nt, Human
ugugucugcagg

SEQ ID NO: 2295125 - RNA, 14 nt, Human
ugugucucuuuucu

SEQ ID NO: 2295126 - RNA, 21 nt, Human
ugugucuaaacugcauuaccg

SEQ ID NO: 2295127 - RNA, 22 nt, Human
ugugucucuugguccugcugca

SEQ ID NO: 2295128 - RNA, 19 nt, Human
ugugucuaaauuugaaugu

SEQ ID NO: 2295129 - RNA, 22 nt, Human
ugugucuaaauuugaauguuaa

SEQ ID NO: 2295130 - RNA, 19 nt, Human
ugugucugcgucuguguug

SEQ ID NO: 2295131 - RNA, 16 nt, Human
ugugucucuuuucucu

SEQ ID NO: 2295132 - RNA, 13 nt, Human
ugugucuguacac

SEQ ID NO: 2295133 - RNA, 14 nt, Human
ugugucugcucagu

SEQ ID NO: 2295134 - RNA, 14 nt, Human
ugugucuguacacg

SEQ ID NO: 2295135 - RNA, 21 nt, Human
ugugucuguacacguguccug

SEQ ID NO: 2295136 - RNA, 14 nt, Human
ugugucuuaauuau

SEQ ID NO: 2295137 - RNA, 16 nt, Human
ugugucuuaauuauua

SEQ ID NO: 2295138 - RNA, 18 nt, Human
uguguguugucuugaaag

SEQ ID NO: 2295139 - RNA, 18 nt, Human
uguguguugucucuugag

SEQ ID NO: 2295140 - RNA, 18 nt, Human
uguguguuguguguggga

SEQ ID NO: 2295141 - RNA, 11 nt, Human
uguguguuuau

SEQ ID NO: 2295142 - RNA, 22 nt, Human
uguguguugaucccaagacaau

SEQ ID NO: 2295143 - RNA, 17 nt, Human
uguguguugccacagga

SEQ ID NO: 2295144 - RNA, 16 nt, Human
uguguguugccacagg

SEQ ID NO: 2295145 - RNA, 20 nt, Human
uguguguugccacaggacac

SEQ ID NO: 2295146 - RNA, 19 nt, Human
uguguguugccacaggaca

SEQ ID NO: 2295147 - RNA, 20 nt, Human
ugugucuugcaauggcagcc

SEQ ID NO: 2295148 - RNA, 17 nt, Human
uguguccaugugugugc

SEQ ID NO: 2295149 - RNA, 16 nt, Human
uguguccaugugugug

SEQ ID NO: 2295150 - RNA, 14 nt, Human
uguguccaugugug

SEQ ID NO: 2295151 - RNA, 18 nt, Human
uguguccaugugugugca

SEQ ID NO: 2295152 - RNA, 19 nt, Human
ugugucccaugaucccugu

SEQ ID NO: 2295153 - RNA, 20 nt, Human
ugugucccaugaucccugug

SEQ ID NO: 2295154 - RNA, 14 nt, Human
ugugucccaugacc

SEQ ID NO: 2295155 - RNA, 19 nt, Human
ugugucccaugacccaccc

SEQ ID NO: 2295156 - RNA, 21 nt, Human
ugugucccaugacccaccccu

SEQ ID NO: 2295157 - RNA, 22 nt, Human
ugugucccaugacccaccccug

SEQ ID NO: 2295158 - RNA, 19 nt, Human
uguguccaagugugugugc

SEQ ID NO: 2295159 - RNA, 16 nt, Human
uguguccaaaacugcc

SEQ ID NO: 2295160 - RNA, 19 nt, Human
uguguccacgacugucucc

SEQ ID NO: 2295161 - RNA, 20 nt, Human
uguguccaugcgcucagggc

SEQ ID NO: 2295162 - RNA, 18 nt, Human
uguguccacgacugucuc

SEQ ID NO: 2295163 - RNA, 17 nt, Human
uguguccacgacugucu

SEQ ID NO: 2295164 - RNA, 20 nt, Human
uguguccuugcaccugcauc

SEQ ID NO: 2295165 - RNA, 16 nt, Human
uguguccuugugcaug

SEQ ID NO: 2295166 - RNA, 19 nt, Human
uguguccuugcaccugcau

SEQ ID NO: 2295167 - RNA, 18 nt, Human
uguguccuugcaccugca

SEQ ID NO: 2295168 - RNA, 12 nt, Human
ugugucuaaacu

SEQ ID NO: 2295169 - RNA, 13 nt, Human
ugugucuaaacug

SEQ ID NO: 2295170 - RNA, 15 nt, Human
ugugucuaaacugca

SEQ ID NO: 2295171 - RNA, 17 nt, Human
ugugucuaaacugcauu

SEQ ID NO: 2295172 - RNA, 14 nt, Human
uguguccuugcacc

SEQ ID NO: 2295173 - RNA, 17 nt, Human
uguguccuucccugcau

SEQ ID NO: 2295174 - RNA, 14 nt, Human
uguguccuucccug

SEQ ID NO: 2295175 - RNA, 16 nt, Human
uguguccuucccugca

SEQ ID NO: 2295176 - RNA, 14 nt, Human
uguguccugguucc

SEQ ID NO: 2295177 - RNA, 20 nt, Human
uguguccuggugcucucugc

SEQ ID NO: 2295178 - RNA, 22 nt, Human
uguguccuggugcucucugcca

SEQ ID NO: 2295179 - RNA, 21 nt, Human
ugugucccccucuguccaggc

SEQ ID NO: 2295180 - RNA, 18 nt, Human
ugugucccccucugucca

SEQ ID NO: 2295181 - RNA, 16 nt, Human
ugugucccccucuguc

SEQ ID NO: 2295182 - RNA, 15 nt, Human
uguguccuggugcuc

SEQ ID NO: 2295183 - RNA, 19 nt, Human
uguguccuggugcucucug

SEQ ID NO: 2295184 - RNA, 22 nt, Human
ugugguagggacuuaaaaaacu

SEQ ID NO: 2295185 - RNA, 18 nt, Human
ugugguagggggugucuc

SEQ ID NO: 2295186 - RNA, 21 nt, Human
ugugguacaagcauucugucu

SEQ ID NO: 2295187 - RNA, 16 nt, Human
ugugguacaaucucaa

SEQ ID NO: 2295188 - RNA, 14 nt, Human
agugcccaacuguu

SEQ ID NO: 2295189 - RNA, 20 nt, Human
agugccagucuugugucugc

SEQ ID NO: 2295190 - RNA, 18 nt, Human
agugcccccacugaccag

SEQ ID NO: 2295191 - RNA, 19 nt, Human
agugccccugcugccuccc

SEQ ID NO: 2295192 - RNA, 14 nt, Human
agugccccugcugc

SEQ ID NO: 2295193 - RNA, 13 nt, Human
agugccccugcug

SEQ ID NO: 2295194 - RNA, 12 nt, Human
agugccccugcu

SEQ ID NO: 2295195 - RNA, 11 nt, Human
agugccccugc

SEQ ID NO: 2295196 - RNA, 21 nt, Human
agugcccuccacagccgcagc

SEQ ID NO: 2295197 - RNA, 17 nt, Human
agugcccuccacagccg

SEQ ID NO: 2295198 - RNA, 16 nt, Human
agugcccuccacagcc

SEQ ID NO: 2295199 - RNA, 21 nt, Human
agugccccugcugccucccca

SEQ ID NO: 2295200 - RNA, 20 nt, Human
agugccccugcugccucccc

SEQ ID NO: 2295201 - RNA, 22 nt, Human
agugccccugcugccuccccaa

SEQ ID NO: 2295202 - RNA, 16 nt, Human
agugcccuccaggaua

SEQ ID NO: 2295203 - RNA, 23 nt, Human
ugugguuuuccccucccuggguu

SEQ ID NO: 2295204 - RNA, 16 nt, Human
ugugguuuuccccucc

SEQ ID NO: 2295205 - RNA, 18 nt, Human
ugugguuuuccccucccu

SEQ ID NO: 2295206 - RNA, 21 nt, Human
ugugguuuuccccucccuggg

SEQ ID NO: 2295207 - RNA, 22 nt, Human
ugugguuuuccccucccugggu

SEQ ID NO: 2295208 - RNA, 15 nt, Human
uguguaaaaagagag

SEQ ID NO: 2295209 - RNA, 14 nt, Human
uguguaaaauguga

SEQ ID NO: 2295210 - RNA, 23 nt, Human
uguggucacagcggaggugugga

SEQ ID NO: 2295211 - RNA, 21 nt, Human
uguguaaaguguaaauccuuu

SEQ ID NO: 2295212 - RNA, 21 nt, Human
uguguaacaauuuuaaugcua

SEQ ID NO: 2295213 - RNA, 14 nt, Human
uguguaaaguuagu

SEQ ID NO: 2295214 - RNA, 17 nt, Human
uguguaaaguuagucua

SEQ ID NO: 2295215 - RNA, 20 nt, Human
ugugucagguggggcagcuu

SEQ ID NO: 2295216 - RNA, 12 nt, Human
uguguaacacag

SEQ ID NO: 2295217 - RNA, 17 nt, Human
aguggcaauauagaaac

SEQ ID NO: 2295218 - RNA, 20 nt, Human
aguggcacgucaucuaguuu

SEQ ID NO: 2295219 - RNA, 20 nt, Human
aguggaugauguuucgugaa

SEQ ID NO: 2295220 - RNA, 15 nt, Human
aguggaugauguuuc

SEQ ID NO: 2295221 - RNA, 13 nt, Human
aguggaugauguu

SEQ ID NO: 2295222 - RNA, 14 nt, Human
aguggauugcauuu

SEQ ID NO: 2295223 - RNA, 17 nt, Human
aguggauggaaggggcu

SEQ ID NO: 2295224 - RNA, 21 nt, Human
uguuacaggcaccgagaaugu

SEQ ID NO: 2295225 - RNA, 23 nt, Human
uguuacaggcaccgagaauguug

SEQ ID NO: 2295226 - RNA, 23 nt, Human
aguggaccuuaggccuuccucuc

SEQ ID NO: 2295227 - RNA, 20 nt, Human
aguggaccuuaggccuuccu

SEQ ID NO: 2295228 - RNA, 19 nt, Human
aguggaccuuaggccuucc

SEQ ID NO: 2295229 - RNA, 17 nt, Human
aguggaccuuaggccuu

SEQ ID NO: 2295230 - RNA, 18 nt, Human
aguggaccuugagaccac

SEQ ID NO: 2295231 - RNA, 13 nt, Human
aguggacucaggg

SEQ ID NO: 2295232 - RNA, 19 nt, Human
aguggaccuugagaccaca

SEQ ID NO: 2295233 - RNA, 18 nt, Human
aguggacucuuugguggc

SEQ ID NO: 2295234 - RNA, 16 nt, Human
aguggacucagggcag

SEQ ID NO: 2295235 - RNA, 19 nt, Human
aguggacuggaguggagca

SEQ ID NO: 2295236 - RNA, 15 nt, Human
aguggacuggccccu

SEQ ID NO: 2295237 - RNA, 16 nt, Human
aguggacuggccccug

SEQ ID NO: 2295238 - RNA, 21 nt, Human
aguggacuguucccugaggug

SEQ ID NO: 2295239 - RNA, 17 nt, Human
aguggacuggccccugg

SEQ ID NO: 2295240 - RNA, 18 nt, Human
aguggacuggccccuggg

SEQ ID NO: 2295241 - RNA, 23 nt, Human
aguggggucucccucuccugccu

SEQ ID NO: 2295242 - RNA, 22 nt, Human
aguggggucucccucuccugcc

SEQ ID NO: 2295243 - RNA, 14 nt, Human
aguggggugcuggg

SEQ ID NO: 2295244 - RNA, 16 nt, Human
aguggggugcugggag

SEQ ID NO: 2295245 - RNA, 20 nt, Human
aguggggucucccucuccug

SEQ ID NO: 2295246 - RNA, 19 nt, Human
aguggggucucccucuccu

SEQ ID NO: 2295247 - RNA, 18 nt, Human
aguggggucucccucucc

SEQ ID NO: 2295248 - RNA, 19 nt, Human
agugggguuaucucugugu

SEQ ID NO: 2295249 - RNA, 18 nt, Human
agugggguuaucucugug

SEQ ID NO: 2295250 - RNA, 18 nt, Human
aguggggugcugggagga

SEQ ID NO: 2295251 - RNA, 21 nt, Human
aguggggugcugggaggaggg

SEQ ID NO: 2295252 - RNA, 16 nt, Human
agugggguagguuggg

SEQ ID NO: 2295253 - RNA, 15 nt, Human
aguggggacagagca

SEQ ID NO: 2295254 - RNA, 14 nt, Human
aguggggaggggcu

SEQ ID NO: 2295255 - RNA, 22 nt, Human
agugggcuugauucugcaguaa

SEQ ID NO: 2295256 - RNA, 16 nt, Human
agugggcuugauucug

SEQ ID NO: 2295257 - RNA, 22 nt, Human
agugggcccaaugcacuuuguu

SEQ ID NO: 2295258 - RNA, 19 nt, Human
agugggcccuccgacagcc

SEQ ID NO: 2295259 - RNA, 17 nt, Human
agugggcugcaucuggg

SEQ ID NO: 2295260 - RNA, 13 nt, Human
uguuaauaaaagu

SEQ ID NO: 2295261 - RNA, 18 nt, Human
uguuaauaaaaguacaug

SEQ ID NO: 2295262 - RNA, 22 nt, Human
uguuaaguugauggugaugaaa

SEQ ID NO: 2295263 - RNA, 20 nt, Human
uguuaagcgugucuguauuu

SEQ ID NO: 2295264 - RNA, 19 nt, Human
uguuaauaaaaguacaugu

SEQ ID NO: 2295265 - RNA, 18 nt, Human
uguuaauacuaguuguga

SEQ ID NO: 2295266 - RNA, 19 nt, Human
uguuacauaagauaaaugu

SEQ ID NO: 2295267 - RNA, 17 nt, Human
uguuacaaauuguagaa

SEQ ID NO: 2295268 - RNA, 18 nt, Human
uguuacaaauuguagaag

SEQ ID NO: 2295269 - RNA, 14 nt, Human
uguuaacuuagcuu

SEQ ID NO: 2295270 - RNA, 22 nt, Human
uguuaacuuaauaguauuuaug

SEQ ID NO: 2295271 - RNA, 23 nt, Human
uguuaagcagauggaaugcugug

SEQ ID NO: 2295272 - RNA, 22 nt, Human
uguuaacugagugccuuuuggu

SEQ ID NO: 2295273 - RNA, 16 nt, Human
uguuaacugagugccu

SEQ ID NO: 2295274 - RNA, 14 nt, Human
uguguuaguuccca

SEQ ID NO: 2295275 - RNA, 17 nt, Human
uguguuaguucccaaca

SEQ ID NO: 2295276 - RNA, 22 nt, Human
uguguguuuaaauaaaguauca

SEQ ID NO: 2295277 - RNA, 23 nt, Human
uguguuaccugaaaacacugugc

SEQ ID NO: 2295278 - RNA, 19 nt, Human
uguguuacccuccuguaaa

SEQ ID NO: 2295279 - RNA, 22 nt, Human
uguguuaaguauguguaaaaug

SEQ ID NO: 2295280 - RNA, 15 nt, Human
uguguguuuaaauaa

SEQ ID NO: 2295281 - RNA, 16 nt, Human
uguguguuuaaauaaa

SEQ ID NO: 2295282 - RNA, 18 nt, Human
uguguguuuaaauaaagu

SEQ ID NO: 2295283 - RNA, 19 nt, Human
uguguguuuaaauaaagua

SEQ ID NO: 2295284 - RNA, 22 nt, Human
uguguuaucacccagaagaaaa

SEQ ID NO: 2295285 - RNA, 23 nt, Human
agucacuggagguugaagccaag

SEQ ID NO: 2295286 - RNA, 10 nt, Human
agucacuguc

SEQ ID NO: 2295287 - RNA, 16 nt, Human
agucacuuauuucaua

SEQ ID NO: 2295288 - RNA, 21 nt, Human
agucacuggagguugaagcca

SEQ ID NO: 2295289 - RNA, 16 nt, Human
agucacugccugcaga

SEQ ID NO: 2295290 - RNA, 22 nt, Human
agucacuggagguugaagccaa

SEQ ID NO: 2295291 - RNA, 21 nt, Human
ugucggccucuaaccccaggc

SEQ ID NO: 2295292 - RNA, 22 nt, Human
ugucggccucuaaccccaggcc

SEQ ID NO: 2295293 - RNA, 21 nt, Human
agucacugccucucccuggcc

SEQ ID NO: 2295294 - RNA, 14 nt, Human
agucacugccugca

SEQ ID NO: 2295295 - RNA, 14 nt, Human
agucagcagaacug

SEQ ID NO: 2295296 - RNA, 17 nt, Human
agucacuuuuuuuuucc

SEQ ID NO: 2295297 - RNA, 19 nt, Human
agucacuuuuuuuuuccaa

SEQ ID NO: 2295298 - RNA, 24 nt, Human
agucacuucgugggaucugccccu

SEQ ID NO: 2295299 - RNA, 20 nt, Human
agucacuugaugugccauuu

SEQ ID NO: 2295300 - RNA, 21 nt, Human
agucacuugaugugccauuuu

SEQ ID NO: 2295301 - RNA, 23 nt, Human
agucacuugaugugccauuuuaa

SEQ ID NO: 2295302 - RNA, 22 nt, Human
agucagugggaacgugacugcc

SEQ ID NO: 2295303 - RNA, 22 nt, Human
agucagcuuugccuuccacgcu

SEQ ID NO: 2295304 - RNA, 19 nt, Human
agucagcuuugccuuccac

SEQ ID NO: 2295305 - RNA, 14 nt, Human
agucaggaaagaga

SEQ ID NO: 2295306 - RNA, 23 nt, Human
agucagccuucccccucccaggg

SEQ ID NO: 2295307 - RNA, 22 nt, Human
agucagccuucccccucccagg

SEQ ID NO: 2295308 - RNA, 21 nt, Human
agucagccucucucccagucu

SEQ ID NO: 2295309 - RNA, 11 nt, Human
agucagccucu

SEQ ID NO: 2295310 - RNA, 15 nt, Human
agucagccucucucc

SEQ ID NO: 2295311 - RNA, 16 nt, Human
agucagccucucuccc

SEQ ID NO: 2295312 - RNA, 17 nt, Human
agucagccucucuccca

SEQ ID NO: 2295313 - RNA, 18 nt, Human
agucagccucucucccag

SEQ ID NO: 2295314 - RNA, 21 nt, Human
ugucccugucaccaagcucac

SEQ ID NO: 2295315 - RNA, 16 nt, Human
ugucccugucaccaag

SEQ ID NO: 2295316 - RNA, 18 nt, Human
uguccacacccagcucag

SEQ ID NO: 2295317 - RNA, 14 nt, Human
ugucccugugccua

SEQ ID NO: 2295318 - RNA, 13 nt, Human
ugucccugucacc

SEQ ID NO: 2295319 - RNA, 12 nt, Human
ugucccuacacc

SEQ ID NO: 2295320 - RNA, 19 nt, Human
ugucccuuacgugaguccu

SEQ ID NO: 2295321 - RNA, 23 nt, Human
ugucccuuacgugaguccuggca

SEQ ID NO: 2295322 - RNA, 14 nt, Human
ugucgccucugcau

SEQ ID NO: 2295323 - RNA, 13 nt, Human
ugucgccucugca

SEQ ID NO: 2295324 - RNA, 16 nt, Human
ugucccuuaaacaaaa

SEQ ID NO: 2295325 - RNA, 14 nt, Human
ugucgcucaugugu

SEQ ID NO: 2295326 - RNA, 15 nt, Human
ugucgcucaugugug

SEQ ID NO: 2295327 - RNA, 17 nt, Human
ugucccuucacauaguu

SEQ ID NO: 2295328 - RNA, 14 nt, Human
ugucgcgccuucuc

SEQ ID NO: 2295329 - RNA, 20 nt, Human
ugucgcgccuucuccccccc

SEQ ID NO: 2295330 - RNA, 14 nt, Human
ugucgcgcucagca

SEQ ID NO: 2295331 - RNA, 16 nt, Human
ugucgcucaugugugc

SEQ ID NO: 2295332 - RNA, 22 nt, Human
ugucgcucaugugugcaacagg

SEQ ID NO: 2295333 - RNA, 17 nt, Human
ugucgcucugcuggccu

SEQ ID NO: 2295334 - RNA, 19 nt, Human
ugucgcucugcuggccugg

SEQ ID NO: 2295335 - RNA, 12 nt, Human
ugucggccucua

SEQ ID NO: 2295336 - RNA, 14 nt, Human
ugucggccucuaac

SEQ ID NO: 2295337 - RNA, 13 nt, Human
agucauaaaccuu

SEQ ID NO: 2295338 - RNA, 14 nt, Human
agucauaaaccuua

SEQ ID NO: 2295339 - RNA, 16 nt, Human
agucaguugaaauucu

SEQ ID NO: 2295340 - RNA, 14 nt, Human
agucaguuugcagu

SEQ ID NO: 2295341 - RNA, 14 nt, Human
agucauaccaauga

SEQ ID NO: 2295342 - RNA, 21 nt, Human
agucauaaucauuagggggaa

SEQ ID NO: 2295343 - RNA, 20 nt, Human
agucauaaaccuuaaguaag

SEQ ID NO: 2295344 - RNA, 15 nt, Human
agucauaaaccuuaa

SEQ ID NO: 2295345 - RNA, 18 nt, Human
agucauaaaccuuaagua

SEQ ID NO: 2295346 - RNA, 18 nt, Human
agucauauaaaagcuaug

SEQ ID NO: 2295347 - RNA, 15 nt, Human
agucauauuuugauu

SEQ ID NO: 2295348 - RNA, 21 nt, Human
agucauauuuugauuauugua

SEQ ID NO: 2295349 - RNA, 23 nt, Human
agucauaccaaugaaaaaaugua

SEQ ID NO: 2295350 - RNA, 17 nt, Human
agucauaccaaugaaaa

SEQ ID NO: 2295351 - RNA, 16 nt, Human
agucauagguuaauau

SEQ ID NO: 2295352 - RNA, 22 nt, Human
agucauagguuaauauuuaaga

SEQ ID NO: 2295353 - RNA, 17 nt, Human
agucccaaggaaagccc

SEQ ID NO: 2295354 - RNA, 14 nt, Human
agucccaaggaaag

SEQ ID NO: 2295355 - RNA, 16 nt, Human
aguccauucucccagg

SEQ ID NO: 2295356 - RNA, 17 nt, Human
aguccauucucccaggu

SEQ ID NO: 2295357 - RNA, 20 nt, Human
agucauauuuugauuauugu

SEQ ID NO: 2295358 - RNA, 14 nt, Human
aguccauucuccca

SEQ ID NO: 2295359 - RNA, 15 nt, Human
aguccauucucccag

SEQ ID NO: 2295360 - RNA, 19 nt, Human
aguccauucucccagguac

SEQ ID NO: 2295361 - RNA, 15 nt, Human
agucccaccuuggcu

SEQ ID NO: 2295362 - RNA, 16 nt, Human
agucccaccuuggcug

SEQ ID NO: 2295363 - RNA, 18 nt, Human
agucccaccuuggcugca

SEQ ID NO: 2295364 - RNA, 19 nt, Human
agucccaccuuggcugcag

SEQ ID NO: 2295365 - RNA, 21 nt, Human
agucccaaggaaagccccagc

SEQ ID NO: 2295366 - RNA, 20 nt, Human
agucccaaggaaagccccag

SEQ ID NO: 2295367 - RNA, 23 nt, Human
agucccacugccucagguuccua

SEQ ID NO: 2295368 - RNA, 12 nt, Human
agucccagagca

SEQ ID NO: 2295369 - RNA, 23 nt, Human
agucccagagcaggaggccccug

SEQ ID NO: 2295370 - RNA, 22 nt, Human
agucccagcuacucagaagccu

SEQ ID NO: 2295371 - RNA, 19 nt, Human
agucccagcuacucaggag

SEQ ID NO: 2295372 - RNA, 18 nt, Human
agucccagcuacucagga

SEQ ID NO: 2295373 - RNA, 18 nt, Human
agucccaggcugagccuc

SEQ ID NO: 2295374 - RNA, 17 nt, Human
agucccaggcugagccu

SEQ ID NO: 2295375 - RNA, 15 nt, Human
agucccccaacccca

SEQ ID NO: 2295376 - RNA, 22 nt, Human
agucccccaacagaugcuuuuc

SEQ ID NO: 2295377 - RNA, 18 nt, Human
agucccccaaccccagcc

SEQ ID NO: 2295378 - RNA, 19 nt, Human
agucccaggcugagccuca

SEQ ID NO: 2295379 - RNA, 21 nt, Human
aguccccaggccccaggaagc

SEQ ID NO: 2295380 - RNA, 18 nt, Human
ugucccuucacauaguuu

SEQ ID NO: 2295381 - RNA, 20 nt, Human
agucccaggagcugcccaga

SEQ ID NO: 2295382 - RNA, 23 nt, Human
ugucucauccccaggggucccag

SEQ ID NO: 2295383 - RNA, 13 nt, Human
ugucucaugugug

SEQ ID NO: 2295384 - RNA, 20 nt, Human
ugucucaugugugcucuucu

SEQ ID NO: 2295385 - RNA, 16 nt, Human
ugucucauccccaggg

SEQ ID NO: 2295386 - RNA, 13 nt, Human
ugucucaucccca

SEQ ID NO: 2295387 - RNA, 21 nt, Human
ugucucauccaucaucaugug

SEQ ID NO: 2295388 - RNA, 11 nt, Human
ugucucauccc

SEQ ID NO: 2295389 - RNA, 12 nt, Human
ugucucauccca

SEQ ID NO: 2295390 - RNA, 11 nt, Human
ugucuccaacc

SEQ ID NO: 2295391 - RNA, 16 nt, Human
ugucuccaacccccca

SEQ ID NO: 2295392 - RNA, 17 nt, Human
ugucuccaaccccccag

SEQ ID NO: 2295393 - RNA, 19 nt, Human
ugucuccaaccccccagca

SEQ ID NO: 2295394 - RNA, 20 nt, Human
ugucuccaaccccccagcac

SEQ ID NO: 2295395 - RNA, 21 nt, Human
ugucuccaaccccccagcacu

SEQ ID NO: 2295396 - RNA, 22 nt, Human
ugucuccaaccccccagcacug

SEQ ID NO: 2295397 - RNA, 23 nt, Human
ugucuccaaccccccagcacuga

SEQ ID NO: 2295398 - RNA, 19 nt, Human
agucucacuuugucgccca

SEQ ID NO: 2295399 - RNA, 13 nt, Human
agucucaggaaau

SEQ ID NO: 2295400 - RNA, 17 nt, Human
ugucucauccaucauca

SEQ ID NO: 2295401 - RNA, 16 nt, Human
ugucucauccaucauc

SEQ ID NO: 2295402 - RNA, 11 nt, Human
ugucucaucca

SEQ ID NO: 2295403 - RNA, 16 nt, Human
agucucaggaaaucaa

SEQ ID NO: 2295404 - RNA, 23 nt, Human
agucucacuguugcccaggcugg

SEQ ID NO: 2295405 - RNA, 14 nt, Human
agucuauuagccac

SEQ ID NO: 2295406 - RNA, 14 nt, Human
agucuauucauuau

SEQ ID NO: 2295407 - RNA, 17 nt, Human
agucuauucauuauauu

SEQ ID NO: 2295408 - RNA, 16 nt, Human
agucuauccacagaga

SEQ ID NO: 2295409 - RNA, 15 nt, Human
agucuauccacagag

SEQ ID NO: 2295410 - RNA, 18 nt, Human
agucuauaugaaaaacaa

SEQ ID NO: 2295411 - RNA, 14 nt, Human
agucuauccacaga

SEQ ID NO: 2295412 - RNA, 18 nt, Human
agucuaucaaucaacuua

SEQ ID NO: 2295413 - RNA, 20 nt, Human
agucuaggagcugggaggaa

SEQ ID NO: 2295414 - RNA, 22 nt, Human
agucuaggagcugggaggaaaa

SEQ ID NO: 2295415 - RNA, 18 nt, Human
agucuaggagcugggagg

SEQ ID NO: 2295416 - RNA, 17 nt, Human
agucuacgcucuccuuu

SEQ ID NO: 2295417 - RNA, 15 nt, Human
agucuacgcucuccu

SEQ ID NO: 2295418 - RNA, 14 nt, Human
agucuacgcucucc

SEQ ID NO: 2295419 - RNA, 13 nt, Human
agucuacccagag

SEQ ID NO: 2295420 - RNA, 14 nt, Human
agucuacccagaga

SEQ ID NO: 2295421 - RNA, 13 nt, Human
agucuaauuuuua

SEQ ID NO: 2295422 - RNA, 14 nt, Human
agucuacagaguga

SEQ ID NO: 2295423 - RNA, 17 nt, Human
agucuaauuuuuauuca

SEQ ID NO: 2295424 - RNA, 20 nt, Human
agucuaauuuuuauucauaa

SEQ ID NO: 2295425 - RNA, 16 nt, Human
agucuaaauauuuccu

SEQ ID NO: 2295426 - RNA, 23 nt, Human
agucuaaaguuuacaguaaauaa

SEQ ID NO: 2295427 - RNA, 18 nt, Human
agucuaaaguuuacagua

SEQ ID NO: 2295428 - RNA, 20 nt, Human
agucuaaaguuuacaguaaa

SEQ ID NO: 2295429 - RNA, 23 nt, Human
agucuaaauauuuccuuaaacug

SEQ ID NO: 2295430 - RNA, 17 nt, Human
agucuaaauauuuccuu

SEQ ID NO: 2295431 - RNA, 18 nt, Human
aguccucacucccagucc

SEQ ID NO: 2295432 - RNA, 17 nt, Human
aguccucacucccaguc

SEQ ID NO: 2295433 - RNA, 16 nt, Human
aguccucacucccagu

SEQ ID NO: 2295434 - RNA, 15 nt, Human
aguccucacucccag

SEQ ID NO: 2295435 - RNA, 18 nt, Human
aguccucauaaaaagcaa

SEQ ID NO: 2295436 - RNA, 17 nt, Human
aguccucauaaaaagca

SEQ ID NO: 2295437 - RNA, 20 nt, Human
aguccucaaggggccauccu

SEQ ID NO: 2295438 - RNA, 16 nt, Human
aguccuauucuauugc

SEQ ID NO: 2295439 - RNA, 21 nt, Human
aguccuagcugcacagggcag

SEQ ID NO: 2295440 - RNA, 22 nt, Human
aguccuagcugcacagggcagc

SEQ ID NO: 2295441 - RNA, 17 nt, Human
aguccuagccacucagg

SEQ ID NO: 2295442 - RNA, 12 nt, Human
aguccuagcugc

SEQ ID NO: 2295443 - RNA, 13 nt, Human
aguccuagcugca

SEQ ID NO: 2295444 - RNA, 14 nt, Human
aguccuagcugcac

SEQ ID NO: 2295445 - RNA, 15 nt, Human
aguccuagcugcaca

SEQ ID NO: 2295446 - RNA, 16 nt, Human
aguccuagcugcacag

SEQ ID NO: 2295447 - RNA, 20 nt, Human
aguccuagcugcacagggca

SEQ ID NO: 2295448 - RNA, 19 nt, Human
aguccccuccccggcccua

SEQ ID NO: 2295449 - RNA, 20 nt, Human
aguccuacaagcuaaaauua

SEQ ID NO: 2295450 - RNA, 21 nt, Human
aguccccucccaucugggagu

SEQ ID NO: 2295451 - RNA, 18 nt, Human
aguccccuccccggcccu

SEQ ID NO: 2295452 - RNA, 21 nt, Human
aguccccuccccggcccuacc

SEQ ID NO: 2295453 - RNA, 16 nt, Human
agucccccugccccag

SEQ ID NO: 2295454 - RNA, 19 nt, Human
aguccccgaguuuccccag

SEQ ID NO: 2295455 - RNA, 15 nt, Human
aguccccgugccccg

SEQ ID NO: 2295456 - RNA, 18 nt, Human
aguccccgugccccgccu

SEQ ID NO: 2295457 - RNA, 16 nt, Human
aguccccucaccuccu

SEQ ID NO: 2295458 - RNA, 23 nt, Human
aguccccgugccccgccuccccg

SEQ ID NO: 2295459 - RNA, 20 nt, Human
aguccccgugccccgccucc

SEQ ID NO: 2295460 - RNA, 13 nt, Human
aguccccucccau

SEQ ID NO: 2295461 - RNA, 16 nt, Human
aguccccucccaucug

SEQ ID NO: 2295462 - RNA, 18 nt, Human
aguccccucccaucuggg

SEQ ID NO: 2295463 - RNA, 19 nt, Human
agucgcaucucagugcagg

SEQ ID NO: 2295464 - RNA, 13 nt, Human
agucgcgcugccu

SEQ ID NO: 2295465 - RNA, 14 nt, Human
agucgcgcugccug

SEQ ID NO: 2295466 - RNA, 17 nt, Human
agucgcgcugccugugu

SEQ ID NO: 2295467 - RNA, 12 nt, Human
aguccuccccuc

SEQ ID NO: 2295468 - RNA, 13 nt, Human
aguccuccccuca

SEQ ID NO: 2295469 - RNA, 14 nt, Human
aguccuccccucac

SEQ ID NO: 2295470 - RNA, 15 nt, Human
aguccuccccucaca

SEQ ID NO: 2295471 - RNA, 16 nt, Human
aguccuccccucacag

SEQ ID NO: 2295472 - RNA, 18 nt, Human
aguccuccccucacagcc

SEQ ID NO: 2295473 - RNA, 19 nt, Human
aguccuccccucacagccu

SEQ ID NO: 2295474 - RNA, 14 nt, Human
aguccucccaucuc

SEQ ID NO: 2295475 - RNA, 16 nt, Human
aguccucccaucucac

SEQ ID NO: 2295476 - RNA, 16 nt, Human
agucgcugaggaaaaa

SEQ ID NO: 2295477 - RNA, 15 nt, Human
agucgcugaggaaaa

SEQ ID NO: 2295478 - RNA, 13 nt, Human
agucgcugaggaa

SEQ ID NO: 2295479 - RNA, 18 nt, Human
agucgcgcugccugugug

SEQ ID NO: 2295480 - RNA, 19 nt, Human
agucgcugugguuguuuua

SEQ ID NO: 2295481 - RNA, 20 nt, Human
agucggaacggagaaaggug

SEQ ID NO: 2295482 - RNA, 15 nt, Human
agucgggggcuggcc

SEQ ID NO: 2295483 - RNA, 16 nt, Human
agucgggggcuggccu

SEQ ID NO: 2295484 - RNA, 17 nt, Human
agucgggggcuggccua

SEQ ID NO: 2295485 - RNA, 20 nt, Human
agucgggggcuggccuagga

SEQ ID NO: 2295486 - RNA, 21 nt, Human
agucgggggcuggccuaggag

SEQ ID NO: 2295487 - RNA, 13 nt, Human
agucuaaaguuua

SEQ ID NO: 2295488 - RNA, 14 nt, Human
agucuaaaguuuac

SEQ ID NO: 2295489 - RNA, 17 nt, Human
agucuaaaguuuacagu

SEQ ID NO: 2295490 - RNA, 12 nt, Human
agucuaaaguuu

SEQ ID NO: 2295491 - RNA, 18 nt, Human
agucguacagaaagcugc

SEQ ID NO: 2295492 - RNA, 22 nt, Human
agucgucaucacuuuucaguga

SEQ ID NO: 2295493 - RNA, 16 nt, Human
agucgucgcacagucu

SEQ ID NO: 2295494 - RNA, 22 nt, Human
aguauuccauugugugagugua

SEQ ID NO: 2295495 - RNA, 20 nt, Human
aguauuccauugugugagug

SEQ ID NO: 2295496 - RNA, 19 nt, Human
aguauuccauugugugagu

SEQ ID NO: 2295497 - RNA, 20 nt, Human
aguauuccagaccugaagaa

SEQ ID NO: 2295498 - RNA, 18 nt, Human
aguauuauuuuccaaaag

SEQ ID NO: 2295499 - RNA, 15 nt, Human
aguauuauuuuccaa

SEQ ID NO: 2295500 - RNA, 14 nt, Human
aguauuauuuucca

SEQ ID NO: 2295501 - RNA, 13 nt, Human
aguauuauuuucc

SEQ ID NO: 2295502 - RNA, 16 nt, Human
uguauauuuguacaaa

SEQ ID NO: 2295503 - RNA, 15 nt, Human
aguauaccugauuuu

SEQ ID NO: 2295504 - RNA, 20 nt, Human
aguauguuuuagcauguguu

SEQ ID NO: 2295505 - RNA, 19 nt, Human
aguauguuuuagcaugugu

SEQ ID NO: 2295506 - RNA, 18 nt, Human
aguauguuuuagcaugug

SEQ ID NO: 2295507 - RNA, 16 nt, Human
aguauguuuuagcaug

SEQ ID NO: 2295508 - RNA, 15 nt, Human
aguauguugucaaag

SEQ ID NO: 2295509 - RNA, 18 nt, Human
aguauguugucaaagaga

SEQ ID NO: 2295510 - RNA, 23 nt, Human
uguauauuauggaagauuuuaaa

SEQ ID NO: 2295511 - RNA, 12 nt, Human
uguauauuauuu

SEQ ID NO: 2295512 - RNA, 21 nt, Human
uguauauuauggaagauuuua

SEQ ID NO: 2295513 - RNA, 14 nt, Human
uguauauuauuucu

SEQ ID NO: 2295514 - RNA, 15 nt, Human
uguauauuauuucua

SEQ ID NO: 2295515 - RNA, 16 nt, Human
uguauauuauuucuag

SEQ ID NO: 2295516 - RNA, 21 nt, Human
uguauauuauuucuaggaaga

SEQ ID NO: 2295517 - RNA, 22 nt, Human
uguauauuauuucuaggaagaa

SEQ ID NO: 2295518 - RNA, 18 nt, Human
uguauauuuaaaagaaag

SEQ ID NO: 2295519 - RNA, 19 nt, Human
uguauauugucagauauuu

SEQ ID NO: 2295520 - RNA, 20 nt, Human
uguauauuguguuuguguau

SEQ ID NO: 2295521 - RNA, 12 nt, Human
uguauauucacu

SEQ ID NO: 2295522 - RNA, 14 nt, Human
uguauauucacuuu

SEQ ID NO: 2295523 - RNA, 21 nt, Human
uguauauuugugauagcacuu

SEQ ID NO: 2295524 - RNA, 14 nt, Human
uguauauuuguaca

SEQ ID NO: 2295525 - RNA, 15 nt, Human
uguauauuuguacaa

SEQ ID NO: 2295526 - RNA, 23 nt, Human
ugucagauauuuuuucagaaaua

SEQ ID NO: 2295527 - RNA, 21 nt, Human
ugucagauauuuuuucagaaa

SEQ ID NO: 2295528 - RNA, 20 nt, Human
ugucagauauuuuuucagaa

SEQ ID NO: 2295529 - RNA, 15 nt, Human
ugucagauaugauau

SEQ ID NO: 2295530 - RNA, 20 nt, Human
ugucagaggcacaaaagggu

SEQ ID NO: 2295531 - RNA, 16 nt, Human
ugucagaguucugcuc

SEQ ID NO: 2295532 - RNA, 15 nt, Human
ugucagauacaaugu

SEQ ID NO: 2295533 - RNA, 16 nt, Human
ugucagauacaaugua

SEQ ID NO: 2295534 - RNA, 15 nt, Human
ugucagagcugggag

SEQ ID NO: 2295535 - RNA, 14 nt, Human
ugucagagcuggga

SEQ ID NO: 2295536 - RNA, 13 nt, Human
ugucagagcuggg

SEQ ID NO: 2295537 - RNA, 12 nt, Human
ugucagagcugg

SEQ ID NO: 2295538 - RNA, 19 nt, Human
agucaccaggaauguuaaa

SEQ ID NO: 2295539 - RNA, 13 nt, Human
agucaccccagga

SEQ ID NO: 2295540 - RNA, 20 nt, Human
agucacccaugaagacagga

SEQ ID NO: 2295541 - RNA, 17 nt, Human
agucacccaugaagaca

SEQ ID NO: 2295542 - RNA, 16 nt, Human
agucacccaugaagac

SEQ ID NO: 2295543 - RNA, 13 nt, Human
agucaccaggaau

SEQ ID NO: 2295544 - RNA, 17 nt, Human
agucaccccggccaccu

SEQ ID NO: 2295545 - RNA, 15 nt, Human
agucaccaagcccag

SEQ ID NO: 2295546 - RNA, 16 nt, Human
aguauuuuccuguaaa

SEQ ID NO: 2295547 - RNA, 17 nt, Human
aguauuuugguucuuag

SEQ ID NO: 2295548 - RNA, 18 nt, Human
aguauuuugguucuuagu

SEQ ID NO: 2295549 - RNA, 23 nt, Human
aguauuuugguucuuaguucuca

SEQ ID NO: 2295550 - RNA, 19 nt, Human
aguauuuucccugcuaggg

SEQ ID NO: 2295551 - RNA, 12 nt, Human
aguauuuuccug

SEQ ID NO: 2295552 - RNA, 14 nt, Human
aguauuuuccugua

SEQ ID NO: 2295553 - RNA, 17 nt, Human
aguauuuugcuggaaua

SEQ ID NO: 2295554 - RNA, 15 nt, Human
aguauuuauuuaaug

SEQ ID NO: 2295555 - RNA, 20 nt, Human
aguauuuauuuaauguuaug

SEQ ID NO: 2295556 - RNA, 23 nt, Human
aguauuuauauauuuauaacuca

SEQ ID NO: 2295557 - RNA, 20 nt, Human
aguauuuauauauuuauaac

SEQ ID NO: 2295558 - RNA, 19 nt, Human
aguauuuauauauuuauaa

SEQ ID NO: 2295559 - RNA, 17 nt, Human
aguauuuauauauuuau

SEQ ID NO: 2295560 - RNA, 14 nt, Human
aguauuugugggga

SEQ ID NO: 2295561 - RNA, 16 nt, Human
aguauuucaaauugga

SEQ ID NO: 2295562 - RNA, 16 nt, Human
aguauuuauauauuua

SEQ ID NO: 2295563 - RNA, 15 nt, Human
aguauuuauauauuu

SEQ ID NO: 2295564 - RNA, 14 nt, Human
aguauuuauauauu

SEQ ID NO: 2295565 - RNA, 13 nt, Human
aguauuuauauau

SEQ ID NO: 2295566 - RNA, 12 nt, Human
aguauuuauaua

SEQ ID NO: 2295567 - RNA, 19 nt, Human
aguauucuuauuuaaugaa

SEQ ID NO: 2295568 - RNA, 22 nt, Human
uguccaaacugccuaagcccuc

SEQ ID NO: 2295569 - RNA, 15 nt, Human
uguccaaacugccua

SEQ ID NO: 2295570 - RNA, 17 nt, Human
uguccaaacugccuaag

SEQ ID NO: 2295571 - RNA, 16 nt, Human
uguccaaaacugccuc

SEQ ID NO: 2295572 - RNA, 23 nt, Human
uguccaaaccaaccgcacaugca

SEQ ID NO: 2295573 - RNA, 15 nt, Human
uguccaaaacugccu

SEQ ID NO: 2295574 - RNA, 13 nt, Human
ugucagcaggaag

SEQ ID NO: 2295575 - RNA, 12 nt, Human
uguccaaagcag

SEQ ID NO: 2295576 - RNA, 17 nt, Human
uguccaaagcagggucu

SEQ ID NO: 2295577 - RNA, 18 nt, Human
uguccaaagcagggucug

SEQ ID NO: 2295578 - RNA, 19 nt, Human
uguccaaaggaggcuggca

SEQ ID NO: 2295579 - RNA, 18 nt, Human
uguccaacccgaggcccg

SEQ ID NO: 2295580 - RNA, 22 nt, Human
uguccaaccuaaccccuuuccu

SEQ ID NO: 2295581 - RNA, 15 nt, Human
uguccaaccuaaccc

SEQ ID NO: 2295582 - RNA, 19 nt, Human
uguccaaagcagggucugg

SEQ ID NO: 2295583 - RNA, 21 nt, Human
uguccaaccuaaccccuuucc

SEQ ID NO: 2295584 - RNA, 14 nt, Human
uguccaagaagccc

SEQ ID NO: 2295585 - RNA, 15 nt, Human
uguccaagaagccca

SEQ ID NO: 2295586 - RNA, 13 nt, Human
ugucagcaaaaag

SEQ ID NO: 2295587 - RNA, 14 nt, Human
ugucagcaaaaagc

SEQ ID NO: 2295588 - RNA, 18 nt, Human
ugucagcaaaaagcaaaa

SEQ ID NO: 2295589 - RNA, 19 nt, Human
ugucagcaaaaagcaaaau

SEQ ID NO: 2295590 - RNA, 22 nt, Human
ugucagcaaaaagcaaaaucau

SEQ ID NO: 2295591 - RNA, 23 nt, Human
ugucagcaaaaagcaaaaucauu

SEQ ID NO: 2295592 - RNA, 17 nt, Human
ugucagguggggcagcu

SEQ ID NO: 2295593 - RNA, 18 nt, Human
ugucagguggggcagcuu

SEQ ID NO: 2295594 - RNA, 20 nt, Human
ugucagguggggcagcuuga

SEQ ID NO: 2295595 - RNA, 20 nt, Human
ugucauuugagcagggcuca

SEQ ID NO: 2295596 - RNA, 21 nt, Human
ugucauuugagcagggcucag

SEQ ID NO: 2295597 - RNA, 22 nt, Human
ugucauuugagcagggcucagc

SEQ ID NO: 2295598 - RNA, 17 nt, Human
uguccaagugugugugc

SEQ ID NO: 2295599 - RNA, 14 nt, Human
uguccaaggaaacu

SEQ ID NO: 2295600 - RNA, 18 nt, Human
uguccaagugugugugcg

SEQ ID NO: 2295601 - RNA, 16 nt, Human
uguccaauucucuuua

SEQ ID NO: 2295602 - RNA, 14 nt, Human
uguccaauccuaug

SEQ ID NO: 2295603 - RNA, 12 nt, Human
uguccagacagc

SEQ ID NO: 2295604 - RNA, 23 nt, Human
uguccaauuguugacaguucuga

SEQ ID NO: 2295605 - RNA, 15 nt, Human
uguccacacccagcu

SEQ ID NO: 2295606 - RNA, 13 nt, Human
uguccagacagcc

SEQ ID NO: 2295607 - RNA, 14 nt, Human
uguccagacagccu

SEQ ID NO: 2295608 - RNA, 15 nt, Human
uguccagacagccug

SEQ ID NO: 2295609 - RNA, 23 nt, Human
uguccagagagagaagugccccu

SEQ ID NO: 2295610 - RNA, 21 nt, Human
uguccagagagcaacucugag

SEQ ID NO: 2295611 - RNA, 11 nt, Human
uguccagagag

SEQ ID NO: 2295612 - RNA, 16 nt, Human
uguccagacagccugu

SEQ ID NO: 2295613 - RNA, 17 nt, Human
uguccagacagccugua

SEQ ID NO: 2295614 - RNA, 12 nt, Human
uguccagccugg

SEQ ID NO: 2295615 - RNA, 16 nt, Human
uguccaagaagcccag

SEQ ID NO: 2295616 - RNA, 17 nt, Human
uguccaagaagcccagg

SEQ ID NO: 2295617 - RNA, 18 nt, Human
uguccaagaagcccagga

SEQ ID NO: 2295618 - RNA, 22 nt, Human
uguccaagaagcccaggaaagg

SEQ ID NO: 2295619 - RNA, 23 nt, Human
uguccagccugggcagccaggcu

SEQ ID NO: 2295620 - RNA, 22 nt, Human
uguccagccugggcagccaggc

SEQ ID NO: 2295621 - RNA, 19 nt, Human
uguccagccugggcagcca

SEQ ID NO: 2295622 - RNA, 14 nt, Human
uguccagccugggc

SEQ ID NO: 2295623 - RNA, 14 nt, Human
uguccagcgccuag

SEQ ID NO: 2295624 - RNA, 21 nt, Human
uguccccuccucacucccuuc

SEQ ID NO: 2295625 - RNA, 11 nt, Human
uguccccucuu

SEQ ID NO: 2295626 - RNA, 14 nt, Human
uguccccucuugac

SEQ ID NO: 2295627 - RNA, 14 nt, Human
uguccccucuugcc

SEQ ID NO: 2295628 - RNA, 15 nt, Human
uguccccucuugccc

SEQ ID NO: 2295629 - RNA, 11 nt, Human
uguccccuucu

SEQ ID NO: 2295630 - RNA, 14 nt, Human
uguccccuucucuc

SEQ ID NO: 2295631 - RNA, 16 nt, Human
uguccccuucucucau

SEQ ID NO: 2295632 - RNA, 20 nt, Human
uguccccuucucucaucucu

SEQ ID NO: 2295633 - RNA, 17 nt, Human
uguccccucuugcccca

SEQ ID NO: 2295634 - RNA, 21 nt, Human
uguccccucuugccccaaccc

SEQ ID NO: 2295635 - RNA, 19 nt, Human
ugucccgggguccuguggc

SEQ ID NO: 2295636 - RNA, 20 nt, Human
ugucccgggguccuguggca

SEQ ID NO: 2295637 - RNA, 21 nt, Human
ugucccgggguccuguggcag

SEQ ID NO: 2295638 - RNA, 16 nt, Human
ugucccgggguccugu

SEQ ID NO: 2295639 - RNA, 22 nt, Human
uguccccuucucucaucucuua

SEQ ID NO: 2295640 - RNA, 20 nt, Human
ugucccugcacuugcagacu

SEQ ID NO: 2295641 - RNA, 22 nt, Human
ugucccugcacuugcagacucu

SEQ ID NO: 2295642 - RNA, 23 nt, Human
ugucccugcacuugcagacucua

SEQ ID NO: 2295643 - RNA, 13 nt, Human
aguaaucugugua

SEQ ID NO: 2295644 - RNA, 19 nt, Human
aguaaucuguguacaaaga

SEQ ID NO: 2295645 - RNA, 19 nt, Human
aguaaucuaauauggccac

SEQ ID NO: 2295646 - RNA, 17 nt, Human
aguaaucgcuuaaagau

SEQ ID NO: 2295647 - RNA, 22 nt, Human
aguaaugaauuuuuaugauauu

SEQ ID NO: 2295648 - RNA, 21 nt, Human
aguaaugaauuuuuaugauau

SEQ ID NO: 2295649 - RNA, 12 nt, Human
aguaaugaauuu

SEQ ID NO: 2295650 - RNA, 13 nt, Human
aguaaugauaacu

SEQ ID NO: 2295651 - RNA, 20 nt, Human
aguaauugacaugugccagg

SEQ ID NO: 2295652 - RNA, 18 nt, Human
aguaauugacaugugcca

SEQ ID NO: 2295653 - RNA, 21 nt, Human
aguaaucuguguacaaagaaa

SEQ ID NO: 2295654 - RNA, 14 nt, Human
aguaauucucaggc

SEQ ID NO: 2295655 - RNA, 17 nt, Human
aguaauucugcugucuc

SEQ ID NO: 2295656 - RNA, 19 nt, Human
aguaauucaagaaaacaac

SEQ ID NO: 2295657 - RNA, 12 nt, Human
aguaauuggaaa

SEQ ID NO: 2295658 - RNA, 13 nt, Human
aguaauuggaaag

SEQ ID NO: 2295659 - RNA, 18 nt, Human
aguacaggcagcacagag

SEQ ID NO: 2295660 - RNA, 17 nt, Human
aguacaggcagcacaga

SEQ ID NO: 2295661 - RNA, 14 nt, Human
aguacaggcagcac

SEQ ID NO: 2295662 - RNA, 19 nt, Human
aguacauuuggagacacaa

SEQ ID NO: 2295663 - RNA, 22 nt, Human
aguaauuuauuguuuuuccuug

SEQ ID NO: 2295664 - RNA, 23 nt, Human
aguaauuuauuguuuuuccuugu

SEQ ID NO: 2295665 - RNA, 23 nt, Human
aguacacuguuucaaacuuuacu

SEQ ID NO: 2295666 - RNA, 13 nt, Human
aguaauuuauugu

SEQ ID NO: 2295667 - RNA, 19 nt, Human
aguaauuguugguuaucuu

SEQ ID NO: 2295668 - RNA, 21 nt, Human
aguacacuguuucaaacuuua

SEQ ID NO: 2295669 - RNA, 12 nt, Human
aguaauugugaa

SEQ ID NO: 2295670 - RNA, 22 nt, Human
aguaauugguccgaucuuugac

SEQ ID NO: 2295671 - RNA, 15 nt, Human
aguaauugugaaaaa

SEQ ID NO: 2295672 - RNA, 13 nt, Human
aguaauugugaaa

SEQ ID NO: 2295673 - RNA, 16 nt, Human
aguaauugugaaaaag

SEQ ID NO: 2295674 - RNA, 19 nt, Human
aguaaaaaacaacuucuuu

SEQ ID NO: 2295675 - RNA, 19 nt, Human
agguuuuuuuccuucugaa

SEQ ID NO: 2295676 - RNA, 23 nt, Human
aguaaaaacaaagaaauuaugug

SEQ ID NO: 2295677 - RNA, 22 nt, Human
agguuuuuuuguauaguaaagu

SEQ ID NO: 2295678 - RNA, 21 nt, Human
agguuuuuuuguauaguaaag

SEQ ID NO: 2295679 - RNA, 16 nt, Human
aguaaaaacaaagaaa

SEQ ID NO: 2295680 - RNA, 21 nt, Human
uguacauggaauaacauguaa

SEQ ID NO: 2295681 - RNA, 16 nt, Human
uguacaugagaaggaa

SEQ ID NO: 2295682 - RNA, 14 nt, Human
uguacaugcauuca

SEQ ID NO: 2295683 - RNA, 22 nt, Human
uguacaugaagaagcuaaaucc

SEQ ID NO: 2295684 - RNA, 17 nt, Human
uguacauggcagaguuu

SEQ ID NO: 2295685 - RNA, 19 nt, Human
uguacauggcagaguuugu

SEQ ID NO: 2295686 - RNA, 11 nt, Human
uguacaugugu

SEQ ID NO: 2295687 - RNA, 15 nt, Human
uguacauguguagcc

SEQ ID NO: 2295688 - RNA, 16 nt, Human
agguuuuuuuccuucu

SEQ ID NO: 2295689 - RNA, 18 nt, Human
agguuuuuuuccuucuga

SEQ ID NO: 2295690 - RNA, 17 nt, Human
aguaauaaacuguguuu

SEQ ID NO: 2295691 - RNA, 13 nt, Human
aguaauagagcaa

SEQ ID NO: 2295692 - RNA, 16 nt, Human
aguaauaaacuguguu

SEQ ID NO: 2295693 - RNA, 16 nt, Human
aguaagugccuuccau

SEQ ID NO: 2295694 - RNA, 13 nt, Human
aguaagugccuuc

SEQ ID NO: 2295695 - RNA, 15 nt, Human
aguaagugccuucca

SEQ ID NO: 2295696 - RNA, 23 nt, Human
aguaagugggguugcaaccacug

SEQ ID NO: 2295697 - RNA, 20 nt, Human
aguaaguaccacucaggcca

SEQ ID NO: 2295698 - RNA, 20 nt, Human
aguaaaaccacagcaguuga

SEQ ID NO: 2295699 - RNA, 19 nt, Human
aguaaaaccacagcaguug

SEQ ID NO: 2295700 - RNA, 17 nt, Human
aguaaaaccacagcagu

SEQ ID NO: 2295701 - RNA, 16 nt, Human
aguaaaaccacagcag

SEQ ID NO: 2295702 - RNA, 16 nt, Human
aguaccaaucauuuua

SEQ ID NO: 2295703 - RNA, 15 nt, Human
aguaccaaucauuuu

SEQ ID NO: 2295704 - RNA, 14 nt, Human
aguaccaaaugcuu

SEQ ID NO: 2295705 - RNA, 19 nt, Human
aguacaggcagcacagaga

SEQ ID NO: 2295706 - RNA, 23 nt, Human
aguaccauaguaccauuuauaca

SEQ ID NO: 2295707 - RNA, 21 nt, Human
aguaccauaguaccauuuaua

SEQ ID NO: 2295708 - RNA, 15 nt, Human
aguaccacucaggcc

SEQ ID NO: 2295709 - RNA, 19 nt, Human
aguaccauaguaccauuua

SEQ ID NO: 2295710 - RNA, 20 nt, Human
aguagcaguagaugcaugua

SEQ ID NO: 2295711 - RNA, 18 nt, Human
aguagcacccuggauuga

SEQ ID NO: 2295712 - RNA, 12 nt, Human
uguagggcugga

SEQ ID NO: 2295713 - RNA, 22 nt, Human
uguagggagggcggcaggggcc

SEQ ID NO: 2295714 - RNA, 19 nt, Human
aguagcauguugagccagg

SEQ ID NO: 2295715 - RNA, 23 nt, Human
aguagcaugagagaauuguauca

SEQ ID NO: 2295716 - RNA, 14 nt, Human
aguagcaugagaga

SEQ ID NO: 2295717 - RNA, 23 nt, Human
aguagauuuucuuuaaaagaaug

SEQ ID NO: 2295718 - RNA, 16 nt, Human
aguagcaaguucuaga

SEQ ID NO: 2295719 - RNA, 20 nt, Human
aguagcaaguucuagagaag

SEQ ID NO: 2295720 - RNA, 22 nt, Human
aguagcaaguucuagagaagag

SEQ ID NO: 2295721 - RNA, 15 nt, Human
aguagauuuuccaaa

SEQ ID NO: 2295722 - RNA, 13 nt, Human
aguagauuuucuu

SEQ ID NO: 2295723 - RNA, 16 nt, Human
aguagauuuucuuuaa

SEQ ID NO: 2295724 - RNA, 17 nt, Human
aguagauuuucuuuaaa

SEQ ID NO: 2295725 - RNA, 18 nt, Human
aguagauuuucuuuaaaa

SEQ ID NO: 2295726 - RNA, 20 nt, Human
aguagauuuucuuuaaaaga

SEQ ID NO: 2295727 - RNA, 21 nt, Human
aguagauuuucuuuaaaagaa

SEQ ID NO: 2295728 - RNA, 15 nt, Human
uguagguaucauuuu

SEQ ID NO: 2295729 - RNA, 15 nt, Human
uguagucccagccac

SEQ ID NO: 2295730 - RNA, 17 nt, Human
uguaggguuauaauaau

SEQ ID NO: 2295731 - RNA, 18 nt, Human
uguaggguaaggugccuu

SEQ ID NO: 2295732 - RNA, 19 nt, Human
uguaggggacgagaaagau

SEQ ID NO: 2295733 - RNA, 15 nt, Human
uguagggcuggaccu

SEQ ID NO: 2295734 - RNA, 16 nt, Human
uguagggcuggaccua

SEQ ID NO: 2295735 - RNA, 16 nt, Human
uguaggguuauaauaa

SEQ ID NO: 2295736 - RNA, 22 nt, Human
uguagugaaucacguaaagcua

SEQ ID NO: 2295737 - RNA, 14 nt, Human
uguagucucaggac

SEQ ID NO: 2295738 - RNA, 21 nt, Human
uguaguccucauaaaaagcaa

SEQ ID NO: 2295739 - RNA, 21 nt, Human
uguagugagauagcauuguga

SEQ ID NO: 2295740 - RNA, 17 nt, Human
uguagucccagcuacuc

SEQ ID NO: 2295741 - RNA, 14 nt, Human
uguagucccagcua

SEQ ID NO: 2295742 - RNA, 20 nt, Human
uguaguccgugcugacagcu

SEQ ID NO: 2295743 - RNA, 23 nt, Human
uguaguccuagccacucaggagg

SEQ ID NO: 2295744 - RNA, 17 nt, Human
uguaguccucauaaaaa

SEQ ID NO: 2295745 - RNA, 22 nt, Human
uguaguccgugcugacagcugc

SEQ ID NO: 2295746 - RNA, 16 nt, Human
uguaguguuggagaag

SEQ ID NO: 2295747 - RNA, 17 nt, Human
uguauauacaauaacau

SEQ ID NO: 2295748 - RNA, 18 nt, Human
uguauaguugcuugccug

SEQ ID NO: 2295749 - RNA, 22 nt, Human
uguauauacauuuaugaauuaa

SEQ ID NO: 2295750 - RNA, 18 nt, Human
uguauauacaauaacaua

SEQ ID NO: 2295751 - RNA, 16 nt, Human
uguauauacaauaaca

SEQ ID NO: 2295752 - RNA, 15 nt, Human
uguauauacaauaac

SEQ ID NO: 2295753 - RNA, 21 nt, Human
uguauaguuguggacauuuaa

SEQ ID NO: 2295754 - RNA, 19 nt, Human
uguauauaaaauauuuuca

SEQ ID NO: 2295755 - RNA, 20 nt, Human
uguauaguuaggauagcauu

SEQ ID NO: 2295756 - RNA, 13 nt, Human
uguauaguugcuu

SEQ ID NO: 2295757 - RNA, 14 nt, Human
uguauaguucacgu

SEQ ID NO: 2295758 - RNA, 14 nt, Human
uguauaguugcuug

SEQ ID NO: 2295759 - RNA, 16 nt, Human
uguauaguugcuugcc

SEQ ID NO: 2295760 - RNA, 22 nt, Human
uguauaguugcuugccugauau

SEQ ID NO: 2295761 - RNA, 17 nt, Human
uguagugagauagcauu

SEQ ID NO: 2295762 - RNA, 15 nt, Human
uguauaguguaaaau

SEQ ID NO: 2295763 - RNA, 16 nt, Human
uguauaguguaaaaua

SEQ ID NO: 2295764 - RNA, 24 nt, Human
uguauaguguaaaauaagaaugau

SEQ ID NO: 2295765 - RNA, 17 nt, Human
uguaguguuggagaaga

SEQ ID NO: 2295766 - RNA, 18 nt, Human
uguaguguuggagaagaa

SEQ ID NO: 2295767 - RNA, 22 nt, Human
uguauauauuuccuauauuguu

SEQ ID NO: 2295768 - RNA, 15 nt, Human
uguauauaugugugu

SEQ ID NO: 2295769 - RNA, 18 nt, Human
uguauauauguguguuua

SEQ ID NO: 2295770 - RNA, 19 nt, Human
uguauauauguguguuuaa

SEQ ID NO: 2295771 - RNA, 20 nt, Human
uguauauauguguguuuaaa

SEQ ID NO: 2295772 - RNA, 18 nt, Human
uguauauccuuucuaaca

SEQ ID NO: 2295773 - RNA, 13 nt, Human
uguauaucagaaa

SEQ ID NO: 2295774 - RNA, 14 nt, Human
uguauaucagaaaa

SEQ ID NO: 2295775 - RNA, 18 nt, Human
uguauaucagaaaaggga

SEQ ID NO: 2295776 - RNA, 17 nt, Human
uguauauauauuaagag

SEQ ID NO: 2295777 - RNA, 13 nt, Human
uguauauacuuuu

SEQ ID NO: 2295778 - RNA, 12 nt, Human
uguauauacuuu

SEQ ID NO: 2295779 - RNA, 17 nt, Human
uguauauacgcaucuau

SEQ ID NO: 2295780 - RNA, 21 nt, Human
uguauauacgcaucuauaaau

SEQ ID NO: 2295781 - RNA, 18 nt, Human
uguauauauuuccuauau

SEQ ID NO: 2295782 - RNA, 17 nt, Human
uguauauaucugcuuca

SEQ ID NO: 2295783 - RNA, 12 nt, Human
uguauauaugug

SEQ ID NO: 2295784 - RNA, 14 nt, Human
uguauauaugugug

SEQ ID NO: 2295785 - RNA, 13 nt, Human
uguauauaugugu

SEQ ID NO: 2295786 - RNA, 23 nt, Human
agguugaagccaaguggggugcu

SEQ ID NO: 2295787 - RNA, 12 nt, Human
agguugaagagg

SEQ ID NO: 2295788 - RNA, 12 nt, Human
agguugaagcca

SEQ ID NO: 2295789 - RNA, 13 nt, Human
agguugaagccaa

SEQ ID NO: 2295790 - RNA, 15 nt, Human
agguugaagccaagu

SEQ ID NO: 2295791 - RNA, 17 nt, Human
agguugcugguugcugu

SEQ ID NO: 2295792 - RNA, 24 nt, Human
agguugcugguugcugugugguuu

SEQ ID NO: 2295793 - RNA, 17 nt, Human
agguugcagugagcuga

SEQ ID NO: 2295794 - RNA, 18 nt, Human
agguugcagugagccaag

SEQ ID NO: 2295795 - RNA, 19 nt, Human
agguugcagugagccaaga

SEQ ID NO: 2295796 - RNA, 14 nt, Human
agguugcagugagc

SEQ ID NO: 2295797 - RNA, 14 nt, Human
agguugaagcacca

SEQ ID NO: 2295798 - RNA, 16 nt, Human
agguucuucuuccuga

SEQ ID NO: 2295799 - RNA, 23 nt, Human
agguucuucccuuuuacauacug

SEQ ID NO: 2295800 - RNA, 23 nt, Human
agguucuucuuccugaagcugag

SEQ ID NO: 2295801 - RNA, 19 nt, Human
agguucuucuuccugaagc

SEQ ID NO: 2295802 - RNA, 21 nt, Human
agguucuucuuccugaagcug

SEQ ID NO: 2295803 - RNA, 12 nt, Human
agguugaaagac

SEQ ID NO: 2295804 - RNA, 19 nt, Human
agguucuucccuuuuacau

SEQ ID NO: 2295805 - RNA, 14 nt, Human
aggugugcaagaga

SEQ ID NO: 2295806 - RNA, 12 nt, Human
aggugugcucug

SEQ ID NO: 2295807 - RNA, 20 nt, Human
aggugggcugagcccuggca

SEQ ID NO: 2295808 - RNA, 22 nt, Human
aggugggcgggcagcacagcaa

SEQ ID NO: 2295809 - RNA, 19 nt, Human
aggugggcugagcccuggc

SEQ ID NO: 2295810 - RNA, 18 nt, Human
aggugggcugagcccugg

SEQ ID NO: 2295811 - RNA, 15 nt, Human
aggugggcuucccag

SEQ ID NO: 2295812 - RNA, 21 nt, Human
aggugggcuucccaguggcug

SEQ ID NO: 2295813 - RNA, 18 nt, Human
agguggggagacugggcu

SEQ ID NO: 2295814 - RNA, 13 nt, Human
agguggggacagg

SEQ ID NO: 2295815 - RNA, 14 nt, Human
agguggggacaggg

SEQ ID NO: 2295816 - RNA, 17 nt, Human
aggugucauuuccauua

SEQ ID NO: 2295817 - RNA, 15 nt, Human
aggugucauuuccau

SEQ ID NO: 2295818 - RNA, 21 nt, Human
aggugucauacagauuugcaa

SEQ ID NO: 2295819 - RNA, 15 nt, Human
aggugucauacagau

SEQ ID NO: 2295820 - RNA, 20 nt, Human
agguguauggagagaaaaca

SEQ ID NO: 2295821 - RNA, 17 nt, Human
agguggggacagggaug

SEQ ID NO: 2295822 - RNA, 17 nt, Human
aggugucaggcugcugg

SEQ ID NO: 2295823 - RNA, 18 nt, Human
aggugucaggcugcuggc

SEQ ID NO: 2295824 - RNA, 19 nt, Human
aggugucaggcugcuggcg

SEQ ID NO: 2295825 - RNA, 16 nt, Human
aggugucccugcacuu

SEQ ID NO: 2295826 - RNA, 20 nt, Human
aggugucccugcacuugcag

SEQ ID NO: 2295827 - RNA, 21 nt, Human
aggugugagucaccaagccca

SEQ ID NO: 2295828 - RNA, 22 nt, Human
aggugugagucaccaagcccag

SEQ ID NO: 2295829 - RNA, 22 nt, Human
aggugggcguggucacugcugu

SEQ ID NO: 2295830 - RNA, 15 nt, Human
aggugggcugagccc

SEQ ID NO: 2295831 - RNA, 17 nt, Human
aggugggcugagcccug

SEQ ID NO: 2295832 - RNA, 16 nt, Human
aggugggcugagcccu

SEQ ID NO: 2295833 - RNA, 22 nt, Human
aggugggccuugcuaccucaag

SEQ ID NO: 2295834 - RNA, 21 nt, Human
aggugggccuugcuaccucaa

SEQ ID NO: 2295835 - RNA, 19 nt, Human
aggugggccuugcuaccuc

SEQ ID NO: 2295836 - RNA, 15 nt, Human
aggugggccuugcua

SEQ ID NO: 2295837 - RNA, 16 nt, Human
aggugggcgggcagca

SEQ ID NO: 2295838 - RNA, 18 nt, Human
aggugggcgggcagcaca

SEQ ID NO: 2295839 - RNA, 19 nt, Human
aggugggcgggcagcacag

SEQ ID NO: 2295840 - RNA, 20 nt, Human
aggugggcgggcagcacagc

SEQ ID NO: 2295841 - RNA, 13 nt, Human
aggugggagcuug

SEQ ID NO: 2295842 - RNA, 20 nt, Human
aggugggagcaggagauuga

SEQ ID NO: 2295843 - RNA, 12 nt, Human
aggugggaggau

SEQ ID NO: 2295844 - RNA, 23 nt, Human
aggugcuaaauggucgcccagga

SEQ ID NO: 2295845 - RNA, 23 nt, Human
aggugccuuggagggucccaagc

SEQ ID NO: 2295846 - RNA, 22 nt, Human
aggugccuucuuauucucacuc

SEQ ID NO: 2295847 - RNA, 10 nt, Human
aggugccuug

SEQ ID NO: 2295848 - RNA, 13 nt, Human
aggugccuucuua

SEQ ID NO: 2295849 - RNA, 21 nt, Human
aggugccugugaggcaggggc

SEQ ID NO: 2295850 - RNA, 16 nt, Human
aggugcuacaaaaaca

SEQ ID NO: 2295851 - RNA, 23 nt, Human
agguggcugacccagucccuggg

SEQ ID NO: 2295852 - RNA, 14 nt, Human
agguggcugagccc

SEQ ID NO: 2295853 - RNA, 17 nt, Human
agguggcugagccccug

SEQ ID NO: 2295854 - RNA, 15 nt, Human
agguggcugagcccc

SEQ ID NO: 2295855 - RNA, 21 nt, Human
aggugccuuggagggucccaa

SEQ ID NO: 2295856 - RNA, 23 nt, Human
aggugggaaaugguaugagcuga

SEQ ID NO: 2295857 - RNA, 19 nt, Human
agguggcugagccccuguc

SEQ ID NO: 2295858 - RNA, 13 nt, Human
aggugggagcagg

SEQ ID NO: 2295859 - RNA, 14 nt, Human
aggugggagcagga

SEQ ID NO: 2295860 - RNA, 15 nt, Human
aggugggagcaggag

SEQ ID NO: 2295861 - RNA, 16 nt, Human
aggugggagcaggaga

SEQ ID NO: 2295862 - RNA, 17 nt, Human
aggugggagcaggagau

SEQ ID NO: 2295863 - RNA, 16 nt, Human
ugggcugccaugugaa

SEQ ID NO: 2295864 - RNA, 21 nt, Human
ugggcugcagcagaggcacug

SEQ ID NO: 2295865 - RNA, 21 nt, Human
ugggcugcacucugugcccau

SEQ ID NO: 2295866 - RNA, 22 nt, Human
ugggcugcacucugugcccaug

SEQ ID NO: 2295867 - RNA, 17 nt, Human
ugggcugcacucugugc

SEQ ID NO: 2295868 - RNA, 18 nt, Human
ugggcugcacucugugcc

SEQ ID NO: 2295869 - RNA, 19 nt, Human
ugggcugcacucugugccc

SEQ ID NO: 2295870 - RNA, 20 nt, Human
ugggcugcacucugugccca

SEQ ID NO: 2295871 - RNA, 13 nt, Human
ugggcugcccugg

SEQ ID NO: 2295872 - RNA, 14 nt, Human
ugggcugcccuggu

SEQ ID NO: 2295873 - RNA, 23 nt, Human
aggugccuucuuauucucacucc

SEQ ID NO: 2295874 - RNA, 22 nt, Human
aggugccugugaggcaggggcg

SEQ ID NO: 2295875 - RNA, 20 nt, Human
aggugccugugaggcagggg

SEQ ID NO: 2295876 - RNA, 19 nt, Human
aggugccugugaggcaggg

SEQ ID NO: 2295877 - RNA, 15 nt, Human
ugggcugcccuggug

SEQ ID NO: 2295878 - RNA, 18 nt, Human
aggugccugugaggcagg

SEQ ID NO: 2295879 - RNA, 19 nt, Human
ugggcucugccccagcucu

SEQ ID NO: 2295880 - RNA, 17 nt, Human
ugggcucugccccagcu

SEQ ID NO: 2295881 - RNA, 15 nt, Human
ugggcucugccccag

SEQ ID NO: 2295882 - RNA, 12 nt, Human
ugggcucugccc

SEQ ID NO: 2295883 - RNA, 20 nt, Human
ugggcucugcaauuccccuc

SEQ ID NO: 2295884 - RNA, 22 nt, Human
ugggcucugcaauuccccucug

SEQ ID NO: 2295885 - RNA, 13 nt, Human
ugggcucugccac

SEQ ID NO: 2295886 - RNA, 15 nt, Human
ugggcucugccaccc

SEQ ID NO: 2295887 - RNA, 18 nt, Human
ugggcucugccacccuac

SEQ ID NO: 2295888 - RNA, 21 nt, Human
ugggcucugccccagcucugg

SEQ ID NO: 2295889 - RNA, 20 nt, Human
ugggcucugccccagcucug

SEQ ID NO: 2295890 - RNA, 23 nt, Human
ugggcucugccccagcucuggcu

SEQ ID NO: 2295891 - RNA, 14 nt, Human
ugggcucugggagc

SEQ ID NO: 2295892 - RNA, 11 nt, Human
ugggcugaggg

SEQ ID NO: 2295893 - RNA, 15 nt, Human
ugggcucugggagca

SEQ ID NO: 2295894 - RNA, 16 nt, Human
ugggcugagggagccu

SEQ ID NO: 2295895 - RNA, 12 nt, Human
ugggcugaggga

SEQ ID NO: 2295896 - RNA, 15 nt, Human
agguuucugaaaauu

SEQ ID NO: 2295897 - RNA, 23 nt, Human
agguuucugaaaauuaacacugc

SEQ ID NO: 2295898 - RNA, 21 nt, Human
agguuucugaguuccugcaug

SEQ ID NO: 2295899 - RNA, 19 nt, Human
agguuucugaguuccugca

SEQ ID NO: 2295900 - RNA, 18 nt, Human
agguuucuggucucuagg

SEQ ID NO: 2295901 - RNA, 18 nt, Human
uguaagggaaacugccag

SEQ ID NO: 2295902 - RNA, 13 nt, Human
uguaagggaaacu

SEQ ID NO: 2295903 - RNA, 14 nt, Human
agguuucugaaaau

SEQ ID NO: 2295904 - RNA, 17 nt, Human
agguuucguuucuguau

SEQ ID NO: 2295905 - RNA, 12 nt, Human
agguuucauacu

SEQ ID NO: 2295906 - RNA, 21 nt, Human
agguuucauacucuagauuuu

SEQ ID NO: 2295907 - RNA, 20 nt, Human
agguuggcaaaaaggcagga

SEQ ID NO: 2295908 - RNA, 18 nt, Human
agguuggaagcuagcucc

SEQ ID NO: 2295909 - RNA, 19 nt, Human
agguuggaagcuagcuccc

SEQ ID NO: 2295910 - RNA, 18 nt, Human
uguaauuaaguacuaugu

SEQ ID NO: 2295911 - RNA, 19 nt, Human
uguaagggaaacugccagc

SEQ ID NO: 2295912 - RNA, 21 nt, Human
uguaauuaaguacuauguauc

SEQ ID NO: 2295913 - RNA, 19 nt, Human
uguaauuaaguacuaugua

SEQ ID NO: 2295914 - RNA, 15 nt, Human
uguaauugaauaaag

SEQ ID NO: 2295915 - RNA, 15 nt, Human
uguaauucuaaauga

SEQ ID NO: 2295916 - RNA, 16 nt, Human
uguaauucuaaaugaa

SEQ ID NO: 2295917 - RNA, 14 nt, Human
uguaauugcuuaca

SEQ ID NO: 2295918 - RNA, 15 nt, Human
uguaauugcuuacau

SEQ ID NO: 2295919 - RNA, 16 nt, Human
uguaauugcuuacauu

SEQ ID NO: 2295920 - RNA, 17 nt, Human
uguaauugcuuacauuu

SEQ ID NO: 2295921 - RNA, 18 nt, Human
uguaauugcuuacauuuu

SEQ ID NO: 2295922 - RNA, 23 nt, Human
uguaauugcuuacauuuuuacaa

SEQ ID NO: 2295923 - RNA, 13 nt, Human
uguaauucuaaau

SEQ ID NO: 2295924 - RNA, 14 nt, Human
uguaauucuaaaug

SEQ ID NO: 2295925 - RNA, 15 nt, Human
uguaauuccuaccuc

SEQ ID NO: 2295926 - RNA, 21 nt, Human
uguaauuccuaccucccugca

SEQ ID NO: 2295927 - RNA, 12 nt, Human
uguacaguuuuu

SEQ ID NO: 2295928 - RNA, 15 nt, Human
uguacauaacugaaa

SEQ ID NO: 2295929 - RNA, 14 nt, Human
uguacauaacugaa

SEQ ID NO: 2295930 - RNA, 13 nt, Human
uguacauaacuga

SEQ ID NO: 2295931 - RNA, 17 nt, Human
uguacaaaauaaacaaa

SEQ ID NO: 2295932 - RNA, 20 nt, Human
uguacauaaugcgugcauac

SEQ ID NO: 2295933 - RNA, 19 nt, Human
uguacauaaugcgugcaua

SEQ ID NO: 2295934 - RNA, 13 nt, Human
uguacaaaauaaa

SEQ ID NO: 2295935 - RNA, 20 nt, Human
uguaauuuuuuuaucgucac

SEQ ID NO: 2295936 - RNA, 16 nt, Human
uguaauuguuguuugu

SEQ ID NO: 2295937 - RNA, 23 nt, Human
uguaauuuuguucuaguuuucag

SEQ ID NO: 2295938 - RNA, 19 nt, Human
uguacauaacugaaaaugu

SEQ ID NO: 2295939 - RNA, 18 nt, Human
uguacauaacugaaaaug

SEQ ID NO: 2295940 - RNA, 17 nt, Human
uguacauaacugaaaau

SEQ ID NO: 2295941 - RNA, 21 nt, Human
uguacauacccuggccgcccc

SEQ ID NO: 2295942 - RNA, 18 nt, Human
uguacauaguuauuuauu

SEQ ID NO: 2295943 - RNA, 23 nt, Human
uguacauagccuauauuuacagu

SEQ ID NO: 2295944 - RNA, 11 nt, Human
uguacauagcc

SEQ ID NO: 2295945 - RNA, 15 nt, Human
uguacauagccuaua

SEQ ID NO: 2295946 - RNA, 16 nt, Human
uguacauagccuauau

SEQ ID NO: 2295947 - RNA, 22 nt, Human
uguacauagccuauauuuacag

SEQ ID NO: 2295948 - RNA, 14 nt, Human
uguacaucuggccu

SEQ ID NO: 2295949 - RNA, 23 nt, Human
uguacaucuauuuuggauuguau

SEQ ID NO: 2295950 - RNA, 16 nt, Human
uguacaugaaaacaca

SEQ ID NO: 2295951 - RNA, 14 nt, Human
uguacaugaaaaca

SEQ ID NO: 2295952 - RNA, 21 nt, Human
uguacaucuauuuuggauugu

SEQ ID NO: 2295953 - RNA, 20 nt, Human
uguacaucuauuuuggauug

SEQ ID NO: 2295954 - RNA, 19 nt, Human
uguacaucuauuuuggauu

SEQ ID NO: 2295955 - RNA, 18 nt, Human
uguacaucuauuuuggau

SEQ ID NO: 2295956 - RNA, 19 nt, Human
ugggcaaugauggcaauuu

SEQ ID NO: 2295957 - RNA, 16 nt, Human
ugggcacacgccuccc

SEQ ID NO: 2295958 - RNA, 21 nt, Human
ugggcacacgccucccacugg

SEQ ID NO: 2295959 - RNA, 13 nt, Human
ugggcagaaggaa

SEQ ID NO: 2295960 - RNA, 16 nt, Human
ugggcaauauagcaag

SEQ ID NO: 2295961 - RNA, 15 nt, Human
ugggcaauauagcaa

SEQ ID NO: 2295962 - RNA, 15 nt, Human
ugggcaagugauuga

SEQ ID NO: 2295963 - RNA, 23 nt, Human
ugggcagaaggaagacuucaucc

SEQ ID NO: 2295964 - RNA, 16 nt, Human
ugggcagaaggaagac

SEQ ID NO: 2295965 - RNA, 20 nt, Human
ugggcagaaggaagacuuca

SEQ ID NO: 2295966 - RNA, 12 nt, Human
ugggagggccca

SEQ ID NO: 2295967 - RNA, 11 nt, Human
ugggaggggca

SEQ ID NO: 2295968 - RNA, 12 nt, Human
ugggaggggcag

SEQ ID NO: 2295969 - RNA, 14 nt, Human
ugggaggggcaggc

SEQ ID NO: 2295970 - RNA, 15 nt, Human
ugggaggggcaggcu

SEQ ID NO: 2295971 - RNA, 16 nt, Human
ugggaggggcaggcug

SEQ ID NO: 2295972 - RNA, 17 nt, Human
ugggaggggcaggcuga

SEQ ID NO: 2295973 - RNA, 18 nt, Human
ugggaggggcaggcugac

SEQ ID NO: 2295974 - RNA, 19 nt, Human
ugggagggcagcagggcua

SEQ ID NO: 2295975 - RNA, 18 nt, Human
ugggagggcagcagggcu

SEQ ID NO: 2295976 - RNA, 17 nt, Human
ugggagggcagcagggc

SEQ ID NO: 2295977 - RNA, 14 nt, Human
ugggagggcagcag

SEQ ID NO: 2295978 - RNA, 16 nt, Human
ugggauuuggucaaca

SEQ ID NO: 2295979 - RNA, 20 nt, Human
ugggaggggcgcccaccucc

SEQ ID NO: 2295980 - RNA, 15 nt, Human
ugggcaaaaaacucg

SEQ ID NO: 2295981 - RNA, 16 nt, Human
ugggcaaaaaacucga

SEQ ID NO: 2295982 - RNA, 23 nt, Human
ugggagggggcuugaagccaaag

SEQ ID NO: 2295983 - RNA, 19 nt, Human
ugggaggggcaggcugaca

SEQ ID NO: 2295984 - RNA, 19 nt, Human
ugggaggggcgcccaccuc

SEQ ID NO: 2295985 - RNA, 23 nt, Human
ugggaggggcgcccaccucccca

SEQ ID NO: 2295986 - RNA, 14 nt, Human
ugggcaacagagca

SEQ ID NO: 2295987 - RNA, 12 nt, Human
ugggcaacagag

SEQ ID NO: 2295988 - RNA, 21 nt, Human
ugggcaaagccuagugaaggc

SEQ ID NO: 2295989 - RNA, 15 nt, Human
ugggcaaagccuagu

SEQ ID NO: 2295990 - RNA, 16 nt, Human
ugggcaaacaggcagu

SEQ ID NO: 2295991 - RNA, 15 nt, Human
ugggcaaacaggcag

SEQ ID NO: 2295992 - RNA, 14 nt, Human
ugggcaaacaggca

SEQ ID NO: 2295993 - RNA, 22 nt, Human
ugggcaaaacugaauuauaaga

SEQ ID NO: 2295994 - RNA, 16 nt, Human
ugggcaacagagcaag

SEQ ID NO: 2295995 - RNA, 15 nt, Human
ugggcaaagagugua

SEQ ID NO: 2295996 - RNA, 16 nt, Human
ugggcaacauugcugg

SEQ ID NO: 2295997 - RNA, 14 nt, Human
ugggcaaggaggcc

SEQ ID NO: 2295998 - RNA, 21 nt, Human
ugggcaacccccagccugcua

SEQ ID NO: 2295999 - RNA, 22 nt, Human
ugggaggcucacccccuucucc

SEQ ID NO: 2296000 - RNA, 20 nt, Human
ugggaggcucacccccuucu

SEQ ID NO: 2296001 - RNA, 14 nt, Human
ugggaggcucugga

SEQ ID NO: 2296002 - RNA, 17 nt, Human
ugggaggcucuggagcc

SEQ ID NO: 2296003 - RNA, 23 nt, Human
ugggaggcucuggagcccacugu

SEQ ID NO: 2296004 - RNA, 18 nt, Human
ugggagggauagaggggg

SEQ ID NO: 2296005 - RNA, 22 nt, Human
ugggagggaggcucaggucccu

SEQ ID NO: 2296006 - RNA, 17 nt, Human
ugggagggaggcucagg

SEQ ID NO: 2296007 - RNA, 16 nt, Human
ugggagggaggcucag

SEQ ID NO: 2296008 - RNA, 14 nt, Human
ugggaggcuucccc

SEQ ID NO: 2296009 - RNA, 17 nt, Human
ugggagggagcagacag

SEQ ID NO: 2296010 - RNA, 18 nt, Human
ugggagggagcagacagg

SEQ ID NO: 2296011 - RNA, 19 nt, Human
ugggagggagcagacagga

SEQ ID NO: 2296012 - RNA, 15 nt, Human
ugggaggcugaggcg

SEQ ID NO: 2296013 - RNA, 14 nt, Human
ugggaggcugaggc

SEQ ID NO: 2296014 - RNA, 13 nt, Human
ugggaggcugagg

SEQ ID NO: 2296015 - RNA, 11 nt, Human
ugggaggcuga

SEQ ID NO: 2296016 - RNA, 19 nt, Human
ugggaggcugagaugggag

SEQ ID NO: 2296017 - RNA, 21 nt, Human
ugggaggauugcuugagcuca

SEQ ID NO: 2296018 - RNA, 18 nt, Human
ugggaggauugcuugagc

SEQ ID NO: 2296019 - RNA, 20 nt, Human
ugggaggauucuaugaggca

SEQ ID NO: 2296020 - RNA, 14 nt, Human
ugggaggcgcgagc

SEQ ID NO: 2296021 - RNA, 13 nt, Human
ugggaggcucacc

SEQ ID NO: 2296022 - RNA, 22 nt, Human
ugggaggcggagaguacaguga

SEQ ID NO: 2296023 - RNA, 17 nt, Human
ugggaggcgggagugga

SEQ ID NO: 2296024 - RNA, 22 nt, Human
ugggaggauugcuugagcucag

SEQ ID NO: 2296025 - RNA, 16 nt, Human
ugggagaaaugaaaaa

SEQ ID NO: 2296026 - RNA, 18 nt, Human
ugggagaaauugacagau

SEQ ID NO: 2296027 - RNA, 19 nt, Human
ugggagaaauugacagauc

SEQ ID NO: 2296028 - RNA, 18 nt, Human
ugggacuucuuuucacau

SEQ ID NO: 2296029 - RNA, 20 nt, Human
ugggacuucuuuucacauuc

SEQ ID NO: 2296030 - RNA, 21 nt, Human
ugggacuucuuuucacauucu

SEQ ID NO: 2296031 - RNA, 22 nt, Human
ugggacuucuuuucacauucuu

SEQ ID NO: 2296032 - RNA, 21 nt, Human
ugggagaaccaaaaagaggcu

SEQ ID NO: 2296033 - RNA, 22 nt, Human
agggagcggccggccagccccu

SEQ ID NO: 2296034 - RNA, 21 nt, Human
agggagcggccggccagcccc

SEQ ID NO: 2296035 - RNA, 18 nt, Human
ugggacuacaggcaccca

SEQ ID NO: 2296036 - RNA, 16 nt, Human
agggagcgagggagaa

SEQ ID NO: 2296037 - RNA, 14 nt, Human
agggagcggaaagc

SEQ ID NO: 2296038 - RNA, 22 nt, Human
agggagccuccugcccaguccc

SEQ ID NO: 2296039 - RNA, 18 nt, Human
agggagcggaaagcagcu

SEQ ID NO: 2296040 - RNA, 17 nt, Human
agggagcggaaagcagc

SEQ ID NO: 2296041 - RNA, 19 nt, Human
agggagcggccggccagcc

SEQ ID NO: 2296042 - RNA, 18 nt, Human
agggagccuuugguucug

SEQ ID NO: 2296043 - RNA, 14 nt, Human
agggagccuggccc

SEQ ID NO: 2296044 - RNA, 14 nt, Human
agggagccuccugc

SEQ ID NO: 2296045 - RNA, 15 nt, Human
agggagccuccugcc

SEQ ID NO: 2296046 - RNA, 16 nt, Human
agggagccuccugccc

SEQ ID NO: 2296047 - RNA, 17 nt, Human
agggagccuccugccca

SEQ ID NO: 2296048 - RNA, 15 nt, Human
agggagcauuuuccu

SEQ ID NO: 2296049 - RNA, 17 nt, Human
agggagcauuuuccucc

SEQ ID NO: 2296050 - RNA, 14 nt, Human
agggagcauggcug

SEQ ID NO: 2296051 - RNA, 20 nt, Human
agggagcauagaaggcaggu

SEQ ID NO: 2296052 - RNA, 21 nt, Human
agggagcauagaaggcaggug

SEQ ID NO: 2296053 - RNA, 17 nt, Human
agggagcauagaaggca

SEQ ID NO: 2296054 - RNA, 19 nt, Human
agggagcauagaaggcagg

SEQ ID NO: 2296055 - RNA, 18 nt, Human
agggagcaucagugcccu

SEQ ID NO: 2296056 - RNA, 17 nt, Human
agggagccccuuugaug

SEQ ID NO: 2296057 - RNA, 11 nt, Human
agggagccucc

SEQ ID NO: 2296058 - RNA, 13 nt, Human
agggagccuccug

SEQ ID NO: 2296059 - RNA, 16 nt, Human
ugggacuacaggugug

SEQ ID NO: 2296060 - RNA, 18 nt, Human
ugggacucaaugcacuga

SEQ ID NO: 2296061 - RNA, 13 nt, Human
ugggacuggccuc

SEQ ID NO: 2296062 - RNA, 18 nt, Human
ugggacugggagggccca

SEQ ID NO: 2296063 - RNA, 16 nt, Human
ugggacugggagggcc

SEQ ID NO: 2296064 - RNA, 15 nt, Human
ugggacugggagggc

SEQ ID NO: 2296065 - RNA, 13 nt, Human
ugggacugggagg

SEQ ID NO: 2296066 - RNA, 12 nt, Human
ugggacugggag

SEQ ID NO: 2296067 - RNA, 16 nt, Human
ugggacuggccucugc

SEQ ID NO: 2296068 - RNA, 14 nt, Human
ugggacuggccucu

SEQ ID NO: 2296069 - RNA, 15 nt, Human
ugggagaaaugaaaa

SEQ ID NO: 2296070 - RNA, 14 nt, Human
ugggacuuaacucc

SEQ ID NO: 2296071 - RNA, 17 nt, Human
ugggacuuccuugcucu

SEQ ID NO: 2296072 - RNA, 19 nt, Human
ugggacuggguuuggaccc

SEQ ID NO: 2296073 - RNA, 19 nt, Human
ugggacuuccuugcucucc

SEQ ID NO: 2296074 - RNA, 20 nt, Human
ugggacuuccuugcucuccc

SEQ ID NO: 2296075 - RNA, 13 nt, Human
ugggacuucuuuu

SEQ ID NO: 2296076 - RNA, 15 nt, Human
ugggacuucuuuuca

SEQ ID NO: 2296077 - RNA, 16 nt, Human
agggagagaccucauc

SEQ ID NO: 2296078 - RNA, 23 nt, Human
agggagagaccucaucaggauga

SEQ ID NO: 2296079 - RNA, 19 nt, Human
agggagcaggcggugggca

SEQ ID NO: 2296080 - RNA, 13 nt, Human
agggagagagaga

SEQ ID NO: 2296081 - RNA, 11 nt, Human
agggagagaga

SEQ ID NO: 2296082 - RNA, 14 nt, Human
agggagagaagaua

SEQ ID NO: 2296083 - RNA, 13 nt, Human
agggagagaagau

SEQ ID NO: 2296084 - RNA, 21 nt, Human
agggagaagacuauauuguac

SEQ ID NO: 2296085 - RNA, 13 nt, Human
agggagaagcucc

SEQ ID NO: 2296086 - RNA, 15 nt, Human
agggagaagaaguca

SEQ ID NO: 2296087 - RNA, 15 nt, Human
agggagaaggaucua

SEQ ID NO: 2296088 - RNA, 16 nt, Human
agggagaaggaucuag

SEQ ID NO: 2296089 - RNA, 22 nt, Human
agggagaaggaucuagaaugug

SEQ ID NO: 2296090 - RNA, 19 nt, Human
agggagacccguccauuug

SEQ ID NO: 2296091 - RNA, 12 nt, Human
agggagacagag

SEQ ID NO: 2296092 - RNA, 18 nt, Human
agggagaagggauggagg

SEQ ID NO: 2296093 - RNA, 20 nt, Human
agggagacacuggccccuca

SEQ ID NO: 2296094 - RNA, 20 nt, Human
agggacuuggaagcuccgcu

SEQ ID NO: 2296095 - RNA, 16 nt, Human
agggaaaugaucaguu

SEQ ID NO: 2296096 - RNA, 23 nt, Human
agggaaauagaaaaacccugccc

SEQ ID NO: 2296097 - RNA, 14 nt, Human
agggacuugaaguu

SEQ ID NO: 2296098 - RNA, 15 nt, Human
agggacuugaaguug

SEQ ID NO: 2296099 - RNA, 16 nt, Human
agggacuugaaguugu

SEQ ID NO: 2296100 - RNA, 13 nt, Human
agggagaaauguu

SEQ ID NO: 2296101 - RNA, 16 nt, Human
agggagaagaaaggug

SEQ ID NO: 2296102 - RNA, 18 nt, Human
agggacuuggaagcuccg

SEQ ID NO: 2296103 - RNA, 19 nt, Human
agggacuuggaagcuccgc

SEQ ID NO: 2296104 - RNA, 15 nt, Human
agggacuuggaagcu

SEQ ID NO: 2296105 - RNA, 23 nt, Human
agggacuucugucuucacaacag

SEQ ID NO: 2296106 - RNA, 14 nt, Human
agggaaaugaaaga

SEQ ID NO: 2296107 - RNA, 15 nt, Human
agggaaauaucauuu

SEQ ID NO: 2296108 - RNA, 19 nt, Human
agggaaaggggugcuuuua

SEQ ID NO: 2296109 - RNA, 15 nt, Human
agggaaauagaaaaa

SEQ ID NO: 2296110 - RNA, 22 nt, Human
agggaaauagaaaaacccugcc

SEQ ID NO: 2296111 - RNA, 22 nt, Human
agggaaaggcucugaaagccag

SEQ ID NO: 2296112 - RNA, 15 nt, Human
agggaaaggggugcu

SEQ ID NO: 2296113 - RNA, 18 nt, Human
agggaaaggggugcuuuu

SEQ ID NO: 2296114 - RNA, 18 nt, Human
agggaaaggauauuuucu

SEQ ID NO: 2296115 - RNA, 23 nt, Human
agggaaagaaaguugcacggcug

SEQ ID NO: 2296116 - RNA, 12 nt, Human
agggaaagaaaa

SEQ ID NO: 2296117 - RNA, 15 nt, Human
agggaaacuucccgu

SEQ ID NO: 2296118 - RNA, 19 nt, Human
agggaaagaaaaggaaggc

SEQ ID NO: 2296119 - RNA, 20 nt, Human
agggcugucaucugugcacu

SEQ ID NO: 2296120 - RNA, 19 nt, Human
agggcugucaucugugcac

SEQ ID NO: 2296121 - RNA, 18 nt, Human
agggcugucaucugugca

SEQ ID NO: 2296122 - RNA, 22 nt, Human
agggcuguuauaaucuuucaca

SEQ ID NO: 2296123 - RNA, 16 nt, Human
agggcuggucucugcu

SEQ ID NO: 2296124 - RNA, 23 nt, Human
agggcuggcccagcccugcuggc

SEQ ID NO: 2296125 - RNA, 22 nt, Human
agggcuggaccuauguccuaag

SEQ ID NO: 2296126 - RNA, 13 nt, Human
agggcuggcccag

SEQ ID NO: 2296127 - RNA, 14 nt, Human
agggcuggcccagc

SEQ ID NO: 2296128 - RNA, 15 nt, Human
agggcuggcccagcc

SEQ ID NO: 2296129 - RNA, 16 nt, Human
agggcuggcccagccc

SEQ ID NO: 2296130 - RNA, 17 nt, Human
agggcuggcccagcccu

SEQ ID NO: 2296131 - RNA, 18 nt, Human
agggcuggcccagcccug

SEQ ID NO: 2296132 - RNA, 19 nt, Human
agggcuggcccagcccugc

SEQ ID NO: 2296133 - RNA, 20 nt, Human
agggcuggcccagcccugcu

SEQ ID NO: 2296134 - RNA, 22 nt, Human
agggcuggcccagcccugcugg

SEQ ID NO: 2296135 - RNA, 20 nt, Human
ugggcucuccaccucagccu

SEQ ID NO: 2296136 - RNA, 19 nt, Human
ugggcucuccaccucagcc

SEQ ID NO: 2296137 - RNA, 18 nt, Human
ugggcucuccaccucagc

SEQ ID NO: 2296138 - RNA, 17 nt, Human
ugggcucuccaccucag

SEQ ID NO: 2296139 - RNA, 16 nt, Human
ugggcucuccaccuca

SEQ ID NO: 2296140 - RNA, 15 nt, Human
ugggcucuccaccuc

SEQ ID NO: 2296141 - RNA, 14 nt, Human
ugggcucuccaccu

SEQ ID NO: 2296142 - RNA, 17 nt, Human
ugggcucgucuuugcag

SEQ ID NO: 2296143 - RNA, 21 nt, Human
ugggcucuccaccucagccuu

SEQ ID NO: 2296144 - RNA, 19 nt, Human
ugggcucugacagaaagca

SEQ ID NO: 2296145 - RNA, 23 nt, Human
ugggcucuccaccucagccuugg

SEQ ID NO: 2296146 - RNA, 15 nt, Human
ugggcuccuccaggg

SEQ ID NO: 2296147 - RNA, 13 nt, Human
ugggcuccuccag

SEQ ID NO: 2296148 - RNA, 23 nt, Human
ugggcuccuccagggugugugcu

SEQ ID NO: 2296149 - RNA, 14 nt, Human
ugggcucgcccacc

SEQ ID NO: 2296150 - RNA, 17 nt, Human
ugggcucggaggcugcc

SEQ ID NO: 2296151 - RNA, 15 nt, Human
ugggcucgucuuugc

SEQ ID NO: 2296152 - RNA, 16 nt, Human
ugggcucgucuuugca

SEQ ID NO: 2296153 - RNA, 16 nt, Human
ugggcucaagcagucu

SEQ ID NO: 2296154 - RNA, 11 nt, Human
ugggcucccug

SEQ ID NO: 2296155 - RNA, 14 nt, Human
ugggcucccuuccc

SEQ ID NO: 2296156 - RNA, 17 nt, Human
ugggcucccuugugcgu

SEQ ID NO: 2296157 - RNA, 21 nt, Human
ugggcucccuucccaccucuc

SEQ ID NO: 2296158 - RNA, 15 nt, Human
ugggcucccuuccca

SEQ ID NO: 2296159 - RNA, 19 nt, Human
ugggcucccugacugggag

SEQ ID NO: 2296160 - RNA, 15 nt, Human
ugggcucccugacug

SEQ ID NO: 2296161 - RNA, 15 nt, Human
agggcucccugcccu

SEQ ID NO: 2296162 - RNA, 11 nt, Human
agggcucccca

SEQ ID NO: 2296163 - RNA, 20 nt, Human
agggcuccccacugccuacu

SEQ ID NO: 2296164 - RNA, 11 nt, Human
agggcuccugc

SEQ ID NO: 2296165 - RNA, 12 nt, Human
agggcuccugcc

SEQ ID NO: 2296166 - RNA, 14 nt, Human
agggcuccugccuu

SEQ ID NO: 2296167 - RNA, 21 nt, Human
agggcugacacguccacccca

SEQ ID NO: 2296168 - RNA, 12 nt, Human
agggcuccuggg

SEQ ID NO: 2296169 - RNA, 15 nt, Human
agggcuccugccuuc

SEQ ID NO: 2296170 - RNA, 22 nt, Human
agggcuccugccuucuguccug

SEQ ID NO: 2296171 - RNA, 17 nt, Human
agggcugagcucucugu

SEQ ID NO: 2296172 - RNA, 16 nt, Human
agggcugagcugggga

SEQ ID NO: 2296173 - RNA, 13 nt, Human
agggcugccacca

SEQ ID NO: 2296174 - RNA, 17 nt, Human
agggcugcuagacggag

SEQ ID NO: 2296175 - RNA, 13 nt, Human
agggcugcuguga

SEQ ID NO: 2296176 - RNA, 14 nt, Human
agggcuggacugag

SEQ ID NO: 2296177 - RNA, 15 nt, Human
agggcuggacugagg

SEQ ID NO: 2296178 - RNA, 22 nt, Human
agggcuggaaucuggagagcua

SEQ ID NO: 2296179 - RNA, 12 nt, Human
agggcuggaccu

SEQ ID NO: 2296180 - RNA, 13 nt, Human
agggcuggaccua

SEQ ID NO: 2296181 - RNA, 16 nt, Human
agggcuggacugaggc

SEQ ID NO: 2296182 - RNA, 17 nt, Human
agggcuggacugaggcc

SEQ ID NO: 2296183 - RNA, 18 nt, Human
agggcuggacugaggccu

SEQ ID NO: 2296184 - RNA, 20 nt, Human
agggcuggacugaggccuga

SEQ ID NO: 2296185 - RNA, 17 nt, Human
agggcccaggcaggcca

SEQ ID NO: 2296186 - RNA, 12 nt, Human
agggccccagca

SEQ ID NO: 2296187 - RNA, 18 nt, Human
agggccccagaaggcagg

SEQ ID NO: 2296188 - RNA, 18 nt, Human
agggccccagcacuaaag

SEQ ID NO: 2296189 - RNA, 14 nt, Human
agggccccagcacu

SEQ ID NO: 2296190 - RNA, 19 nt, Human
agggccccucacccugccu

SEQ ID NO: 2296191 - RNA, 20 nt, Human
agggcuccagacacaugucc

SEQ ID NO: 2296192 - RNA, 11 nt, Human
agggccccucu

SEQ ID NO: 2296193 - RNA, 15 nt, Human
agggcccaggcaggc

SEQ ID NO: 2296194 - RNA, 14 nt, Human
agggcccaggcagg

SEQ ID NO: 2296195 - RNA, 21 nt, Human
agggcccagagcccagcucca

SEQ ID NO: 2296196 - RNA, 20 nt, Human
agggcccagagcccagcucc

SEQ ID NO: 2296197 - RNA, 19 nt, Human
agggcccagagcccagcuc

SEQ ID NO: 2296198 - RNA, 18 nt, Human
agggcccagagcccagcu

SEQ ID NO: 2296199 - RNA, 17 nt, Human
agggcccagagcccagc

SEQ ID NO: 2296200 - RNA, 16 nt, Human
agggccaagacuuggc

SEQ ID NO: 2296201 - RNA, 18 nt, Human
agggccacacuauuacca

SEQ ID NO: 2296202 - RNA, 24 nt, Human
agggccacacuauuaccaugagaa

SEQ ID NO: 2296203 - RNA, 14 nt, Human
agggcccagagagg

SEQ ID NO: 2296204 - RNA, 21 nt, Human
agggaguuaucuaaaagaaau

SEQ ID NO: 2296205 - RNA, 14 nt, Human
agggauacacugaa

SEQ ID NO: 2296206 - RNA, 16 nt, Human
agggauacaugcucuu

SEQ ID NO: 2296207 - RNA, 15 nt, Human
agggauaagguaccu

SEQ ID NO: 2296208 - RNA, 17 nt, Human
agggcacugguggcccg

SEQ ID NO: 2296209 - RNA, 15 nt, Human
agggcagagccggga

SEQ ID NO: 2296210 - RNA, 22 nt, Human
agggcagaacacuaaccugacc

SEQ ID NO: 2296211 - RNA, 15 nt, Human
agggcagaacacuaa

SEQ ID NO: 2296212 - RNA, 17 nt, Human
agggcagaacacuaacc

SEQ ID NO: 2296213 - RNA, 16 nt, Human
agggcacuucacagag

SEQ ID NO: 2296214 - RNA, 17 nt, Human
agggcacuucacagagu

SEQ ID NO: 2296215 - RNA, 23 nt, Human
agggcacuucacagagugugcug

SEQ ID NO: 2296216 - RNA, 19 nt, Human
agggcagaaagguucugcc

SEQ ID NO: 2296217 - RNA, 20 nt, Human
agggcagaaagguucugccc

SEQ ID NO: 2296218 - RNA, 15 nt, Human
agggcagaggcugga

SEQ ID NO: 2296219 - RNA, 14 nt, Human
agggcagaggcugg

SEQ ID NO: 2296220 - RNA, 22 nt, Human
agggcagaggcuggaggcaggg

SEQ ID NO: 2296221 - RNA, 17 nt, Human
agggcagagucacacgg

SEQ ID NO: 2296222 - RNA, 20 nt, Human
agggcagaggcuggaggcag

SEQ ID NO: 2296223 - RNA, 17 nt, Human
agggcagaggcuggagg

SEQ ID NO: 2296224 - RNA, 20 nt, Human
agggcagucgauagagcugu

SEQ ID NO: 2296225 - RNA, 12 nt, Human
agggcagaguga

SEQ ID NO: 2296226 - RNA, 13 nt, Human
agggcaguguuuc

SEQ ID NO: 2296227 - RNA, 15 nt, Human
agggcaguguuuccu

SEQ ID NO: 2296228 - RNA, 16 nt, Human
agggcaguguuuccuu

SEQ ID NO: 2296229 - RNA, 17 nt, Human
agggcaguguuuccuuu

SEQ ID NO: 2296230 - RNA, 18 nt, Human
agggcaguguuuccuuuu

SEQ ID NO: 2296231 - RNA, 17 nt, Human
agggccaacccuucucc

SEQ ID NO: 2296232 - RNA, 21 nt, Human
agggccaacccuucuccucuu

SEQ ID NO: 2296233 - RNA, 21 nt, Human
agggccaagcccagcacugcu

SEQ ID NO: 2296234 - RNA, 23 nt, Human
agggccaacuugagggcccagag

SEQ ID NO: 2296235 - RNA, 15 nt, Human
agggccaacccuucu

SEQ ID NO: 2296236 - RNA, 16 nt, Human
agggccaacccuucuc

SEQ ID NO: 2296237 - RNA, 12 nt, Human
agggcccagaga

SEQ ID NO: 2296238 - RNA, 13 nt, Human
agggcccagagag

SEQ ID NO: 2296239 - RNA, 17 nt, Human
agggcaucaugcaucuu

SEQ ID NO: 2296240 - RNA, 22 nt, Human
agggcauaaugaugaugggaau

SEQ ID NO: 2296241 - RNA, 18 nt, Human
agggcauccuucugccuu

SEQ ID NO: 2296242 - RNA, 13 nt, Human
agggcaucuccag

SEQ ID NO: 2296243 - RNA, 14 nt, Human
agggcaucuccagg

SEQ ID NO: 2296244 - RNA, 15 nt, Human
agggcaucuccagga

SEQ ID NO: 2296245 - RNA, 15 nt, Human
agggcauaaugauga

SEQ ID NO: 2296246 - RNA, 19 nt, Human
agggcauaaugaugauggg

SEQ ID NO: 2296247 - RNA, 16 nt, Human
agggcaucuccaggaa

SEQ ID NO: 2296248 - RNA, 19 nt, Human
agggcaucuccaggaaggc

SEQ ID NO: 2296249 - RNA, 17 nt, Human
agggcauggccaggugg

SEQ ID NO: 2296250 - RNA, 19 nt, Human
agggcauuugagaaaugca

SEQ ID NO: 2296251 - RNA, 22 nt, Human
agggcauuugagaaaugcauau

SEQ ID NO: 2296252 - RNA, 22 nt, Human
agggcaucuccaggaaggcggg

SEQ ID NO: 2296253 - RNA, 13 nt, Human
agggcauuggcca

SEQ ID NO: 2296254 - RNA, 15 nt, Human
ugggcauuugugagg

SEQ ID NO: 2296255 - RNA, 20 nt, Human
ugggcauugcuuuccacuga

SEQ ID NO: 2296256 - RNA, 15 nt, Human
ugggcauugcuuucc

SEQ ID NO: 2296257 - RNA, 14 nt, Human
ugggcauugcuuuc

SEQ ID NO: 2296258 - RNA, 16 nt, Human
ugggcauuugugaggc

SEQ ID NO: 2296259 - RNA, 23 nt, Human
ugggccaacaaagaacacuaacu

SEQ ID NO: 2296260 - RNA, 13 nt, Human
ugggcauugcuuu

SEQ ID NO: 2296261 - RNA, 12 nt, Human
ugggcauugcuu

SEQ ID NO: 2296262 - RNA, 23 nt, Human
ugggcauugauggggaaggaggc

SEQ ID NO: 2296263 - RNA, 18 nt, Human
ugggcauugauggggaag

SEQ ID NO: 2296264 - RNA, 17 nt, Human
ugggcauugauggggaa

SEQ ID NO: 2296265 - RNA, 20 nt, Human
ugggccaagucaaagacauu

SEQ ID NO: 2296266 - RNA, 16 nt, Human
ugggccaacucaccug

SEQ ID NO: 2296267 - RNA, 17 nt, Human
agggagggagggcucca

SEQ ID NO: 2296268 - RNA, 15 nt, Human
agggagggccugggc

SEQ ID NO: 2296269 - RNA, 13 nt, Human
agggagggccugg

SEQ ID NO: 2296270 - RNA, 12 nt, Human
agggagggcucc

SEQ ID NO: 2296271 - RNA, 17 nt, Human
agggagggcuccagaca

SEQ ID NO: 2296272 - RNA, 19 nt, Human
agggagggcuccagacaca

SEQ ID NO: 2296273 - RNA, 20 nt, Human
agggaguccgaaagggacuu

SEQ ID NO: 2296274 - RNA, 20 nt, Human
agggagguguuuaaagagag

SEQ ID NO: 2296275 - RNA, 22 nt, Human
agggagguguuuaaagagaggu

SEQ ID NO: 2296276 - RNA, 23 nt, Human
agggagguguuuaaagagagguu

SEQ ID NO: 2296277 - RNA, 15 nt, Human
agggagggcugucau

SEQ ID NO: 2296278 - RNA, 22 nt, Human
agggagggcuccagacacaugu

SEQ ID NO: 2296279 - RNA, 23 nt, Human
agggaguccgaaagggacuugga

SEQ ID NO: 2296280 - RNA, 14 nt, Human
agggaguccccucc

SEQ ID NO: 2296281 - RNA, 22 nt, Human
agggaguccccuccccggcccu

SEQ ID NO: 2296282 - RNA, 15 nt, Human
agggaguccccuccc

SEQ ID NO: 2296283 - RNA, 16 nt, Human
agggaguccccucccc

SEQ ID NO: 2296284 - RNA, 20 nt, Human
agggagugacagaggcagcc

SEQ ID NO: 2296285 - RNA, 20 nt, Human
agggagugaguugauagcac

SEQ ID NO: 2296286 - RNA, 18 nt, Human
aggcugggcguaguggcu

SEQ ID NO: 2296287 - RNA, 14 nt, Human
aggcugggcuucag

SEQ ID NO: 2296288 - RNA, 21 nt, Human
aggcugggcucccuucccacc

SEQ ID NO: 2296289 - RNA, 23 nt, Human
aggcugggcucccuucccaccuc

SEQ ID NO: 2296290 - RNA, 13 nt, Human
aggcugggcuccc

SEQ ID NO: 2296291 - RNA, 14 nt, Human
aggcugggcucccu

SEQ ID NO: 2296292 - RNA, 18 nt, Human
aggcugggcucccuuccc

SEQ ID NO: 2296293 - RNA, 19 nt, Human
aggcugggagagccuucca

SEQ ID NO: 2296294 - RNA, 16 nt, Human
aggcugggagagccuu

SEQ ID NO: 2296295 - RNA, 20 nt, Human
ugggaaccccuucauccucu

SEQ ID NO: 2296296 - RNA, 22 nt, Human
ugggaaccccuucauccucuga

SEQ ID NO: 2296297 - RNA, 22 nt, Human
ugggaaaugguaugagcugagg

SEQ ID NO: 2296298 - RNA, 23 nt, Human
ugggaaaugguaugagcugaggg

SEQ ID NO: 2296299 - RNA, 20 nt, Human
ugggaacccaaguccaagca

SEQ ID NO: 2296300 - RNA, 22 nt, Human
aggcugggagagccuuccaggg

SEQ ID NO: 2296301 - RNA, 21 nt, Human
ugggaaccccccucccaccca

SEQ ID NO: 2296302 - RNA, 13 nt, Human
aggcugggcaagg

SEQ ID NO: 2296303 - RNA, 20 nt, Human
aggcugggagagccuuccag

SEQ ID NO: 2296304 - RNA, 21 nt, Human
aggcugggagagccuuccagg

SEQ ID NO: 2296305 - RNA, 22 nt, Human
aggcugggggaagaagcucucu

SEQ ID NO: 2296306 - RNA, 10 nt, Human
aggcuggguc

SEQ ID NO: 2296307 - RNA, 15 nt, Human
aggcugggucgcccu

SEQ ID NO: 2296308 - RNA, 18 nt, Human
aggcugggucgcccugga

SEQ ID NO: 2296309 - RNA, 20 nt, Human
aggcugggucgcccuggacu

SEQ ID NO: 2296310 - RNA, 21 nt, Human
aggcugggucgcccuggacug

SEQ ID NO: 2296311 - RNA, 14 nt, Human
aggcuggguucuga

SEQ ID NO: 2296312 - RNA, 17 nt, Human
aggcuggguucugaucc

SEQ ID NO: 2296313 - RNA, 18 nt, Human
aggcugggcuucaguggc

SEQ ID NO: 2296314 - RNA, 19 nt, Human
aggcugggcuucaguggca

SEQ ID NO: 2296315 - RNA, 20 nt, Human
aggcugggcuucaguggcag

SEQ ID NO: 2296316 - RNA, 21 nt, Human
aggcugggcuucaguggcagc

SEQ ID NO: 2296317 - RNA, 17 nt, Human
aggcugggggaagaagc

SEQ ID NO: 2296318 - RNA, 16 nt, Human
aggcuggggaaguccu

SEQ ID NO: 2296319 - RNA, 18 nt, Human
aggcuggggaaguccucu

SEQ ID NO: 2296320 - RNA, 21 nt, Human
aggcuggggaaguccucuggg

SEQ ID NO: 2296321 - RNA, 22 nt, Human
aggcuggggaaguccucugggu

SEQ ID NO: 2296322 - RNA, 12 nt, Human
aggcuggggcug

SEQ ID NO: 2296323 - RNA, 22 nt, Human
aggcugggcuucaguggcagcu

SEQ ID NO: 2296324 - RNA, 23 nt, Human
aggcugggcuucaguggcagcug

SEQ ID NO: 2296325 - RNA, 16 nt, Human
agggaaaagcagcucu

SEQ ID NO: 2296326 - RNA, 16 nt, Human
agggaaacuauugucc

SEQ ID NO: 2296327 - RNA, 22 nt, Human
agggaaaaugcagcagggaugc

SEQ ID NO: 2296328 - RNA, 17 nt, Human
agggaaaaugcagcagg

SEQ ID NO: 2296329 - RNA, 18 nt, Human
agggaaaauuauuugcau

SEQ ID NO: 2296330 - RNA, 15 nt, Human
agggaaacugccagc

SEQ ID NO: 2296331 - RNA, 14 nt, Human
agggaaacugccag

SEQ ID NO: 2296332 - RNA, 23 nt, Human
agggaaacugccagcaacgcagg

SEQ ID NO: 2296333 - RNA, 21 nt, Human
agggaaacugccagcaacgca

SEQ ID NO: 2296334 - RNA, 19 nt, Human
agggaaacugccagcaacg

SEQ ID NO: 2296335 - RNA, 16 nt, Human
agggaaacugccagca

SEQ ID NO: 2296336 - RNA, 20 nt, Human
aggcuugucagagcugggag

SEQ ID NO: 2296337 - RNA, 17 nt, Human
aggcuugucagagcugg

SEQ ID NO: 2296338 - RNA, 16 nt, Human
aggcuugucagagcug

SEQ ID NO: 2296339 - RNA, 18 nt, Human
aggcuugucagagcuggg

SEQ ID NO: 2296340 - RNA, 15 nt, Human
aggcuuucacuauuu

SEQ ID NO: 2296341 - RNA, 20 nt, Human
aggcuuucacuauuuccuuu

SEQ ID NO: 2296342 - RNA, 19 nt, Human
aggcuuucacuauuuccuu

SEQ ID NO: 2296343 - RNA, 15 nt, Human
aggcuuuuuuaucau

SEQ ID NO: 2296344 - RNA, 19 nt, Human
aggcuuuggauuugacauu

SEQ ID NO: 2296345 - RNA, 18 nt, Human
agggaaaacauuccaucc

SEQ ID NO: 2296346 - RNA, 16 nt, Human
agggaaaacauuccau

SEQ ID NO: 2296347 - RNA, 15 nt, Human
agggaaaacauucca

SEQ ID NO: 2296348 - RNA, 18 nt, Human
aggcuuuuuuaucaugug

SEQ ID NO: 2296349 - RNA, 21 nt, Human
aggcuuuuuuaucaugugaaa

SEQ ID NO: 2296350 - RNA, 17 nt, Human
aggcuugccugcaggca

SEQ ID NO: 2296351 - RNA, 14 nt, Human
aggcuugcugagag

SEQ ID NO: 2296352 - RNA, 19 nt, Human
aggcuugcugagaggggcu

SEQ ID NO: 2296353 - RNA, 20 nt, Human
aggcuugcugagaggggcug

SEQ ID NO: 2296354 - RNA, 15 nt, Human
aggcuugucagagcu

SEQ ID NO: 2296355 - RNA, 22 nt, Human
aggcuugggaccgccagauggg

SEQ ID NO: 2296356 - RNA, 15 nt, Human
aggcuugccugcagg

SEQ ID NO: 2296357 - RNA, 16 nt, Human
aggcuugccugcaggc

SEQ ID NO: 2296358 - RNA, 18 nt, Human
aggcuugcauaauaagcu

SEQ ID NO: 2296359 - RNA, 23 nt, Human
aggcuucuucagaucagugcuug

SEQ ID NO: 2296360 - RNA, 22 nt, Human
aggcuucuucagaucagugcuu

SEQ ID NO: 2296361 - RNA, 16 nt, Human
aggcuucuucagauca

SEQ ID NO: 2296362 - RNA, 13 nt, Human
aggcuuccuuggc

SEQ ID NO: 2296363 - RNA, 21 nt, Human
aggcuuccuucauuuccuccg

SEQ ID NO: 2296364 - RNA, 22 nt, Human
aggcuuccugcguccuccucac

SEQ ID NO: 2296365 - RNA, 22 nt, Human
aggcuucuccaauucugcccaa

SEQ ID NO: 2296366 - RNA, 14 nt, Human
aggcuucuccgcca

SEQ ID NO: 2296367 - RNA, 15 nt, Human
aggcuucuccgccag

SEQ ID NO: 2296368 - RNA, 16 nt, Human
aggcuucuccgccagc

SEQ ID NO: 2296369 - RNA, 17 nt, Human
aggcuucuccgccagcc

SEQ ID NO: 2296370 - RNA, 18 nt, Human
aggcuucuccgccagccu

SEQ ID NO: 2296371 - RNA, 19 nt, Human
aggcuucuccgccagccuc

SEQ ID NO: 2296372 - RNA, 20 nt, Human
aggcuucuccgccagccucc

SEQ ID NO: 2296373 - RNA, 21 nt, Human
aggcuucuccgccagccuccu

SEQ ID NO: 2296374 - RNA, 22 nt, Human
aggcuucuccgccagccuccuc

SEQ ID NO: 2296375 - RNA, 23 nt, Human
aggcuucuccgccagccuccucu

SEQ ID NO: 2296376 - RNA, 23 nt, Human
aggcuucugguugaugccuguga

SEQ ID NO: 2296377 - RNA, 16 nt, Human
aggcuucucucugugg

SEQ ID NO: 2296378 - RNA, 18 nt, Human
aggcuucucucucaccag

SEQ ID NO: 2296379 - RNA, 12 nt, Human
aggcuucucucu

SEQ ID NO: 2296380 - RNA, 13 nt, Human
aggcuucucucuc

SEQ ID NO: 2296381 - RNA, 14 nt, Human
aggcuucucucuca

SEQ ID NO: 2296382 - RNA, 16 nt, Human
aggcuucucucucacc

SEQ ID NO: 2296383 - RNA, 16 nt, Human
aggcuggggcugaccu

SEQ ID NO: 2296384 - RNA, 21 nt, Human
aggcuggggcugaccuuccuc

SEQ ID NO: 2296385 - RNA, 21 nt, Human
aggcuuagucacugagacagc

SEQ ID NO: 2296386 - RNA, 22 nt, Human
aggcuuagucacugagacagcc

SEQ ID NO: 2296387 - RNA, 23 nt, Human
aggcuuagucacugagacagccc

SEQ ID NO: 2296388 - RNA, 14 nt, Human
aggcuuaguuugug

SEQ ID NO: 2296389 - RNA, 13 nt, Human
aggcuuccagaga

SEQ ID NO: 2296390 - RNA, 14 nt, Human
aggcuuccagagag

SEQ ID NO: 2296391 - RNA, 23 nt, Human
aggcuuccagagaguccucugga

SEQ ID NO: 2296392 - RNA, 10 nt, Human
aggcuuccug

SEQ ID NO: 2296393 - RNA, 20 nt, Human
aggcuuccugcguccuccuc

SEQ ID NO: 2296394 - RNA, 21 nt, Human
aggcuuccugcguccuccuca

SEQ ID NO: 2296395 - RNA, 19 nt, Human
aggcuuccuucauuuccuc

SEQ ID NO: 2296396 - RNA, 18 nt, Human
aggcuuccuucauuuccu

SEQ ID NO: 2296397 - RNA, 16 nt, Human
aggcuuccuucauuuc

SEQ ID NO: 2296398 - RNA, 14 nt, Human
aggcuuccuucauu

SEQ ID NO: 2296399 - RNA, 12 nt, Human
aggcuucacccu

SEQ ID NO: 2296400 - RNA, 20 nt, Human
aggcuucagcauauuuauag

SEQ ID NO: 2296401 - RNA, 15 nt, Human
aggcuuaguuugugu

SEQ ID NO: 2296402 - RNA, 15 nt, Human
ugggaaacagaggcu

SEQ ID NO: 2296403 - RNA, 16 nt, Human
ugggaaaacacugcca

SEQ ID NO: 2296404 - RNA, 18 nt, Human
ugggaaacuuggcucgaa

SEQ ID NO: 2296405 - RNA, 23 nt, Human
ugggaaaauaccccaucauucau

SEQ ID NO: 2296406 - RNA, 21 nt, Human
ugggaaagaaggcaaaguccc

SEQ ID NO: 2296407 - RNA, 23 nt, Human
ugggaaagacauccauaaagaag

SEQ ID NO: 2296408 - RNA, 16 nt, Human
ugggaaagcauuguaa

SEQ ID NO: 2296409 - RNA, 14 nt, Human
ugggaaagcauugu

SEQ ID NO: 2296410 - RNA, 15 nt, Human
ugggaaauggcuuga

SEQ ID NO: 2296411 - RNA, 20 nt, Human
ugggaaaugagaaggcagcc

SEQ ID NO: 2296412 - RNA, 20 nt, Human
ugggaacaccauaggucacc

SEQ ID NO: 2296413 - RNA, 19 nt, Human
ugggaaauauuuagcaaau

SEQ ID NO: 2296414 - RNA, 20 nt, Human
ugggaaauauuuagcaaaua

SEQ ID NO: 2296415 - RNA, 19 nt, Human
ugggaaaugagaaggcagc

SEQ ID NO: 2296416 - RNA, 21 nt, Human
ugggaaagcauuguaaaugug

SEQ ID NO: 2296417 - RNA, 18 nt, Human
ugggaaagcauuguaaau

SEQ ID NO: 2296418 - RNA, 17 nt, Human
ugggaaagcauuguaaa

SEQ ID NO: 2296419 - RNA, 20 nt, Human
uggcuucacggaagagccuu

SEQ ID NO: 2296420 - RNA, 17 nt, Human
uggcuucacggaagagc

SEQ ID NO: 2296421 - RNA, 16 nt, Human
uggcuuuugugcauua

SEQ ID NO: 2296422 - RNA, 15 nt, Human
uggcuuuugugcauu

SEQ ID NO: 2296423 - RNA, 19 nt, Human
uggcuuuuuuccuccugug

SEQ ID NO: 2296424 - RNA, 23 nt, Human
ugggaaaaaugcccuuaaaucau

SEQ ID NO: 2296425 - RNA, 17 nt, Human
uggcuucaaaauagaga

SEQ ID NO: 2296426 - RNA, 21 nt, Human
uggcuuuugugcauuaucuag

SEQ ID NO: 2296427 - RNA, 18 nt, Human
ugggaaacaaaaggauaa

SEQ ID NO: 2296428 - RNA, 22 nt, Human
uggcugugccucugccugucuc

SEQ ID NO: 2296429 - RNA, 16 nt, Human
uggcuguggagugugg

SEQ ID NO: 2296430 - RNA, 18 nt, Human
uggcugugccucugccug

SEQ ID NO: 2296431 - RNA, 19 nt, Human
uggcugugccucugccugu

SEQ ID NO: 2296432 - RNA, 14 nt, Human
uggcugugucuaaa

SEQ ID NO: 2296433 - RNA, 15 nt, Human
uggcugugucuaaac

SEQ ID NO: 2296434 - RNA, 17 nt, Human
uggcugugucuaaacug

SEQ ID NO: 2296435 - RNA, 17 nt, Human
uggcugaggaggccucc

SEQ ID NO: 2296436 - RNA, 16 nt, Human
uggcuguuggcugggg

SEQ ID NO: 2296437 - RNA, 18 nt, Human
uggcuguuggcugggggc

SEQ ID NO: 2296438 - RNA, 14 nt, Human
uggcuucacggaag

SEQ ID NO: 2296439 - RNA, 23 nt, Human
uggcuguuggcugggggccucag

SEQ ID NO: 2296440 - RNA, 23 nt, Human
uggcugcaaaggguaucaggugc

SEQ ID NO: 2296441 - RNA, 17 nt, Human
uggcugagccccugucu

SEQ ID NO: 2296442 - RNA, 13 nt, Human
uggcugagccccu

SEQ ID NO: 2296443 - RNA, 13 nt, Human
uggcugagcccug

SEQ ID NO: 2296444 - RNA, 16 nt, Human
uggcugagccuggcug

SEQ ID NO: 2296445 - RNA, 19 nt, Human
uggcugagauaugaacaua

SEQ ID NO: 2296446 - RNA, 20 nt, Human
uggcugagagaguggcauug

SEQ ID NO: 2296447 - RNA, 22 nt, Human
uggcugcagagcagugggccug

SEQ ID NO: 2296448 - RNA, 19 nt, Human
uggcugagccuggcuggca

SEQ ID NO: 2296449 - RNA, 19 nt, Human
uggcugagcggaugcaucu

SEQ ID NO: 2296450 - RNA, 12 nt, Human
uggcugcagcag

SEQ ID NO: 2296451 - RNA, 13 nt, Human
uggcugcagcagc

SEQ ID NO: 2296452 - RNA, 18 nt, Human
uggcugcagagcaguggg

SEQ ID NO: 2296453 - RNA, 15 nt, Human
uggcugcagagcagu

SEQ ID NO: 2296454 - RNA, 14 nt, Human
uggcugugccucug

SEQ ID NO: 2296455 - RNA, 15 nt, Human
uggcugugccucugc

SEQ ID NO: 2296456 - RNA, 16 nt, Human
uggcugugccucugcc

SEQ ID NO: 2296457 - RNA, 17 nt, Human
uggcugugccucugccu

SEQ ID NO: 2296458 - RNA, 23 nt, Human
uggcuguccagugcccauuccuc

SEQ ID NO: 2296459 - RNA, 12 nt, Human
uggcugugagga

SEQ ID NO: 2296460 - RNA, 15 nt, Human
uggcugugaggcccc

SEQ ID NO: 2296461 - RNA, 21 nt, Human
uggcugcagcagcgguggccu

SEQ ID NO: 2296462 - RNA, 23 nt, Human
uggcugcagcagcgguggccucu

SEQ ID NO: 2296463 - RNA, 16 nt, Human
uggcucacaccuguaa

SEQ ID NO: 2296464 - RNA, 16 nt, Human
uggcucaauccucuaa

SEQ ID NO: 2296465 - RNA, 19 nt, Human
uggcucacaccuguaaucc

SEQ ID NO: 2296466 - RNA, 12 nt, Human
uggcucacacug

SEQ ID NO: 2296467 - RNA, 13 nt, Human
uggcucacacuga

SEQ ID NO: 2296468 - RNA, 14 nt, Human
uggcucacacugag

SEQ ID NO: 2296469 - RNA, 15 nt, Human
uggcucacacugaga

SEQ ID NO: 2296470 - RNA, 16 nt, Human
uggcucacacugagaa

SEQ ID NO: 2296471 - RNA, 21 nt, Human
uggcuauauggcaagaaagcu

SEQ ID NO: 2296472 - RNA, 23 nt, Human
uggcuauaggugcuacaaaaaca

SEQ ID NO: 2296473 - RNA, 21 nt, Human
uggcucacugcaacuucugcc

SEQ ID NO: 2296474 - RNA, 21 nt, Human
uggcucacuauggugccaaug

SEQ ID NO: 2296475 - RNA, 16 nt, Human
uggcucacguguguga

SEQ ID NO: 2296476 - RNA, 16 nt, Human
uggcucacgccuguaa

SEQ ID NO: 2296477 - RNA, 20 nt, Human
uggcucacuaugaaucuauu

SEQ ID NO: 2296478 - RNA, 18 nt, Human
uggcucacuauggugcca

SEQ ID NO: 2296479 - RNA, 19 nt, Human
uggcucacgccuguaaucc

SEQ ID NO: 2296480 - RNA, 17 nt, Human
uggcucacgccuguaau

SEQ ID NO: 2296481 - RNA, 15 nt, Human
uggcucacccaagca

SEQ ID NO: 2296482 - RNA, 13 nt, Human
uggcucacgccug

SEQ ID NO: 2296483 - RNA, 16 nt, Human
uggcugacuuugcucu

SEQ ID NO: 2296484 - RNA, 21 nt, Human
uggcugacccagucccugggg

SEQ ID NO: 2296485 - RNA, 20 nt, Human
uggcugaccccaaagagccu

SEQ ID NO: 2296486 - RNA, 21 nt, Human
uggcugaccccaaagagccug

SEQ ID NO: 2296487 - RNA, 22 nt, Human
uggcugaccccaaagagccugg

SEQ ID NO: 2296488 - RNA, 20 nt, Human
uggcugacccagucccuggg

SEQ ID NO: 2296489 - RNA, 19 nt, Human
uggcugacccagucccugg

SEQ ID NO: 2296490 - RNA, 17 nt, Human
uggcugacccagucccu

SEQ ID NO: 2296491 - RNA, 16 nt, Human
uggcugacccaguccc

SEQ ID NO: 2296492 - RNA, 15 nt, Human
uggcugacccagucc

SEQ ID NO: 2296493 - RNA, 16 nt, Human
uggcugaaggacugug

SEQ ID NO: 2296494 - RNA, 21 nt, Human
uggcugaaauucuccuggagg

SEQ ID NO: 2296495 - RNA, 22 nt, Human
uggcugaaauucuccuggaggu

SEQ ID NO: 2296496 - RNA, 15 nt, Human
uggcugaacccugug

SEQ ID NO: 2296497 - RNA, 16 nt, Human
uggcugaacccugugc

SEQ ID NO: 2296498 - RNA, 18 nt, Human
uggcugaacccugugcug

SEQ ID NO: 2296499 - RNA, 20 nt, Human
uggcugaacccugugcuggu

SEQ ID NO: 2296500 - RNA, 13 nt, Human
uggcugaacucau

SEQ ID NO: 2296501 - RNA, 23 nt, Human
uggcugaacccugugcugguguc

SEQ ID NO: 2296502 - RNA, 11 nt, Human
uggcugaagga

SEQ ID NO: 2296503 - RNA, 12 nt, Human
uggcugaaggac

SEQ ID NO: 2296504 - RNA, 13 nt, Human
uggcugaaggacu

SEQ ID NO: 2296505 - RNA, 14 nt, Human
uggcugaaggacug

SEQ ID NO: 2296506 - RNA, 15 nt, Human
uggcugaaggacugu

SEQ ID NO: 2296507 - RNA, 23 nt, Human
uggcucuugauaccccccucugu

SEQ ID NO: 2296508 - RNA, 19 nt, Human
uggcucuuuggagaucaag

SEQ ID NO: 2296509 - RNA, 16 nt, Human
uggcugaaauucuccu

SEQ ID NO: 2296510 - RNA, 18 nt, Human
uggcugaaauucuccugg

SEQ ID NO: 2296511 - RNA, 19 nt, Human
uggcugaaauucuccugga

SEQ ID NO: 2296512 - RNA, 20 nt, Human
uggcugaaauucuccuggag

SEQ ID NO: 2296513 - RNA, 16 nt, Human
uggcucagccagcacu

SEQ ID NO: 2296514 - RNA, 13 nt, Human
uggcucagccagc

SEQ ID NO: 2296515 - RNA, 18 nt, Human
uggcucagacauguuuuc

SEQ ID NO: 2296516 - RNA, 12 nt, Human
uggcucagccag

SEQ ID NO: 2296517 - RNA, 19 nt, Human
uggcucuugauaccccccu

SEQ ID NO: 2296518 - RNA, 20 nt, Human
uggcucuugauaccccccuc

SEQ ID NO: 2296519 - RNA, 21 nt, Human
uggcucuugauaccccccucu

SEQ ID NO: 2296520 - RNA, 22 nt, Human
uggcuagaggccagccccaccc

SEQ ID NO: 2296521 - RNA, 21 nt, Human
uggcuagaggccagccccacc

SEQ ID NO: 2296522 - RNA, 23 nt, Human
uggcuagaggccagccccaccca

SEQ ID NO: 2296523 - RNA, 20 nt, Human
uggcuagaauauccuacuuc

SEQ ID NO: 2296524 - RNA, 19 nt, Human
uggcuagaggccagcccca

SEQ ID NO: 2296525 - RNA, 19 nt, Human
uggcuauaggugcuacaaa

SEQ ID NO: 2296526 - RNA, 15 nt, Human
uggcuauaggugcua

SEQ ID NO: 2296527 - RNA, 15 nt, Human
uggcuaagagugucc

SEQ ID NO: 2296528 - RNA, 15 nt, Human
uggcuaauucccaga

SEQ ID NO: 2296529 - RNA, 19 nt, Human
uggcuaauguacugcauau

SEQ ID NO: 2296530 - RNA, 17 nt, Human
uggcuaauguacugcau

SEQ ID NO: 2296531 - RNA, 14 nt, Human
aggcuccauuagga

SEQ ID NO: 2296532 - RNA, 12 nt, Human
aggcucauuuua

SEQ ID NO: 2296533 - RNA, 16 nt, Human
aggcuccagagggcac

SEQ ID NO: 2296534 - RNA, 15 nt, Human
aggcuccagagggca

SEQ ID NO: 2296535 - RNA, 18 nt, Human
uggcuaagcaaaauguga

SEQ ID NO: 2296536 - RNA, 14 nt, Human
uggcuaaauucaug

SEQ ID NO: 2296537 - RNA, 21 nt, Human
uggcuaacuauauuugcuuuu

SEQ ID NO: 2296538 - RNA, 17 nt, Human
aggcuccaggagcagcc

SEQ ID NO: 2296539 - RNA, 18 nt, Human
aggcuccaggagcagcca

SEQ ID NO: 2296540 - RNA, 19 nt, Human
aggcuccaggagcagccac

SEQ ID NO: 2296541 - RNA, 23 nt, Human
aggcuccaggagcagccacauuc

SEQ ID NO: 2296542 - RNA, 22 nt, Human
aggcuccaccccauccaguuca

SEQ ID NO: 2296543 - RNA, 14 nt, Human
aggcuccagagggc

SEQ ID NO: 2296544 - RNA, 13 nt, Human
aggcuccagaggg

SEQ ID NO: 2296545 - RNA, 13 nt, Human
aggcuccaggagc

SEQ ID NO: 2296546 - RNA, 14 nt, Human
aggcuccaggagca

SEQ ID NO: 2296547 - RNA, 16 nt, Human
aggcuccaggagcagc

SEQ ID NO: 2296548 - RNA, 22 nt, Human
aggcuccacuuggucugugaga

SEQ ID NO: 2296549 - RNA, 21 nt, Human
aggcuccacuuggucugugag

SEQ ID NO: 2296550 - RNA, 17 nt, Human
aggcuccacuuggucug

SEQ ID NO: 2296551 - RNA, 11 nt, Human
aggcuccacuu

SEQ ID NO: 2296552 - RNA, 10 nt, Human
aggcucaggu

SEQ ID NO: 2296553 - RNA, 21 nt, Human
aggcucagagaugugcaccca

SEQ ID NO: 2296554 - RNA, 24 nt, Human
aggcucagagaugugcacccaugg

SEQ ID NO: 2296555 - RNA, 23 nt, Human
aggcucagucucaggagcauggg

SEQ ID NO: 2296556 - RNA, 19 nt, Human
aggcucagucucaggagca

SEQ ID NO: 2296557 - RNA, 22 nt, Human
aggcucauagggaagaccugcu

SEQ ID NO: 2296558 - RNA, 21 nt, Human
aggcucauagggaagaccugc

SEQ ID NO: 2296559 - RNA, 20 nt, Human
aggcucauagggaagaccug

SEQ ID NO: 2296560 - RNA, 18 nt, Human
aggcucagucucaggagc

SEQ ID NO: 2296561 - RNA, 17 nt, Human
aggcucagucucaggag

SEQ ID NO: 2296562 - RNA, 16 nt, Human
aggcucagucucagga

SEQ ID NO: 2296563 - RNA, 16 nt, Human
aggcucaggucccugg

SEQ ID NO: 2296564 - RNA, 23 nt, Human
aggcucacccccuucuccaucca

SEQ ID NO: 2296565 - RNA, 21 nt, Human
aggcucacccccuucuccauc

SEQ ID NO: 2296566 - RNA, 12 nt, Human
aggcucacugcc

SEQ ID NO: 2296567 - RNA, 13 nt, Human
aggcucacugcca

SEQ ID NO: 2296568 - RNA, 14 nt, Human
aggcucacugccag

SEQ ID NO: 2296569 - RNA, 15 nt, Human
aggcucacugccagg

SEQ ID NO: 2296570 - RNA, 19 nt, Human
aggcucacccccuucucca

SEQ ID NO: 2296571 - RNA, 16 nt, Human
aggcucacccccuucu

SEQ ID NO: 2296572 - RNA, 15 nt, Human
aggcucaacuaggga

SEQ ID NO: 2296573 - RNA, 16 nt, Human
aggcucaacuagggag

SEQ ID NO: 2296574 - RNA, 11 nt, Human
aggcucagaga

SEQ ID NO: 2296575 - RNA, 13 nt, Human
aggcucagagaug

SEQ ID NO: 2296576 - RNA, 14 nt, Human
aggcucagagaugu

SEQ ID NO: 2296577 - RNA, 16 nt, Human
aggcucacugccaggc

SEQ ID NO: 2296578 - RNA, 17 nt, Human
aggcucacugccaggcc

SEQ ID NO: 2296579 - RNA, 19 nt, Human
aggcucacugccaggccag

SEQ ID NO: 2296580 - RNA, 20 nt, Human
aggcucacugccaggccagc

SEQ ID NO: 2296581 - RNA, 21 nt, Human
aggcucacugccaggccagcc

SEQ ID NO: 2296582 - RNA, 22 nt, Human
aggcucacugccaggccagccu

SEQ ID NO: 2296583 - RNA, 23 nt, Human
aggcucacugccaggccagccuc

SEQ ID NO: 2296584 - RNA, 24 nt, Human
aggcucacugccaggccagccucc

SEQ ID NO: 2296585 - RNA, 21 nt, Human
aggccuuuagauauuauucau

SEQ ID NO: 2296586 - RNA, 15 nt, Human
aggccuuuaaaauuu

SEQ ID NO: 2296587 - RNA, 14 nt, Human
aggccuuuaaaauu

SEQ ID NO: 2296588 - RNA, 14 nt, Human
aggccuugucccag

SEQ ID NO: 2296589 - RNA, 14 nt, Human
aggcgagugccagg

SEQ ID NO: 2296590 - RNA, 15 nt, Human
aggcgagugccagga

SEQ ID NO: 2296591 - RNA, 17 nt, Human
aggcgagugccaggacu

SEQ ID NO: 2296592 - RNA, 18 nt, Human
aggcgagugccaggacuc

SEQ ID NO: 2296593 - RNA, 16 nt, Human
aggccuuuuggaaugu

SEQ ID NO: 2296594 - RNA, 17 nt, Human
aggccuucucugaagga

SEQ ID NO: 2296595 - RNA, 18 nt, Human
aggccuucucugaaggac

SEQ ID NO: 2296596 - RNA, 9 nt, Human
aggccuugc

SEQ ID NO: 2296597 - RNA, 13 nt, Human
uggccuguucugu

SEQ ID NO: 2296598 - RNA, 16 nt, Human
uggccugugucccaug

SEQ ID NO: 2296599 - RNA, 20 nt, Human
uggccugugucccaugaccc

SEQ ID NO: 2296600 - RNA, 22 nt, Human
uggccugugucccaugacccac

SEQ ID NO: 2296601 - RNA, 11 nt, Human
aggccuugcuc

SEQ ID NO: 2296602 - RNA, 21 nt, Human
uggccugugucccaugaccca

SEQ ID NO: 2296603 - RNA, 15 nt, Human
aggccuugcgcuguu

SEQ ID NO: 2296604 - RNA, 21 nt, Human
aggcuauuguccccuaaacca

SEQ ID NO: 2296605 - RNA, 19 nt, Human
aggcuauuauuuucacugu

SEQ ID NO: 2296606 - RNA, 18 nt, Human
aggcuauuauuuucacug

SEQ ID NO: 2296607 - RNA, 16 nt, Human
aggcuauuauuuucac

SEQ ID NO: 2296608 - RNA, 12 nt, Human
aggcggccccuc

SEQ ID NO: 2296609 - RNA, 15 nt, Human
aggcggacguuccag

SEQ ID NO: 2296610 - RNA, 17 nt, Human
aggcggacguuccagcc

SEQ ID NO: 2296611 - RNA, 18 nt, Human
aggcggacguuccagccg

SEQ ID NO: 2296612 - RNA, 15 nt, Human
aggcggagaguacag

SEQ ID NO: 2296613 - RNA, 20 nt, Human
aggcggagaguacagugagc

SEQ ID NO: 2296614 - RNA, 24 nt, Human
aggcggagaguacagugagccaag

SEQ ID NO: 2296615 - RNA, 14 nt, Human
aggcggccccuccc

SEQ ID NO: 2296616 - RNA, 23 nt, Human
aggcgauccaccugucucagccu

SEQ ID NO: 2296617 - RNA, 21 nt, Human
aggcgaucacaacgugcauug

SEQ ID NO: 2296618 - RNA, 19 nt, Human
aggcgaucacaacgugcau

SEQ ID NO: 2296619 - RNA, 20 nt, Human
aggcgaucacaacgugcauu

SEQ ID NO: 2296620 - RNA, 24 nt, Human
aggcgagugccaggacuccccagg

SEQ ID NO: 2296621 - RNA, 21 nt, Human
aggcgcacugugacccccagc

SEQ ID NO: 2296622 - RNA, 21 nt, Human
aggcgcacuuuccuccuggca

SEQ ID NO: 2296623 - RNA, 22 nt, Human
aggcgcacugugacccccagcu

SEQ ID NO: 2296624 - RNA, 21 nt, Human
aggcgcagugcuucucuacag

SEQ ID NO: 2296625 - RNA, 22 nt, Human
aggcgcacuuuccuccuggcag

SEQ ID NO: 2296626 - RNA, 23 nt, Human
aggcgcacuuuccuccuggcaga

SEQ ID NO: 2296627 - RNA, 14 nt, Human
aggcgccccuuccc

SEQ ID NO: 2296628 - RNA, 14 nt, Human
aggcgccggcgggc

SEQ ID NO: 2296629 - RNA, 22 nt, Human
uggccugcugggcucuccaccu

SEQ ID NO: 2296630 - RNA, 11 nt, Human
uggccugcugu

SEQ ID NO: 2296631 - RNA, 21 nt, Human
uggccugcugggcucuccacc

SEQ ID NO: 2296632 - RNA, 24 nt, Human
uggccugcacggugggccuugcug

SEQ ID NO: 2296633 - RNA, 18 nt, Human
uggccugccuugaagcca

SEQ ID NO: 2296634 - RNA, 20 nt, Human
uggccugcugggcucuccac

SEQ ID NO: 2296635 - RNA, 16 nt, Human
uggccugcacuaauuu

SEQ ID NO: 2296636 - RNA, 14 nt, Human
uggccugcacuaau

SEQ ID NO: 2296637 - RNA, 21 nt, Human
uggccugcacggugggccuug

SEQ ID NO: 2296638 - RNA, 23 nt, Human
uggccugcacggugggccuugcu

SEQ ID NO: 2296639 - RNA, 23 nt, Human
uggccucuguggagccccagcau

SEQ ID NO: 2296640 - RNA, 16 nt, Human
uggccucuggcucuca

SEQ ID NO: 2296641 - RNA, 18 nt, Human
uggccugagcugggauga

SEQ ID NO: 2296642 - RNA, 22 nt, Human
uggccugaucagaccacggcuc

SEQ ID NO: 2296643 - RNA, 11 nt, Human
uggccugggca

SEQ ID NO: 2296644 - RNA, 17 nt, Human
uggccugggagagcugg

SEQ ID NO: 2296645 - RNA, 13 nt, Human
uggccuggacugu

SEQ ID NO: 2296646 - RNA, 12 nt, Human
uggccugcugug

SEQ ID NO: 2296647 - RNA, 12 nt, Human
uggccugucuca

SEQ ID NO: 2296648 - RNA, 14 nt, Human
uggccugggccucc

SEQ ID NO: 2296649 - RNA, 17 nt, Human
uggccugggccuccuca

SEQ ID NO: 2296650 - RNA, 20 nt, Human
uggccugucucauccccagg

SEQ ID NO: 2296651 - RNA, 18 nt, Human
uggccugucucaucccca

SEQ ID NO: 2296652 - RNA, 16 nt, Human
uggccugucucauccc

SEQ ID NO: 2296653 - RNA, 14 nt, Human
uggccugucucauc

SEQ ID NO: 2296654 - RNA, 24 nt, Human
uggccugucucauccccagggguc

SEQ ID NO: 2296655 - RNA, 14 nt, Human
uggccuguguccca

SEQ ID NO: 2296656 - RNA, 15 nt, Human
uggccuguggccugu

SEQ ID NO: 2296657 - RNA, 20 nt, Human
uggccgaggguccuggcucc

SEQ ID NO: 2296658 - RNA, 19 nt, Human
uggccgaggguccuggcuc

SEQ ID NO: 2296659 - RNA, 18 nt, Human
uggccucugcacuccccu

SEQ ID NO: 2296660 - RNA, 19 nt, Human
uggccucugcacuccccug

SEQ ID NO: 2296661 - RNA, 21 nt, Human
uggccucugcugauccuccca

SEQ ID NO: 2296662 - RNA, 15 nt, Human
uggccgaguccaagc

SEQ ID NO: 2296663 - RNA, 20 nt, Human
uggccucugcacuccccugc

SEQ ID NO: 2296664 - RNA, 22 nt, Human
uggcccuugcaguucagcacca

SEQ ID NO: 2296665 - RNA, 23 nt, Human
uggcccuugcaguucagcaccac

SEQ ID NO: 2296666 - RNA, 18 nt, Human
uggccgaggguccuggcu

SEQ ID NO: 2296667 - RNA, 13 nt, Human
uggcccugcccug

SEQ ID NO: 2296668 - RNA, 17 nt, Human
uggcccugucccuccca

SEQ ID NO: 2296669 - RNA, 19 nt, Human
uggcccugucccucccacc

SEQ ID NO: 2296670 - RNA, 20 nt, Human
uggcccugucccucccaccu

SEQ ID NO: 2296671 - RNA, 19 nt, Human
uggcccuucccacuggagg

SEQ ID NO: 2296672 - RNA, 21 nt, Human
uggcccugucccucccaccuc

SEQ ID NO: 2296673 - RNA, 22 nt, Human
uggcccugucccucccaccucu

SEQ ID NO: 2296674 - RNA, 23 nt, Human
uggcccugucccucccaccucug

SEQ ID NO: 2296675 - RNA, 22 nt, Human
uggcccagccaaacccugucug

SEQ ID NO: 2296676 - RNA, 18 nt, Human
uggcauuauguccacugu

SEQ ID NO: 2296677 - RNA, 10 nt, Human
uggcccagcc

SEQ ID NO: 2296678 - RNA, 12 nt, Human
uggcccagcccu

SEQ ID NO: 2296679 - RNA, 13 nt, Human
uggcccagcccug

SEQ ID NO: 2296680 - RNA, 14 nt, Human
uggcccagcccugc

SEQ ID NO: 2296681 - RNA, 15 nt, Human
uggcccagcccugcu

SEQ ID NO: 2296682 - RNA, 17 nt, Human
uggcccagcccugcugg

SEQ ID NO: 2296683 - RNA, 19 nt, Human
uggcccagcccugcuggcc

SEQ ID NO: 2296684 - RNA, 20 nt, Human
uggcccagcccugcuggccg

SEQ ID NO: 2296685 - RNA, 11 nt, Human
uggcccagccg

SEQ ID NO: 2296686 - RNA, 13 nt, Human
uggcccagccggc

SEQ ID NO: 2296687 - RNA, 15 nt, Human
uggcccagccggccu

SEQ ID NO: 2296688 - RNA, 17 nt, Human
uggcccagccggccucu

SEQ ID NO: 2296689 - RNA, 18 nt, Human
uggcccagccggccucuc

SEQ ID NO: 2296690 - RNA, 22 nt, Human
uggcccagccggccucucuggc

SEQ ID NO: 2296691 - RNA, 23 nt, Human
uggcccagccggccucucuggcc

SEQ ID NO: 2296692 - RNA, 14 nt, Human
uggcccagcggccc

SEQ ID NO: 2296693 - RNA, 16 nt, Human
uggcccagcggccccu

SEQ ID NO: 2296694 - RNA, 17 nt, Human
uggcccagcggccccuc

SEQ ID NO: 2296695 - RNA, 19 nt, Human
uggcccagcggccccuccc

SEQ ID NO: 2296696 - RNA, 20 nt, Human
uggcccagcggccccuccca

SEQ ID NO: 2296697 - RNA, 21 nt, Human
uggcccagcggccccucccac

SEQ ID NO: 2296698 - RNA, 12 nt, Human
uggcccagcucc

SEQ ID NO: 2296699 - RNA, 13 nt, Human
uggcccagcuccc

SEQ ID NO: 2296700 - RNA, 14 nt, Human
uggcccagcucccc

SEQ ID NO: 2296701 - RNA, 15 nt, Human
uggcccagcucccca

SEQ ID NO: 2296702 - RNA, 22 nt, Human
uggcccagcucccccgggaggg

SEQ ID NO: 2296703 - RNA, 14 nt, Human
uggcccucaguuuc

SEQ ID NO: 2296704 - RNA, 20 nt, Human
uggcccucaccccugcccug

SEQ ID NO: 2296705 - RNA, 21 nt, Human
uggcccucccaguaccuccug

SEQ ID NO: 2296706 - RNA, 14 nt, Human
uggcccucuacccc

SEQ ID NO: 2296707 - RNA, 18 nt, Human
uggcccucaccccugccc

SEQ ID NO: 2296708 - RNA, 16 nt, Human
uggcccucaccccugc

SEQ ID NO: 2296709 - RNA, 23 nt, Human
uggcccucaaggccucccacagu

SEQ ID NO: 2296710 - RNA, 17 nt, Human
uggcccaggaccaucau

SEQ ID NO: 2296711 - RNA, 16 nt, Human
uggcccugaggugugg

SEQ ID NO: 2296712 - RNA, 18 nt, Human
uggcccugaggugugggg

SEQ ID NO: 2296713 - RNA, 23 nt, Human
uggcccugaggugugggggcugc

SEQ ID NO: 2296714 - RNA, 15 nt, Human
uggcccucuguguug

SEQ ID NO: 2296715 - RNA, 12 nt, Human
uggcccugcccu

SEQ ID NO: 2296716 - RNA, 15 nt, Human
uggcccugcaaaagg

SEQ ID NO: 2296717 - RNA, 19 nt, Human
uggcccugccaucuuccca

SEQ ID NO: 2296718 - RNA, 21 nt, Human
uggcccugccaucuucccagc

SEQ ID NO: 2296719 - RNA, 14 nt, Human
uggcccacugcauc

SEQ ID NO: 2296720 - RNA, 13 nt, Human
uggcccacugcau

SEQ ID NO: 2296721 - RNA, 20 nt, Human
uggcccacgccuguaauccc

SEQ ID NO: 2296722 - RNA, 23 nt, Human
uggcauuauguccacuguguaua

SEQ ID NO: 2296723 - RNA, 13 nt, Human
uggcauuggcagc

SEQ ID NO: 2296724 - RNA, 19 nt, Human
uggcccacgcacuucggga

SEQ ID NO: 2296725 - RNA, 14 nt, Human
uggcauguggccug

SEQ ID NO: 2296726 - RNA, 15 nt, Human
uggcauguggccugu

SEQ ID NO: 2296727 - RNA, 16 nt, Human
uggcauguggccugug

SEQ ID NO: 2296728 - RNA, 12 nt, Human
uggcauguguuu

SEQ ID NO: 2296729 - RNA, 17 nt, Human
uggcauguggccugugg

SEQ ID NO: 2296730 - RNA, 18 nt, Human
uggcauguggccuguggc

SEQ ID NO: 2296731 - RNA, 13 nt, Human
uggcauuaugucc

SEQ ID NO: 2296732 - RNA, 17 nt, Human
uggcauuagaauuauuu

SEQ ID NO: 2296733 - RNA, 19 nt, Human
uggcauuacagcuggagaa

SEQ ID NO: 2296734 - RNA, 19 nt, Human
uggcaucccaguggccuca

SEQ ID NO: 2296735 - RNA, 15 nt, Human
uggcaucccaguggc

SEQ ID NO: 2296736 - RNA, 22 nt, Human
uggcaugggaaugaaugucagu

SEQ ID NO: 2296737 - RNA, 22 nt, Human
uggcagauuuagugaaagcuag

SEQ ID NO: 2296738 - RNA, 18 nt, Human
uggcagcaccugucuccu

SEQ ID NO: 2296739 - RNA, 13 nt, Human
uggcagcaggugc

SEQ ID NO: 2296740 - RNA, 20 nt, Human
uggcagcagaguguggccuu

SEQ ID NO: 2296741 - RNA, 14 nt, Human
uggcagcagagugu

SEQ ID NO: 2296742 - RNA, 11 nt, Human
uggcagcagau

SEQ ID NO: 2296743 - RNA, 15 nt, Human
uggcagcaggugcug

SEQ ID NO: 2296744 - RNA, 16 nt, Human
uggcagcaggugcugc

SEQ ID NO: 2296745 - RNA, 17 nt, Human
uggcagcaggugcugcu

SEQ ID NO: 2296746 - RNA, 17 nt, Human
uggcagccgugccuuca

SEQ ID NO: 2296747 - RNA, 20 nt, Human
uggcagcaggugcugcuacc

SEQ ID NO: 2296748 - RNA, 21 nt, Human
uggcagcaggugcugcuaccc

SEQ ID NO: 2296749 - RNA, 13 nt, Human
uggcagcauaaag

SEQ ID NO: 2296750 - RNA, 14 nt, Human
uggcagcauaaagg

SEQ ID NO: 2296751 - RNA, 17 nt, Human
uggcaccagcagccugg

SEQ ID NO: 2296752 - RNA, 16 nt, Human
uggcaccagcagccug

SEQ ID NO: 2296753 - RNA, 23 nt, Human
uggcaccagaggcugcagaaggc

SEQ ID NO: 2296754 - RNA, 19 nt, Human
uggcaccagaggcugcaga

SEQ ID NO: 2296755 - RNA, 20 nt, Human
uggcaccagaggcugcagaa

SEQ ID NO: 2296756 - RNA, 17 nt, Human
uggcaccagacacccag

SEQ ID NO: 2296757 - RNA, 14 nt, Human
uggcaccagaggcu

SEQ ID NO: 2296758 - RNA, 23 nt, Human
uggcaccagacacccaggacuua

SEQ ID NO: 2296759 - RNA, 20 nt, Human
uggcacagcccaaagaagga

SEQ ID NO: 2296760 - RNA, 22 nt, Human
uggcacagaaaccucuacuaaa

SEQ ID NO: 2296761 - RNA, 18 nt, Human
uggcacagcccaaagaag

SEQ ID NO: 2296762 - RNA, 14 nt, Human
uggcacaggacaug

SEQ ID NO: 2296763 - RNA, 21 nt, Human
uggcaccagacacccaggacu

SEQ ID NO: 2296764 - RNA, 20 nt, Human
uggcaccagacacccaggac

SEQ ID NO: 2296765 - RNA, 15 nt, Human
uggcacagggcagug

SEQ ID NO: 2296766 - RNA, 16 nt, Human
uggcacaggcccccuu

SEQ ID NO: 2296767 - RNA, 20 nt, Human
aggcauccuuccucacacca

SEQ ID NO: 2296768 - RNA, 14 nt, Human
uggcacagaaacac

SEQ ID NO: 2296769 - RNA, 23 nt, Human
aggcaucccaggggaccacaccu

SEQ ID NO: 2296770 - RNA, 22 nt, Human
uggcacacaccuguagucccag

SEQ ID NO: 2296771 - RNA, 18 nt, Human
aggcauccuuccucacac

SEQ ID NO: 2296772 - RNA, 18 nt, Human
aggcaucccaggggacca

SEQ ID NO: 2296773 - RNA, 17 nt, Human
aggcaucccaggggacc

SEQ ID NO: 2296774 - RNA, 16 nt, Human
aggcaucccaggggac

SEQ ID NO: 2296775 - RNA, 13 nt, Human
aggcaucccaggg

SEQ ID NO: 2296776 - RNA, 19 nt, Human
aggcauaggccugggugcu

SEQ ID NO: 2296777 - RNA, 18 nt, Human
aggcauaggccugggugc

SEQ ID NO: 2296778 - RNA, 17 nt, Human
aggcauaggccugggug

SEQ ID NO: 2296779 - RNA, 16 nt, Human
aggcauaggccugggu

SEQ ID NO: 2296780 - RNA, 20 nt, Human
aggcauaggccugggugcug

SEQ ID NO: 2296781 - RNA, 20 nt, Human
aggcauaucagucucugagg

SEQ ID NO: 2296782 - RNA, 20 nt, Human
aggcauauugcuuuuucuaa

SEQ ID NO: 2296783 - RNA, 22 nt, Human
aggcauauugcuuuuucuaaug

SEQ ID NO: 2296784 - RNA, 14 nt, Human
aggcaucacagcua

SEQ ID NO: 2296785 - RNA, 19 nt, Human
aggcaucagucccuaugua

SEQ ID NO: 2296786 - RNA, 20 nt, Human
aggcaucagucccuauguau

SEQ ID NO: 2296787 - RNA, 16 nt, Human
aggcaucaugcagagu

SEQ ID NO: 2296788 - RNA, 18 nt, Human
uggcagccgugccuucag

SEQ ID NO: 2296789 - RNA, 19 nt, Human
uggcagccgugccuucagc

SEQ ID NO: 2296790 - RNA, 20 nt, Human
uggcagccgugccuucagcu

SEQ ID NO: 2296791 - RNA, 21 nt, Human
uggcagccgugccuucagcuc

SEQ ID NO: 2296792 - RNA, 14 nt, Human
uggcagcucagaga

SEQ ID NO: 2296793 - RNA, 15 nt, Human
uggcagcucagagag

SEQ ID NO: 2296794 - RNA, 16 nt, Human
uggcagcucagagagg

SEQ ID NO: 2296795 - RNA, 18 nt, Human
uggcagcucagagagggu

SEQ ID NO: 2296796 - RNA, 13 nt, Human
aggccagagacac

SEQ ID NO: 2296797 - RNA, 18 nt, Human
aggccagagacacaagcc

SEQ ID NO: 2296798 - RNA, 18 nt, Human
aggccaugggccuccugu

SEQ ID NO: 2296799 - RNA, 18 nt, Human
aggccagaggcccccagc

SEQ ID NO: 2296800 - RNA, 20 nt, Human
aggccauguuccaauaaaca

SEQ ID NO: 2296801 - RNA, 21 nt, Human
aggccauguuccaauaaacag

SEQ ID NO: 2296802 - RNA, 20 nt, Human
uggcagcauaaaggccuuuu

SEQ ID NO: 2296803 - RNA, 23 nt, Human
aggccagagacacaagccuucgg

SEQ ID NO: 2296804 - RNA, 20 nt, Human
aggccauuccccgucucugg

SEQ ID NO: 2296805 - RNA, 13 nt, Human
aggccauuauugu

SEQ ID NO: 2296806 - RNA, 23 nt, Human
aggccauguuccaauaaacagga

SEQ ID NO: 2296807 - RNA, 15 nt, Human
aggcccagagggccu

SEQ ID NO: 2296808 - RNA, 16 nt, Human
aggcccagagggccug

SEQ ID NO: 2296809 - RNA, 21 nt, Human
aggccccugucucagggugag

SEQ ID NO: 2296810 - RNA, 17 nt, Human
aggccccuggacaagca

SEQ ID NO: 2296811 - RNA, 14 nt, Human
aggccccuggccca

SEQ ID NO: 2296812 - RNA, 15 nt, Human
aggccccuggcccag

SEQ ID NO: 2296813 - RNA, 14 nt, Human
aggcccggcuccag

SEQ ID NO: 2296814 - RNA, 15 nt, Human
aggcccggcuccagg

SEQ ID NO: 2296815 - RNA, 16 nt, Human
aggcccggcuccaggc

SEQ ID NO: 2296816 - RNA, 12 nt, Human
aggccguggcug

SEQ ID NO: 2296817 - RNA, 22 nt, Human
aggccguccucccgggcccucc

SEQ ID NO: 2296818 - RNA, 20 nt, Human
aggccgggugcucagggcug

SEQ ID NO: 2296819 - RNA, 15 nt, Human
aggccggggccgggu

SEQ ID NO: 2296820 - RNA, 19 nt, Human
aggccggggccggguacug

SEQ ID NO: 2296821 - RNA, 13 nt, Human
aggccguccuccc

SEQ ID NO: 2296822 - RNA, 16 nt, Human
aggccguccucccggg

SEQ ID NO: 2296823 - RNA, 17 nt, Human
aggccguccucccgggc

SEQ ID NO: 2296824 - RNA, 21 nt, Human
aggccguccucccgggcccuc

SEQ ID NO: 2296825 - RNA, 16 nt, Human
aggccccuggcccagc

SEQ ID NO: 2296826 - RNA, 20 nt, Human
aggccccuggcccagcggcc

SEQ ID NO: 2296827 - RNA, 21 nt, Human
aggccgggccgaauccccucc

SEQ ID NO: 2296828 - RNA, 13 nt, Human
aggccccugccac

SEQ ID NO: 2296829 - RNA, 15 nt, Human
aggccccugccaccc

SEQ ID NO: 2296830 - RNA, 19 nt, Human
aggcccagagggccugcaa

SEQ ID NO: 2296831 - RNA, 20 nt, Human
aggcccagagggccugcaag

SEQ ID NO: 2296832 - RNA, 17 nt, Human
aggccccugccacccug

SEQ ID NO: 2296833 - RNA, 18 nt, Human
aggccccugccacccugg

SEQ ID NO: 2296834 - RNA, 21 nt, Human
aggccccugccacccugggga

SEQ ID NO: 2296835 - RNA, 12 nt, Human
aggccccuggcc

SEQ ID NO: 2296836 - RNA, 20 nt, Human
aggccguggcugcccacaca

SEQ ID NO: 2296837 - RNA, 22 nt, Human
aggccuacaugcuuugugaaca

SEQ ID NO: 2296838 - RNA, 17 nt, Human
aggccuaaaaguaaaca

SEQ ID NO: 2296839 - RNA, 23 nt, Human
aggccuacaugcuuugugaacaa

SEQ ID NO: 2296840 - RNA, 16 nt, Human
aggccuaccccgcaga

SEQ ID NO: 2296841 - RNA, 19 nt, Human
aggccuaccccgcagacac

SEQ ID NO: 2296842 - RNA, 22 nt, Human
aggccuaccccgcagacaccuu

SEQ ID NO: 2296843 - RNA, 16 nt, Human
aggccuaaaaguaaac

SEQ ID NO: 2296844 - RNA, 16 nt, Human
aggccuauaaccccag

SEQ ID NO: 2296845 - RNA, 14 nt, Human
aggccucugugucc

SEQ ID NO: 2296846 - RNA, 15 nt, Human
aggccucuguguccu

SEQ ID NO: 2296847 - RNA, 16 nt, Human
aggccucuguguccuu

SEQ ID NO: 2296848 - RNA, 20 nt, Human
aggccucuguguccuucccu

SEQ ID NO: 2296849 - RNA, 18 nt, Human
aggccugaaaggagcccu

SEQ ID NO: 2296850 - RNA, 23 nt, Human
aggccugaaagaggcugaggccu

SEQ ID NO: 2296851 - RNA, 17 nt, Human
aggccugaaagaggcug

SEQ ID NO: 2296852 - RNA, 21 nt, Human
aggccugaaagaggcugaggc

SEQ ID NO: 2296853 - RNA, 22 nt, Human
aggccucuguguccuucccugc

SEQ ID NO: 2296854 - RNA, 23 nt, Human
aggccucuguguccuucccugca

SEQ ID NO: 2296855 - RNA, 18 nt, Human
aggccucuuggaccucug

SEQ ID NO: 2296856 - RNA, 21 nt, Human
aggccucuuggaccucugcuc

SEQ ID NO: 2296857 - RNA, 22 nt, Human
aggccucuuggaccucugcucu

SEQ ID NO: 2296858 - RNA, 23 nt, Human
aggccucuuggaccucugcucug

SEQ ID NO: 2296859 - RNA, 24 nt, Human
aggccucuuggaccucugcucuga

SEQ ID NO: 2296860 - RNA, 23 nt, Human
uggcaucaccuuaggcagggaag

SEQ ID NO: 2296861 - RNA, 14 nt, Human
uggcaucagcuggc

SEQ ID NO: 2296862 - RNA, 20 nt, Human
uggcaucacagggcagagcc

SEQ ID NO: 2296863 - RNA, 18 nt, Human
uggcaucacagggcagag

SEQ ID NO: 2296864 - RNA, 15 nt, Human
uggcaucacagggca

SEQ ID NO: 2296865 - RNA, 13 nt, Human
aggccuggccaga

SEQ ID NO: 2296866 - RNA, 15 nt, Human
uggcaucagcuggcg

SEQ ID NO: 2296867 - RNA, 18 nt, Human
uggcaucagcuggcguca

SEQ ID NO: 2296868 - RNA, 11 nt, Human
aggccuggcca

SEQ ID NO: 2296869 - RNA, 23 nt, Human
aggccuggcacagugucugggcu

SEQ ID NO: 2296870 - RNA, 16 nt, Human
aggccuggcacagugu

SEQ ID NO: 2296871 - RNA, 18 nt, Human
aggccuggcacagugucu

SEQ ID NO: 2296872 - RNA, 17 nt, Human
aggccuggacuuuccug

SEQ ID NO: 2296873 - RNA, 13 nt, Human
aggccuggcacag

SEQ ID NO: 2296874 - RNA, 14 nt, Human
aggccuggcacagu

SEQ ID NO: 2296875 - RNA, 15 nt, Human
aggccuggcacagug

SEQ ID NO: 2296876 - RNA, 12 nt, Human
aggccuggccag

SEQ ID NO: 2296877 - RNA, 18 nt, Human
aggccuggacuuuccugc

SEQ ID NO: 2296878 - RNA, 19 nt, Human
aggccuggacuuuccugca

SEQ ID NO: 2296879 - RNA, 22 nt, Human
aggccuggacuuuccugcaacu

SEQ ID NO: 2296880 - RNA, 16 nt, Human
aggccugacucucagc

SEQ ID NO: 2296881 - RNA, 16 nt, Human
uggaagcuguguccuu

SEQ ID NO: 2296882 - RNA, 17 nt, Human
uggaaguccaauguggc

SEQ ID NO: 2296883 - RNA, 20 nt, Human
uggaaguacuauaauuuacc

SEQ ID NO: 2296884 - RNA, 22 nt, Human
uggaagcuagcuccccuccucu

SEQ ID NO: 2296885 - RNA, 18 nt, Human
uggaagcuagcuccccuc

SEQ ID NO: 2296886 - RNA, 20 nt, Human
uggaagcuagcuccccuccu

SEQ ID NO: 2296887 - RNA, 18 nt, Human
uggaagcugcccugccca

SEQ ID NO: 2296888 - RNA, 17 nt, Human
uggaagcugcccugccc

SEQ ID NO: 2296889 - RNA, 13 nt, Human
uggaagcuccgcu

SEQ ID NO: 2296890 - RNA, 18 nt, Human
uggaagcuaauuugcauu

SEQ ID NO: 2296891 - RNA, 12 nt, Human
uggaagcuagcu

SEQ ID NO: 2296892 - RNA, 14 nt, Human
uggaagcuagcucc

SEQ ID NO: 2296893 - RNA, 14 nt, Human
uggaacacucugag

SEQ ID NO: 2296894 - RNA, 17 nt, Human
uggaagcuaauuugcau

SEQ ID NO: 2296895 - RNA, 16 nt, Human
uggaagcuaauuugca

SEQ ID NO: 2296896 - RNA, 12 nt, Human
uggaacacucug

SEQ ID NO: 2296897 - RNA, 14 nt, Human
ugcugcccuaggcu

SEQ ID NO: 2296898 - RNA, 17 nt, Human
ugcugcccgcucugcag

SEQ ID NO: 2296899 - RNA, 22 nt, Human
ugcugcccgucuucagccuagc

SEQ ID NO: 2296900 - RNA, 13 nt, Human
ugcugcccuccau

SEQ ID NO: 2296901 - RNA, 12 nt, Human
ugcugcccugcc

SEQ ID NO: 2296902 - RNA, 15 nt, Human
uggaacacggccaca

SEQ ID NO: 2296903 - RNA, 22 nt, Human
uggaacaccuaccaaaaaauaa

SEQ ID NO: 2296904 - RNA, 21 nt, Human
uggaacaaucuaaaaguuuaa

SEQ ID NO: 2296905 - RNA, 17 nt, Human
uggaacacggccacauc

SEQ ID NO: 2296906 - RNA, 14 nt, Human
ugcugcccccaccc

SEQ ID NO: 2296907 - RNA, 15 nt, Human
ugcugcccccacccc

SEQ ID NO: 2296908 - RNA, 22 nt, Human
ugcugcccccaccccggggacc

SEQ ID NO: 2296909 - RNA, 20 nt, Human
ugcugcccccaccccgggga

SEQ ID NO: 2296910 - RNA, 21 nt, Human
ugcugccccaucagugcuccc

SEQ ID NO: 2296911 - RNA, 19 nt, Human
ugcugccccaucagugcuc

SEQ ID NO: 2296912 - RNA, 18 nt, Human
ugcugccccaucagugcu

SEQ ID NO: 2296913 - RNA, 21 nt, Human
ugcugcccaugccaccgcuuc

SEQ ID NO: 2296914 - RNA, 21 nt, Human
ugcugcccgucuucagccuag

SEQ ID NO: 2296915 - RNA, 20 nt, Human
ugcugcccgucuucagccua

SEQ ID NO: 2296916 - RNA, 17 nt, Human
ugcugcccgucuucagc

SEQ ID NO: 2296917 - RNA, 10 nt, Human
ugcugcccug

SEQ ID NO: 2296918 - RNA, 21 nt, Human
uggaagugagggucagagagg

SEQ ID NO: 2296919 - RNA, 19 nt, Human
uggaagugagggucagaga

SEQ ID NO: 2296920 - RNA, 18 nt, Human
uggaagugagggucagag

SEQ ID NO: 2296921 - RNA, 16 nt, Human
uggaagugaggcauug

SEQ ID NO: 2296922 - RNA, 15 nt, Human
uggaagcuguguccu

SEQ ID NO: 2296923 - RNA, 14 nt, Human
uggaagugaggcau

SEQ ID NO: 2296924 - RNA, 23 nt, Human
uggaagugacuuuggcugcaugc

SEQ ID NO: 2296925 - RNA, 17 nt, Human
uggaagugacuuuggcu

SEQ ID NO: 2296926 - RNA, 15 nt, Human
uggaagugacuuugg

SEQ ID NO: 2296927 - RNA, 14 nt, Human
uggaagugcuaauu

SEQ ID NO: 2296928 - RNA, 14 nt, Human
uggaaguguggguc

SEQ ID NO: 2296929 - RNA, 13 nt, Human
uggaagugugggu

SEQ ID NO: 2296930 - RNA, 15 nt, Human
aggaggccagccuug

SEQ ID NO: 2296931 - RNA, 22 nt, Human
aggaggccaggccggcgagccc

SEQ ID NO: 2296932 - RNA, 16 nt, Human
aggaggccaggcucag

SEQ ID NO: 2296933 - RNA, 12 nt, Human
aggaggccccug

SEQ ID NO: 2296934 - RNA, 13 nt, Human
aggaggccaggcc

SEQ ID NO: 2296935 - RNA, 14 nt, Human
aggaggccacguga

SEQ ID NO: 2296936 - RNA, 19 nt, Human
aggaggccacgugaugugg

SEQ ID NO: 2296937 - RNA, 14 nt, Human
aggaggccaccucu

SEQ ID NO: 2296938 - RNA, 20 nt, Human
uggaagugugggucugugug

SEQ ID NO: 2296939 - RNA, 15 nt, Human
aggaggccaccucuc

SEQ ID NO: 2296940 - RNA, 16 nt, Human
aggaggccaccucucc

SEQ ID NO: 2296941 - RNA, 17 nt, Human
aggaggccaccucucca

SEQ ID NO: 2296942 - RNA, 18 nt, Human
aggaggccaccucuccaa

SEQ ID NO: 2296943 - RNA, 19 nt, Human
aggaggccaccucuccaag

SEQ ID NO: 2296944 - RNA, 20 nt, Human
aggaggccaccucuccaagg

SEQ ID NO: 2296945 - RNA, 22 nt, Human
aggaggccaccucuccaagggc

SEQ ID NO: 2296946 - RNA, 23 nt, Human
aggaggccaccucuccaagggcu

SEQ ID NO: 2296947 - RNA, 20 nt, Human
aggaguuugaggcugcagcg

SEQ ID NO: 2296948 - RNA, 19 nt, Human
aggaguuugaggcugcagc

SEQ ID NO: 2296949 - RNA, 19 nt, Human
aggaguuugagaccagccu

SEQ ID NO: 2296950 - RNA, 16 nt, Human
aggaguuugagaccag

SEQ ID NO: 2296951 - RNA, 21 nt, Human
aggaguuugagaccaaccugg

SEQ ID NO: 2296952 - RNA, 15 nt, Human
aggaggccuccaucu

SEQ ID NO: 2296953 - RNA, 17 nt, Human
aggaggccuccaucuca

SEQ ID NO: 2296954 - RNA, 17 nt, Human
aggaggccccuggccca

SEQ ID NO: 2296955 - RNA, 18 nt, Human
aggaggccccuggcccag

SEQ ID NO: 2296956 - RNA, 16 nt, Human
aggaggccggggccgg

SEQ ID NO: 2296957 - RNA, 12 nt, Human
aggaggccucca

SEQ ID NO: 2296958 - RNA, 19 nt, Human
aggaguuucguuuucaaaa

SEQ ID NO: 2296959 - RNA, 22 nt, Human
aggaucacuggagcccaggagu

SEQ ID NO: 2296960 - RNA, 20 nt, Human
aggaucacuggagcccagga

SEQ ID NO: 2296961 - RNA, 19 nt, Human
aggaucacuggagcccagg

SEQ ID NO: 2296962 - RNA, 18 nt, Human
aggaucacuggagcccag

SEQ ID NO: 2296963 - RNA, 16 nt, Human
aggaucacuggagccc

SEQ ID NO: 2296964 - RNA, 15 nt, Human
aggaucacuggagcc

SEQ ID NO: 2296965 - RNA, 14 nt, Human
aggaucacuggagc

SEQ ID NO: 2296966 - RNA, 24 nt, Human
aggaguuugaggcugcagcgagcu

SEQ ID NO: 2296967 - RNA, 15 nt, Human
aggaucaagaaagug

SEQ ID NO: 2296968 - RNA, 23 nt, Human
aggauauguucacaccuagcguc

SEQ ID NO: 2296969 - RNA, 21 nt, Human
aggauauguucacaccuagcg

SEQ ID NO: 2296970 - RNA, 12 nt, Human
aggcaagagaau

SEQ ID NO: 2296971 - RNA, 16 nt, Human
aggauuuuaugcuuua

SEQ ID NO: 2296972 - RNA, 16 nt, Human
aggcaacuugggaacu

SEQ ID NO: 2296973 - RNA, 19 nt, Human
aggcaacugcauuggcuuu

SEQ ID NO: 2296974 - RNA, 14 nt, Human
aggcaagcaccucc

SEQ ID NO: 2296975 - RNA, 24 nt, Human
aggcaagagggguggagacugcuu

SEQ ID NO: 2296976 - RNA, 17 nt, Human
aggcaagagggggugga

SEQ ID NO: 2296977 - RNA, 21 nt, Human
aggcaagaggggguggagggg

SEQ ID NO: 2296978 - RNA, 13 nt, Human
aggcaagaggggu

SEQ ID NO: 2296979 - RNA, 14 nt, Human
uggaauuugaaaca

SEQ ID NO: 2296980 - RNA, 22 nt, Human
uggaauuugcaagucauggcug

SEQ ID NO: 2296981 - RNA, 16 nt, Human
uggaauuuguaaccuc

SEQ ID NO: 2296982 - RNA, 17 nt, Human
uggaauuuguaaccuca

SEQ ID NO: 2296983 - RNA, 18 nt, Human
uggaauuuguaaccucag

SEQ ID NO: 2296984 - RNA, 19 nt, Human
uggaauuuguaaccucagc

SEQ ID NO: 2296985 - RNA, 14 nt, Human
uggaauuuguaagu

SEQ ID NO: 2296986 - RNA, 16 nt, Human
uggaauuuguaaguuu

SEQ ID NO: 2296987 - RNA, 12 nt, Human
uggaauuuuuca

SEQ ID NO: 2296988 - RNA, 23 nt, Human
uggaauuuuucauugauaugaaa

SEQ ID NO: 2296989 - RNA, 21 nt, Human
uggacaccaggagucccuggu

SEQ ID NO: 2296990 - RNA, 22 nt, Human
uggacaagcagagguggccaga

SEQ ID NO: 2296991 - RNA, 20 nt, Human
uggacaccccuuauccagga

SEQ ID NO: 2296992 - RNA, 20 nt, Human
uggacaccaggagucccugg

SEQ ID NO: 2296993 - RNA, 15 nt, Human
uggacaccggaaaca

SEQ ID NO: 2296994 - RNA, 21 nt, Human
uggacaccccuuauccaggac

SEQ ID NO: 2296995 - RNA, 22 nt, Human
uggacaccccuuauccaggacu

SEQ ID NO: 2296996 - RNA, 14 nt, Human
aggaucucucagga

SEQ ID NO: 2296997 - RNA, 15 nt, Human
aggaucucucaggag

SEQ ID NO: 2296998 - RNA, 19 nt, Human
aggaucucucaggagcaca

SEQ ID NO: 2296999 - RNA, 20 nt, Human
aggaucucucaggagcacag

SEQ ID NO: 2297000 - RNA, 22 nt, Human
aggaugcuaacaucuaaaaaua

SEQ ID NO: 2297001 - RNA, 21 nt, Human
aggaucucucaggagcacagg

SEQ ID NO: 2297002 - RNA, 22 nt, Human
aggaucucucaggagcacaggc

SEQ ID NO: 2297003 - RNA, 23 nt, Human
aggaugcuaacaucuaaaaauag

SEQ ID NO: 2297004 - RNA, 16 nt, Human
aggaugcuuguacaua

SEQ ID NO: 2297005 - RNA, 15 nt, Human
aggaugcuuguacau

SEQ ID NO: 2297006 - RNA, 12 nt, Human
aggaucagucug

SEQ ID NO: 2297007 - RNA, 21 nt, Human
aggauccugagccagauuuca

SEQ ID NO: 2297008 - RNA, 16 nt, Human
aggaucagauugcaug

SEQ ID NO: 2297009 - RNA, 18 nt, Human
aggaucacagugcugaga

SEQ ID NO: 2297010 - RNA, 14 nt, Human
aggaucuagagggg

SEQ ID NO: 2297011 - RNA, 16 nt, Human
aggaucuagaaugugu

SEQ ID NO: 2297012 - RNA, 22 nt, Human
aggaucuagaauguguuuucug

SEQ ID NO: 2297013 - RNA, 13 nt, Human
aggaucucucagg

SEQ ID NO: 2297014 - RNA, 16 nt, Human
aggauugugauauuuu

SEQ ID NO: 2297015 - RNA, 19 nt, Human
aggauuguaaaaaaaaaug

SEQ ID NO: 2297016 - RNA, 23 nt, Human
aggauuguaaaaaaaaaugccuu

SEQ ID NO: 2297017 - RNA, 12 nt, Human
aggauuuaacag

SEQ ID NO: 2297018 - RNA, 16 nt, Human
aggauuuaacagucau

SEQ ID NO: 2297019 - RNA, 16 nt, Human
aggauuucaagccugc

SEQ ID NO: 2297020 - RNA, 15 nt, Human
aggauuucaagccug

SEQ ID NO: 2297021 - RNA, 14 nt, Human
aggauuucaagccu

SEQ ID NO: 2297022 - RNA, 21 nt, Human
aggauuuaacagucauuuaaa

SEQ ID NO: 2297023 - RNA, 12 nt, Human
aggauuucaagc

SEQ ID NO: 2297024 - RNA, 18 nt, Human
aggauuuaacagucauuu

SEQ ID NO: 2297025 - RNA, 20 nt, Human
aggauuuaacagucauuuaa

SEQ ID NO: 2297026 - RNA, 19 nt, Human
aggauuucaugauuucauu

SEQ ID NO: 2297027 - RNA, 20 nt, Human
aggauuucaugauuucauuu

SEQ ID NO: 2297028 - RNA, 13 nt, Human
aggauuucguggg

SEQ ID NO: 2297029 - RNA, 19 nt, Human
aggauuuuaacaaaagcaa

SEQ ID NO: 2297030 - RNA, 15 nt, Human
aggauuuuaugcuuu

SEQ ID NO: 2297031 - RNA, 14 nt, Human
aggauuuuaugcuu

SEQ ID NO: 2297032 - RNA, 11 nt, Human
aggauuuuaug

SEQ ID NO: 2297033 - RNA, 23 nt, Human
aggauuuuaacaaaagcaagacu

SEQ ID NO: 2297034 - RNA, 20 nt, Human
aggauugcuugagcccagga

SEQ ID NO: 2297035 - RNA, 19 nt, Human
aggauugcuugagcccagg

SEQ ID NO: 2297036 - RNA, 18 nt, Human
aggauugcuugagcccag

SEQ ID NO: 2297037 - RNA, 17 nt, Human
aggauugcuugagccca

SEQ ID NO: 2297038 - RNA, 22 nt, Human
aggauugcuugagcccaggagu

SEQ ID NO: 2297039 - RNA, 21 nt, Human
aggauugcuugagcccaggag

SEQ ID NO: 2297040 - RNA, 13 nt, Human
aggauuguaaaaa

SEQ ID NO: 2297041 - RNA, 22 nt, Human
aggauugcuacuguccuaccca

SEQ ID NO: 2297042 - RNA, 18 nt, Human
aggaugcuuguacauaau

SEQ ID NO: 2297043 - RNA, 21 nt, Human
aggcaggucuugaacuccugg

SEQ ID NO: 2297044 - RNA, 16 nt, Human
aggcagguagccaggg

SEQ ID NO: 2297045 - RNA, 19 nt, Human
aggcaguaauaaaaagauu

SEQ ID NO: 2297046 - RNA, 16 nt, Human
aggcagguccccagac

SEQ ID NO: 2297047 - RNA, 15 nt, Human
aggcagguccccaga

SEQ ID NO: 2297048 - RNA, 14 nt, Human
aggcagguccccag

SEQ ID NO: 2297049 - RNA, 13 nt, Human
aggcaggucccca

SEQ ID NO: 2297050 - RNA, 12 nt, Human
aggcaggucccc

SEQ ID NO: 2297051 - RNA, 16 nt, Human
aggcagugggucccac

SEQ ID NO: 2297052 - RNA, 18 nt, Human
aggcagugggucccacuu

SEQ ID NO: 2297053 - RNA, 19 nt, Human
aggcagugggucccacuuc

SEQ ID NO: 2297054 - RNA, 19 nt, Human
aggcagugaugcuggaugc

SEQ ID NO: 2297055 - RNA, 22 nt, Human
aggcagugcaagagacucuggc

SEQ ID NO: 2297056 - RNA, 23 nt, Human
aggcagucgggggcuggccuagg

SEQ ID NO: 2297057 - RNA, 18 nt, Human
aggcagucgggggcuggc

SEQ ID NO: 2297058 - RNA, 19 nt, Human
aggcagucgggggcuggcc

SEQ ID NO: 2297059 - RNA, 20 nt, Human
aggcagucgggggcuggccu

SEQ ID NO: 2297060 - RNA, 21 nt, Human
aggcagucgggggcuggccua

SEQ ID NO: 2297061 - RNA, 22 nt, Human
aggcagucgggggcuggccuag

SEQ ID NO: 2297062 - RNA, 20 nt, Human
aggcagggccuugcccagag

SEQ ID NO: 2297063 - RNA, 14 nt, Human
aggcagggugcagu

SEQ ID NO: 2297064 - RNA, 19 nt, Human
aggcagggccuugcccaga

SEQ ID NO: 2297065 - RNA, 22 nt, Human
aggcagggucucacucugucgc

SEQ ID NO: 2297066 - RNA, 14 nt, Human
aggcagguagccag

SEQ ID NO: 2297067 - RNA, 15 nt, Human
aggcagguagccagg

SEQ ID NO: 2297068 - RNA, 11 nt, Human
aggcagguccc

SEQ ID NO: 2297069 - RNA, 14 nt, Human
aggcagguccaggg

SEQ ID NO: 2297070 - RNA, 19 nt, Human
aggcagggucucacucugu

SEQ ID NO: 2297071 - RNA, 18 nt, Human
aggcagggucucacucug

SEQ ID NO: 2297072 - RNA, 20 nt, Human
aggcagggucucacucuguc

SEQ ID NO: 2297073 - RNA, 21 nt, Human
aggcagggucucacucugucg

SEQ ID NO: 2297074 - RNA, 12 nt, Human
aggcaggauggc

SEQ ID NO: 2297075 - RNA, 20 nt, Human
aggcaggaguuucguuuuca

SEQ ID NO: 2297076 - RNA, 23 nt, Human
aggcaggaccuucgggcugugcc

SEQ ID NO: 2297077 - RNA, 22 nt, Human
aggcaggaccuucgggcugugc

SEQ ID NO: 2297078 - RNA, 21 nt, Human
aggcaggaccuucgggcugug

SEQ ID NO: 2297079 - RNA, 14 nt, Human
aggcagcgccaagc

SEQ ID NO: 2297080 - RNA, 19 nt, Human
aggcagcgccaagcaaccu

SEQ ID NO: 2297081 - RNA, 20 nt, Human
aggcagcgccaagcaaccug

SEQ ID NO: 2297082 - RNA, 16 nt, Human
aggcagggaggggacu

SEQ ID NO: 2297083 - RNA, 14 nt, Human
aggcagggagggga

SEQ ID NO: 2297084 - RNA, 13 nt, Human
aggcagggagggg

SEQ ID NO: 2297085 - RNA, 12 nt, Human
aggcagggaggg

SEQ ID NO: 2297086 - RNA, 16 nt, Human
aggcagggagggccug

SEQ ID NO: 2297087 - RNA, 14 nt, Human
aggcagggauuuga

SEQ ID NO: 2297088 - RNA, 15 nt, Human
aggcagggauuugag

SEQ ID NO: 2297089 - RNA, 16 nt, Human
aggcagggauuugagg

SEQ ID NO: 2297090 - RNA, 23 nt, Human
aggcagggaaguccccaggcccc

SEQ ID NO: 2297091 - RNA, 19 nt, Human
aggcagggaaguccccagg

SEQ ID NO: 2297092 - RNA, 13 nt, Human
aggcagggaaguc

SEQ ID NO: 2297093 - RNA, 21 nt, Human
aggcagggaaguguaagaaac

SEQ ID NO: 2297094 - RNA, 12 nt, Human
aggcagggaagu

SEQ ID NO: 2297095 - RNA, 17 nt, Human
aggcaggagaaucacuu

SEQ ID NO: 2297096 - RNA, 23 nt, Human
aggcaggacaugcugaagccaaa

SEQ ID NO: 2297097 - RNA, 15 nt, Human
aggcacccaccauca

SEQ ID NO: 2297098 - RNA, 19 nt, Human
aggcagccccauucugccu

SEQ ID NO: 2297099 - RNA, 20 nt, Human
aggcagccccauucugccug

SEQ ID NO: 2297100 - RNA, 21 nt, Human
aggcagccccauucugccugc

SEQ ID NO: 2297101 - RNA, 20 nt, Human
aggcagcccugucugaagga

SEQ ID NO: 2297102 - RNA, 22 nt, Human
aggcagccccauucugccugcc

SEQ ID NO: 2297103 - RNA, 20 nt, Human
aggcagccuggacauagaga

SEQ ID NO: 2297104 - RNA, 22 nt, Human
aggcagccuggacauagagagg

SEQ ID NO: 2297105 - RNA, 20 nt, Human
aggcagcucuaaaugucaau

SEQ ID NO: 2297106 - RNA, 14 nt, Human
uggacuuuguucac

SEQ ID NO: 2297107 - RNA, 24 nt, Human
uggacuuuguuaguuucuccaagc

SEQ ID NO: 2297108 - RNA, 12 nt, Human
uggagaagagag

SEQ ID NO: 2297109 - RNA, 17 nt, Human
uggagaagacccucccc

SEQ ID NO: 2297110 - RNA, 20 nt, Human
uggagaagagagaggaaagg

SEQ ID NO: 2297111 - RNA, 14 nt, Human
uggagaagagagga

SEQ ID NO: 2297112 - RNA, 19 nt, Human
uggagaagagaggagagga

SEQ ID NO: 2297113 - RNA, 16 nt, Human
uggagaagaacugaaa

SEQ ID NO: 2297114 - RNA, 13 nt, Human
uggagaagcagug

SEQ ID NO: 2297115 - RNA, 16 nt, Human
uggagaagagaggaga

SEQ ID NO: 2297116 - RNA, 18 nt, Human
uggagaagccacaggccu

SEQ ID NO: 2297117 - RNA, 19 nt, Human
uggagaagccacaggccug

SEQ ID NO: 2297118 - RNA, 20 nt, Human
uggagaagccacaggccuga

SEQ ID NO: 2297119 - RNA, 16 nt, Human
uggagcccacuguacu

SEQ ID NO: 2297120 - RNA, 19 nt, Human
uggagcccacuguacuugc

SEQ ID NO: 2297121 - RNA, 23 nt, Human
uggagcccacuguacuugcucuu

SEQ ID NO: 2297122 - RNA, 21 nt, Human
uggaccccaucugugaauaag

SEQ ID NO: 2297123 - RNA, 20 nt, Human
uggaccccaucugugaauaa

SEQ ID NO: 2297124 - RNA, 18 nt, Human
uggaccccaucugugaau

SEQ ID NO: 2297125 - RNA, 16 nt, Human
uggaccccaucuguga

SEQ ID NO: 2297126 - RNA, 14 nt, Human
uggacccccagcuu

SEQ ID NO: 2297127 - RNA, 23 nt, Human
uggaccccagcugggaggcaaga

SEQ ID NO: 2297128 - RNA, 13 nt, Human
uggacccccagcu

SEQ ID NO: 2297129 - RNA, 13 nt, Human
uggaccccagcug

SEQ ID NO: 2297130 - RNA, 14 nt, Human
uggaccccagcugg

SEQ ID NO: 2297131 - RNA, 15 nt, Human
uggaccccagcuggg

SEQ ID NO: 2297132 - RNA, 16 nt, Human
uggaccccagcuggga

SEQ ID NO: 2297133 - RNA, 18 nt, Human
uggaccccagcugggagg

SEQ ID NO: 2297134 - RNA, 19 nt, Human
uggaccccagcugggaggc

SEQ ID NO: 2297135 - RNA, 20 nt, Human
uggaccccagcugggaggca

SEQ ID NO: 2297136 - RNA, 23 nt, Human
uggacaccccuuauccaggacuc

SEQ ID NO: 2297137 - RNA, 22 nt, Human
uggacuuuguuaguuucuccaa

SEQ ID NO: 2297138 - RNA, 11 nt, Human
uggacuuuguu

SEQ ID NO: 2297139 - RNA, 14 nt, Human
uggacccgcucugg

SEQ ID NO: 2297140 - RNA, 19 nt, Human
uggacccgcucuggaccaa

SEQ ID NO: 2297141 - RNA, 15 nt, Human
uggacccgcucugga

SEQ ID NO: 2297142 - RNA, 16 nt, Human
uggacccgcucuggac

SEQ ID NO: 2297143 - RNA, 11 nt, Human
uggagaagcca

SEQ ID NO: 2297144 - RNA, 21 nt, Human
uggagaagccacaggccugag

SEQ ID NO: 2297145 - RNA, 15 nt, Human
uggagcccagaggag

SEQ ID NO: 2297146 - RNA, 19 nt, Human
uggagcccagaggagggca

SEQ ID NO: 2297147 - RNA, 13 nt, Human
uggagcccaggcg

SEQ ID NO: 2297148 - RNA, 12 nt, Human
uggagccgaggc

SEQ ID NO: 2297149 - RNA, 20 nt, Human
uggagcccagaggagggcag

SEQ ID NO: 2297150 - RNA, 23 nt, Human
uggagcccagaggagggcagcag

SEQ ID NO: 2297151 - RNA, 22 nt, Human
uggagccuagagugagggccug

SEQ ID NO: 2297152 - RNA, 22 nt, Human
uggagccggacuuucggaguug

SEQ ID NO: 2297153 - RNA, 23 nt, Human
uggagccggacuuucggaguugg

SEQ ID NO: 2297154 - RNA, 17 nt, Human
uggagccgaggccuacc

SEQ ID NO: 2297155 - RNA, 16 nt, Human
uggagcccaggcggga

SEQ ID NO: 2297156 - RNA, 20 nt, Human
uggagccggacuuucggagu

SEQ ID NO: 2297157 - RNA, 11 nt, Human
uggagccugca

SEQ ID NO: 2297158 - RNA, 18 nt, Human
uggagcuggcgucugucu

SEQ ID NO: 2297159 - RNA, 21 nt, Human
uggagcuucauggcagaaggc

SEQ ID NO: 2297160 - RNA, 13 nt, Human
uggagcugccuga

SEQ ID NO: 2297161 - RNA, 15 nt, Human
uggagcugccugaua

SEQ ID NO: 2297162 - RNA, 17 nt, Human
uggagcugagccucuca

SEQ ID NO: 2297163 - RNA, 14 nt, Human
uggagccuguguaa

SEQ ID NO: 2297164 - RNA, 15 nt, Human
uggagcugagccucu

SEQ ID NO: 2297165 - RNA, 13 nt, Human
uggagcugagccu

SEQ ID NO: 2297166 - RNA, 14 nt, Human
uggagccuggugcc

SEQ ID NO: 2297167 - RNA, 12 nt, Human
uggagccugugu

SEQ ID NO: 2297168 - RNA, 13 nt, Human
uggagccugcagg

SEQ ID NO: 2297169 - RNA, 16 nt, Human
uggagccugcagagcu

SEQ ID NO: 2297170 - RNA, 23 nt, Human
uggagccugcaggguggugcugg

SEQ ID NO: 2297171 - RNA, 15 nt, Human
uggagccugcagggu

SEQ ID NO: 2297172 - RNA, 13 nt, Human
uggagccuggugc

SEQ ID NO: 2297173 - RNA, 16 nt, Human
uggagccuguguaaca

SEQ ID NO: 2297174 - RNA, 15 nt, Human
aggcaaugcuggcug

SEQ ID NO: 2297175 - RNA, 21 nt, Human
uggaggaaaaccaagccgugg

SEQ ID NO: 2297176 - RNA, 23 nt, Human
uggaggaaaaccaagccguggcu

SEQ ID NO: 2297177 - RNA, 19 nt, Human
aggcaaugucaggaacaga

SEQ ID NO: 2297178 - RNA, 17 nt, Human
aggcaaugucaggaaca

SEQ ID NO: 2297179 - RNA, 14 nt, Human
uggagcuuuuuucc

SEQ ID NO: 2297180 - RNA, 16 nt, Human
uggagcuuuuuucuuu

SEQ ID NO: 2297181 - RNA, 21 nt, Human
uggagcuuuuuucuuuaagau

SEQ ID NO: 2297182 - RNA, 13 nt, Human
uggaggaaagcaa

SEQ ID NO: 2297183 - RNA, 16 nt, Human
aggcaaugcuggcugu

SEQ ID NO: 2297184 - RNA, 17 nt, Human
aggcacauggaggagcu

SEQ ID NO: 2297185 - RNA, 14 nt, Human
aggcacauggagga

SEQ ID NO: 2297186 - RNA, 13 nt, Human
aggcacauggagg

SEQ ID NO: 2297187 - RNA, 17 nt, Human
aggcacagugaaggcug

SEQ ID NO: 2297188 - RNA, 23 nt, Human
aggcaaugucaggaacagaagga

SEQ ID NO: 2297189 - RNA, 22 nt, Human
aggcaaugucaggaacagaagg

SEQ ID NO: 2297190 - RNA, 17 nt, Human
aggcacaaaaugaugga

SEQ ID NO: 2297191 - RNA, 13 nt, Human
aggcacaaaauga

SEQ ID NO: 2297192 - RNA, 16 nt, Human
aggaaaauaguaaugu

SEQ ID NO: 2297193 - RNA, 19 nt, Human
aggaaaaguacauuuaaua

SEQ ID NO: 2297194 - RNA, 22 nt, Human
aggaaaaguacauuuaauacag

SEQ ID NO: 2297195 - RNA, 15 nt, Human
aggaaacccagcucu

SEQ ID NO: 2297196 - RNA, 16 nt, Human
aggaaacccagcucug

SEQ ID NO: 2297197 - RNA, 17 nt, Human
aggaaacccagcucugg

SEQ ID NO: 2297198 - RNA, 14 nt, Human
aggaaaauccucug

SEQ ID NO: 2297199 - RNA, 23 nt, Human
aggaaaccaguuaggucucaaua

SEQ ID NO: 2297200 - RNA, 21 nt, Human
aggaaacccagcucuggucca

SEQ ID NO: 2297201 - RNA, 18 nt, Human
aggaaacccagcucuggu

SEQ ID NO: 2297202 - RNA, 20 nt, Human
aggaaacccagcucuggucc

SEQ ID NO: 2297203 - RNA, 19 nt, Human
agcuuugaaggccgaaggc

SEQ ID NO: 2297204 - RNA, 22 nt, Human
agcuuugaaggccgaaggcagu

SEQ ID NO: 2297205 - RNA, 18 nt, Human
aggaaaaggugauaucca

SEQ ID NO: 2297206 - RNA, 21 nt, Human
aggaaaaggugauauccauuc

SEQ ID NO: 2297207 - RNA, 16 nt, Human
aggaaaaguacauuua

SEQ ID NO: 2297208 - RNA, 19 nt, Human
agcuuugaaaauucagugg

SEQ ID NO: 2297209 - RNA, 18 nt, Human
agcuuugaaaauucagug

SEQ ID NO: 2297210 - RNA, 16 nt, Human
agcuuugaaaauucag

SEQ ID NO: 2297211 - RNA, 12 nt, Human
agcuuugaaaau

SEQ ID NO: 2297212 - RNA, 22 nt, Human
aggaaagauuuuuguuguuauu

SEQ ID NO: 2297213 - RNA, 14 nt, Human
ugcuauagccuggg

SEQ ID NO: 2297214 - RNA, 13 nt, Human
ugcuauacugcau

SEQ ID NO: 2297215 - RNA, 21 nt, Human
ugcuauaacuauguugauaaa

SEQ ID NO: 2297216 - RNA, 16 nt, Human
ugcuagucuuaagaac

SEQ ID NO: 2297217 - RNA, 20 nt, Human
aggaaagaaugaaagaguaa

SEQ ID NO: 2297218 - RNA, 16 nt, Human
ugcuaguaauuggaaa

SEQ ID NO: 2297219 - RNA, 16 nt, Human
aggaaagaggcucugg

SEQ ID NO: 2297220 - RNA, 17 nt, Human
aggaaagcaaaggagau

SEQ ID NO: 2297221 - RNA, 14 nt, Human
aggaaaaugaauaa

SEQ ID NO: 2297222 - RNA, 19 nt, Human
aggaaagcaaaggagauug

SEQ ID NO: 2297223 - RNA, 14 nt, Human
ugcuaguaauugga

SEQ ID NO: 2297224 - RNA, 17 nt, Human
aggaaagaaagaaggaa

SEQ ID NO: 2297225 - RNA, 18 nt, Human
aggaaacucuuaucucag

SEQ ID NO: 2297226 - RNA, 22 nt, Human
aggaaacucuuaucucagucau

SEQ ID NO: 2297227 - RNA, 19 nt, Human
aggaaacuggguuccugca

SEQ ID NO: 2297228 - RNA, 12 nt, Human
aggaaacucuua

SEQ ID NO: 2297229 - RNA, 13 nt, Human
aggaaacucuuau

SEQ ID NO: 2297230 - RNA, 17 nt, Human
aggaaacucuuaucuca

SEQ ID NO: 2297231 - RNA, 23 nt, Human
aggaaacucaccugcuggccccu

SEQ ID NO: 2297232 - RNA, 22 nt, Human
aggaaacucaccugcuggcccc

SEQ ID NO: 2297233 - RNA, 21 nt, Human
aggaaacucaccugcuggccc

SEQ ID NO: 2297234 - RNA, 20 nt, Human
aggaaacucaccugcuggcc

SEQ ID NO: 2297235 - RNA, 17 nt, Human
aggaaacucaccugcug

SEQ ID NO: 2297236 - RNA, 16 nt, Human
aggaaacucaccugcu

SEQ ID NO: 2297237 - RNA, 21 nt, Human
aggaaacucugcauucuagua

SEQ ID NO: 2297238 - RNA, 22 nt, Human
aggaaacuccacaucugccuua

SEQ ID NO: 2297239 - RNA, 20 nt, Human
aggaaacuccugacagucuu

SEQ ID NO: 2297240 - RNA, 16 nt, Human
aggaaacuccacaucu

SEQ ID NO: 2297241 - RNA, 19 nt, Human
aggaaacuccacaucugcc

SEQ ID NO: 2297242 - RNA, 20 nt, Human
aggaaacuccacaucugccu

SEQ ID NO: 2297243 - RNA, 21 nt, Human
aggaaacuccacaucugccuu

SEQ ID NO: 2297244 - RNA, 12 nt, Human
aggaaagaggcu

SEQ ID NO: 2297245 - RNA, 13 nt, Human
aggaaagaggcuc

SEQ ID NO: 2297246 - RNA, 13 nt, Human
aggaaagagaacu

SEQ ID NO: 2297247 - RNA, 19 nt, Human
aggaaagagaacuuccaga

SEQ ID NO: 2297248 - RNA, 22 nt, Human
agcuuucuguccuuuuggcacu

SEQ ID NO: 2297249 - RNA, 20 nt, Human
agcuuucuguccuuuuggca

SEQ ID NO: 2297250 - RNA, 16 nt, Human
agcuugggacaaauca

SEQ ID NO: 2297251 - RNA, 19 nt, Human
agcuuguaaauagcucagg

SEQ ID NO: 2297252 - RNA, 23 nt, Human
agcuuggcuguagaaggagacag

SEQ ID NO: 2297253 - RNA, 16 nt, Human
agcuuggcuguagaag

SEQ ID NO: 2297254 - RNA, 14 nt, Human
agcuugggaaugga

SEQ ID NO: 2297255 - RNA, 12 nt, Human
agcuugggaaug

SEQ ID NO: 2297256 - RNA, 20 nt, Human
agcuuguaaauagcucaggu

SEQ ID NO: 2297257 - RNA, 21 nt, Human
agcuuguaaauagcucaggug

SEQ ID NO: 2297258 - RNA, 23 nt, Human
agcuuggaaacuggaugagguca

SEQ ID NO: 2297259 - RNA, 17 nt, Human
agcuuggaaaggaccag

SEQ ID NO: 2297260 - RNA, 16 nt, Human
agcuuggaagagccug

SEQ ID NO: 2297261 - RNA, 17 nt, Human
agcuuggaagagccugc

SEQ ID NO: 2297262 - RNA, 18 nt, Human
agcuuggaagagccugca

SEQ ID NO: 2297263 - RNA, 14 nt, Human
agcuuggccagaag

SEQ ID NO: 2297264 - RNA, 21 nt, Human
agcuuggcagccgagcucgug

SEQ ID NO: 2297265 - RNA, 17 nt, Human
agcuuggcagccgagcu

SEQ ID NO: 2297266 - RNA, 20 nt, Human
agcuuggcagccgagcucgu

SEQ ID NO: 2297267 - RNA, 12 nt, Human
agcuuggcagcc

SEQ ID NO: 2297268 - RNA, 13 nt, Human
agcuuggcagccg

SEQ ID NO: 2297269 - RNA, 14 nt, Human
agcuuggcagccga

SEQ ID NO: 2297270 - RNA, 15 nt, Human
agcuuggcagccgag

SEQ ID NO: 2297271 - RNA, 20 nt, Human
agcuugcugcccuaggcucc

SEQ ID NO: 2297272 - RNA, 22 nt, Human
agcuuauucaucuguuuuucuu

SEQ ID NO: 2297273 - RNA, 21 nt, Human
agcuuauugucuagugaaacu

SEQ ID NO: 2297274 - RNA, 19 nt, Human
agcuuaucaugcugucuuu

SEQ ID NO: 2297275 - RNA, 15 nt, Human
agcuuauuaaaacuc

SEQ ID NO: 2297276 - RNA, 20 nt, Human
agcuuauuaaaacucauuuu

SEQ ID NO: 2297277 - RNA, 15 nt, Human
agcuuaucucagggg

SEQ ID NO: 2297278 - RNA, 14 nt, Human
agcuuaucucaggg

SEQ ID NO: 2297279 - RNA, 15 nt, Human
agcuuaucaugcugu

SEQ ID NO: 2297280 - RNA, 13 nt, Human
agcuuaggcaggg

SEQ ID NO: 2297281 - RNA, 12 nt, Human
agcuuaucucag

SEQ ID NO: 2297282 - RNA, 18 nt, Human
agcuguuuucccugaccu

SEQ ID NO: 2297283 - RNA, 14 nt, Human
agcuguuuucuucu

SEQ ID NO: 2297284 - RNA, 17 nt, Human
agcuuagccaauguggg

SEQ ID NO: 2297285 - RNA, 16 nt, Human
agcuuagcaggagagg

SEQ ID NO: 2297286 - RNA, 22 nt, Human
agcuuagcaggagaggagagcc

SEQ ID NO: 2297287 - RNA, 14 nt, Human
agcuuagcaggaga

SEQ ID NO: 2297288 - RNA, 20 nt, Human
agcuuaaaggggcuagagug

SEQ ID NO: 2297289 - RNA, 19 nt, Human
ugcuaccuggguccuuuuc

SEQ ID NO: 2297290 - RNA, 21 nt, Human
ugcuacccucccugcuguccc

SEQ ID NO: 2297291 - RNA, 13 nt, Human
ugcuaccucaguc

SEQ ID NO: 2297292 - RNA, 16 nt, Human
ugcuaccucagucagu

SEQ ID NO: 2297293 - RNA, 22 nt, Human
ugcuaccuggguccuuuucaga

SEQ ID NO: 2297294 - RNA, 23 nt, Human
ugcuaccuggguccuuuucagaa

SEQ ID NO: 2297295 - RNA, 20 nt, Human
ugcuacgccugcauguaaac

SEQ ID NO: 2297296 - RNA, 19 nt, Human
ugcuacguacaugugaggc

SEQ ID NO: 2297297 - RNA, 16 nt, Human
ugcuacgccugcaugu

SEQ ID NO: 2297298 - RNA, 13 nt, Human
ugcuacgccugca

SEQ ID NO: 2297299 - RNA, 15 nt, Human
agcuguuuucccuga

SEQ ID NO: 2297300 - RNA, 18 nt, Human
agcuguuuuaguuaaauu

SEQ ID NO: 2297301 - RNA, 20 nt, Human
agcuguuuuaguuaaauuuc

SEQ ID NO: 2297302 - RNA, 13 nt, Human
agcuguuugucau

SEQ ID NO: 2297303 - RNA, 14 nt, Human
agcuguuuccauag

SEQ ID NO: 2297304 - RNA, 13 nt, Human
ugcuacgugugau

SEQ ID NO: 2297305 - RNA, 14 nt, Human
ugcuacgugugauu

SEQ ID NO: 2297306 - RNA, 15 nt, Human
ugcuacgugugauuu

SEQ ID NO: 2297307 - RNA, 16 nt, Human
ugcuacgugugauuuu

SEQ ID NO: 2297308 - RNA, 22 nt, Human
ugcuaccucacugggguccugg

SEQ ID NO: 2297309 - RNA, 16 nt, Human
ugcuaccucacugggg

SEQ ID NO: 2297310 - RNA, 15 nt, Human
ugcuaccucacuggg

SEQ ID NO: 2297311 - RNA, 14 nt, Human
ugcuaccucacugg

SEQ ID NO: 2297312 - RNA, 14 nt, Human
ugcgaguauguguu

SEQ ID NO: 2297313 - RNA, 15 nt, Human
ugcgaguauguguuu

SEQ ID NO: 2297314 - RNA, 17 nt, Human
ugcuacccucccugcug

SEQ ID NO: 2297315 - RNA, 18 nt, Human
ugcuacccucccugcugu

SEQ ID NO: 2297316 - RNA, 19 nt, Human
ugcuacccucccugcuguc

SEQ ID NO: 2297317 - RNA, 20 nt, Human
ugcuacccucccugcugucc

SEQ ID NO: 2297318 - RNA, 23 nt, Human
ugcuacccucccugcuguccccu

SEQ ID NO: 2297319 - RNA, 20 nt, Human
ugcggacagccacggccagg

SEQ ID NO: 2297320 - RNA, 21 nt, Human
ugcggacagccacggccaggc

SEQ ID NO: 2297321 - RNA, 19 nt, Human
ugcucugugcccacccucc

SEQ ID NO: 2297322 - RNA, 22 nt, Human
ugcucuguaaucucguuucaaa

SEQ ID NO: 2297323 - RNA, 22 nt, Human
ugcucugucuucuuugcccaca

SEQ ID NO: 2297324 - RNA, 17 nt, Human
ugcugacuguuuucucu

SEQ ID NO: 2297325 - RNA, 20 nt, Human
ugcucugcaggcaccuuagu

SEQ ID NO: 2297326 - RNA, 17 nt, Human
ugcucuggacaggcaug

SEQ ID NO: 2297327 - RNA, 18 nt, Human
ugcucugcauguuacaua

SEQ ID NO: 2297328 - RNA, 15 nt, Human
ugcucugcauguuac

SEQ ID NO: 2297329 - RNA, 19 nt, Human
ugcuauccagcuauuuuua

SEQ ID NO: 2297330 - RNA, 22 nt, Human
ugcuauauuuucaugacuuuuc

SEQ ID NO: 2297331 - RNA, 16 nt, Human
ugcuauauuuucauga

SEQ ID NO: 2297332 - RNA, 18 nt, Human
ugcuauauuuucaugacu

SEQ ID NO: 2297333 - RNA, 23 nt, Human
ugcuauaggcuggagaagcucac

SEQ ID NO: 2297334 - RNA, 19 nt, Human
ugcuauaggcuggagaagc

SEQ ID NO: 2297335 - RNA, 20 nt, Human
ugcuauaggcuggagaagcu

SEQ ID NO: 2297336 - RNA, 19 nt, Human
ugcucugaucauccacugu

SEQ ID NO: 2297337 - RNA, 20 nt, Human
ugcuauccugccaaaaucau

SEQ ID NO: 2297338 - RNA, 22 nt, Human
ugcuauccauuucucauguuuu

SEQ ID NO: 2297339 - RNA, 15 nt, Human
ugcuauccauuucuc

SEQ ID NO: 2297340 - RNA, 14 nt, Human
ugcuaucacacagu

SEQ ID NO: 2297341 - RNA, 22 nt, Human
ugcucugaucauccacugugcc

SEQ ID NO: 2297342 - RNA, 19 nt, Human
ugcucugaucccucuacag

SEQ ID NO: 2297343 - RNA, 16 nt, Human
ugcucugaucccucua

SEQ ID NO: 2297344 - RNA, 14 nt, Human
ugcucugaucccuc

SEQ ID NO: 2297345 - RNA, 13 nt, Human
ugcucugaucccu

SEQ ID NO: 2297346 - RNA, 15 nt, Human
ugcucugcaggcacc

SEQ ID NO: 2297347 - RNA, 16 nt, Human
ugcucugcaggcaccu

SEQ ID NO: 2297348 - RNA, 19 nt, Human
ugcucugcaggcaccuuag

SEQ ID NO: 2297349 - RNA, 19 nt, Human
ugcucugaugaagaggagu

SEQ ID NO: 2297350 - RNA, 18 nt, Human
ugcucugaugaagaggag

SEQ ID NO: 2297351 - RNA, 20 nt, Human
aggaaagccccagcacuaac

SEQ ID NO: 2297352 - RNA, 19 nt, Human
aggaaagccccagcacuaa

SEQ ID NO: 2297353 - RNA, 22 nt, Human
aggaaaggccagcuggcagcag

SEQ ID NO: 2297354 - RNA, 16 nt, Human
aggaaaggccagcugg

SEQ ID NO: 2297355 - RNA, 15 nt, Human
aggaaaggccagcug

SEQ ID NO: 2297356 - RNA, 14 nt, Human
aggaaaggccagcu

SEQ ID NO: 2297357 - RNA, 13 nt, Human
aggaaaggccagc

SEQ ID NO: 2297358 - RNA, 18 nt, Human
aggaaaggcuccaggagc

SEQ ID NO: 2297359 - RNA, 20 nt, Human
aggaaaggcuccaggagcag

SEQ ID NO: 2297360 - RNA, 22 nt, Human
aggaaaggcuccaggagcagcc

SEQ ID NO: 2297361 - RNA, 14 nt, Human
aggaaauauuuauu

SEQ ID NO: 2297362 - RNA, 18 nt, Human
aggaaauauuuauuuuaa

SEQ ID NO: 2297363 - RNA, 16 nt, Human
ugcugagggaccagcc

SEQ ID NO: 2297364 - RNA, 14 nt, Human
ugcugagggaccag

SEQ ID NO: 2297365 - RNA, 12 nt, Human
ugcucuuagcug

SEQ ID NO: 2297366 - RNA, 15 nt, Human
ugcucuuagcugucu

SEQ ID NO: 2297367 - RNA, 20 nt, Human
ugcugagggaccagccaaga

SEQ ID NO: 2297368 - RNA, 19 nt, Human
ugcugagggaccagccaag

SEQ ID NO: 2297369 - RNA, 17 nt, Human
ugcugagggaccagcca

SEQ ID NO: 2297370 - RNA, 21 nt, Human
ugcugaguauguuaagcucuu

SEQ ID NO: 2297371 - RNA, 24 nt, Human
ugcugacuguuuucucuugagagg

SEQ ID NO: 2297372 - RNA, 21 nt, Human
ugcugacuguuuucucuugag

SEQ ID NO: 2297373 - RNA, 16 nt, Human
aggaaagcaauaaaug

SEQ ID NO: 2297374 - RNA, 19 nt, Human
aggaaagcaauaaaugaau

SEQ ID NO: 2297375 - RNA, 18 nt, Human
aggaaagcaauaaaugaa

SEQ ID NO: 2297376 - RNA, 22 nt, Human
aggaaagcaauaaaugaauggg

SEQ ID NO: 2297377 - RNA, 15 nt, Human
ugcugagucucccaa

SEQ ID NO: 2297378 - RNA, 16 nt, Human
ugcugagucucccaag

SEQ ID NO: 2297379 - RNA, 17 nt, Human
ugcugagucucccaagg

SEQ ID NO: 2297380 - RNA, 22 nt, Human
ugcugagucccaggcugagccu

SEQ ID NO: 2297381 - RNA, 18 nt, Human
ugcugagucccaggcuga

SEQ ID NO: 2297382 - RNA, 15 nt, Human
ugcugagucccaggc

SEQ ID NO: 2297383 - RNA, 16 nt, Human
aggaauuuucuuugug

SEQ ID NO: 2297384 - RNA, 14 nt, Human
aggaauuuucuuug

SEQ ID NO: 2297385 - RNA, 22 nt, Human
aggaauuuuauuuuuuucugaa

SEQ ID NO: 2297386 - RNA, 18 nt, Human
aggacaaaaaugaacuga

SEQ ID NO: 2297387 - RNA, 16 nt, Human
aggacaaacagcucag

SEQ ID NO: 2297388 - RNA, 19 nt, Human
aggacaaaaaugaacugaa

SEQ ID NO: 2297389 - RNA, 14 nt, Human
aggacaaccauucc

SEQ ID NO: 2297390 - RNA, 11 nt, Human
ugcugccaucc

SEQ ID NO: 2297391 - RNA, 22 nt, Human
ugcugccacacuucaggcucuu

SEQ ID NO: 2297392 - RNA, 14 nt, Human
ugcugccacuuuuu

SEQ ID NO: 2297393 - RNA, 15 nt, Human
ugcugccacacuuca

SEQ ID NO: 2297394 - RNA, 16 nt, Human
ugcugccacacuucag

SEQ ID NO: 2297395 - RNA, 19 nt, Human
ugcugccacacuucaggcu

SEQ ID NO: 2297396 - RNA, 21 nt, Human
ugcugccauccagguucagcu

SEQ ID NO: 2297397 - RNA, 22 nt, Human
ugcugccauccagguucagcuu

SEQ ID NO: 2297398 - RNA, 14 nt, Human
ugcugcccagccuc

SEQ ID NO: 2297399 - RNA, 16 nt, Human
ugcugcccagccucca

SEQ ID NO: 2297400 - RNA, 16 nt, Human
ugcugcccaggcccag

SEQ ID NO: 2297401 - RNA, 14 nt, Human
ugcugcccaugcca

SEQ ID NO: 2297402 - RNA, 16 nt, Human
ugcugcccaugccacc

SEQ ID NO: 2297403 - RNA, 12 nt, Human
ugcugccaucca

SEQ ID NO: 2297404 - RNA, 13 nt, Human
ugcugccauccag

SEQ ID NO: 2297405 - RNA, 14 nt, Human
ugcugccauccagg

SEQ ID NO: 2297406 - RNA, 15 nt, Human
ugcugccauccaggu

SEQ ID NO: 2297407 - RNA, 18 nt, Human
aggaaaggccagcuggca

SEQ ID NO: 2297408 - RNA, 17 nt, Human
aggaaaggccagcuggc

SEQ ID NO: 2297409 - RNA, 21 nt, Human
aggaaaggccagcuggcagca

SEQ ID NO: 2297410 - RNA, 19 nt, Human
aggaaaucaaauaugcaaa

SEQ ID NO: 2297411 - RNA, 15 nt, Human
aggaagacuuuggaa

SEQ ID NO: 2297412 - RNA, 14 nt, Human
aggaagagaaacca

SEQ ID NO: 2297413 - RNA, 14 nt, Human
aggaagagaaaaaa

SEQ ID NO: 2297414 - RNA, 20 nt, Human
aggaagagcaggcacaugga

SEQ ID NO: 2297415 - RNA, 17 nt, Human
aggaagagcaggcacau

SEQ ID NO: 2297416 - RNA, 12 nt, Human
aggaagagcagg

SEQ ID NO: 2297417 - RNA, 14 nt, Human
aggaagagagcaug

SEQ ID NO: 2297418 - RNA, 17 nt, Human
aggaagcucagggccug

SEQ ID NO: 2297419 - RNA, 18 nt, Human
aggaagcucagggccugg

SEQ ID NO: 2297420 - RNA, 22 nt, Human
aggaagcucagggccuggcuca

SEQ ID NO: 2297421 - RNA, 23 nt, Human
aggaaugaaauccugcuucagug

SEQ ID NO: 2297422 - RNA, 19 nt, Human
aggaauugacccacaagaa

SEQ ID NO: 2297423 - RNA, 20 nt, Human
aggaaucgaggaaccagagc

SEQ ID NO: 2297424 - RNA, 19 nt, Human
aggaaucgaggaaccagag

SEQ ID NO: 2297425 - RNA, 15 nt, Human
aggaagcuccacugu

SEQ ID NO: 2297426 - RNA, 16 nt, Human
aggaagcucucuuucc

SEQ ID NO: 2297427 - RNA, 23 nt, Human
aggaagagcaggcacauggagga

SEQ ID NO: 2297428 - RNA, 23 nt, Human
aggaauccagacccggcugcgug

SEQ ID NO: 2297429 - RNA, 16 nt, Human
ugcccuugucccacuc

SEQ ID NO: 2297430 - RNA, 19 nt, Human
ugcccuuggaggccagcca

SEQ ID NO: 2297431 - RNA, 17 nt, Human
ugcccuugucccacuca

SEQ ID NO: 2297432 - RNA, 13 nt, Human
ugcccuugucuga

SEQ ID NO: 2297433 - RNA, 14 nt, Human
ugcccuugucugag

SEQ ID NO: 2297434 - RNA, 15 nt, Human
ugcccuugucugaga

SEQ ID NO: 2297435 - RNA, 17 nt, Human
ugcccuuggaggccagc

SEQ ID NO: 2297436 - RNA, 19 nt, Human
ugcccuugcccugaccucc

SEQ ID NO: 2297437 - RNA, 17 nt, Human
ugcccuugcccugaccu

SEQ ID NO: 2297438 - RNA, 18 nt, Human
ugcccuugcccugaccuc

SEQ ID NO: 2297439 - RNA, 14 nt, Human
agcugccagagaag

SEQ ID NO: 2297440 - RNA, 13 nt, Human
ugcccuugcccug

SEQ ID NO: 2297441 - RNA, 14 nt, Human
ugcccuugcccuga

SEQ ID NO: 2297442 - RNA, 15 nt, Human
ugcccuugcccugac

SEQ ID NO: 2297443 - RNA, 13 nt, Human
agcugccagagaa

SEQ ID NO: 2297444 - RNA, 12 nt, Human
agcugccagaga

SEQ ID NO: 2297445 - RNA, 14 nt, Human
agcugccagccgag

SEQ ID NO: 2297446 - RNA, 13 nt, Human
agcugccaccugc

SEQ ID NO: 2297447 - RNA, 16 nt, Human
agcugauuuuaacaau

SEQ ID NO: 2297448 - RNA, 15 nt, Human
agcugauuuuaacaa

SEQ ID NO: 2297449 - RNA, 20 nt, Human
agcugauguuggaagagaaa

SEQ ID NO: 2297450 - RNA, 21 nt, Human
agcugauguuggaagagaaag

SEQ ID NO: 2297451 - RNA, 16 nt, Human
agcugcaccugccagc

SEQ ID NO: 2297452 - RNA, 19 nt, Human
agcugauuuuaacaauaac

SEQ ID NO: 2297453 - RNA, 18 nt, Human
agcugcauacaguuugca

SEQ ID NO: 2297454 - RNA, 22 nt, Human
agcugcauccuccaagaaucua

SEQ ID NO: 2297455 - RNA, 18 nt, Human
agcugcauccuccaagaa

SEQ ID NO: 2297456 - RNA, 19 nt, Human
agcugcauccuccaagaau

SEQ ID NO: 2297457 - RNA, 21 nt, Human
agcugcauccuccaagaaucu

SEQ ID NO: 2297458 - RNA, 21 nt, Human
agcugcaccugccagccuggc

SEQ ID NO: 2297459 - RNA, 18 nt, Human
agcugcaccugccagccu

SEQ ID NO: 2297460 - RNA, 22 nt, Human
agcugcaccugccagccuggcu

SEQ ID NO: 2297461 - RNA, 21 nt, Human
ugccgcgucgcccucccaggc

SEQ ID NO: 2297462 - RNA, 16 nt, Human
ugccgcgucgcccucc

SEQ ID NO: 2297463 - RNA, 24 nt, Human
ugccgccuccccacggccgcucca

SEQ ID NO: 2297464 - RNA, 18 nt, Human
ugccgccucccagccugg

SEQ ID NO: 2297465 - RNA, 10 nt, Human
ugccgccugc

SEQ ID NO: 2297466 - RNA, 17 nt, Human
ugccgccucccagccug

SEQ ID NO: 2297467 - RNA, 19 nt, Human
ugccgaaugugcagguuug

SEQ ID NO: 2297468 - RNA, 16 nt, Human
ugccgccucccagccu

SEQ ID NO: 2297469 - RNA, 13 nt, Human
ugccgaaccagga

SEQ ID NO: 2297470 - RNA, 15 nt, Human
ugcccuuucugggca

SEQ ID NO: 2297471 - RNA, 20 nt, Human
ugccgcgucgcccucccagg

SEQ ID NO: 2297472 - RNA, 12 nt, Human
ugccgccugccc

SEQ ID NO: 2297473 - RNA, 14 nt, Human
ugccggaugugcuu

SEQ ID NO: 2297474 - RNA, 20 nt, Human
ugccggcucuuuccuugcuc

SEQ ID NO: 2297475 - RNA, 15 nt, Human
ugccggcccuggggc

SEQ ID NO: 2297476 - RNA, 16 nt, Human
ugccggccggggcuga

SEQ ID NO: 2297477 - RNA, 14 nt, Human
ugccggcccugggg

SEQ ID NO: 2297478 - RNA, 20 nt, Human
ugccucaucuauaacaugca

SEQ ID NO: 2297479 - RNA, 19 nt, Human
ugccucaguguauuuguau

SEQ ID NO: 2297480 - RNA, 22 nt, Human
ugccucauuuagagaggaaaag

SEQ ID NO: 2297481 - RNA, 21 nt, Human
ugccucauuuuagaaccacca

SEQ ID NO: 2297482 - RNA, 19 nt, Human
ugccggguucuagucuccu

SEQ ID NO: 2297483 - RNA, 18 nt, Human
ugccucaguaaaaugaac

SEQ ID NO: 2297484 - RNA, 15 nt, Human
ugccucaguguauuu

SEQ ID NO: 2297485 - RNA, 12 nt, Human
ugccuccaccac

SEQ ID NO: 2297486 - RNA, 14 nt, Human
ugccuccaccacca

SEQ ID NO: 2297487 - RNA, 15 nt, Human
ugccuccaccaccac

SEQ ID NO: 2297488 - RNA, 16 nt, Human
ugccuccaccaccacu

SEQ ID NO: 2297489 - RNA, 17 nt, Human
ugccuccaccaccacug

SEQ ID NO: 2297490 - RNA, 19 nt, Human
ugccuccaccaccacuggc

SEQ ID NO: 2297491 - RNA, 17 nt, Human
ugccuccaggugugcac

SEQ ID NO: 2297492 - RNA, 16 nt, Human
ugccucucucaggcca

SEQ ID NO: 2297493 - RNA, 15 nt, Human
ugccucucucaggcc

SEQ ID NO: 2297494 - RNA, 16 nt, Human
ugccucucugcagguc

SEQ ID NO: 2297495 - RNA, 18 nt, Human
ugccucucugcagguccc

SEQ ID NO: 2297496 - RNA, 20 nt, Human
ugccucugacacacagcucu

SEQ ID NO: 2297497 - RNA, 21 nt, Human
ugccucugacacacagcucug

SEQ ID NO: 2297498 - RNA, 19 nt, Human
ugccucucugcaggucccu

SEQ ID NO: 2297499 - RNA, 20 nt, Human
ugccucucugcaggucccua

SEQ ID NO: 2297500 - RNA, 18 nt, Human
ugccuccaccgcugccua

SEQ ID NO: 2297501 - RNA, 17 nt, Human
ugccuccaccgcugccu

SEQ ID NO: 2297502 - RNA, 16 nt, Human
ugccuccaccgcugcc

SEQ ID NO: 2297503 - RNA, 13 nt, Human
ugccuccaccgcu

SEQ ID NO: 2297504 - RNA, 11 nt, Human
ugccuccaccg

SEQ ID NO: 2297505 - RNA, 17 nt, Human
ugccuccacccucugag

SEQ ID NO: 2297506 - RNA, 15 nt, Human
ugccuccacccucug

SEQ ID NO: 2297507 - RNA, 16 nt, Human
ugccuccacccucuga

SEQ ID NO: 2297508 - RNA, 18 nt, Human
ugccuccaccccccagaa

SEQ ID NO: 2297509 - RNA, 12 nt, Human
ugccuccacccu

SEQ ID NO: 2297510 - RNA, 13 nt, Human
ugccuccacccuc

SEQ ID NO: 2297511 - RNA, 14 nt, Human
ugccuccacccucu

SEQ ID NO: 2297512 - RNA, 20 nt, Human
ugccuccaccaccacuggcc

SEQ ID NO: 2297513 - RNA, 21 nt, Human
ugccuccaccaccacuggcca

SEQ ID NO: 2297514 - RNA, 22 nt, Human
ugccuccaccaccacuggccac

SEQ ID NO: 2297515 - RNA, 23 nt, Human
ugccuccaccaccacuggccacc

SEQ ID NO: 2297516 - RNA, 20 nt, Human
ugccuccaccgcugccuaag

SEQ ID NO: 2297517 - RNA, 13 nt, Human
ugccuccaggugu

SEQ ID NO: 2297518 - RNA, 15 nt, Human
ugccuccaggugugc

SEQ ID NO: 2297519 - RNA, 13 nt, Human
ugccucccaucac

SEQ ID NO: 2297520 - RNA, 14 nt, Human
ugccucccaucacc

SEQ ID NO: 2297521 - RNA, 19 nt, Human
ugccucccaucacccgcua

SEQ ID NO: 2297522 - RNA, 13 nt, Human
ugccucucucagg

SEQ ID NO: 2297523 - RNA, 14 nt, Human
ugccucucucaggc

SEQ ID NO: 2297524 - RNA, 20 nt, Human
agcugaugaacuuauucugu

SEQ ID NO: 2297525 - RNA, 22 nt, Human
agcugaugaacuuauucuguag

SEQ ID NO: 2297526 - RNA, 19 nt, Human
agcugauccagagcacaga

SEQ ID NO: 2297527 - RNA, 19 nt, Human
agcucuugaagacacugaa

SEQ ID NO: 2297528 - RNA, 18 nt, Human
agcucuucuuaaaguauu

SEQ ID NO: 2297529 - RNA, 12 nt, Human
agcucuugcccu

SEQ ID NO: 2297530 - RNA, 14 nt, Human
agcucuugcccuuc

SEQ ID NO: 2297531 - RNA, 15 nt, Human
agcucuugcccuucc

SEQ ID NO: 2297532 - RNA, 16 nt, Human
agcucuugcccuuccc

SEQ ID NO: 2297533 - RNA, 23 nt, Human
agcucuucugccggcccuggggc

SEQ ID NO: 2297534 - RNA, 22 nt, Human
agcucuucugccggcccugggg

SEQ ID NO: 2297535 - RNA, 21 nt, Human
agcucuucugccggcccuggg

SEQ ID NO: 2297536 - RNA, 20 nt, Human
agcucuucugccggcccugg

SEQ ID NO: 2297537 - RNA, 16 nt, Human
agcucuucuccccagg

SEQ ID NO: 2297538 - RNA, 17 nt, Human
agcucuucuccccaggu

SEQ ID NO: 2297539 - RNA, 20 nt, Human
agcucuucuccccaggugug

SEQ ID NO: 2297540 - RNA, 18 nt, Human
agcucuucuccaggcugu

SEQ ID NO: 2297541 - RNA, 20 nt, Human
agcucuggugacaccagccu

SEQ ID NO: 2297542 - RNA, 19 nt, Human
agcucuggugacaccagcc

SEQ ID NO: 2297543 - RNA, 17 nt, Human
agcucuggugacaccag

SEQ ID NO: 2297544 - RNA, 21 nt, Human
agcucuggugacaccagccuu

SEQ ID NO: 2297545 - RNA, 23 nt, Human
agcucuggugagucuuggcggca

SEQ ID NO: 2297546 - RNA, 12 nt, Human
agcucuguauca

SEQ ID NO: 2297547 - RNA, 23 nt, Human
agcucuguaucaggacccagagg

SEQ ID NO: 2297548 - RNA, 22 nt, Human
agcucuguaucaggacccagag

SEQ ID NO: 2297549 - RNA, 17 nt, Human
agcucuucuccaggcug

SEQ ID NO: 2297550 - RNA, 12 nt, Human
agcucuguccug

SEQ ID NO: 2297551 - RNA, 17 nt, Human
agcugauguuggaagag

SEQ ID NO: 2297552 - RNA, 14 nt, Human
agcugauuuuaaca

SEQ ID NO: 2297553 - RNA, 17 nt, Human
agcugcacccucaggca

SEQ ID NO: 2297554 - RNA, 13 nt, Human
agcugcacccuca

SEQ ID NO: 2297555 - RNA, 22 nt, Human
agcugcacccucaggcaggugg

SEQ ID NO: 2297556 - RNA, 20 nt, Human
agcugcacccucaggcaggu

SEQ ID NO: 2297557 - RNA, 19 nt, Human
agcugcacccucaggcagg

SEQ ID NO: 2297558 - RNA, 18 nt, Human
agcugcacccucaggcag

SEQ ID NO: 2297559 - RNA, 15 nt, Human
agcucuccccucaga

SEQ ID NO: 2297560 - RNA, 16 nt, Human
agcucuccagcuccaa

SEQ ID NO: 2297561 - RNA, 17 nt, Human
agcucuccagcuccaag

SEQ ID NO: 2297562 - RNA, 13 nt, Human
agcucuccagcuc

SEQ ID NO: 2297563 - RNA, 14 nt, Human
agcucuccagcucc

SEQ ID NO: 2297564 - RNA, 13 nt, Human
agcucucagccaa

SEQ ID NO: 2297565 - RNA, 12 nt, Human
agcucucagcca

SEQ ID NO: 2297566 - RNA, 19 nt, Human
ugcccuccagcucuuuccu

SEQ ID NO: 2297567 - RNA, 18 nt, Human
ugcccuccagcucuuucc

SEQ ID NO: 2297568 - RNA, 17 nt, Human
agcucuaucaccaagga

SEQ ID NO: 2297569 - RNA, 22 nt, Human
agcucuaucaccaaggagccaa

SEQ ID NO: 2297570 - RNA, 22 nt, Human
agcucuauguuuacaaauggac

SEQ ID NO: 2297571 - RNA, 20 nt, Human
agcucuauuaagauuuccaa

SEQ ID NO: 2297572 - RNA, 22 nt, Human
agcucuauuaagauuuccaagu

SEQ ID NO: 2297573 - RNA, 21 nt, Human
ugcccuccacagccgcagccu

SEQ ID NO: 2297574 - RNA, 18 nt, Human
ugcccuccacagccgcag

SEQ ID NO: 2297575 - RNA, 18 nt, Human
ugcccucauuuuauguca

SEQ ID NO: 2297576 - RNA, 21 nt, Human
ugcccucauggccccucugac

SEQ ID NO: 2297577 - RNA, 22 nt, Human
ugcccuccaagaccuucuccuu

SEQ ID NO: 2297578 - RNA, 19 nt, Human
ugcccuccaagaccuucuc

SEQ ID NO: 2297579 - RNA, 20 nt, Human
ugcccuccaagaccuucucc

SEQ ID NO: 2297580 - RNA, 18 nt, Human
agcucucccucuggcccu

SEQ ID NO: 2297581 - RNA, 17 nt, Human
agcucucccucuggccc

SEQ ID NO: 2297582 - RNA, 16 nt, Human
agcucucccucuggcc

SEQ ID NO: 2297583 - RNA, 15 nt, Human
agcucucccucuggc

SEQ ID NO: 2297584 - RNA, 14 nt, Human
agcucucccucugg

SEQ ID NO: 2297585 - RNA, 13 nt, Human
agcucucccucug

SEQ ID NO: 2297586 - RNA, 11 nt, Human
agcucucccuc

SEQ ID NO: 2297587 - RNA, 19 nt, Human
agcucuccagucaggaggc

SEQ ID NO: 2297588 - RNA, 23 nt, Human
agcucucccucuggcccugccuu

SEQ ID NO: 2297589 - RNA, 22 nt, Human
agcucucccucuggcccugccu

SEQ ID NO: 2297590 - RNA, 20 nt, Human
agcucucccucuggcccugc

SEQ ID NO: 2297591 - RNA, 19 nt, Human
agcucucccucuggcccug

SEQ ID NO: 2297592 - RNA, 18 nt, Human
agcucuccggucucucuc

SEQ ID NO: 2297593 - RNA, 16 nt, Human
agcucucuccucccuu

SEQ ID NO: 2297594 - RNA, 23 nt, Human
agcucucggaacugcaugcugcu

SEQ ID NO: 2297595 - RNA, 22 nt, Human
agcucucggaacugcaugcugc

SEQ ID NO: 2297596 - RNA, 20 nt, Human
agcucucggaacugcaugcu

SEQ ID NO: 2297597 - RNA, 18 nt, Human
agcucucggaacugcaug

SEQ ID NO: 2297598 - RNA, 17 nt, Human
agcucucggaacugcau

SEQ ID NO: 2297599 - RNA, 22 nt, Human
agcucugcuccucuccccagca

SEQ ID NO: 2297600 - RNA, 20 nt, Human
agcucugguccauagagagc

SEQ ID NO: 2297601 - RNA, 12 nt, Human
agcucugcuccu

SEQ ID NO: 2297602 - RNA, 14 nt, Human
ugcgaccccaucug

SEQ ID NO: 2297603 - RNA, 15 nt, Human
ugcgaccccaucugc

SEQ ID NO: 2297604 - RNA, 18 nt, Human
ugcgaccccaucugccca

SEQ ID NO: 2297605 - RNA, 19 nt, Human
ugcgaccccaucugcccag

SEQ ID NO: 2297606 - RNA, 20 nt, Human
ugcgaccccaucugcccagg

SEQ ID NO: 2297607 - RNA, 22 nt, Human
ugcgaaugguuccauucucucu

SEQ ID NO: 2297608 - RNA, 18 nt, Human
ugcgaaggggcccugguc

SEQ ID NO: 2297609 - RNA, 21 nt, Human
ugcgaaggggcccugguccuu

SEQ ID NO: 2297610 - RNA, 16 nt, Human
ugcgaaggggcccugg

SEQ ID NO: 2297611 - RNA, 14 nt, Human
ugccuuuuuugauc

SEQ ID NO: 2297612 - RNA, 21 nt, Human
ugccuuuuuucacggaaguuu

SEQ ID NO: 2297613 - RNA, 19 nt, Human
ugcgaaaggaugaaaguga

SEQ ID NO: 2297614 - RNA, 15 nt, Human
ugcgacuuucugccu

SEQ ID NO: 2297615 - RNA, 16 nt, Human
ugcgacuuucugccug

SEQ ID NO: 2297616 - RNA, 17 nt, Human
ugcgacuuucugccugg

SEQ ID NO: 2297617 - RNA, 18 nt, Human
ugcgacuuucugccugga

SEQ ID NO: 2297618 - RNA, 21 nt, Human
ugcgacuuucugccuggagug

SEQ ID NO: 2297619 - RNA, 18 nt, Human
ugcggacagccacggcca

SEQ ID NO: 2297620 - RNA, 22 nt, Human
ugcgaguauguguuugugugug

SEQ ID NO: 2297621 - RNA, 17 nt, Human
ugcggacagccacggcc

SEQ ID NO: 2297622 - RNA, 19 nt, Human
ugccuuuaaaucugugaug

SEQ ID NO: 2297623 - RNA, 15 nt, Human
ugccuuuaaaucugu

SEQ ID NO: 2297624 - RNA, 18 nt, Human
ugccuuuaaaucugugau

SEQ ID NO: 2297625 - RNA, 14 nt, Human
ugccuuuauugugu

SEQ ID NO: 2297626 - RNA, 16 nt, Human
ugccuuuaaaguauga

SEQ ID NO: 2297627 - RNA, 17 nt, Human
ugccuuuaaaguaugaa

SEQ ID NO: 2297628 - RNA, 18 nt, Human
ugccuuuaaaguaugaau

SEQ ID NO: 2297629 - RNA, 14 nt, Human
ugccuuuaaaucug

SEQ ID NO: 2297630 - RNA, 20 nt, Human
ugccuuuauuguguuuguca

SEQ ID NO: 2297631 - RNA, 21 nt, Human
ugccuuuauuguguuugucau

SEQ ID NO: 2297632 - RNA, 13 nt, Human
ugcgaaaggauga

SEQ ID NO: 2297633 - RNA, 20 nt, Human
ugccuuuuuucacggaaguu

SEQ ID NO: 2297634 - RNA, 18 nt, Human
agcugugagccuuggcug

SEQ ID NO: 2297635 - RNA, 21 nt, Human
agcugugagacagugggaaau

SEQ ID NO: 2297636 - RNA, 15 nt, Human
agcugugagccuugg

SEQ ID NO: 2297637 - RNA, 16 nt, Human
agcugugagccuuggc

SEQ ID NO: 2297638 - RNA, 17 nt, Human
agcugugagccuuggcu

SEQ ID NO: 2297639 - RNA, 18 nt, Human
agcugugcagguggggag

SEQ ID NO: 2297640 - RNA, 12 nt, Human
agcugugcaggu

SEQ ID NO: 2297641 - RNA, 10 nt, Human
agcugugcag

SEQ ID NO: 2297642 - RNA, 17 nt, Human
agcugugaccucucccc

SEQ ID NO: 2297643 - RNA, 17 nt, Human
agcugugaacauggacu

SEQ ID NO: 2297644 - RNA, 18 nt, Human
agcugugacuucuccagg

SEQ ID NO: 2297645 - RNA, 18 nt, Human
agcugugagacaguggga

SEQ ID NO: 2297646 - RNA, 19 nt, Human
agcugugagacagugggaa

SEQ ID NO: 2297647 - RNA, 18 nt, Human
agcugggggccaugagcu

SEQ ID NO: 2297648 - RNA, 17 nt, Human
agcuggggcugagggau

SEQ ID NO: 2297649 - RNA, 16 nt, Human
agcugggggccaugag

SEQ ID NO: 2297650 - RNA, 20 nt, Human
agcugggggccaugagcucc

SEQ ID NO: 2297651 - RNA, 17 nt, Human
agcugggggugggccag

SEQ ID NO: 2297652 - RNA, 19 nt, Human
agcugggggugggccaggc

SEQ ID NO: 2297653 - RNA, 18 nt, Human
agcugggggugggccagg

SEQ ID NO: 2297654 - RNA, 21 nt, Human
agcugggggugggccaggcug

SEQ ID NO: 2297655 - RNA, 20 nt, Human
agcugggggugggccaggcu

SEQ ID NO: 2297656 - RNA, 20 nt, Human
agcuggggaagcuucuuaaa

SEQ ID NO: 2297657 - RNA, 16 nt, Human
agcuggggcgugggga

SEQ ID NO: 2297658 - RNA, 18 nt, Human
agcuggggcguggggagg

SEQ ID NO: 2297659 - RNA, 20 nt, Human
agcuggggcguggggagggc

SEQ ID NO: 2297660 - RNA, 15 nt, Human
agcuggggaugucuc

SEQ ID NO: 2297661 - RNA, 20 nt, Human
agcuggggccaggcuggguc

SEQ ID NO: 2297662 - RNA, 23 nt, Human
ugccuuaccuccugcccaggaga

SEQ ID NO: 2297663 - RNA, 15 nt, Human
ugccuuagagccagg

SEQ ID NO: 2297664 - RNA, 19 nt, Human
ugccuuguguacaguuauu

SEQ ID NO: 2297665 - RNA, 19 nt, Human
ugccuugugaaggaauuau

SEQ ID NO: 2297666 - RNA, 21 nt, Human
ugccuuagaaccuuucuuaca

SEQ ID NO: 2297667 - RNA, 19 nt, Human
ugccuuacucuucuugaaa

SEQ ID NO: 2297668 - RNA, 18 nt, Human
ugccuuacucuucuugaa

SEQ ID NO: 2297669 - RNA, 15 nt, Human
ugccuuacucuucuu

SEQ ID NO: 2297670 - RNA, 14 nt, Human
ugccuuagaaccuu

SEQ ID NO: 2297671 - RNA, 17 nt, Human
ugccuuagaaccuuucu

SEQ ID NO: 2297672 - RNA, 21 nt, Human
ugccugugugacaucaguggc

SEQ ID NO: 2297673 - RNA, 14 nt, Human
ugccugugucuucu

SEQ ID NO: 2297674 - RNA, 18 nt, Human
ugccuguuauaacucugc

SEQ ID NO: 2297675 - RNA, 19 nt, Human
ugccuguuauaacucugca

SEQ ID NO: 2297676 - RNA, 20 nt, Human
ugccuguuauaacucugcac

SEQ ID NO: 2297677 - RNA, 11 nt, Human
ugccuguucag

SEQ ID NO: 2297678 - RNA, 15 nt, Human
ugccuguucagcucc

SEQ ID NO: 2297679 - RNA, 16 nt, Human
ugccuguucagcucca

SEQ ID NO: 2297680 - RNA, 21 nt, Human
ugccuuaccuccugcccagga

SEQ ID NO: 2297681 - RNA, 20 nt, Human
ugccuuaccuccugcccagg

SEQ ID NO: 2297682 - RNA, 19 nt, Human
ugccuuaccuccugcccag

SEQ ID NO: 2297683 - RNA, 18 nt, Human
ugccuuaccuccugccca

SEQ ID NO: 2297684 - RNA, 17 nt, Human
ugccuguucagcuccag

SEQ ID NO: 2297685 - RNA, 17 nt, Human
agcugggauguuucugu

SEQ ID NO: 2297686 - RNA, 16 nt, Human
agcugggcagaaggcc

SEQ ID NO: 2297687 - RNA, 18 nt, Human
agcugggcagaaggccaa

SEQ ID NO: 2297688 - RNA, 12 nt, Human
agcugggcccaa

SEQ ID NO: 2297689 - RNA, 15 nt, Human
agcugggcccaaccc

SEQ ID NO: 2297690 - RNA, 20 nt, Human
agcugggcccaacccugucu

SEQ ID NO: 2297691 - RNA, 21 nt, Human
agcugggcccaacccugucug

SEQ ID NO: 2297692 - RNA, 13 nt, Human
agcugggccccag

SEQ ID NO: 2297693 - RNA, 14 nt, Human
agcugggccccagc

SEQ ID NO: 2297694 - RNA, 15 nt, Human
agcugggccccagcc

SEQ ID NO: 2297695 - RNA, 16 nt, Human
agcugggccccagccc

SEQ ID NO: 2297696 - RNA, 14 nt, Human
agcugggcagguug

SEQ ID NO: 2297697 - RNA, 23 nt, Human
agcugggauuacaggcuccugcc

SEQ ID NO: 2297698 - RNA, 22 nt, Human
agcugggauuacaggcuccugc

SEQ ID NO: 2297699 - RNA, 17 nt, Human
agcuggggccaggcugg

SEQ ID NO: 2297700 - RNA, 22 nt, Human
agcuggggaucccuccccccca

SEQ ID NO: 2297701 - RNA, 15 nt, Human
agcuggggaucccuc

SEQ ID NO: 2297702 - RNA, 14 nt, Human
agcuggggaccugg

SEQ ID NO: 2297703 - RNA, 15 nt, Human
agcugggcucugcca

SEQ ID NO: 2297704 - RNA, 11 nt, Human
agcugggcugu

SEQ ID NO: 2297705 - RNA, 20 nt, Human
agcugggccccagcccaccc

SEQ ID NO: 2297706 - RNA, 17 nt, Human
agcugggccccagccca

SEQ ID NO: 2297707 - RNA, 18 nt, Human
agcugggccccagcccac

SEQ ID NO: 2297708 - RNA, 22 nt, Human
agcugggccccagcccacccuc

SEQ ID NO: 2297709 - RNA, 15 nt, Human
agcugggcucugcaa

SEQ ID NO: 2297710 - RNA, 14 nt, Human
agcugggcucugcc

SEQ ID NO: 2297711 - RNA, 22 nt, Human
agcugggcucugccacccuacc

SEQ ID NO: 2297712 - RNA, 21 nt, Human
agcugggaggcauggcccugg

SEQ ID NO: 2297713 - RNA, 22 nt, Human
agcugggaggcauggcccuggg

SEQ ID NO: 2297714 - RNA, 22 nt, Human
agcugggaucacauguggacuu

SEQ ID NO: 2297715 - RNA, 16 nt, Human
agcugggaggcaagag

SEQ ID NO: 2297716 - RNA, 17 nt, Human
agcugggaggcaagagg

SEQ ID NO: 2297717 - RNA, 19 nt, Human
agcugggaggcaagagggg

SEQ ID NO: 2297718 - RNA, 23 nt, Human
agcugggaggcaagaggggugga

SEQ ID NO: 2297719 - RNA, 14 nt, Human
agcugggaggcaug

SEQ ID NO: 2297720 - RNA, 16 nt, Human
agcugggaggcauggc

SEQ ID NO: 2297721 - RNA, 19 nt, Human
agcugggaggcauggcccu

SEQ ID NO: 2297722 - RNA, 20 nt, Human
agcugggaggcauggcccug

SEQ ID NO: 2297723 - RNA, 21 nt, Human
agcugggauuacaggcuccug

SEQ ID NO: 2297724 - RNA, 18 nt, Human
agcugggauuacaggcuc

SEQ ID NO: 2297725 - RNA, 23 nt, Human
agcugggaugauuggagggggga

SEQ ID NO: 2297726 - RNA, 17 nt, Human
agcugggacuacaggug

SEQ ID NO: 2297727 - RNA, 19 nt, Human
agcugggacuacaggugug

SEQ ID NO: 2297728 - RNA, 18 nt, Human
agcugggaggaaaagaaa

SEQ ID NO: 2297729 - RNA, 13 nt, Human
agcugggaggcaa

SEQ ID NO: 2297730 - RNA, 15 nt, Human
agcugggaggaaaag

SEQ ID NO: 2297731 - RNA, 14 nt, Human
agcugggaggaaaa

SEQ ID NO: 2297732 - RNA, 13 nt, Human
agcugggaggaaa

SEQ ID NO: 2297733 - RNA, 12 nt, Human
agcugggaggaa

SEQ ID NO: 2297734 - RNA, 15 nt, Human
agcuggagaagaccc

SEQ ID NO: 2297735 - RNA, 17 nt, Human
agcuggagaaauauggu

SEQ ID NO: 2297736 - RNA, 15 nt, Human
agcuggacuacccac

SEQ ID NO: 2297737 - RNA, 16 nt, Human
agcuggacuacccacg

SEQ ID NO: 2297738 - RNA, 12 nt, Human
agcuggaagcac

SEQ ID NO: 2297739 - RNA, 13 nt, Human
agcuggaaaagua

SEQ ID NO: 2297740 - RNA, 15 nt, Human
agcugccugguauau

SEQ ID NO: 2297741 - RNA, 21 nt, Human
agcugccugggaucccucauc

SEQ ID NO: 2297742 - RNA, 13 nt, Human
agcugccugggau

SEQ ID NO: 2297743 - RNA, 19 nt, Human
agcugccugggaucccuca

SEQ ID NO: 2297744 - RNA, 22 nt, Human
ugccucugacacacagcucugu

SEQ ID NO: 2297745 - RNA, 20 nt, Human
agcugccucucgguggccag

SEQ ID NO: 2297746 - RNA, 23 nt, Human
agcugccuccccucuccuuccug

SEQ ID NO: 2297747 - RNA, 12 nt, Human
agcugccugcuu

SEQ ID NO: 2297748 - RNA, 23 nt, Human
agcugccugcuuuucacugcugc

SEQ ID NO: 2297749 - RNA, 16 nt, Human
agcugccucuucugug

SEQ ID NO: 2297750 - RNA, 14 nt, Human
agcugccucuucug

SEQ ID NO: 2297751 - RNA, 20 nt, Human
agcugccuccccucuccuuc

SEQ ID NO: 2297752 - RNA, 23 nt, Human
agcuauugauauaaauaaaacau

SEQ ID NO: 2297753 - RNA, 17 nt, Human
agcuauugauauaaaua

SEQ ID NO: 2297754 - RNA, 13 nt, Human
agcuauuucaucu

SEQ ID NO: 2297755 - RNA, 21 nt, Human
agcuauuucaucuauuuuugg

SEQ ID NO: 2297756 - RNA, 20 nt, Human
agcuauggugagaugcagcu

SEQ ID NO: 2297757 - RNA, 18 nt, Human
agcuauuuccauuccaga

SEQ ID NO: 2297758 - RNA, 17 nt, Human
agcuauuucaucuauuu

SEQ ID NO: 2297759 - RNA, 14 nt, Human
agcuauuucaucua

SEQ ID NO: 2297760 - RNA, 19 nt, Human
agcuauggugucauaggcu

SEQ ID NO: 2297761 - RNA, 18 nt, Human
agcuauagacccgaggaa

SEQ ID NO: 2297762 - RNA, 17 nt, Human
agcuauagacccgagga

SEQ ID NO: 2297763 - RNA, 17 nt, Human
agcuauaccugugccuc

SEQ ID NO: 2297764 - RNA, 19 nt, Human
agcuauagacccgaggaaa

SEQ ID NO: 2297765 - RNA, 15 nt, Human
agcuauauccaugua

SEQ ID NO: 2297766 - RNA, 14 nt, Human
agcuauauccaugu

SEQ ID NO: 2297767 - RNA, 24 nt, Human
agcuaucuggucaaccuccuggac

SEQ ID NO: 2297768 - RNA, 17 nt, Human
agcuaugggagccccag

SEQ ID NO: 2297769 - RNA, 23 nt, Human
agcuaugcugguaggcuccugcc

SEQ ID NO: 2297770 - RNA, 19 nt, Human
agcuaugggagccccaggg

SEQ ID NO: 2297771 - RNA, 18 nt, Human
agcuaugggagccccagg

SEQ ID NO: 2297772 - RNA, 22 nt, Human
agcuaugggagccccagggucu

SEQ ID NO: 2297773 - RNA, 17 nt, Human
agcuauggugagaugca

SEQ ID NO: 2297774 - RNA, 20 nt, Human
agcuacugauuuccuuugga

SEQ ID NO: 2297775 - RNA, 23 nt, Human
agcuacugauuuccuuuggagcu

SEQ ID NO: 2297776 - RNA, 18 nt, Human
agcuacucaggaggcuga

SEQ ID NO: 2297777 - RNA, 17 nt, Human
agcuacucaggaggcug

SEQ ID NO: 2297778 - RNA, 15 nt, Human
agcuacucaggaggc

SEQ ID NO: 2297779 - RNA, 13 nt, Human
agcuacucaggag

SEQ ID NO: 2297780 - RNA, 22 nt, Human
agcuacucaagaggcugaggca

SEQ ID NO: 2297781 - RNA, 21 nt, Human
agcuacucagaagccugaggc

SEQ ID NO: 2297782 - RNA, 20 nt, Human
agcuacugugugugugaaug

SEQ ID NO: 2297783 - RNA, 19 nt, Human
agcuacugugugugugaau

SEQ ID NO: 2297784 - RNA, 15 nt, Human
agcuacugugugugu

SEQ ID NO: 2297785 - RNA, 19 nt, Human
agcuacugcggaaaaggaa

SEQ ID NO: 2297786 - RNA, 18 nt, Human
agcuacugcggaaaagga

SEQ ID NO: 2297787 - RNA, 16 nt, Human
agcuacugauuuuugu

SEQ ID NO: 2297788 - RNA, 14 nt, Human
agcuacuugggagg

SEQ ID NO: 2297789 - RNA, 21 nt, Human
agcuacuuccuccuccccacu

SEQ ID NO: 2297790 - RNA, 22 nt, Human
agcuacuugggaagcugaggcg

SEQ ID NO: 2297791 - RNA, 23 nt, Human
agcuacugugugugugaaugaac

SEQ ID NO: 2297792 - RNA, 15 nt, Human
agcuacuuccuccuc

SEQ ID NO: 2297793 - RNA, 16 nt, Human
agcuacuuccuccucc

SEQ ID NO: 2297794 - RNA, 23 nt, Human
agcuauaaauuccucuuugcuuu

SEQ ID NO: 2297795 - RNA, 16 nt, Human
agcuauaccugugccu

SEQ ID NO: 2297796 - RNA, 15 nt, Human
agcuauaccugugcc

SEQ ID NO: 2297797 - RNA, 12 nt, Human
agcuaguuuucu

SEQ ID NO: 2297798 - RNA, 18 nt, Human
agcuauaaaaugaauaca

SEQ ID NO: 2297799 - RNA, 22 nt, Human
agcuauuuuuauuuguuugugc

SEQ ID NO: 2297800 - RNA, 16 nt, Human
agcuauuuuuacuaga

SEQ ID NO: 2297801 - RNA, 10 nt, Human
agcuauuuuu

SEQ ID NO: 2297802 - RNA, 20 nt, Human
agcuauuuccauuccagaau

SEQ ID NO: 2297803 - RNA, 15 nt, Human
agcucagggccuggc

SEQ ID NO: 2297804 - RNA, 16 nt, Human
agcucagggccuggcu

SEQ ID NO: 2297805 - RNA, 17 nt, Human
ugccauguuggccaggc

SEQ ID NO: 2297806 - RNA, 17 nt, Human
agcucagggccuggcuc

SEQ ID NO: 2297807 - RNA, 18 nt, Human
ugccauguuggccaggcu

SEQ ID NO: 2297808 - RNA, 19 nt, Human
ugccauguuggccaggcug

SEQ ID NO: 2297809 - RNA, 18 nt, Human
ugcccaaccugcucuccu

SEQ ID NO: 2297810 - RNA, 22 nt, Human
ugcccaaccugcucuccucuug

SEQ ID NO: 2297811 - RNA, 22 nt, Human
ugcccaacccuucccucaccuu

SEQ ID NO: 2297812 - RNA, 20 nt, Human
ugcccaacccuucccucacc

SEQ ID NO: 2297813 - RNA, 18 nt, Human
ugccauucccugccuggg

SEQ ID NO: 2297814 - RNA, 23 nt, Human
ugccauuaucccugaaucccccu

SEQ ID NO: 2297815 - RNA, 23 nt, Human
ugcccaagccagaggcuggguuc

SEQ ID NO: 2297816 - RNA, 23 nt, Human
ugcccaaccugcucuccucuugc

SEQ ID NO: 2297817 - RNA, 24 nt, Human
ugcccaaccugcucuccucuugcc

SEQ ID NO: 2297818 - RNA, 21 nt, Human
agcuauuuuuacuagaacaca

SEQ ID NO: 2297819 - RNA, 18 nt, Human
agcucagggccuggcuca

SEQ ID NO: 2297820 - RNA, 16 nt, Human
ugccauuaucccugaa

SEQ ID NO: 2297821 - RNA, 16 nt, Human
ugccauucacuucaua

SEQ ID NO: 2297822 - RNA, 20 nt, Human
ugccauguuggccaggcugg

SEQ ID NO: 2297823 - RNA, 21 nt, Human
ugccauguuggccaggcuggu

SEQ ID NO: 2297824 - RNA, 16 nt, Human
ugcccacacaccccaa

SEQ ID NO: 2297825 - RNA, 15 nt, Human
ugcccaauuggagga

SEQ ID NO: 2297826 - RNA, 20 nt, Human
ugcccaauaugcaguucugc

SEQ ID NO: 2297827 - RNA, 14 nt, Human
ugcccaacuguuau

SEQ ID NO: 2297828 - RNA, 22 nt, Human
ugcccaaguuguggugcugaca

SEQ ID NO: 2297829 - RNA, 22 nt, Human
ugcccaauaugcaguucugcag

SEQ ID NO: 2297830 - RNA, 14 nt, Human
ugcccaagggaaag

SEQ ID NO: 2297831 - RNA, 22 nt, Human
ugcccaagccagaggcuggguu

SEQ ID NO: 2297832 - RNA, 14 nt, Human
ugcccacaggauca

SEQ ID NO: 2297833 - RNA, 15 nt, Human
ugcccaggcaggucu

SEQ ID NO: 2297834 - RNA, 16 nt, Human
ugcccaggcaggucuu

SEQ ID NO: 2297835 - RNA, 17 nt, Human
ugcccaggcaggucuug

SEQ ID NO: 2297836 - RNA, 20 nt, Human
ugcccaggcaggucuugaac

SEQ ID NO: 2297837 - RNA, 11 nt, Human
ugcccaggccc

SEQ ID NO: 2297838 - RNA, 14 nt, Human
ugcccaggcccaga

SEQ ID NO: 2297839 - RNA, 15 nt, Human
ugcccaggccugccu

SEQ ID NO: 2297840 - RNA, 17 nt, Human
ugcccaggccugccugu

SEQ ID NO: 2297841 - RNA, 15 nt, Human
ugcccaggcccagac

SEQ ID NO: 2297842 - RNA, 22 nt, Human
ugcccccaccccggggacccug

SEQ ID NO: 2297843 - RNA, 17 nt, Human
ugcccccacugaccaga

SEQ ID NO: 2297844 - RNA, 23 nt, Human
ugcccccaccccggggacccugu

SEQ ID NO: 2297845 - RNA, 11 nt, Human
ugcccccagga

SEQ ID NO: 2297846 - RNA, 13 nt, Human
ugcccccagcugg

SEQ ID NO: 2297847 - RNA, 14 nt, Human
ugcccccagcuggc

SEQ ID NO: 2297848 - RNA, 14 nt, Human
ugcccccagccccg

SEQ ID NO: 2297849 - RNA, 16 nt, Human
ugcccccagccccggg

SEQ ID NO: 2297850 - RNA, 20 nt, Human
ugcccccagccccgggguga

SEQ ID NO: 2297851 - RNA, 12 nt, Human
ugcccaggcccc

SEQ ID NO: 2297852 - RNA, 14 nt, Human
ugcccaggccccug

SEQ ID NO: 2297853 - RNA, 16 nt, Human
ugcccaauuggaggaa

SEQ ID NO: 2297854 - RNA, 21 nt, Human
ugcccaauuggaggaaagcaa

SEQ ID NO: 2297855 - RNA, 20 nt, Human
ugcccaggccccugccaccc

SEQ ID NO: 2297856 - RNA, 22 nt, Human
ugcccaggccccugccacccug

SEQ ID NO: 2297857 - RNA, 21 nt, Human
ugcccccugguggacaguccu

SEQ ID NO: 2297858 - RNA, 13 nt, Human
ugcccccuggugg

SEQ ID NO: 2297859 - RNA, 12 nt, Human
ugcccccuggug

SEQ ID NO: 2297860 - RNA, 16 nt, Human
ugcccccugcuggcuc

SEQ ID NO: 2297861 - RNA, 22 nt, Human
ugcccccugcuggcucuucugc

SEQ ID NO: 2297862 - RNA, 13 nt, Human
ugcccccugcugg

SEQ ID NO: 2297863 - RNA, 14 nt, Human
ugcccccugcuggc

SEQ ID NO: 2297864 - RNA, 20 nt, Human
ugccccccaccccagccuaa

SEQ ID NO: 2297865 - RNA, 18 nt, Human
ugccccccaccccagccu

SEQ ID NO: 2297866 - RNA, 14 nt, Human
ugccccccagccuc

SEQ ID NO: 2297867 - RNA, 15 nt, Human
ugccccccagccucu

SEQ ID NO: 2297868 - RNA, 19 nt, Human
ugccccccagccucuggca

SEQ ID NO: 2297869 - RNA, 12 nt, Human
ugccccccaucc

SEQ ID NO: 2297870 - RNA, 20 nt, Human
ugccccccagccucuggcau

SEQ ID NO: 2297871 - RNA, 16 nt, Human
ugccccccauccuggc

SEQ ID NO: 2297872 - RNA, 13 nt, Human
ugccccccauccu

SEQ ID NO: 2297873 - RNA, 14 nt, Human
ugccccccauccug

SEQ ID NO: 2297874 - RNA, 13 nt, Human
ugccccccacccc

SEQ ID NO: 2297875 - RNA, 12 nt, Human
ugccccccaccc

SEQ ID NO: 2297876 - RNA, 15 nt, Human
ugcccccagggcacu

SEQ ID NO: 2297877 - RNA, 17 nt, Human
ugccccccaccccagcc

SEQ ID NO: 2297878 - RNA, 16 nt, Human
ugccccccaccccagc

SEQ ID NO: 2297879 - RNA, 15 nt, Human
ugccccccaccccag

SEQ ID NO: 2297880 - RNA, 14 nt, Human
ugccccccacccca

SEQ ID NO: 2297881 - RNA, 12 nt, Human
ugccccccagcc

SEQ ID NO: 2297882 - RNA, 12 nt, Human
ugcccccaggac

SEQ ID NO: 2297883 - RNA, 13 nt, Human
ugcccccaggacu

SEQ ID NO: 2297884 - RNA, 14 nt, Human
ugcccccaggacug

SEQ ID NO: 2297885 - RNA, 15 nt, Human
ugcccccaggacugg

SEQ ID NO: 2297886 - RNA, 16 nt, Human
ugcccccaggacuggg

SEQ ID NO: 2297887 - RNA, 17 nt, Human
ugcccccaggacugggc

SEQ ID NO: 2297888 - RNA, 19 nt, Human
ugcccccaggacugggcca

SEQ ID NO: 2297889 - RNA, 16 nt, Human
ugcccccagcuggccc

SEQ ID NO: 2297890 - RNA, 14 nt, Human
ugcccccagggcac

SEQ ID NO: 2297891 - RNA, 18 nt, Human
ugcccuaggcuccgucag

SEQ ID NO: 2297892 - RNA, 16 nt, Human
ugcccucaaucccagc

SEQ ID NO: 2297893 - RNA, 12 nt, Human
ugcccucagggg

SEQ ID NO: 2297894 - RNA, 12 nt, Human
ugcccucaggga

SEQ ID NO: 2297895 - RNA, 17 nt, Human
ugcccucauggccccuc

SEQ ID NO: 2297896 - RNA, 19 nt, Human
ugcccucauggccccucug

SEQ ID NO: 2297897 - RNA, 23 nt, Human
ugcccucauggccccucugaccu

SEQ ID NO: 2297898 - RNA, 14 nt, Human
ugcccuaggcuccg

SEQ ID NO: 2297899 - RNA, 14 nt, Human
ugcccuagcuccac

SEQ ID NO: 2297900 - RNA, 13 nt, Human
ugcccuagcucca

SEQ ID NO: 2297901 - RNA, 23 nt, Human
ugcccuagagcacacuguagcau

SEQ ID NO: 2297902 - RNA, 21 nt, Human
ugccccgugcagacuggaggg

SEQ ID NO: 2297903 - RNA, 23 nt, Human
ugccccuagcuuagagccucccu

SEQ ID NO: 2297904 - RNA, 17 nt, Human
ugcccuagagcacacug

SEQ ID NO: 2297905 - RNA, 16 nt, Human
ugccccuagcuuagag

SEQ ID NO: 2297906 - RNA, 19 nt, Human
ugccccgucaccaucucag

SEQ ID NO: 2297907 - RNA, 18 nt, Human
ugccccgucaccaucuca

SEQ ID NO: 2297908 - RNA, 17 nt, Human
ugccccgucaccaucuc

SEQ ID NO: 2297909 - RNA, 22 nt, Human
ugcccccuucucccacacugcu

SEQ ID NO: 2297910 - RNA, 20 nt, Human
ugcccccuucucccacacug

SEQ ID NO: 2297911 - RNA, 19 nt, Human
ugcccccuucucccacacu

SEQ ID NO: 2297912 - RNA, 18 nt, Human
ugcccccuucucccacac

SEQ ID NO: 2297913 - RNA, 17 nt, Human
ugcccccuucucccaca

SEQ ID NO: 2297914 - RNA, 16 nt, Human
ugcccccuucucccac

SEQ ID NO: 2297915 - RNA, 15 nt, Human
ugcccccuucuccca

SEQ ID NO: 2297916 - RNA, 13 nt, Human
ugcccccuucucc

SEQ ID NO: 2297917 - RNA, 12 nt, Human
ugcccccuucuc

SEQ ID NO: 2297918 - RNA, 22 nt, Human
ugcccccugguggacaguccug

SEQ ID NO: 2297919 - RNA, 21 nt, Human
ugccccgucaccaucucaggc

SEQ ID NO: 2297920 - RNA, 20 nt, Human
ugccccgucaccaucucagg

SEQ ID NO: 2297921 - RNA, 22 nt, Human
ugccccguccacggcucuaggu

SEQ ID NO: 2297922 - RNA, 18 nt, Human
ugccccgugcagacugga

SEQ ID NO: 2297923 - RNA, 16 nt, Human
ugccccgugcagacug

SEQ ID NO: 2297924 - RNA, 18 nt, Human
ugccccgucccccucugg

SEQ ID NO: 2297925 - RNA, 16 nt, Human
ugccccgucccccucu

SEQ ID NO: 2297926 - RNA, 19 nt, Human
agcggcugagucaugaucu

SEQ ID NO: 2297927 - RNA, 16 nt, Human
agcggcugagucauga

SEQ ID NO: 2297928 - RNA, 22 nt, Human
agcggccggccagccccuggcc

SEQ ID NO: 2297929 - RNA, 20 nt, Human
agcggccccuugacucuggg

SEQ ID NO: 2297930 - RNA, 23 nt, Human
agcggccccuugacucuggggac

SEQ ID NO: 2297931 - RNA, 18 nt, Human
agcggccggccagccccu

SEQ ID NO: 2297932 - RNA, 11 nt, Human
agcggccggcc

SEQ ID NO: 2297933 - RNA, 19 nt, Human
agcgcugccgcaccccaga

SEQ ID NO: 2297934 - RNA, 18 nt, Human
agcgcugccgcaccccag

SEQ ID NO: 2297935 - RNA, 17 nt, Human
agcgcugccgcacccca

SEQ ID NO: 2297936 - RNA, 22 nt, Human
agcgcuccugccgcagagcugg

SEQ ID NO: 2297937 - RNA, 12 nt, Human
agcggccccucc

SEQ ID NO: 2297938 - RNA, 13 nt, Human
agcggccccuccc

SEQ ID NO: 2297939 - RNA, 14 nt, Human
agcggccccuccca

SEQ ID NO: 2297940 - RNA, 18 nt, Human
agcggccccucccacaca

SEQ ID NO: 2297941 - RNA, 17 nt, Human
agcgcuccugccgcaga

SEQ ID NO: 2297942 - RNA, 20 nt, Human
agcgcuccugccgcagagcu

SEQ ID NO: 2297943 - RNA, 21 nt, Human
agcgcuccugccgcagagcug

SEQ ID NO: 2297944 - RNA, 20 nt, Human
agcgcgccacucgcuucccc

SEQ ID NO: 2297945 - RNA, 19 nt, Human
agcgcgccacucgcuuccc

SEQ ID NO: 2297946 - RNA, 12 nt, Human
agcgcgccacuc

SEQ ID NO: 2297947 - RNA, 22 nt, Human
agcgcgccacucgcuuccccca

SEQ ID NO: 2297948 - RNA, 14 nt, Human
agccugccuggcag

SEQ ID NO: 2297949 - RNA, 15 nt, Human
agccugccuggagcg

SEQ ID NO: 2297950 - RNA, 14 nt, Human
agccugccuggagc

SEQ ID NO: 2297951 - RNA, 21 nt, Human
agccugcgccaccgcccagag

SEQ ID NO: 2297952 - RNA, 13 nt, Human
agccugccuggag

SEQ ID NO: 2297953 - RNA, 17 nt, Human
agccugcccuugucuga

SEQ ID NO: 2297954 - RNA, 23 nt, Human
agccugcccuugucugagaugcu

SEQ ID NO: 2297955 - RNA, 13 nt, Human
agccugcccuugu

SEQ ID NO: 2297956 - RNA, 14 nt, Human
agccugcccuuguc

SEQ ID NO: 2297957 - RNA, 18 nt, Human
agccugcggccugcugga

SEQ ID NO: 2297958 - RNA, 18 nt, Human
agcgccagccugucccau

SEQ ID NO: 2297959 - RNA, 20 nt, Human
agcgcccacuagacccacug

SEQ ID NO: 2297960 - RNA, 21 nt, Human
agcgccaggcugaccacagca

SEQ ID NO: 2297961 - RNA, 12 nt, Human
agcgccaggcug

SEQ ID NO: 2297962 - RNA, 14 nt, Human
agcgcccaguuggg

SEQ ID NO: 2297963 - RNA, 22 nt, Human
agcgcccaguuggguggaugcc

SEQ ID NO: 2297964 - RNA, 13 nt, Human
ugcauuugagguc

SEQ ID NO: 2297965 - RNA, 15 nt, Human
ugccaauauguauug

SEQ ID NO: 2297966 - RNA, 16 nt, Human
ugccacacgucugacc

SEQ ID NO: 2297967 - RNA, 14 nt, Human
ugccacacccuccc

SEQ ID NO: 2297968 - RNA, 22 nt, Human
ugccacacccucccccgccacu

SEQ ID NO: 2297969 - RNA, 13 nt, Human
ugccacacccucc

SEQ ID NO: 2297970 - RNA, 20 nt, Human
ugccacaccaagcugugcca

SEQ ID NO: 2297971 - RNA, 21 nt, Human
ugccacaccaagcugugccac

SEQ ID NO: 2297972 - RNA, 22 nt, Human
ugccacaccaagcugugccacc

SEQ ID NO: 2297973 - RNA, 23 nt, Human
ugccacaccaagcugugccaccc

SEQ ID NO: 2297974 - RNA, 23 nt, Human
ugccacacagaguggucuuucug

SEQ ID NO: 2297975 - RNA, 19 nt, Human
ugccacaccaagcugugcc

SEQ ID NO: 2297976 - RNA, 20 nt, Human
ugccacacagaguggucuuu

SEQ ID NO: 2297977 - RNA, 13 nt, Human
ugccacacagagu

SEQ ID NO: 2297978 - RNA, 22 nt, Human
ugccacacaaggauagaugcug

SEQ ID NO: 2297979 - RNA, 14 nt, Human
ugccacacaaacgu

SEQ ID NO: 2297980 - RNA, 19 nt, Human
ugccacaaggacuuccugu

SEQ ID NO: 2297981 - RNA, 18 nt, Human
ugccaauauuaaaucugc

SEQ ID NO: 2297982 - RNA, 16 nt, Human
ugccaauauguauugu

SEQ ID NO: 2297983 - RNA, 19 nt, Human
ugccaauauguauuguaaa

SEQ ID NO: 2297984 - RNA, 21 nt, Human
agcggcugagucaugaucucc

SEQ ID NO: 2297985 - RNA, 20 nt, Human
ugcauucuugguuggcuggc

SEQ ID NO: 2297986 - RNA, 16 nt, Human
ugcauucuuucuguau

SEQ ID NO: 2297987 - RNA, 17 nt, Human
agcggcuggacuuggag

SEQ ID NO: 2297988 - RNA, 20 nt, Human
agcggcuggaauuggguggg

SEQ ID NO: 2297989 - RNA, 18 nt, Human
ugcauugaacacaaacug

SEQ ID NO: 2297990 - RNA, 17 nt, Human
ugcauugaacacaaacu

SEQ ID NO: 2297991 - RNA, 15 nt, Human
ugcauugaacacaaa

SEQ ID NO: 2297992 - RNA, 14 nt, Human
ugcauugaacacaa

SEQ ID NO: 2297993 - RNA, 13 nt, Human
ugcauugaacaca

SEQ ID NO: 2297994 - RNA, 22 nt, Human
ugcauucuuuuaaaagacaaga

SEQ ID NO: 2297995 - RNA, 16 nt, Human
ugcauucuuuuaaaag

SEQ ID NO: 2297996 - RNA, 21 nt, Human
ugcauucuuuuaaaagacaag

SEQ ID NO: 2297997 - RNA, 13 nt, Human
ugcauuuccugac

SEQ ID NO: 2297998 - RNA, 21 nt, Human
ugcauugaacacaaacuguaa

SEQ ID NO: 2297999 - RNA, 19 nt, Human
ugcauugaacacaaacugu

SEQ ID NO: 2298000 - RNA, 14 nt, Human
ugcauuuccugaca

SEQ ID NO: 2298001 - RNA, 22 nt, Human
ugcauugaacacaaacuguaaa

SEQ ID NO: 2298002 - RNA, 14 nt, Human
ugcauuucucuggg

SEQ ID NO: 2298003 - RNA, 23 nt, Human
ugcauuugaaaauuuugauguuu

SEQ ID NO: 2298004 - RNA, 19 nt, Human
ugcauuugaaaauuuugau

SEQ ID NO: 2298005 - RNA, 13 nt, Human
agcgugagccacu

SEQ ID NO: 2298006 - RNA, 13 nt, Human
agcgggcgccugu

SEQ ID NO: 2298007 - RNA, 20 nt, Human
ugccauauugcacaugucuu

SEQ ID NO: 2298008 - RNA, 15 nt, Human
agcgugagccacugc

SEQ ID NO: 2298009 - RNA, 16 nt, Human
agcggggacagcuccu

SEQ ID NO: 2298010 - RNA, 17 nt, Human
agcggggacagcuccuu

SEQ ID NO: 2298011 - RNA, 15 nt, Human
agcggggacagcucc

SEQ ID NO: 2298012 - RNA, 15 nt, Human
ugccauauugcacau

SEQ ID NO: 2298013 - RNA, 16 nt, Human
ugccauauugcacaug

SEQ ID NO: 2298014 - RNA, 19 nt, Human
ugccauauugcacaugucu

SEQ ID NO: 2298015 - RNA, 20 nt, Human
ugccauauucuguuggccag

SEQ ID NO: 2298016 - RNA, 21 nt, Human
ugccauauucuguuggccagu

SEQ ID NO: 2298017 - RNA, 16 nt, Human
agcgugagccacugca

SEQ ID NO: 2298018 - RNA, 17 nt, Human
agcgugagccacugcac

SEQ ID NO: 2298019 - RNA, 20 nt, Human
agcgugguggacaugcacag

SEQ ID NO: 2298020 - RNA, 17 nt, Human
agcgugcuuuaaaaaau

SEQ ID NO: 2298021 - RNA, 19 nt, Human
agcgugcuccagccuggcu

SEQ ID NO: 2298022 - RNA, 20 nt, Human
agcgugcuccagccuggcuc

SEQ ID NO: 2298023 - RNA, 15 nt, Human
agcguggacaggugu

SEQ ID NO: 2298024 - RNA, 20 nt, Human
agcuacucagaagccugagg

SEQ ID NO: 2298025 - RNA, 19 nt, Human
agcuacucagaagccugag

SEQ ID NO: 2298026 - RNA, 18 nt, Human
agcuacucagaagccuga

SEQ ID NO: 2298027 - RNA, 15 nt, Human
agcuacucagaagcc

SEQ ID NO: 2298028 - RNA, 14 nt, Human
agcuacucagaagc

SEQ ID NO: 2298029 - RNA, 21 nt, Human
agcuacucaagaggcugaggc

SEQ ID NO: 2298030 - RNA, 23 nt, Human
agcgugucuguauuuauguguga

SEQ ID NO: 2298031 - RNA, 23 nt, Human
agcgugguggacaugcacagcua

SEQ ID NO: 2298032 - RNA, 23 nt, Human
ugccacugccucuuccucccuca

SEQ ID NO: 2298033 - RNA, 12 nt, Human
ugccacacuuca

SEQ ID NO: 2298034 - RNA, 22 nt, Human
ugccacugccuucgcuucuugc

SEQ ID NO: 2298035 - RNA, 19 nt, Human
ugccacugccuucgcuucu

SEQ ID NO: 2298036 - RNA, 21 nt, Human
ugccacugccuucgcuucuug

SEQ ID NO: 2298037 - RNA, 16 nt, Human
ugccacuucccaggua

SEQ ID NO: 2298038 - RNA, 15 nt, Human
ugccagucaccccgg

SEQ ID NO: 2298039 - RNA, 16 nt, Human
ugccagucaccccggc

SEQ ID NO: 2298040 - RNA, 18 nt, Human
ugccagucaccccggcca

SEQ ID NO: 2298041 - RNA, 20 nt, Human
ugccagucaccccggccacc

SEQ ID NO: 2298042 - RNA, 19 nt, Human
ugccagucccccugcccca

SEQ ID NO: 2298043 - RNA, 20 nt, Human
ugccacuucacuccagccug

SEQ ID NO: 2298044 - RNA, 17 nt, Human
ugccagucccccugccc

SEQ ID NO: 2298045 - RNA, 22 nt, Human
ugccagucaccccggccaccug

SEQ ID NO: 2298046 - RNA, 23 nt, Human
ugccagucaccccggccaccugc

SEQ ID NO: 2298047 - RNA, 16 nt, Human
ugccauauucuguugg

SEQ ID NO: 2298048 - RNA, 17 nt, Human
ugccauauucuguuggc

SEQ ID NO: 2298049 - RNA, 15 nt, Human
ugccauauucuguug

SEQ ID NO: 2298050 - RNA, 18 nt, Human
ugccauagucacauggcc

SEQ ID NO: 2298051 - RNA, 19 nt, Human
ugccauagucacauggccu

SEQ ID NO: 2298052 - RNA, 18 nt, Human
agccuauauuuacaguga

SEQ ID NO: 2298053 - RNA, 22 nt, Human
agccuaguucauccaauccuca

SEQ ID NO: 2298054 - RNA, 14 nt, Human
agccuauauuuaca

SEQ ID NO: 2298055 - RNA, 17 nt, Human
agccuaucaaagaccuu

SEQ ID NO: 2298056 - RNA, 15 nt, Human
agccucaaccuccug

SEQ ID NO: 2298057 - RNA, 23 nt, Human
agccuaggggucagggaccaagg

SEQ ID NO: 2298058 - RNA, 20 nt, Human
agccuaggggucagggacca

SEQ ID NO: 2298059 - RNA, 14 nt, Human
agccuagugaaggc

SEQ ID NO: 2298060 - RNA, 23 nt, Human
agccuagugaaggcuucucucug

SEQ ID NO: 2298061 - RNA, 23 nt, Human
agccuaguucauccaauccucac

SEQ ID NO: 2298062 - RNA, 20 nt, Human
agccuaguucauccaauccu

SEQ ID NO: 2298063 - RNA, 17 nt, Human
agccuaguucauccaau

SEQ ID NO: 2298064 - RNA, 15 nt, Human
agccuaguucaucca

SEQ ID NO: 2298065 - RNA, 14 nt, Human
agccuaguucaucc

SEQ ID NO: 2298066 - RNA, 20 nt, Human
agccuagugaaggcuucucu

SEQ ID NO: 2298067 - RNA, 15 nt, Human
agccuaggugacaga

SEQ ID NO: 2298068 - RNA, 17 nt, Human
agccuaggugacagagu

SEQ ID NO: 2298069 - RNA, 23 nt, Human
agccuaaucccugggcauugcuu

SEQ ID NO: 2298070 - RNA, 14 nt, Human
agccuaggggucag

SEQ ID NO: 2298071 - RNA, 22 nt, Human
agccuaccggcaauuuccggcc

SEQ ID NO: 2298072 - RNA, 22 nt, Human
agccuaaucccugggcauugcu

SEQ ID NO: 2298073 - RNA, 15 nt, Human
agccuaaucccuggg

SEQ ID NO: 2298074 - RNA, 18 nt, Human
agccuaagaugaagagga

SEQ ID NO: 2298075 - RNA, 15 nt, Human
agccuaauacaacau

SEQ ID NO: 2298076 - RNA, 17 nt, Human
agcccuugagcucccca

SEQ ID NO: 2298077 - RNA, 16 nt, Human
agcccuugaagauauc

SEQ ID NO: 2298078 - RNA, 20 nt, Human
agcccuugagcuccccaaaa

SEQ ID NO: 2298079 - RNA, 19 nt, Human
agccguuuguuccccaaga

SEQ ID NO: 2298080 - RNA, 23 nt, Human
agccguuuguuccccaagacauu

SEQ ID NO: 2298081 - RNA, 18 nt, Human
agcccuucuuuccacaga

SEQ ID NO: 2298082 - RNA, 19 nt, Human
agcccuucuuuccacagaa

SEQ ID NO: 2298083 - RNA, 24 nt, Human
ugcagagacagagaggacgugggc

SEQ ID NO: 2298084 - RNA, 20 nt, Human
ugcagagacaggaccugacu

SEQ ID NO: 2298085 - RNA, 17 nt, Human
ugcagagacaggaccug

SEQ ID NO: 2298086 - RNA, 13 nt, Human
ugcagagagaagc

SEQ ID NO: 2298087 - RNA, 14 nt, Human
ugcagagagaagcc

SEQ ID NO: 2298088 - RNA, 15 nt, Human
ugcagagagaagccu

SEQ ID NO: 2298089 - RNA, 15 nt, Human
ugcagagagccauuu

SEQ ID NO: 2298090 - RNA, 16 nt, Human
ugcagagagccauuuu

SEQ ID NO: 2298091 - RNA, 17 nt, Human
ugcagagagccauuuug

SEQ ID NO: 2298092 - RNA, 18 nt, Human
ugcagagagccauuuugu

SEQ ID NO: 2298093 - RNA, 16 nt, Human
ugcagacuggagggga

SEQ ID NO: 2298094 - RNA, 14 nt, Human
ugcagacuggaggg

SEQ ID NO: 2298095 - RNA, 17 nt, Human
ugcagacuggaggggac

SEQ ID NO: 2298096 - RNA, 13 nt, Human
ugcagacuggagg

SEQ ID NO: 2298097 - RNA, 22 nt, Human
ugcagacugcugcuagagccag

SEQ ID NO: 2298098 - RNA, 22 nt, Human
ugcagacucuacagaggccaug

SEQ ID NO: 2298099 - RNA, 19 nt, Human
agcccuuccaugucgccuc

SEQ ID NO: 2298100 - RNA, 22 nt, Human
agcccuuccaugucgccucugc

SEQ ID NO: 2298101 - RNA, 23 nt, Human
agcccuuccaugucgccucugca

SEQ ID NO: 2298102 - RNA, 23 nt, Human
ugcagagagccauuuugugaaug

SEQ ID NO: 2298103 - RNA, 21 nt, Human
ugcagagagccauuuugugaa

SEQ ID NO: 2298104 - RNA, 22 nt, Human
ugcagagagccauuuugugaau

SEQ ID NO: 2298105 - RNA, 13 nt, Human
agcccuucauuug

SEQ ID NO: 2298106 - RNA, 14 nt, Human
agcccuucauuugg

SEQ ID NO: 2298107 - RNA, 20 nt, Human
ugcagaaaagcaccugccga

SEQ ID NO: 2298108 - RNA, 19 nt, Human
ugcagaaaagcaccugccg

SEQ ID NO: 2298109 - RNA, 18 nt, Human
ugcagaaaagcaccugcc

SEQ ID NO: 2298110 - RNA, 17 nt, Human
ugcagaaaagcaccugc

SEQ ID NO: 2298111 - RNA, 22 nt, Human
ugcagaaaagcaccugccgacc

SEQ ID NO: 2298112 - RNA, 21 nt, Human
ugcagaaaagcaccugccgac

SEQ ID NO: 2298113 - RNA, 16 nt, Human
ugcagaaaagcaccug

SEQ ID NO: 2298114 - RNA, 16 nt, Human
ugcagaaaacauuguu

SEQ ID NO: 2298115 - RNA, 14 nt, Human
ugcagaaaacauug

SEQ ID NO: 2298116 - RNA, 15 nt, Human
ugcagaaaacauugu

SEQ ID NO: 2298117 - RNA, 12 nt, Human
ugcagaaaacau

SEQ ID NO: 2298118 - RNA, 13 nt, Human
ugcagaaaacauu

SEQ ID NO: 2298119 - RNA, 15 nt, Human
ugcacuccccugcug

SEQ ID NO: 2298120 - RNA, 19 nt, Human
ugcagacucuacagaggcc

SEQ ID NO: 2298121 - RNA, 20 nt, Human
ugcagacucuacagaggcca

SEQ ID NO: 2298122 - RNA, 18 nt, Human
ugcagacucuacagaggc

SEQ ID NO: 2298123 - RNA, 15 nt, Human
ugcacgucaugggag

SEQ ID NO: 2298124 - RNA, 22 nt, Human
ugcacguaguagggucaggcca

SEQ ID NO: 2298125 - RNA, 12 nt, Human
ugcacguggaga

SEQ ID NO: 2298126 - RNA, 20 nt, Human
ugcacguggagagcuggugc

SEQ ID NO: 2298127 - RNA, 18 nt, Human
ugcacguggagagcuggu

SEQ ID NO: 2298128 - RNA, 17 nt, Human
ugcacguggagagcugg

SEQ ID NO: 2298129 - RNA, 16 nt, Human
ugcacguggagagcug

SEQ ID NO: 2298130 - RNA, 19 nt, Human
ugcacguaguagggucagg

SEQ ID NO: 2298131 - RNA, 19 nt, Human
ugcaccaccaagccaaggg

SEQ ID NO: 2298132 - RNA, 16 nt, Human
ugcaccaccaagccaa

SEQ ID NO: 2298133 - RNA, 18 nt, Human
ugcaccaccaagccaagg

SEQ ID NO: 2298134 - RNA, 19 nt, Human
ugcacguacacacacauac

SEQ ID NO: 2298135 - RNA, 14 nt, Human
ugcaccacugcacu

SEQ ID NO: 2298136 - RNA, 22 nt, Human
ugcaccaagcaggaaaugaaaa

SEQ ID NO: 2298137 - RNA, 12 nt, Human
ugcaccaccaag

SEQ ID NO: 2298138 - RNA, 14 nt, Human
ugcaccaccaagcc

SEQ ID NO: 2298139 - RNA, 15 nt, Human
ugcaccaccaagcca

SEQ ID NO: 2298140 - RNA, 19 nt, Human
ugcacaugucuuguacaug

SEQ ID NO: 2298141 - RNA, 20 nt, Human
ugcaccaacccagccgcugc

SEQ ID NO: 2298142 - RNA, 14 nt, Human
ugcaccaagcagga

SEQ ID NO: 2298143 - RNA, 22 nt, Human
ugcaccaacccagccgcugccc

SEQ ID NO: 2298144 - RNA, 23 nt, Human
ugcaccaacccagccgcugcccg

SEQ ID NO: 2298145 - RNA, 15 nt, Human
ugcacaugucuugua

SEQ ID NO: 2298146 - RNA, 16 nt, Human
ugcacaugucuuaaug

SEQ ID NO: 2298147 - RNA, 14 nt, Human
ugcacaugucuuaa

SEQ ID NO: 2298148 - RNA, 15 nt, Human
ugcacaugucuuaau

SEQ ID NO: 2298149 - RNA, 21 nt, Human
ugcacguggagagcuggugcc

SEQ ID NO: 2298150 - RNA, 16 nt, Human
ugcacguggcaugugg

SEQ ID NO: 2298151 - RNA, 23 nt, Human
ugcacguggcauguggccugugg

SEQ ID NO: 2298152 - RNA, 14 nt, Human
ugcacguggccucu

SEQ ID NO: 2298153 - RNA, 15 nt, Human
ugcacguggccucuu

SEQ ID NO: 2298154 - RNA, 16 nt, Human
ugcacguggccucuug

SEQ ID NO: 2298155 - RNA, 17 nt, Human
ugcacguggccucuuga

SEQ ID NO: 2298156 - RNA, 20 nt, Human
ugcacguuaugguguuucuc

SEQ ID NO: 2298157 - RNA, 18 nt, Human
ugcacuaaaguauguaaa

SEQ ID NO: 2298158 - RNA, 15 nt, Human
ugcacuacuccucug

SEQ ID NO: 2298159 - RNA, 16 nt, Human
ugcacuacuccucugc

SEQ ID NO: 2298160 - RNA, 18 nt, Human
ugcacuacuccucugcag

SEQ ID NO: 2298161 - RNA, 14 nt, Human
ugcacuacugacau

SEQ ID NO: 2298162 - RNA, 19 nt, Human
ugcacuacuccucugcagu

SEQ ID NO: 2298163 - RNA, 23 nt, Human
ugcacuacuccucugcagugccu

SEQ ID NO: 2298164 - RNA, 15 nt, Human
ugcacuaaggggccc

SEQ ID NO: 2298165 - RNA, 23 nt, Human
ugcacuaaggggcccggccagcc

SEQ ID NO: 2298166 - RNA, 22 nt, Human
ugcacuaaggggcccggccagc

SEQ ID NO: 2298167 - RNA, 17 nt, Human
ugcacuaaggggcccgg

SEQ ID NO: 2298168 - RNA, 19 nt, Human
ugcacuccagccugggcga

SEQ ID NO: 2298169 - RNA, 18 nt, Human
ugcacuacugacaugugg

SEQ ID NO: 2298170 - RNA, 22 nt, Human
ugcacuauagccuaggugacag

SEQ ID NO: 2298171 - RNA, 15 nt, Human
ugcacuacugacaug

SEQ ID NO: 2298172 - RNA, 16 nt, Human
ugcacuacugacaugu

SEQ ID NO: 2298173 - RNA, 12 nt, Human
ugcacuccccug

SEQ ID NO: 2298174 - RNA, 13 nt, Human
ugcacuccccugc

SEQ ID NO: 2298175 - RNA, 14 nt, Human
ugcacaagcugcac

SEQ ID NO: 2298176 - RNA, 21 nt, Human
ugcacaauaaaaauguuuaac

SEQ ID NO: 2298177 - RNA, 20 nt, Human
ugcacaauaaaaauguuuaa

SEQ ID NO: 2298178 - RNA, 15 nt, Human
ugcacaauaaaaaug

SEQ ID NO: 2298179 - RNA, 15 nt, Human
ugcacacaccagagc

SEQ ID NO: 2298180 - RNA, 17 nt, Human
ugcacaauauugaacuu

SEQ ID NO: 2298181 - RNA, 19 nt, Human
ugcacaauauugaacuuuu

SEQ ID NO: 2298182 - RNA, 21 nt, Human
ugcacaugacucggggguggg

SEQ ID NO: 2298183 - RNA, 12 nt, Human
ugcacaugucuu

SEQ ID NO: 2298184 - RNA, 23 nt, Human
ugcacaugaaucccacccacaug

SEQ ID NO: 2298185 - RNA, 18 nt, Human
agcagcaccguucugugc

SEQ ID NO: 2298186 - RNA, 21 nt, Human
ugcacaaccaucugucccugc

SEQ ID NO: 2298187 - RNA, 15 nt, Human
ugcacaagcuccaag

SEQ ID NO: 2298188 - RNA, 16 nt, Human
ugcacaagcuccaagc

SEQ ID NO: 2298189 - RNA, 18 nt, Human
ugcacaagcuccaagcuc

SEQ ID NO: 2298190 - RNA, 20 nt, Human
ugcacaagcuccaagcuccc

SEQ ID NO: 2298191 - RNA, 22 nt, Human
ugcacaagcuccaagcucccag

SEQ ID NO: 2298192 - RNA, 23 nt, Human
ugcacaagcuccaagcucccagg

SEQ ID NO: 2298193 - RNA, 9 nt, Human
ugcauacac

SEQ ID NO: 2298194 - RNA, 21 nt, Human
ugcauaccacuuuuguucuug

SEQ ID NO: 2298195 - RNA, 11 nt, Human
ugcauacacac

SEQ ID NO: 2298196 - RNA, 10 nt, Human
ugcauacaca

SEQ ID NO: 2298197 - RNA, 22 nt, Human
ugcauaccacuuuuguucuugg

SEQ ID NO: 2298198 - RNA, 12 nt, Human
ugcauacacaca

SEQ ID NO: 2298199 - RNA, 19 nt, Human
ugcaucuggguagcuguaa

SEQ ID NO: 2298200 - RNA, 18 nt, Human
ugcaucuggguagcugua

SEQ ID NO: 2298201 - RNA, 19 nt, Human
ugcaucugggauucccacc

SEQ ID NO: 2298202 - RNA, 20 nt, Human
ugcaucugggauucccacca

SEQ ID NO: 2298203 - RNA, 23 nt, Human
ugcaucugggauucccaccaagg

SEQ ID NO: 2298204 - RNA, 21 nt, Human
ugcaucugaccagcagcgccu

SEQ ID NO: 2298205 - RNA, 18 nt, Human
ugcaucugaccagcagcg

SEQ ID NO: 2298206 - RNA, 22 nt, Human
ugcaucugaccagcagcgccuu

SEQ ID NO: 2298207 - RNA, 17 nt, Human
ugcaucugaccagcagc

SEQ ID NO: 2298208 - RNA, 15 nt, Human
ugcaucugaccagca

SEQ ID NO: 2298209 - RNA, 18 nt, Human
ugcaucucccagauaaug

SEQ ID NO: 2298210 - RNA, 13 nt, Human
ugcaucucccaga

SEQ ID NO: 2298211 - RNA, 14 nt, Human
ugcaucuccaccug

SEQ ID NO: 2298212 - RNA, 13 nt, Human
ugcauacacacac

SEQ ID NO: 2298213 - RNA, 13 nt, Human
ugcaucuccaccu

SEQ ID NO: 2298214 - RNA, 15 nt, Human
ugcaucucagcccac

SEQ ID NO: 2298215 - RNA, 22 nt, Human
ugcaugagcuacgccugccucc

SEQ ID NO: 2298216 - RNA, 15 nt, Human
ugcaugagcuuuuau

SEQ ID NO: 2298217 - RNA, 19 nt, Human
ugcaugaauaaaauuauuc

SEQ ID NO: 2298218 - RNA, 23 nt, Human
ugcaucuguauaaguaagaaaau

SEQ ID NO: 2298219 - RNA, 21 nt, Human
ugcaugagcuacgccugccuc

SEQ ID NO: 2298220 - RNA, 13 nt, Human
ugcaugcuguccc

SEQ ID NO: 2298221 - RNA, 14 nt, Human
ugcaugcugucccu

SEQ ID NO: 2298222 - RNA, 15 nt, Human
ugcaugcugucccuu

SEQ ID NO: 2298223 - RNA, 21 nt, Human
ugcaucuggguagcuguaagg

SEQ ID NO: 2298224 - RNA, 20 nt, Human
ugcaucuggguagcuguaag

SEQ ID NO: 2298225 - RNA, 11 nt, Human
ugcaucuguau

SEQ ID NO: 2298226 - RNA, 20 nt, Human
ugcaucuguauaaguaagaa

SEQ ID NO: 2298227 - RNA, 21 nt, Human
ugcaucuguauaaguaagaaa

SEQ ID NO: 2298228 - RNA, 22 nt, Human
ugcaucuguauaaguaagaaaa

SEQ ID NO: 2298229 - RNA, 20 nt, Human
ugcaugaaguaauaugcaca

SEQ ID NO: 2298230 - RNA, 22 nt, Human
ugcaugaaguaauaugcacaca

SEQ ID NO: 2298231 - RNA, 21 nt, Human
ugcaugaggcuaguguggugu

SEQ ID NO: 2298232 - RNA, 19 nt, Human
agccugccucuucucuacu

SEQ ID NO: 2298233 - RNA, 16 nt, Human
agccugccucuucucu

SEQ ID NO: 2298234 - RNA, 12 nt, Human
agccugcccucc

SEQ ID NO: 2298235 - RNA, 18 nt, Human
agccugccacucaggccc

SEQ ID NO: 2298236 - RNA, 23 nt, Human
agccugcaguuauuaacacuaac

SEQ ID NO: 2298237 - RNA, 22 nt, Human
agccugcaggguggugcuggga

SEQ ID NO: 2298238 - RNA, 23 nt, Human
agccugcaggguggugcugggac

SEQ ID NO: 2298239 - RNA, 15 nt, Human
agccugcaggugcug

SEQ ID NO: 2298240 - RNA, 17 nt, Human
agccugcaggugcugcu

SEQ ID NO: 2298241 - RNA, 18 nt, Human
agccugcaggugcugcug

SEQ ID NO: 2298242 - RNA, 19 nt, Human
agccugcaggugcugcugc

SEQ ID NO: 2298243 - RNA, 20 nt, Human
agccugcaggugcugcugcg

SEQ ID NO: 2298244 - RNA, 22 nt, Human
agccugcaggugcugcugcgug

SEQ ID NO: 2298245 - RNA, 12 nt, Human
agccugcagggu

SEQ ID NO: 2298246 - RNA, 18 nt, Human
agccugcaggguggugcu

SEQ ID NO: 2298247 - RNA, 19 nt, Human
agccugcaggguggugcug

SEQ ID NO: 2298248 - RNA, 21 nt, Human
agccugcaggguggugcuggg

SEQ ID NO: 2298249 - RNA, 19 nt, Human
agccugaucaccugcccug

SEQ ID NO: 2298250 - RNA, 19 nt, Human
agccugcaauuucauaugc

SEQ ID NO: 2298251 - RNA, 17 nt, Human
agccugcaaacucacug

SEQ ID NO: 2298252 - RNA, 18 nt, Human
agccugaucaccugcccu

SEQ ID NO: 2298253 - RNA, 14 nt, Human
ugcaugauguauuu

SEQ ID NO: 2298254 - RNA, 16 nt, Human
agccugagucuccugu

SEQ ID NO: 2298255 - RNA, 17 nt, Human
agccugagucuccugug

SEQ ID NO: 2298256 - RNA, 18 nt, Human
agccugagucuccugugc

SEQ ID NO: 2298257 - RNA, 16 nt, Human
ugcaugcugucccuua

SEQ ID NO: 2298258 - RNA, 21 nt, Human
agccugcaacucaucuuucau

SEQ ID NO: 2298259 - RNA, 18 nt, Human
agccugcaaacucacugc

SEQ ID NO: 2298260 - RNA, 19 nt, Human
agccugcaaacucacugcu

SEQ ID NO: 2298261 - RNA, 21 nt, Human
agccugcaauuucauaugcug

SEQ ID NO: 2298262 - RNA, 15 nt, Human
agccugcagagcugc

SEQ ID NO: 2298263 - RNA, 14 nt, Human
agccugcagagcug

SEQ ID NO: 2298264 - RNA, 13 nt, Human
agccugcagagcu

SEQ ID NO: 2298265 - RNA, 12 nt, Human
agccugcagagc

SEQ ID NO: 2298266 - RNA, 13 nt, Human
ugcagugaauugu

SEQ ID NO: 2298267 - RNA, 19 nt, Human
ugcagugacgugcaccugu

SEQ ID NO: 2298268 - RNA, 18 nt, Human
ugcagugacgugcaccug

SEQ ID NO: 2298269 - RNA, 21 nt, Human
ugcaggucccuaauaaagcug

SEQ ID NO: 2298270 - RNA, 17 nt, Human
ugcaggucccuaauaaa

SEQ ID NO: 2298271 - RNA, 14 nt, Human
ugcagugagccgag

SEQ ID NO: 2298272 - RNA, 18 nt, Human
ugcaggucccuaauaaag

SEQ ID NO: 2298273 - RNA, 16 nt, Human
ugcagcuucuguccug

SEQ ID NO: 2298274 - RNA, 19 nt, Human
ugcaggucccuaauaaagc

SEQ ID NO: 2298275 - RNA, 20 nt, Human
ugcaggucccuaauaaagcu

SEQ ID NO: 2298276 - RNA, 22 nt, Human
ugcauaauaagcuaaagaggcu

SEQ ID NO: 2298277 - RNA, 19 nt, Human
ugcauaauaagcuaaagag

SEQ ID NO: 2298278 - RNA, 18 nt, Human
ugcauaacaauuccucua

SEQ ID NO: 2298279 - RNA, 17 nt, Human
ugcauaacaauuccucu

SEQ ID NO: 2298280 - RNA, 14 nt, Human
ugcauaaauaugca

SEQ ID NO: 2298281 - RNA, 15 nt, Human
ugcauaaauaugcag

SEQ ID NO: 2298282 - RNA, 19 nt, Human
ugcauaaauaugcagugau

SEQ ID NO: 2298283 - RNA, 24 nt, Human
ugcauaauaagcuaaagaggcuga

SEQ ID NO: 2298284 - RNA, 23 nt, Human
ugcauaauaagcuaaagaggcug

SEQ ID NO: 2298285 - RNA, 15 nt, Human
ugcauaauggucaga

SEQ ID NO: 2298286 - RNA, 12 nt, Human
ugcaguuuuccu

SEQ ID NO: 2298287 - RNA, 19 nt, Human
ugcagugagccgagauugu

SEQ ID NO: 2298288 - RNA, 17 nt, Human
ugcauaaagucagugcc

SEQ ID NO: 2298289 - RNA, 12 nt, Human
ugcauaaauaug

SEQ ID NO: 2298290 - RNA, 13 nt, Human
ugcauaaauaugc

SEQ ID NO: 2298291 - RNA, 11 nt, Human
ugcauaaaaug

SEQ ID NO: 2298292 - RNA, 22 nt, Human
ugcagugacgugcaccuguacu

SEQ ID NO: 2298293 - RNA, 15 nt, Human
ugcagugagccaaga

SEQ ID NO: 2298294 - RNA, 14 nt, Human
ugcaguuuuucaga

SEQ ID NO: 2298295 - RNA, 15 nt, Human
ugcaguuuuucagag

SEQ ID NO: 2298296 - RNA, 16 nt, Human
ugcaguuuuucagagu

SEQ ID NO: 2298297 - RNA, 17 nt, Human
agccucaaccuccuggg

SEQ ID NO: 2298298 - RNA, 18 nt, Human
agccucaaccuccugggc

SEQ ID NO: 2298299 - RNA, 13 nt, Human
agccucagcaucc

SEQ ID NO: 2298300 - RNA, 14 nt, Human
agccucagcauccu

SEQ ID NO: 2298301 - RNA, 15 nt, Human
agccucagcauccug

SEQ ID NO: 2298302 - RNA, 21 nt, Human
agccugagcaacucuugauua

SEQ ID NO: 2298303 - RNA, 16 nt, Human
agccugagcaacucuu

SEQ ID NO: 2298304 - RNA, 18 nt, Human
agccugagcgacagugag

SEQ ID NO: 2298305 - RNA, 15 nt, Human
ugcagcuucuguccu

SEQ ID NO: 2298306 - RNA, 22 nt, Human
ugcagcugauuuuaacaauaac

SEQ ID NO: 2298307 - RNA, 20 nt, Human
ugcagcugauuuuaacaaua

SEQ ID NO: 2298308 - RNA, 19 nt, Human
ugcagcuggaaaagggucu

SEQ ID NO: 2298309 - RNA, 19 nt, Human
ugcagcugauuuuaacaau

SEQ ID NO: 2298310 - RNA, 18 nt, Human
ugcagcugauuuuaacaa

SEQ ID NO: 2298311 - RNA, 16 nt, Human
ugcagcugauuuuaac

SEQ ID NO: 2298312 - RNA, 15 nt, Human
ugcagcugauuuuaa

SEQ ID NO: 2298313 - RNA, 14 nt, Human
ugcagcugauuuua

SEQ ID NO: 2298314 - RNA, 16 nt, Human
ugcagcugauguugga

SEQ ID NO: 2298315 - RNA, 19 nt, Human
ugcagcugagagaaaauaa

SEQ ID NO: 2298316 - RNA, 18 nt, Human
ugcagccggcacaggguc

SEQ ID NO: 2298317 - RNA, 19 nt, Human
ugcagccggcacagggucu

SEQ ID NO: 2298318 - RNA, 18 nt, Human
ugcagccucaaccuccug

SEQ ID NO: 2298319 - RNA, 19 nt, Human
ugcagccucaaccuccugg

SEQ ID NO: 2298320 - RNA, 14 nt, Human
ugcagccgcugagc

SEQ ID NO: 2298321 - RNA, 17 nt, Human
ugcagccggcacagggu

SEQ ID NO: 2298322 - RNA, 19 nt, Human
agccugagcgacagugaga

SEQ ID NO: 2298323 - RNA, 17 nt, Human
acuuugggaggccaagg

SEQ ID NO: 2298324 - RNA, 16 nt, Human
acuuugggaggccaag

SEQ ID NO: 2298325 - RNA, 19 nt, Human
acuuugggaggccaaggug

SEQ ID NO: 2298326 - RNA, 17 nt, Human
acuuugggaggcugagg

SEQ ID NO: 2298327 - RNA, 20 nt, Human
acuuugggaggccaaggugg

SEQ ID NO: 2298328 - RNA, 14 nt, Human
acuuugggaggcca

SEQ ID NO: 2298329 - RNA, 15 nt, Human
acuuugggaggccaa

SEQ ID NO: 2298330 - RNA, 12 nt, Human
acuuugggaggc

SEQ ID NO: 2298331 - RNA, 17 nt, Human
acuuuggaaagacuuuu

SEQ ID NO: 2298332 - RNA, 13 nt, Human
acuuuggcugcau

SEQ ID NO: 2298333 - RNA, 17 nt, Human
acuuuggcugcaugcga

SEQ ID NO: 2298334 - RNA, 14 nt, Human
acuuuggcugcaug

SEQ ID NO: 2298335 - RNA, 21 nt, Human
acuuugacuuuuugcauuuaa

SEQ ID NO: 2298336 - RNA, 13 nt, Human
acuuuggaaagac

SEQ ID NO: 2298337 - RNA, 14 nt, Human
acuuuggaaagacu

SEQ ID NO: 2298338 - RNA, 17 nt, Human
acuuguuuuaugcucag

SEQ ID NO: 2298339 - RNA, 20 nt, Human
acuuugacuuuuugcauuua

SEQ ID NO: 2298340 - RNA, 15 nt, Human
acuuugacuuuuugc

SEQ ID NO: 2298341 - RNA, 23 nt, Human
acuuugaccucugcagcaauaaa

SEQ ID NO: 2298342 - RNA, 19 nt, Human
acuuugaccucugcagcaa

SEQ ID NO: 2298343 - RNA, 13 nt, Human
acuuguuuccaau

SEQ ID NO: 2298344 - RNA, 23 nt, Human
acuuuaccuuuuuuauacauaaa

SEQ ID NO: 2298345 - RNA, 22 nt, Human
acuuuaccuuuuuuauacauaa

SEQ ID NO: 2298346 - RNA, 19 nt, Human
acuuuaccuuuuuuauaca

SEQ ID NO: 2298347 - RNA, 21 nt, Human
acuuguuguuuuacuaaagaa

SEQ ID NO: 2298348 - RNA, 18 nt, Human
acuuuaccuuuuuuauac

SEQ ID NO: 2298349 - RNA, 15 nt, Human
acuuuuucuuuaugu

SEQ ID NO: 2298350 - RNA, 13 nt, Human
acuuuuugcauuu

SEQ ID NO: 2298351 - RNA, 18 nt, Human
acuuuuugguuugcagau

SEQ ID NO: 2298352 - RNA, 13 nt, Human
acuuuuuuccaca

SEQ ID NO: 2298353 - RNA, 23 nt, Human
acuuuuuugcuauccagcuauuu

SEQ ID NO: 2298354 - RNA, 21 nt, Human
acuuuuuuggggauaugcuua

SEQ ID NO: 2298355 - RNA, 22 nt, Human
acuuuuuugaguggaugauguu

SEQ ID NO: 2298356 - RNA, 21 nt, Human
acuuuuuugaaauaauaaauc

SEQ ID NO: 2298357 - RNA, 22 nt, Human
acuuuuuuggggauaugcuuag

SEQ ID NO: 2298358 - RNA, 23 nt, Human
acuuuuuuggggauaugcuuagu

SEQ ID NO: 2298359 - RNA, 15 nt, Human
acuuuuuuuuaaguu

SEQ ID NO: 2298360 - RNA, 22 nt, Human
acuuuuuuuuuuuaagaguaaa

SEQ ID NO: 2298361 - RNA, 19 nt, Human
acuuugggauucuuuccau

SEQ ID NO: 2298362 - RNA, 19 nt, Human
acuuugggaggcugaggcg

SEQ ID NO: 2298363 - RNA, 19 nt, Human
acuuugguacauggccagu

SEQ ID NO: 2298364 - RNA, 20 nt, Human
acuuugggauaggaaaaaug

SEQ ID NO: 2298365 - RNA, 14 nt, Human
acuuuuggcauuuu

SEQ ID NO: 2298366 - RNA, 22 nt, Human
acuuuugguuaagucuguuuua

SEQ ID NO: 2298367 - RNA, 20 nt, Human
acuuuugguuaagucuguuu

SEQ ID NO: 2298368 - RNA, 16 nt, Human
acuuuugguuaagucu

SEQ ID NO: 2298369 - RNA, 11 nt, Human
acuuuuuccag

SEQ ID NO: 2298370 - RNA, 18 nt, Human
acuuuuucauuugccuau

SEQ ID NO: 2298371 - RNA, 13 nt, Human
acuuuuucauuug

SEQ ID NO: 2298372 - RNA, 22 nt, Human
acuuuuuauggcacuaguauuu

SEQ ID NO: 2298373 - RNA, 12 nt, Human
acuuuuguaaga

SEQ ID NO: 2298374 - RNA, 17 nt, Human
acuuuuguaagacaaag

SEQ ID NO: 2298375 - RNA, 12 nt, Human
ucucccaggggc

SEQ ID NO: 2298376 - RNA, 18 nt, Human
ucucccaggggcuggcuu

SEQ ID NO: 2298377 - RNA, 23 nt, Human
ucucccaggggcuggcuucagga

SEQ ID NO: 2298378 - RNA, 23 nt, Human
ucucccaggccaggcuccuuccu

SEQ ID NO: 2298379 - RNA, 18 nt, Human
ucucccaggccaggcucc

SEQ ID NO: 2298380 - RNA, 14 nt, Human
ucucccaggccagg

SEQ ID NO: 2298381 - RNA, 13 nt, Human
ucucccaggccag

SEQ ID NO: 2298382 - RNA, 12 nt, Human
ucucccacacug

SEQ ID NO: 2298383 - RNA, 19 nt, Human
ucucccaaggcugcgucug

SEQ ID NO: 2298384 - RNA, 13 nt, Human
ucucccaggaagc

SEQ ID NO: 2298385 - RNA, 12 nt, Human
ucucccaaggcu

SEQ ID NO: 2298386 - RNA, 18 nt, Human
ucucccaaagugcuggga

SEQ ID NO: 2298387 - RNA, 11 nt, Human
ucucccuugga

SEQ ID NO: 2298388 - RNA, 18 nt, Human
ucucccuuggauuguccc

SEQ ID NO: 2298389 - RNA, 15 nt, Human
ucucccagucauuua

SEQ ID NO: 2298390 - RNA, 19 nt, Human
ucucccagucuacccagag

SEQ ID NO: 2298391 - RNA, 20 nt, Human
ucucccagucuacccagaga

SEQ ID NO: 2298392 - RNA, 17 nt, Human
ucucccagguaccagcu

SEQ ID NO: 2298393 - RNA, 18 nt, Human
ucucccagguaccagcug

SEQ ID NO: 2298394 - RNA, 19 nt, Human
ucucccagguaccagcugc

SEQ ID NO: 2298395 - RNA, 18 nt, Human
ucucccagucuacccaga

SEQ ID NO: 2298396 - RNA, 21 nt, Human
acuguaguuuuucuucaacau

SEQ ID NO: 2298397 - RNA, 12 nt, Human
acuguauaaaua

SEQ ID NO: 2298398 - RNA, 13 nt, Human
acuguauaaauag

SEQ ID NO: 2298399 - RNA, 14 nt, Human
acuguauaaauagg

SEQ ID NO: 2298400 - RNA, 15 nt, Human
acuguauaaauagga

SEQ ID NO: 2298401 - RNA, 17 nt, Human
acuguauaaauaggaga

SEQ ID NO: 2298402 - RNA, 20 nt, Human
acuguauaaauaggagagga

SEQ ID NO: 2298403 - RNA, 21 nt, Human
acuguauaaauaggagaggau

SEQ ID NO: 2298404 - RNA, 22 nt, Human
acuguauaaauaggagaggaug

SEQ ID NO: 2298405 - RNA, 23 nt, Human
acuguauaaauaggagaggauga

SEQ ID NO: 2298406 - RNA, 13 nt, Human
acuguauauaaag

SEQ ID NO: 2298407 - RNA, 18 nt, Human
acuguauauaaaggaaaa

SEQ ID NO: 2298408 - RNA, 20 nt, Human
acuguaguuuuucuucaaca

SEQ ID NO: 2298409 - RNA, 18 nt, Human
acuguaguuuuucuucaa

SEQ ID NO: 2298410 - RNA, 16 nt, Human
acuguagucucaggac

SEQ ID NO: 2298411 - RNA, 15 nt, Human
acuguagucucagga

SEQ ID NO: 2298412 - RNA, 13 nt, Human
acuguagucucag

SEQ ID NO: 2298413 - RNA, 20 nt, Human
acuguaggaagaguagcauu

SEQ ID NO: 2298414 - RNA, 22 nt, Human
acuguagccucgccgucuguga

SEQ ID NO: 2298415 - RNA, 17 nt, Human
acuguagccuggauauu

SEQ ID NO: 2298416 - RNA, 19 nt, Human
acuguaggaagaguagcau

SEQ ID NO: 2298417 - RNA, 15 nt, Human
acuguaggcacacuu

SEQ ID NO: 2298418 - RNA, 13 nt, Human
acuguagggaggg

SEQ ID NO: 2298419 - RNA, 12 nt, Human
ucuccucugcug

SEQ ID NO: 2298420 - RNA, 16 nt, Human
ucuccguuagcuccug

SEQ ID NO: 2298421 - RNA, 17 nt, Human
ucuccguuagcuccugu

SEQ ID NO: 2298422 - RNA, 18 nt, Human
ucuccguuagcuccugug

SEQ ID NO: 2298423 - RNA, 19 nt, Human
ucuccguuagcuccugugg

SEQ ID NO: 2298424 - RNA, 18 nt, Human
ucucccuucucccaugag

SEQ ID NO: 2298425 - RNA, 17 nt, Human
ucuccgacugcuaggga

SEQ ID NO: 2298426 - RNA, 13 nt, Human
ucuccgccagccu

SEQ ID NO: 2298427 - RNA, 14 nt, Human
ucuccgccagccuc

SEQ ID NO: 2298428 - RNA, 15 nt, Human
ucuccgccagccucc

SEQ ID NO: 2298429 - RNA, 18 nt, Human
ucuccgccagccuccucu

SEQ ID NO: 2298430 - RNA, 20 nt, Human
ucuccgccagccuccucugg

SEQ ID NO: 2298431 - RNA, 21 nt, Human
ucuccgccagccuccucugga

SEQ ID NO: 2298432 - RNA, 19 nt, Human
ucucccuuggauugucccc

SEQ ID NO: 2298433 - RNA, 21 nt, Human
ucucccuuggauuguccccga

SEQ ID NO: 2298434 - RNA, 23 nt, Human
acuugugugugggcugugagugu

SEQ ID NO: 2298435 - RNA, 17 nt, Human
acuuguuccagcucuuu

SEQ ID NO: 2298436 - RNA, 22 nt, Human
acuugugugugggcugugagug

SEQ ID NO: 2298437 - RNA, 21 nt, Human
acuugugugugggcugugagu

SEQ ID NO: 2298438 - RNA, 20 nt, Human
acuugugugugggcugugag

SEQ ID NO: 2298439 - RNA, 22 nt, Human
acuugugucucugugcuuuuaa

SEQ ID NO: 2298440 - RNA, 14 nt, Human
acuugugucucugu

SEQ ID NO: 2298441 - RNA, 21 nt, Human
acuugugucucugugcuuuua

SEQ ID NO: 2298442 - RNA, 16 nt, Human
acuugugucucugugc

SEQ ID NO: 2298443 - RNA, 21 nt, Human
acuuguugauuaauggaaaug

SEQ ID NO: 2298444 - RNA, 19 nt, Human
acuuguugauuaauggaaa

SEQ ID NO: 2298445 - RNA, 13 nt, Human
ucuccucugcugc

SEQ ID NO: 2298446 - RNA, 14 nt, Human
ucuccucugcugcu

SEQ ID NO: 2298447 - RNA, 23 nt, Human
acuugugucccaugaucccugug

SEQ ID NO: 2298448 - RNA, 22 nt, Human
ucucugcucugcgugucaccug

SEQ ID NO: 2298449 - RNA, 21 nt, Human
ucucugcucugcgugucaccu

SEQ ID NO: 2298450 - RNA, 18 nt, Human
ucucugcucugcguguca

SEQ ID NO: 2298451 - RNA, 14 nt, Human
ucucuucugcucca

SEQ ID NO: 2298452 - RNA, 13 nt, Human
ucucuucugcucc

SEQ ID NO: 2298453 - RNA, 22 nt, Human
ucucuucugagcuauuucaucu

SEQ ID NO: 2298454 - RNA, 21 nt, Human
ucucuucugagcuauuucauc

SEQ ID NO: 2298455 - RNA, 17 nt, Human
ucucuucugcuccaccc

SEQ ID NO: 2298456 - RNA, 16 nt, Human
ucucuucugcuccacc

SEQ ID NO: 2298457 - RNA, 18 nt, Human
ucucuucuggguuccuuc

SEQ ID NO: 2298458 - RNA, 20 nt, Human
ucucuucuggguuccuuccu

SEQ ID NO: 2298459 - RNA, 19 nt, Human
ucucuucuggguuccuucc

SEQ ID NO: 2298460 - RNA, 14 nt, Human
ucucuugagagggu

SEQ ID NO: 2298461 - RNA, 13 nt, Human
ucucuucuuuaaa

SEQ ID NO: 2298462 - RNA, 19 nt, Human
ucucuucugcuccacccuu

SEQ ID NO: 2298463 - RNA, 21 nt, Human
ucucuucuggguuccuuccuc

SEQ ID NO: 2298464 - RNA, 12 nt, Human
ucucuucuuuaa

SEQ ID NO: 2298465 - RNA, 19 nt, Human
ucucugcuccaccacaucc

SEQ ID NO: 2298466 - RNA, 17 nt, Human
ucucugcuccaccacau

SEQ ID NO: 2298467 - RNA, 15 nt, Human
ucucugcuccaccac

SEQ ID NO: 2298468 - RNA, 14 nt, Human
ucucugcuccacca

SEQ ID NO: 2298469 - RNA, 13 nt, Human
ucucuggccuucg

SEQ ID NO: 2298470 - RNA, 17 nt, Human
ucucuggccuucggccu

SEQ ID NO: 2298471 - RNA, 16 nt, Human
ucucuggccuucggcc

SEQ ID NO: 2298472 - RNA, 13 nt, Human
ucucugcuccacc

SEQ ID NO: 2298473 - RNA, 12 nt, Human
ucucugcuccac

SEQ ID NO: 2298474 - RNA, 11 nt, Human
ucucugcucca

SEQ ID NO: 2298475 - RNA, 21 nt, Human
ucucugccucccucacccuga

SEQ ID NO: 2298476 - RNA, 23 nt, Human
ucucugccucccucacccugagc

SEQ ID NO: 2298477 - RNA, 15 nt, Human
ucucugccggcucuu

SEQ ID NO: 2298478 - RNA, 19 nt, Human
ucucugccggcucuuuccu

SEQ ID NO: 2298479 - RNA, 21 nt, Human
ucucugccggcucuuuccuug

SEQ ID NO: 2298480 - RNA, 11 nt, Human
ucucugcccua

SEQ ID NO: 2298481 - RNA, 22 nt, Human
ucucugcccuaaugcgcaggcu

SEQ ID NO: 2298482 - RNA, 17 nt, Human
acuuuuuuuuguauguu

SEQ ID NO: 2298483 - RNA, 15 nt, Human
acuuuuuuuugagaa

SEQ ID NO: 2298484 - RNA, 20 nt, Human
agaaaaaaaaaaacuuacac

SEQ ID NO: 2298485 - RNA, 16 nt, Human
agaaaaaaaaagaaaa

SEQ ID NO: 2298486 - RNA, 22 nt, Human
acuuuuuuuuuccaaaaaaaua

SEQ ID NO: 2298487 - RNA, 15 nt, Human
agaaaaaaaaagaaa

SEQ ID NO: 2298488 - RNA, 14 nt, Human
agaaaaaaaaagaa

SEQ ID NO: 2298489 - RNA, 16 nt, Human
acuuuuuuuugagaau

SEQ ID NO: 2298490 - RNA, 20 nt, Human
ucuccuucaccuuugucccc

SEQ ID NO: 2298491 - RNA, 18 nt, Human
ucuccuucaccuuugucc

SEQ ID NO: 2298492 - RNA, 15 nt, Human
ucuccuucagcccuc

SEQ ID NO: 2298493 - RNA, 19 nt, Human
ucuccuucagcccucaccc

SEQ ID NO: 2298494 - RNA, 20 nt, Human
ucuccuucagcccucacccc

SEQ ID NO: 2298495 - RNA, 13 nt, Human
ucuccuuccugug

SEQ ID NO: 2298496 - RNA, 19 nt, Human
ucuccuuccccuuucccca

SEQ ID NO: 2298497 - RNA, 14 nt, Human
ucuccuuccugugu

SEQ ID NO: 2298498 - RNA, 13 nt, Human
ucucuccagcccc

SEQ ID NO: 2298499 - RNA, 14 nt, Human
ucucuccagccccu

SEQ ID NO: 2298500 - RNA, 21 nt, Human
ucucugccagugacagacagg

SEQ ID NO: 2298501 - RNA, 13 nt, Human
ucucugcccaacc

SEQ ID NO: 2298502 - RNA, 12 nt, Human
ucucugcccaac

SEQ ID NO: 2298503 - RNA, 14 nt, Human
ucucugccagugac

SEQ ID NO: 2298504 - RNA, 15 nt, Human
ucucugccagugaca

SEQ ID NO: 2298505 - RNA, 15 nt, Human
ucucugcaucugacc

SEQ ID NO: 2298506 - RNA, 16 nt, Human
ucucugcaucugacca

SEQ ID NO: 2298507 - RNA, 17 nt, Human
ucucugcaucugaccac

SEQ ID NO: 2298508 - RNA, 14 nt, Human
ucucuccuguacuu

SEQ ID NO: 2298509 - RNA, 13 nt, Human
ucucuccugucca

SEQ ID NO: 2298510 - RNA, 14 nt, Human
ucucuccuguccaa

SEQ ID NO: 2298511 - RNA, 15 nt, Human
ucucuccuuguucug

SEQ ID NO: 2298512 - RNA, 19 nt, Human
ucucuccuuguucugauaa

SEQ ID NO: 2298513 - RNA, 14 nt, Human
ucucuccuuucuuu

SEQ ID NO: 2298514 - RNA, 22 nt, Human
ucucuccuuucuuuuucuucuu

SEQ ID NO: 2298515 - RNA, 14 nt, Human
ucucuccuuugcug

SEQ ID NO: 2298516 - RNA, 19 nt, Human
ucucugcaucuacucccaa

SEQ ID NO: 2298517 - RNA, 21 nt, Human
ucucugcaucuacucccaagu

SEQ ID NO: 2298518 - RNA, 13 nt, Human
ucucugcaucuga

SEQ ID NO: 2298519 - RNA, 22 nt, Human
ucucuccuguaccucuugagcc

SEQ ID NO: 2298520 - RNA, 20 nt, Human
ucucuccuguaccucuugag

SEQ ID NO: 2298521 - RNA, 15 nt, Human
ucucuccagccccug

SEQ ID NO: 2298522 - RNA, 16 nt, Human
ucucuccagauguuuc

SEQ ID NO: 2298523 - RNA, 13 nt, Human
ucucuccagaugu

SEQ ID NO: 2298524 - RNA, 15 nt, Human
ucucuuucaugaguu

SEQ ID NO: 2298525 - RNA, 16 nt, Human
ucucuuuccuucuugc

SEQ ID NO: 2298526 - RNA, 23 nt, Human
ucucuuucuccuuagucuucuca

SEQ ID NO: 2298527 - RNA, 12 nt, Human
ucucuuuccuug

SEQ ID NO: 2298528 - RNA, 18 nt, Human
ucucuuuccuucuugccu

SEQ ID NO: 2298529 - RNA, 19 nt, Human
ucucuuuccuucuugccuu

SEQ ID NO: 2298530 - RNA, 14 nt, Human
ucucuuucucuccu

SEQ ID NO: 2298531 - RNA, 18 nt, Human
ucucuucuuuuggcuucc

SEQ ID NO: 2298532 - RNA, 16 nt, Human
ucucuucuuuuggcuu

SEQ ID NO: 2298533 - RNA, 22 nt, Human
ucucuuuaaugucacaggcagg

SEQ ID NO: 2298534 - RNA, 15 nt, Human
ucucuugagccuggg

SEQ ID NO: 2298535 - RNA, 13 nt, Human
ucucuucuugaac

SEQ ID NO: 2298536 - RNA, 14 nt, Human
ucucuugagccugg

SEQ ID NO: 2298537 - RNA, 13 nt, Human
ucucuugagccug

SEQ ID NO: 2298538 - RNA, 19 nt, Human
ucucuuucuucucugcugc

SEQ ID NO: 2298539 - RNA, 18 nt, Human
agaaaaaggaugcacaga

SEQ ID NO: 2298540 - RNA, 19 nt, Human
agaaaaauaugaccacacu

SEQ ID NO: 2298541 - RNA, 15 nt, Human
agaaaaauaacccuu

SEQ ID NO: 2298542 - RNA, 17 nt, Human
agaaaaaugagccuggc

SEQ ID NO: 2298543 - RNA, 14 nt, Human
agaaaaaucauguu

SEQ ID NO: 2298544 - RNA, 17 nt, Human
agaaaacacuuguaagu

SEQ ID NO: 2298545 - RNA, 16 nt, Human
agaaaacagaaaacaa

SEQ ID NO: 2298546 - RNA, 12 nt, Human
agaaaacagaaa

SEQ ID NO: 2298547 - RNA, 15 nt, Human
agaaaacaucacuga

SEQ ID NO: 2298548 - RNA, 23 nt, Human
agaaaacauaaucuucugccuuc

SEQ ID NO: 2298549 - RNA, 21 nt, Human
agaaaaaucauguuugcucuc

SEQ ID NO: 2298550 - RNA, 19 nt, Human
agaaaacaaggaugaauua

SEQ ID NO: 2298551 - RNA, 15 nt, Human
agaaagaagaugaau

SEQ ID NO: 2298552 - RNA, 12 nt, Human
agaaagaagaga

SEQ ID NO: 2298553 - RNA, 14 nt, Human
agaaagaaggaagu

SEQ ID NO: 2298554 - RNA, 13 nt, Human
agaaagaaggaag

SEQ ID NO: 2298555 - RNA, 12 nt, Human
agaaagaaggaa

SEQ ID NO: 2298556 - RNA, 12 nt, Human
agaaagaagccc

SEQ ID NO: 2298557 - RNA, 22 nt, Human
agaaagaaacccgacagaggga

SEQ ID NO: 2298558 - RNA, 20 nt, Human
agaaagaaacccgacagagg

SEQ ID NO: 2298559 - RNA, 16 nt, Human
agaaagaaaaugaaga

SEQ ID NO: 2298560 - RNA, 16 nt, Human
agaaacugagaccaaa

SEQ ID NO: 2298561 - RNA, 15 nt, Human
agaaacugcagggaa

SEQ ID NO: 2298562 - RNA, 18 nt, Human
agaaacugaggaauuuuc

SEQ ID NO: 2298563 - RNA, 14 nt, Human
agaaacccugucuc

SEQ ID NO: 2298564 - RNA, 21 nt, Human
agaaacccgacagagggaaga

SEQ ID NO: 2298565 - RNA, 16 nt, Human
agaaacugaggaauuu

SEQ ID NO: 2298566 - RNA, 13 nt, Human
agaaacugaggaa

SEQ ID NO: 2298567 - RNA, 15 nt, Human
agaaacuggaacucu

SEQ ID NO: 2298568 - RNA, 13 nt, Human
agaaacuggaacu

SEQ ID NO: 2298569 - RNA, 20 nt, Human
agaaaacgguuaaaacuguc

SEQ ID NO: 2298570 - RNA, 21 nt, Human
agaaaacuccuuuagcaggug

SEQ ID NO: 2298571 - RNA, 15 nt, Human
agaaaacugaaaauc

SEQ ID NO: 2298572 - RNA, 16 nt, Human
agaaaacugaaaaucu

SEQ ID NO: 2298573 - RNA, 16 nt, Human
agaaaacccuuuucua

SEQ ID NO: 2298574 - RNA, 13 nt, Human
agaaaacccaccc

SEQ ID NO: 2298575 - RNA, 14 nt, Human
agaaaacccacccc

SEQ ID NO: 2298576 - RNA, 15 nt, Human
agaaaacauuguucc

SEQ ID NO: 2298577 - RNA, 12 nt, Human
agaaaacauugu

SEQ ID NO: 2298578 - RNA, 13 nt, Human
agaaaacauuguu

SEQ ID NO: 2298579 - RNA, 19 nt, Human
agaaaacauuguuccagau

SEQ ID NO: 2298580 - RNA, 12 nt, Human
agaaaacaucua

SEQ ID NO: 2298581 - RNA, 15 nt, Human
agaaaacaugccucu

SEQ ID NO: 2298582 - RNA, 11 nt, Human
agaaaacauug

SEQ ID NO: 2298583 - RNA, 13 nt, Human
agaaaacauguuu

SEQ ID NO: 2298584 - RNA, 14 nt, Human
agaaaacuucuuuu

SEQ ID NO: 2298585 - RNA, 18 nt, Human
agaaacccgacagaggga

SEQ ID NO: 2298586 - RNA, 16 nt, Human
agaaacccgacagagg

SEQ ID NO: 2298587 - RNA, 15 nt, Human
agaaacccagacuga

SEQ ID NO: 2298588 - RNA, 13 nt, Human
agaaacccugucu

SEQ ID NO: 2298589 - RNA, 21 nt, Human
agaaaccaguuaugugaauga

SEQ ID NO: 2298590 - RNA, 18 nt, Human
agaagaaacgucuaugug

SEQ ID NO: 2298591 - RNA, 16 nt, Human
agaagaaaauugcugu

SEQ ID NO: 2298592 - RNA, 19 nt, Human
agaagaaaauugcugugcc

SEQ ID NO: 2298593 - RNA, 13 nt, Human
agaagaaacuagg

SEQ ID NO: 2298594 - RNA, 21 nt, Human
agaagaacugaaaucauacuu

SEQ ID NO: 2298595 - RNA, 21 nt, Human
agaagaacuugcauggagcag

SEQ ID NO: 2298596 - RNA, 13 nt, Human
agaagaaggcagc

SEQ ID NO: 2298597 - RNA, 14 nt, Human
agaagaaggcagca

SEQ ID NO: 2298598 - RNA, 21 nt, Human
agaagaacuguguuucaaguu

SEQ ID NO: 2298599 - RNA, 20 nt, Human
agaagaacuguguuucaagu

SEQ ID NO: 2298600 - RNA, 21 nt, Human
agaagaaggcagcagguggca

SEQ ID NO: 2298601 - RNA, 16 nt, Human
agaagaagucagagag

SEQ ID NO: 2298602 - RNA, 17 nt, Human
agaagaagucagagagg

SEQ ID NO: 2298603 - RNA, 14 nt, Human
ucugccccuccccc

SEQ ID NO: 2298604 - RNA, 13 nt, Human
ucugccccucccc

SEQ ID NO: 2298605 - RNA, 22 nt, Human
ucugccccucccccaaccccca

SEQ ID NO: 2298606 - RNA, 18 nt, Human
ucugccccucccccaacc

SEQ ID NO: 2298607 - RNA, 16 nt, Human
ucugccccucccccaa

SEQ ID NO: 2298608 - RNA, 15 nt, Human
ucugccccuccccca

SEQ ID NO: 2298609 - RNA, 12 nt, Human
ucugccccuccc

SEQ ID NO: 2298610 - RNA, 13 nt, Human
ucugccccucccu

SEQ ID NO: 2298611 - RNA, 15 nt, Human
ucugccccucccugc

SEQ ID NO: 2298612 - RNA, 18 nt, Human
ucugccccucccugcuuc

SEQ ID NO: 2298613 - RNA, 22 nt, Human
ucugccccucuccaggcgccgg

SEQ ID NO: 2298614 - RNA, 20 nt, Human
ucugccuuuauuguguuugu

SEQ ID NO: 2298615 - RNA, 23 nt, Human
ucugccuuuauuguguuugucau

SEQ ID NO: 2298616 - RNA, 16 nt, Human
ucugccuuuauugugu

SEQ ID NO: 2298617 - RNA, 18 nt, Human
ucugccuuuauuguguuu

SEQ ID NO: 2298618 - RNA, 11 nt, Human
ucugccuuuau

SEQ ID NO: 2298619 - RNA, 20 nt, Human
ucugccuucucaugauccaa

SEQ ID NO: 2298620 - RNA, 14 nt, Human
ucugccuuccuugc

SEQ ID NO: 2298621 - RNA, 15 nt, Human
ucugccuuccuugcu

SEQ ID NO: 2298622 - RNA, 16 nt, Human
ucugccggcccugggg

SEQ ID NO: 2298623 - RNA, 15 nt, Human
ucugccggcccuggg

SEQ ID NO: 2298624 - RNA, 10 nt, Human
ucugcccggg

SEQ ID NO: 2298625 - RNA, 23 nt, Human
ucugcccgggaaggucaccagca

SEQ ID NO: 2298626 - RNA, 17 nt, Human
ucugccggcccuggggc

SEQ ID NO: 2298627 - RNA, 13 nt, Human
ucugccggcucuu

SEQ ID NO: 2298628 - RNA, 23 nt, Human
ucugccggcucuuuccuugcuca

SEQ ID NO: 2298629 - RNA, 14 nt, Human
ucugcccuccaaga

SEQ ID NO: 2298630 - RNA, 23 nt, Human
ucugccgcagcccugcagagggc

SEQ ID NO: 2298631 - RNA, 18 nt, Human
ucugcucagcuucuccug

SEQ ID NO: 2298632 - RNA, 15 nt, Human
ucugcucagcuucuc

SEQ ID NO: 2298633 - RNA, 14 nt, Human
ucugcucagcuucu

SEQ ID NO: 2298634 - RNA, 12 nt, Human
ucugcucaucau

SEQ ID NO: 2298635 - RNA, 22 nt, Human
ucugcucaguaauuugaggaca

SEQ ID NO: 2298636 - RNA, 16 nt, Human
ucugcucagcucuggg

SEQ ID NO: 2298637 - RNA, 14 nt, Human
ucugcucagcucug

SEQ ID NO: 2298638 - RNA, 16 nt, Human
ucugcucagcccugga

SEQ ID NO: 2298639 - RNA, 17 nt, Human
ucugcucagcccuggag

SEQ ID NO: 2298640 - RNA, 18 nt, Human
ucugcucagcccuggagg

SEQ ID NO: 2298641 - RNA, 19 nt, Human
ucugcucagcccuggaggu

SEQ ID NO: 2298642 - RNA, 16 nt, Human
ucugcuaugugacuug

SEQ ID NO: 2298643 - RNA, 16 nt, Human
ucugcucagcagcuau

SEQ ID NO: 2298644 - RNA, 17 nt, Human
ucugcuauauuuucaug

SEQ ID NO: 2298645 - RNA, 13 nt, Human
ucugcucagcccu

SEQ ID NO: 2298646 - RNA, 14 nt, Human
ucugcucagcccug

SEQ ID NO: 2298647 - RNA, 15 nt, Human
ucugcucagcccugg

SEQ ID NO: 2298648 - RNA, 21 nt, Human
ucugcuacguuccuauuguca

SEQ ID NO: 2298649 - RNA, 14 nt, Human
ucugcuaauaaaac

SEQ ID NO: 2298650 - RNA, 19 nt, Human
ucugcuacguuccuauugu

SEQ ID NO: 2298651 - RNA, 14 nt, Human
ucugcuaccucacu

SEQ ID NO: 2298652 - RNA, 17 nt, Human
ucugcuaccucacuggg

SEQ ID NO: 2298653 - RNA, 16 nt, Human
ucugcucacauaucug

SEQ ID NO: 2298654 - RNA, 22 nt, Human
ucugcuaagcucaaggcgugag

SEQ ID NO: 2298655 - RNA, 22 nt, Human
ucugcuaacuuggagccccagu

SEQ ID NO: 2298656 - RNA, 17 nt, Human
ucugcggaccccagcug

SEQ ID NO: 2298657 - RNA, 22 nt, Human
ucugcggaccccagcugugagc

SEQ ID NO: 2298658 - RNA, 14 nt, Human
ucugcggaccccag

SEQ ID NO: 2298659 - RNA, 15 nt, Human
ucugcggaccccagc

SEQ ID NO: 2298660 - RNA, 16 nt, Human
ucugcggaccccagcu

SEQ ID NO: 2298661 - RNA, 16 nt, Human
ucugccuuccuugcua

SEQ ID NO: 2298662 - RNA, 22 nt, Human
ucugccuuuggggacuuuucuu

SEQ ID NO: 2298663 - RNA, 13 nt, Human
ucugccuuuuuua

SEQ ID NO: 2298664 - RNA, 17 nt, Human
ucugcuuacaauucccu

SEQ ID NO: 2298665 - RNA, 19 nt, Human
ucugcuuacaauucccugc

SEQ ID NO: 2298666 - RNA, 20 nt, Human
ucugcuuacaauucccugcu

SEQ ID NO: 2298667 - RNA, 15 nt, Human
ucugcugucucagcc

SEQ ID NO: 2298668 - RNA, 16 nt, Human
ucugcugucucagccu

SEQ ID NO: 2298669 - RNA, 21 nt, Human
ucugcuguccagacagccugu

SEQ ID NO: 2298670 - RNA, 19 nt, Human
ucugcuguccagacagccu

SEQ ID NO: 2298671 - RNA, 14 nt, Human
ucugcuguccagac

SEQ ID NO: 2298672 - RNA, 15 nt, Human
ucugcuguccagaca

SEQ ID NO: 2298673 - RNA, 17 nt, Human
ucugcuguccagacagc

SEQ ID NO: 2298674 - RNA, 18 nt, Human
ucugcuguccagacagcc

SEQ ID NO: 2298675 - RNA, 22 nt, Human
ucugcucaucauucucugucuc

SEQ ID NO: 2298676 - RNA, 18 nt, Human
ucugcucaucauucucug

SEQ ID NO: 2298677 - RNA, 15 nt, Human
ucugcucaucauucu

SEQ ID NO: 2298678 - RNA, 14 nt, Human
ucugcucaucauuc

SEQ ID NO: 2298679 - RNA, 21 nt, Human
ucugcuuaugcaguuuuucag

SEQ ID NO: 2298680 - RNA, 16 nt, Human
ucugcuuaggagagac

SEQ ID NO: 2298681 - RNA, 17 nt, Human
ucugcuuaggagagacc

SEQ ID NO: 2298682 - RNA, 14 nt, Human
ucugcuucucugac

SEQ ID NO: 2298683 - RNA, 21 nt, Human
ucugcuuacaauucccugcug

SEQ ID NO: 2298684 - RNA, 22 nt, Human
ucugcuuacaauucccugcugu

SEQ ID NO: 2298685 - RNA, 23 nt, Human
ucugcuuacaauucccugcuguc

SEQ ID NO: 2298686 - RNA, 19 nt, Human
ucugcuugacaacaucuga

SEQ ID NO: 2298687 - RNA, 18 nt, Human
ucugcuugacaacaucug

SEQ ID NO: 2298688 - RNA, 22 nt, Human
ucugcuucucugacuucugccu

SEQ ID NO: 2298689 - RNA, 16 nt, Human
ucugcuucucugacuu

SEQ ID NO: 2298690 - RNA, 19 nt, Human
ucugcuucucugacuucug

SEQ ID NO: 2298691 - RNA, 14 nt, Human
ucugcuugagucag

SEQ ID NO: 2298692 - RNA, 12 nt, Human
ucugcuugaguc

SEQ ID NO: 2298693 - RNA, 18 nt, Human
ucugcuugauuuuugccu

SEQ ID NO: 2298694 - RNA, 13 nt, Human
ucuggaaaagagg

SEQ ID NO: 2298695 - RNA, 19 nt, Human
ucuggaaaggggggagcug

SEQ ID NO: 2298696 - RNA, 14 nt, Human
ucuggaacccagac

SEQ ID NO: 2298697 - RNA, 13 nt, Human
ucuggaacccaga

SEQ ID NO: 2298698 - RNA, 18 nt, Human
ucuggaacccagacucag

SEQ ID NO: 2298699 - RNA, 17 nt, Human
ucuggaacccagacuca

SEQ ID NO: 2298700 - RNA, 16 nt, Human
ucuggaacccagacuc

SEQ ID NO: 2298701 - RNA, 15 nt, Human
ucuggaacccagacu

SEQ ID NO: 2298702 - RNA, 18 nt, Human
ucuggaaaaugugaccca

SEQ ID NO: 2298703 - RNA, 20 nt, Human
ucugcuugagucagguuuga

SEQ ID NO: 2298704 - RNA, 23 nt, Human
ucugcuuuuuaaagaaugcucuu

SEQ ID NO: 2298705 - RNA, 18 nt, Human
ucuggagguacgaaaaga

SEQ ID NO: 2298706 - RNA, 17 nt, Human
ucuggaguauucuauaa

SEQ ID NO: 2298707 - RNA, 17 nt, Human
ucuggagguugauaacu

SEQ ID NO: 2298708 - RNA, 19 nt, Human
ucuggagguugauaacuuu

SEQ ID NO: 2298709 - RNA, 16 nt, Human
ucuggaaccucagccu

SEQ ID NO: 2298710 - RNA, 15 nt, Human
ucuggaaccucagcc

SEQ ID NO: 2298711 - RNA, 23 nt, Human
ucuggaacccagacucagacauu

SEQ ID NO: 2298712 - RNA, 22 nt, Human
ucuggaacccagacucagacau

SEQ ID NO: 2298713 - RNA, 21 nt, Human
ucuggaguugaucuggaaccc

SEQ ID NO: 2298714 - RNA, 22 nt, Human
ucuggaguuuuuguuuggagag

SEQ ID NO: 2298715 - RNA, 24 nt, Human
ucuggaguuuuuguuuggagagca

SEQ ID NO: 2298716 - RNA, 17 nt, Human
ucuggaguugaucugga

SEQ ID NO: 2298717 - RNA, 16 nt, Human
ucuggaguugaucugg

SEQ ID NO: 2298718 - RNA, 19 nt, Human
ucuggaguggccacuaagc

SEQ ID NO: 2298719 - RNA, 15 nt, Human
ucuggaguggccacu

SEQ ID NO: 2298720 - RNA, 14 nt, Human
ucuggaguggccac

SEQ ID NO: 2298721 - RNA, 21 nt, Human
ucuggagucucacuugucuca

SEQ ID NO: 2298722 - RNA, 20 nt, Human
ucuggagguugauaacuuug

SEQ ID NO: 2298723 - RNA, 19 nt, Human
ucuggagucuccagugguu

SEQ ID NO: 2298724 - RNA, 14 nt, Human
ucuggauaggagcc

SEQ ID NO: 2298725 - RNA, 16 nt, Human
ucuggauaggagccug

SEQ ID NO: 2298726 - RNA, 20 nt, Human
ucuggauaggagccugcugg

SEQ ID NO: 2298727 - RNA, 21 nt, Human
ucuggauaggagccugcuggu

SEQ ID NO: 2298728 - RNA, 14 nt, Human
ucuggaucugggac

SEQ ID NO: 2298729 - RNA, 17 nt, Human
ucuggaugcauuucucu

SEQ ID NO: 2298730 - RNA, 18 nt, Human
ucuggaugcauuucucug

SEQ ID NO: 2298731 - RNA, 22 nt, Human
ucuggaugccugauugccaagc

SEQ ID NO: 2298732 - RNA, 18 nt, Human
ucuggauggcaccagagg

SEQ ID NO: 2298733 - RNA, 19 nt, Human
ucuggauggcaccagaggc

SEQ ID NO: 2298734 - RNA, 12 nt, Human
ucuggauuauau

SEQ ID NO: 2298735 - RNA, 18 nt, Human
ucuggauuauauuaugaa

SEQ ID NO: 2298736 - RNA, 14 nt, Human
ucuggcagcucaga

SEQ ID NO: 2298737 - RNA, 15 nt, Human
ucuggcagcucagag

SEQ ID NO: 2298738 - RNA, 16 nt, Human
ucuggcagccucccau

SEQ ID NO: 2298739 - RNA, 20 nt, Human
agaagcuauaaauuccucuu

SEQ ID NO: 2298740 - RNA, 21 nt, Human
agaagcuauaaauuccucuuu

SEQ ID NO: 2298741 - RNA, 14 nt, Human
agaagcgagcacug

SEQ ID NO: 2298742 - RNA, 19 nt, Human
agaagccuuugggaagggg

SEQ ID NO: 2298743 - RNA, 23 nt, Human
agaagcgggacgagacccuacag

SEQ ID NO: 2298744 - RNA, 19 nt, Human
agaagcgugagacgccacc

SEQ ID NO: 2298745 - RNA, 18 nt, Human
agaagcuaaaaccugagc

SEQ ID NO: 2298746 - RNA, 16 nt, Human
agaagcggcuggcagc

SEQ ID NO: 2298747 - RNA, 15 nt, Human
agaagcggcuggcag

SEQ ID NO: 2298748 - RNA, 20 nt, Human
agaagcugagcaccagggga

SEQ ID NO: 2298749 - RNA, 15 nt, Human
agaagcugagcacca

SEQ ID NO: 2298750 - RNA, 14 nt, Human
agaagcuccaggua

SEQ ID NO: 2298751 - RNA, 17 nt, Human
agaagcugcucuggaau

SEQ ID NO: 2298752 - RNA, 13 nt, Human
agaagcuggagga

SEQ ID NO: 2298753 - RNA, 16 nt, Human
agaagcuggaggacua

SEQ ID NO: 2298754 - RNA, 13 nt, Human
agaagcuguagua

SEQ ID NO: 2298755 - RNA, 14 nt, Human
agaagcuguuguac

SEQ ID NO: 2298756 - RNA, 16 nt, Human
agaagcuguuguacau

SEQ ID NO: 2298757 - RNA, 18 nt, Human
agaagcuguuguacauuu

SEQ ID NO: 2298758 - RNA, 19 nt, Human
agaagcuguuguacauuua

SEQ ID NO: 2298759 - RNA, 20 nt, Human
agaagcuguuguacauuuau

SEQ ID NO: 2298760 - RNA, 21 nt, Human
agaagcuguuguacauuuaug

SEQ ID NO: 2298761 - RNA, 22 nt, Human
agaagcuguuguacauuuauga

SEQ ID NO: 2298762 - RNA, 16 nt, Human
ucuggcccugccuucu

SEQ ID NO: 2298763 - RNA, 15 nt, Human
ucuggcccugccuuc

SEQ ID NO: 2298764 - RNA, 14 nt, Human
ucuggcccugccuu

SEQ ID NO: 2298765 - RNA, 21 nt, Human
agaagccugaugcugacauuc

SEQ ID NO: 2298766 - RNA, 16 nt, Human
agaagccuguuuuguu

SEQ ID NO: 2298767 - RNA, 13 nt, Human
ucuggcccugccu

SEQ ID NO: 2298768 - RNA, 21 nt, Human
ucuggcccucuaccccugauc

SEQ ID NO: 2298769 - RNA, 23 nt, Human
ucuggcccucaccccugcccugg

SEQ ID NO: 2298770 - RNA, 19 nt, Human
ucuggcccucaccccugcc

SEQ ID NO: 2298771 - RNA, 11 nt, Human
ucuggcccuau

SEQ ID NO: 2298772 - RNA, 19 nt, Human
ucuggccaggauggagggg

SEQ ID NO: 2298773 - RNA, 18 nt, Human
ucuggcauuagaauuauu

SEQ ID NO: 2298774 - RNA, 11 nt, Human
ucuggccaggc

SEQ ID NO: 2298775 - RNA, 16 nt, Human
ucuggcagcucagaga

SEQ ID NO: 2298776 - RNA, 21 nt, Human
ucuggcagccucccauccagg

SEQ ID NO: 2298777 - RNA, 18 nt, Human
ucuggcaguucuggaaug

SEQ ID NO: 2298778 - RNA, 13 nt, Human
ucugaccccuccu

SEQ ID NO: 2298779 - RNA, 15 nt, Human
ucugaccccuccuca

SEQ ID NO: 2298780 - RNA, 18 nt, Human
agaaagaaggaagugaag

SEQ ID NO: 2298781 - RNA, 13 nt, Human
agaaagaagagac

SEQ ID NO: 2298782 - RNA, 19 nt, Human
ucugacccugcuucaaaua

SEQ ID NO: 2298783 - RNA, 21 nt, Human
ucugaccgaaacagcgcuggg

SEQ ID NO: 2298784 - RNA, 23 nt, Human
ucugacccuuacagccucugacu

SEQ ID NO: 2298785 - RNA, 14 nt, Human
ucugacccucucca

SEQ ID NO: 2298786 - RNA, 16 nt, Human
ucugacccucucccca

SEQ ID NO: 2298787 - RNA, 18 nt, Human
ucugaccccuccucacug

SEQ ID NO: 2298788 - RNA, 16 nt, Human
ucugaccccuccucac

SEQ ID NO: 2298789 - RNA, 17 nt, Human
ucugaccccuccucacu

SEQ ID NO: 2298790 - RNA, 12 nt, Human
ucugaccugcag

SEQ ID NO: 2298791 - RNA, 18 nt, Human
ucugaccugcacugggga

SEQ ID NO: 2298792 - RNA, 16 nt, Human
ucugaccucuuggcca

SEQ ID NO: 2298793 - RNA, 14 nt, Human
ucugaccuccauga

SEQ ID NO: 2298794 - RNA, 23 nt, Human
agaaagacuauucaaacagucuc

SEQ ID NO: 2298795 - RNA, 20 nt, Human
agaaagacuauucaaacagu

SEQ ID NO: 2298796 - RNA, 18 nt, Human
agaaagacuauucaaaca

SEQ ID NO: 2298797 - RNA, 19 nt, Human
agaaagacuauucaaacag

SEQ ID NO: 2298798 - RNA, 15 nt, Human
ucugaccugcaggcc

SEQ ID NO: 2298799 - RNA, 18 nt, Human
ucugaccucuuggccaca

SEQ ID NO: 2298800 - RNA, 14 nt, Human
ucugaccugcaggc

SEQ ID NO: 2298801 - RNA, 12 nt, Human
ucugacuucugc

SEQ ID NO: 2298802 - RNA, 20 nt, Human
ucugacuuaagcugccucaa

SEQ ID NO: 2298803 - RNA, 21 nt, Human
ucugacuguuuccaucaaggg

SEQ ID NO: 2298804 - RNA, 19 nt, Human
ucugacuucugccuggaga

SEQ ID NO: 2298805 - RNA, 20 nt, Human
ucugacuucugccuggagac

SEQ ID NO: 2298806 - RNA, 14 nt, Human
ucugacuucugccu

SEQ ID NO: 2298807 - RNA, 15 nt, Human
ucugacuucugccug

SEQ ID NO: 2298808 - RNA, 16 nt, Human
ucugacuucugccugg

SEQ ID NO: 2298809 - RNA, 17 nt, Human
ucugacuucugccugga

SEQ ID NO: 2298810 - RNA, 20 nt, Human
ucugagaaagacuauucaaa

SEQ ID NO: 2298811 - RNA, 19 nt, Human
ucugagaaagacuauucaa

SEQ ID NO: 2298812 - RNA, 15 nt, Human
ucugagaaagacuau

SEQ ID NO: 2298813 - RNA, 14 nt, Human
ucugagaaagacua

SEQ ID NO: 2298814 - RNA, 13 nt, Human
ucugagaacucau

SEQ ID NO: 2298815 - RNA, 11 nt, Human
ucugaggcugu

SEQ ID NO: 2298816 - RNA, 12 nt, Human
ucugaggcugua

SEQ ID NO: 2298817 - RNA, 22 nt, Human
ucugagaaaagcuuugaacccu

SEQ ID NO: 2298818 - RNA, 23 nt, Human
ucugagaaagacuauucaaacag

SEQ ID NO: 2298819 - RNA, 22 nt, Human
ucugagaaagacuauucaaaca

SEQ ID NO: 2298820 - RNA, 21 nt, Human
ucugagaaagacuauucaaac

SEQ ID NO: 2298821 - RNA, 18 nt, Human
ucugagggcuuccuuugg

SEQ ID NO: 2298822 - RNA, 23 nt, Human
ucugagggaggaggccaccucuc

SEQ ID NO: 2298823 - RNA, 15 nt, Human
ucugagggcuuccuu

SEQ ID NO: 2298824 - RNA, 18 nt, Human
ucugagggaggaggccac

SEQ ID NO: 2298825 - RNA, 20 nt, Human
ucugagggaggaggccaccu

SEQ ID NO: 2298826 - RNA, 21 nt, Human
ucugagggaggaggccaccuc

SEQ ID NO: 2298827 - RNA, 22 nt, Human
ucugagggaggaggccaccucu

SEQ ID NO: 2298828 - RNA, 14 nt, Human
ucugaggcuuccag

SEQ ID NO: 2298829 - RNA, 15 nt, Human
ucugaggcuuccaga

SEQ ID NO: 2298830 - RNA, 16 nt, Human
ucugaggcuuccagag

SEQ ID NO: 2298831 - RNA, 19 nt, Human
ucugaggcuuccagagagu

SEQ ID NO: 2298832 - RNA, 13 nt, Human
ucugagggaggag

SEQ ID NO: 2298833 - RNA, 17 nt, Human
ucugagggaggaggcca

SEQ ID NO: 2298834 - RNA, 19 nt, Human
ucugaggggcaacugaguc

SEQ ID NO: 2298835 - RNA, 20 nt, Human
ucugauauuccaugaaugua

SEQ ID NO: 2298836 - RNA, 19 nt, Human
ucugauauuccaugaaugu

SEQ ID NO: 2298837 - RNA, 17 nt, Human
ucugauauuccaugaau

SEQ ID NO: 2298838 - RNA, 15 nt, Human
ucugauaggccaagu

SEQ ID NO: 2298839 - RNA, 23 nt, Human
ucugauaggaaugugaaagcacg

SEQ ID NO: 2298840 - RNA, 14 nt, Human
ucugauacccagag

SEQ ID NO: 2298841 - RNA, 16 nt, Human
ucugauacccagagca

SEQ ID NO: 2298842 - RNA, 19 nt, Human
ucugauucccaagcucugc

SEQ ID NO: 2298843 - RNA, 20 nt, Human
ucugauucccaagcucugcu

SEQ ID NO: 2298844 - RNA, 21 nt, Human
ucugauucccaagcucugcuc

SEQ ID NO: 2298845 - RNA, 22 nt, Human
ucugauauuccaugaauguauc

SEQ ID NO: 2298846 - RNA, 21 nt, Human
ucugcacucuaacccuaggca

SEQ ID NO: 2298847 - RNA, 22 nt, Human
ucugcacuccccugcugggugu

SEQ ID NO: 2298848 - RNA, 15 nt, Human
agaagaaaacaucua

SEQ ID NO: 2298849 - RNA, 23 nt, Human
agaagaaaacaucuauucucucc

SEQ ID NO: 2298850 - RNA, 20 nt, Human
agaacucugggcugcuaccc

SEQ ID NO: 2298851 - RNA, 20 nt, Human
agaacucugggcugccaugu

SEQ ID NO: 2298852 - RNA, 14 nt, Human
agaacucuuucaaa

SEQ ID NO: 2298853 - RNA, 21 nt, Human
agaacugaaccggcuuuacca

SEQ ID NO: 2298854 - RNA, 23 nt, Human
agaacugaaccggcuuuaccaaa

SEQ ID NO: 2298855 - RNA, 14 nt, Human
agaacucccuuuca

SEQ ID NO: 2298856 - RNA, 23 nt, Human
agaacucuccaucuuauuuucau

SEQ ID NO: 2298857 - RNA, 14 nt, Human
agaacucugggcug

SEQ ID NO: 2298858 - RNA, 21 nt, Human
agaacucaugacggaagaguu

SEQ ID NO: 2298859 - RNA, 23 nt, Human
agaacucaucccuaaugcugcag

SEQ ID NO: 2298860 - RNA, 17 nt, Human
agaacucaguuuuaacu

SEQ ID NO: 2298861 - RNA, 19 nt, Human
agaacucacuggggccuac

SEQ ID NO: 2298862 - RNA, 22 nt, Human
agaacuacaaacaaaauuucua

SEQ ID NO: 2298863 - RNA, 23 nt, Human
agaacuacaaacaaaauuucuau

SEQ ID NO: 2298864 - RNA, 12 nt, Human
agaacuaaacuc

SEQ ID NO: 2298865 - RNA, 19 nt, Human
agaacguggcucugcuggc

SEQ ID NO: 2298866 - RNA, 18 nt, Human
agaacuaaacucauuuau

SEQ ID NO: 2298867 - RNA, 16 nt, Human
agaacuaaacucauuu

SEQ ID NO: 2298868 - RNA, 22 nt, Human
agaacuaacacuauuuuaugca

SEQ ID NO: 2298869 - RNA, 18 nt, Human
agaacuacaaacaaaauu

SEQ ID NO: 2298870 - RNA, 21 nt, Human
agaaccucaggcuuccuuggc

SEQ ID NO: 2298871 - RNA, 19 nt, Human
agaaccucaggcuuccuug

SEQ ID NO: 2298872 - RNA, 12 nt, Human
agaaccucaggc

SEQ ID NO: 2298873 - RNA, 21 nt, Human
agaaccucacgcaccucccau

SEQ ID NO: 2298874 - RNA, 18 nt, Human
agaaccucacgcaccucc

SEQ ID NO: 2298875 - RNA, 14 nt, Human
agaaccucuucccc

SEQ ID NO: 2298876 - RNA, 13 nt, Human
agaaccucuuccc

SEQ ID NO: 2298877 - RNA, 22 nt, Human
agaacguauugguccagcuugc

SEQ ID NO: 2298878 - RNA, 17 nt, Human
agaacguggcucugcug

SEQ ID NO: 2298879 - RNA, 18 nt, Human
agaacguggcucugcugg

SEQ ID NO: 2298880 - RNA, 20 nt, Human
agaacggggcucuucucauu

SEQ ID NO: 2298881 - RNA, 21 nt, Human
agaacggggcucuucucauuu

SEQ ID NO: 2298882 - RNA, 22 nt, Human
agaaccucacgcaccucccauc

SEQ ID NO: 2298883 - RNA, 15 nt, Human
agaaccucuucccca

SEQ ID NO: 2298884 - RNA, 17 nt, Human
agaacggggcucuucuc

SEQ ID NO: 2298885 - RNA, 19 nt, Human
agaacggggcucuucucau

SEQ ID NO: 2298886 - RNA, 15 nt, Human
ucugcagaaacagaa

SEQ ID NO: 2298887 - RNA, 10 nt, Human
ucugcagaag

SEQ ID NO: 2298888 - RNA, 15 nt, Human
ucugcacugagcaga

SEQ ID NO: 2298889 - RNA, 22 nt, Human
ucugcacugagcagagucuugc

SEQ ID NO: 2298890 - RNA, 23 nt, Human
ucugcagaaggaaaaauguguaa

SEQ ID NO: 2298891 - RNA, 13 nt, Human
ucugcagaaggaa

SEQ ID NO: 2298892 - RNA, 15 nt, Human
ucugcagaaggaaaa

SEQ ID NO: 2298893 - RNA, 21 nt, Human
ucugcagaaggaaaaaugugu

SEQ ID NO: 2298894 - RNA, 22 nt, Human
ucugcagaaggaaaaaugugua

SEQ ID NO: 2298895 - RNA, 16 nt, Human
agaaauguacagcaag

SEQ ID NO: 2298896 - RNA, 17 nt, Human
agaaauguacagcaagg

SEQ ID NO: 2298897 - RNA, 12 nt, Human
ucugcagagcag

SEQ ID NO: 2298898 - RNA, 11 nt, Human
agaaauguguu

SEQ ID NO: 2298899 - RNA, 16 nt, Human
agaaauguuguucauu

SEQ ID NO: 2298900 - RNA, 20 nt, Human
agaaaugucuaaaugcugaa

SEQ ID NO: 2298901 - RNA, 14 nt, Human
agaaauuggcugga

SEQ ID NO: 2298902 - RNA, 19 nt, Human
agaaauuggaacagaaugu

SEQ ID NO: 2298903 - RNA, 15 nt, Human
agaaauuggcuggau

SEQ ID NO: 2298904 - RNA, 22 nt, Human
agaaauuggaacagaauguuuu

SEQ ID NO: 2298905 - RNA, 23 nt, Human
agaaauuuuucagaugcuucugg

SEQ ID NO: 2298906 - RNA, 10 nt, Human
agaacaaaaa

SEQ ID NO: 2298907 - RNA, 19 nt, Human
agaacaaaaaaaucugcag

SEQ ID NO: 2298908 - RNA, 20 nt, Human
agaacaaaaaaaucugcaga

SEQ ID NO: 2298909 - RNA, 22 nt, Human
agaaauuuuucagaugcuucug

SEQ ID NO: 2298910 - RNA, 21 nt, Human
agaaauuuuucagaugcuucu

SEQ ID NO: 2298911 - RNA, 18 nt, Human
agaaauuuuucagaugcu

SEQ ID NO: 2298912 - RNA, 17 nt, Human
agaaauuuuucagaugc

SEQ ID NO: 2298913 - RNA, 23 nt, Human
agaacaaaaaaaucugcagaagg

SEQ ID NO: 2298914 - RNA, 21 nt, Human
agaacaaaaaaaucugcagaa

SEQ ID NO: 2298915 - RNA, 14 nt, Human
agaacaaaggacag

SEQ ID NO: 2298916 - RNA, 21 nt, Human
agaacaaaggacagaguauga

SEQ ID NO: 2298917 - RNA, 22 nt, Human
agaacaaaggacagaguaugaa

SEQ ID NO: 2298918 - RNA, 16 nt, Human
agaacaaagugagaca

SEQ ID NO: 2298919 - RNA, 18 nt, Human
agaaccgagcaaagauca

SEQ ID NO: 2298920 - RNA, 22 nt, Human
agaaccgagcaaagaucaaaau

SEQ ID NO: 2298921 - RNA, 20 nt, Human
agaaccgagcaaagaucaaa

SEQ ID NO: 2298922 - RNA, 21 nt, Human
agaaccgagcaaagaucaaaa

SEQ ID NO: 2298923 - RNA, 16 nt, Human
agaaccuagaagggcu

SEQ ID NO: 2298924 - RNA, 22 nt, Human
agaaauuuaauucauguuucuu

SEQ ID NO: 2298925 - RNA, 21 nt, Human
agaaauuuaauucauguuucu

SEQ ID NO: 2298926 - RNA, 17 nt, Human
agaaauuuaauucaugu

SEQ ID NO: 2298927 - RNA, 20 nt, Human
agaaauuugauuucuauuca

SEQ ID NO: 2298928 - RNA, 13 nt, Human
agaaauuuuuauu

SEQ ID NO: 2298929 - RNA, 22 nt, Human
agaaauuuuuauuuuucuaagg

SEQ ID NO: 2298930 - RNA, 18 nt, Human
agaaauuuaaaagacacu

SEQ ID NO: 2298931 - RNA, 16 nt, Human
agaaggaaaaggcagg

SEQ ID NO: 2298932 - RNA, 16 nt, Human
agaaggaaaaaugugu

SEQ ID NO: 2298933 - RNA, 17 nt, Human
agaaggaaaaaugugua

SEQ ID NO: 2298934 - RNA, 22 nt, Human
agaagcuuuugaauaaaaacuu

SEQ ID NO: 2298935 - RNA, 17 nt, Human
agaagcuucagaaguuu

SEQ ID NO: 2298936 - RNA, 17 nt, Human
agaagcuuaggcagggc

SEQ ID NO: 2298937 - RNA, 16 nt, Human
agaagcuucagaaguu

SEQ ID NO: 2298938 - RNA, 18 nt, Human
agaagcuuccauuccaag

SEQ ID NO: 2298939 - RNA, 23 nt, Human
agaagcuguuguacauuuaugau

SEQ ID NO: 2298940 - RNA, 13 nt, Human
agaagcuuaggca

SEQ ID NO: 2298941 - RNA, 15 nt, Human
agaagcuuaggcagg

SEQ ID NO: 2298942 - RNA, 16 nt, Human
agaagcuuaggcaggg

SEQ ID NO: 2298943 - RNA, 17 nt, Human
agaaggaaauugagauu

SEQ ID NO: 2298944 - RNA, 9 nt, Human
agaaggaag

SEQ ID NO: 2298945 - RNA, 18 nt, Human
agaaggaaaaauguguaa

SEQ ID NO: 2298946 - RNA, 19 nt, Human
agaaggaaaaugaucugag

SEQ ID NO: 2298947 - RNA, 22 nt, Human
agaaggaaggagacucaccucu

SEQ ID NO: 2298948 - RNA, 15 nt, Human
ucuggggcaggguua

SEQ ID NO: 2298949 - RNA, 13 nt, Human
ucuggggccccuu

SEQ ID NO: 2298950 - RNA, 15 nt, Human
ucuggggcucuggga

SEQ ID NO: 2298951 - RNA, 17 nt, Human
agaaggaagugaagagg

SEQ ID NO: 2298952 - RNA, 13 nt, Human
agaaggaagggca

SEQ ID NO: 2298953 - RNA, 14 nt, Human
ucuggucccuugca

SEQ ID NO: 2298954 - RNA, 13 nt, Human
ucuggucccuugc

SEQ ID NO: 2298955 - RNA, 17 nt, Human
ucuggucaaccuccugg

SEQ ID NO: 2298956 - RNA, 21 nt, Human
ucuggucaaccuccuggacau

SEQ ID NO: 2298957 - RNA, 13 nt, Human
ucugguccuaccc

SEQ ID NO: 2298958 - RNA, 18 nt, Human
ucugguccggacacuccu

SEQ ID NO: 2298959 - RNA, 14 nt, Human
ucugguccuaccca

SEQ ID NO: 2298960 - RNA, 15 nt, Human
ucuggucgcuccugc

SEQ ID NO: 2298961 - RNA, 17 nt, Human
ucuggucgcuccugccc

SEQ ID NO: 2298962 - RNA, 13 nt, Human
ucuggguggccuc

SEQ ID NO: 2298963 - RNA, 16 nt, Human
ucuggguuccuuccuc

SEQ ID NO: 2298964 - RNA, 18 nt, Human
ucugguccauagagagca

SEQ ID NO: 2298965 - RNA, 16 nt, Human
ucuggggcucugggau

SEQ ID NO: 2298966 - RNA, 16 nt, Human
ucuggggccacacaga

SEQ ID NO: 2298967 - RNA, 15 nt, Human
ucugggggaguggaa

SEQ ID NO: 2298968 - RNA, 18 nt, Human
ucugggugcucccuacca

SEQ ID NO: 2298969 - RNA, 11 nt, Human
ucuggggcugu

SEQ ID NO: 2298970 - RNA, 14 nt, Human
ucuggguucacugc

SEQ ID NO: 2298971 - RNA, 16 nt, Human
ucuggguucacugcaa

SEQ ID NO: 2298972 - RNA, 20 nt, Human
ucugucauuugagcagggcu

SEQ ID NO: 2298973 - RNA, 23 nt, Human
ucugucauuugagcagggcucag

SEQ ID NO: 2298974 - RNA, 17 nt, Human
ucuguccaaaggaggcu

SEQ ID NO: 2298975 - RNA, 16 nt, Human
ucuguccaaaggaggc

SEQ ID NO: 2298976 - RNA, 15 nt, Human
ucuguccaaaggagg

SEQ ID NO: 2298977 - RNA, 22 nt, Human
ucugucaugaacauguuccuga

SEQ ID NO: 2298978 - RNA, 22 nt, Human
ucuguccaaaggaggcuggcag

SEQ ID NO: 2298979 - RNA, 19 nt, Human
ucuguccaaaggaggcugg

SEQ ID NO: 2298980 - RNA, 23 nt, Human
ucuguccaaaggaggcuggcagg

SEQ ID NO: 2298981 - RNA, 15 nt, Human
ucugucauuugagca

SEQ ID NO: 2298982 - RNA, 19 nt, Human
ucugucagucacagccacc

SEQ ID NO: 2298983 - RNA, 17 nt, Human
ucugucagucacagcca

SEQ ID NO: 2298984 - RNA, 13 nt, Human
ucugucagucaca

SEQ ID NO: 2298985 - RNA, 16 nt, Human
ucugucaggagagcag

SEQ ID NO: 2298986 - RNA, 17 nt, Human
ucugucaggagagcagc

SEQ ID NO: 2298987 - RNA, 21 nt, Human
ucugucagcgcagguuuaguu

SEQ ID NO: 2298988 - RNA, 22 nt, Human
ucuguauauaaaauauuuucau

SEQ ID NO: 2298989 - RNA, 14 nt, Human
ucuguauauaaaau

SEQ ID NO: 2298990 - RNA, 15 nt, Human
ucuguauauaaaaua

SEQ ID NO: 2298991 - RNA, 14 nt, Human
ucuguagugagaua

SEQ ID NO: 2298992 - RNA, 17 nt, Human
ucuguagugagauagca

SEQ ID NO: 2298993 - RNA, 21 nt, Human
ucuguaguuuuaucacaugua

SEQ ID NO: 2298994 - RNA, 22 nt, Human
ucuguaguuuuaucacauguau

SEQ ID NO: 2298995 - RNA, 23 nt, Human
ucuguaguuuuaucacauguaug

SEQ ID NO: 2298996 - RNA, 17 nt, Human
ucuguagggcuggaccu

SEQ ID NO: 2298997 - RNA, 14 nt, Human
ucuguauacugugg

SEQ ID NO: 2298998 - RNA, 21 nt, Human
ucuguauaaguaagaaaauau

SEQ ID NO: 2298999 - RNA, 15 nt, Human
ucuguauacaacccu

SEQ ID NO: 2299000 - RNA, 23 nt, Human
ucuguauaaagccuguauucuca

SEQ ID NO: 2299001 - RNA, 16 nt, Human
ucuguauaaguaagaa

SEQ ID NO: 2299002 - RNA, 17 nt, Human
ucuguauaaguaagaaa

SEQ ID NO: 2299003 - RNA, 18 nt, Human
ucuguauaaguaagaaaa

SEQ ID NO: 2299004 - RNA, 22 nt, Human
ucuguauaaguaagaaaauauu

SEQ ID NO: 2299005 - RNA, 14 nt, Human
ucuguagcuccuca

SEQ ID NO: 2299006 - RNA, 13 nt, Human
ucuguagcuccuc

SEQ ID NO: 2299007 - RNA, 19 nt, Human
ucuguagggaacucugggg

SEQ ID NO: 2299008 - RNA, 16 nt, Human
ucuguagauucugugg

SEQ ID NO: 2299009 - RNA, 19 nt, Human
ucuguagauucuguggaac

SEQ ID NO: 2299010 - RNA, 23 nt, Human
ucuguagauucuguggaacaagc

SEQ ID NO: 2299011 - RNA, 23 nt, Human
ucuguagcuccucaacucaccua

SEQ ID NO: 2299012 - RNA, 14 nt, Human
ucuguagggcugga

SEQ ID NO: 2299013 - RNA, 22 nt, Human
ucuguagggauuuuuggcuaca

SEQ ID NO: 2299014 - RNA, 20 nt, Human
ucuguaggguaauuaguaac

SEQ ID NO: 2299015 - RNA, 15 nt, Human
ucuguagggcuggac

SEQ ID NO: 2299016 - RNA, 16 nt, Human
ucuguagggcuggacc

SEQ ID NO: 2299017 - RNA, 16 nt, Human
ucuguagagggcccug

SEQ ID NO: 2299018 - RNA, 22 nt, Human
ucuguagaaaugguuguauuag

SEQ ID NO: 2299019 - RNA, 17 nt, Human
ucuguagagggcccugg

SEQ ID NO: 2299020 - RNA, 18 nt, Human
ucuguagagggcccuggu

SEQ ID NO: 2299021 - RNA, 19 nt, Human
ucuguagagggcccuggug

SEQ ID NO: 2299022 - RNA, 20 nt, Human
ucuguagagggcccuggugu

SEQ ID NO: 2299023 - RNA, 17 nt, Human
ucuggucuccucagccu

SEQ ID NO: 2299024 - RNA, 18 nt, Human
ucuggucuccucagccuc

SEQ ID NO: 2299025 - RNA, 22 nt, Human
agaauugcugauucuugaguuu

SEQ ID NO: 2299026 - RNA, 18 nt, Human
ucuguuuuagguuaaaaa

SEQ ID NO: 2299027 - RNA, 21 nt, Human
agaauuggagaguaaaaacug

SEQ ID NO: 2299028 - RNA, 20 nt, Human
agaauugucuuucugucucu

SEQ ID NO: 2299029 - RNA, 18 nt, Human
agaauuggcugaacucau

SEQ ID NO: 2299030 - RNA, 21 nt, Human
agaauuggcugaacucaugag

SEQ ID NO: 2299031 - RNA, 22 nt, Human
agaauuggcugaacucaugaga

SEQ ID NO: 2299032 - RNA, 15 nt, Human
agaauuguaucauuu

SEQ ID NO: 2299033 - RNA, 15 nt, Human
agaauugugucugca

SEQ ID NO: 2299034 - RNA, 16 nt, Human
agaauugugucugcag

SEQ ID NO: 2299035 - RNA, 17 nt, Human
agaauugugucugcagg

SEQ ID NO: 2299036 - RNA, 18 nt, Human
agaauugugucugcagga

SEQ ID NO: 2299037 - RNA, 20 nt, Human
ucuguuuuauaauuuuguga

SEQ ID NO: 2299038 - RNA, 18 nt, Human
ucuguuuuauaauuuugu

SEQ ID NO: 2299039 - RNA, 16 nt, Human
ucuguuucucuuuccu

SEQ ID NO: 2299040 - RNA, 14 nt, Human
ucuguuugacaaac

SEQ ID NO: 2299041 - RNA, 18 nt, Human
ucuguuucucuuuccuug

SEQ ID NO: 2299042 - RNA, 13 nt, Human
ucuguuuccuuuu

SEQ ID NO: 2299043 - RNA, 21 nt, Human
agaauuuaucacacuucugug

SEQ ID NO: 2299044 - RNA, 15 nt, Human
agaauuuagguuuuu

SEQ ID NO: 2299045 - RNA, 13 nt, Human
agaauuuauucaa

SEQ ID NO: 2299046 - RNA, 14 nt, Human
agaauuuauucaau

SEQ ID NO: 2299047 - RNA, 14 nt, Human
agaauuuagggaga

SEQ ID NO: 2299048 - RNA, 19 nt, Human
agaauuuagggagaaaugu

SEQ ID NO: 2299049 - RNA, 22 nt, Human
agaauuuagggagaaauguugu

SEQ ID NO: 2299050 - RNA, 17 nt, Human
agaauuucccaaagcag

SEQ ID NO: 2299051 - RNA, 18 nt, Human
agaauuucccaaagcagu

SEQ ID NO: 2299052 - RNA, 22 nt, Human
agaauuucuugguaagaagccg

SEQ ID NO: 2299053 - RNA, 21 nt, Human
agaauuucuugguaagaagcc

SEQ ID NO: 2299054 - RNA, 13 nt, Human
agaauuucuuggu

SEQ ID NO: 2299055 - RNA, 21 nt, Human
agaauuucuaccauuucagag

SEQ ID NO: 2299056 - RNA, 21 nt, Human
agaauuuauucaauuccucug

SEQ ID NO: 2299057 - RNA, 20 nt, Human
agaauuucuaccauuucaga

SEQ ID NO: 2299058 - RNA, 16 nt, Human
agaauuucuaccauuu

SEQ ID NO: 2299059 - RNA, 23 nt, Human
agaauuucccaaagcagugcaug

SEQ ID NO: 2299060 - RNA, 22 nt, Human
ucugugccccaugccuguccag

SEQ ID NO: 2299061 - RNA, 17 nt, Human
ucugugccugaauauuu

SEQ ID NO: 2299062 - RNA, 15 nt, Human
ucugugccugaauau

SEQ ID NO: 2299063 - RNA, 13 nt, Human
ucuguccaaggaa

SEQ ID NO: 2299064 - RNA, 16 nt, Human
ucugugccuucgucuu

SEQ ID NO: 2299065 - RNA, 22 nt, Human
ucugugccuucuuuugauuaug

SEQ ID NO: 2299066 - RNA, 18 nt, Human
ucugugccuucuuuugau

SEQ ID NO: 2299067 - RNA, 22 nt, Human
ucugugcgugaaacacaccagg

SEQ ID NO: 2299068 - RNA, 16 nt, Human
ucugugcgugaaacac

SEQ ID NO: 2299069 - RNA, 21 nt, Human
ucugugcuagggaaacuuccc

SEQ ID NO: 2299070 - RNA, 22 nt, Human
ucugugcuagggaaacuucccg

SEQ ID NO: 2299071 - RNA, 24 nt, Human
ucuguccaggcacugcugcccagc

SEQ ID NO: 2299072 - RNA, 12 nt, Human
ucuguccaagga

SEQ ID NO: 2299073 - RNA, 15 nt, Human
ucugugaaaggaaag

SEQ ID NO: 2299074 - RNA, 21 nt, Human
ucugugaaaggaaagagggag

SEQ ID NO: 2299075 - RNA, 18 nt, Human
ucuguucauuuccucaaa

SEQ ID NO: 2299076 - RNA, 13 nt, Human
ucuguucccccuu

SEQ ID NO: 2299077 - RNA, 20 nt, Human
ucuguuccccauggccacuu

SEQ ID NO: 2299078 - RNA, 13 nt, Human
ucugugcucagga

SEQ ID NO: 2299079 - RNA, 14 nt, Human
ucugugcuccuccu

SEQ ID NO: 2299080 - RNA, 19 nt, Human
ucugugcugacccuccugu

SEQ ID NO: 2299081 - RNA, 23 nt, Human
ucugugcugacccuccuguugca

SEQ ID NO: 2299082 - RNA, 19 nt, Human
ucugugcuggagauguuuu

SEQ ID NO: 2299083 - RNA, 21 nt, Human
ucugugcuggagauguuuuag

SEQ ID NO: 2299084 - RNA, 17 nt, Human
ucuguucaguguaaaua

SEQ ID NO: 2299085 - RNA, 16 nt, Human
ucuguucaguguaaau

SEQ ID NO: 2299086 - RNA, 15 nt, Human
ucuguuccuucacau

SEQ ID NO: 2299087 - RNA, 20 nt, Human
ucuguucuacauagaugcuu

SEQ ID NO: 2299088 - RNA, 13 nt, Human
ucuguuccuucac

SEQ ID NO: 2299089 - RNA, 20 nt, Human
ucuguucccccuucacaaag

SEQ ID NO: 2299090 - RNA, 18 nt, Human
ucuguucccccuucacaa

SEQ ID NO: 2299091 - RNA, 18 nt, Human
ucuguuggccagugugac

SEQ ID NO: 2299092 - RNA, 19 nt, Human
ucuguuggccagugugaca

SEQ ID NO: 2299093 - RNA, 20 nt, Human
ucuguuggccagugugacaa

SEQ ID NO: 2299094 - RNA, 16 nt, Human
ucuuaauauuaaauau

SEQ ID NO: 2299095 - RNA, 14 nt, Human
ucuuaauuaaaaga

SEQ ID NO: 2299096 - RNA, 21 nt, Human
ucuuaauuaaaagaauauuuu

SEQ ID NO: 2299097 - RNA, 18 nt, Human
ucuuaauuaaaagaauau

SEQ ID NO: 2299098 - RNA, 23 nt, Human
ucuuagacuugaaauacuacuua

SEQ ID NO: 2299099 - RNA, 18 nt, Human
ucuuagacuugaaauacu

SEQ ID NO: 2299100 - RNA, 18 nt, Human
ucuuagacuucugcuuuc

SEQ ID NO: 2299101 - RNA, 20 nt, Human
ucuuagacuucugcuuucca

SEQ ID NO: 2299102 - RNA, 21 nt, Human
ucuuagaaguggaccaggaca

SEQ ID NO: 2299103 - RNA, 14 nt, Human
ucuuagacuacauu

SEQ ID NO: 2299104 - RNA, 20 nt, Human
ucuuagacuacauuuagaga

SEQ ID NO: 2299105 - RNA, 15 nt, Human
ucuuagacuucugcu

SEQ ID NO: 2299106 - RNA, 19 nt, Human
ucuuagaaguggaccagga

SEQ ID NO: 2299107 - RNA, 15 nt, Human
ucuuagaaaugaagg

SEQ ID NO: 2299108 - RNA, 12 nt, Human
ucuuagaaauuu

SEQ ID NO: 2299109 - RNA, 15 nt, Human
ucuuagaaauuuauu

SEQ ID NO: 2299110 - RNA, 17 nt, Human
ucuuaaucuuuucacaa

SEQ ID NO: 2299111 - RNA, 18 nt, Human
ucuuaaucuuuucacaaa

SEQ ID NO: 2299112 - RNA, 11 nt, Human
ucuuagaaauu

SEQ ID NO: 2299113 - RNA, 20 nt, Human
ucuuaauuauuauuuguguu

SEQ ID NO: 2299114 - RNA, 14 nt, Human
ucuuagaaaugaag

SEQ ID NO: 2299115 - RNA, 12 nt, Human
ucuuaauuauua

SEQ ID NO: 2299116 - RNA, 18 nt, Human
ucuuaugggcuggguucu

SEQ ID NO: 2299117 - RNA, 14 nt, Human
ucuuauugcccacg

SEQ ID NO: 2299118 - RNA, 18 nt, Human
ucuuauugcccacgcugg

SEQ ID NO: 2299119 - RNA, 22 nt, Human
ucuuauugcccacgcuggagug

SEQ ID NO: 2299120 - RNA, 15 nt, Human
ucuuaugggcugggu

SEQ ID NO: 2299121 - RNA, 16 nt, Human
ucuuaugggcuggguu

SEQ ID NO: 2299122 - RNA, 14 nt, Human
ucuuaugggcuggg

SEQ ID NO: 2299123 - RNA, 22 nt, Human
ucuuagaugcaguucugaagaa

SEQ ID NO: 2299124 - RNA, 14 nt, Human
ucuuauuuaacuua

SEQ ID NO: 2299125 - RNA, 17 nt, Human
ucuucaaaaugagcccu

SEQ ID NO: 2299126 - RNA, 20 nt, Human
ucuucaaauuagaagacauu

SEQ ID NO: 2299127 - RNA, 19 nt, Human
ucuucaaauuagaagacau

SEQ ID NO: 2299128 - RNA, 20 nt, Human
ucuucaacaucaauguucau

SEQ ID NO: 2299129 - RNA, 19 nt, Human
ucuucaacaucaauguuca

SEQ ID NO: 2299130 - RNA, 11 nt, Human
ucuucaacaga

SEQ ID NO: 2299131 - RNA, 18 nt, Human
ucuucaacaggagaauuu

SEQ ID NO: 2299132 - RNA, 16 nt, Human
ucuucaaauuagaaga

SEQ ID NO: 2299133 - RNA, 18 nt, Human
ucuucacagcucuguguu

SEQ ID NO: 2299134 - RNA, 23 nt, Human
ucuucaacaucaauguucauugu

SEQ ID NO: 2299135 - RNA, 21 nt, Human
ucuucaacaucaauguucauu

SEQ ID NO: 2299136 - RNA, 24 nt, Human
ucuucaacaucaauguucauugua

SEQ ID NO: 2299137 - RNA, 17 nt, Human
ucuucaccauuuggcaa

SEQ ID NO: 2299138 - RNA, 19 nt, Human
ucuucacccagcuaaucug

SEQ ID NO: 2299139 - RNA, 20 nt, Human
ucuucacccagcuaaucugu

SEQ ID NO: 2299140 - RNA, 14 nt, Human
ucuucacucgcccc

SEQ ID NO: 2299141 - RNA, 20 nt, Human
ucuucagaaagugugcuuua

SEQ ID NO: 2299142 - RNA, 18 nt, Human
ucuucacucucugaagau

SEQ ID NO: 2299143 - RNA, 18 nt, Human
ucuucagaagacacugca

SEQ ID NO: 2299144 - RNA, 13 nt, Human
ucuucagaagaca

SEQ ID NO: 2299145 - RNA, 23 nt, Human
ucuucagaaagugugcuuuaugc

SEQ ID NO: 2299146 - RNA, 21 nt, Human
ucuucaccugauucaacuaaa

SEQ ID NO: 2299147 - RNA, 14 nt, Human
ucuucacggcagga

SEQ ID NO: 2299148 - RNA, 23 nt, Human
ucuucaccugauucaacuaaaaa

SEQ ID NO: 2299149 - RNA, 16 nt, Human
ucuuccauaauguaua

SEQ ID NO: 2299150 - RNA, 19 nt, Human
ucuuccauaugaccucaug

SEQ ID NO: 2299151 - RNA, 12 nt, Human
ucuuccauaaug

SEQ ID NO: 2299152 - RNA, 13 nt, Human
ucuuccaucaugg

SEQ ID NO: 2299153 - RNA, 18 nt, Human
ucuuccaucauggauuca

SEQ ID NO: 2299154 - RNA, 16 nt, Human
ucuuccaucauguccc

SEQ ID NO: 2299155 - RNA, 19 nt, Human
ucuuccagguggggugagg

SEQ ID NO: 2299156 - RNA, 21 nt, Human
ucuuccagucuuccugacacu

SEQ ID NO: 2299157 - RNA, 18 nt, Human
ucuuccagucuuccugac

SEQ ID NO: 2299158 - RNA, 22 nt, Human
ucuuccaggcugggagagccuu

SEQ ID NO: 2299159 - RNA, 18 nt, Human
ucuuccaggugcccagcu

SEQ ID NO: 2299160 - RNA, 13 nt, Human
ucuuccagguggg

SEQ ID NO: 2299161 - RNA, 15 nt, Human
ucuuccaggugccca

SEQ ID NO: 2299162 - RNA, 16 nt, Human
ucuuccggagauguag

SEQ ID NO: 2299163 - RNA, 15 nt, Human
ucuuccggagaugua

SEQ ID NO: 2299164 - RNA, 21 nt, Human
ucuuccgaaaaauccucuucc

SEQ ID NO: 2299165 - RNA, 22 nt, Human
ucuucccuuuuacauacugcug

SEQ ID NO: 2299166 - RNA, 21 nt, Human
ucuucccuuuuacauacugcu

SEQ ID NO: 2299167 - RNA, 19 nt, Human
ucuucccuuuuacauacug

SEQ ID NO: 2299168 - RNA, 21 nt, Human
ucuucccuaccucaggcagga

SEQ ID NO: 2299169 - RNA, 14 nt, Human
ucuucccuaccuca

SEQ ID NO: 2299170 - RNA, 13 nt, Human
ucuucccuaccuc

SEQ ID NO: 2299171 - RNA, 15 nt, Human
ucuuccaucccagga

SEQ ID NO: 2299172 - RNA, 20 nt, Human
ucuucccuagaggguuccug

SEQ ID NO: 2299173 - RNA, 19 nt, Human
ucuuccaucauguccccaa

SEQ ID NO: 2299174 - RNA, 10 nt, Human
ucuucccucc

SEQ ID NO: 2299175 - RNA, 21 nt, Human
agacacugaaauauacacaca

SEQ ID NO: 2299176 - RNA, 20 nt, Human
agacacugaaauauacacac

SEQ ID NO: 2299177 - RNA, 22 nt, Human
agacacugaaauauacacacag

SEQ ID NO: 2299178 - RNA, 22 nt, Human
agacagaaucucgcucugucgc

SEQ ID NO: 2299179 - RNA, 18 nt, Human
agacagaaucucgcucug

SEQ ID NO: 2299180 - RNA, 13 nt, Human
agacacugaaaua

SEQ ID NO: 2299181 - RNA, 18 nt, Human
agacacugaaaaaucuaa

SEQ ID NO: 2299182 - RNA, 17 nt, Human
agacacucugcucugcc

SEQ ID NO: 2299183 - RNA, 18 nt, Human
agacacucugcucugccc

SEQ ID NO: 2299184 - RNA, 13 nt, Human
agacacucuggcu

SEQ ID NO: 2299185 - RNA, 16 nt, Human
agacacucuggcuggu

SEQ ID NO: 2299186 - RNA, 23 nt, Human
agacacuccccgaagucuuuugu

SEQ ID NO: 2299187 - RNA, 22 nt, Human
agacacuccccgaagucuuuug

SEQ ID NO: 2299188 - RNA, 12 nt, Human
agacacucugcu

SEQ ID NO: 2299189 - RNA, 14 nt, Human
agacacucugcucu

SEQ ID NO: 2299190 - RNA, 15 nt, Human
agacacucugcucug

SEQ ID NO: 2299191 - RNA, 16 nt, Human
agacacucugcucugc

SEQ ID NO: 2299192 - RNA, 22 nt, Human
agacagcuucucauccugcagg

SEQ ID NO: 2299193 - RNA, 23 nt, Human
agacagcuucucauccugcaggc

SEQ ID NO: 2299194 - RNA, 21 nt, Human
agacaggaaaauccucuggcu

SEQ ID NO: 2299195 - RNA, 20 nt, Human
agacaggaaaauccucuggc

SEQ ID NO: 2299196 - RNA, 19 nt, Human
agacaggaaaauccucugg

SEQ ID NO: 2299197 - RNA, 18 nt, Human
agacaggaaaauccucug

SEQ ID NO: 2299198 - RNA, 22 nt, Human
agacagagacccucugccacca

SEQ ID NO: 2299199 - RNA, 14 nt, Human
agacagacacacac

SEQ ID NO: 2299200 - RNA, 15 nt, Human
agacagacacacaca

SEQ ID NO: 2299201 - RNA, 16 nt, Human
agacagacacacacac

SEQ ID NO: 2299202 - RNA, 12 nt, Human
agacagaaucuc

SEQ ID NO: 2299203 - RNA, 19 nt, Human
agacagagacccucugcca

SEQ ID NO: 2299204 - RNA, 21 nt, Human
agacaccaucuuuugugagau

SEQ ID NO: 2299205 - RNA, 19 nt, Human
agacacccucaaccucuuc

SEQ ID NO: 2299206 - RNA, 16 nt, Human
agacacccaggacuua

SEQ ID NO: 2299207 - RNA, 15 nt, Human
agacacccaggacuu

SEQ ID NO: 2299208 - RNA, 14 nt, Human
agacacccaggacu

SEQ ID NO: 2299209 - RNA, 13 nt, Human
agacacccaggac

SEQ ID NO: 2299210 - RNA, 12 nt, Human
agacacccagga

SEQ ID NO: 2299211 - RNA, 20 nt, Human
agacaccagagcagaugcag

SEQ ID NO: 2299212 - RNA, 22 nt, Human
agacacuaacgacuucagggca

SEQ ID NO: 2299213 - RNA, 15 nt, Human
agacacuaaguuaua

SEQ ID NO: 2299214 - RNA, 20 nt, Human
agacacuccccgaagucuuu

SEQ ID NO: 2299215 - RNA, 15 nt, Human
agacacggaucugag

SEQ ID NO: 2299216 - RNA, 18 nt, Human
agacacggaucugagaau

SEQ ID NO: 2299217 - RNA, 20 nt, Human
agacacggaucugagaaucu

SEQ ID NO: 2299218 - RNA, 21 nt, Human
agacacggaucugagaaucuu

SEQ ID NO: 2299219 - RNA, 22 nt, Human
agacaccgccacauggcuuccu

SEQ ID NO: 2299220 - RNA, 21 nt, Human
agacacccucaaccucuucug

SEQ ID NO: 2299221 - RNA, 17 nt, Human
agaauuugagugcucug

SEQ ID NO: 2299222 - RNA, 18 nt, Human
agaauuugagugcucuga

SEQ ID NO: 2299223 - RNA, 13 nt, Human
agacaccagagca

SEQ ID NO: 2299224 - RNA, 15 nt, Human
agacaccagagcaga

SEQ ID NO: 2299225 - RNA, 19 nt, Human
agacaggguuucaccaugu

SEQ ID NO: 2299226 - RNA, 23 nt, Human
agacaggcccaagagaugaagag

SEQ ID NO: 2299227 - RNA, 20 nt, Human
agacaggcucuuagcagcuu

SEQ ID NO: 2299228 - RNA, 22 nt, Human
agacaggcccaagagaugaaga

SEQ ID NO: 2299229 - RNA, 18 nt, Human
agacaggcccaagagaug

SEQ ID NO: 2299230 - RNA, 15 nt, Human
agacaggcucuuagc

SEQ ID NO: 2299231 - RNA, 21 nt, Human
agacaggguuuugccauguug

SEQ ID NO: 2299232 - RNA, 23 nt, Human
agacaggguuucaccauguugcc

SEQ ID NO: 2299233 - RNA, 16 nt, Human
agacaggguuuggcug

SEQ ID NO: 2299234 - RNA, 23 nt, Human
agacaggguuuggcugugucuaa

SEQ ID NO: 2299235 - RNA, 21 nt, Human
agacaggguuuggcugugucu

SEQ ID NO: 2299236 - RNA, 22 nt, Human
agacaggguuuggcugugucua

SEQ ID NO: 2299237 - RNA, 23 nt, Human
agacaggcaagcaccuccugccu

SEQ ID NO: 2299238 - RNA, 21 nt, Human
agacaggacagugcuucagcc

SEQ ID NO: 2299239 - RNA, 18 nt, Human
agacaggaaagggaaggc

SEQ ID NO: 2299240 - RNA, 16 nt, Human
agacaggcccaagaga

SEQ ID NO: 2299241 - RNA, 15 nt, Human
agacaggcccaagag

SEQ ID NO: 2299242 - RNA, 14 nt, Human
agacaggaaaggga

SEQ ID NO: 2299243 - RNA, 15 nt, Human
agacaggaccaggga

SEQ ID NO: 2299244 - RNA, 18 nt, Human
ucuuaauauaacugccuu

SEQ ID NO: 2299245 - RNA, 19 nt, Human
ucuuaauauaacugccuua

SEQ ID NO: 2299246 - RNA, 15 nt, Human
ucuuaauauaacugc

SEQ ID NO: 2299247 - RNA, 18 nt, Human
ucuuaaguuucucagcuc

SEQ ID NO: 2299248 - RNA, 23 nt, Human
ucuuaaggauugugauauuuuua

SEQ ID NO: 2299249 - RNA, 18 nt, Human
agacaguauauuuauagu

SEQ ID NO: 2299250 - RNA, 17 nt, Human
agacaguauauuuauag

SEQ ID NO: 2299251 - RNA, 16 nt, Human
ucuuaaggggcagcuu

SEQ ID NO: 2299252 - RNA, 15 nt, Human
ucuuaaguuucucag

SEQ ID NO: 2299253 - RNA, 17 nt, Human
ucuuaaguuucucagcu

SEQ ID NO: 2299254 - RNA, 12 nt, Human
agacaguaugag

SEQ ID NO: 2299255 - RNA, 14 nt, Human
agacaguauacagu

SEQ ID NO: 2299256 - RNA, 15 nt, Human
agacaguauauuuau

SEQ ID NO: 2299257 - RNA, 17 nt, Human
agacaguauacaguccu

SEQ ID NO: 2299258 - RNA, 21 nt, Human
agacaguauacaguccugugg

SEQ ID NO: 2299259 - RNA, 15 nt, Human
agacagucccugcca

SEQ ID NO: 2299260 - RNA, 16 nt, Human
agacagucccugccaa

SEQ ID NO: 2299261 - RNA, 17 nt, Human
agacagucccugccaau

SEQ ID NO: 2299262 - RNA, 14 nt, Human
agacuuaucaacau

SEQ ID NO: 2299263 - RNA, 11 nt, Human
agacuguuggg

SEQ ID NO: 2299264 - RNA, 23 nt, Human
agacuguugggguggguauaaaa

SEQ ID NO: 2299265 - RNA, 17 nt, Human
agacuguuaaaugaaac

SEQ ID NO: 2299266 - RNA, 18 nt, Human
agacuguuaaaugaaacc

SEQ ID NO: 2299267 - RNA, 14 nt, Human
agacuguugcucaa

SEQ ID NO: 2299268 - RNA, 15 nt, Human
agacuguugcucaaa

SEQ ID NO: 2299269 - RNA, 20 nt, Human
agacuguggcugcuagcacu

SEQ ID NO: 2299270 - RNA, 14 nt, Human
agacuguggcugcu

SEQ ID NO: 2299271 - RNA, 11 nt, Human
agacuguggcu

SEQ ID NO: 2299272 - RNA, 11 nt, Human
agacuguguau

SEQ ID NO: 2299273 - RNA, 18 nt, Human
agacuggcacaguuuucu

SEQ ID NO: 2299274 - RNA, 14 nt, Human
agacugucucaaga

SEQ ID NO: 2299275 - RNA, 15 nt, Human
agacuggcacaguuu

SEQ ID NO: 2299276 - RNA, 14 nt, Human
agacuggcacaguu

SEQ ID NO: 2299277 - RNA, 15 nt, Human
agacuucacacugca

SEQ ID NO: 2299278 - RNA, 21 nt, Human
agacuucacacugcaagagcc

SEQ ID NO: 2299279 - RNA, 23 nt, Human
agacuguugcucaaaucuauuca

SEQ ID NO: 2299280 - RNA, 14 nt, Human
agacuucaucccuc

SEQ ID NO: 2299281 - RNA, 18 nt, Human
agacuucugcuuuccaca

SEQ ID NO: 2299282 - RNA, 22 nt, Human
agacuucaguauguugucaaag

SEQ ID NO: 2299283 - RNA, 12 nt, Human
agacuucugcuu

SEQ ID NO: 2299284 - RNA, 13 nt, Human
agacuucaguaug

SEQ ID NO: 2299285 - RNA, 19 nt, Human
agacuucaguauguuguca

SEQ ID NO: 2299286 - RNA, 21 nt, Human
agacuucaguauguugucaaa

SEQ ID NO: 2299287 - RNA, 17 nt, Human
agacuucaucccucugg

SEQ ID NO: 2299288 - RNA, 13 nt, Human
agacuugcucucu

SEQ ID NO: 2299289 - RNA, 19 nt, Human
agacuuggcaacagaagca

SEQ ID NO: 2299290 - RNA, 15 nt, Human
agacuugggacauug

SEQ ID NO: 2299291 - RNA, 17 nt, Human
agacuuggcaacagaag

SEQ ID NO: 2299292 - RNA, 18 nt, Human
agacuuggcaacagaagc

SEQ ID NO: 2299293 - RNA, 14 nt, Human
agacuugaaauacu

SEQ ID NO: 2299294 - RNA, 18 nt, Human
agagaaugaaagggccca

SEQ ID NO: 2299295 - RNA, 14 nt, Human
agacuuuggaaaga

SEQ ID NO: 2299296 - RNA, 23 nt, Human
agacuuuggaaaaugcauuguau

SEQ ID NO: 2299297 - RNA, 22 nt, Human
agacuuuggaaaaugcauugua

SEQ ID NO: 2299298 - RNA, 21 nt, Human
agacuuuggaaaaugcauugu

SEQ ID NO: 2299299 - RNA, 14 nt, Human
agacuuuggaaaau

SEQ ID NO: 2299300 - RNA, 12 nt, Human
agacuuuggaaa

SEQ ID NO: 2299301 - RNA, 15 nt, Human
agagaauggaaaaca

SEQ ID NO: 2299302 - RNA, 23 nt, Human
agagaaucccuagucuucaagca

SEQ ID NO: 2299303 - RNA, 17 nt, Human
agagacacacugaagaa

SEQ ID NO: 2299304 - RNA, 22 nt, Human
agagaaugaaauugcugaaaga

SEQ ID NO: 2299305 - RNA, 15 nt, Human
agagaaucauacuua

SEQ ID NO: 2299306 - RNA, 20 nt, Human
agagaaucaacauuucucaa

SEQ ID NO: 2299307 - RNA, 15 nt, Human
agagaaugagagaca

SEQ ID NO: 2299308 - RNA, 15 nt, Human
agagaccaucccuga

SEQ ID NO: 2299309 - RNA, 19 nt, Human
agagaccaggcaaagcaag

SEQ ID NO: 2299310 - RNA, 20 nt, Human
ucuuugggccagacaugcca

SEQ ID NO: 2299311 - RNA, 21 nt, Human
ucuuuggggucagccagggcc

SEQ ID NO: 2299312 - RNA, 18 nt, Human
ucuuuggggucagccagg

SEQ ID NO: 2299313 - RNA, 19 nt, Human
ucuuuggguaccuauuuuc

SEQ ID NO: 2299314 - RNA, 20 nt, Human
ucuuuggguaccuauuuuca

SEQ ID NO: 2299315 - RNA, 16 nt, Human
ucuuugggccagacau

SEQ ID NO: 2299316 - RNA, 15 nt, Human
ucuuugggccagaca

SEQ ID NO: 2299317 - RNA, 14 nt, Human
ucuuugggaauguu

SEQ ID NO: 2299318 - RNA, 18 nt, Human
ucuuugggaauguuuguc

SEQ ID NO: 2299319 - RNA, 13 nt, Human
agagaccaucccu

SEQ ID NO: 2299320 - RNA, 14 nt, Human
agagaccaucccug

SEQ ID NO: 2299321 - RNA, 18 nt, Human
agagacacacugaagaag

SEQ ID NO: 2299322 - RNA, 20 nt, Human
agagacacacugaagaagca

SEQ ID NO: 2299323 - RNA, 19 nt, Human
agacucuacagaggccaug

SEQ ID NO: 2299324 - RNA, 17 nt, Human
agacucuacagaggcca

SEQ ID NO: 2299325 - RNA, 21 nt, Human
agacucgcgacaaugcaaacc

SEQ ID NO: 2299326 - RNA, 18 nt, Human
agacuccugcaggcagcc

SEQ ID NO: 2299327 - RNA, 19 nt, Human
agacuccugcaggcagcca

SEQ ID NO: 2299328 - RNA, 20 nt, Human
agacuccugcaggcagccag

SEQ ID NO: 2299329 - RNA, 23 nt, Human
agacuccugcaggcagccaggcc

SEQ ID NO: 2299330 - RNA, 13 nt, Human
ucuuuccugaggc

SEQ ID NO: 2299331 - RNA, 14 nt, Human
ucuuuccugaggcu

SEQ ID NO: 2299332 - RNA, 15 nt, Human
ucuuuccugaggcug

SEQ ID NO: 2299333 - RNA, 16 nt, Human
ucuuuccugaggcugg

SEQ ID NO: 2299334 - RNA, 23 nt, Human
ucuuuaggauugugaugguucgu

SEQ ID NO: 2299335 - RNA, 14 nt, Human
agacuccugcaggc

SEQ ID NO: 2299336 - RNA, 15 nt, Human
agacuccugcaggca

SEQ ID NO: 2299337 - RNA, 16 nt, Human
agacuccugcaggcag

SEQ ID NO: 2299338 - RNA, 17 nt, Human
agacuccugcaggcagc

SEQ ID NO: 2299339 - RNA, 18 nt, Human
ucuuuaaagucaggucca

SEQ ID NO: 2299340 - RNA, 21 nt, Human
ucuuuaaagggauggcaagau

SEQ ID NO: 2299341 - RNA, 21 nt, Human
ucuuuaaaauuuaaguaucuu

SEQ ID NO: 2299342 - RNA, 17 nt, Human
ucuuuaaaauacacacu

SEQ ID NO: 2299343 - RNA, 21 nt, Human
ucuuggagcugagccucucac

SEQ ID NO: 2299344 - RNA, 14 nt, Human
ucuuggagucuucc

SEQ ID NO: 2299345 - RNA, 21 nt, Human
ucuuggcacauuuaagagaca

SEQ ID NO: 2299346 - RNA, 22 nt, Human
ucuuggcacauuuaagagacag

SEQ ID NO: 2299347 - RNA, 19 nt, Human
ucuuggagccugcagagcu

SEQ ID NO: 2299348 - RNA, 16 nt, Human
ucuuggagcugagccu

SEQ ID NO: 2299349 - RNA, 18 nt, Human
ucuuggagccugcagagc

SEQ ID NO: 2299350 - RNA, 15 nt, Human
ucuuggagccugcag

SEQ ID NO: 2299351 - RNA, 15 nt, Human
ucuuuacuucaugga

SEQ ID NO: 2299352 - RNA, 13 nt, Human
ucuuuaccugaga

SEQ ID NO: 2299353 - RNA, 12 nt, Human
ucuuuacuuuua

SEQ ID NO: 2299354 - RNA, 18 nt, Human
ucuuuaccugagaccagu

SEQ ID NO: 2299355 - RNA, 16 nt, Human
ucuuuaccugagacca

SEQ ID NO: 2299356 - RNA, 12 nt, Human
ucuuuagaguua

SEQ ID NO: 2299357 - RNA, 13 nt, Human
ucuuuagagcauu

SEQ ID NO: 2299358 - RNA, 14 nt, Human
ucuuuagagcauug

SEQ ID NO: 2299359 - RNA, 19 nt, Human
ucuuuagaguuagacuguu

SEQ ID NO: 2299360 - RNA, 19 nt, Human
ucuuuagagcauugccauu

SEQ ID NO: 2299361 - RNA, 17 nt, Human
ucuuuaggauugugaug

SEQ ID NO: 2299362 - RNA, 14 nt, Human
ucuuuagaguuaga

SEQ ID NO: 2299363 - RNA, 16 nt, Human
ucuuuagaguuagacu

SEQ ID NO: 2299364 - RNA, 17 nt, Human
ucuuuagaguuagacug

SEQ ID NO: 2299365 - RNA, 18 nt, Human
ucuuuagaguuagacugu

SEQ ID NO: 2299366 - RNA, 23 nt, Human
agaccugauccuggaggcccagu

SEQ ID NO: 2299367 - RNA, 14 nt, Human
ucuugaucugcuca

SEQ ID NO: 2299368 - RNA, 17 nt, Human
ucuugaucugcucagcc

SEQ ID NO: 2299369 - RNA, 19 nt, Human
ucuugaucugcucagcccu

SEQ ID NO: 2299370 - RNA, 20 nt, Human
ucuugaucugcucagcccug

SEQ ID NO: 2299371 - RNA, 21 nt, Human
ucuugaucugcucagcccugg

SEQ ID NO: 2299372 - RNA, 22 nt, Human
ucuugaucugcucagcccugga

SEQ ID NO: 2299373 - RNA, 19 nt, Human
agacuccaaagaaauguaa

SEQ ID NO: 2299374 - RNA, 16 nt, Human
agacuccaaagaaaug

SEQ ID NO: 2299375 - RNA, 12 nt, Human
ucuugaugacca

SEQ ID NO: 2299376 - RNA, 23 nt, Human
ucuugaucugcucagcccuggag

SEQ ID NO: 2299377 - RNA, 15 nt, Human
ucuugaucuguucug

SEQ ID NO: 2299378 - RNA, 14 nt, Human
ucuugaugccuggc

SEQ ID NO: 2299379 - RNA, 21 nt, Human
ucuugaugcaugcacuguucc

SEQ ID NO: 2299380 - RNA, 13 nt, Human
ucuugaugcaugc

SEQ ID NO: 2299381 - RNA, 20 nt, Human
ucuugaugccuggcggggug

SEQ ID NO: 2299382 - RNA, 16 nt, Human
ucuuggaaagaaacaa

SEQ ID NO: 2299383 - RNA, 16 nt, Human
ucuuggaaaaagugau

SEQ ID NO: 2299384 - RNA, 15 nt, Human
ucuuggaaaaaguga

SEQ ID NO: 2299385 - RNA, 17 nt, Human
ucuugcaauggcagccu

SEQ ID NO: 2299386 - RNA, 13 nt, Human
ucuugcaauggca

SEQ ID NO: 2299387 - RNA, 16 nt, Human
ucuugcaauggcagcc

SEQ ID NO: 2299388 - RNA, 12 nt, Human
ucuuggagccug

SEQ ID NO: 2299389 - RNA, 23 nt, Human
ucuuggaccucugcucugaggcu

SEQ ID NO: 2299390 - RNA, 14 nt, Human
ucuuggagccugca

SEQ ID NO: 2299391 - RNA, 13 nt, Human
ucuuggagccugc

SEQ ID NO: 2299392 - RNA, 16 nt, Human
ucuuggacacuguaca

SEQ ID NO: 2299393 - RNA, 17 nt, Human
ucuuggacacuguacaa

SEQ ID NO: 2299394 - RNA, 14 nt, Human
ucuuggaccucugc

SEQ ID NO: 2299395 - RNA, 16 nt, Human
ucuuggaccucugcuc

SEQ ID NO: 2299396 - RNA, 18 nt, Human
ucuuggaccucugcucug

SEQ ID NO: 2299397 - RNA, 21 nt, Human
ucuuggaccucugcucugagg

SEQ ID NO: 2299398 - RNA, 19 nt, Human
agaccugacaccuuucaua

SEQ ID NO: 2299399 - RNA, 19 nt, Human
agaccugacaagcacugcu

SEQ ID NO: 2299400 - RNA, 17 nt, Human
agaccugacaagcacug

SEQ ID NO: 2299401 - RNA, 16 nt, Human
agaccugagcucccca

SEQ ID NO: 2299402 - RNA, 14 nt, Human
agaccugauccugg

SEQ ID NO: 2299403 - RNA, 16 nt, Human
agaccugauccuggag

SEQ ID NO: 2299404 - RNA, 15 nt, Human
agaccugauccugga

SEQ ID NO: 2299405 - RNA, 15 nt, Human
agacuaucuaaaugu

SEQ ID NO: 2299406 - RNA, 22 nt, Human
agaccugauccuggaggcccag

SEQ ID NO: 2299407 - RNA, 21 nt, Human
agaccugauccuggaggccca

SEQ ID NO: 2299408 - RNA, 19 nt, Human
agaccugauccuggaggcc

SEQ ID NO: 2299409 - RNA, 18 nt, Human
agaccugauccuggaggc

SEQ ID NO: 2299410 - RNA, 18 nt, Human
agacuaucuaaauguuga

SEQ ID NO: 2299411 - RNA, 17 nt, Human
agacuaucuaaauguug

SEQ ID NO: 2299412 - RNA, 19 nt, Human
agacuaucuaaauguugaa

SEQ ID NO: 2299413 - RNA, 12 nt, Human
agaccugccccu

SEQ ID NO: 2299414 - RNA, 17 nt, Human
agacucauucuucugua

SEQ ID NO: 2299415 - RNA, 21 nt, Human
agacuauucaaacagucucag

SEQ ID NO: 2299416 - RNA, 20 nt, Human
agacuauucaaacagucuca

SEQ ID NO: 2299417 - RNA, 18 nt, Human
agacuauucaaacagucu

SEQ ID NO: 2299418 - RNA, 18 nt, Human
agacucauucuucuguac

SEQ ID NO: 2299419 - RNA, 12 nt, Human
agacuccaaaga

SEQ ID NO: 2299420 - RNA, 14 nt, Human
agacuccaaagaaa

SEQ ID NO: 2299421 - RNA, 13 nt, Human
agacuccaaagaa

SEQ ID NO: 2299422 - RNA, 19 nt, Human
agaccuaacgagaaauaga

SEQ ID NO: 2299423 - RNA, 15 nt, Human
agaccuaaugcuccu

SEQ ID NO: 2299424 - RNA, 18 nt, Human
agaccuaaugcuccuugu

SEQ ID NO: 2299425 - RNA, 14 nt, Human
agaccuaccucagg

SEQ ID NO: 2299426 - RNA, 15 nt, Human
agaccuaccucaggu

SEQ ID NO: 2299427 - RNA, 16 nt, Human
agaccuaccucagguu

SEQ ID NO: 2299428 - RNA, 19 nt, Human
agaccuaccucagguugcu

SEQ ID NO: 2299429 - RNA, 23 nt, Human
agaccuaccucagguugcugguu

SEQ ID NO: 2299430 - RNA, 19 nt, Human
agacccuuguggucccacc

SEQ ID NO: 2299431 - RNA, 20 nt, Human
agacccuuguggucccaccc

SEQ ID NO: 2299432 - RNA, 22 nt, Human
agacccuuguggucccacccca

SEQ ID NO: 2299433 - RNA, 23 nt, Human
agacccuuguggucccaccccac

SEQ ID NO: 2299434 - RNA, 13 nt, Human
agacccugucucu

SEQ ID NO: 2299435 - RNA, 22 nt, Human
agacccugggugggcucugugc

SEQ ID NO: 2299436 - RNA, 17 nt, Human
agacccuuauuacacgg

SEQ ID NO: 2299437 - RNA, 18 nt, Human
agacccuugacaccugcu

SEQ ID NO: 2299438 - RNA, 20 nt, Human
agacccucugccaccagaga

SEQ ID NO: 2299439 - RNA, 21 nt, Human
agacccucugccaccagagac

SEQ ID NO: 2299440 - RNA, 17 nt, Human
agacccugggugggcuc

SEQ ID NO: 2299441 - RNA, 19 nt, Human
agacccugggugggcucug

SEQ ID NO: 2299442 - RNA, 20 nt, Human
agacccugggugggcucugu

SEQ ID NO: 2299443 - RNA, 13 nt, Human
agacccuuguggu

SEQ ID NO: 2299444 - RNA, 15 nt, Human
agacccuuguggucc

SEQ ID NO: 2299445 - RNA, 16 nt, Human
agacccugcccugugg

SEQ ID NO: 2299446 - RNA, 19 nt, Human
agacccugcccugugggcc

SEQ ID NO: 2299447 - RNA, 21 nt, Human
agacccugcccugugggcccc

SEQ ID NO: 2299448 - RNA, 23 nt, Human
agacccugcccugugggccccca

SEQ ID NO: 2299449 - RNA, 14 nt, Human
agacccucguggcc

SEQ ID NO: 2299450 - RNA, 15 nt, Human
agacccucugccacc

SEQ ID NO: 2299451 - RNA, 16 nt, Human
agacccucugccacca

SEQ ID NO: 2299452 - RNA, 17 nt, Human
agacccucugccaccag

SEQ ID NO: 2299453 - RNA, 12 nt, Human
agacccugcccu

SEQ ID NO: 2299454 - RNA, 13 nt, Human
agacccugcccug

SEQ ID NO: 2299455 - RNA, 14 nt, Human
agacccugcccugu

SEQ ID NO: 2299456 - RNA, 19 nt, Human
agacauguuuuagacaaau

SEQ ID NO: 2299457 - RNA, 23 nt, Human
agacauguuuuagacaaauacuc

SEQ ID NO: 2299458 - RNA, 22 nt, Human
agacauguagguguuuguucau

SEQ ID NO: 2299459 - RNA, 15 nt, Human
agacauguuuuagac

SEQ ID NO: 2299460 - RNA, 17 nt, Human
agacauguuuuagacaa

SEQ ID NO: 2299461 - RNA, 12 nt, Human
agacccucucaa

SEQ ID NO: 2299462 - RNA, 19 nt, Human
ucuuccggagauguagcaa

SEQ ID NO: 2299463 - RNA, 18 nt, Human
ucuuccggagauguagca

SEQ ID NO: 2299464 - RNA, 21 nt, Human
ucuuccggagauguagcaaaa

SEQ ID NO: 2299465 - RNA, 19 nt, Human
ucuuccuaguuuucuccuc

SEQ ID NO: 2299466 - RNA, 23 nt, Human
ucuuccuaguuuucuccucccag

SEQ ID NO: 2299467 - RNA, 21 nt, Human
ucuuccuaguuuucuccuccc

SEQ ID NO: 2299468 - RNA, 21 nt, Human
ucuuccuauuugccaugggcu

SEQ ID NO: 2299469 - RNA, 17 nt, Human
agacauguggugggaca

SEQ ID NO: 2299470 - RNA, 17 nt, Human
agacaugugacauuuau

SEQ ID NO: 2299471 - RNA, 15 nt, Human
agacaugugacauuu

SEQ ID NO: 2299472 - RNA, 16 nt, Human
agacaugugacauuua

SEQ ID NO: 2299473 - RNA, 20 nt, Human
agacaugucuguucuacaua

SEQ ID NO: 2299474 - RNA, 12 nt, Human
agacaugugaca

SEQ ID NO: 2299475 - RNA, 13 nt, Human
agacaugugacau

SEQ ID NO: 2299476 - RNA, 14 nt, Human
agacaugugacauu

SEQ ID NO: 2299477 - RNA, 19 nt, Human
agacauggggaggaaggac

SEQ ID NO: 2299478 - RNA, 18 nt, Human
agacauggggaggaagga

SEQ ID NO: 2299479 - RNA, 16 nt, Human
agacauggggaggaag

SEQ ID NO: 2299480 - RNA, 18 nt, Human
agacaugucuguucuaca

SEQ ID NO: 2299481 - RNA, 16 nt, Human
agacauguagguguuu

SEQ ID NO: 2299482 - RNA, 19 nt, Human
agacauguagguguuuguu

SEQ ID NO: 2299483 - RNA, 21 nt, Human
agcagagaaugaaagggccca

SEQ ID NO: 2299484 - RNA, 13 nt, Human
agcagacauuguc

SEQ ID NO: 2299485 - RNA, 17 nt, Human
agcagacauugucagca

SEQ ID NO: 2299486 - RNA, 22 nt, Human
agcagaccaccccgccugcccu

SEQ ID NO: 2299487 - RNA, 23 nt, Human
agcagacauugucagcaaauuaa

SEQ ID NO: 2299488 - RNA, 19 nt, Human
agcagaauagcaaggugcu

SEQ ID NO: 2299489 - RNA, 14 nt, Human
agcagaauaaagca

SEQ ID NO: 2299490 - RNA, 15 nt, Human
agcagaauaaagcaa

SEQ ID NO: 2299491 - RNA, 16 nt, Human
agcagaauaaagcaau

SEQ ID NO: 2299492 - RNA, 17 nt, Human
agcagaauaaagcaauu

SEQ ID NO: 2299493 - RNA, 18 nt, Human
agcagaauaaagcaauuu

SEQ ID NO: 2299494 - RNA, 21 nt, Human
agcagaauaaagcaauuuucc

SEQ ID NO: 2299495 - RNA, 22 nt, Human
agcagaauaaagcaauuuuccu

SEQ ID NO: 2299496 - RNA, 23 nt, Human
agcagaauaaagcaauuuuccuu

SEQ ID NO: 2299497 - RNA, 12 nt, Human
agcagacaggcc

SEQ ID NO: 2299498 - RNA, 21 nt, Human
agcagacaguguuuucuggga

SEQ ID NO: 2299499 - RNA, 12 nt, Human
agcagacauugu

SEQ ID NO: 2299500 - RNA, 10 nt, Human
ugagccuggc

SEQ ID NO: 2299501 - RNA, 19 nt, Human
agcagacuggugagcagac

SEQ ID NO: 2299502 - RNA, 14 nt, Human
agcagacuggugag

SEQ ID NO: 2299503 - RNA, 15 nt, Human
agcagagacacuaac

SEQ ID NO: 2299504 - RNA, 15 nt, Human
agcagagaccauccc

SEQ ID NO: 2299505 - RNA, 16 nt, Human
agcagagaccaucccu

SEQ ID NO: 2299506 - RNA, 21 nt, Human
agcagagaauucucuuaucca

SEQ ID NO: 2299507 - RNA, 14 nt, Human
agcagagaauucuc

SEQ ID NO: 2299508 - RNA, 22 nt, Human
agcagagaaugaaagggcccag

SEQ ID NO: 2299509 - RNA, 23 nt, Human
agcagagaaugaaagggcccaga

SEQ ID NO: 2299510 - RNA, 14 nt, Human
ugagccuucagucu

SEQ ID NO: 2299511 - RNA, 13 nt, Human
ugagccuggcugg

SEQ ID NO: 2299512 - RNA, 17 nt, Human
ugagccuggcuggcaca

SEQ ID NO: 2299513 - RNA, 13 nt, Human
ugagccuucaguc

SEQ ID NO: 2299514 - RNA, 14 nt, Human
ugagccuugaacuu

SEQ ID NO: 2299515 - RNA, 22 nt, Human
ugagccugggaggucaaggcug

SEQ ID NO: 2299516 - RNA, 19 nt, Human
ugagccugggaggucaagg

SEQ ID NO: 2299517 - RNA, 16 nt, Human
ugagccuggcaagaau

SEQ ID NO: 2299518 - RNA, 11 nt, Human
ugagccuggca

SEQ ID NO: 2299519 - RNA, 14 nt, Human
ugagccugggaggu

SEQ ID NO: 2299520 - RNA, 16 nt, Human
ugagccuggccagccu

SEQ ID NO: 2299521 - RNA, 13 nt, Human
ugagccuggcucu

SEQ ID NO: 2299522 - RNA, 18 nt, Human
ugagccuggcucuugugc

SEQ ID NO: 2299523 - RNA, 12 nt, Human
ugagccuggcca

SEQ ID NO: 2299524 - RNA, 11 nt, Human
ugagccuggcc

SEQ ID NO: 2299525 - RNA, 19 nt, Human
ugagccuugaacuuugacc

SEQ ID NO: 2299526 - RNA, 18 nt, Human
ugagccuugaacuuugac

SEQ ID NO: 2299527 - RNA, 17 nt, Human
ugagccuugaacuuuga

SEQ ID NO: 2299528 - RNA, 15 nt, Human
ugagccuugaacuuu

SEQ ID NO: 2299529 - RNA, 20 nt, Human
ugagcgacagugagacucug

SEQ ID NO: 2299530 - RNA, 16 nt, Human
ugagcgacagugagac

SEQ ID NO: 2299531 - RNA, 14 nt, Human
ugagcgacagugag

SEQ ID NO: 2299532 - RNA, 13 nt, Human
ugagcgacaguga

SEQ ID NO: 2299533 - RNA, 13 nt, Human
agcagaaaauaca

SEQ ID NO: 2299534 - RNA, 19 nt, Human
agcagaaaauacagcugga

SEQ ID NO: 2299535 - RNA, 22 nt, Human
agcacuuugggaggcugaggcg

SEQ ID NO: 2299536 - RNA, 21 nt, Human
agcacuuugggaggcugaggc

SEQ ID NO: 2299537 - RNA, 20 nt, Human
agcacuuugggaggccaagg

SEQ ID NO: 2299538 - RNA, 21 nt, Human
agcacuuugggaggccaaggu

SEQ ID NO: 2299539 - RNA, 16 nt, Human
agcacuuugggaggcu

SEQ ID NO: 2299540 - RNA, 23 nt, Human
agcacuuugggaggccaaggugg

SEQ ID NO: 2299541 - RNA, 22 nt, Human
agcacuuucuacaaugugaacu

SEQ ID NO: 2299542 - RNA, 16 nt, Human
agcacuuguccagcug

SEQ ID NO: 2299543 - RNA, 13 nt, Human
agcacuuguauau

SEQ ID NO: 2299544 - RNA, 21 nt, Human
agcacuuguggguuuuuguuu

SEQ ID NO: 2299545 - RNA, 12 nt, Human
agcacuuuggga

SEQ ID NO: 2299546 - RNA, 15 nt, Human
agcacuuugggaggc

SEQ ID NO: 2299547 - RNA, 19 nt, Human
agcacuuugggaggccaag

SEQ ID NO: 2299548 - RNA, 14 nt, Human
agcacuuugggagg

SEQ ID NO: 2299549 - RNA, 22 nt, Human
agcacuuugggaggccaaggug

SEQ ID NO: 2299550 - RNA, 14 nt, Human
agcagaacugaacc

SEQ ID NO: 2299551 - RNA, 21 nt, Human
agcagaacggagccccaggcc

SEQ ID NO: 2299552 - RNA, 14 nt, Human
agcagaacagugau

SEQ ID NO: 2299553 - RNA, 12 nt, Human
agcagaaggggg

SEQ ID NO: 2299554 - RNA, 16 nt, Human
agcagaaggggguggu

SEQ ID NO: 2299555 - RNA, 22 nt, Human
agcagaaggggguggugucucc

SEQ ID NO: 2299556 - RNA, 23 nt, Human
agcagaaggggguggugucucca

SEQ ID NO: 2299557 - RNA, 16 nt, Human
agcagaaguggagcug

SEQ ID NO: 2299558 - RNA, 11 nt, Human
agcagaauaaa

SEQ ID NO: 2299559 - RNA, 12 nt, Human
agcagaauaaag

SEQ ID NO: 2299560 - RNA, 13 nt, Human
agcagaauaaagc

SEQ ID NO: 2299561 - RNA, 15 nt, Human
agcagaaaucuagaa

SEQ ID NO: 2299562 - RNA, 13 nt, Human
agcagaaauacau

SEQ ID NO: 2299563 - RNA, 19 nt, Human
agcagaaaugccuuacccu

SEQ ID NO: 2299564 - RNA, 13 nt, Human
agcagaaaugccu

SEQ ID NO: 2299565 - RNA, 12 nt, Human
agcagaaaugcc

SEQ ID NO: 2299566 - RNA, 23 nt, Human
agcaccaggcacgaacccaccug

SEQ ID NO: 2299567 - RNA, 15 nt, Human
agcaccagggacuau

SEQ ID NO: 2299568 - RNA, 17 nt, Human
agcaccagggcucacgu

SEQ ID NO: 2299569 - RNA, 13 nt, Human
agcaccagggaag

SEQ ID NO: 2299570 - RNA, 12 nt, Human
agcaccagggaa

SEQ ID NO: 2299571 - RNA, 10 nt, Human
agcaccaggg

SEQ ID NO: 2299572 - RNA, 14 nt, Human
agcaccaggcacga

SEQ ID NO: 2299573 - RNA, 21 nt, Human
agcaccagcuucuccaggcuc

SEQ ID NO: 2299574 - RNA, 19 nt, Human
agcaccagcuucuccaggc

SEQ ID NO: 2299575 - RNA, 20 nt, Human
agcaccagcuucuccaggcu

SEQ ID NO: 2299576 - RNA, 18 nt, Human
agcaccagcuucuccagg

SEQ ID NO: 2299577 - RNA, 17 nt, Human
agcaccagcuucuccag

SEQ ID NO: 2299578 - RNA, 23 nt, Human
agcaccacccuagucccuucccc

SEQ ID NO: 2299579 - RNA, 17 nt, Human
agcaccaagcucaaagc

SEQ ID NO: 2299580 - RNA, 18 nt, Human
agcaccaagcucaaagcg

SEQ ID NO: 2299581 - RNA, 19 nt, Human
agcaccuuagacagucccu

SEQ ID NO: 2299582 - RNA, 20 nt, Human
agcaccuuagacagucccug

SEQ ID NO: 2299583 - RNA, 21 nt, Human
agcaccuuagacagucccugc

SEQ ID NO: 2299584 - RNA, 22 nt, Human
agcaccuuagacagucccugcc

SEQ ID NO: 2299585 - RNA, 23 nt, Human
agcacuuggagccaaggguucag

SEQ ID NO: 2299586 - RNA, 18 nt, Human
agcacgaaauguuauuuu

SEQ ID NO: 2299587 - RNA, 12 nt, Human
agcacuuguaua

SEQ ID NO: 2299588 - RNA, 16 nt, Human
agcacgauuucuguuu

SEQ ID NO: 2299589 - RNA, 15 nt, Human
agcacgauuucuguu

SEQ ID NO: 2299590 - RNA, 14 nt, Human
agcacgauuucugu

SEQ ID NO: 2299591 - RNA, 13 nt, Human
agcacgauuucug

SEQ ID NO: 2299592 - RNA, 17 nt, Human
agcacgaaauguuauuu

SEQ ID NO: 2299593 - RNA, 18 nt, Human
agcaccuuccucacuucc

SEQ ID NO: 2299594 - RNA, 19 nt, Human
agcaccuuccucacuucca

SEQ ID NO: 2299595 - RNA, 20 nt, Human
agcaccuuccucacuuccau

SEQ ID NO: 2299596 - RNA, 23 nt, Human
agcaccuuagacagucccugcca

SEQ ID NO: 2299597 - RNA, 22 nt, Human
agcaccugucuccuuucacccc

SEQ ID NO: 2299598 - RNA, 15 nt, Human
agcaccuuccucacu

SEQ ID NO: 2299599 - RNA, 16 nt, Human
agcaccuuccucacuu

SEQ ID NO: 2299600 - RNA, 20 nt, Human
agcaccugcuucaugcucag

SEQ ID NO: 2299601 - RNA, 21 nt, Human
agcaccugcuucaugcucagc

SEQ ID NO: 2299602 - RNA, 16 nt, Human
ugagcaaugucugugc

SEQ ID NO: 2299603 - RNA, 17 nt, Human
ugagcaacuuucuuaca

SEQ ID NO: 2299604 - RNA, 22 nt, Human
ugagcacaacuuuaagaggaca

SEQ ID NO: 2299605 - RNA, 21 nt, Human
ugagcacaacuuuaagaggac

SEQ ID NO: 2299606 - RNA, 20 nt, Human
ugagcacacuuuaguggccg

SEQ ID NO: 2299607 - RNA, 17 nt, Human
ugagcaaugucugugcu

SEQ ID NO: 2299608 - RNA, 18 nt, Human
ugagcaaugucugugcua

SEQ ID NO: 2299609 - RNA, 20 nt, Human
ugagcaaugucugugcuagg

SEQ ID NO: 2299610 - RNA, 14 nt, Human
ugagcaauucuccu

SEQ ID NO: 2299611 - RNA, 14 nt, Human
ugagcaccagggga

SEQ ID NO: 2299612 - RNA, 13 nt, Human
ugagcaccagggg

SEQ ID NO: 2299613 - RNA, 17 nt, Human
ugagcaccgucauggcu

SEQ ID NO: 2299614 - RNA, 17 nt, Human
ugagcacagccuagggc

SEQ ID NO: 2299615 - RNA, 13 nt, Human
ugagcacacuuua

SEQ ID NO: 2299616 - RNA, 13 nt, Human
ugagcacauucug

SEQ ID NO: 2299617 - RNA, 16 nt, Human
ugagcaccaggggaug

SEQ ID NO: 2299618 - RNA, 19 nt, Human
ugagcaccgucauggcuua

SEQ ID NO: 2299619 - RNA, 21 nt, Human
ugagcaccugcuucaugcuca

SEQ ID NO: 2299620 - RNA, 20 nt, Human
ugagcacggccaacaaagcu

SEQ ID NO: 2299621 - RNA, 12 nt, Human
ugagcaccugcu

SEQ ID NO: 2299622 - RNA, 20 nt, Human
ugagcacuaaggugugcucu

SEQ ID NO: 2299623 - RNA, 21 nt, Human
ugagcacuaaggugugcucug

SEQ ID NO: 2299624 - RNA, 22 nt, Human
ugagcacuaaggugugcucuga

SEQ ID NO: 2299625 - RNA, 23 nt, Human
ugagcacuaaggugugcucugau

SEQ ID NO: 2299626 - RNA, 15 nt, Human
ugagcaaauguggcu

SEQ ID NO: 2299627 - RNA, 18 nt, Human
ugagcaacucuugauuau

SEQ ID NO: 2299628 - RNA, 16 nt, Human
ugagcaacucuugauu

SEQ ID NO: 2299629 - RNA, 15 nt, Human
ugagcaauccugcaa

SEQ ID NO: 2299630 - RNA, 16 nt, Human
ugagcaaauguggcuc

SEQ ID NO: 2299631 - RNA, 18 nt, Human
ugagcaaauguggcuccu

SEQ ID NO: 2299632 - RNA, 19 nt, Human
ugagcaaauguggcuccug

SEQ ID NO: 2299633 - RNA, 22 nt, Human
agcaacccuccuaucaccuccc

SEQ ID NO: 2299634 - RNA, 18 nt, Human
agcaaccgguggauccuc

SEQ ID NO: 2299635 - RNA, 15 nt, Human
agcaaccugggucca

SEQ ID NO: 2299636 - RNA, 22 nt, Human
agcaaccuggguccaaauaaaa

SEQ ID NO: 2299637 - RNA, 18 nt, Human
agcaaccuggguccaaau

SEQ ID NO: 2299638 - RNA, 19 nt, Human
agcaaccuggguccaaaua

SEQ ID NO: 2299639 - RNA, 20 nt, Human
agcaaccuggguccaaauaa

SEQ ID NO: 2299640 - RNA, 21 nt, Human
agcaaccuggguccaaauaaa

SEQ ID NO: 2299641 - RNA, 14 nt, Human
agcaacgcaggccc

SEQ ID NO: 2299642 - RNA, 16 nt, Human
ugagcagacuggugag

SEQ ID NO: 2299643 - RNA, 21 nt, Human
ugagcaucaggccaggcccuc

SEQ ID NO: 2299644 - RNA, 13 nt, Human
ugagcacuguagg

SEQ ID NO: 2299645 - RNA, 15 nt, Human
ugagcacucccaagu

SEQ ID NO: 2299646 - RNA, 17 nt, Human
ugagcacucccaagucu

SEQ ID NO: 2299647 - RNA, 18 nt, Human
ugagcacucccaagucua

SEQ ID NO: 2299648 - RNA, 23 nt, Human
ugagcacucccaagucuacagag

SEQ ID NO: 2299649 - RNA, 19 nt, Human
ugagcagacuggugagcag

SEQ ID NO: 2299650 - RNA, 17 nt, Human
ugagcagacuggugagc

SEQ ID NO: 2299651 - RNA, 14 nt, Human
ugagccaccgugcc

SEQ ID NO: 2299652 - RNA, 15 nt, Human
ugagccaccacgccc

SEQ ID NO: 2299653 - RNA, 22 nt, Human
ugagcaucaggccaggcccucu

SEQ ID NO: 2299654 - RNA, 24 nt, Human
ugagcaucaggccaggcccucugc

SEQ ID NO: 2299655 - RNA, 21 nt, Human
ugagccacugcaccgggccac

SEQ ID NO: 2299656 - RNA, 18 nt, Human
ugagccacugcaccgggc

SEQ ID NO: 2299657 - RNA, 21 nt, Human
ugagccaccgugccuggccac

SEQ ID NO: 2299658 - RNA, 20 nt, Human
ugagccaccgugccuggcca

SEQ ID NO: 2299659 - RNA, 19 nt, Human
ugagccaccgugccuggcc

SEQ ID NO: 2299660 - RNA, 18 nt, Human
ugagccaccgugccuggc

SEQ ID NO: 2299661 - RNA, 23 nt, Human
ugagccacugcaccgggccacag

SEQ ID NO: 2299662 - RNA, 13 nt, Human
ugagccagauuuc

SEQ ID NO: 2299663 - RNA, 14 nt, Human
ugagccagauuuca

SEQ ID NO: 2299664 - RNA, 16 nt, Human
ugagccagauuucacu

SEQ ID NO: 2299665 - RNA, 12 nt, Human
agcaccacccua

SEQ ID NO: 2299666 - RNA, 16 nt, Human
agcaccaaucaugaau

SEQ ID NO: 2299667 - RNA, 23 nt, Human
agcacaucugcauuuucacccca

SEQ ID NO: 2299668 - RNA, 23 nt, Human
agcacaugaaaccuuauuuuuuc

SEQ ID NO: 2299669 - RNA, 17 nt, Human
agcaccaaaauaagaaa

SEQ ID NO: 2299670 - RNA, 16 nt, Human
agcaccaaaauaagaa

SEQ ID NO: 2299671 - RNA, 21 nt, Human
agcaccaaaauaagaaaagau

SEQ ID NO: 2299672 - RNA, 20 nt, Human
agcaccaaaauaagaaaaga

SEQ ID NO: 2299673 - RNA, 19 nt, Human
agcaccaaaauaagaaaag

SEQ ID NO: 2299674 - RNA, 18 nt, Human
agcaccaaaauaagaaaa

SEQ ID NO: 2299675 - RNA, 22 nt, Human
agcaccaaaagcuuaccaaggg

SEQ ID NO: 2299676 - RNA, 14 nt, Human
agcacaugccucuc

SEQ ID NO: 2299677 - RNA, 16 nt, Human
agcacaucugcauuuu

SEQ ID NO: 2299678 - RNA, 15 nt, Human
agcacaucugcauuu

SEQ ID NO: 2299679 - RNA, 13 nt, Human
agcacaugccucu

SEQ ID NO: 2299680 - RNA, 15 nt, Human
agcacagugccugca

SEQ ID NO: 2299681 - RNA, 15 nt, Human
agcacagugguggca

SEQ ID NO: 2299682 - RNA, 14 nt, Human
agcacagugccugc

SEQ ID NO: 2299683 - RNA, 19 nt, Human
agcacagucugaugacaca

SEQ ID NO: 2299684 - RNA, 21 nt, Human
agcacaggugggcuucccagu

SEQ ID NO: 2299685 - RNA, 19 nt, Human
agcacaggugggcuuccca

SEQ ID NO: 2299686 - RNA, 17 nt, Human
agcacaguuugaacaaa

SEQ ID NO: 2299687 - RNA, 19 nt, Human
agcacaguguuaaaugaaa

SEQ ID NO: 2299688 - RNA, 22 nt, Human
agcacaguguuaaaugaaauug

SEQ ID NO: 2299689 - RNA, 12 nt, Human
agcacaguuuga

SEQ ID NO: 2299690 - RNA, 14 nt, Human
agcacaguuugaac

SEQ ID NO: 2299691 - RNA, 16 nt, Human
agcacagugguggcag

SEQ ID NO: 2299692 - RNA, 17 nt, Human
agcacagugguggcagg

SEQ ID NO: 2299693 - RNA, 18 nt, Human
agcacagugguggcaggg

SEQ ID NO: 2299694 - RNA, 19 nt, Human
agcacagugguggcagggc

SEQ ID NO: 2299695 - RNA, 20 nt, Human
agcacagugguggcagggcc

SEQ ID NO: 2299696 - RNA, 23 nt, Human
agcacagugguggcagggccuag

SEQ ID NO: 2299697 - RNA, 16 nt, Human
agcacaguguuaaaug

SEQ ID NO: 2299698 - RNA, 18 nt, Human
agcacaguguuaaaugaa

SEQ ID NO: 2299699 - RNA, 16 nt, Human
agcacagcuucauuuc

SEQ ID NO: 2299700 - RNA, 12 nt, Human
agcacagccuag

SEQ ID NO: 2299701 - RNA, 22 nt, Human
agcacagccucuuagaugcagu

SEQ ID NO: 2299702 - RNA, 10 nt, Human
agcacagccc

SEQ ID NO: 2299703 - RNA, 12 nt, Human
agcacagcccuc

SEQ ID NO: 2299704 - RNA, 13 nt, Human
agcacagcccucc

SEQ ID NO: 2299705 - RNA, 14 nt, Human
agcacagcccuccc

SEQ ID NO: 2299706 - RNA, 15 nt, Human
agcacagcccucccg

SEQ ID NO: 2299707 - RNA, 16 nt, Human
agcacagcccucccgc

SEQ ID NO: 2299708 - RNA, 21 nt, Human
agcacagcccucccgccccuu

SEQ ID NO: 2299709 - RNA, 22 nt, Human
agcacagcccucccgccccuuc

SEQ ID NO: 2299710 - RNA, 21 nt, Human
agcacagcagccccugcacaa

SEQ ID NO: 2299711 - RNA, 15 nt, Human
agcacagcagccugg

SEQ ID NO: 2299712 - RNA, 13 nt, Human
agcacagcagccu

SEQ ID NO: 2299713 - RNA, 23 nt, Human
agcacagccaacacgcaccugcc

SEQ ID NO: 2299714 - RNA, 13 nt, Human
agcacagccaaca

SEQ ID NO: 2299715 - RNA, 12 nt, Human
agcacagccaac

SEQ ID NO: 2299716 - RNA, 23 nt, Human
agcacagcagccuggggcuggcc

SEQ ID NO: 2299717 - RNA, 12 nt, Human
agcacagcagcc

SEQ ID NO: 2299718 - RNA, 10 nt, Human
agcacagcag

SEQ ID NO: 2299719 - RNA, 19 nt, Human
agcacagcaaggaggcugg

SEQ ID NO: 2299720 - RNA, 22 nt, Human
agcacagcaaggaggcuggcug

SEQ ID NO: 2299721 - RNA, 23 nt, Human
agcacagcaaggaggcuggcugg

SEQ ID NO: 2299722 - RNA, 24 nt, Human
agcacagcaaggaggcuggcuggg

SEQ ID NO: 2299723 - RNA, 17 nt, Human
agcaaguucuagagaag

SEQ ID NO: 2299724 - RNA, 20 nt, Human
agcaaguucuagagaagagg

SEQ ID NO: 2299725 - RNA, 21 nt, Human
agcaaguucuagagaagaggc

SEQ ID NO: 2299726 - RNA, 23 nt, Human
agcaaguucuagagaagaggcug

SEQ ID NO: 2299727 - RNA, 14 nt, Human
agcaauaaagaaga

SEQ ID NO: 2299728 - RNA, 16 nt, Human
agcaauaaagaagagu

SEQ ID NO: 2299729 - RNA, 22 nt, Human
agcaagugagagcuggguguca

SEQ ID NO: 2299730 - RNA, 16 nt, Human
agcaaguuacagugau

SEQ ID NO: 2299731 - RNA, 21 nt, Human
agcaagugauugggacagagg

SEQ ID NO: 2299732 - RNA, 18 nt, Human
agcaagugagagcugggu

SEQ ID NO: 2299733 - RNA, 14 nt, Human
agcaagugagagcu

SEQ ID NO: 2299734 - RNA, 20 nt, Human
ugagccagacaaauggagga

SEQ ID NO: 2299735 - RNA, 14 nt, Human
ugagccagacaaau

SEQ ID NO: 2299736 - RNA, 12 nt, Human
ugagccaccacg

SEQ ID NO: 2299737 - RNA, 13 nt, Human
ugagccagcagac

SEQ ID NO: 2299738 - RNA, 16 nt, Human
ugagccagcagacauu

SEQ ID NO: 2299739 - RNA, 14 nt, Human
ugagccaggccugg

SEQ ID NO: 2299740 - RNA, 23 nt, Human
ugagccagcagacauugucagca

SEQ ID NO: 2299741 - RNA, 17 nt, Human
ugagccagcagacauug

SEQ ID NO: 2299742 - RNA, 18 nt, Human
ugagccagcagacauugu

SEQ ID NO: 2299743 - RNA, 18 nt, Human
ugagccaggccugggucu

SEQ ID NO: 2299744 - RNA, 20 nt, Human
ugagccagguaaugagggac

SEQ ID NO: 2299745 - RNA, 17 nt, Human
ugagccagauuucacuc

SEQ ID NO: 2299746 - RNA, 22 nt, Human
ugagccagauuucacucuccuu

SEQ ID NO: 2299747 - RNA, 20 nt, Human
agcaagugagacccugucuc

SEQ ID NO: 2299748 - RNA, 21 nt, Human
ugagccagguaaugagggacu

SEQ ID NO: 2299749 - RNA, 13 nt, Human
ugagccaguccca

SEQ ID NO: 2299750 - RNA, 14 nt, Human
ugagccagucccag

SEQ ID NO: 2299751 - RNA, 16 nt, Human
ugagccagucccaggg

SEQ ID NO: 2299752 - RNA, 17 nt, Human
ugagccagucccagggg

SEQ ID NO: 2299753 - RNA, 19 nt, Human
ugagccagucccaggggca

SEQ ID NO: 2299754 - RNA, 13 nt, Human
agcaagugagagc

SEQ ID NO: 2299755 - RNA, 18 nt, Human
ugagccagucccaggggc

SEQ ID NO: 2299756 - RNA, 22 nt, Human
ugagccaguucaguaccuggag

SEQ ID NO: 2299757 - RNA, 15 nt, Human
ugagcccacaaagcc

SEQ ID NO: 2299758 - RNA, 23 nt, Human
ugagccaguucaguaccuggagg

SEQ ID NO: 2299759 - RNA, 17 nt, Human
agcaagugagagagaug

SEQ ID NO: 2299760 - RNA, 18 nt, Human
agcaagugagagagaugg

SEQ ID NO: 2299761 - RNA, 24 nt, Human
agcaagugagagagaugggagcuc

SEQ ID NO: 2299762 - RNA, 21 nt, Human
ugagcggugcuguccucaggu

SEQ ID NO: 2299763 - RNA, 18 nt, Human
ugagcuacgccugccucc

SEQ ID NO: 2299764 - RNA, 20 nt, Human
ugagcggugcuguccucagg

SEQ ID NO: 2299765 - RNA, 19 nt, Human
ugagcuagaagcuggagga

SEQ ID NO: 2299766 - RNA, 22 nt, Human
ugagcuagaagcuggaggacua

SEQ ID NO: 2299767 - RNA, 16 nt, Human
ugagcuacaaaugcau

SEQ ID NO: 2299768 - RNA, 22 nt, Human
ugagcuuuauguaauaauguga

SEQ ID NO: 2299769 - RNA, 18 nt, Human
ugagcuuuccauguugcu

SEQ ID NO: 2299770 - RNA, 21 nt, Human
ugagcuuggccagaagggggc

SEQ ID NO: 2299771 - RNA, 12 nt, Human
ugagcuuuaaaa

SEQ ID NO: 2299772 - RNA, 19 nt, Human
ugagcuuggccagaagggg

SEQ ID NO: 2299773 - RNA, 14 nt, Human
ugagcuaggaauug

SEQ ID NO: 2299774 - RNA, 19 nt, Human
ugagcuuuccauguugcug

SEQ ID NO: 2299775 - RNA, 20 nt, Human
ugagcuuuccauguugcugc

SEQ ID NO: 2299776 - RNA, 21 nt, Human
ugagcuuuccauguugcugcc

SEQ ID NO: 2299777 - RNA, 22 nt, Human
ugagcuuuccauguugcugcca

SEQ ID NO: 2299778 - RNA, 22 nt, Human
ugagcuuugcauguuccacuaa

SEQ ID NO: 2299779 - RNA, 23 nt, Human
ugagcuuugcauguuccacuaac

SEQ ID NO: 2299780 - RNA, 14 nt, Human
ugagcuuugcugcu

SEQ ID NO: 2299781 - RNA, 16 nt, Human
ugagcgacaaagauga

SEQ ID NO: 2299782 - RNA, 17 nt, Human
ugagcgacaaagaugau

SEQ ID NO: 2299783 - RNA, 13 nt, Human
ugagccuuguaau

SEQ ID NO: 2299784 - RNA, 16 nt, Human
ugagccuuuucccucu

SEQ ID NO: 2299785 - RNA, 23 nt, Human
ugagcgaggagaugcuccuuggg

SEQ ID NO: 2299786 - RNA, 22 nt, Human
ugagcgaggagaugcuccuugg

SEQ ID NO: 2299787 - RNA, 17 nt, Human
ugagcgaggacauucuc

SEQ ID NO: 2299788 - RNA, 23 nt, Human
ugagcgauuauuaucuaaagugu

SEQ ID NO: 2299789 - RNA, 12 nt, Human
ugagcgccagga

SEQ ID NO: 2299790 - RNA, 18 nt, Human
ugagcgccuccauccaag

SEQ ID NO: 2299791 - RNA, 23 nt, Human
ugagcgccuccauccaaggccag

SEQ ID NO: 2299792 - RNA, 14 nt, Human
ugagcgcuccugcc

SEQ ID NO: 2299793 - RNA, 20 nt, Human
ugagcgccuccauccaaggc

SEQ ID NO: 2299794 - RNA, 18 nt, Human
ugagcgcuccugccgcag

SEQ ID NO: 2299795 - RNA, 22 nt, Human
ugagcgcuccugccgcagagcu

SEQ ID NO: 2299796 - RNA, 14 nt, Human
ugagcuacaaaugc

SEQ ID NO: 2299797 - RNA, 13 nt, Human
ugagcuacaaaug

SEQ ID NO: 2299798 - RNA, 16 nt, Human
ugaggaaacaacagcu

SEQ ID NO: 2299799 - RNA, 23 nt, Human
ugaggaaaaaaaucguccaggga

SEQ ID NO: 2299800 - RNA, 12 nt, Human
ugagcuuuucua

SEQ ID NO: 2299801 - RNA, 15 nt, Human
ugagcuuugcugcua

SEQ ID NO: 2299802 - RNA, 16 nt, Human
ugagcuuugcugcuac

SEQ ID NO: 2299803 - RNA, 17 nt, Human
ugagcuuugcugcuaca

SEQ ID NO: 2299804 - RNA, 13 nt, Human
ugagcuuuucuag

SEQ ID NO: 2299805 - RNA, 18 nt, Human
ugaggaaaggccagcugg

SEQ ID NO: 2299806 - RNA, 16 nt, Human
ugaggaaaggccagcu

SEQ ID NO: 2299807 - RNA, 15 nt, Human
ugaggaaaggccagc

SEQ ID NO: 2299808 - RNA, 19 nt, Human
ugaggaaagcauguauuca

SEQ ID NO: 2299809 - RNA, 15 nt, Human
ugaggaaagucauug

SEQ ID NO: 2299810 - RNA, 17 nt, Human
ugaggaaagucauuggc

SEQ ID NO: 2299811 - RNA, 18 nt, Human
ugaggaaagucauuggcu

SEQ ID NO: 2299812 - RNA, 19 nt, Human
ugaggaaagucauuggcuu

SEQ ID NO: 2299813 - RNA, 19 nt, Human
ugaggaaaggccagcuggc

SEQ ID NO: 2299814 - RNA, 21 nt, Human
ugaggaaagucauuggcuuua

SEQ ID NO: 2299815 - RNA, 22 nt, Human
ugaggaaagucauuggcuuuau

SEQ ID NO: 2299816 - RNA, 15 nt, Human
ugaggaagcaaaagc

SEQ ID NO: 2299817 - RNA, 17 nt, Human
ugaggaagaacggggcu

SEQ ID NO: 2299818 - RNA, 19 nt, Human
ugaggaagaacggggcucu

SEQ ID NO: 2299819 - RNA, 23 nt, Human
ugaggaagaacggggcucuucuc

SEQ ID NO: 2299820 - RNA, 24 nt, Human
ugaggaagaacggggcucuucuca

SEQ ID NO: 2299821 - RNA, 22 nt, Human
ugaggaagcgugaaggccgaga

SEQ ID NO: 2299822 - RNA, 19 nt, Human
ugaggaaggcaggaagaga

SEQ ID NO: 2299823 - RNA, 20 nt, Human
ugaggaaggcaggaagagag

SEQ ID NO: 2299824 - RNA, 17 nt, Human
ugaggaauaauuauuua

SEQ ID NO: 2299825 - RNA, 19 nt, Human
ugaggaauaauuauuuauu

SEQ ID NO: 2299826 - RNA, 19 nt, Human
ugaggaauaguugagcccc

SEQ ID NO: 2299827 - RNA, 17 nt, Human
ugaggaagcgugaaggc

SEQ ID NO: 2299828 - RNA, 23 nt, Human
ugaggaagccagguccacggucu

SEQ ID NO: 2299829 - RNA, 23 nt, Human
ugaggaagaugggggcaagaaga

SEQ ID NO: 2299830 - RNA, 17 nt, Human
ugaggaagagggacugu

SEQ ID NO: 2299831 - RNA, 19 nt, Human
ugaggaagccgcuggggcc

SEQ ID NO: 2299832 - RNA, 21 nt, Human
ugaggaagccgcuggggccag

SEQ ID NO: 2299833 - RNA, 22 nt, Human
ugaggaagcaaaagcaucuaug

SEQ ID NO: 2299834 - RNA, 14 nt, Human
ugaggaagccgcug

SEQ ID NO: 2299835 - RNA, 17 nt, Human
ugaggaagccgcugggg

SEQ ID NO: 2299836 - RNA, 18 nt, Human
ugaggaagccgcuggggc

SEQ ID NO: 2299837 - RNA, 23 nt, Human
ugaggcccagggagaggccauga

SEQ ID NO: 2299838 - RNA, 20 nt, Human
ugaggcccagggagaggcca

SEQ ID NO: 2299839 - RNA, 17 nt, Human
ugaggcccagggagagg

SEQ ID NO: 2299840 - RNA, 14 nt, Human
ugaggcccagggag

SEQ ID NO: 2299841 - RNA, 13 nt, Human
ugaggcccaggga

SEQ ID NO: 2299842 - RNA, 23 nt, Human
ugaggcccagagggccugcaagg

SEQ ID NO: 2299843 - RNA, 21 nt, Human
ugaggcccagagggccugcaa

SEQ ID NO: 2299844 - RNA, 22 nt, Human
ugaggcccagagggccugcaag

SEQ ID NO: 2299845 - RNA, 15 nt, Human
ugaggcccagagggc

SEQ ID NO: 2299846 - RNA, 17 nt, Human
ugaggcccagagggccu

SEQ ID NO: 2299847 - RNA, 18 nt, Human
ugaggcccagagggccug

SEQ ID NO: 2299848 - RNA, 20 nt, Human
ugaggcccagagggccugca

SEQ ID NO: 2299849 - RNA, 13 nt, Human
ugaggccaggagu

SEQ ID NO: 2299850 - RNA, 12 nt, Human
ugaggccaggag

SEQ ID NO: 2299851 - RNA, 16 nt, Human
ugaggccagggcagag

SEQ ID NO: 2299852 - RNA, 15 nt, Human
ugaggccagggcaga

SEQ ID NO: 2299853 - RNA, 14 nt, Human
ugaggccagggcag

SEQ ID NO: 2299854 - RNA, 13 nt, Human
ugaggccagggca

SEQ ID NO: 2299855 - RNA, 12 nt, Human
ugaggcccagag

SEQ ID NO: 2299856 - RNA, 13 nt, Human
ugaggcccagagg

SEQ ID NO: 2299857 - RNA, 20 nt, Human
ugaggccagagacacaagcc

SEQ ID NO: 2299858 - RNA, 14 nt, Human
ugaggccagagaca

SEQ ID NO: 2299859 - RNA, 16 nt, Human
ugaggccagagacaca

SEQ ID NO: 2299860 - RNA, 22 nt, Human
ugaggccaaacguuuugaacua

SEQ ID NO: 2299861 - RNA, 12 nt, Human
ugaggccacacu

SEQ ID NO: 2299862 - RNA, 19 nt, Human
ugaggccacacucagcaca

SEQ ID NO: 2299863 - RNA, 13 nt, Human
ugaggccacacuc

SEQ ID NO: 2299864 - RNA, 18 nt, Human
ugaggacagcuguccucu

SEQ ID NO: 2299865 - RNA, 16 nt, Human
ugaggacagcuguccu

SEQ ID NO: 2299866 - RNA, 17 nt, Human
ugaggacagcuguccuc

SEQ ID NO: 2299867 - RNA, 12 nt, Human
ugaggccagaga

SEQ ID NO: 2299868 - RNA, 23 nt, Human
ugaggccacacucagcacaaggc

SEQ ID NO: 2299869 - RNA, 20 nt, Human
ugaggccacacucagcacaa

SEQ ID NO: 2299870 - RNA, 22 nt, Human
ugaggccacugcugcuucucca

SEQ ID NO: 2299871 - RNA, 21 nt, Human
ugaggacacuaaccacgcugg

SEQ ID NO: 2299872 - RNA, 15 nt, Human
ugaggacacugauau

SEQ ID NO: 2299873 - RNA, 13 nt, Human
ugaggacagcugu

SEQ ID NO: 2299874 - RNA, 14 nt, Human
ugaggacagcuguc

SEQ ID NO: 2299875 - RNA, 15 nt, Human
ugaggacagcugucc

SEQ ID NO: 2299876 - RNA, 21 nt, Human
ugaggaauccagacccggcug

SEQ ID NO: 2299877 - RNA, 22 nt, Human
ugaggaauccagacccggcugc

SEQ ID NO: 2299878 - RNA, 20 nt, Human
ugaggaauaguugagcccca

SEQ ID NO: 2299879 - RNA, 16 nt, Human
ugaggaaugaugaagc

SEQ ID NO: 2299880 - RNA, 20 nt, Human
ugaggacaaccauuccagac

SEQ ID NO: 2299881 - RNA, 19 nt, Human
ugaggacaaccauuccaga

SEQ ID NO: 2299882 - RNA, 18 nt, Human
ugaggaauuuucuuugug

SEQ ID NO: 2299883 - RNA, 14 nt, Human
ugaggaauuuucuu

SEQ ID NO: 2299884 - RNA, 13 nt, Human
ugaggaauuuucu

SEQ ID NO: 2299885 - RNA, 22 nt, Human
ugaggaauuucaccuguaaacc

SEQ ID NO: 2299886 - RNA, 21 nt, Human
ugaggaauuucaccuguaaac

SEQ ID NO: 2299887 - RNA, 15 nt, Human
ugaggaauuucaccu

SEQ ID NO: 2299888 - RNA, 17 nt, Human
ugaggaauguauauguu

SEQ ID NO: 2299889 - RNA, 19 nt, Human
ugaggaauguauauguuuu

SEQ ID NO: 2299890 - RNA, 20 nt, Human
ugaggggucuccaggaggag

SEQ ID NO: 2299891 - RNA, 14 nt, Human
ugaggggucccuga

SEQ ID NO: 2299892 - RNA, 18 nt, Human
ugagggguaaaagcugau

SEQ ID NO: 2299893 - RNA, 15 nt, Human
ugaggggcuccugga

SEQ ID NO: 2299894 - RNA, 14 nt, Human
ugaggggcuggccu

SEQ ID NO: 2299895 - RNA, 22 nt, Human
ugaggggcuggccuuccugccc

SEQ ID NO: 2299896 - RNA, 22 nt, Human
ugagggggaauagucuagaugg

SEQ ID NO: 2299897 - RNA, 20 nt, Human
ugaggggggccgugcccagg

SEQ ID NO: 2299898 - RNA, 22 nt, Human
ugaggggggccgugcccagggg

SEQ ID NO: 2299899 - RNA, 14 nt, Human
ugaggggcuccugg

SEQ ID NO: 2299900 - RNA, 13 nt, Human
ugaggggccucuu

SEQ ID NO: 2299901 - RNA, 22 nt, Human
ugagggucagagaggagucaga

SEQ ID NO: 2299902 - RNA, 18 nt, Human
ugaggguaucaaauaaaa

SEQ ID NO: 2299903 - RNA, 15 nt, Human
ugaggguccccaccu

SEQ ID NO: 2299904 - RNA, 19 nt, Human
ugaggguccccaccuggga

SEQ ID NO: 2299905 - RNA, 18 nt, Human
ugaggguaauaaacuuag

SEQ ID NO: 2299906 - RNA, 21 nt, Human
ugaggguaauaaacuuagaau

SEQ ID NO: 2299907 - RNA, 22 nt, Human
ugaggguaauaaacuuagaaua

SEQ ID NO: 2299908 - RNA, 23 nt, Human
ugaggguaaccccaaaccuccaa

SEQ ID NO: 2299909 - RNA, 17 nt, Human
ugaggggcaucugcccc

SEQ ID NO: 2299910 - RNA, 21 nt, Human
ugaggggaggaaacucaccug

SEQ ID NO: 2299911 - RNA, 15 nt, Human
ugaggggaggggggc

SEQ ID NO: 2299912 - RNA, 22 nt, Human
ugaggggcaucugccccucccc

SEQ ID NO: 2299913 - RNA, 16 nt, Human
ugaggggcccgagcag

SEQ ID NO: 2299914 - RNA, 12 nt, Human
ugaggggccucu

SEQ ID NO: 2299915 - RNA, 22 nt, Human
ugaggggaggaucacuggagcc

SEQ ID NO: 2299916 - RNA, 21 nt, Human
ugaggggaggaucacuggagc

SEQ ID NO: 2299917 - RNA, 17 nt, Human
ugagggcgaggggaggg

SEQ ID NO: 2299918 - RNA, 21 nt, Human
ugagggccccucugcccagcu

SEQ ID NO: 2299919 - RNA, 17 nt, Human
ugagggccccucugccc

SEQ ID NO: 2299920 - RNA, 19 nt, Human
ugagggccccucugcccag

SEQ ID NO: 2299921 - RNA, 17 nt, Human
ugagggcccagagcagg

SEQ ID NO: 2299922 - RNA, 18 nt, Human
ugagggcccagagcagga

SEQ ID NO: 2299923 - RNA, 19 nt, Human
ugagggcccagagcaggaa

SEQ ID NO: 2299924 - RNA, 20 nt, Human
ugagggcccagagcaggaag

SEQ ID NO: 2299925 - RNA, 21 nt, Human
ugagggcccagagcaggaagc

SEQ ID NO: 2299926 - RNA, 14 nt, Human
ugagggccccucug

SEQ ID NO: 2299927 - RNA, 15 nt, Human
ugagggccccucugc

SEQ ID NO: 2299928 - RNA, 16 nt, Human
ugagggccccucugcc

SEQ ID NO: 2299929 - RNA, 18 nt, Human
ugagggccaagaaagagu

SEQ ID NO: 2299930 - RNA, 12 nt, Human
ugagggcccaga

SEQ ID NO: 2299931 - RNA, 21 nt, Human
ugagggcaucuugguccagga

SEQ ID NO: 2299932 - RNA, 13 nt, Human
ugagggcccagag

SEQ ID NO: 2299933 - RNA, 14 nt, Human
ugagggcccagagc

SEQ ID NO: 2299934 - RNA, 15 nt, Human
ugagggcccagagca

SEQ ID NO: 2299935 - RNA, 16 nt, Human
ugagggcccagagcag

SEQ ID NO: 2299936 - RNA, 11 nt, Human
ugagggcaguc

SEQ ID NO: 2299937 - RNA, 18 nt, Human
ugagggaucacagggccc

SEQ ID NO: 2299938 - RNA, 17 nt, Human
ugagggaucacagggcc

SEQ ID NO: 2299939 - RNA, 23 nt, Human
ugagggaggaggccaccucucca

SEQ ID NO: 2299940 - RNA, 19 nt, Human
ugagggaggaggccaccuc

SEQ ID NO: 2299941 - RNA, 20 nt, Human
ugagggaggaggccaccucu

SEQ ID NO: 2299942 - RNA, 19 nt, Human
ugagggauacccaucccau

SEQ ID NO: 2299943 - RNA, 15 nt, Human
ugagggauuaucuuu

SEQ ID NO: 2299944 - RNA, 19 nt, Human
ugaggccucaguggacuuu

SEQ ID NO: 2299945 - RNA, 22 nt, Human
ugaggccuccagcuucaggcag

SEQ ID NO: 2299946 - RNA, 15 nt, Human
ugaggccucagugga

SEQ ID NO: 2299947 - RNA, 23 nt, Human
ugaggccucuuggaccucugcuc

SEQ ID NO: 2299948 - RNA, 14 nt, Human
ugaggccucuugga

SEQ ID NO: 2299949 - RNA, 15 nt, Human
ugaggccucuuggac

SEQ ID NO: 2299950 - RNA, 21 nt, Human
ugaggccucuuggaccucugc

SEQ ID NO: 2299951 - RNA, 17 nt, Human
ugaggccugcccucagg

SEQ ID NO: 2299952 - RNA, 18 nt, Human
ugaggccugcccucaggg

SEQ ID NO: 2299953 - RNA, 19 nt, Human
ugaggccugcccucaggga

SEQ ID NO: 2299954 - RNA, 14 nt, Human
ugagggaggaggcc

SEQ ID NO: 2299955 - RNA, 18 nt, Human
ugagggaggaggccaccu

SEQ ID NO: 2299956 - RNA, 19 nt, Human
ugaggccuaaaaguaaaca

SEQ ID NO: 2299957 - RNA, 23 nt, Human
ugaggccgcuagaggccugagga

SEQ ID NO: 2299958 - RNA, 16 nt, Human
ugaggccgcuagaggc

SEQ ID NO: 2299959 - RNA, 17 nt, Human
ugaggccgcuagaggcc

SEQ ID NO: 2299960 - RNA, 18 nt, Human
ugaggccgcuagaggccu

SEQ ID NO: 2299961 - RNA, 19 nt, Human
ugaggccgcuagaggccug

SEQ ID NO: 2299962 - RNA, 20 nt, Human
ugaggccgcuagaggccuga

SEQ ID NO: 2299963 - RNA, 22 nt, Human
ugaggccgcuagaggccugagg

SEQ ID NO: 2299964 - RNA, 16 nt, Human
ugaggcccuucucucc

SEQ ID NO: 2299965 - RNA, 21 nt, Human
ugaggccccuucuagguggca

SEQ ID NO: 2299966 - RNA, 18 nt, Human
ugaggcccuucucuccag

SEQ ID NO: 2299967 - RNA, 19 nt, Human
ugaggcccuucucuccagc

SEQ ID NO: 2299968 - RNA, 20 nt, Human
ugaggcccuucucuccagcc

SEQ ID NO: 2299969 - RNA, 22 nt, Human
ugaggcccuucucuccagcccc

SEQ ID NO: 2299970 - RNA, 23 nt, Human
ugaggcccuucucuccagccccu

SEQ ID NO: 2299971 - RNA, 24 nt, Human
ugaggcccuucucuccagccccug

SEQ ID NO: 2299972 - RNA, 19 nt, Human
agcagaugcaaugacucag

SEQ ID NO: 2299973 - RNA, 21 nt, Human
agcagaugcaaagaggcaaga

SEQ ID NO: 2299974 - RNA, 12 nt, Human
agcagaugcaga

SEQ ID NO: 2299975 - RNA, 13 nt, Human
agcagaugcagag

SEQ ID NO: 2299976 - RNA, 16 nt, Human
agcagaugcagagagc

SEQ ID NO: 2299977 - RNA, 17 nt, Human
agcagaugcagagagcc

SEQ ID NO: 2299978 - RNA, 18 nt, Human
agcagaugcagagagcca

SEQ ID NO: 2299979 - RNA, 19 nt, Human
agcagauggagaccccuug

SEQ ID NO: 2299980 - RNA, 21 nt, Human
agcagauggaaugcuguguua

SEQ ID NO: 2299981 - RNA, 20 nt, Human
agcagauuggagaaacccuu

SEQ ID NO: 2299982 - RNA, 21 nt, Human
agcagaugcagagagccauuu

SEQ ID NO: 2299983 - RNA, 13 nt, Human
agcagaugcuggu

SEQ ID NO: 2299984 - RNA, 18 nt, Human
agcagauuuaacaauucc

SEQ ID NO: 2299985 - RNA, 14 nt, Human
agcagaugcugguc

SEQ ID NO: 2299986 - RNA, 13 nt, Human
agcagauuuuaau

SEQ ID NO: 2299987 - RNA, 21 nt, Human
agcagauuuuaauuuugaaua

SEQ ID NO: 2299988 - RNA, 22 nt, Human
agcagauuuuaauuuugaauaa

SEQ ID NO: 2299989 - RNA, 20 nt, Human
agcagauuuuaggaaaugaa

SEQ ID NO: 2299990 - RNA, 17 nt, Human
agcagauuuuaggaaau

SEQ ID NO: 2299991 - RNA, 13 nt, Human
agcagaggcacug

SEQ ID NO: 2299992 - RNA, 21 nt, Human
agcagaggaggggccgcugcc

SEQ ID NO: 2299993 - RNA, 19 nt, Human
agcagaggaggggccgcug

SEQ ID NO: 2299994 - RNA, 22 nt, Human
agcagaggaggggccgcugcca

SEQ ID NO: 2299995 - RNA, 14 nt, Human
agcagaggcacugg

SEQ ID NO: 2299996 - RNA, 15 nt, Human
agcagaggcacuggg

SEQ ID NO: 2299997 - RNA, 17 nt, Human
agcagaggcacuggggg

SEQ ID NO: 2299998 - RNA, 15 nt, Human
agcagaggaggggcc

SEQ ID NO: 2299999 - RNA, 12 nt, Human
agcagaggaggg

SEQ ID NO: 2300000 - RNA, 16 nt, Human
agcagagcuuccucag

SEQ ID NO: 2300001 - RNA, 17 nt, Human
agcagaggaaggagagg

SEQ ID NO: 2300002 - RNA, 15 nt, Human
agcagagcucugccg

SEQ ID NO: 2300003 - RNA, 17 nt, Human
agcagaugaccccuccc

SEQ ID NO: 2300004 - RNA, 14 nt, Human
agcagaugcaaaga

SEQ ID NO: 2300005 - RNA, 13 nt, Human
agcagaugcaaag

SEQ ID NO: 2300006 - RNA, 20 nt, Human
agcagaugcaaagaggcaag

SEQ ID NO: 2300007 - RNA, 19 nt, Human
agcagaugcaaagaggcaa

SEQ ID NO: 2300008 - RNA, 18 nt, Human
agcagaugcaaagaggca

SEQ ID NO: 2300009 - RNA, 17 nt, Human
agcagaugcaaagaggc

SEQ ID NO: 2300010 - RNA, 16 nt, Human
agcagaucccagcuca

SEQ ID NO: 2300011 - RNA, 19 nt, Human
agcagauaccucacccugc

SEQ ID NO: 2300012 - RNA, 20 nt, Human
agcagauacauaugagugug

SEQ ID NO: 2300013 - RNA, 22 nt, Human
agcagauacauaugagugugga

SEQ ID NO: 2300014 - RNA, 18 nt, Human
agcagauaccucacccug

SEQ ID NO: 2300015 - RNA, 18 nt, Human
agcagagggacuuuguau

SEQ ID NO: 2300016 - RNA, 13 nt, Human
agcagaggcagcg

SEQ ID NO: 2300017 - RNA, 23 nt, Human
agcagagguggccagagcuggga

SEQ ID NO: 2300018 - RNA, 14 nt, Human
agcagaggggcuga

SEQ ID NO: 2300019 - RNA, 15 nt, Human
agcagagcaggggca

SEQ ID NO: 2300020 - RNA, 14 nt, Human
agcagagcaggggc

SEQ ID NO: 2300021 - RNA, 17 nt, Human
agcagagcaagucugca

SEQ ID NO: 2300022 - RNA, 18 nt, Human
agcagagcaagucugcag

SEQ ID NO: 2300023 - RNA, 19 nt, Human
agcagagcaagucugcagg

SEQ ID NO: 2300024 - RNA, 20 nt, Human
agcagagcaagucugcaggu

SEQ ID NO: 2300025 - RNA, 20 nt, Human
agcagagcaccuuagacagu

SEQ ID NO: 2300026 - RNA, 20 nt, Human
ugaggucaaguaagaagaca

SEQ ID NO: 2300027 - RNA, 19 nt, Human
ugagguacaaccuguucug

SEQ ID NO: 2300028 - RNA, 20 nt, Human
agcagagaccaucccugaag

SEQ ID NO: 2300029 - RNA, 17 nt, Human
ugaggucagagccugca

SEQ ID NO: 2300030 - RNA, 17 nt, Human
agcagagaccaucccug

SEQ ID NO: 2300031 - RNA, 18 nt, Human
agcagagaccaucccuga

SEQ ID NO: 2300032 - RNA, 19 nt, Human
agcagagaccaucccugaa

SEQ ID NO: 2300033 - RNA, 14 nt, Human
ugaggucagagccu

SEQ ID NO: 2300034 - RNA, 16 nt, Human
ugaggucagagccugc

SEQ ID NO: 2300035 - RNA, 13 nt, Human
ugaggucagagcc

SEQ ID NO: 2300036 - RNA, 22 nt, Human
ugagguacugagagugaacaaa

SEQ ID NO: 2300037 - RNA, 21 nt, Human
ugagggugcuuguucccucuc

SEQ ID NO: 2300038 - RNA, 18 nt, Human
ugaggguuucagagagcc

SEQ ID NO: 2300039 - RNA, 14 nt, Human
ugaggguggagacu

SEQ ID NO: 2300040 - RNA, 19 nt, Human
ugaggguuucugagcugcu

SEQ ID NO: 2300041 - RNA, 17 nt, Human
ugagguacugagaguga

SEQ ID NO: 2300042 - RNA, 19 nt, Human
ugagggucuucuuacaugc

SEQ ID NO: 2300043 - RNA, 12 nt, Human
ugagggucuucu

SEQ ID NO: 2300044 - RNA, 22 nt, Human
ugagggugacuauggagcugag

SEQ ID NO: 2300045 - RNA, 20 nt, Human
ugaggguugggcugguguca

SEQ ID NO: 2300046 - RNA, 22 nt, Human
ugaagcucuggugacaccagcc

SEQ ID NO: 2300047 - RNA, 14 nt, Human
ugaagccucuggga

SEQ ID NO: 2300048 - RNA, 13 nt, Human
ugaagccucuggg

SEQ ID NO: 2300049 - RNA, 13 nt, Human
ugaagccugcccu

SEQ ID NO: 2300050 - RNA, 22 nt, Human
ugaagcccuccaaaagcacuua

SEQ ID NO: 2300051 - RNA, 15 nt, Human
ugaagccuuagccag

SEQ ID NO: 2300052 - RNA, 15 nt, Human
ugaagcugccugcuu

SEQ ID NO: 2300053 - RNA, 16 nt, Human
ugaagcugccugcuuu

SEQ ID NO: 2300054 - RNA, 20 nt, Human
ugaagccacugaagcuggga

SEQ ID NO: 2300055 - RNA, 19 nt, Human
ugaagcauguuucauguuu

SEQ ID NO: 2300056 - RNA, 12 nt, Human
ugaagccagccu

SEQ ID NO: 2300057 - RNA, 13 nt, Human
ugaagccagccuu

SEQ ID NO: 2300058 - RNA, 14 nt, Human
ugaagccagccuuc

SEQ ID NO: 2300059 - RNA, 21 nt, Human
ugaagccagccuucuuccauc

SEQ ID NO: 2300060 - RNA, 15 nt, Human
ugaagcccaauaaac

SEQ ID NO: 2300061 - RNA, 16 nt, Human
ugaagcccuccaaaag

SEQ ID NO: 2300062 - RNA, 19 nt, Human
ugaagcccaauaaaccucu

SEQ ID NO: 2300063 - RNA, 16 nt, Human
ugaagcccaagugaaa

SEQ ID NO: 2300064 - RNA, 16 nt, Human
ugaagccagccuucuu

SEQ ID NO: 2300065 - RNA, 14 nt, Human
ugaagcauguuuca

SEQ ID NO: 2300066 - RNA, 16 nt, Human
ugaagcauguuucaug

SEQ ID NO: 2300067 - RNA, 19 nt, Human
ugaagccacugaagcuggg

SEQ ID NO: 2300068 - RNA, 20 nt, Human
ugaagcauguuucauguuuu

SEQ ID NO: 2300069 - RNA, 20 nt, Human
ugaagcagguucccaagcuc

SEQ ID NO: 2300070 - RNA, 14 nt, Human
ugaagcaguugugu

SEQ ID NO: 2300071 - RNA, 17 nt, Human
ugaagcaguugugucag

SEQ ID NO: 2300072 - RNA, 19 nt, Human
ugaagcagguucccaagcu

SEQ ID NO: 2300073 - RNA, 19 nt, Human
ugaagcaggagaaucacuu

SEQ ID NO: 2300074 - RNA, 23 nt, Human
ugaagcagaugcaaagaggcaag

SEQ ID NO: 2300075 - RNA, 22 nt, Human
ugaagcagaugcaaagaggcaa

SEQ ID NO: 2300076 - RNA, 19 nt, Human
ugaagcagaugcaaagagg

SEQ ID NO: 2300077 - RNA, 19 nt, Human
ugaagauucuccugugcua

SEQ ID NO: 2300078 - RNA, 16 nt, Human
ugaagauucuuuccca

SEQ ID NO: 2300079 - RNA, 13 nt, Human
ugaagcagccucu

SEQ ID NO: 2300080 - RNA, 15 nt, Human
ugaagcagccucucc

SEQ ID NO: 2300081 - RNA, 20 nt, Human
ugaagcagccucuccccagg

SEQ ID NO: 2300082 - RNA, 17 nt, Human
ugaagcagcuuuaaaca

SEQ ID NO: 2300083 - RNA, 19 nt, Human
ugaagcagcuuuaaacaaa

SEQ ID NO: 2300084 - RNA, 16 nt, Human
ugaagaugucuaauag

SEQ ID NO: 2300085 - RNA, 15 nt, Human
ugaagauucuccugu

SEQ ID NO: 2300086 - RNA, 18 nt, Human
ugaagauucuccugugcu

SEQ ID NO: 2300087 - RNA, 18 nt, Human
ugaagauguagaggagaa

SEQ ID NO: 2300088 - RNA, 12 nt, Human
agaggugccagc

SEQ ID NO: 2300089 - RNA, 14 nt, Human
agaggugccagcaa

SEQ ID NO: 2300090 - RNA, 16 nt, Human
agaggugccagcaacu

SEQ ID NO: 2300091 - RNA, 18 nt, Human
agaggugccagcaacuga

SEQ ID NO: 2300092 - RNA, 19 nt, Human
agaggugccagcaacugaa

SEQ ID NO: 2300093 - RNA, 20 nt, Human
agaggugccagcaacugaau

SEQ ID NO: 2300094 - RNA, 21 nt, Human
agaggugccagcaacugaaua

SEQ ID NO: 2300095 - RNA, 12 nt, Human
agaggugggcag

SEQ ID NO: 2300096 - RNA, 18 nt, Human
agagguggccagagcugg

SEQ ID NO: 2300097 - RNA, 13 nt, Human
agagguggccaga

SEQ ID NO: 2300098 - RNA, 22 nt, Human
agaggugccagcaacugaauaa

SEQ ID NO: 2300099 - RNA, 17 nt, Human
ugaagauguagaggaga

SEQ ID NO: 2300100 - RNA, 13 nt, Human
agaggugggccag

SEQ ID NO: 2300101 - RNA, 21 nt, Human
agaggugggccagucugugga

SEQ ID NO: 2300102 - RNA, 13 nt, Human
agaggugggcagg

SEQ ID NO: 2300103 - RNA, 14 nt, Human
agaggugggcaggu

SEQ ID NO: 2300104 - RNA, 17 nt, Human
agaggugggcagguggu

SEQ ID NO: 2300105 - RNA, 19 nt, Human
agaggugggcagguggugg

SEQ ID NO: 2300106 - RNA, 19 nt, Human
agagggaccucucccaggg

SEQ ID NO: 2300107 - RNA, 16 nt, Human
agagggaccucuccca

SEQ ID NO: 2300108 - RNA, 15 nt, Human
agagggaccucuccc

SEQ ID NO: 2300109 - RNA, 17 nt, Human
agagggaagagugcauu

SEQ ID NO: 2300110 - RNA, 12 nt, Human
agagggacagau

SEQ ID NO: 2300111 - RNA, 21 nt, Human
agagggagggagggcuccaga

SEQ ID NO: 2300112 - RNA, 20 nt, Human
agagggagggagggcuccag

SEQ ID NO: 2300113 - RNA, 19 nt, Human
agaggucuuuuuuaaaagg

SEQ ID NO: 2300114 - RNA, 20 nt, Human
agagggaggggccuaggccu

SEQ ID NO: 2300115 - RNA, 18 nt, Human
agagggaggggccuaggc

SEQ ID NO: 2300116 - RNA, 16 nt, Human
agagggaggggccuag

SEQ ID NO: 2300117 - RNA, 14 nt, Human
agaggugagggaag

SEQ ID NO: 2300118 - RNA, 22 nt, Human
agagggagggagggcuccagac

SEQ ID NO: 2300119 - RNA, 14 nt, Human
agagggaggggccu

SEQ ID NO: 2300120 - RNA, 13 nt, Human
agagggaggggcc

SEQ ID NO: 2300121 - RNA, 15 nt, Human
agagggacgccuggg

SEQ ID NO: 2300122 - RNA, 21 nt, Human
agagggacgccugggggugcc

SEQ ID NO: 2300123 - RNA, 13 nt, Human
agaggcagagaaa

SEQ ID NO: 2300124 - RNA, 14 nt, Human
agaggcagagaaag

SEQ ID NO: 2300125 - RNA, 17 nt, Human
agaggcagagaaagaag

SEQ ID NO: 2300126 - RNA, 18 nt, Human
agaggcagagaaagaaga

SEQ ID NO: 2300127 - RNA, 20 nt, Human
agaggcagagaaagaagaga

SEQ ID NO: 2300128 - RNA, 21 nt, Human
agaggcagagaaagaagagac

SEQ ID NO: 2300129 - RNA, 21 nt, Human
agaggcgcaugaauuugugaa

SEQ ID NO: 2300130 - RNA, 24 nt, Human
agaggcaccacuaaaagaucgcag

SEQ ID NO: 2300131 - RNA, 19 nt, Human
agaggaaauauugcugggg

SEQ ID NO: 2300132 - RNA, 20 nt, Human
agaggaaauauugcuggggu

SEQ ID NO: 2300133 - RNA, 21 nt, Human
agaggauuuuuuucugagcga

SEQ ID NO: 2300134 - RNA, 20 nt, Human
agaggcagaaaauugcacaa

SEQ ID NO: 2300135 - RNA, 18 nt, Human
agaggcagaaaauugcac

SEQ ID NO: 2300136 - RNA, 18 nt, Human
agaggcaccugucccaga

SEQ ID NO: 2300137 - RNA, 19 nt, Human
agaggccuuuuggaaugug

SEQ ID NO: 2300138 - RNA, 13 nt, Human
agaggcgggccag

SEQ ID NO: 2300139 - RNA, 14 nt, Human
agaggcgggccagc

SEQ ID NO: 2300140 - RNA, 15 nt, Human
agaggcgggccagcc

SEQ ID NO: 2300141 - RNA, 16 nt, Human
agaggcgggccagcca

SEQ ID NO: 2300142 - RNA, 16 nt, Human
agaggcgucuguauau

SEQ ID NO: 2300143 - RNA, 17 nt, Human
agaggcgggccagccag

SEQ ID NO: 2300144 - RNA, 18 nt, Human
agaggcgggccagccagg

SEQ ID NO: 2300145 - RNA, 19 nt, Human
agaggcgggccagccaggc

SEQ ID NO: 2300146 - RNA, 20 nt, Human
agaggcgggccagccaggcg

SEQ ID NO: 2300147 - RNA, 23 nt, Human
agagggaagaaaagagcuuucuu

SEQ ID NO: 2300148 - RNA, 15 nt, Human
agagggaagaaaaga

SEQ ID NO: 2300149 - RNA, 14 nt, Human
agagggaagaaaag

SEQ ID NO: 2300150 - RNA, 19 nt, Human
agaggcuagcuucugcuuu

SEQ ID NO: 2300151 - RNA, 21 nt, Human
agaggcuaaauuacucaggaa

SEQ ID NO: 2300152 - RNA, 17 nt, Human
agaggcuagcuucugcu

SEQ ID NO: 2300153 - RNA, 19 nt, Human
agaggcuaaauuacucagg

SEQ ID NO: 2300154 - RNA, 16 nt, Human
agaggcuagcuucugc

SEQ ID NO: 2300155 - RNA, 21 nt, Human
agaggcuucuucagaucagug

SEQ ID NO: 2300156 - RNA, 11 nt, Human
ugaagaagaga

SEQ ID NO: 2300157 - RNA, 23 nt, Human
ugaagaacugcaggcccuggccu

SEQ ID NO: 2300158 - RNA, 22 nt, Human
ugaagaagcaccaaucaugaau

SEQ ID NO: 2300159 - RNA, 11 nt, Human
ugaagacaaug

SEQ ID NO: 2300160 - RNA, 17 nt, Human
ugaagacaaugacuuac

SEQ ID NO: 2300161 - RNA, 13 nt, Human
ugaagacaaugac

SEQ ID NO: 2300162 - RNA, 23 nt, Human
ucuuuguaaucguuaugugugua

SEQ ID NO: 2300163 - RNA, 11 nt, Human
ugaacuuucuc

SEQ ID NO: 2300164 - RNA, 22 nt, Human
ugaacuuucucuucauacuuuu

SEQ ID NO: 2300165 - RNA, 17 nt, Human
ugaacuuugaccucugc

SEQ ID NO: 2300166 - RNA, 16 nt, Human
ugaacuuugaccucug

SEQ ID NO: 2300167 - RNA, 14 nt, Human
ugaagaagauggua

SEQ ID NO: 2300168 - RNA, 20 nt, Human
ugaagaagcaccaaucauga

SEQ ID NO: 2300169 - RNA, 23 nt, Human
ucuuuguaagaguguagaagcau

SEQ ID NO: 2300170 - RNA, 24 nt, Human
ucuuuguaagaguguagaagcauu

SEQ ID NO: 2300171 - RNA, 19 nt, Human
ucuuuguaagaguguagaa

SEQ ID NO: 2300172 - RNA, 21 nt, Human
ucuuuguaagaguguagaagc

SEQ ID NO: 2300173 - RNA, 22 nt, Human
ucuuuguaagaguguagaagca

SEQ ID NO: 2300174 - RNA, 12 nt, Human
ucuuuguaauga

SEQ ID NO: 2300175 - RNA, 14 nt, Human
ucuuuggucuacac

SEQ ID NO: 2300176 - RNA, 21 nt, Human
ucuuuggucuacacugugcug

SEQ ID NO: 2300177 - RNA, 13 nt, Human
ucuuuguaaugaa

SEQ ID NO: 2300178 - RNA, 15 nt, Human
ucuuuguaaugaaaa

SEQ ID NO: 2300179 - RNA, 11 nt, Human
ugaacuuugac

SEQ ID NO: 2300180 - RNA, 18 nt, Human
agaggcaacugcauuggc

SEQ ID NO: 2300181 - RNA, 14 nt, Human
agaggaaauaagaa

SEQ ID NO: 2300182 - RNA, 22 nt, Human
agaggaaauaagaaaaaucaug

SEQ ID NO: 2300183 - RNA, 23 nt, Human
agaggaaauaagaaaaaucaugu

SEQ ID NO: 2300184 - RNA, 21 nt, Human
agaggaaaucaccgaaaacgu

SEQ ID NO: 2300185 - RNA, 11 nt, Human
agaggaaauca

SEQ ID NO: 2300186 - RNA, 12 nt, Human
agaggaaaucac

SEQ ID NO: 2300187 - RNA, 12 nt, Human
agaggaaagcaa

SEQ ID NO: 2300188 - RNA, 16 nt, Human
agaggaaagcaaagga

SEQ ID NO: 2300189 - RNA, 18 nt, Human
agaggaaagcaaaggaga

SEQ ID NO: 2300190 - RNA, 19 nt, Human
agaggaaagcaaaggagau

SEQ ID NO: 2300191 - RNA, 13 nt, Human
agagcuggcucug

SEQ ID NO: 2300192 - RNA, 21 nt, Human
ugaagacaaugacuuacugua

SEQ ID NO: 2300193 - RNA, 15 nt, Human
agagcuggcucugag

SEQ ID NO: 2300194 - RNA, 16 nt, Human
agagcuggcucugagc

SEQ ID NO: 2300195 - RNA, 21 nt, Human
ugaacuuucucuucauacuuu

SEQ ID NO: 2300196 - RNA, 12 nt, Human
agagcugggagg

SEQ ID NO: 2300197 - RNA, 22 nt, Human
agagcugggaggcauggcccug

SEQ ID NO: 2300198 - RNA, 23 nt, Human
agagcugggaggcauggcccugg

SEQ ID NO: 2300199 - RNA, 21 nt, Human
agagcuggggcugagggaugg

SEQ ID NO: 2300200 - RNA, 13 nt, Human
agagcugggaggg

SEQ ID NO: 2300201 - RNA, 18 nt, Human
agagcuggggcugaggga

SEQ ID NO: 2300202 - RNA, 23 nt, Human
agagcugguaguuaguagcaugu

SEQ ID NO: 2300203 - RNA, 21 nt, Human
agagcugguaguuaguagcau

SEQ ID NO: 2300204 - RNA, 13 nt, Human
agagcuggugccc

SEQ ID NO: 2300205 - RNA, 19 nt, Human
agagcugggugucaagagg

SEQ ID NO: 2300206 - RNA, 15 nt, Human
agagcuggugcccgg

SEQ ID NO: 2300207 - RNA, 16 nt, Human
agagcuggugcccgga

SEQ ID NO: 2300208 - RNA, 12 nt, Human
agagcuucccug

SEQ ID NO: 2300209 - RNA, 16 nt, Human
agagcuucccugacuc

SEQ ID NO: 2300210 - RNA, 13 nt, Human
agagcuucccuga

SEQ ID NO: 2300211 - RNA, 15 nt, Human
agagcuucuggcacu

SEQ ID NO: 2300212 - RNA, 20 nt, Human
agagcuucccugacucauuc

SEQ ID NO: 2300213 - RNA, 17 nt, Human
agagcuucccugacuca

SEQ ID NO: 2300214 - RNA, 21 nt, Human
agagcuucuguugcugccuca

SEQ ID NO: 2300215 - RNA, 16 nt, Human
agaggaaaaugaauaa

SEQ ID NO: 2300216 - RNA, 17 nt, Human
agaggaaaaugaauaau

SEQ ID NO: 2300217 - RNA, 20 nt, Human
agaggaaaaugaauaauaca

SEQ ID NO: 2300218 - RNA, 20 nt, Human
agagcuucuguugcugccuc

SEQ ID NO: 2300219 - RNA, 19 nt, Human
agagcuucuguugcugccu

SEQ ID NO: 2300220 - RNA, 13 nt, Human
agaguccucugaa

SEQ ID NO: 2300221 - RNA, 12 nt, Human
agaguccucuga

SEQ ID NO: 2300222 - RNA, 23 nt, Human
ugaauguauuuauuugggagacc

SEQ ID NO: 2300223 - RNA, 19 nt, Human
ugaauguauuuauuuggga

SEQ ID NO: 2300224 - RNA, 14 nt, Human
agaguccucugaau

SEQ ID NO: 2300225 - RNA, 14 nt, Human
agaguccucuggau

SEQ ID NO: 2300226 - RNA, 14 nt, Human
agaguccugcacag

SEQ ID NO: 2300227 - RNA, 21 nt, Human
agaguccugcacaguuuucug

SEQ ID NO: 2300228 - RNA, 22 nt, Human
agagucggaacggagaaaggug

SEQ ID NO: 2300229 - RNA, 14 nt, Human
ugaaugucagugug

SEQ ID NO: 2300230 - RNA, 17 nt, Human
ugaauguauuuauuugg

SEQ ID NO: 2300231 - RNA, 15 nt, Human
ugaaugucaguguga

SEQ ID NO: 2300232 - RNA, 18 nt, Human
ugaaugucagugugacug

SEQ ID NO: 2300233 - RNA, 15 nt, Human
agagugagacucugu

SEQ ID NO: 2300234 - RNA, 16 nt, Human
agagugagacucuguc

SEQ ID NO: 2300235 - RNA, 22 nt, Human
agagugaacaaauuuacagaga

SEQ ID NO: 2300236 - RNA, 20 nt, Human
agagucucacuguugcccag

SEQ ID NO: 2300237 - RNA, 22 nt, Human
agagucucacuguugcccaggc

SEQ ID NO: 2300238 - RNA, 14 nt, Human
agagugaacaaauu

SEQ ID NO: 2300239 - RNA, 12 nt, Human
ugaagcuuccuu

SEQ ID NO: 2300240 - RNA, 13 nt, Human
ugaagcuugugua

SEQ ID NO: 2300241 - RNA, 14 nt, Human
ugaagcuuguguau

SEQ ID NO: 2300242 - RNA, 12 nt, Human
ugaagcuuuaua

SEQ ID NO: 2300243 - RNA, 15 nt, Human
ugaagcuuguguauc

SEQ ID NO: 2300244 - RNA, 23 nt, Human
ugaagcuuguguauccauuauca

SEQ ID NO: 2300245 - RNA, 14 nt, Human
ugaagcuuuauacg

SEQ ID NO: 2300246 - RNA, 23 nt, Human
ugaagcuuuauacguguagcuau

SEQ ID NO: 2300247 - RNA, 15 nt, Human
ugaaggugcugacgg

SEQ ID NO: 2300248 - RNA, 15 nt, Human
ugaaggugucagaau

SEQ ID NO: 2300249 - RNA, 15 nt, Human
ugaagguuaggauuu

SEQ ID NO: 2300250 - RNA, 14 nt, Human
ugaaggugucagaa

SEQ ID NO: 2300251 - RNA, 20 nt, Human
ugaaggugcugacggccagg

SEQ ID NO: 2300252 - RNA, 19 nt, Human
ugaaggugcugacggccag

SEQ ID NO: 2300253 - RNA, 18 nt, Human
ugaagguggaaauaaacu

SEQ ID NO: 2300254 - RNA, 13 nt, Human
ugaagguuucuga

SEQ ID NO: 2300255 - RNA, 16 nt, Human
ugaagguuucugaaaa

SEQ ID NO: 2300256 - RNA, 15 nt, Human
ugaauauaaacacua

SEQ ID NO: 2300257 - RNA, 14 nt, Human
ugaauauaaacacu

SEQ ID NO: 2300258 - RNA, 14 nt, Human
ugaagguugaagag

SEQ ID NO: 2300259 - RNA, 16 nt, Human
ugaagguuaggauuua

SEQ ID NO: 2300260 - RNA, 20 nt, Human
ugaagguuaggauuuaacag

SEQ ID NO: 2300261 - RNA, 14 nt, Human
ugaagguuuacaau

SEQ ID NO: 2300262 - RNA, 21 nt, Human
ugaagguuuacaauuuacaaa

SEQ ID NO: 2300263 - RNA, 22 nt, Human
ugaagguuuacaauuuacaaag

SEQ ID NO: 2300264 - RNA, 21 nt, Human
ugaauauaauauauuugugua

SEQ ID NO: 2300265 - RNA, 22 nt, Human
ugaauauaauauauuuguguau

SEQ ID NO: 2300266 - RNA, 16 nt, Human
ugaauauaaacacuau

SEQ ID NO: 2300267 - RNA, 22 nt, Human
ugaauauaccccuuaguguuug

SEQ ID NO: 2300268 - RNA, 21 nt, Human
ugaauauacagcaggugcuca

SEQ ID NO: 2300269 - RNA, 18 nt, Human
ugaauauauuauaaucuu

SEQ ID NO: 2300270 - RNA, 23 nt, Human
ugaagguuuacaauuuacaaagu

SEQ ID NO: 2300271 - RNA, 13 nt, Human
ugaauauccccuc

SEQ ID NO: 2300272 - RNA, 14 nt, Human
ugaauauccccucc

SEQ ID NO: 2300273 - RNA, 16 nt, Human
ugaauauccccuccca

SEQ ID NO: 2300274 - RNA, 18 nt, Human
ugaauauccccucccagu

SEQ ID NO: 2300275 - RNA, 15 nt, Human
ugaaugcauaaaaug

SEQ ID NO: 2300276 - RNA, 16 nt, Human
ugaaugcauaaaaugu

SEQ ID NO: 2300277 - RNA, 22 nt, Human
ugaaugcauuuuguuugguauu

SEQ ID NO: 2300278 - RNA, 15 nt, Human
ugaaugccacugccu

SEQ ID NO: 2300279 - RNA, 15 nt, Human
ugaaugcauuuuguu

SEQ ID NO: 2300280 - RNA, 21 nt, Human
ugaaugcauuuuguuugguau

SEQ ID NO: 2300281 - RNA, 12 nt, Human
ugaaugcauuuu

SEQ ID NO: 2300282 - RNA, 13 nt, Human
ugaaugcauuuug

SEQ ID NO: 2300283 - RNA, 14 nt, Human
ugaaugcauuuugu

SEQ ID NO: 2300284 - RNA, 21 nt, Human
ugaauggccugccuugaagcc

SEQ ID NO: 2300285 - RNA, 17 nt, Human
ugaauggccugccuuga

SEQ ID NO: 2300286 - RNA, 15 nt, Human
ugaauggccugccuu

SEQ ID NO: 2300287 - RNA, 12 nt, Human
ugaauggccugc

SEQ ID NO: 2300288 - RNA, 14 nt, Human
ugaauggauuggau

SEQ ID NO: 2300289 - RNA, 15 nt, Human
ugaauggauuggauu

SEQ ID NO: 2300290 - RNA, 17 nt, Human
ugaauggauuggauuau

SEQ ID NO: 2300291 - RNA, 20 nt, Human
ugaauggauuggauuauuua

SEQ ID NO: 2300292 - RNA, 21 nt, Human
ugaauggauuggauuauuuaa

SEQ ID NO: 2300293 - RNA, 22 nt, Human
ugaauggauuggauuauuuaau

SEQ ID NO: 2300294 - RNA, 23 nt, Human
ugaauggauuggauuauuuaaua

SEQ ID NO: 2300295 - RNA, 23 nt, Human
ugaaugcccacaggcaaaugcau

SEQ ID NO: 2300296 - RNA, 21 nt, Human
ugaaugcuuauagguggccuc

SEQ ID NO: 2300297 - RNA, 21 nt, Human
ugaaugccacugccuucgcuu

SEQ ID NO: 2300298 - RNA, 22 nt, Human
ugaaugccacugccuucgcuuc

SEQ ID NO: 2300299 - RNA, 23 nt, Human
ugaaugcuuuuugaauguuauuu

SEQ ID NO: 2300300 - RNA, 18 nt, Human
ugaaugcuuuuugaaugu

SEQ ID NO: 2300301 - RNA, 19 nt, Human
ugaaugcuuuuugaauguu

SEQ ID NO: 2300302 - RNA, 12 nt, Human
ugaaugcuuuuu

SEQ ID NO: 2300303 - RNA, 18 nt, Human
agaucacguuccuucccc

SEQ ID NO: 2300304 - RNA, 21 nt, Human
agaucacgcuccccgccuguu

SEQ ID NO: 2300305 - RNA, 22 nt, Human
agaucacgcuccccgccuguuc

SEQ ID NO: 2300306 - RNA, 23 nt, Human
agaucacgcuccccgccuguucc

SEQ ID NO: 2300307 - RNA, 14 nt, Human
agaucacuacugca

SEQ ID NO: 2300308 - RNA, 15 nt, Human
agaucacuacugcag

SEQ ID NO: 2300309 - RNA, 11 nt, Human
agaucacuuuc

SEQ ID NO: 2300310 - RNA, 21 nt, Human
agaucaaccccuucgcuccug

SEQ ID NO: 2300311 - RNA, 13 nt, Human
agauauuuuuucu

SEQ ID NO: 2300312 - RNA, 22 nt, Human
agauauuuuuucagaaauaugu

SEQ ID NO: 2300313 - RNA, 21 nt, Human
agauauuuuuucagaaauaug

SEQ ID NO: 2300314 - RNA, 19 nt, Human
agauauuuuuucagaaaua

SEQ ID NO: 2300315 - RNA, 15 nt, Human
agaucaagagaucaa

SEQ ID NO: 2300316 - RNA, 18 nt, Human
agauauuuuuucagaaau

SEQ ID NO: 2300317 - RNA, 16 nt, Human
agauacgacuuuauuu

SEQ ID NO: 2300318 - RNA, 19 nt, Human
agauauuuuuccauuuuuu

SEQ ID NO: 2300319 - RNA, 16 nt, Human
agauauuuuucaugau

SEQ ID NO: 2300320 - RNA, 19 nt, Human
agauauuuuucaugauuuu

SEQ ID NO: 2300321 - RNA, 12 nt, Human
agauauuuuuca

SEQ ID NO: 2300322 - RNA, 13 nt, Human
agauauuuuucau

SEQ ID NO: 2300323 - RNA, 21 nt, Human
agauauuuuuaucuuuauaug

SEQ ID NO: 2300324 - RNA, 20 nt, Human
agauauuuuuaucuuuauau

SEQ ID NO: 2300325 - RNA, 14 nt, Human
agaucaaccccuuc

SEQ ID NO: 2300326 - RNA, 19 nt, Human
agaucaaccccuucgcucc

SEQ ID NO: 2300327 - RNA, 14 nt, Human
agauacgacuuuau

SEQ ID NO: 2300328 - RNA, 19 nt, Human
agauauuuuuaucuuuaua

SEQ ID NO: 2300329 - RNA, 17 nt, Human
agauauuuuuaucuuua

SEQ ID NO: 2300330 - RNA, 22 nt, Human
agauauuuugcuuugugauuuu

SEQ ID NO: 2300331 - RNA, 19 nt, Human
agauaccagguugaaagac

SEQ ID NO: 2300332 - RNA, 18 nt, Human
agauaccagguugaaaga

SEQ ID NO: 2300333 - RNA, 19 nt, Human
agauaccuaaaagagauuu

SEQ ID NO: 2300334 - RNA, 22 nt, Human
agauaccuaaaagagauuucaa

SEQ ID NO: 2300335 - RNA, 13 nt, Human
agauaccucaccc

SEQ ID NO: 2300336 - RNA, 14 nt, Human
agauaccucacccu

SEQ ID NO: 2300337 - RNA, 17 nt, Human
agauaccucacccugcu

SEQ ID NO: 2300338 - RNA, 19 nt, Human
agauacaggaaaagcugcu

SEQ ID NO: 2300339 - RNA, 18 nt, Human
agauacagaacucuuuca

SEQ ID NO: 2300340 - RNA, 15 nt, Human
agauacaauguauuu

SEQ ID NO: 2300341 - RNA, 16 nt, Human
agauacaauguauuua

SEQ ID NO: 2300342 - RNA, 13 nt, Human
agauacaauguau

SEQ ID NO: 2300343 - RNA, 20 nt, Human
agauacagaacucuuucaaa

SEQ ID NO: 2300344 - RNA, 21 nt, Human
agauacaugguugugaccuga

SEQ ID NO: 2300345 - RNA, 23 nt, Human
agauacaauguauuuauuuaaaa

SEQ ID NO: 2300346 - RNA, 23 nt, Human
agauaccagcgaggaggcuccag

SEQ ID NO: 2300347 - RNA, 21 nt, Human
agauaccagcgaggaggcucc

SEQ ID NO: 2300348 - RNA, 19 nt, Human
agauaccagcgaggaggcu

SEQ ID NO: 2300349 - RNA, 14 nt, Human
agauaccagcgagg

SEQ ID NO: 2300350 - RNA, 17 nt, Human
agauaaagauuucuuga

SEQ ID NO: 2300351 - RNA, 14 nt, Human
agauaaagauuucu

SEQ ID NO: 2300352 - RNA, 17 nt, Human
agauaaggguaucuggu

SEQ ID NO: 2300353 - RNA, 19 nt, Human
agauaaggguaucugguga

SEQ ID NO: 2300354 - RNA, 13 nt, Human
agauaaacucaga

SEQ ID NO: 2300355 - RNA, 21 nt, Human
agauaaaauuauagaugggaa

SEQ ID NO: 2300356 - RNA, 22 nt, Human
agauaaaauuauagaugggaau

SEQ ID NO: 2300357 - RNA, 19 nt, Human
agauaaacucagaaauuua

SEQ ID NO: 2300358 - RNA, 11 nt, Human
agauaaagaug

SEQ ID NO: 2300359 - RNA, 16 nt, Human
agauaaagaugaucua

SEQ ID NO: 2300360 - RNA, 13 nt, Human
agauaaagaugau

SEQ ID NO: 2300361 - RNA, 15 nt, Human
agauaaagaugaucu

SEQ ID NO: 2300362 - RNA, 14 nt, Human
agagugagagggca

SEQ ID NO: 2300363 - RNA, 18 nt, Human
agagugagacucagucuu

SEQ ID NO: 2300364 - RNA, 15 nt, Human
agagugagacccugu

SEQ ID NO: 2300365 - RNA, 19 nt, Human
agagugagacucugucuca

SEQ ID NO: 2300366 - RNA, 21 nt, Human
agagugagagggcaugcgcac

SEQ ID NO: 2300367 - RNA, 18 nt, Human
agagugagggccugaggu

SEQ ID NO: 2300368 - RNA, 21 nt, Human
agaguuuuggaugcagugcuc

SEQ ID NO: 2300369 - RNA, 13 nt, Human
agaguuuugucuu

SEQ ID NO: 2300370 - RNA, 14 nt, Human
agaguuuugucuug

SEQ ID NO: 2300371 - RNA, 16 nt, Human
agaguuuugucuugaa

SEQ ID NO: 2300372 - RNA, 19 nt, Human
agaguuuugucuugaaugu

SEQ ID NO: 2300373 - RNA, 17 nt, Human
agauaaucagccucuua

SEQ ID NO: 2300374 - RNA, 16 nt, Human
agauaaucagccucuu

SEQ ID NO: 2300375 - RNA, 19 nt, Human
agauaaucagugugucuaa

SEQ ID NO: 2300376 - RNA, 15 nt, Human
agauaaucagccucu

SEQ ID NO: 2300377 - RNA, 16 nt, Human
agauaauaauauaugu

SEQ ID NO: 2300378 - RNA, 17 nt, Human
agauaauaauauauguu

SEQ ID NO: 2300379 - RNA, 14 nt, Human
agauaauaauauau

SEQ ID NO: 2300380 - RNA, 20 nt, Human
agauaaguguauuuuucaau

SEQ ID NO: 2300381 - RNA, 18 nt, Human
agauaaguguauuuuuca

SEQ ID NO: 2300382 - RNA, 16 nt, Human
agauaaguguauuuuu

SEQ ID NO: 2300383 - RNA, 16 nt, Human
agauaaucuagaacac

SEQ ID NO: 2300384 - RNA, 23 nt, Human
agauaaucuagaacacaggcaaa

SEQ ID NO: 2300385 - RNA, 15 nt, Human
agauaaucucucagc

SEQ ID NO: 2300386 - RNA, 12 nt, Human
agauaaugugaa

SEQ ID NO: 2300387 - RNA, 18 nt, Human
agauaaugugaaaauggu

SEQ ID NO: 2300388 - RNA, 13 nt, Human
agauaaugugaaa

SEQ ID NO: 2300389 - RNA, 18 nt, Human
agauaauucuagcuuuga

SEQ ID NO: 2300390 - RNA, 12 nt, Human
agauaauuauaa

SEQ ID NO: 2300391 - RNA, 19 nt, Human
agauaaugugauauuauac

SEQ ID NO: 2300392 - RNA, 21 nt, Human
agauaauguuagagguuuuaa

SEQ ID NO: 2300393 - RNA, 15 nt, Human
agauccuuccuuuug

SEQ ID NO: 2300394 - RNA, 14 nt, Human
agauccuuguuuca

SEQ ID NO: 2300395 - RNA, 15 nt, Human
agauccuuguuucaa

SEQ ID NO: 2300396 - RNA, 21 nt, Human
agauccugucuuuaaggaaaa

SEQ ID NO: 2300397 - RNA, 12 nt, Human
agauccaggacu

SEQ ID NO: 2300398 - RNA, 14 nt, Human
agauccagccuggg

SEQ ID NO: 2300399 - RNA, 13 nt, Human
agauccagccugg

SEQ ID NO: 2300400 - RNA, 15 nt, Human
agaucgcgccacugc

SEQ ID NO: 2300401 - RNA, 20 nt, Human
agaucgcgccacugcacucc

SEQ ID NO: 2300402 - RNA, 15 nt, Human
agaucgcaguuugcc

SEQ ID NO: 2300403 - RNA, 16 nt, Human
agaucgcaucauugca

SEQ ID NO: 2300404 - RNA, 15 nt, Human
agaucgcccccaccu

SEQ ID NO: 2300405 - RNA, 14 nt, Human
agaucgcaguuugc

SEQ ID NO: 2300406 - RNA, 20 nt, Human
agauccuuuaaauccuucca

SEQ ID NO: 2300407 - RNA, 18 nt, Human
agauccuuguuucaaaca

SEQ ID NO: 2300408 - RNA, 20 nt, Human
agauccuuguuucaaacaca

SEQ ID NO: 2300409 - RNA, 19 nt, Human
agaugaugaugaucuuuaa

SEQ ID NO: 2300410 - RNA, 21 nt, Human
agaucgugccguuacucucca

SEQ ID NO: 2300411 - RNA, 16 nt, Human
agaugauggaugccaa

SEQ ID NO: 2300412 - RNA, 19 nt, Human
agaugauggaugccaauau

SEQ ID NO: 2300413 - RNA, 17 nt, Human
agaugaugggggagggg

SEQ ID NO: 2300414 - RNA, 19 nt, Human
agaugauuuaaaagggaag

SEQ ID NO: 2300415 - RNA, 18 nt, Human
agauccacacacagagga

SEQ ID NO: 2300416 - RNA, 17 nt, Human
agauccacacacagagg

SEQ ID NO: 2300417 - RNA, 16 nt, Human
agauccacacacagag

SEQ ID NO: 2300418 - RNA, 15 nt, Human
agauccacacacaga

SEQ ID NO: 2300419 - RNA, 14 nt, Human
agauccacacacag

SEQ ID NO: 2300420 - RNA, 21 nt, Human
agauccaaaagaagcccccag

SEQ ID NO: 2300421 - RNA, 23 nt, Human
ugaccacacuuccuguccagaga

SEQ ID NO: 2300422 - RNA, 18 nt, Human
agauccaaaagaagcccc

SEQ ID NO: 2300423 - RNA, 23 nt, Human
agauccaaaagaagcccccagcu

SEQ ID NO: 2300424 - RNA, 20 nt, Human
ugaccacacuuccuguccag

SEQ ID NO: 2300425 - RNA, 18 nt, Human
ugaccacacuuccugucc

SEQ ID NO: 2300426 - RNA, 15 nt, Human
ugaccacacuuccug

SEQ ID NO: 2300427 - RNA, 21 nt, Human
agaucauugugaaauuauuca

SEQ ID NO: 2300428 - RNA, 20 nt, Human
ugaccaacauggagaaaccc

SEQ ID NO: 2300429 - RNA, 18 nt, Human
ugaccaacauggagaaac

SEQ ID NO: 2300430 - RNA, 15 nt, Human
ugaccaaugucuuga

SEQ ID NO: 2300431 - RNA, 17 nt, Human
ugaccaacauggagaaa

SEQ ID NO: 2300432 - RNA, 16 nt, Human
ugaccaacauggagaa

SEQ ID NO: 2300433 - RNA, 17 nt, Human
ugaccaacaguuccuuc

SEQ ID NO: 2300434 - RNA, 20 nt, Human
ugaccacacuccagcuggga

SEQ ID NO: 2300435 - RNA, 19 nt, Human
ugaccacacuccagcuggg

SEQ ID NO: 2300436 - RNA, 17 nt, Human
ugaccacacuccagcug

SEQ ID NO: 2300437 - RNA, 12 nt, Human
ugaccacacucc

SEQ ID NO: 2300438 - RNA, 18 nt, Human
ugaccaaaauccccuucu

SEQ ID NO: 2300439 - RNA, 16 nt, Human
ugaccaaaauccccuu

SEQ ID NO: 2300440 - RNA, 16 nt, Human
ugaccaaaguccuuuu

SEQ ID NO: 2300441 - RNA, 14 nt, Human
ugaccaaaguccuu

SEQ ID NO: 2300442 - RNA, 14 nt, Human
ugacauuuugccaa

SEQ ID NO: 2300443 - RNA, 18 nt, Human
ugacauuguagagcuucu

SEQ ID NO: 2300444 - RNA, 16 nt, Human
ugacauugcuaagaug

SEQ ID NO: 2300445 - RNA, 18 nt, Human
ugacauugcuaagaugcu

SEQ ID NO: 2300446 - RNA, 19 nt, Human
ugacauugcuaagaugcuc

SEQ ID NO: 2300447 - RNA, 13 nt, Human
ugacauugcuuua

SEQ ID NO: 2300448 - RNA, 15 nt, Human
ugacauugcuuuacu

SEQ ID NO: 2300449 - RNA, 21 nt, Human
ugacaguaguaccaaaugcuu

SEQ ID NO: 2300450 - RNA, 15 nt, Human
ugacaguccucucca

SEQ ID NO: 2300451 - RNA, 16 nt, Human
ugacaguccucuccac

SEQ ID NO: 2300452 - RNA, 17 nt, Human
ugacaguccucuccacc

SEQ ID NO: 2300453 - RNA, 14 nt, Human
ugacagugccuggg

SEQ ID NO: 2300454 - RNA, 18 nt, Human
ugacaguccucuccaccu

SEQ ID NO: 2300455 - RNA, 15 nt, Human
ugacagucuugugcu

SEQ ID NO: 2300456 - RNA, 17 nt, Human
ugacagugccugggaau

SEQ ID NO: 2300457 - RNA, 23 nt, Human
ugacagucuugugcuuuuccuau

SEQ ID NO: 2300458 - RNA, 20 nt, Human
ugacagugccugggaaugua

SEQ ID NO: 2300459 - RNA, 19 nt, Human
ugacauugcguuugaccuu

SEQ ID NO: 2300460 - RNA, 15 nt, Human
ugacauugcguuuga

SEQ ID NO: 2300461 - RNA, 17 nt, Human
ugacagguuugggaccc

SEQ ID NO: 2300462 - RNA, 14 nt, Human
ugacaguaguacca

SEQ ID NO: 2300463 - RNA, 15 nt, Human
ugaauuuauuauugu

SEQ ID NO: 2300464 - RNA, 18 nt, Human
ugaauuuauuauuguucu

SEQ ID NO: 2300465 - RNA, 20 nt, Human
ugaauuuaaauauaauucug

SEQ ID NO: 2300466 - RNA, 15 nt, Human
ugaauuuaaauauaa

SEQ ID NO: 2300467 - RNA, 16 nt, Human
ugaauuuaaauauaau

SEQ ID NO: 2300468 - RNA, 19 nt, Human
ugaauuuaaauauaauucu

SEQ ID NO: 2300469 - RNA, 19 nt, Human
ugaauuuaauaaucuguag

SEQ ID NO: 2300470 - RNA, 23 nt, Human
agaucacuuucucaguuuucaua

SEQ ID NO: 2300471 - RNA, 19 nt, Human
agaucacuuucucaguuuu

SEQ ID NO: 2300472 - RNA, 18 nt, Human
agaucacuuucucaguuu

SEQ ID NO: 2300473 - RNA, 20 nt, Human
agaucagcaaaccggggccu

SEQ ID NO: 2300474 - RNA, 17 nt, Human
agaucagagcagcagug

SEQ ID NO: 2300475 - RNA, 16 nt, Human
agaugugucuauggcu

SEQ ID NO: 2300476 - RNA, 15 nt, Human
agauguguucacaau

SEQ ID NO: 2300477 - RNA, 18 nt, Human
agauguguucacaaugga

SEQ ID NO: 2300478 - RNA, 13 nt, Human
ugacccaggcugg

SEQ ID NO: 2300479 - RNA, 12 nt, Human
ugacccaggcug

SEQ ID NO: 2300480 - RNA, 14 nt, Human
ugacccaggcuggg

SEQ ID NO: 2300481 - RNA, 15 nt, Human
ugacccaggcugggc

SEQ ID NO: 2300482 - RNA, 17 nt, Human
ugacccaggcugggcaa

SEQ ID NO: 2300483 - RNA, 19 nt, Human
ugacccaggcugggcaagg

SEQ ID NO: 2300484 - RNA, 19 nt, Human
agauguguugcuauccuga

SEQ ID NO: 2300485 - RNA, 16 nt, Human
ugacccaggccgcagc

SEQ ID NO: 2300486 - RNA, 19 nt, Human
ugacccaggccgcagcucu

SEQ ID NO: 2300487 - RNA, 21 nt, Human
ugacccaggccgcagcucuug

SEQ ID NO: 2300488 - RNA, 22 nt, Human
ugacccaggccgcagcucuugc

SEQ ID NO: 2300489 - RNA, 15 nt, Human
ugacccagucccugg

SEQ ID NO: 2300490 - RNA, 14 nt, Human
ugacccagucccug

SEQ ID NO: 2300491 - RNA, 12 nt, Human
ugacccaguccc

SEQ ID NO: 2300492 - RNA, 21 nt, Human
ugacccaguccccgugccccg

SEQ ID NO: 2300493 - RNA, 20 nt, Human
ugacccagucccugggggaa

SEQ ID NO: 2300494 - RNA, 16 nt, Human
ugacccagucccuggg

SEQ ID NO: 2300495 - RNA, 16 nt, Human
ugacccagugccccca

SEQ ID NO: 2300496 - RNA, 18 nt, Human
ugacccagugcccccacu

SEQ ID NO: 2300497 - RNA, 17 nt, Human
ugacccagugcccccac

SEQ ID NO: 2300498 - RNA, 23 nt, Human
ugacccagugcccccacugacca

SEQ ID NO: 2300499 - RNA, 14 nt, Human
ugaccucugccuga

SEQ ID NO: 2300500 - RNA, 17 nt, Human
ugaccucuguuguccuc

SEQ ID NO: 2300501 - RNA, 18 nt, Human
ugaccucuguuguccucc

SEQ ID NO: 2300502 - RNA, 19 nt, Human
ugaccucuguuguccuccc

SEQ ID NO: 2300503 - RNA, 12 nt, Human
ugaccugaggcc

SEQ ID NO: 2300504 - RNA, 22 nt, Human
ugaccucuguuguccuccccuu

SEQ ID NO: 2300505 - RNA, 21 nt, Human
ugaccucuguuguccuccccu

SEQ ID NO: 2300506 - RNA, 13 nt, Human
ugaccugaaguuc

SEQ ID NO: 2300507 - RNA, 14 nt, Human
ugaccugaaguuca

SEQ ID NO: 2300508 - RNA, 18 nt, Human
ugaccugaaguucaccau

SEQ ID NO: 2300509 - RNA, 13 nt, Human
ugaccucugccug

SEQ ID NO: 2300510 - RNA, 20 nt, Human
ugaccccucauagcccucac

SEQ ID NO: 2300511 - RNA, 19 nt, Human
ugaccccucauagcccuca

SEQ ID NO: 2300512 - RNA, 22 nt, Human
ugacccccaaccaaguggcucc

SEQ ID NO: 2300513 - RNA, 14 nt, Human
ugacccccagcucc

SEQ ID NO: 2300514 - RNA, 13 nt, Human
ugacccagugaga

SEQ ID NO: 2300515 - RNA, 17 nt, Human
ugaccccucauagcccu

SEQ ID NO: 2300516 - RNA, 18 nt, Human
agaugcaaagaggcaaga

SEQ ID NO: 2300517 - RNA, 17 nt, Human
agaugcaaagaggcaag

SEQ ID NO: 2300518 - RNA, 16 nt, Human
agaugcaaagaggcaa

SEQ ID NO: 2300519 - RNA, 15 nt, Human
agaugcaaagaggca

SEQ ID NO: 2300520 - RNA, 14 nt, Human
agaugcaaagaggc

SEQ ID NO: 2300521 - RNA, 22 nt, Human
agaugcuagaacucccuuucaa

SEQ ID NO: 2300522 - RNA, 23 nt, Human
agaugcuagaacucccuuucaac

SEQ ID NO: 2300523 - RNA, 16 nt, Human
agaugcuucugggaga

SEQ ID NO: 2300524 - RNA, 15 nt, Human
agaugcuucugggag

SEQ ID NO: 2300525 - RNA, 12 nt, Human
agaugcuucugg

SEQ ID NO: 2300526 - RNA, 16 nt, Human
agaugcuuuucugucu

SEQ ID NO: 2300527 - RNA, 17 nt, Human
agaugcuuuucugucuc

SEQ ID NO: 2300528 - RNA, 19 nt, Human
agaugcuuuucugucucug

SEQ ID NO: 2300529 - RNA, 22 nt, Human
agaugcuuuucugucucugccu

SEQ ID NO: 2300530 - RNA, 16 nt, Human
agaugcuucucacugc

SEQ ID NO: 2300531 - RNA, 18 nt, Human
agaugcuucucacugcca

SEQ ID NO: 2300532 - RNA, 20 nt, Human
agauggauucucagauauuu

SEQ ID NO: 2300533 - RNA, 18 nt, Human
agauggauucucagauau

SEQ ID NO: 2300534 - RNA, 18 nt, Human
agauggauucuccacuca

SEQ ID NO: 2300535 - RNA, 13 nt, Human
agauggauucucc

SEQ ID NO: 2300536 - RNA, 20 nt, Human
agauggauuugccugugcca

SEQ ID NO: 2300537 - RNA, 15 nt, Human
agauggauuugccug

SEQ ID NO: 2300538 - RNA, 18 nt, Human
agauggauugguguaaaa

SEQ ID NO: 2300539 - RNA, 23 nt, Human
agauggauucuccacucaguugc

SEQ ID NO: 2300540 - RNA, 16 nt, Human
agauggcaaaugacca

SEQ ID NO: 2300541 - RNA, 15 nt, Human
agaugucagacuggc

SEQ ID NO: 2300542 - RNA, 17 nt, Human
agauggauucucagaua

SEQ ID NO: 2300543 - RNA, 16 nt, Human
agauggauucucagau

SEQ ID NO: 2300544 - RNA, 15 nt, Human
agauggauucucaga

SEQ ID NO: 2300545 - RNA, 11 nt, Human
agauggauucu

SEQ ID NO: 2300546 - RNA, 17 nt, Human
agauggaguucuugugc

SEQ ID NO: 2300547 - RNA, 19 nt, Human
agauggaguucuugugcca

SEQ ID NO: 2300548 - RNA, 18 nt, Human
agaugucuaauaguuauu

SEQ ID NO: 2300549 - RNA, 12 nt, Human
agaugucuauuc

SEQ ID NO: 2300550 - RNA, 22 nt, Human
agaugucucuggcgugugggua

SEQ ID NO: 2300551 - RNA, 13 nt, Human
agaugucuucgua

SEQ ID NO: 2300552 - RNA, 18 nt, Human
agaugucuucugccuguu

SEQ ID NO: 2300553 - RNA, 16 nt, Human
agaugucuucugccug

SEQ ID NO: 2300554 - RNA, 17 nt, Human
agaugucuucugccugu

SEQ ID NO: 2300555 - RNA, 15 nt, Human
agaugucuucguaca

SEQ ID NO: 2300556 - RNA, 18 nt, Human
agaugucuucguacaguu

SEQ ID NO: 2300557 - RNA, 19 nt, Human
agaugucuucguacaguuc

SEQ ID NO: 2300558 - RNA, 20 nt, Human
agaugucuucguacaguucu

SEQ ID NO: 2300559 - RNA, 18 nt, Human
agaugucagacuggcugg

SEQ ID NO: 2300560 - RNA, 20 nt, Human
agaugucagccgagccgggc

SEQ ID NO: 2300561 - RNA, 18 nt, Human
agaugucagccgagccgg

SEQ ID NO: 2300562 - RNA, 21 nt, Human
agaugucccuuucuuggccag

SEQ ID NO: 2300563 - RNA, 20 nt, Human
agaugucccuuucuuggcca

SEQ ID NO: 2300564 - RNA, 22 nt, Human
agaugucccuuucuuggccagu

SEQ ID NO: 2300565 - RNA, 20 nt, Human
agcaacagagugagacccug

SEQ ID NO: 2300566 - RNA, 23 nt, Human
agcaacagagugagacccugucu

SEQ ID NO: 2300567 - RNA, 22 nt, Human
agcaacagagugagacccuguc

SEQ ID NO: 2300568 - RNA, 18 nt, Human
agcaacacaagcuggaag

SEQ ID NO: 2300569 - RNA, 20 nt, Human
agcaacacaagcuggaagca

SEQ ID NO: 2300570 - RNA, 21 nt, Human
agcaacaauuuaugaauugaa

SEQ ID NO: 2300571 - RNA, 14 nt, Human
agcaacacaagcug

SEQ ID NO: 2300572 - RNA, 17 nt, Human
agcaacacaagcuggaa

SEQ ID NO: 2300573 - RNA, 20 nt, Human
agcaacauuuuacccacaca

SEQ ID NO: 2300574 - RNA, 18 nt, Human
agcaacagguuuuauaau

SEQ ID NO: 2300575 - RNA, 21 nt, Human
agcaacaggaaucaagagcug

SEQ ID NO: 2300576 - RNA, 22 nt, Human
agcaacaggaaucaagagcugc

SEQ ID NO: 2300577 - RNA, 23 nt, Human
agcaacaggaaucaagagcugcc

SEQ ID NO: 2300578 - RNA, 21 nt, Human
agcaacaucuagcaaauguua

SEQ ID NO: 2300579 - RNA, 19 nt, Human
agcaacagguuuuauaauu

SEQ ID NO: 2300580 - RNA, 22 nt, Human
agcaacauuuuacccacacaca

SEQ ID NO: 2300581 - RNA, 15 nt, Human
agcaaccaguuggcu

SEQ ID NO: 2300582 - RNA, 14 nt, Human
agcaaccccaggcu

SEQ ID NO: 2300583 - RNA, 16 nt, Human
agcaaccccaggcuga

SEQ ID NO: 2300584 - RNA, 15 nt, Human
agcaaccccaggcug

SEQ ID NO: 2300585 - RNA, 23 nt, Human
agauuuuccacaagauucccaga

SEQ ID NO: 2300586 - RNA, 12 nt, Human
agcaaaacaaaa

SEQ ID NO: 2300587 - RNA, 15 nt, Human
agcaacaauuuauga

SEQ ID NO: 2300588 - RNA, 12 nt, Human
agauuuucagaa

SEQ ID NO: 2300589 - RNA, 19 nt, Human
agauuugugaacucagcca

SEQ ID NO: 2300590 - RNA, 21 nt, Human
agauuugugaacucagccaag

SEQ ID NO: 2300591 - RNA, 15 nt, Human
agcaaaaagcaaaau

SEQ ID NO: 2300592 - RNA, 17 nt, Human
agauuuucagaaaauau

SEQ ID NO: 2300593 - RNA, 19 nt, Human
agauuuucagcaaacucuu

SEQ ID NO: 2300594 - RNA, 22 nt, Human
agauuugugaacucagccaagc

SEQ ID NO: 2300595 - RNA, 15 nt, Human
agauuuacacuggga

SEQ ID NO: 2300596 - RNA, 16 nt, Human
agauuuacacugggag

SEQ ID NO: 2300597 - RNA, 13 nt, Human
agauuuaucaaau

SEQ ID NO: 2300598 - RNA, 17 nt, Human
agauuuaucaaaucagu

SEQ ID NO: 2300599 - RNA, 15 nt, Human
agauuuaucaaauca

SEQ ID NO: 2300600 - RNA, 16 nt, Human
agauuuaucaaaucag

SEQ ID NO: 2300601 - RNA, 13 nt, Human
agauuucacucuc

SEQ ID NO: 2300602 - RNA, 14 nt, Human
agauuucacucucc

SEQ ID NO: 2300603 - RNA, 14 nt, Human
agauuugggcugga

SEQ ID NO: 2300604 - RNA, 17 nt, Human
agauuugggcuggaaca

SEQ ID NO: 2300605 - RNA, 11 nt, Human
agauuugugaa

SEQ ID NO: 2300606 - RNA, 13 nt, Human
agauuugugaacu

SEQ ID NO: 2300607 - RNA, 15 nt, Human
agauuugugaacuca

SEQ ID NO: 2300608 - RNA, 16 nt, Human
agauuugugaacucag

SEQ ID NO: 2300609 - RNA, 13 nt, Human
agauuugggcugg

SEQ ID NO: 2300610 - RNA, 16 nt, Human
agauuugaaggucugc

SEQ ID NO: 2300611 - RNA, 14 nt, Human
agauuucaagagau

SEQ ID NO: 2300612 - RNA, 13 nt, Human
agauuucaagaga

SEQ ID NO: 2300613 - RNA, 12 nt, Human
agauuugaccua

SEQ ID NO: 2300614 - RNA, 18 nt, Human
agauuuagugaaagcuag

SEQ ID NO: 2300615 - RNA, 13 nt, Human
agauuuaauuaau

SEQ ID NO: 2300616 - RNA, 22 nt, Human
agauuuaauuaaucaugaaugu

SEQ ID NO: 2300617 - RNA, 14 nt, Human
agauuuaugcauau

SEQ ID NO: 2300618 - RNA, 18 nt, Human
agauugugaauauuucca

SEQ ID NO: 2300619 - RNA, 16 nt, Human
agauuuaccacuugug

SEQ ID NO: 2300620 - RNA, 17 nt, Human
agauucacacugucugg

SEQ ID NO: 2300621 - RNA, 23 nt, Human
agauuggcucacacugagaaugu

SEQ ID NO: 2300622 - RNA, 13 nt, Human
agauucacacugu

SEQ ID NO: 2300623 - RNA, 12 nt, Human
agauugggucua

SEQ ID NO: 2300624 - RNA, 21 nt, Human
agauugugccccugcacucca

SEQ ID NO: 2300625 - RNA, 16 nt, Human
agauugugccccugca

SEQ ID NO: 2300626 - RNA, 17 nt, Human
ugacuugacagaacacu

SEQ ID NO: 2300627 - RNA, 19 nt, Human
ugacuugacagaacacugu

SEQ ID NO: 2300628 - RNA, 18 nt, Human
ugacuucugccuggagac

SEQ ID NO: 2300629 - RNA, 16 nt, Human
ugacuugacuuuaguc

SEQ ID NO: 2300630 - RNA, 13 nt, Human
ugacuugcccagu

SEQ ID NO: 2300631 - RNA, 18 nt, Human
ugacuuggggagauggag

SEQ ID NO: 2300632 - RNA, 19 nt, Human
ugacuuggggagauggagu

SEQ ID NO: 2300633 - RNA, 12 nt, Human
ugacuuguauau

SEQ ID NO: 2300634 - RNA, 19 nt, Human
ugacuuguauauuuuaaga

SEQ ID NO: 2300635 - RNA, 15 nt, Human
ugacuugugucccau

SEQ ID NO: 2300636 - RNA, 14 nt, Human
ugacuuccacaccu

SEQ ID NO: 2300637 - RNA, 21 nt, Human
ugacuucaggggcugcccgcu

SEQ ID NO: 2300638 - RNA, 20 nt, Human
ugacuucgacugugaccugu

SEQ ID NO: 2300639 - RNA, 22 nt, Human
ugacuucauuaauaauaaauuc

SEQ ID NO: 2300640 - RNA, 22 nt, Human
ugacuucaggggcugcccgcuc

SEQ ID NO: 2300641 - RNA, 23 nt, Human
ugacuucaaugauaguaagaaaa

SEQ ID NO: 2300642 - RNA, 13 nt, Human
ugacuucaggggc

SEQ ID NO: 2300643 - RNA, 17 nt, Human
ugacuucaggggcugcc

SEQ ID NO: 2300644 - RNA, 18 nt, Human
ugacuucaggggcugccc

SEQ ID NO: 2300645 - RNA, 14 nt, Human
ugacuucuccaggu

SEQ ID NO: 2300646 - RNA, 23 nt, Human
ugacuucuccaggucucacgggc

SEQ ID NO: 2300647 - RNA, 15 nt, Human
ugacuucuccagguc

SEQ ID NO: 2300648 - RNA, 16 nt, Human
ugacuucuccaggucu

SEQ ID NO: 2300649 - RNA, 12 nt, Human
ugacuucugccu

SEQ ID NO: 2300650 - RNA, 13 nt, Human
ugacuucugccug

SEQ ID NO: 2300651 - RNA, 15 nt, Human
ugacuucugccugga

SEQ ID NO: 2300652 - RNA, 16 nt, Human
ugacuucugccuggag

SEQ ID NO: 2300653 - RNA, 20 nt, Human
agauuauggagcuuuuuucc

SEQ ID NO: 2300654 - RNA, 22 nt, Human
agauucacaccugacucugaaa

SEQ ID NO: 2300655 - RNA, 16 nt, Human
agauucaaucccagga

SEQ ID NO: 2300656 - RNA, 20 nt, Human
agauuauaggcaccuaccac

SEQ ID NO: 2300657 - RNA, 12 nt, Human
ugacuuucaggu

SEQ ID NO: 2300658 - RNA, 18 nt, Human
ugacuuuauauggaugau

SEQ ID NO: 2300659 - RNA, 19 nt, Human
ugacuuuagucugcaaaau

SEQ ID NO: 2300660 - RNA, 18 nt, Human
ugacuuuagucugcaaaa

SEQ ID NO: 2300661 - RNA, 20 nt, Human
ugacuuauuuauauaaauuu

SEQ ID NO: 2300662 - RNA, 17 nt, Human
ugacuuauuuauauaaa

SEQ ID NO: 2300663 - RNA, 21 nt, Human
ugacuuauuuauauaaauuuu

SEQ ID NO: 2300664 - RNA, 18 nt, Human
ugacuguucaagagcaca

SEQ ID NO: 2300665 - RNA, 18 nt, Human
ugacuuauuuucucugug

SEQ ID NO: 2300666 - RNA, 19 nt, Human
ugacuuauuuucucugugu

SEQ ID NO: 2300667 - RNA, 17 nt, Human
ugacuucaaugauagua

SEQ ID NO: 2300668 - RNA, 14 nt, Human
ugacuccaggagag

SEQ ID NO: 2300669 - RNA, 11 nt, Human
ugacugugugu

SEQ ID NO: 2300670 - RNA, 24 nt, Human
ugacuguucaagagcacacuuggc

SEQ ID NO: 2300671 - RNA, 15 nt, Human
ugacuguuuccauca

SEQ ID NO: 2300672 - RNA, 12 nt, Human
ugacuccaggag

SEQ ID NO: 2300673 - RNA, 13 nt, Human
ugacucauccucu

SEQ ID NO: 2300674 - RNA, 11 nt, Human
ugacuccagga

SEQ ID NO: 2300675 - RNA, 17 nt, Human
ugacugucacuguuccu

SEQ ID NO: 2300676 - RNA, 16 nt, Human
ugacugucacuguucc

SEQ ID NO: 2300677 - RNA, 13 nt, Human
ugacugucacugu

SEQ ID NO: 2300678 - RNA, 20 nt, Human
ugacuccagaauuucccaaa

SEQ ID NO: 2300679 - RNA, 23 nt, Human
ugacuccagaauuucccaaagca

SEQ ID NO: 2300680 - RNA, 16 nt, Human
ugacucagaugucucu

SEQ ID NO: 2300681 - RNA, 21 nt, Human
ugacucagcauaccugcuggu

SEQ ID NO: 2300682 - RNA, 18 nt, Human
ugacucacuuaucccaag

SEQ ID NO: 2300683 - RNA, 15 nt, Human
ugaccugaggaagcg

SEQ ID NO: 2300684 - RNA, 14 nt, Human
ugaccugaggaagc

SEQ ID NO: 2300685 - RNA, 17 nt, Human
ugaccugaggcccuucu

SEQ ID NO: 2300686 - RNA, 14 nt, Human
ugaccugaggcccu

SEQ ID NO: 2300687 - RNA, 15 nt, Human
ugaccugaggcccuu

SEQ ID NO: 2300688 - RNA, 17 nt, Human
ugacuccagaauuuccc

SEQ ID NO: 2300689 - RNA, 19 nt, Human
ugacuccagaauuucccaa

SEQ ID NO: 2300690 - RNA, 20 nt, Human
ugacucauucugaaggagcc

SEQ ID NO: 2300691 - RNA, 19 nt, Human
ugacucagggcuccugggu

SEQ ID NO: 2300692 - RNA, 18 nt, Human
ugacucagggcuccuggg

SEQ ID NO: 2300693 - RNA, 17 nt, Human
ugacucagggcuccugg

SEQ ID NO: 2300694 - RNA, 15 nt, Human
ugacucagggcuccu

SEQ ID NO: 2300695 - RNA, 14 nt, Human
ugacucagggcucc

SEQ ID NO: 2300696 - RNA, 13 nt, Human
ugacucagggcuc

SEQ ID NO: 2300697 - RNA, 15 nt, Human
acccuucuccucuug

SEQ ID NO: 2300698 - RNA, 17 nt, Human
acccuucuccucuugua

SEQ ID NO: 2300699 - RNA, 19 nt, Human
acccuucuccucuuguaaa

SEQ ID NO: 2300700 - RNA, 21 nt, Human
acccuucuccucuuguaaaua

SEQ ID NO: 2300701 - RNA, 19 nt, Human
acccuuccucaccacuucc

SEQ ID NO: 2300702 - RNA, 22 nt, Human
acccuuccccuccuucucccuu

SEQ ID NO: 2300703 - RNA, 19 nt, Human
acccuucccuugagcccuc

SEQ ID NO: 2300704 - RNA, 20 nt, Human
acccuucccuugagcccucu

SEQ ID NO: 2300705 - RNA, 21 nt, Human
acccuucacauacccuccccc

SEQ ID NO: 2300706 - RNA, 12 nt, Human
acccuuugcccc

SEQ ID NO: 2300707 - RNA, 20 nt, Human
acccuuugaauuggacaaua

SEQ ID NO: 2300708 - RNA, 15 nt, Human
acccuugugguccca

SEQ ID NO: 2300709 - RNA, 19 nt, Human
acccuuguggucccacccc

SEQ ID NO: 2300710 - RNA, 16 nt, Human
acccuuguggucccac

SEQ ID NO: 2300711 - RNA, 17 nt, Human
acccuuguggucccacc

SEQ ID NO: 2300712 - RNA, 18 nt, Human
acccugccccugccccgu

SEQ ID NO: 2300713 - RNA, 15 nt, Human
acccugccccugccc

SEQ ID NO: 2300714 - RNA, 13 nt, Human
acccucuucaugg

SEQ ID NO: 2300715 - RNA, 14 nt, Human
acccucuuagaaaa

SEQ ID NO: 2300716 - RNA, 23 nt, Human
acccucuggagggguguggcucc

SEQ ID NO: 2300717 - RNA, 19 nt, Human
acccucugccaccagagac

SEQ ID NO: 2300718 - RNA, 14 nt, Human
acccugcccugugg

SEQ ID NO: 2300719 - RNA, 13 nt, Human
acccugcccugug

SEQ ID NO: 2300720 - RNA, 11 nt, Human
acccugcccug

SEQ ID NO: 2300721 - RNA, 12 nt, Human
acccugcccugu

SEQ ID NO: 2300722 - RNA, 17 nt, Human
acccuccuaucaccucc

SEQ ID NO: 2300723 - RNA, 14 nt, Human
acccucccuggagu

SEQ ID NO: 2300724 - RNA, 22 nt, Human
acccuccgccuucacuccggug

SEQ ID NO: 2300725 - RNA, 15 nt, Human
acccuccgccuucac

SEQ ID NO: 2300726 - RNA, 15 nt, Human
acccucccuggagug

SEQ ID NO: 2300727 - RNA, 12 nt, Human
acccucccugcu

SEQ ID NO: 2300728 - RNA, 13 nt, Human
acccucccugcug

SEQ ID NO: 2300729 - RNA, 14 nt, Human
acccucccugcugu

SEQ ID NO: 2300730 - RNA, 15 nt, Human
acccucccugcuguc

SEQ ID NO: 2300731 - RNA, 20 nt, Human
acccucccugcuguccccuc

SEQ ID NO: 2300732 - RNA, 21 nt, Human
acccucccugcuguccccucu

SEQ ID NO: 2300733 - RNA, 12 nt, Human
acccucccugga

SEQ ID NO: 2300734 - RNA, 13 nt, Human
acccucccuggag

SEQ ID NO: 2300735 - RNA, 21 nt, Human
acccuccuaucaccuccccuc

SEQ ID NO: 2300736 - RNA, 19 nt, Human
acccuccuccagaccauuc

SEQ ID NO: 2300737 - RNA, 13 nt, Human
acccuccuggcuc

SEQ ID NO: 2300738 - RNA, 11 nt, Human
acccuccuggc

SEQ ID NO: 2300739 - RNA, 14 nt, Human
acccuccuguaaau

SEQ ID NO: 2300740 - RNA, 17 nt, Human
acccuccuguaaauggu

SEQ ID NO: 2300741 - RNA, 21 nt, Human
acccuccuguaaaugguguac

SEQ ID NO: 2300742 - RNA, 13 nt, Human
acccuccugucuu

SEQ ID NO: 2300743 - RNA, 16 nt, Human
acccuccugucuuccc

SEQ ID NO: 2300744 - RNA, 18 nt, Human
acccuccugucuucccag

SEQ ID NO: 2300745 - RNA, 20 nt, Human
acccucugccaccagagacc

SEQ ID NO: 2300746 - RNA, 13 nt, Human
acccucccacccc

SEQ ID NO: 2300747 - RNA, 12 nt, Human
acccucccaccc

SEQ ID NO: 2300748 - RNA, 15 nt, Human
acccuccacucuccu

SEQ ID NO: 2300749 - RNA, 23 nt, Human
acccucccacccccuucucugcu

SEQ ID NO: 2300750 - RNA, 23 nt, Human
acccuccacccugucccccagcu

SEQ ID NO: 2300751 - RNA, 13 nt, Human
acccucccagacc

SEQ ID NO: 2300752 - RNA, 20 nt, Human
acccucccacccccuucucu

SEQ ID NO: 2300753 - RNA, 14 nt, Human
acccucccaccccc

SEQ ID NO: 2300754 - RNA, 16 nt, Human
acccucccauggcacc

SEQ ID NO: 2300755 - RNA, 15 nt, Human
acccucccagaccug

SEQ ID NO: 2300756 - RNA, 16 nt, Human
acccucccagaccugc

SEQ ID NO: 2300757 - RNA, 23 nt, Human
acccucccucuacugggagccua

SEQ ID NO: 2300758 - RNA, 17 nt, Human
acccucccauggcaccu

SEQ ID NO: 2300759 - RNA, 11 nt, Human
acccucccugc

SEQ ID NO: 2300760 - RNA, 24 nt, Human
acccgaggcugcccacuaugguca

SEQ ID NO: 2300761 - RNA, 21 nt, Human
acccgagucauucguucugug

SEQ ID NO: 2300762 - RNA, 12 nt, Human
acccgaugcugc

SEQ ID NO: 2300763 - RNA, 13 nt, Human
acccgaugcugcu

SEQ ID NO: 2300764 - RNA, 14 nt, Human
acccgaugcugcuu

SEQ ID NO: 2300765 - RNA, 22 nt, Human
acccgaugcugcuuuccccugu

SEQ ID NO: 2300766 - RNA, 13 nt, Human
acccuccacccug

SEQ ID NO: 2300767 - RNA, 23 nt, Human
acccgaugcugcuuuccccugug

SEQ ID NO: 2300768 - RNA, 14 nt, Human
acccuccacccugu

SEQ ID NO: 2300769 - RNA, 15 nt, Human
acccuccacccuguc

SEQ ID NO: 2300770 - RNA, 16 nt, Human
acccuccacccugucc

SEQ ID NO: 2300771 - RNA, 17 nt, Human
acccuccacccuguccc

SEQ ID NO: 2300772 - RNA, 17 nt, Human
acccgaggcugcccacu

SEQ ID NO: 2300773 - RNA, 15 nt, Human
acccgaggcugccca

SEQ ID NO: 2300774 - RNA, 14 nt, Human
acccgaggcugccc

SEQ ID NO: 2300775 - RNA, 14 nt, Human
acccgaggcccgca

SEQ ID NO: 2300776 - RNA, 13 nt, Human
acccgaggaaacu

SEQ ID NO: 2300777 - RNA, 16 nt, Human
acccgacagagggaag

SEQ ID NO: 2300778 - RNA, 23 nt, Human
accccuuuucagcuucugcuggg

SEQ ID NO: 2300779 - RNA, 19 nt, Human
accccuuuucagcuucugc

SEQ ID NO: 2300780 - RNA, 20 nt, Human
accccuuuucagcuucugcu

SEQ ID NO: 2300781 - RNA, 21 nt, Human
acccgacagagggaagaaaag

SEQ ID NO: 2300782 - RNA, 20 nt, Human
accccuucgcuccugugucu

SEQ ID NO: 2300783 - RNA, 15 nt, Human
accccuucucuccuc

SEQ ID NO: 2300784 - RNA, 17 nt, Human
accccuucucuccuccc

SEQ ID NO: 2300785 - RNA, 12 nt, Human
accccuuuccug

SEQ ID NO: 2300786 - RNA, 17 nt, Human
accccuuucuggcucuc

SEQ ID NO: 2300787 - RNA, 16 nt, Human
accccuuuucagcuuc

SEQ ID NO: 2300788 - RNA, 17 nt, Human
accccuuuucagcuucu

SEQ ID NO: 2300789 - RNA, 23 nt, Human
accccuucucuccuccccaaauc

SEQ ID NO: 2300790 - RNA, 15 nt, Human
ucagggucauagcau

SEQ ID NO: 2300791 - RNA, 18 nt, Human
ucagggguucgagaccag

SEQ ID NO: 2300792 - RNA, 22 nt, Human
ucagggguucgagaccagucug

SEQ ID NO: 2300793 - RNA, 19 nt, Human
ucaggcccuuauuuucaag

SEQ ID NO: 2300794 - RNA, 13 nt, Human
ucagggucccugg

SEQ ID NO: 2300795 - RNA, 14 nt, Human
ucagggucccuggu

SEQ ID NO: 2300796 - RNA, 18 nt, Human
ucagggucccugguggca

SEQ ID NO: 2300797 - RNA, 13 nt, Human
ucagguaacaggc

SEQ ID NO: 2300798 - RNA, 15 nt, Human
ucagguaacaggcag

SEQ ID NO: 2300799 - RNA, 16 nt, Human
ucagguaacaggcaga

SEQ ID NO: 2300800 - RNA, 19 nt, Human
accccuucgcuccuguguc

SEQ ID NO: 2300801 - RNA, 23 nt, Human
ucaggccaucaucaguggagcca

SEQ ID NO: 2300802 - RNA, 15 nt, Human
ucaggccgaaggagg

SEQ ID NO: 2300803 - RNA, 19 nt, Human
ucaggccaggugcaguggc

SEQ ID NO: 2300804 - RNA, 18 nt, Human
ucaggccaggugcagugg

SEQ ID NO: 2300805 - RNA, 17 nt, Human
ucaggccaggugcagug

SEQ ID NO: 2300806 - RNA, 16 nt, Human
ucaggccaggugcagu

SEQ ID NO: 2300807 - RNA, 22 nt, Human
ucaggccaucaucaguggagcc

SEQ ID NO: 2300808 - RNA, 21 nt, Human
ucaggccaucaucaguggagc

SEQ ID NO: 2300809 - RNA, 14 nt, Human
ucaggcccaaagcc

SEQ ID NO: 2300810 - RNA, 15 nt, Human
ucaggccagcugcuu

SEQ ID NO: 2300811 - RNA, 20 nt, Human
ucaggccagcugcuugggcu

SEQ ID NO: 2300812 - RNA, 11 nt, Human
ucaggccaggc

SEQ ID NO: 2300813 - RNA, 12 nt, Human
ucaggccaggcc

SEQ ID NO: 2300814 - RNA, 22 nt, Human
ucaggcauaggccugggugcug

SEQ ID NO: 2300815 - RNA, 17 nt, Human
ucaggcaugaacaugua

SEQ ID NO: 2300816 - RNA, 20 nt, Human
ucaggcauaggccugggugc

SEQ ID NO: 2300817 - RNA, 19 nt, Human
ucaggcauaggccugggug

SEQ ID NO: 2300818 - RNA, 22 nt, Human
ucaggaagaacacccucuaaau

SEQ ID NO: 2300819 - RNA, 18 nt, Human
ucaggcauaggccugggu

SEQ ID NO: 2300820 - RNA, 20 nt, Human
ucaggaagaugaaagaggag

SEQ ID NO: 2300821 - RNA, 15 nt, Human
ucaggcaugccugug

SEQ ID NO: 2300822 - RNA, 14 nt, Human
ucaggcaugccugu

SEQ ID NO: 2300823 - RNA, 18 nt, Human
ucaggcaugaacauguac

SEQ ID NO: 2300824 - RNA, 19 nt, Human
ucaggcaugaacauguacu

SEQ ID NO: 2300825 - RNA, 17 nt, Human
ucaggcaugccugugug

SEQ ID NO: 2300826 - RNA, 16 nt, Human
ucaggcaugccugugu

SEQ ID NO: 2300827 - RNA, 20 nt, Human
ucaggccaaacucaccugcc

SEQ ID NO: 2300828 - RNA, 23 nt, Human
ucaggccaaacucaccugccccu

SEQ ID NO: 2300829 - RNA, 16 nt, Human
ucaggaagcucagggc

SEQ ID NO: 2300830 - RNA, 17 nt, Human
ucaggaagcucagggcc

SEQ ID NO: 2300831 - RNA, 19 nt, Human
ucaggaagcucagggccug

SEQ ID NO: 2300832 - RNA, 20 nt, Human
ucaggaagcucagggccugg

SEQ ID NO: 2300833 - RNA, 22 nt, Human
accccuuccccacugccugccc

SEQ ID NO: 2300834 - RNA, 21 nt, Human
accccuuccccacugccugcc

SEQ ID NO: 2300835 - RNA, 19 nt, Human
ucagccuggccagacacag

SEQ ID NO: 2300836 - RNA, 20 nt, Human
ucagccuggccagacacagg

SEQ ID NO: 2300837 - RNA, 15 nt, Human
ucagcggggacagcu

SEQ ID NO: 2300838 - RNA, 16 nt, Human
ucagcggggacagcuc

SEQ ID NO: 2300839 - RNA, 17 nt, Human
ucagcggggacagcucc

SEQ ID NO: 2300840 - RNA, 14 nt, Human
ucagccuggugggc

SEQ ID NO: 2300841 - RNA, 12 nt, Human
ucaggaagaaau

SEQ ID NO: 2300842 - RNA, 23 nt, Human
ucaggaagaaaggagucugcaca

SEQ ID NO: 2300843 - RNA, 13 nt, Human
ucaggaagaacac

SEQ ID NO: 2300844 - RNA, 23 nt, Human
ucaggaagaaaucacagaaucau

SEQ ID NO: 2300845 - RNA, 15 nt, Human
ucaggaagaaaucac

SEQ ID NO: 2300846 - RNA, 22 nt, Human
ucaggaagaaaucacagaauca

SEQ ID NO: 2300847 - RNA, 13 nt, Human
ucagaucugucug

SEQ ID NO: 2300848 - RNA, 14 nt, Human
ucagaucugucuga

SEQ ID NO: 2300849 - RNA, 21 nt, Human
ucagaugaacucuuagaaaug

SEQ ID NO: 2300850 - RNA, 13 nt, Human
ucagaucuucugu

SEQ ID NO: 2300851 - RNA, 13 nt, Human
ucagaagacacug

SEQ ID NO: 2300852 - RNA, 12 nt, Human
ucagaagaaaga

SEQ ID NO: 2300853 - RNA, 20 nt, Human
ucagaaccucuuccccagaa

SEQ ID NO: 2300854 - RNA, 18 nt, Human
ucagaaccucuuccccag

SEQ ID NO: 2300855 - RNA, 17 nt, Human
ucagaaccucuucccca

SEQ ID NO: 2300856 - RNA, 16 nt, Human
ucagaaccucuucccc

SEQ ID NO: 2300857 - RNA, 15 nt, Human
ucagaaccucuuccc

SEQ ID NO: 2300858 - RNA, 24 nt, Human
ucagaacccuuggcuugcccacgu

SEQ ID NO: 2300859 - RNA, 20 nt, Human
ucagaacccuuggcuugccc

SEQ ID NO: 2300860 - RNA, 18 nt, Human
ucagaacccuuggcuugc

SEQ ID NO: 2300861 - RNA, 22 nt, Human
ucagaacucaaauggggccaga

SEQ ID NO: 2300862 - RNA, 21 nt, Human
ucagaacucaaauggggccag

SEQ ID NO: 2300863 - RNA, 15 nt, Human
ucagaacuagaauuu

SEQ ID NO: 2300864 - RNA, 18 nt, Human
ucagaugggaagacauga

SEQ ID NO: 2300865 - RNA, 15 nt, Human
ucagaugggaagaca

SEQ ID NO: 2300866 - RNA, 13 nt, Human
ucagaugucuucu

SEQ ID NO: 2300867 - RNA, 14 nt, Human
ucagaugucuucug

SEQ ID NO: 2300868 - RNA, 15 nt, Human
ucagaugucuucugc

SEQ ID NO: 2300869 - RNA, 16 nt, Human
ucagaugucuucugcc

SEQ ID NO: 2300870 - RNA, 17 nt, Human
ucagaugucuucugccu

SEQ ID NO: 2300871 - RNA, 19 nt, Human
ucagaugucuucugccugu

SEQ ID NO: 2300872 - RNA, 20 nt, Human
ucagaugucuucugccuguu

SEQ ID NO: 2300873 - RNA, 21 nt, Human
ucagaugucuucugccuguua

SEQ ID NO: 2300874 - RNA, 21 nt, Human
ucagaugcccagagggcccag

SEQ ID NO: 2300875 - RNA, 14 nt, Human
ucagaugcccagag

SEQ ID NO: 2300876 - RNA, 22 nt, Human
ucagaugucuucugccuguuau

SEQ ID NO: 2300877 - RNA, 14 nt, Human
ucagauucccagag

SEQ ID NO: 2300878 - RNA, 19 nt, Human
ucagauuuuaaaaagucuu

SEQ ID NO: 2300879 - RNA, 21 nt, Human
ucagauuuuaaaaagucuuca

SEQ ID NO: 2300880 - RNA, 13 nt, Human
ucagcccugaccc

SEQ ID NO: 2300881 - RNA, 17 nt, Human
ucagcccucccugcccc

SEQ ID NO: 2300882 - RNA, 19 nt, Human
ucagcccucccugccccuc

SEQ ID NO: 2300883 - RNA, 16 nt, Human
ucagcccugacccugu

SEQ ID NO: 2300884 - RNA, 13 nt, Human
ucagcccugaggu

SEQ ID NO: 2300885 - RNA, 23 nt, Human
ucagcccugaggugaaagggagc

SEQ ID NO: 2300886 - RNA, 18 nt, Human
ucagccccuccucugcca

SEQ ID NO: 2300887 - RNA, 13 nt, Human
ucagccccuccuc

SEQ ID NO: 2300888 - RNA, 12 nt, Human
ucagccccuccu

SEQ ID NO: 2300889 - RNA, 17 nt, Human
ucagccccuccucugcc

SEQ ID NO: 2300890 - RNA, 16 nt, Human
ucagccccuccucugc

SEQ ID NO: 2300891 - RNA, 15 nt, Human
ucagccccuccucug

SEQ ID NO: 2300892 - RNA, 14 nt, Human
ucagccccuccucu

SEQ ID NO: 2300893 - RNA, 18 nt, Human
ucagcccucccugccccu

SEQ ID NO: 2300894 - RNA, 20 nt, Human
ucagccccaccccagguccu

SEQ ID NO: 2300895 - RNA, 18 nt, Human
ucagcccaccccccucau

SEQ ID NO: 2300896 - RNA, 16 nt, Human
ucagcccauauuucau

SEQ ID NO: 2300897 - RNA, 17 nt, Human
ucagcccaccccccuca

SEQ ID NO: 2300898 - RNA, 12 nt, Human
ucagcccugggc

SEQ ID NO: 2300899 - RNA, 21 nt, Human
ucagcccuggaggugccagca

SEQ ID NO: 2300900 - RNA, 17 nt, Human
ucagcccuggaggugcc

SEQ ID NO: 2300901 - RNA, 19 nt, Human
ucagcccuggaggugccag

SEQ ID NO: 2300902 - RNA, 12 nt, Human
ucagcccuggag

SEQ ID NO: 2300903 - RNA, 13 nt, Human
ucagcccuggagg

SEQ ID NO: 2300904 - RNA, 14 nt, Human
ucagcccuggaggu

SEQ ID NO: 2300905 - RNA, 19 nt, Human
ucagcccugggccccacca

SEQ ID NO: 2300906 - RNA, 18 nt, Human
ucagcccugggccccacc

SEQ ID NO: 2300907 - RNA, 22 nt, Human
acccagcuaugguucucucgca

SEQ ID NO: 2300908 - RNA, 13 nt, Human
acccagcucuggu

SEQ ID NO: 2300909 - RNA, 15 nt, Human
acccagcucuggucc

SEQ ID NO: 2300910 - RNA, 15 nt, Human
acccagucccugggg

SEQ ID NO: 2300911 - RNA, 13 nt, Human
acccagucccugg

SEQ ID NO: 2300912 - RNA, 21 nt, Human
acccaguccccgugccccgcc

SEQ ID NO: 2300913 - RNA, 17 nt, Human
acccaguccccgugccc

SEQ ID NO: 2300914 - RNA, 17 nt, Human
acccaguaacucaucug

SEQ ID NO: 2300915 - RNA, 16 nt, Human
acccaguccacaaaau

SEQ ID NO: 2300916 - RNA, 18 nt, Human
acccaguaacucaucugu

SEQ ID NO: 2300917 - RNA, 16 nt, Human
accccauuuucugugg

SEQ ID NO: 2300918 - RNA, 15 nt, Human
acccccagccugcua

SEQ ID NO: 2300919 - RNA, 23 nt, Human
accccaugucaccggauccuggg

SEQ ID NO: 2300920 - RNA, 14 nt, Human
acccccagccugcu

SEQ ID NO: 2300921 - RNA, 14 nt, Human
acccagucccuggg

SEQ ID NO: 2300922 - RNA, 16 nt, Human
acccagucuguucccc

SEQ ID NO: 2300923 - RNA, 14 nt, Human
acccagugagcacu

SEQ ID NO: 2300924 - RNA, 18 nt, Human
acccagugcccccacuga

SEQ ID NO: 2300925 - RNA, 15 nt, Human
acccagugcccccac

SEQ ID NO: 2300926 - RNA, 18 nt, Human
accccaucugugaauaag

SEQ ID NO: 2300927 - RNA, 16 nt, Human
accccaucugugaaua

SEQ ID NO: 2300928 - RNA, 15 nt, Human
accccaucugugaau

SEQ ID NO: 2300929 - RNA, 15 nt, Human
accccaucugcccag

SEQ ID NO: 2300930 - RNA, 16 nt, Human
accccaucugcccagg

SEQ ID NO: 2300931 - RNA, 16 nt, Human
accccaugccaaagcu

SEQ ID NO: 2300932 - RNA, 17 nt, Human
accccaucugcccagga

SEQ ID NO: 2300933 - RNA, 12 nt, Human
accccaugcugu

SEQ ID NO: 2300934 - RNA, 16 nt, Human
accccaugcuguugau

SEQ ID NO: 2300935 - RNA, 17 nt, Human
accccaugcuguugauu

SEQ ID NO: 2300936 - RNA, 23 nt, Human
accccaugcuguugauugcuaaa

SEQ ID NO: 2300937 - RNA, 20 nt, Human
accccaugcuguugauugcu

SEQ ID NO: 2300938 - RNA, 22 nt, Human
accccaugcuguugauugcuaa

SEQ ID NO: 2300939 - RNA, 15 nt, Human
acccccgcccccugc

SEQ ID NO: 2300940 - RNA, 18 nt, Human
acccccgcccccugcccu

SEQ ID NO: 2300941 - RNA, 19 nt, Human
acccccgcccccugcccuc

SEQ ID NO: 2300942 - RNA, 20 nt, Human
acccccgcccccugcccucc

SEQ ID NO: 2300943 - RNA, 21 nt, Human
acccccgcccccugcccuccc

SEQ ID NO: 2300944 - RNA, 19 nt, Human
accccccagaaccuguccu

SEQ ID NO: 2300945 - RNA, 16 nt, Human
acccccucauuguuua

SEQ ID NO: 2300946 - RNA, 14 nt, Human
acccccgcccccug

SEQ ID NO: 2300947 - RNA, 13 nt, Human
acccccgcccccu

SEQ ID NO: 2300948 - RNA, 18 nt, Human
accccccagaaccugucc

SEQ ID NO: 2300949 - RNA, 19 nt, Human
accccccacucugugccug

SEQ ID NO: 2300950 - RNA, 22 nt, Human
accccccacacucacuccugag

SEQ ID NO: 2300951 - RNA, 16 nt, Human
accccccacucugugc

SEQ ID NO: 2300952 - RNA, 13 nt, Human
accccccaccugc

SEQ ID NO: 2300953 - RNA, 12 nt, Human
accccccaccug

SEQ ID NO: 2300954 - RNA, 14 nt, Human
accccccaagcugu

SEQ ID NO: 2300955 - RNA, 19 nt, Human
accccccaaccccugagga

SEQ ID NO: 2300956 - RNA, 20 nt, Human
accccccaaccccugaggaa

SEQ ID NO: 2300957 - RNA, 17 nt, Human
acccccauuucuauuua

SEQ ID NO: 2300958 - RNA, 18 nt, Human
acccccauuucuauuuau

SEQ ID NO: 2300959 - RNA, 17 nt, Human
acccccaucucucccuc

SEQ ID NO: 2300960 - RNA, 16 nt, Human
acccccaggaccccug

SEQ ID NO: 2300961 - RNA, 16 nt, Human
acccccagcuuugcua

SEQ ID NO: 2300962 - RNA, 21 nt, Human
acccccaggccucagucuccc

SEQ ID NO: 2300963 - RNA, 18 nt, Human
acccccagcuccggccug

SEQ ID NO: 2300964 - RNA, 14 nt, Human
acccccagcuuugc

SEQ ID NO: 2300965 - RNA, 19 nt, Human
acccccagcugcuuguguc

SEQ ID NO: 2300966 - RNA, 22 nt, Human
acccccagcuuugcccaacacc

SEQ ID NO: 2300967 - RNA, 12 nt, Human
acccccagcuca

SEQ ID NO: 2300968 - RNA, 13 nt, Human
acccccagcucaa

SEQ ID NO: 2300969 - RNA, 20 nt, Human
acccccagcucaauggacug

SEQ ID NO: 2300970 - RNA, 21 nt, Human
acccccagcucaauggacugg

SEQ ID NO: 2300971 - RNA, 15 nt, Human
acccccucccuggcc

SEQ ID NO: 2300972 - RNA, 14 nt, Human
acccccucccuggc

SEQ ID NO: 2300973 - RNA, 16 nt, Human
acccccuccccagggg

SEQ ID NO: 2300974 - RNA, 13 nt, Human
accccucccuuuc

SEQ ID NO: 2300975 - RNA, 14 nt, Human
accccucccuuucu

SEQ ID NO: 2300976 - RNA, 12 nt, Human
acccccucccca

SEQ ID NO: 2300977 - RNA, 19 nt, Human
acccccucaagccaauccc

SEQ ID NO: 2300978 - RNA, 14 nt, Human
acccccuccccagg

SEQ ID NO: 2300979 - RNA, 13 nt, Human
acccccuccccag

SEQ ID NO: 2300980 - RNA, 15 nt, Human
acccccuccccgccc

SEQ ID NO: 2300981 - RNA, 16 nt, Human
accccucccuuucucc

SEQ ID NO: 2300982 - RNA, 18 nt, Human
accccucccuuucucccc

SEQ ID NO: 2300983 - RNA, 19 nt, Human
accccucccuuucuccccu

SEQ ID NO: 2300984 - RNA, 23 nt, Human
accccucccuuucuccccugccc

SEQ ID NO: 2300985 - RNA, 13 nt, Human
accccuccucacu

SEQ ID NO: 2300986 - RNA, 14 nt, Human
accccuccucacug

SEQ ID NO: 2300987 - RNA, 16 nt, Human
accccuccucacuggc

SEQ ID NO: 2300988 - RNA, 17 nt, Human
accccuccucacuggcc

SEQ ID NO: 2300989 - RNA, 18 nt, Human
accccuccucacuggcca

SEQ ID NO: 2300990 - RNA, 19 nt, Human
accccuccucacuggccau

SEQ ID NO: 2300991 - RNA, 21 nt, Human
accccuccucacuggccaucc

SEQ ID NO: 2300992 - RNA, 23 nt, Human
accccuccucacuggccaucccu

SEQ ID NO: 2300993 - RNA, 12 nt, Human
accccuggcuuu

SEQ ID NO: 2300994 - RNA, 22 nt, Human
accccuggcuccaggccagggg

SEQ ID NO: 2300995 - RNA, 20 nt, Human
accccuggcuccaggccagg

SEQ ID NO: 2300996 - RNA, 19 nt, Human
accccuggcuccaggccag

SEQ ID NO: 2300997 - RNA, 16 nt, Human
accccuccuuccuuga

SEQ ID NO: 2300998 - RNA, 12 nt, Human
accccuccuucc

SEQ ID NO: 2300999 - RNA, 15 nt, Human
accccuccucccuuu

SEQ ID NO: 2301000 - RNA, 18 nt, Human
accccuccucccuuuuuc

SEQ ID NO: 2301001 - RNA, 23 nt, Human
accccuccucccuuuuuccuugu

SEQ ID NO: 2301002 - RNA, 17 nt, Human
accccuccuuccuugac

SEQ ID NO: 2301003 - RNA, 12 nt, Human
accccuggccuc

SEQ ID NO: 2301004 - RNA, 13 nt, Human
accccuggccucc

SEQ ID NO: 2301005 - RNA, 14 nt, Human
accccuggccuccg

SEQ ID NO: 2301006 - RNA, 12 nt, Human
ucagccugggca

SEQ ID NO: 2301007 - RNA, 10 nt, Human
ucagccuggg

SEQ ID NO: 2301008 - RNA, 20 nt, Human
accccuuccccacugccugc

SEQ ID NO: 2301009 - RNA, 18 nt, Human
accccuuccccacugccu

SEQ ID NO: 2301010 - RNA, 16 nt, Human
accccuuccccacugc

SEQ ID NO: 2301011 - RNA, 15 nt, Human
accccuuccccacug

SEQ ID NO: 2301012 - RNA, 14 nt, Human
accccuuccccacu

SEQ ID NO: 2301013 - RNA, 18 nt, Human
accccuuccauguggaga

SEQ ID NO: 2301014 - RNA, 19 nt, Human
accccuuccauguggagaa

SEQ ID NO: 2301015 - RNA, 19 nt, Human
ucagccuggcuucaaauug

SEQ ID NO: 2301016 - RNA, 18 nt, Human
accccuuagccucccuga

SEQ ID NO: 2301017 - RNA, 15 nt, Human
accccuuauccagga

SEQ ID NO: 2301018 - RNA, 16 nt, Human
accccuuauccaggac

SEQ ID NO: 2301019 - RNA, 17 nt, Human
accccuuagccucccug

SEQ ID NO: 2301020 - RNA, 16 nt, Human
accccuuagccucccu

SEQ ID NO: 2301021 - RNA, 17 nt, Human
accccuuauccaggacu

SEQ ID NO: 2301022 - RNA, 18 nt, Human
accccuuauccaggacuc

SEQ ID NO: 2301023 - RNA, 15 nt, Human
accccuuccaugugg

SEQ ID NO: 2301024 - RNA, 15 nt, Human
accccuuagccuccc

SEQ ID NO: 2301025 - RNA, 14 nt, Human
accccuuagccucc

SEQ ID NO: 2301026 - RNA, 15 nt, Human
accccuggcuuuuca

SEQ ID NO: 2301027 - RNA, 15 nt, Human
acccaagcaaggcca

SEQ ID NO: 2301028 - RNA, 19 nt, Human
acccaacuagcucuauguu

SEQ ID NO: 2301029 - RNA, 13 nt, Human
acccaacucuccu

SEQ ID NO: 2301030 - RNA, 15 nt, Human
acccaacucuccugg

SEQ ID NO: 2301031 - RNA, 16 nt, Human
acccaacucuccugga

SEQ ID NO: 2301032 - RNA, 19 nt, Human
acccacuugcuuuuaaaau

SEQ ID NO: 2301033 - RNA, 16 nt, Human
acccagaagaaaauag

SEQ ID NO: 2301034 - RNA, 12 nt, Human
acccaaccacuc

SEQ ID NO: 2301035 - RNA, 22 nt, Human
acccaaaagcucagccagcccc

SEQ ID NO: 2301036 - RNA, 21 nt, Human
acccaaauguucaucaaugaa

SEQ ID NO: 2301037 - RNA, 23 nt, Human
acccaaaagucaaaaggugccug

SEQ ID NO: 2301038 - RNA, 21 nt, Human
acccaaaagcucagccagccc

SEQ ID NO: 2301039 - RNA, 18 nt, Human
acccaaaaggcagaagca

SEQ ID NO: 2301040 - RNA, 16 nt, Human
acccagcccacuucug

SEQ ID NO: 2301041 - RNA, 17 nt, Human
acccagcccacuucugc

SEQ ID NO: 2301042 - RNA, 15 nt, Human
acccagacagcuccc

SEQ ID NO: 2301043 - RNA, 22 nt, Human
acccagacagcucccucugccu

SEQ ID NO: 2301044 - RNA, 21 nt, Human
acccagacagcucccucugcc

SEQ ID NO: 2301045 - RNA, 18 nt, Human
acccagcccacuucugcc

SEQ ID NO: 2301046 - RNA, 11 nt, Human
acccagcccau

SEQ ID NO: 2301047 - RNA, 16 nt, Human
ucagaacagagccuuu

SEQ ID NO: 2301048 - RNA, 22 nt, Human
ucagaaccauccauaguaguau

SEQ ID NO: 2301049 - RNA, 16 nt, Human
ucagaacccuuggcuu

SEQ ID NO: 2301050 - RNA, 15 nt, Human
ucagaacccuuggcu

SEQ ID NO: 2301051 - RNA, 13 nt, Human
accauuuauacaa

SEQ ID NO: 2301052 - RNA, 22 nt, Human
accauuuauacaaauuagaaaa

SEQ ID NO: 2301053 - RNA, 21 nt, Human
accauuuauacaaauuagaaa

SEQ ID NO: 2301054 - RNA, 19 nt, Human
accauuuauacaaauuaga

SEQ ID NO: 2301055 - RNA, 16 nt, Human
accauuuauacaaauu

SEQ ID NO: 2301056 - RNA, 23 nt, Human
accauuuauacaaauuagaaaau

SEQ ID NO: 2301057 - RNA, 14 nt, Human
accauuucagagag

SEQ ID NO: 2301058 - RNA, 11 nt, Human
accauuucaga

SEQ ID NO: 2301059 - RNA, 22 nt, Human
accauuuugggguacccacugc

SEQ ID NO: 2301060 - RNA, 20 nt, Human
accauuucagagaggccuuu

SEQ ID NO: 2301061 - RNA, 23 nt, Human
accauuuugggguacccacugcu

SEQ ID NO: 2301062 - RNA, 20 nt, Human
accauuuuuuaaggaaacaa

SEQ ID NO: 2301063 - RNA, 22 nt, Human
accauuuuuuaaggaaacaaua

SEQ ID NO: 2301064 - RNA, 15 nt, Human
acccaaaaggcagaa

SEQ ID NO: 2301065 - RNA, 13 nt, Human
acccaaaaggcag

SEQ ID NO: 2301066 - RNA, 21 nt, Human
accauugucuuguucugugau

SEQ ID NO: 2301067 - RNA, 19 nt, Human
accaugaguggcauggcca

SEQ ID NO: 2301068 - RNA, 22 nt, Human
accaugaguggcauggccacca

SEQ ID NO: 2301069 - RNA, 17 nt, Human
accauugucuuguucug

SEQ ID NO: 2301070 - RNA, 18 nt, Human
accauucuccaccugcca

SEQ ID NO: 2301071 - RNA, 13 nt, Human
accauucuccacc

SEQ ID NO: 2301072 - RNA, 16 nt, Human
accauucuccaccugc

SEQ ID NO: 2301073 - RNA, 18 nt, Human
accaugagaagagggccu

SEQ ID NO: 2301074 - RNA, 20 nt, Human
accaugagaagagggccugu

SEQ ID NO: 2301075 - RNA, 21 nt, Human
accaugagaagagggccugug

SEQ ID NO: 2301076 - RNA, 23 nt, Human
accaugagaauaagagaaagaaa

SEQ ID NO: 2301077 - RNA, 18 nt, Human
accaugagcaauucuccu

SEQ ID NO: 2301078 - RNA, 22 nt, Human
accaugauuaaccacuucagcu

SEQ ID NO: 2301079 - RNA, 23 nt, Human
accaugauuaaccacuucagcug

SEQ ID NO: 2301080 - RNA, 15 nt, Human
accauuccccauggg

SEQ ID NO: 2301081 - RNA, 12 nt, Human
accauuccccau

SEQ ID NO: 2301082 - RNA, 21 nt, Human
accagggagaccgagcgcuuu

SEQ ID NO: 2301083 - RNA, 20 nt, Human
accagggagccccuuugaug

SEQ ID NO: 2301084 - RNA, 14 nt, Human
ucacugucuuuccu

SEQ ID NO: 2301085 - RNA, 19 nt, Human
ucacuguugcccaggcugg

SEQ ID NO: 2301086 - RNA, 17 nt, Human
ucacuguugcccaggcu

SEQ ID NO: 2301087 - RNA, 18 nt, Human
ucacuguugcccaggcug

SEQ ID NO: 2301088 - RNA, 14 nt, Human
accagggcagggcc

SEQ ID NO: 2301089 - RNA, 15 nt, Human
accagggcagggcca

SEQ ID NO: 2301090 - RNA, 19 nt, Human
accagggccugagccaagc

SEQ ID NO: 2301091 - RNA, 23 nt, Human
accagggcgaacgacaauagcuu

SEQ ID NO: 2301092 - RNA, 22 nt, Human
accagggcgaacgacaauagcu

SEQ ID NO: 2301093 - RNA, 15 nt, Human
accaggggcaggcac

SEQ ID NO: 2301094 - RNA, 16 nt, Human
accaggggcaggcaca

SEQ ID NO: 2301095 - RNA, 17 nt, Human
accaggggcaggcacag

SEQ ID NO: 2301096 - RNA, 12 nt, Human
accagugacuuu

SEQ ID NO: 2301097 - RNA, 18 nt, Human
accaggggcaggcacagc

SEQ ID NO: 2301098 - RNA, 19 nt, Human
accaggggcaggcacagca

SEQ ID NO: 2301099 - RNA, 20 nt, Human
accaggggcaggcacagcac

SEQ ID NO: 2301100 - RNA, 17 nt, Human
accagugcaacagcacu

SEQ ID NO: 2301101 - RNA, 16 nt, Human
accaguguagccuugc

SEQ ID NO: 2301102 - RNA, 13 nt, Human
accaguguagccu

SEQ ID NO: 2301103 - RNA, 17 nt, Human
accaguggucucacaug

SEQ ID NO: 2301104 - RNA, 12 nt, Human
accaguggucuc

SEQ ID NO: 2301105 - RNA, 21 nt, Human
accaguguuguggauuuaaca

SEQ ID NO: 2301106 - RNA, 18 nt, Human
accagugcgauucuggau

SEQ ID NO: 2301107 - RNA, 18 nt, Human
accagugcaacagcacug

SEQ ID NO: 2301108 - RNA, 23 nt, Human
accagugcccaaagucuguguga

SEQ ID NO: 2301109 - RNA, 22 nt, Human
accagugcccaaagucugugug

SEQ ID NO: 2301110 - RNA, 17 nt, Human
accaguuaugugaauga

SEQ ID NO: 2301111 - RNA, 24 nt, Human
accaggggugauuucagagagggc

SEQ ID NO: 2301112 - RNA, 21 nt, Human
accaguguagccuugcccgga

SEQ ID NO: 2301113 - RNA, 21 nt, Human
accaguugcacuuggccucug

SEQ ID NO: 2301114 - RNA, 15 nt, Human
accaguucugggcaa

SEQ ID NO: 2301115 - RNA, 15 nt, Human
accaguugggagcac

SEQ ID NO: 2301116 - RNA, 24 nt, Human
accaugaagagauuuuucaugauu

SEQ ID NO: 2301117 - RNA, 19 nt, Human
ucacuguccuccaagccag

SEQ ID NO: 2301118 - RNA, 20 nt, Human
ucacugucaggaagaaauca

SEQ ID NO: 2301119 - RNA, 15 nt, Human
ucacugucugagagu

SEQ ID NO: 2301120 - RNA, 20 nt, Human
ucacugucugagaguuuagu

SEQ ID NO: 2301121 - RNA, 12 nt, Human
ucacugucuuuc

SEQ ID NO: 2301122 - RNA, 16 nt, Human
ucacuguugcccaggc

SEQ ID NO: 2301123 - RNA, 16 nt, Human
ucacuguccuccaagc

SEQ ID NO: 2301124 - RNA, 15 nt, Human
ucacuguccuccaag

SEQ ID NO: 2301125 - RNA, 18 nt, Human
ucacugucaggaagaaau

SEQ ID NO: 2301126 - RNA, 18 nt, Human
ucacugucccucaaauga

SEQ ID NO: 2301127 - RNA, 14 nt, Human
ucaccugggcaccu

SEQ ID NO: 2301128 - RNA, 14 nt, Human
ucacuguauaaaua

SEQ ID NO: 2301129 - RNA, 15 nt, Human
ucacuguauaaauag

SEQ ID NO: 2301130 - RNA, 16 nt, Human
ucacuguauaaauagg

SEQ ID NO: 2301131 - RNA, 17 nt, Human
ucacuguauaaauagga

SEQ ID NO: 2301132 - RNA, 19 nt, Human
ucacuguauaaauaggaga

SEQ ID NO: 2301133 - RNA, 23 nt, Human
ucacuguauaaauaggagaggau

SEQ ID NO: 2301134 - RNA, 24 nt, Human
ucacuguauaaauaggagaggaug

SEQ ID NO: 2301135 - RNA, 21 nt, Human
ucacuguagaaugauuucaug

SEQ ID NO: 2301136 - RNA, 12 nt, Human
ucacugcagccu

SEQ ID NO: 2301137 - RNA, 19 nt, Human
ucacugacacaaaaaguag

SEQ ID NO: 2301138 - RNA, 20 nt, Human
ucacugcacagugcaucuca

SEQ ID NO: 2301139 - RNA, 22 nt, Human
ucacugcacagugcaucucagc

SEQ ID NO: 2301140 - RNA, 24 nt, Human
ucacugcacagugcaucucagccc

SEQ ID NO: 2301141 - RNA, 23 nt, Human
ucacugaaugcuucugacuucau

SEQ ID NO: 2301142 - RNA, 17 nt, Human
ucaccugggcaccuggg

SEQ ID NO: 2301143 - RNA, 13 nt, Human
ucacugagacagc

SEQ ID NO: 2301144 - RNA, 14 nt, Human
ucacugagacagcc

SEQ ID NO: 2301145 - RNA, 15 nt, Human
ucacugagacagccc

SEQ ID NO: 2301146 - RNA, 16 nt, Human
ucaccugcuggccccu

SEQ ID NO: 2301147 - RNA, 15 nt, Human
ucaccugcuggcccc

SEQ ID NO: 2301148 - RNA, 11 nt, Human
ucaccugcugg

SEQ ID NO: 2301149 - RNA, 15 nt, Human
ucaccugaggucggg

SEQ ID NO: 2301150 - RNA, 16 nt, Human
ucaccugccccucaac

SEQ ID NO: 2301151 - RNA, 21 nt, Human
ucaccugcuggccccucaccu

SEQ ID NO: 2301152 - RNA, 20 nt, Human
ucaccugcuggccccucacc

SEQ ID NO: 2301153 - RNA, 19 nt, Human
ucaccugcuggccccucac

SEQ ID NO: 2301154 - RNA, 17 nt, Human
ucaccugcuggccccuc

SEQ ID NO: 2301155 - RNA, 20 nt, Human
uauuucauaaacaacuuaau

SEQ ID NO: 2301156 - RNA, 21 nt, Human
uauuucaucauauuauacaga

SEQ ID NO: 2301157 - RNA, 20 nt, Human
uauuucaucauauuauacag

SEQ ID NO: 2301158 - RNA, 17 nt, Human
uauuucaugaaaauugu

SEQ ID NO: 2301159 - RNA, 21 nt, Human
accacacuggacuccggcccu

SEQ ID NO: 2301160 - RNA, 22 nt, Human
accacacuggacuccggcccuc

SEQ ID NO: 2301161 - RNA, 17 nt, Human
accacacuuccugucca

SEQ ID NO: 2301162 - RNA, 16 nt, Human
accacacuuccugucc

SEQ ID NO: 2301163 - RNA, 13 nt, Human
accacacuuccug

SEQ ID NO: 2301164 - RNA, 22 nt, Human
accacacuuccuguccagagag

SEQ ID NO: 2301165 - RNA, 21 nt, Human
accacacuuccuguccagaga

SEQ ID NO: 2301166 - RNA, 12 nt, Human
accacagacaca

SEQ ID NO: 2301167 - RNA, 13 nt, Human
accacagacacac

SEQ ID NO: 2301168 - RNA, 14 nt, Human
accacagacacaca

SEQ ID NO: 2301169 - RNA, 15 nt, Human
accacagacacacac

SEQ ID NO: 2301170 - RNA, 21 nt, Human
uauuucaugcugggaaugaga

SEQ ID NO: 2301171 - RNA, 12 nt, Human
uauuucauuucu

SEQ ID NO: 2301172 - RNA, 14 nt, Human
accacaucuugcuc

SEQ ID NO: 2301173 - RNA, 20 nt, Human
accacauccuccguccagcc

SEQ ID NO: 2301174 - RNA, 14 nt, Human
accacauccuccgu

SEQ ID NO: 2301175 - RNA, 13 nt, Human
accacagugucug

SEQ ID NO: 2301176 - RNA, 12 nt, Human
accacagugucu

SEQ ID NO: 2301177 - RNA, 19 nt, Human
accacauagcaugaggcca

SEQ ID NO: 2301178 - RNA, 19 nt, Human
accacagcaggugucauau

SEQ ID NO: 2301179 - RNA, 16 nt, Human
accacagcaucauuuu

SEQ ID NO: 2301180 - RNA, 16 nt, Human
accacagccagcaccu

SEQ ID NO: 2301181 - RNA, 11 nt, Human
accacaguguc

SEQ ID NO: 2301182 - RNA, 17 nt, Human
accacagccagcaccug

SEQ ID NO: 2301183 - RNA, 11 nt, Human
accacagcagu

SEQ ID NO: 2301184 - RNA, 22 nt, Human
accacagacauacuaaccagca

SEQ ID NO: 2301185 - RNA, 21 nt, Human
accacagacauacuaaccagc

SEQ ID NO: 2301186 - RNA, 18 nt, Human
accacagcaaggcaccug

SEQ ID NO: 2301187 - RNA, 10 nt, Human
accacagcaa

SEQ ID NO: 2301188 - RNA, 20 nt, Human
accacagacacacacacgca

SEQ ID NO: 2301189 - RNA, 16 nt, Human
accacagacacacaca

SEQ ID NO: 2301190 - RNA, 18 nt, Human
accacagacacacacacg

SEQ ID NO: 2301191 - RNA, 16 nt, Human
accacagcacagccaa

SEQ ID NO: 2301192 - RNA, 16 nt, Human
accacagcagcugaac

SEQ ID NO: 2301193 - RNA, 21 nt, Human
accacagcagcugaacagcca

SEQ ID NO: 2301194 - RNA, 15 nt, Human
accacagcacagcca

SEQ ID NO: 2301195 - RNA, 19 nt, Human
accacagcaaggcaccugc

SEQ ID NO: 2301196 - RNA, 21 nt, Human
accacagcaaggcaccugcag

SEQ ID NO: 2301197 - RNA, 20 nt, Human
accacucaaauuaaucuuuc

SEQ ID NO: 2301198 - RNA, 20 nt, Human
accacaugccaagcacugug

SEQ ID NO: 2301199 - RNA, 20 nt, Human
accacaucuaagccugaagg

SEQ ID NO: 2301200 - RNA, 17 nt, Human
accacaucuuuaucugu

SEQ ID NO: 2301201 - RNA, 16 nt, Human
accacaucuaagccug

SEQ ID NO: 2301202 - RNA, 23 nt, Human
accacauccacacacgcaggaac

SEQ ID NO: 2301203 - RNA, 20 nt, Human
accacucuaucaaguauuau

SEQ ID NO: 2301204 - RNA, 22 nt, Human
accacauccuccguccagccgc

SEQ ID NO: 2301205 - RNA, 21 nt, Human
accacauccuccguccagccg

SEQ ID NO: 2301206 - RNA, 16 nt, Human
accacaucuugcucug

SEQ ID NO: 2301207 - RNA, 20 nt, Human
accacaucuugcucugcuga

SEQ ID NO: 2301208 - RNA, 21 nt, Human
accacaucuugcucugcugac

SEQ ID NO: 2301209 - RNA, 24 nt, Human
accacaucuugcucugcugacaga

SEQ ID NO: 2301210 - RNA, 13 nt, Human
accacugcagaag

SEQ ID NO: 2301211 - RNA, 19 nt, Human
accacugcagaagacagua

SEQ ID NO: 2301212 - RNA, 14 nt, Human
accacugcagaaga

SEQ ID NO: 2301213 - RNA, 14 nt, Human
accacuucagcuga

SEQ ID NO: 2301214 - RNA, 13 nt, Human
accacuucagcug

SEQ ID NO: 2301215 - RNA, 18 nt, Human
accacuuaaaaaaugucc

SEQ ID NO: 2301216 - RNA, 15 nt, Human
accacuucagcugac

SEQ ID NO: 2301217 - RNA, 20 nt, Human
accagccuggccaacauggu

SEQ ID NO: 2301218 - RNA, 15 nt, Human
accagccuggccaac

SEQ ID NO: 2301219 - RNA, 13 nt, Human
accagccugggca

SEQ ID NO: 2301220 - RNA, 20 nt, Human
accagccugaccaacauggu

SEQ ID NO: 2301221 - RNA, 17 nt, Human
accagccuuucucccag

SEQ ID NO: 2301222 - RNA, 16 nt, Human
accagccuuucuccca

SEQ ID NO: 2301223 - RNA, 14 nt, Human
accagccuguugga

SEQ ID NO: 2301224 - RNA, 23 nt, Human
accagccuguuggacccgcucug

SEQ ID NO: 2301225 - RNA, 14 nt, Human
accagccugggcag

SEQ ID NO: 2301226 - RNA, 20 nt, Human
accagccuggucaacauggu

SEQ ID NO: 2301227 - RNA, 12 nt, Human
accagccuggcc

SEQ ID NO: 2301228 - RNA, 11 nt, Human
accagccuggc

SEQ ID NO: 2301229 - RNA, 20 nt, Human
accagagccccacacggagg

SEQ ID NO: 2301230 - RNA, 17 nt, Human
accagagccccacacgg

SEQ ID NO: 2301231 - RNA, 14 nt, Human
accagagccccaca

SEQ ID NO: 2301232 - RNA, 23 nt, Human
accagagccauggacucuacacu

SEQ ID NO: 2301233 - RNA, 17 nt, Human
accagagccauggacuc

SEQ ID NO: 2301234 - RNA, 14 nt, Human
accagagccaugga

SEQ ID NO: 2301235 - RNA, 13 nt, Human
accagagccaugg

SEQ ID NO: 2301236 - RNA, 16 nt, Human
accagagcagaugcag

SEQ ID NO: 2301237 - RNA, 17 nt, Human
accagagcagaugcaga

SEQ ID NO: 2301238 - RNA, 22 nt, Human
accagagcagaugcagagagcc

SEQ ID NO: 2301239 - RNA, 20 nt, Human
accagagcauuuccaacacc

SEQ ID NO: 2301240 - RNA, 20 nt, Human
accagagauaauaugagaau

SEQ ID NO: 2301241 - RNA, 15 nt, Human
accagagcagaugca

SEQ ID NO: 2301242 - RNA, 12 nt, Human
accagagcagau

SEQ ID NO: 2301243 - RNA, 19 nt, Human
accagagcccaccuuggcu

SEQ ID NO: 2301244 - RNA, 22 nt, Human
accagagcccaccuuggcucaa

SEQ ID NO: 2301245 - RNA, 22 nt, Human
accagacaccuugacagggcac

SEQ ID NO: 2301246 - RNA, 23 nt, Human
accagacaccuugacagggcaca

SEQ ID NO: 2301247 - RNA, 16 nt, Human
accagagaccguccuc

SEQ ID NO: 2301248 - RNA, 18 nt, Human
accagagaccguccucac

SEQ ID NO: 2301249 - RNA, 17 nt, Human
accagacaccuugacag

SEQ ID NO: 2301250 - RNA, 12 nt, Human
accacuuuuguu

SEQ ID NO: 2301251 - RNA, 19 nt, Human
accacuuguguuuugcaag

SEQ ID NO: 2301252 - RNA, 23 nt, Human
accacuuguguuuugcaagccag

SEQ ID NO: 2301253 - RNA, 17 nt, Human
ucaccuccccuccuugc

SEQ ID NO: 2301254 - RNA, 21 nt, Human
ucaccuccggucgugucucug

SEQ ID NO: 2301255 - RNA, 23 nt, Human
ucaccuccggucgugucucuggu

SEQ ID NO: 2301256 - RNA, 15 nt, Human
ucaccuccccuccuu

SEQ ID NO: 2301257 - RNA, 14 nt, Human
ucaccuccccuccu

SEQ ID NO: 2301258 - RNA, 13 nt, Human
ucaccuccccucc

SEQ ID NO: 2301259 - RNA, 16 nt, Human
accaggccgccccagc

SEQ ID NO: 2301260 - RNA, 12 nt, Human
ucaccuccucua

SEQ ID NO: 2301261 - RNA, 22 nt, Human
ucaccuccucuaagguugggca

SEQ ID NO: 2301262 - RNA, 19 nt, Human
accaggccgccccagccuc

SEQ ID NO: 2301263 - RNA, 14 nt, Human
accaggccaccucc

SEQ ID NO: 2301264 - RNA, 17 nt, Human
accaggccaccucccca

SEQ ID NO: 2301265 - RNA, 15 nt, Human
ucaccucccccaucu

SEQ ID NO: 2301266 - RNA, 13 nt, Human
ucaccucccccau

SEQ ID NO: 2301267 - RNA, 19 nt, Human
ucaccugaagacucauucu

SEQ ID NO: 2301268 - RNA, 23 nt, Human
ucaccugagcccggaugcuucuc

SEQ ID NO: 2301269 - RNA, 22 nt, Human
ucaccugagcccggaugcuucu

SEQ ID NO: 2301270 - RNA, 21 nt, Human
ucaccugagcccggaugcuuc

SEQ ID NO: 2301271 - RNA, 22 nt, Human
ucaccugagcaggaccucugaa

SEQ ID NO: 2301272 - RNA, 23 nt, Human
ucaccugaagacucauucuucug

SEQ ID NO: 2301273 - RNA, 19 nt, Human
accaggcaacuugggaacu

SEQ ID NO: 2301274 - RNA, 14 nt, Human
accaggauggcccu

SEQ ID NO: 2301275 - RNA, 23 nt, Human
accaggcacgaacccaccugcug

SEQ ID NO: 2301276 - RNA, 22 nt, Human
accaggcacgaacccaccugcu

SEQ ID NO: 2301277 - RNA, 12 nt, Human
accaggccaccu

SEQ ID NO: 2301278 - RNA, 21 nt, Human
accaggcacgaacccaccugc

SEQ ID NO: 2301279 - RNA, 20 nt, Human
accaggcacgaacccaccug

SEQ ID NO: 2301280 - RNA, 22 nt, Human
accaggagucccugguaauaag

SEQ ID NO: 2301281 - RNA, 17 nt, Human
accaggagucccuggua

SEQ ID NO: 2301282 - RNA, 15 nt, Human
accagcgcccgcugg

SEQ ID NO: 2301283 - RNA, 15 nt, Human
accaggagcugcuca

SEQ ID NO: 2301284 - RNA, 16 nt, Human
accaggagcugcucac

SEQ ID NO: 2301285 - RNA, 18 nt, Human
accaggagggcacuggag

SEQ ID NO: 2301286 - RNA, 14 nt, Human
accaggagcugcuc

SEQ ID NO: 2301287 - RNA, 20 nt, Human
accaggagaaccacuacaug

SEQ ID NO: 2301288 - RNA, 19 nt, Human
accaggagaaccacuacau

SEQ ID NO: 2301289 - RNA, 18 nt, Human
accaggagaaccacuaca

SEQ ID NO: 2301290 - RNA, 14 nt, Human
accaggagaaccac

SEQ ID NO: 2301291 - RNA, 21 nt, Human
accaggacucccuccucaccu

SEQ ID NO: 2301292 - RNA, 18 nt, Human
accaggacucccuccuca

SEQ ID NO: 2301293 - RNA, 17 nt, Human
accaggacucccuccuc

SEQ ID NO: 2301294 - RNA, 22 nt, Human
accagccuuucucccaggccag

SEQ ID NO: 2301295 - RNA, 19 nt, Human
accagccuuucucccaggc

SEQ ID NO: 2301296 - RNA, 23 nt, Human
accagcgaggaggcuccagaggg

SEQ ID NO: 2301297 - RNA, 14 nt, Human
accagcgaagggag

SEQ ID NO: 2301298 - RNA, 13 nt, Human
accagcgcccgcu

SEQ ID NO: 2301299 - RNA, 14 nt, Human
accagcgcccgcug

SEQ ID NO: 2301300 - RNA, 14 nt, Human
accucucccugacc

SEQ ID NO: 2301301 - RNA, 17 nt, Human
accucucccugacccug

SEQ ID NO: 2301302 - RNA, 22 nt, Human
accucucccugacccuguauau

SEQ ID NO: 2301303 - RNA, 23 nt, Human
accucucccugacccuguauaua

SEQ ID NO: 2301304 - RNA, 13 nt, Human
accucucccuugg

SEQ ID NO: 2301305 - RNA, 14 nt, Human
accucucccuugga

SEQ ID NO: 2301306 - RNA, 15 nt, Human
accucucccuuggau

SEQ ID NO: 2301307 - RNA, 18 nt, Human
accucuaauuuauuuugu

SEQ ID NO: 2301308 - RNA, 21 nt, Human
accucuccccuggaacugucu

SEQ ID NO: 2301309 - RNA, 12 nt, Human
accucucccuca

SEQ ID NO: 2301310 - RNA, 22 nt, Human
accucuacuaaaaagaaggaaa

SEQ ID NO: 2301311 - RNA, 23 nt, Human
accucuacuaaaaagaaggaaaa

SEQ ID NO: 2301312 - RNA, 14 nt, Human
accucuccucaugu

SEQ ID NO: 2301313 - RNA, 20 nt, Human
accucuccuuuggccauucc

SEQ ID NO: 2301314 - RNA, 15 nt, Human
accucucccucaaca

SEQ ID NO: 2301315 - RNA, 23 nt, Human
accucucuccuuugcugaggccu

SEQ ID NO: 2301316 - RNA, 19 nt, Human
accucucucacuccuugaa

SEQ ID NO: 2301317 - RNA, 23 nt, Human
accucucccuuggauuguccccg

SEQ ID NO: 2301318 - RNA, 14 nt, Human
accucucucacucc

SEQ ID NO: 2301319 - RNA, 20 nt, Human
accucugaaaacggcccucu

SEQ ID NO: 2301320 - RNA, 14 nt, Human
accucucuuuuuca

SEQ ID NO: 2301321 - RNA, 20 nt, Human
accucugaaacccuggacca

SEQ ID NO: 2301322 - RNA, 22 nt, Human
accucucuuauagaauauuuau

SEQ ID NO: 2301323 - RNA, 23 nt, Human
accucucuuauagaauauuuauu

SEQ ID NO: 2301324 - RNA, 13 nt, Human
accucugauaccu

SEQ ID NO: 2301325 - RNA, 15 nt, Human
accucugauaccuca

SEQ ID NO: 2301326 - RNA, 22 nt, Human
accugaagcuaucguaaaauua

SEQ ID NO: 2301327 - RNA, 12 nt, Human
accucugcacaa

SEQ ID NO: 2301328 - RNA, 16 nt, Human
ucauuguaauguuacu

SEQ ID NO: 2301329 - RNA, 23 nt, Human
ucauuaagguauuauuuuuucca

SEQ ID NO: 2301330 - RNA, 16 nt, Human
accuccuuucucuucu

SEQ ID NO: 2301331 - RNA, 17 nt, Human
accuccuuucucuucuc

SEQ ID NO: 2301332 - RNA, 13 nt, Human
ucauuguaaucac

SEQ ID NO: 2301333 - RNA, 21 nt, Human
ucauuggauucugagagcugu

SEQ ID NO: 2301334 - RNA, 23 nt, Human
ucauugcuuugaagcaguugugu

SEQ ID NO: 2301335 - RNA, 11 nt, Human
ucauuggcuuu

SEQ ID NO: 2301336 - RNA, 14 nt, Human
ucauuggcuuuauc

SEQ ID NO: 2301337 - RNA, 16 nt, Human
ucauuggcuuuauccu

SEQ ID NO: 2301338 - RNA, 17 nt, Human
ucauuggcuuuauccuc

SEQ ID NO: 2301339 - RNA, 17 nt, Human
accucggugccuuccuc

SEQ ID NO: 2301340 - RNA, 18 nt, Human
accucgcuggacucucag

SEQ ID NO: 2301341 - RNA, 16 nt, Human
accucgcuggacucuc

SEQ ID NO: 2301342 - RNA, 14 nt, Human
accucgcuggacuc

SEQ ID NO: 2301343 - RNA, 18 nt, Human
accuccuuucucuucucu

SEQ ID NO: 2301344 - RNA, 20 nt, Human
accuccuuucucuucucugu

SEQ ID NO: 2301345 - RNA, 12 nt, Human
ucauucuccugc

SEQ ID NO: 2301346 - RNA, 15 nt, Human
ucauucguucugugg

SEQ ID NO: 2301347 - RNA, 22 nt, Human
ucauuaagcccucuuccaucau

SEQ ID NO: 2301348 - RNA, 19 nt, Human
ucauugaccugaggcccuu

SEQ ID NO: 2301349 - RNA, 13 nt, Human
ucauucuccugcc

SEQ ID NO: 2301350 - RNA, 14 nt, Human
ucauucuccugccu

SEQ ID NO: 2301351 - RNA, 15 nt, Human
ucauucuccugccug

SEQ ID NO: 2301352 - RNA, 16 nt, Human
ucauucuccugccugu

SEQ ID NO: 2301353 - RNA, 21 nt, Human
ucauucuccuuguguuacuaa

SEQ ID NO: 2301354 - RNA, 21 nt, Human
ucauugacuaucaaacugaag

SEQ ID NO: 2301355 - RNA, 20 nt, Human
ucauugacuaucaaacugaa

SEQ ID NO: 2301356 - RNA, 14 nt, Human
ucauugagaguuuu

SEQ ID NO: 2301357 - RNA, 18 nt, Human
ucauugagaguuuugucu

SEQ ID NO: 2301358 - RNA, 22 nt, Human
ucauugaccugaggcccuucuc

SEQ ID NO: 2301359 - RNA, 16 nt, Human
ucauugauaugaaaaa

SEQ ID NO: 2301360 - RNA, 15 nt, Human
ucauugauaugaaaa

SEQ ID NO: 2301361 - RNA, 13 nt, Human
ucauugauaugaa

SEQ ID NO: 2301362 - RNA, 19 nt, Human
ucauugagaguuuugucuu

SEQ ID NO: 2301363 - RNA, 18 nt, Human
ucauugauaugaaaaaua

SEQ ID NO: 2301364 - RNA, 17 nt, Human
ucauugauaugaaaaau

SEQ ID NO: 2301365 - RNA, 13 nt, Human
ucauugcuuacaa

SEQ ID NO: 2301366 - RNA, 21 nt, Human
ucauugcuuugaagcaguugu

SEQ ID NO: 2301367 - RNA, 22 nt, Human
ucaugacauuccuaaacuaucu

SEQ ID NO: 2301368 - RNA, 19 nt, Human
ucaugacauguuauauauu

SEQ ID NO: 2301369 - RNA, 21 nt, Human
ucaugacauguuauauauuuu

SEQ ID NO: 2301370 - RNA, 14 nt, Human
ucaugacauguuau

SEQ ID NO: 2301371 - RNA, 17 nt, Human
ucaugacauguuauaua

SEQ ID NO: 2301372 - RNA, 19 nt, Human
ucaugacaaagacugagua

SEQ ID NO: 2301373 - RNA, 20 nt, Human
ucaugaauucuuaugcuuau

SEQ ID NO: 2301374 - RNA, 19 nt, Human
ucauccacugugccaugug

SEQ ID NO: 2301375 - RNA, 21 nt, Human
ucauccacugugccaugugcc

SEQ ID NO: 2301376 - RNA, 23 nt, Human
ucauccacugugccaugugccag

SEQ ID NO: 2301377 - RNA, 22 nt, Human
ucaugaauuaguuuuauaugcu

SEQ ID NO: 2301378 - RNA, 17 nt, Human
ucaugacuuuuccaugu

SEQ ID NO: 2301379 - RNA, 18 nt, Human
ucaugacuuuuccaugua

SEQ ID NO: 2301380 - RNA, 16 nt, Human
ucaugagcugagcagg

SEQ ID NO: 2301381 - RNA, 18 nt, Human
ucaugagugaauaaaugu

SEQ ID NO: 2301382 - RNA, 12 nt, Human
ucaugcauuguu

SEQ ID NO: 2301383 - RNA, 18 nt, Human
ucaugcauguccuguaaa

SEQ ID NO: 2301384 - RNA, 15 nt, Human
ucaugcauggaaauu

SEQ ID NO: 2301385 - RNA, 22 nt, Human
ucaugauagaaggcuaugggga

SEQ ID NO: 2301386 - RNA, 14 nt, Human
ucaugcauggaaau

SEQ ID NO: 2301387 - RNA, 13 nt, Human
ucaugcccacccc

SEQ ID NO: 2301388 - RNA, 21 nt, Human
ucaugccaagcauuuaaugua

SEQ ID NO: 2301389 - RNA, 15 nt, Human
ucaugcccacccccu

SEQ ID NO: 2301390 - RNA, 21 nt, Human
ucaugccagcuacuuccuccu

SEQ ID NO: 2301391 - RNA, 23 nt, Human
ucaugccagcuacuuccuccucc

SEQ ID NO: 2301392 - RNA, 22 nt, Human
ucaugccaccauggccagccaa

SEQ ID NO: 2301393 - RNA, 12 nt, Human
ucaugccagcua

SEQ ID NO: 2301394 - RNA, 19 nt, Human
ucaugccaccauggccagc

SEQ ID NO: 2301395 - RNA, 16 nt, Human
ucaugccaagcauuua

SEQ ID NO: 2301396 - RNA, 16 nt, Human
ucaugcccacccccug

SEQ ID NO: 2301397 - RNA, 18 nt, Human
ucaugcccacccccugcc

SEQ ID NO: 2301398 - RNA, 19 nt, Human
ucaugcccacccccugccc

SEQ ID NO: 2301399 - RNA, 20 nt, Human
ucaugcccacccccugcccu

SEQ ID NO: 2301400 - RNA, 21 nt, Human
ucaugcccacccccugcccug

SEQ ID NO: 2301401 - RNA, 22 nt, Human
ucaugcccacccccugcccugc

SEQ ID NO: 2301402 - RNA, 23 nt, Human
ucaugcccacccccugcccugca

SEQ ID NO: 2301403 - RNA, 18 nt, Human
ucaugucaacuucuggcu

SEQ ID NO: 2301404 - RNA, 21 nt, Human
ucaugucaacuucuggcuccu

SEQ ID NO: 2301405 - RNA, 14 nt, Human
ucaugucaggccug

SEQ ID NO: 2301406 - RNA, 16 nt, Human
ucaugucaggccugug

SEQ ID NO: 2301407 - RNA, 17 nt, Human
ucaugucaggccugugu

SEQ ID NO: 2301408 - RNA, 19 nt, Human
ucaugucaggccugugugu

SEQ ID NO: 2301409 - RNA, 17 nt, Human
ucauguccccaaaccug

SEQ ID NO: 2301410 - RNA, 20 nt, Human
ucauguccccaaaccugcaa

SEQ ID NO: 2301411 - RNA, 21 nt, Human
ucauguccccaaaccugcaag

SEQ ID NO: 2301412 - RNA, 15 nt, Human
ucauuaaagcauuua

SEQ ID NO: 2301413 - RNA, 18 nt, Human
ucauuaaaggcuucucuc

SEQ ID NO: 2301414 - RNA, 21 nt, Human
ucauguuuuugaaacagaacc

SEQ ID NO: 2301415 - RNA, 14 nt, Human
ucauuaaaguucua

SEQ ID NO: 2301416 - RNA, 12 nt, Human
ucauuaaaguuc

SEQ ID NO: 2301417 - RNA, 13 nt, Human
ucauuaaaguucu

SEQ ID NO: 2301418 - RNA, 21 nt, Human
ucauuaaaauaaauaaaugca

SEQ ID NO: 2301419 - RNA, 14 nt, Human
ucauguuuugugac

SEQ ID NO: 2301420 - RNA, 15 nt, Human
ucauguuuugugacu

SEQ ID NO: 2301421 - RNA, 16 nt, Human
ucauguuuugugacua

SEQ ID NO: 2301422 - RNA, 17 nt, Human
ucauguuuugugacuau

SEQ ID NO: 2301423 - RNA, 23 nt, Human
ucauuccuugagaaaaacaauga

SEQ ID NO: 2301424 - RNA, 18 nt, Human
ucauuaagcccucuucca

SEQ ID NO: 2301425 - RNA, 19 nt, Human
ucauuaagcccucuuccau

SEQ ID NO: 2301426 - RNA, 15 nt, Human
ucauuaaauggggcu

SEQ ID NO: 2301427 - RNA, 17 nt, Human
ucauguucuuaauucuu

SEQ ID NO: 2301428 - RNA, 11 nt, Human
ucauguucuua

SEQ ID NO: 2301429 - RNA, 22 nt, Human
ucauguugcacacccacucagc

SEQ ID NO: 2301430 - RNA, 21 nt, Human
ucauguuccuucaagaucaug

SEQ ID NO: 2301431 - RNA, 17 nt, Human
ucauguuggccaggcug

SEQ ID NO: 2301432 - RNA, 13 nt, Human
ucauguuggucaa

SEQ ID NO: 2301433 - RNA, 18 nt, Human
ucauguuuuaacaaaaac

SEQ ID NO: 2301434 - RNA, 16 nt, Human
ucauguuuuaacaaaa

SEQ ID NO: 2301435 - RNA, 22 nt, Human
ucauguuuuccauuguuugaaa

SEQ ID NO: 2301436 - RNA, 14 nt, Human
ucauguuuaagaaa

SEQ ID NO: 2301437 - RNA, 16 nt, Human
ucauguuuaagaaauu

SEQ ID NO: 2301438 - RNA, 13 nt, Human
ucaugucuggcua

SEQ ID NO: 2301439 - RNA, 14 nt, Human
ucaugugaaaucau

SEQ ID NO: 2301440 - RNA, 12 nt, Human
ucaugugugucc

SEQ ID NO: 2301441 - RNA, 14 nt, Human
ucaugugugcucuu

SEQ ID NO: 2301442 - RNA, 20 nt, Human
ucaugugugcaacaggguau

SEQ ID NO: 2301443 - RNA, 16 nt, Human
ucaugugugcucuucu

SEQ ID NO: 2301444 - RNA, 17 nt, Human
ucauguguuugaacuuc

SEQ ID NO: 2301445 - RNA, 23 nt, Human
ucauguguguccacgacugucuc

SEQ ID NO: 2301446 - RNA, 21 nt, Human
ucauguguguccacgacuguc

SEQ ID NO: 2301447 - RNA, 16 nt, Human
ucauguguguccacga

SEQ ID NO: 2301448 - RNA, 13 nt, Human
ucauguuccucaa

SEQ ID NO: 2301449 - RNA, 14 nt, Human
ucauguuccuucaa

SEQ ID NO: 2301450 - RNA, 13 nt, Human
ucauguuccaaau

SEQ ID NO: 2301451 - RNA, 12 nt, Human
ucauauugaaua

SEQ ID NO: 2301452 - RNA, 16 nt, Human
ucauauuuacuucuua

SEQ ID NO: 2301453 - RNA, 22 nt, Human
ucauauuuacuucuuauacauu

SEQ ID NO: 2301454 - RNA, 21 nt, Human
ucauauuuacuucuuauacau

SEQ ID NO: 2301455 - RNA, 20 nt, Human
ucauauuuacuucuuauaca

SEQ ID NO: 2301456 - RNA, 23 nt, Human
accgagaguagccgagagccugc

SEQ ID NO: 2301457 - RNA, 15 nt, Human
accgagcaaagauca

SEQ ID NO: 2301458 - RNA, 17 nt, Human
accgagaguagccgaga

SEQ ID NO: 2301459 - RNA, 18 nt, Human
accgagucucuucuccac

SEQ ID NO: 2301460 - RNA, 17 nt, Human
accgacgcgucuccugu

SEQ ID NO: 2301461 - RNA, 18 nt, Human
accgacgcgucuccuguu

SEQ ID NO: 2301462 - RNA, 18 nt, Human
accgacguugccaucaaa

SEQ ID NO: 2301463 - RNA, 23 nt, Human
accgaccugguuuuuaaauagag

SEQ ID NO: 2301464 - RNA, 16 nt, Human
accgacgcgucuccug

SEQ ID NO: 2301465 - RNA, 20 nt, Human
accgaaguggacuggccccu

SEQ ID NO: 2301466 - RNA, 21 nt, Human
accgaaguggacuggccccug

SEQ ID NO: 2301467 - RNA, 23 nt, Human
accgaaguggacuggccccuggg

SEQ ID NO: 2301468 - RNA, 12 nt, Human
acccuuuggggg

SEQ ID NO: 2301469 - RNA, 12 nt, Human
acccuuugguuu

SEQ ID NO: 2301470 - RNA, 23 nt, Human
acccuuuggggggggcccgccug

SEQ ID NO: 2301471 - RNA, 22 nt, Human
acccuuugcugugaggcugucc

SEQ ID NO: 2301472 - RNA, 23 nt, Human
acccuuugcugugaggcuguccu

SEQ ID NO: 2301473 - RNA, 12 nt, Human
acccuuuuccag

SEQ ID NO: 2301474 - RNA, 21 nt, Human
acccuuugguuuuuuucuucu

SEQ ID NO: 2301475 - RNA, 23 nt, Human
acccuuugguuuuuuucuucugu

SEQ ID NO: 2301476 - RNA, 14 nt, Human
acccuuuuggcccc

SEQ ID NO: 2301477 - RNA, 10 nt, Human
acccuuuucu

SEQ ID NO: 2301478 - RNA, 23 nt, Human
acccuuuuggcccccgagcuggg

SEQ ID NO: 2301479 - RNA, 13 nt, Human
ucauauguugcuc

SEQ ID NO: 2301480 - RNA, 14 nt, Human
ucauauguugcuca

SEQ ID NO: 2301481 - RNA, 15 nt, Human
ucauauguugcucag

SEQ ID NO: 2301482 - RNA, 20 nt, Human
ucauauguugcucagucucc

SEQ ID NO: 2301483 - RNA, 18 nt, Human
ucauauguugcucagucu

SEQ ID NO: 2301484 - RNA, 19 nt, Human
ucauauguugcucagucuc

SEQ ID NO: 2301485 - RNA, 17 nt, Human
ucauauuccugcagccu

SEQ ID NO: 2301486 - RNA, 16 nt, Human
ucauauucugucugga

SEQ ID NO: 2301487 - RNA, 12 nt, Human
ucauauuauaca

SEQ ID NO: 2301488 - RNA, 20 nt, Human
accgcugccuaaguggcugc

SEQ ID NO: 2301489 - RNA, 19 nt, Human
accgcugccuaaguggcug

SEQ ID NO: 2301490 - RNA, 13 nt, Human
accgcugaauaug

SEQ ID NO: 2301491 - RNA, 17 nt, Human
accgcugauucucaggg

SEQ ID NO: 2301492 - RNA, 22 nt, Human
accgcuuccggcuccugugcuu

SEQ ID NO: 2301493 - RNA, 21 nt, Human
accgcugccuaaguggcugcu

SEQ ID NO: 2301494 - RNA, 16 nt, Human
accgcuuccggcuccu

SEQ ID NO: 2301495 - RNA, 23 nt, Human
accggagcuuucaaagaaggaau

SEQ ID NO: 2301496 - RNA, 16 nt, Human
accggacuuuucugca

SEQ ID NO: 2301497 - RNA, 15 nt, Human
accggacuuuucugc

SEQ ID NO: 2301498 - RNA, 18 nt, Human
accgugggcagggagcgg

SEQ ID NO: 2301499 - RNA, 16 nt, Human
accgugggcagggagc

SEQ ID NO: 2301500 - RNA, 21 nt, Human
accgccgacuuuguacccccc

SEQ ID NO: 2301501 - RNA, 16 nt, Human
accgccuccuacagcc

SEQ ID NO: 2301502 - RNA, 20 nt, Human
accgcuccccagcccagggu

SEQ ID NO: 2301503 - RNA, 19 nt, Human
accgcuccccagcccaggg

SEQ ID NO: 2301504 - RNA, 18 nt, Human
accgcuccccagcccagg

SEQ ID NO: 2301505 - RNA, 17 nt, Human
accgcuccccagcccag

SEQ ID NO: 2301506 - RNA, 15 nt, Human
accgcuccccagccc

SEQ ID NO: 2301507 - RNA, 12 nt, Human
accgccuucucu

SEQ ID NO: 2301508 - RNA, 11 nt, Human
accgcccccuc

SEQ ID NO: 2301509 - RNA, 12 nt, Human
accgcccccucc

SEQ ID NO: 2301510 - RNA, 14 nt, Human
accgcccccuccuc

SEQ ID NO: 2301511 - RNA, 19 nt, Human
accgcccccuccucuagcu

SEQ ID NO: 2301512 - RNA, 18 nt, Human
accgccgacuuuguaccc

SEQ ID NO: 2301513 - RNA, 23 nt, Human
accgaugcuccagccaaccccug

SEQ ID NO: 2301514 - RNA, 22 nt, Human
accgauucaucucucagaaggg

SEQ ID NO: 2301515 - RNA, 15 nt, Human
accgaugcuccagcc

SEQ ID NO: 2301516 - RNA, 13 nt, Human
accgaugcuccag

SEQ ID NO: 2301517 - RNA, 21 nt, Human
accgagugaaccuaccuucau

SEQ ID NO: 2301518 - RNA, 20 nt, Human
accgcagacaggaccaggga

SEQ ID NO: 2301519 - RNA, 20 nt, Human
accgagucucuucuccacug

SEQ ID NO: 2301520 - RNA, 21 nt, Human
accgagucucuucuccacugg

SEQ ID NO: 2301521 - RNA, 24 nt, Human
accgagucucuucuccacuggaug

SEQ ID NO: 2301522 - RNA, 17 nt, Human
accgagcaaagaucaaa

SEQ ID NO: 2301523 - RNA, 19 nt, Human
accgagcaaagaucaaaau

SEQ ID NO: 2301524 - RNA, 23 nt, Human
accgagccucugucacugcaggc

SEQ ID NO: 2301525 - RNA, 14 nt, Human
accgagugaaccua

SEQ ID NO: 2301526 - RNA, 19 nt, Human
accgcaggaagcugcuccg

SEQ ID NO: 2301527 - RNA, 16 nt, Human
accgcaggaagcugcu

SEQ ID NO: 2301528 - RNA, 21 nt, Human
accgcagucgucgcacagucu

SEQ ID NO: 2301529 - RNA, 22 nt, Human
accgcagucgucgcacagucuc

SEQ ID NO: 2301530 - RNA, 23 nt, Human
accgcagucgucgcacagucucu

SEQ ID NO: 2301531 - RNA, 14 nt, Human
accgcaugcccccu

SEQ ID NO: 2301532 - RNA, 22 nt, Human
accgcaugcccccucgugccag

SEQ ID NO: 2301533 - RNA, 21 nt, Human
accgccacacacacaggagca

SEQ ID NO: 2301534 - RNA, 20 nt, Human
accgccagauggggccucug

SEQ ID NO: 2301535 - RNA, 17 nt, Human
accgccacauggcuucc

SEQ ID NO: 2301536 - RNA, 17 nt, Human
accgccagauggggccu

SEQ ID NO: 2301537 - RNA, 14 nt, Human
accgcaggaagcug

SEQ ID NO: 2301538 - RNA, 13 nt, Human
accgcaggaagcu

SEQ ID NO: 2301539 - RNA, 12 nt, Human
accgcaggaagc

SEQ ID NO: 2301540 - RNA, 17 nt, Human
accgccaaggcuggggg

SEQ ID NO: 2301541 - RNA, 17 nt, Human
accuauaugauuuauag

SEQ ID NO: 2301542 - RNA, 15 nt, Human
accuaucucguggga

SEQ ID NO: 2301543 - RNA, 17 nt, Human
accuaucucgugggaga

SEQ ID NO: 2301544 - RNA, 18 nt, Human
accuaucucgugggagag

SEQ ID NO: 2301545 - RNA, 22 nt, Human
accuauagucccagcuacucag

SEQ ID NO: 2301546 - RNA, 22 nt, Human
accuauauaauaaagcuacuga

SEQ ID NO: 2301547 - RNA, 13 nt, Human
accuauaugauuu

SEQ ID NO: 2301548 - RNA, 16 nt, Human
accuauagucccagcu

SEQ ID NO: 2301549 - RNA, 15 nt, Human
accuauagucccagc

SEQ ID NO: 2301550 - RNA, 22 nt, Human
accuaugguauaaugguugacu

SEQ ID NO: 2301551 - RNA, 19 nt, Human
accuaugauauuuucugug

SEQ ID NO: 2301552 - RNA, 15 nt, Human
accuaugucauuuca

SEQ ID NO: 2301553 - RNA, 12 nt, Human
accuaugucauu

SEQ ID NO: 2301554 - RNA, 14 nt, Human
accucaagcugcau

SEQ ID NO: 2301555 - RNA, 18 nt, Human
accuaugucauuucauuu

SEQ ID NO: 2301556 - RNA, 16 nt, Human
accuaugucauuucau

SEQ ID NO: 2301557 - RNA, 23 nt, Human
accuagcagcaccguucugugca

SEQ ID NO: 2301558 - RNA, 16 nt, Human
accuagcgucaguauu

SEQ ID NO: 2301559 - RNA, 13 nt, Human
accuagccuuaga

SEQ ID NO: 2301560 - RNA, 22 nt, Human
accuagcagcaccguucugugc

SEQ ID NO: 2301561 - RNA, 21 nt, Human
accuagcagcaccguucugug

SEQ ID NO: 2301562 - RNA, 14 nt, Human
accuagcagcaccg

SEQ ID NO: 2301563 - RNA, 20 nt, Human
accuaaguuucaguugauuu

SEQ ID NO: 2301564 - RNA, 18 nt, Human
accuaaguccuuuaugug

SEQ ID NO: 2301565 - RNA, 23 nt, Human
accuaagggacauguuuugauaa

SEQ ID NO: 2301566 - RNA, 21 nt, Human
accuaacucaccuaacucaua

SEQ ID NO: 2301567 - RNA, 15 nt, Human
accuaagggacaugu

SEQ ID NO: 2301568 - RNA, 16 nt, Human
accuaagggacauguu

SEQ ID NO: 2301569 - RNA, 16 nt, Human
accuaaucaggcugag

SEQ ID NO: 2301570 - RNA, 17 nt, Human
accuaaucaggcugagg

SEQ ID NO: 2301571 - RNA, 15 nt, Human
accuaauccaggcag

SEQ ID NO: 2301572 - RNA, 11 nt, Human
accuaauccaa

SEQ ID NO: 2301573 - RNA, 20 nt, Human
accuaauccaggcagaucca

SEQ ID NO: 2301574 - RNA, 18 nt, Human
accuaaccccuuuccugc

SEQ ID NO: 2301575 - RNA, 14 nt, Human
accguuucuucccu

SEQ ID NO: 2301576 - RNA, 13 nt, Human
accuaaaaaagau

SEQ ID NO: 2301577 - RNA, 17 nt, Human
accuaaccccuuuccug

SEQ ID NO: 2301578 - RNA, 19 nt, Human
accuaacgcccuauuuuug

SEQ ID NO: 2301579 - RNA, 18 nt, Human
accguuggggauugggga

SEQ ID NO: 2301580 - RNA, 13 nt, Human
accguuucuuccc

SEQ ID NO: 2301581 - RNA, 14 nt, Human
accguucugugcac

SEQ ID NO: 2301582 - RNA, 21 nt, Human
accguguugguuuugacugga

SEQ ID NO: 2301583 - RNA, 14 nt, Human
accguguaaaccaa

SEQ ID NO: 2301584 - RNA, 16 nt, Human
accgugggcucccuga

SEQ ID NO: 2301585 - RNA, 14 nt, Human
accgugggcucccu

SEQ ID NO: 2301586 - RNA, 15 nt, Human
accgugggcggggcc

SEQ ID NO: 2301587 - RNA, 17 nt, Human
accgugggcggggccuu

SEQ ID NO: 2301588 - RNA, 19 nt, Human
accgugggcggggccuugc

SEQ ID NO: 2301589 - RNA, 20 nt, Human
accgugggcggggccuugcg

SEQ ID NO: 2301590 - RNA, 13 nt, Human
accuccccaggcc

SEQ ID NO: 2301591 - RNA, 14 nt, Human
accuccccaggccg

SEQ ID NO: 2301592 - RNA, 19 nt, Human
accuccccaggccguggcu

SEQ ID NO: 2301593 - RNA, 20 nt, Human
accuccccaggccguggcug

SEQ ID NO: 2301594 - RNA, 13 nt, Human
accuccccagccu

SEQ ID NO: 2301595 - RNA, 23 nt, Human
accuccccagccccuagcccagg

SEQ ID NO: 2301596 - RNA, 20 nt, Human
accuccgccucuuggguuca

SEQ ID NO: 2301597 - RNA, 18 nt, Human
accuccccccacugcagg

SEQ ID NO: 2301598 - RNA, 17 nt, Human
accuccccccacugcag

SEQ ID NO: 2301599 - RNA, 16 nt, Human
accuccccccacugca

SEQ ID NO: 2301600 - RNA, 15 nt, Human
accuccccccacugc

SEQ ID NO: 2301601 - RNA, 14 nt, Human
accuccccccacug

SEQ ID NO: 2301602 - RNA, 13 nt, Human
accuccccccacu

SEQ ID NO: 2301603 - RNA, 23 nt, Human
accuccuacgucaaacaugaagu

SEQ ID NO: 2301604 - RNA, 19 nt, Human
accucccccucccccuucu

SEQ ID NO: 2301605 - RNA, 22 nt, Human
accuccccccacugcaggcccc

SEQ ID NO: 2301606 - RNA, 20 nt, Human
accucccccucccccuucuc

SEQ ID NO: 2301607 - RNA, 16 nt, Human
accuccuccacaccag

SEQ ID NO: 2301608 - RNA, 14 nt, Human
accuccucagggau

SEQ ID NO: 2301609 - RNA, 23 nt, Human
accuccucagggauggccguugg

SEQ ID NO: 2301610 - RNA, 13 nt, Human
accuccucaggga

SEQ ID NO: 2301611 - RNA, 19 nt, Human
accucagaguccaggcccc

SEQ ID NO: 2301612 - RNA, 17 nt, Human
accucagaguccaggcc

SEQ ID NO: 2301613 - RNA, 20 nt, Human
accucagaguccaggcccca

SEQ ID NO: 2301614 - RNA, 22 nt, Human
accucagaggcuguucuugggg

SEQ ID NO: 2301615 - RNA, 18 nt, Human
accucagaguauggagcu

SEQ ID NO: 2301616 - RNA, 20 nt, Human
accucacugaaaacaucugg

SEQ ID NO: 2301617 - RNA, 22 nt, Human
accucagacuuaccaggaagca

SEQ ID NO: 2301618 - RNA, 10 nt, Human
accucagccu

SEQ ID NO: 2301619 - RNA, 23 nt, Human
accucagccaugaggaguugcug

SEQ ID NO: 2301620 - RNA, 22 nt, Human
accucagccaugaggaguugcu

SEQ ID NO: 2301621 - RNA, 14 nt, Human
accucagccaugag

SEQ ID NO: 2301622 - RNA, 15 nt, Human
accucagccuagacc

SEQ ID NO: 2301623 - RNA, 13 nt, Human
accucagccuaga

SEQ ID NO: 2301624 - RNA, 16 nt, Human
accuccccagccccua

SEQ ID NO: 2301625 - RNA, 19 nt, Human
accuccccagccccuagcc

SEQ ID NO: 2301626 - RNA, 21 nt, Human
accucaagggggacugucuuu

SEQ ID NO: 2301627 - RNA, 20 nt, Human
accucaagggggacugucuu

SEQ ID NO: 2301628 - RNA, 15 nt, Human
accucaagggggacu

SEQ ID NO: 2301629 - RNA, 10 nt, Human
accucaaggg

SEQ ID NO: 2301630 - RNA, 16 nt, Human
accucaagcugcaucu

SEQ ID NO: 2301631 - RNA, 19 nt, Human
accucaaguuuuuguuuug

SEQ ID NO: 2301632 - RNA, 23 nt, Human
accucacugggguccuggggccu

SEQ ID NO: 2301633 - RNA, 21 nt, Human
accucacugggguccuggggc

SEQ ID NO: 2301634 - RNA, 12 nt, Human
accucaccccac

SEQ ID NO: 2301635 - RNA, 15 nt, Human
accucaccccacuua

SEQ ID NO: 2301636 - RNA, 11 nt, Human
accucacccca

SEQ ID NO: 2301637 - RNA, 18 nt, Human
accucacagaaaugagau

SEQ ID NO: 2301638 - RNA, 23 nt, Human
accuuaggaauaaucuccuguua

SEQ ID NO: 2301639 - RNA, 15 nt, Human
accuuaggcagggaa

SEQ ID NO: 2301640 - RNA, 13 nt, Human
accuuaggcaggg

SEQ ID NO: 2301641 - RNA, 16 nt, Human
accuuaggcagggaag

SEQ ID NO: 2301642 - RNA, 13 nt, Human
accuuaggccuuc

SEQ ID NO: 2301643 - RNA, 22 nt, Human
accuuagcuggcauuacagcug

SEQ ID NO: 2301644 - RNA, 21 nt, Human
accuuagcuggcauuacagcu

SEQ ID NO: 2301645 - RNA, 18 nt, Human
accuuagauuagcucugg

SEQ ID NO: 2301646 - RNA, 19 nt, Human
accuuagauuagcucugga

SEQ ID NO: 2301647 - RNA, 17 nt, Human
accuuagauuagcucug

SEQ ID NO: 2301648 - RNA, 14 nt, Human
accuuagccugccc

SEQ ID NO: 2301649 - RNA, 17 nt, Human
accuuagacagucccug

SEQ ID NO: 2301650 - RNA, 17 nt, Human
accuuaggccuuccucu

SEQ ID NO: 2301651 - RNA, 16 nt, Human
accuuaggccuuccuc

SEQ ID NO: 2301652 - RNA, 15 nt, Human
accuuaggccuuccu

SEQ ID NO: 2301653 - RNA, 14 nt, Human
accuuaggccuucc

SEQ ID NO: 2301654 - RNA, 20 nt, Human
accuuaggccuuccucucuc

SEQ ID NO: 2301655 - RNA, 18 nt, Human
accuuaggccuuccucuc

SEQ ID NO: 2301656 - RNA, 21 nt, Human
accuuaggccuuccucucucc

SEQ ID NO: 2301657 - RNA, 14 nt, Human
accuuaguggcuuu

SEQ ID NO: 2301658 - RNA, 14 nt, Human
accuuaguguuucu

SEQ ID NO: 2301659 - RNA, 15 nt, Human
accuuaguguuucug

SEQ ID NO: 2301660 - RNA, 19 nt, Human
accuuaguguuucugugca

SEQ ID NO: 2301661 - RNA, 20 nt, Human
accuuaguguuucugugcau

SEQ ID NO: 2301662 - RNA, 21 nt, Human
accuuaguguuucugugcaug

SEQ ID NO: 2301663 - RNA, 21 nt, Human
uccaccaggaaccucuucaga

SEQ ID NO: 2301664 - RNA, 19 nt, Human
uccaccaggaaccucuuca

SEQ ID NO: 2301665 - RNA, 15 nt, Human
uccaccaucaagcca

SEQ ID NO: 2301666 - RNA, 22 nt, Human
accuggucacaggacucugccu

SEQ ID NO: 2301667 - RNA, 23 nt, Human
accuggucacaggacucugccuc

SEQ ID NO: 2301668 - RNA, 22 nt, Human
accugguuccggaauccugucc

SEQ ID NO: 2301669 - RNA, 15 nt, Human
accugguggccucug

SEQ ID NO: 2301670 - RNA, 22 nt, Human
accuggugcuggauauuuucaa

SEQ ID NO: 2301671 - RNA, 21 nt, Human
accuuaaguaagcaacagcau

SEQ ID NO: 2301672 - RNA, 11 nt, Human
accuggugcug

SEQ ID NO: 2301673 - RNA, 10 nt, Human
accuggugcu

SEQ ID NO: 2301674 - RNA, 14 nt, Human
accuggucucuccu

SEQ ID NO: 2301675 - RNA, 14 nt, Human
accuggugcuggau

SEQ ID NO: 2301676 - RNA, 13 nt, Human
accuggugcugga

SEQ ID NO: 2301677 - RNA, 16 nt, Human
accuggugcugccucu

SEQ ID NO: 2301678 - RNA, 21 nt, Human
accuuacuguggaggaaggau

SEQ ID NO: 2301679 - RNA, 19 nt, Human
accuuaccaacuuucugua

SEQ ID NO: 2301680 - RNA, 15 nt, Human
accuuacuguggagg

SEQ ID NO: 2301681 - RNA, 20 nt, Human
accuuaccaacuuucuguaa

SEQ ID NO: 2301682 - RNA, 16 nt, Human
accuuaccaacuuucu

SEQ ID NO: 2301683 - RNA, 17 nt, Human
accuuaccaacuuucug

SEQ ID NO: 2301684 - RNA, 18 nt, Human
accuuaccaacuuucugu

SEQ ID NO: 2301685 - RNA, 15 nt, Human
accuuaccaacuuuc

SEQ ID NO: 2301686 - RNA, 22 nt, Human
accuuaaguaagcaacagcaua

SEQ ID NO: 2301687 - RNA, 12 nt, Human
accuucuguggc

SEQ ID NO: 2301688 - RNA, 13 nt, Human
accuucuguaguu

SEQ ID NO: 2301689 - RNA, 13 nt, Human
accuucuccuuca

SEQ ID NO: 2301690 - RNA, 13 nt, Human
accuucuguggcu

SEQ ID NO: 2301691 - RNA, 15 nt, Human
accuucuguggcuca

SEQ ID NO: 2301692 - RNA, 20 nt, Human
accuucuucagccaccucuc

SEQ ID NO: 2301693 - RNA, 19 nt, Human
accuucuucagccaccucu

SEQ ID NO: 2301694 - RNA, 16 nt, Human
accuucuguggcucac

SEQ ID NO: 2301695 - RNA, 15 nt, Human
accuugacagggcac

SEQ ID NO: 2301696 - RNA, 14 nt, Human
accuugacagggca

SEQ ID NO: 2301697 - RNA, 15 nt, Human
accuugaaugaugcc

SEQ ID NO: 2301698 - RNA, 19 nt, Human
accuuccauggcucuuuuu

SEQ ID NO: 2301699 - RNA, 17 nt, Human
accuuccagcuccugua

SEQ ID NO: 2301700 - RNA, 14 nt, Human
accuucccaaacgc

SEQ ID NO: 2301701 - RNA, 13 nt, Human
accuuccagcucc

SEQ ID NO: 2301702 - RNA, 14 nt, Human
accuuccagcuccu

SEQ ID NO: 2301703 - RNA, 11 nt, Human
accuuaucugu

SEQ ID NO: 2301704 - RNA, 22 nt, Human
accuuaguguuucugugcaugg

SEQ ID NO: 2301705 - RNA, 13 nt, Human
accuuaucugugc

SEQ ID NO: 2301706 - RNA, 17 nt, Human
accuuccaagagccuga

SEQ ID NO: 2301707 - RNA, 11 nt, Human
accuucccagc

SEQ ID NO: 2301708 - RNA, 17 nt, Human
accuuccagucaggaug

SEQ ID NO: 2301709 - RNA, 22 nt, Human
accuucccaaacgccuccccug

SEQ ID NO: 2301710 - RNA, 21 nt, Human
accuucccaaacgccuccccu

SEQ ID NO: 2301711 - RNA, 19 nt, Human
accuucccaaacgccuccc

SEQ ID NO: 2301712 - RNA, 14 nt, Human
accuucuccaaaug

SEQ ID NO: 2301713 - RNA, 12 nt, Human
accuucccagcu

SEQ ID NO: 2301714 - RNA, 17 nt, Human
accuucuccccauucug

SEQ ID NO: 2301715 - RNA, 23 nt, Human
accuucucccucauuucaggagc

SEQ ID NO: 2301716 - RNA, 12 nt, Human
accuucuccuuc

SEQ ID NO: 2301717 - RNA, 17 nt, Human
uccacguucaccccucc

SEQ ID NO: 2301718 - RNA, 19 nt, Human
uccacguucugcucaucau

SEQ ID NO: 2301719 - RNA, 18 nt, Human
uccacggucuguucuuga

SEQ ID NO: 2301720 - RNA, 16 nt, Human
uccacgucccccuggg

SEQ ID NO: 2301721 - RNA, 17 nt, Human
uccacgucccccugggg

SEQ ID NO: 2301722 - RNA, 18 nt, Human
uccacgucccccuggggc

SEQ ID NO: 2301723 - RNA, 16 nt, Human
uccacggucuguucuu

SEQ ID NO: 2301724 - RNA, 13 nt, Human
uccacuacugcua

SEQ ID NO: 2301725 - RNA, 15 nt, Human
uccacuagugcaaau

SEQ ID NO: 2301726 - RNA, 17 nt, Human
uccacuagugcaaauca

SEQ ID NO: 2301727 - RNA, 16 nt, Human
uccacuacaccuggcu

SEQ ID NO: 2301728 - RNA, 17 nt, Human
uccacuacaccuggcug

SEQ ID NO: 2301729 - RNA, 18 nt, Human
uccacuacaccuggcuga

SEQ ID NO: 2301730 - RNA, 21 nt, Human
uccacguucugcucaucauuc

SEQ ID NO: 2301731 - RNA, 20 nt, Human
uccacguucugcucaucauu

SEQ ID NO: 2301732 - RNA, 11 nt, Human
uccacuaaccc

SEQ ID NO: 2301733 - RNA, 16 nt, Human
uccacuaaccccgggc

SEQ ID NO: 2301734 - RNA, 19 nt, Human
uccacuaaccccgggcggg

SEQ ID NO: 2301735 - RNA, 15 nt, Human
uccacuacaccuggc

SEQ ID NO: 2301736 - RNA, 11 nt, Human
accuuugucac

SEQ ID NO: 2301737 - RNA, 23 nt, Human
accuuuguauucucuccuguacc

SEQ ID NO: 2301738 - RNA, 19 nt, Human
accuuuguauucucuccug

SEQ ID NO: 2301739 - RNA, 15 nt, Human
accuuuguauucucu

SEQ ID NO: 2301740 - RNA, 22 nt, Human
uccagaaguuugagaucagccu

SEQ ID NO: 2301741 - RNA, 23 nt, Human
uccagaagggguuuggucuggga

SEQ ID NO: 2301742 - RNA, 15 nt, Human
uccagaagugugauu

SEQ ID NO: 2301743 - RNA, 22 nt, Human
uccagaauaaaacgcaaagggc

SEQ ID NO: 2301744 - RNA, 18 nt, Human
uccagaaucuaaagccag

SEQ ID NO: 2301745 - RNA, 19 nt, Human
uccagaaucuaaagccagu

SEQ ID NO: 2301746 - RNA, 12 nt, Human
uccagaauaucu

SEQ ID NO: 2301747 - RNA, 14 nt, Human
uccagaauaucugg

SEQ ID NO: 2301748 - RNA, 23 nt, Human
uccagaauaucugggauucuacu

SEQ ID NO: 2301749 - RNA, 14 nt, Human
uccagaaucuaaag

SEQ ID NO: 2301750 - RNA, 16 nt, Human
uccagaaugcuguaca

SEQ ID NO: 2301751 - RNA, 15 nt, Human
uccagaaugcuguac

SEQ ID NO: 2301752 - RNA, 13 nt, Human
uccagaaugcugu

SEQ ID NO: 2301753 - RNA, 24 nt, Human
uccacucugcuucucugacuucug

SEQ ID NO: 2301754 - RNA, 21 nt, Human
uccacucugcuucucugacuu

SEQ ID NO: 2301755 - RNA, 23 nt, Human
uccacucugcuucucugacuucu

SEQ ID NO: 2301756 - RNA, 13 nt, Human
uccacugagcucc

SEQ ID NO: 2301757 - RNA, 14 nt, Human
uccacugagcucca

SEQ ID NO: 2301758 - RNA, 19 nt, Human
uccacucuccuugcuaccc

SEQ ID NO: 2301759 - RNA, 12 nt, Human
uccacucugcuu

SEQ ID NO: 2301760 - RNA, 22 nt, Human
uccacucucccccacccccucc

SEQ ID NO: 2301761 - RNA, 18 nt, Human
uccacuagugcaaaucau

SEQ ID NO: 2301762 - RNA, 17 nt, Human
uccacucuccuugcuac

SEQ ID NO: 2301763 - RNA, 14 nt, Human
uccacucugcuucu

SEQ ID NO: 2301764 - RNA, 15 nt, Human
uccacucugcuucuc

SEQ ID NO: 2301765 - RNA, 19 nt, Human
uccacucugcuucucugac

SEQ ID NO: 2301766 - RNA, 20 nt, Human
uccacucugcuucucugacu

SEQ ID NO: 2301767 - RNA, 23 nt, Human
uccagccugggcagccaggcugc

SEQ ID NO: 2301768 - RNA, 22 nt, Human
uccagccugggcagccaggcug

SEQ ID NO: 2301769 - RNA, 19 nt, Human
uccagccugggcagccagg

SEQ ID NO: 2301770 - RNA, 20 nt, Human
uccagccugggcaacagagc

SEQ ID NO: 2301771 - RNA, 13 nt, Human
uccagccugggca

SEQ ID NO: 2301772 - RNA, 12 nt, Human
uccagccugggc

SEQ ID NO: 2301773 - RNA, 13 nt, Human
uccagccugagca

SEQ ID NO: 2301774 - RNA, 21 nt, Human
uccagccugagcgacagugag

SEQ ID NO: 2301775 - RNA, 11 nt, Human
uccagccugcc

SEQ ID NO: 2301776 - RNA, 23 nt, Human
uccagaccccuggcuuuucacug

SEQ ID NO: 2301777 - RNA, 17 nt, Human
uccagccccuucucaga

SEQ ID NO: 2301778 - RNA, 18 nt, Human
uccagccccuucucagaa

SEQ ID NO: 2301779 - RNA, 22 nt, Human
uccagccccuggaugcagccuc

SEQ ID NO: 2301780 - RNA, 20 nt, Human
uccagccugagcgacaguga

SEQ ID NO: 2301781 - RNA, 22 nt, Human
uccagccccuucucagaaucua

SEQ ID NO: 2301782 - RNA, 21 nt, Human
uccagccccuucucagaaucu

SEQ ID NO: 2301783 - RNA, 12 nt, Human
uccagccucugu

SEQ ID NO: 2301784 - RNA, 16 nt, Human
uccagccucuguuccc

SEQ ID NO: 2301785 - RNA, 21 nt, Human
uccagccucuguuccccuagu

SEQ ID NO: 2301786 - RNA, 15 nt, Human
uccagaccccuggcu

SEQ ID NO: 2301787 - RNA, 16 nt, Human
uccagaccccuggcuu

SEQ ID NO: 2301788 - RNA, 17 nt, Human
uccagaccccuggcuuu

SEQ ID NO: 2301789 - RNA, 18 nt, Human
uccagaccccuggcuuuu

SEQ ID NO: 2301790 - RNA, 15 nt, Human
uccagccccuggaug

SEQ ID NO: 2301791 - RNA, 14 nt, Human
uccagccccuggau

SEQ ID NO: 2301792 - RNA, 16 nt, Human
uccagccccuggaugc

SEQ ID NO: 2301793 - RNA, 17 nt, Human
uccagccccuggaugca

SEQ ID NO: 2301794 - RNA, 19 nt, Human
uccagccccuggaugcagc

SEQ ID NO: 2301795 - RNA, 21 nt, Human
uccagccccuggaugcagccu

SEQ ID NO: 2301796 - RNA, 22 nt, Human
ucauuuuaacaucugagaaaag

SEQ ID NO: 2301797 - RNA, 15 nt, Human
ucauuuguuggaaug

SEQ ID NO: 2301798 - RNA, 18 nt, Human
ucauuuuacccuuggcuc

SEQ ID NO: 2301799 - RNA, 14 nt, Human
ucauuuuaauuauu

SEQ ID NO: 2301800 - RNA, 13 nt, Human
ucauuuuaauuau

SEQ ID NO: 2301801 - RNA, 20 nt, Human
ucauuuuaacaucugagaaa

SEQ ID NO: 2301802 - RNA, 20 nt, Human
ucauuugcuaacuagcuugg

SEQ ID NO: 2301803 - RNA, 19 nt, Human
ucauuugcccuuaaggaca

SEQ ID NO: 2301804 - RNA, 21 nt, Human
ucauuugcccuuaaggacaaa

SEQ ID NO: 2301805 - RNA, 16 nt, Human
ucauuugaugcuaaau

SEQ ID NO: 2301806 - RNA, 21 nt, Human
ucauuugagcagggcucagcg

SEQ ID NO: 2301807 - RNA, 13 nt, Human
ucauuugugucaa

SEQ ID NO: 2301808 - RNA, 15 nt, Human
ucauuugugucaaug

SEQ ID NO: 2301809 - RNA, 12 nt, Human
ucauuuguguca

SEQ ID NO: 2301810 - RNA, 18 nt, Human
ucauuugugccagaaugc

SEQ ID NO: 2301811 - RNA, 19 nt, Human
ucauuuuccccccacucuc

SEQ ID NO: 2301812 - RNA, 15 nt, Human
ucauuuuccccccac

SEQ ID NO: 2301813 - RNA, 18 nt, Human
ucauuuuauaugucaaag

SEQ ID NO: 2301814 - RNA, 15 nt, Human
ucauuuuauguuaag

SEQ ID NO: 2301815 - RNA, 16 nt, Human
ucauuuuauaugucaa

SEQ ID NO: 2301816 - RNA, 17 nt, Human
ucauuuuauaugucaaa

SEQ ID NO: 2301817 - RNA, 21 nt, Human
ucauuuuauaugucaaagcag

SEQ ID NO: 2301818 - RNA, 13 nt, Human
ucauuuuuucuua

SEQ ID NO: 2301819 - RNA, 17 nt, Human
ucauuuuuuuaauuuau

SEQ ID NO: 2301820 - RNA, 19 nt, Human
ucauuuuuguuucuaccuc

SEQ ID NO: 2301821 - RNA, 20 nt, Human
ucauuuuuguuucuaccucc

SEQ ID NO: 2301822 - RNA, 16 nt, Human
ucauuuuuguacaguu

SEQ ID NO: 2301823 - RNA, 21 nt, Human
ucauuuuuguacaguuugcug

SEQ ID NO: 2301824 - RNA, 22 nt, Human
ucauuuuuguacaguuugcugu

SEQ ID NO: 2301825 - RNA, 23 nt, Human
ucauuuuuguacaguuugcugua

SEQ ID NO: 2301826 - RNA, 23 nt, Human
uccaaagucucuggaauuugaaa

SEQ ID NO: 2301827 - RNA, 10 nt, Human
uccaaauaaa

SEQ ID NO: 2301828 - RNA, 13 nt, Human
uccaaauaaaaac

SEQ ID NO: 2301829 - RNA, 13 nt, Human
ucauuuuuuuuaa

SEQ ID NO: 2301830 - RNA, 18 nt, Human
ucauuuuuuuccaggcug

SEQ ID NO: 2301831 - RNA, 13 nt, Human
ucauuuuuuucca

SEQ ID NO: 2301832 - RNA, 16 nt, Human
ucauuuuuuuccaggc

SEQ ID NO: 2301833 - RNA, 18 nt, Human
accugcucuccucuugcc

SEQ ID NO: 2301834 - RNA, 17 nt, Human
accugcucuccucuugc

SEQ ID NO: 2301835 - RNA, 23 nt, Human
accugcggugcuaucucccccag

SEQ ID NO: 2301836 - RNA, 19 nt, Human
accugcggugcuaucuccc

SEQ ID NO: 2301837 - RNA, 22 nt, Human
accugcggugcuaucuccccca

SEQ ID NO: 2301838 - RNA, 15 nt, Human
accugaagucuuugu

SEQ ID NO: 2301839 - RNA, 22 nt, Human
accugaagucuuuguacagaca

SEQ ID NO: 2301840 - RNA, 18 nt, Human
accugcggugcuaucucc

SEQ ID NO: 2301841 - RNA, 13 nt, Human
accugaaguucac

SEQ ID NO: 2301842 - RNA, 15 nt, Human
accugaaguucacca

SEQ ID NO: 2301843 - RNA, 22 nt, Human
accugcugagagacccaaggag

SEQ ID NO: 2301844 - RNA, 18 nt, Human
accuggaacuuggggagu

SEQ ID NO: 2301845 - RNA, 22 nt, Human
accugcuuggguggagaagcca

SEQ ID NO: 2301846 - RNA, 23 nt, Human
accugcuuggguggagaagccau

SEQ ID NO: 2301847 - RNA, 19 nt, Human
accugcucuccucuugcca

SEQ ID NO: 2301848 - RNA, 13 nt, Human
accugcucucuug

SEQ ID NO: 2301849 - RNA, 16 nt, Human
accugcucucuuguaa

SEQ ID NO: 2301850 - RNA, 19 nt, Human
accugcugagagacccaag

SEQ ID NO: 2301851 - RNA, 16 nt, Human
accugcugagagaccc

SEQ ID NO: 2301852 - RNA, 19 nt, Human
accugcugaagggcagagg

SEQ ID NO: 2301853 - RNA, 19 nt, Human
ucauuugagcagggcucag

SEQ ID NO: 2301854 - RNA, 21 nt, Human
accuggaagggcuagaaccug

SEQ ID NO: 2301855 - RNA, 16 nt, Human
ucauuugaacaacuag

SEQ ID NO: 2301856 - RNA, 17 nt, Human
accuggaauauauaacc

SEQ ID NO: 2301857 - RNA, 14 nt, Human
accuggaauauaua

SEQ ID NO: 2301858 - RNA, 21 nt, Human
uccaacaccacagacacacac

SEQ ID NO: 2301859 - RNA, 22 nt, Human
uccaacaccacagacacacaca

SEQ ID NO: 2301860 - RNA, 17 nt, Human
uccaacaccacagacac

SEQ ID NO: 2301861 - RNA, 18 nt, Human
uccaacaccacagacaca

SEQ ID NO: 2301862 - RNA, 19 nt, Human
uccaacaccacagacacac

SEQ ID NO: 2301863 - RNA, 20 nt, Human
uccaacaccacagacacaca

SEQ ID NO: 2301864 - RNA, 23 nt, Human
uccaacaccaagcacagcagccu

SEQ ID NO: 2301865 - RNA, 20 nt, Human
uccaaaugaauguugucugu

SEQ ID NO: 2301866 - RNA, 16 nt, Human
uccaacaccacagaca

SEQ ID NO: 2301867 - RNA, 21 nt, Human
uccaacaccaagcacagcagc

SEQ ID NO: 2301868 - RNA, 17 nt, Human
uccaacaccaagcacag

SEQ ID NO: 2301869 - RNA, 19 nt, Human
uccaaaugaaugaccuugu

SEQ ID NO: 2301870 - RNA, 16 nt, Human
uccaaaugaaugaccu

SEQ ID NO: 2301871 - RNA, 17 nt, Human
uccaaauaagaaaccua

SEQ ID NO: 2301872 - RNA, 17 nt, Human
uccaaauaaaaacuaaa

SEQ ID NO: 2301873 - RNA, 18 nt, Human
uccaaauaaaaacuaaau

SEQ ID NO: 2301874 - RNA, 15 nt, Human
uccaaaugcagcuuu

SEQ ID NO: 2301875 - RNA, 14 nt, Human
uccaaaugcagcuu

SEQ ID NO: 2301876 - RNA, 19 nt, Human
uccaacguggggcagcaca

SEQ ID NO: 2301877 - RNA, 19 nt, Human
uccaacuaaugccuuacuc

SEQ ID NO: 2301878 - RNA, 15 nt, Human
uccaacuaaugccuu

SEQ ID NO: 2301879 - RNA, 17 nt, Human
uccaacguggggcagca

SEQ ID NO: 2301880 - RNA, 18 nt, Human
uccaacguggggcagcac

SEQ ID NO: 2301881 - RNA, 14 nt, Human
uccaacguggccca

SEQ ID NO: 2301882 - RNA, 16 nt, Human
uccaacguggcccaga

SEQ ID NO: 2301883 - RNA, 17 nt, Human
uccaacaggagcuggga

SEQ ID NO: 2301884 - RNA, 13 nt, Human
uccaacagugagu

SEQ ID NO: 2301885 - RNA, 16 nt, Human
uccaacaggagcuggg

SEQ ID NO: 2301886 - RNA, 14 nt, Human
uccaacaggagcug

SEQ ID NO: 2301887 - RNA, 19 nt, Human
uccaacagcucaagucuuc

SEQ ID NO: 2301888 - RNA, 17 nt, Human
uccaacagaagaacugu

SEQ ID NO: 2301889 - RNA, 14 nt, Human
uccaaccuucccaa

SEQ ID NO: 2301890 - RNA, 18 nt, Human
uccaagcuccaucuccac

SEQ ID NO: 2301891 - RNA, 16 nt, Human
uccaagcucccaggca

SEQ ID NO: 2301892 - RNA, 14 nt, Human
uccaagcucccagg

SEQ ID NO: 2301893 - RNA, 15 nt, Human
uccaagcucccaggc

SEQ ID NO: 2301894 - RNA, 12 nt, Human
uccaagcuccca

SEQ ID NO: 2301895 - RNA, 13 nt, Human
uccaagcucccag

SEQ ID NO: 2301896 - RNA, 21 nt, Human
uccaacuaucucauuuccaag

SEQ ID NO: 2301897 - RNA, 22 nt, Human
uccaacuaaugccuuacucuuc

SEQ ID NO: 2301898 - RNA, 14 nt, Human
uccacagugacucc

SEQ ID NO: 2301899 - RNA, 14 nt, Human
uccaauaaaccagg

SEQ ID NO: 2301900 - RNA, 23 nt, Human
uccaauaaaugugaaauucuguc

SEQ ID NO: 2301901 - RNA, 12 nt, Human
uccaauaaacag

SEQ ID NO: 2301902 - RNA, 13 nt, Human
uccaauaaacagg

SEQ ID NO: 2301903 - RNA, 14 nt, Human
uccaauaaacagga

SEQ ID NO: 2301904 - RNA, 18 nt, Human
uccaagugugugugcgug

SEQ ID NO: 2301905 - RNA, 14 nt, Human
uccaagugugugug

SEQ ID NO: 2301906 - RNA, 13 nt, Human
uccaagugugugu

SEQ ID NO: 2301907 - RNA, 21 nt, Human
uccaagugugcauauuguaca

SEQ ID NO: 2301908 - RNA, 14 nt, Human
uccaagugugcaua

SEQ ID NO: 2301909 - RNA, 15 nt, Human
uccaagugugcauau

SEQ ID NO: 2301910 - RNA, 19 nt, Human
uccaagugugcauauugua

SEQ ID NO: 2301911 - RNA, 20 nt, Human
uccaagugugcauauuguac

SEQ ID NO: 2301912 - RNA, 21 nt, Human
uccaaguuuacucaacccucu

SEQ ID NO: 2301913 - RNA, 17 nt, Human
uccaauaaaaugccuca

SEQ ID NO: 2301914 - RNA, 11 nt, Human
uccaagcuggu

SEQ ID NO: 2301915 - RNA, 11 nt, Human
uccaagugugc

SEQ ID NO: 2301916 - RNA, 13 nt, Human
uccaagugugcau

SEQ ID NO: 2301917 - RNA, 22 nt, Human
uccaagcugggagauucaaggg

SEQ ID NO: 2301918 - RNA, 12 nt, Human
uccaagcuggga

SEQ ID NO: 2301919 - RNA, 13 nt, Human
uccacaguucagu

SEQ ID NO: 2301920 - RNA, 18 nt, Human
uccacauaaggaaacugg

SEQ ID NO: 2301921 - RNA, 15 nt, Human
uccacaguucagugg

SEQ ID NO: 2301922 - RNA, 16 nt, Human
uccacaguucaguggc

SEQ ID NO: 2301923 - RNA, 22 nt, Human
uccacaguucgaccugcggcug

SEQ ID NO: 2301924 - RNA, 23 nt, Human
uccacaguucaguggcagggcuc

SEQ ID NO: 2301925 - RNA, 18 nt, Human
uccaccaacccaucagaa

SEQ ID NO: 2301926 - RNA, 16 nt, Human
uccaccaacccaucag

SEQ ID NO: 2301927 - RNA, 18 nt, Human
uccaccaagccuggucag

SEQ ID NO: 2301928 - RNA, 17 nt, Human
uccaccacccaaaaguc

SEQ ID NO: 2301929 - RNA, 13 nt, Human
uccaccacccaaa

SEQ ID NO: 2301930 - RNA, 23 nt, Human
uccaccaccacuggccaccaggc

SEQ ID NO: 2301931 - RNA, 14 nt, Human
uccaccaccucccu

SEQ ID NO: 2301932 - RNA, 16 nt, Human
uccaccaccucccuca

SEQ ID NO: 2301933 - RNA, 17 nt, Human
uccaccaccucccucac

SEQ ID NO: 2301934 - RNA, 18 nt, Human
uccaccaccucccucacc

SEQ ID NO: 2301935 - RNA, 15 nt, Human
uccaccagccugcac

SEQ ID NO: 2301936 - RNA, 14 nt, Human
uccaccagccugca

SEQ ID NO: 2301937 - RNA, 16 nt, Human
uccaccagccugcacu

SEQ ID NO: 2301938 - RNA, 15 nt, Human
uccaccaggaaccuc

SEQ ID NO: 2301939 - RNA, 22 nt, Human
uccaccaccucccucaccaaca

SEQ ID NO: 2301940 - RNA, 17 nt, Human
uccaccaagaaagcagg

SEQ ID NO: 2301941 - RNA, 13 nt, Human
uccaccaccacug

SEQ ID NO: 2301942 - RNA, 14 nt, Human
uccaccaccacugg

SEQ ID NO: 2301943 - RNA, 18 nt, Human
uccaccaccacuggccac

SEQ ID NO: 2301944 - RNA, 19 nt, Human
uccaccaccacuggccacc

SEQ ID NO: 2301945 - RNA, 21 nt, Human
uccaccaccacuggccaccag

SEQ ID NO: 2301946 - RNA, 22 nt, Human
uccaccaccacuggccaccagg

SEQ ID NO: 2301947 - RNA, 23 nt, Human
uccaccaagccuggucagcccaa

SEQ ID NO: 2301948 - RNA, 22 nt, Human
uccaccaagccuggucagccca

SEQ ID NO: 2301949 - RNA, 20 nt, Human
uccugcaggccaggccagcu

SEQ ID NO: 2301950 - RNA, 19 nt, Human
uccugcaggccaggccagc

SEQ ID NO: 2301951 - RNA, 14 nt, Human
uccugcaggccagg

SEQ ID NO: 2301952 - RNA, 22 nt, Human
uccugcaggcagccaggccaca

SEQ ID NO: 2301953 - RNA, 19 nt, Human
uccugccucagccucccaa

SEQ ID NO: 2301954 - RNA, 16 nt, Human
uccugcauucacccag

SEQ ID NO: 2301955 - RNA, 22 nt, Human
uccugcauucacccagacagcu

SEQ ID NO: 2301956 - RNA, 22 nt, Human
uccugcagggccagaccugccu

SEQ ID NO: 2301957 - RNA, 18 nt, Human
uccugcagguaaacaguu

SEQ ID NO: 2301958 - RNA, 21 nt, Human
uccugcagucuggcugagccc

SEQ ID NO: 2301959 - RNA, 16 nt, Human
uccugcaggcagccag

SEQ ID NO: 2301960 - RNA, 17 nt, Human
uccugcaggcagccagg

SEQ ID NO: 2301961 - RNA, 19 nt, Human
uccugcaggcagccaggcc

SEQ ID NO: 2301962 - RNA, 20 nt, Human
uccugcaggcagccaggcca

SEQ ID NO: 2301963 - RNA, 21 nt, Human
uccugccucgaacuggcugca

SEQ ID NO: 2301964 - RNA, 23 nt, Human
uccugcgggcuuuuccccggucc

SEQ ID NO: 2301965 - RNA, 13 nt, Human
uccugcggguggg

SEQ ID NO: 2301966 - RNA, 14 nt, Human
uccugcgggugggg

SEQ ID NO: 2301967 - RNA, 21 nt, Human
uccugcguccuccucaccuca

SEQ ID NO: 2301968 - RNA, 16 nt, Human
uccugcguccuccuca

SEQ ID NO: 2301969 - RNA, 18 nt, Human
uccugcguccuccucacc

SEQ ID NO: 2301970 - RNA, 13 nt, Human
uccugcguccucc

SEQ ID NO: 2301971 - RNA, 14 nt, Human
uccugcguccuccu

SEQ ID NO: 2301972 - RNA, 15 nt, Human
uccugcguccuccuc

SEQ ID NO: 2301973 - RNA, 17 nt, Human
uccugccucagccuccg

SEQ ID NO: 2301974 - RNA, 14 nt, Human
uccugccuccgccu

SEQ ID NO: 2301975 - RNA, 20 nt, Human
uccugccucgaacuggcugc

SEQ ID NO: 2301976 - RNA, 18 nt, Human
uccugcuacucuguuccu

SEQ ID NO: 2301977 - RNA, 16 nt, Human
uccugcucauauugug

SEQ ID NO: 2301978 - RNA, 15 nt, Human
uccugcucauauugu

SEQ ID NO: 2301979 - RNA, 19 nt, Human
uccugcuacaacuucagca

SEQ ID NO: 2301980 - RNA, 14 nt, Human
uccugcuacucugu

SEQ ID NO: 2301981 - RNA, 20 nt, Human
uccugcuacaacuucagcag

SEQ ID NO: 2301982 - RNA, 21 nt, Human
uccugcuacaacuucagcagu

SEQ ID NO: 2301983 - RNA, 16 nt, Human
uccugcuccacagugu

SEQ ID NO: 2301984 - RNA, 13 nt, Human
uccugcucugccc

SEQ ID NO: 2301985 - RNA, 13 nt, Human
uccugcuccacag

SEQ ID NO: 2301986 - RNA, 14 nt, Human
uccugcuccacagc

SEQ ID NO: 2301987 - RNA, 18 nt, Human
uccugcuccacagccauc

SEQ ID NO: 2301988 - RNA, 14 nt, Human
uccugcuccacagu

SEQ ID NO: 2301989 - RNA, 15 nt, Human
uccugcuccacagug

SEQ ID NO: 2301990 - RNA, 18 nt, Human
uccugcuccacaguguug

SEQ ID NO: 2301991 - RNA, 19 nt, Human
uccugaguagcuggauuac

SEQ ID NO: 2301992 - RNA, 20 nt, Human
uccugaguagcugggauuac

SEQ ID NO: 2301993 - RNA, 22 nt, Human
uccugaggggcaucugccccuc

SEQ ID NO: 2301994 - RNA, 21 nt, Human
uccugaggggcaucugccccu

SEQ ID NO: 2301995 - RNA, 18 nt, Human
acugcacagcguccuguc

SEQ ID NO: 2301996 - RNA, 17 nt, Human
uccugaggguccccacc

SEQ ID NO: 2301997 - RNA, 19 nt, Human
uccugaggguccccaccug

SEQ ID NO: 2301998 - RNA, 22 nt, Human
uccugaggguccccaccuggga

SEQ ID NO: 2301999 - RNA, 23 nt, Human
uccugauaugauuuaaaacaugu

SEQ ID NO: 2302000 - RNA, 18 nt, Human
uccugauaauaauugauc

SEQ ID NO: 2302001 - RNA, 19 nt, Human
uccugauaauaauugauca

SEQ ID NO: 2302002 - RNA, 24 nt, Human
uccugauaugauuuaaaacaugua

SEQ ID NO: 2302003 - RNA, 21 nt, Human
uccugauggcaggauggccug

SEQ ID NO: 2302004 - RNA, 18 nt, Human
uccugaugguacaggaaa

SEQ ID NO: 2302005 - RNA, 17 nt, Human
uccugauaauaauugau

SEQ ID NO: 2302006 - RNA, 15 nt, Human
uccugaguggugcca

SEQ ID NO: 2302007 - RNA, 16 nt, Human
acugcacagugcaucu

SEQ ID NO: 2302008 - RNA, 23 nt, Human
acugcacagagcucuccagcucc

SEQ ID NO: 2302009 - RNA, 20 nt, Human
acugcacagcggccccugca

SEQ ID NO: 2302010 - RNA, 22 nt, Human
acugcacagcggccccugcauc

SEQ ID NO: 2302011 - RNA, 16 nt, Human
acugcacagcguccug

SEQ ID NO: 2302012 - RNA, 18 nt, Human
acugcacagugcaucuca

SEQ ID NO: 2302013 - RNA, 20 nt, Human
acugcaauccugucuuucug

SEQ ID NO: 2302014 - RNA, 17 nt, Human
acugcaauuaaagugau

SEQ ID NO: 2302015 - RNA, 21 nt, Human
acugcaauccugucuuucuga

SEQ ID NO: 2302016 - RNA, 12 nt, Human
acugcacagagc

SEQ ID NO: 2302017 - RNA, 15 nt, Human
acugcacagagcucu

SEQ ID NO: 2302018 - RNA, 16 nt, Human
acugcacagagcucuc

SEQ ID NO: 2302019 - RNA, 17 nt, Human
acugcacagagcucucc

SEQ ID NO: 2302020 - RNA, 18 nt, Human
acugcacagagcucucca

SEQ ID NO: 2302021 - RNA, 19 nt, Human
acugcacagagcucuccag

SEQ ID NO: 2302022 - RNA, 21 nt, Human
uccugcacuuacuugcuuauu

SEQ ID NO: 2302023 - RNA, 17 nt, Human
uccugcagaccacgccc

SEQ ID NO: 2302024 - RNA, 15 nt, Human
uccugcaggcagcca

SEQ ID NO: 2302025 - RNA, 12 nt, Human
uccugcagccuc

SEQ ID NO: 2302026 - RNA, 15 nt, Human
uccugcagccuccuc

SEQ ID NO: 2302027 - RNA, 16 nt, Human
uccugcagccuccucc

SEQ ID NO: 2302028 - RNA, 18 nt, Human
uccugcagccuccuccug

SEQ ID NO: 2302029 - RNA, 19 nt, Human
uccugcagccuccuccuga

SEQ ID NO: 2302030 - RNA, 22 nt, Human
uccugcagccuccuccugacca

SEQ ID NO: 2302031 - RNA, 19 nt, Human
uccugcaaaauuuuauagc

SEQ ID NO: 2302032 - RNA, 17 nt, Human
uccugcaaaauuuuaua

SEQ ID NO: 2302033 - RNA, 17 nt, Human
uccugcaacucaaggac

SEQ ID NO: 2302034 - RNA, 20 nt, Human
uccugauggucagcucccuu

SEQ ID NO: 2302035 - RNA, 21 nt, Human
uccugauggucagcucccuuc

SEQ ID NO: 2302036 - RNA, 23 nt, Human
uccugaugguacaggaaagcuca

SEQ ID NO: 2302037 - RNA, 17 nt, Human
uccugauggucagcucc

SEQ ID NO: 2302038 - RNA, 18 nt, Human
uccugauggucagcuccc

SEQ ID NO: 2302039 - RNA, 19 nt, Human
uccugauggucagcucccu

SEQ ID NO: 2302040 - RNA, 20 nt, Human
uccugcaaugaagucucuga

SEQ ID NO: 2302041 - RNA, 18 nt, Human
uccugcaaugaagucucu

SEQ ID NO: 2302042 - RNA, 15 nt, Human
uccugcaaugaaguc

SEQ ID NO: 2302043 - RNA, 18 nt, Human
uccugcaacucaaggacu

SEQ ID NO: 2302044 - RNA, 16 nt, Human
acugcaaccuccgccu

SEQ ID NO: 2302045 - RNA, 22 nt, Human
acugcaaccuccgccucuuggg

SEQ ID NO: 2302046 - RNA, 20 nt, Human
acugcaaccuucgccaccug

SEQ ID NO: 2302047 - RNA, 13 nt, Human
acugcaaccuccg

SEQ ID NO: 2302048 - RNA, 14 nt, Human
acugcaaccuccgc

SEQ ID NO: 2302049 - RNA, 18 nt, Human
acugcaacaggcuugugc

SEQ ID NO: 2302050 - RNA, 22 nt, Human
acugcaaaugucaucagaacuu

SEQ ID NO: 2302051 - RNA, 21 nt, Human
acugcaaaugucaucagaacu

SEQ ID NO: 2302052 - RNA, 21 nt, Human
acugaguuaaauuauacugga

SEQ ID NO: 2302053 - RNA, 15 nt, Human
acugaguuacauugu

SEQ ID NO: 2302054 - RNA, 18 nt, Human
acugaguuacauugucau

SEQ ID NO: 2302055 - RNA, 15 nt, Human
acugauaaagaaaga

SEQ ID NO: 2302056 - RNA, 21 nt, Human
acugaggggucuccaggagga

SEQ ID NO: 2302057 - RNA, 18 nt, Human
acugaggggucuccagga

SEQ ID NO: 2302058 - RNA, 16 nt, Human
acugaguccuuaaaca

SEQ ID NO: 2302059 - RNA, 20 nt, Human
acugaguaagaaaugcugcc

SEQ ID NO: 2302060 - RNA, 16 nt, Human
acugagugccuuuugg

SEQ ID NO: 2302061 - RNA, 23 nt, Human
acugaguacguugugcauuuggu

SEQ ID NO: 2302062 - RNA, 22 nt, Human
acugaguacguugugcauuugg

SEQ ID NO: 2302063 - RNA, 18 nt, Human
acugaguacguugugcau

SEQ ID NO: 2302064 - RNA, 23 nt, Human
acugagggcagucgauagagcug

SEQ ID NO: 2302065 - RNA, 22 nt, Human
acugagggacucugaagccucu

SEQ ID NO: 2302066 - RNA, 12 nt, Human
acugagggccac

SEQ ID NO: 2302067 - RNA, 22 nt, Human
acugagggccacacuauuacca

SEQ ID NO: 2302068 - RNA, 21 nt, Human
acugaguacguugugcauuug

SEQ ID NO: 2302069 - RNA, 19 nt, Human
acugaguacguugugcauu

SEQ ID NO: 2302070 - RNA, 17 nt, Human
acugagcuucucuguga

SEQ ID NO: 2302071 - RNA, 18 nt, Human
acugagcuucucugugaa

SEQ ID NO: 2302072 - RNA, 12 nt, Human
acugagcuugga

SEQ ID NO: 2302073 - RNA, 16 nt, Human
acugagcuuggaagcu

SEQ ID NO: 2302074 - RNA, 13 nt, Human
acugagcuuggaa

SEQ ID NO: 2302075 - RNA, 18 nt, Human
acugaggaaugaugaagc

SEQ ID NO: 2302076 - RNA, 21 nt, Human
acugagcuccucugggcagga

SEQ ID NO: 2302077 - RNA, 17 nt, Human
acugaggaauuucaccu

SEQ ID NO: 2302078 - RNA, 16 nt, Human
acugaggaauuuucuu

SEQ ID NO: 2302079 - RNA, 19 nt, Human
acugaggaauuucaccugu

SEQ ID NO: 2302080 - RNA, 17 nt, Human
acugagcuuggaagcuu

SEQ ID NO: 2302081 - RNA, 13 nt, Human
acugaggaagaac

SEQ ID NO: 2302082 - RNA, 22 nt, Human
acugaggaagaacggggcucuu

SEQ ID NO: 2302083 - RNA, 14 nt, Human
acugagcuccucug

SEQ ID NO: 2302084 - RNA, 13 nt, Human
acugagcuccucu

SEQ ID NO: 2302085 - RNA, 16 nt, Human
acugagcuccaugugc

SEQ ID NO: 2302086 - RNA, 23 nt, Human
acugagcuccaugugcccccucu

SEQ ID NO: 2302087 - RNA, 19 nt, Human
acugagcuccucugggcag

SEQ ID NO: 2302088 - RNA, 16 nt, Human
acugagcuccucuggg

SEQ ID NO: 2302089 - RNA, 16 nt, Human
acugagcuucucugug

SEQ ID NO: 2302090 - RNA, 19 nt, Human
uccucuccccagcccagag

SEQ ID NO: 2302091 - RNA, 18 nt, Human
uccucuccccagcccaga

SEQ ID NO: 2302092 - RNA, 17 nt, Human
uccucuccccagcccag

SEQ ID NO: 2302093 - RNA, 15 nt, Human
uccucuccccagcaa

SEQ ID NO: 2302094 - RNA, 16 nt, Human
uccucuccccagccca

SEQ ID NO: 2302095 - RNA, 15 nt, Human
uccucuccccagccc

SEQ ID NO: 2302096 - RNA, 14 nt, Human
uccucuccccagcc

SEQ ID NO: 2302097 - RNA, 17 nt, Human
uccucuccaccuagugg

SEQ ID NO: 2302098 - RNA, 19 nt, Human
uccucuccaccuaguggcu

SEQ ID NO: 2302099 - RNA, 15 nt, Human
acugaggcacgagca

SEQ ID NO: 2302100 - RNA, 20 nt, Human
acugaggaauuuucuuugug

SEQ ID NO: 2302101 - RNA, 15 nt, Human
acugaggaccagcca

SEQ ID NO: 2302102 - RNA, 14 nt, Human
acugaggaucagag

SEQ ID NO: 2302103 - RNA, 22 nt, Human
acugaggcagacagcagcucag

SEQ ID NO: 2302104 - RNA, 19 nt, Human
acugaggcagacagcagcu

SEQ ID NO: 2302105 - RNA, 15 nt, Human
acugaggcagacagc

SEQ ID NO: 2302106 - RNA, 13 nt, Human
acugaggcagaca

SEQ ID NO: 2302107 - RNA, 14 nt, Human
acugaggcagggaa

SEQ ID NO: 2302108 - RNA, 12 nt, Human
acugaggcaggg

SEQ ID NO: 2302109 - RNA, 23 nt, Human
acugaggcagacagcagcucagg

SEQ ID NO: 2302110 - RNA, 15 nt, Human
acugaggcagggaag

SEQ ID NO: 2302111 - RNA, 22 nt, Human
acugaggccaaaagaggccuga

SEQ ID NO: 2302112 - RNA, 22 nt, Human
acugagggaccaacugggccca

SEQ ID NO: 2302113 - RNA, 21 nt, Human
acugaggccuaaaaguaaaca

SEQ ID NO: 2302114 - RNA, 14 nt, Human
acugagggacucug

SEQ ID NO: 2302115 - RNA, 12 nt, Human
acugagggcagu

SEQ ID NO: 2302116 - RNA, 17 nt, Human
acugagggacucugaag

SEQ ID NO: 2302117 - RNA, 18 nt, Human
acugagggacucugaagc

SEQ ID NO: 2302118 - RNA, 21 nt, Human
acugagggaccaacugggccc

SEQ ID NO: 2302119 - RNA, 20 nt, Human
acugagggaccaacugggcc

SEQ ID NO: 2302120 - RNA, 13 nt, Human
acugaggccugag

SEQ ID NO: 2302121 - RNA, 14 nt, Human
acugaggccugagc

SEQ ID NO: 2302122 - RNA, 22 nt, Human
acugaggggaggggagcauggg

SEQ ID NO: 2302123 - RNA, 17 nt, Human
acugaggggaggggagc

SEQ ID NO: 2302124 - RNA, 18 nt, Human
uccugugcuacuuugccu

SEQ ID NO: 2302125 - RNA, 20 nt, Human
uccugugcaugggugaaggg

SEQ ID NO: 2302126 - RNA, 18 nt, Human
uccugugcaugggugaag

SEQ ID NO: 2302127 - RNA, 16 nt, Human
uccugugcauggguga

SEQ ID NO: 2302128 - RNA, 15 nt, Human
uccugugcaugggug

SEQ ID NO: 2302129 - RNA, 18 nt, Human
uccugugacauguaacag

SEQ ID NO: 2302130 - RNA, 18 nt, Human
uccugugacuucagcucu

SEQ ID NO: 2302131 - RNA, 20 nt, Human
uccugugaaugccacugccu

SEQ ID NO: 2302132 - RNA, 22 nt, Human
uccugugaaugccacugccuuc

SEQ ID NO: 2302133 - RNA, 14 nt, Human
uccugugacaugua

SEQ ID NO: 2302134 - RNA, 15 nt, Human
uccugugacauguaa

SEQ ID NO: 2302135 - RNA, 14 nt, Human
uccuguggcaggca

SEQ ID NO: 2302136 - RNA, 17 nt, Human
uccugugcccacauccc

SEQ ID NO: 2302137 - RNA, 15 nt, Human
uccuguggcaggcag

SEQ ID NO: 2302138 - RNA, 16 nt, Human
uccuguggcaggcagc

SEQ ID NO: 2302139 - RNA, 19 nt, Human
uccuguggcaggcagcgcc

SEQ ID NO: 2302140 - RNA, 20 nt, Human
uccuguggcaggcagcgcca

SEQ ID NO: 2302141 - RNA, 12 nt, Human
uccuguggcccc

SEQ ID NO: 2302142 - RNA, 21 nt, Human
uccuguggcaggcagcgccaa

SEQ ID NO: 2302143 - RNA, 22 nt, Human
uccuguggccccacccugggcc

SEQ ID NO: 2302144 - RNA, 23 nt, Human
uccuguggccccacccugggccc

SEQ ID NO: 2302145 - RNA, 22 nt, Human
uccuguguaaucauuucuuggg

SEQ ID NO: 2302146 - RNA, 18 nt, Human
uccuguguaaucauuucu

SEQ ID NO: 2302147 - RNA, 13 nt, Human
uccuguguacagg

SEQ ID NO: 2302148 - RNA, 22 nt, Human
uccugugggggaagagcacagc

SEQ ID NO: 2302149 - RNA, 23 nt, Human
uccugugggggaagagcacagcc

SEQ ID NO: 2302150 - RNA, 19 nt, Human
uccugucuuuaaggaaaaa

SEQ ID NO: 2302151 - RNA, 15 nt, Human
uccugucuuucugag

SEQ ID NO: 2302152 - RNA, 16 nt, Human
uccugugaaugccacu

SEQ ID NO: 2302153 - RNA, 22 nt, Human
uccugucuuucugagcacacuu

SEQ ID NO: 2302154 - RNA, 18 nt, Human
uccugucuuuaaggaaaa

SEQ ID NO: 2302155 - RNA, 17 nt, Human
uccugucuuuaaggaaa

SEQ ID NO: 2302156 - RNA, 21 nt, Human
uccugucuuuaaagccugccu

SEQ ID NO: 2302157 - RNA, 11 nt, Human
uccugucuucc

SEQ ID NO: 2302158 - RNA, 12 nt, Human
uccugucuuccc

SEQ ID NO: 2302159 - RNA, 14 nt, Human
uccugucuucccag

SEQ ID NO: 2302160 - RNA, 15 nt, Human
uccugucuuccugca

SEQ ID NO: 2302161 - RNA, 17 nt, Human
uccugucuucccagggu

SEQ ID NO: 2302162 - RNA, 15 nt, Human
uccugucuucccagg

SEQ ID NO: 2302163 - RNA, 16 nt, Human
uccugucuucccaggg

SEQ ID NO: 2302164 - RNA, 23 nt, Human
uccugggguauaaaacuuuccuc

SEQ ID NO: 2302165 - RNA, 19 nt, Human
uccuggguggucugcaggc

SEQ ID NO: 2302166 - RNA, 15 nt, Human
uccuggguggucugc

SEQ ID NO: 2302167 - RNA, 22 nt, Human
uccuggguggucugcaggcagg

SEQ ID NO: 2302168 - RNA, 21 nt, Human
uccuggguggucugcaggcag

SEQ ID NO: 2302169 - RNA, 23 nt, Human
uccuggguuuucuuaaccaucuu

SEQ ID NO: 2302170 - RNA, 22 nt, Human
uccuggguuuuguauucucuga

SEQ ID NO: 2302171 - RNA, 21 nt, Human
uccuggguuuuguauucucug

SEQ ID NO: 2302172 - RNA, 20 nt, Human
uccuggguuuuguauucucu

SEQ ID NO: 2302173 - RNA, 17 nt, Human
uccuggguuuuguauuc

SEQ ID NO: 2302174 - RNA, 23 nt, Human
uccuggguuuuguauucucugag

SEQ ID NO: 2302175 - RNA, 15 nt, Human
uccugguacccagcc

SEQ ID NO: 2302176 - RNA, 16 nt, Human
uccugguacccagcca

SEQ ID NO: 2302177 - RNA, 13 nt, Human
uccugguagaaua

SEQ ID NO: 2302178 - RNA, 17 nt, Human
uccugguacccagccau

SEQ ID NO: 2302179 - RNA, 18 nt, Human
uccugguacccagccauc

SEQ ID NO: 2302180 - RNA, 13 nt, Human
uccugggcucagg

SEQ ID NO: 2302181 - RNA, 12 nt, Human
uccugggcucag

SEQ ID NO: 2302182 - RNA, 16 nt, Human
uccugggcgcccugga

SEQ ID NO: 2302183 - RNA, 18 nt, Human
uccugggcgcccuggaag

SEQ ID NO: 2302184 - RNA, 19 nt, Human
uccugggcgcccuggaagc

SEQ ID NO: 2302185 - RNA, 20 nt, Human
uccugggcgcccuggaagcc

SEQ ID NO: 2302186 - RNA, 16 nt, Human
uccugggccugcagaa

SEQ ID NO: 2302187 - RNA, 13 nt, Human
uccugggcgcccu

SEQ ID NO: 2302188 - RNA, 14 nt, Human
uccugggcgcccug

SEQ ID NO: 2302189 - RNA, 15 nt, Human
uccugggccugcaga

SEQ ID NO: 2302190 - RNA, 13 nt, Human
uccugggccugca

SEQ ID NO: 2302191 - RNA, 13 nt, Human
uccuggggccucg

SEQ ID NO: 2302192 - RNA, 12 nt, Human
uccugggcuggu

SEQ ID NO: 2302193 - RNA, 19 nt, Human
uccuggggaaccugacccc

SEQ ID NO: 2302194 - RNA, 18 nt, Human
uccuggggaaccugaccc

SEQ ID NO: 2302195 - RNA, 18 nt, Human
uccuggggcucugugcag

SEQ ID NO: 2302196 - RNA, 16 nt, Human
uccuggggcucugugc

SEQ ID NO: 2302197 - RNA, 15 nt, Human
uccuggggcucugug

SEQ ID NO: 2302198 - RNA, 15 nt, Human
uccuggggcucccuu

SEQ ID NO: 2302199 - RNA, 16 nt, Human
uccuggggcucccuuc

SEQ ID NO: 2302200 - RNA, 15 nt, Human
uccuggggccucuug

SEQ ID NO: 2302201 - RNA, 14 nt, Human
uccuggggcucccu

SEQ ID NO: 2302202 - RNA, 22 nt, Human
uccuggggccucggagccucau

SEQ ID NO: 2302203 - RNA, 21 nt, Human
uccuggggccucggagccuca

SEQ ID NO: 2302204 - RNA, 19 nt, Human
uccuggggcucugugcagg

SEQ ID NO: 2302205 - RNA, 21 nt, Human
uccuggggguucuuucuuccu

SEQ ID NO: 2302206 - RNA, 22 nt, Human
uccuggggguucuuucuuccuc

SEQ ID NO: 2302207 - RNA, 23 nt, Human
uccuggggguucuuucuuccucu

SEQ ID NO: 2302208 - RNA, 16 nt, Human
uccugggcccucucug

SEQ ID NO: 2302209 - RNA, 18 nt, Human
uccugcugcagaggggca

SEQ ID NO: 2302210 - RNA, 21 nt, Human
uccugcugcagaggggcaggc

SEQ ID NO: 2302211 - RNA, 12 nt, Human
uccugggccugc

SEQ ID NO: 2302212 - RNA, 23 nt, Human
uccugggcccucucugcucugcg

SEQ ID NO: 2302213 - RNA, 21 nt, Human
uccugggcccucucugcucug

SEQ ID NO: 2302214 - RNA, 17 nt, Human
uccugggcccucucugc

SEQ ID NO: 2302215 - RNA, 13 nt, Human
uccugcugcaguu

SEQ ID NO: 2302216 - RNA, 12 nt, Human
uccugcugcacc

SEQ ID NO: 2302217 - RNA, 13 nt, Human
uccugcugcacca

SEQ ID NO: 2302218 - RNA, 17 nt, Human
uccugcugcaccaaccc

SEQ ID NO: 2302219 - RNA, 19 nt, Human
uccugcugcaccaacccag

SEQ ID NO: 2302220 - RNA, 20 nt, Human
uccugcugcaccaacccagc

SEQ ID NO: 2302221 - RNA, 21 nt, Human
uccugcugcaccaacccagcc

SEQ ID NO: 2302222 - RNA, 22 nt, Human
uccugcugcaccaacccagccg

SEQ ID NO: 2302223 - RNA, 16 nt, Human
uccugcugcagagggg

SEQ ID NO: 2302224 - RNA, 19 nt, Human
uccuguucuuaagacguga

SEQ ID NO: 2302225 - RNA, 12 nt, Human
uccuguucugaa

SEQ ID NO: 2302226 - RNA, 13 nt, Human
uccuguugcaccc

SEQ ID NO: 2302227 - RNA, 16 nt, Human
uccuguugcacccagc

SEQ ID NO: 2302228 - RNA, 19 nt, Human
uccuguugcacccagcccu

SEQ ID NO: 2302229 - RNA, 20 nt, Human
uccuguugcacccagcccug

SEQ ID NO: 2302230 - RNA, 21 nt, Human
uccuguugcacccagcccugg

SEQ ID NO: 2302231 - RNA, 22 nt, Human
uccuguugcacccagcccuggu

SEQ ID NO: 2302232 - RNA, 21 nt, Human
uccuguuggauuuguuuaaaa

SEQ ID NO: 2302233 - RNA, 23 nt, Human
uccuguuagcuguuauuucuauu

SEQ ID NO: 2302234 - RNA, 22 nt, Human
uccuguuagguauuagaaagug

SEQ ID NO: 2302235 - RNA, 18 nt, Human
uccuguuacuuaccuaaa

SEQ ID NO: 2302236 - RNA, 19 nt, Human
uccuguguuucuagggaaa

SEQ ID NO: 2302237 - RNA, 20 nt, Human
uccuguguuuuuucugccac

SEQ ID NO: 2302238 - RNA, 19 nt, Human
uccuguucccaugagauga

SEQ ID NO: 2302239 - RNA, 21 nt, Human
uccuguuguuguuaaugaaaa

SEQ ID NO: 2302240 - RNA, 20 nt, Human
uccuguuguuauggaaacug

SEQ ID NO: 2302241 - RNA, 19 nt, Human
uccuguuguuguuaaugaa

SEQ ID NO: 2302242 - RNA, 14 nt, Human
uccuguuuuucaca

SEQ ID NO: 2302243 - RNA, 18 nt, Human
uccuguuugggccccucu

SEQ ID NO: 2302244 - RNA, 22 nt, Human
uccuguuugggccccucuccca

SEQ ID NO: 2302245 - RNA, 12 nt, Human
uccuguguuucu

SEQ ID NO: 2302246 - RNA, 18 nt, Human
uccugugugugcgccuac

SEQ ID NO: 2302247 - RNA, 13 nt, Human
uccugugugugcg

SEQ ID NO: 2302248 - RNA, 14 nt, Human
uccugugugugcgc

SEQ ID NO: 2302249 - RNA, 22 nt, Human
uccuguguguccaaaacugccu

SEQ ID NO: 2302250 - RNA, 19 nt, Human
uccugugugauugacagcu

SEQ ID NO: 2302251 - RNA, 15 nt, Human
uccugugugcaguga

SEQ ID NO: 2302252 - RNA, 23 nt, Human
uccuguguaaucauuucuugggc

SEQ ID NO: 2302253 - RNA, 23 nt, Human
uccugugucuugcaauggcagcc

SEQ ID NO: 2302254 - RNA, 24 nt, Human
uccugugucuugcaauggcagccu

SEQ ID NO: 2302255 - RNA, 15 nt, Human
uccuuaaacagggca

SEQ ID NO: 2302256 - RNA, 16 nt, Human
uccuguuuuucugggu

SEQ ID NO: 2302257 - RNA, 17 nt, Human
uccuguuuuucugggug

SEQ ID NO: 2302258 - RNA, 20 nt, Human
uccuguuuuucuggguggcc

SEQ ID NO: 2302259 - RNA, 16 nt, Human
uccuuaaacugugugg

SEQ ID NO: 2302260 - RNA, 15 nt, Human
uccuuaaacugugug

SEQ ID NO: 2302261 - RNA, 14 nt, Human
uccuuaaacugugu

SEQ ID NO: 2302262 - RNA, 23 nt, Human
uccuuaaacagggcaucuccagg

SEQ ID NO: 2302263 - RNA, 23 nt, Human
uccuuaaacuguguggacuguga

SEQ ID NO: 2302264 - RNA, 17 nt, Human
uccuuaaacugugugga

SEQ ID NO: 2302265 - RNA, 13 nt, Human
acugcacuguuuu

SEQ ID NO: 2302266 - RNA, 23 nt, Human
uccuuaaauaaacucaaugagcu

SEQ ID NO: 2302267 - RNA, 22 nt, Human
uccuuaaaggcaccaucuaaua

SEQ ID NO: 2302268 - RNA, 19 nt, Human
acugcagccucaaccuccu

SEQ ID NO: 2302269 - RNA, 23 nt, Human
uccuuaaaggcaccaucuaauag

SEQ ID NO: 2302270 - RNA, 21 nt, Human
acugcagaauacaguaagcug

SEQ ID NO: 2302271 - RNA, 16 nt, Human
acugcagaccuguccu

SEQ ID NO: 2302272 - RNA, 18 nt, Human
acugcagaccuguccucc

SEQ ID NO: 2302273 - RNA, 21 nt, Human
acugcagccucaaccuccugg

SEQ ID NO: 2302274 - RNA, 22 nt, Human
acugcagccucaaccuccuggg

SEQ ID NO: 2302275 - RNA, 12 nt, Human
acugcaggcccc

SEQ ID NO: 2302276 - RNA, 19 nt, Human
acugcaggcaucacagcua

SEQ ID NO: 2302277 - RNA, 15 nt, Human
acugcagcuuuacau

SEQ ID NO: 2302278 - RNA, 21 nt, Human
acugcaggccccgcuugucca

SEQ ID NO: 2302279 - RNA, 15 nt, Human
acugcaggccccgcu

SEQ ID NO: 2302280 - RNA, 12 nt, Human
acugcaggcccu

SEQ ID NO: 2302281 - RNA, 13 nt, Human
acugcaggcccug

SEQ ID NO: 2302282 - RNA, 14 nt, Human
acugcaggcccugg

SEQ ID NO: 2302283 - RNA, 15 nt, Human
acugcaggcccuggc

SEQ ID NO: 2302284 - RNA, 16 nt, Human
acugcaggcccuggcc

SEQ ID NO: 2302285 - RNA, 23 nt, Human
acugcagccucaaccuccugggc

SEQ ID NO: 2302286 - RNA, 20 nt, Human
acugcagaccuguccuccug

SEQ ID NO: 2302287 - RNA, 21 nt, Human
acugcagaccuguccuccugg

SEQ ID NO: 2302288 - RNA, 23 nt, Human
acugcagaccuguccuccuggug

SEQ ID NO: 2302289 - RNA, 23 nt, Human
acugcaggccccgcuuguccagc

SEQ ID NO: 2302290 - RNA, 13 nt, Human
acugcagggccag

SEQ ID NO: 2302291 - RNA, 15 nt, Human
acugcagggccagga

SEQ ID NO: 2302292 - RNA, 16 nt, Human
acugcagggccaggac

SEQ ID NO: 2302293 - RNA, 17 nt, Human
acugcagggccaggacu

SEQ ID NO: 2302294 - RNA, 20 nt, Human
acugcagggccaggacugag

SEQ ID NO: 2302295 - RNA, 17 nt, Human
acugcagggacugccag

SEQ ID NO: 2302296 - RNA, 18 nt, Human
acugcagggacugccagu

SEQ ID NO: 2302297 - RNA, 16 nt, Human
acugcagggacugcca

SEQ ID NO: 2302298 - RNA, 23 nt, Human
acugcagggaaaauuauuugcau

SEQ ID NO: 2302299 - RNA, 10 nt, Human
acugcaggga

SEQ ID NO: 2302300 - RNA, 17 nt, Human
acugcaggcccuggccu

SEQ ID NO: 2302301 - RNA, 18 nt, Human
acugcaggcccuggccuc

SEQ ID NO: 2302302 - RNA, 19 nt, Human
acugcaggcccuggccucc

SEQ ID NO: 2302303 - RNA, 22 nt, Human
acugcaggcccuggccuccccu

SEQ ID NO: 2302304 - RNA, 23 nt, Human
acuggcauggauauaguuuuacu

SEQ ID NO: 2302305 - RNA, 21 nt, Human
acuggcauggauauaguuuua

SEQ ID NO: 2302306 - RNA, 22 nt, Human
acuggccugcacggugggccuu

SEQ ID NO: 2302307 - RNA, 23 nt, Human
acuggccucugcugauccuccca

SEQ ID NO: 2302308 - RNA, 21 nt, Human
acuggcuagaguccucacucc

SEQ ID NO: 2302309 - RNA, 18 nt, Human
acuggcuagaguccucac

SEQ ID NO: 2302310 - RNA, 23 nt, Human
acuggcguagaaguuuuuguacu

SEQ ID NO: 2302311 - RNA, 16 nt, Human
acuggccucugcugau

SEQ ID NO: 2302312 - RNA, 19 nt, Human
acuggcgacacguagcagc

SEQ ID NO: 2302313 - RNA, 22 nt, Human
acuggcaguuuuccauugguuu

SEQ ID NO: 2302314 - RNA, 16 nt, Human
acuggcaguuuuccau

SEQ ID NO: 2302315 - RNA, 14 nt, Human
acuggcagcaucuu

SEQ ID NO: 2302316 - RNA, 16 nt, Human
acuggcacugaauuaa

SEQ ID NO: 2302317 - RNA, 21 nt, Human
acuggcaaacuucagacugaa

SEQ ID NO: 2302318 - RNA, 20 nt, Human
acuggcacugaauuaaucau

SEQ ID NO: 2302319 - RNA, 22 nt, Human
acuggcacaguuuucugagaaa

SEQ ID NO: 2302320 - RNA, 21 nt, Human
acuggcacaguuuucugagaa

SEQ ID NO: 2302321 - RNA, 17 nt, Human
acuggcuggcugcagug

SEQ ID NO: 2302322 - RNA, 16 nt, Human
acuggcuggcugcagu

SEQ ID NO: 2302323 - RNA, 17 nt, Human
acuggcugccuccacuc

SEQ ID NO: 2302324 - RNA, 19 nt, Human
acuggcugccuccacuccc

SEQ ID NO: 2302325 - RNA, 21 nt, Human
acuggcugccuccacucccac

SEQ ID NO: 2302326 - RNA, 22 nt, Human
acuggcugccuccacucccacu

SEQ ID NO: 2302327 - RNA, 12 nt, Human
acuggcugguga

SEQ ID NO: 2302328 - RNA, 13 nt, Human
uccuucagcccuc

SEQ ID NO: 2302329 - RNA, 14 nt, Human
uccuucagcccuca

SEQ ID NO: 2302330 - RNA, 15 nt, Human
uccuucagcccucac

SEQ ID NO: 2302331 - RNA, 19 nt, Human
uccuucagcccucaccccu

SEQ ID NO: 2302332 - RNA, 22 nt, Human
acuggcucauauuccugcagcc

SEQ ID NO: 2302333 - RNA, 12 nt, Human
acuggcucucca

SEQ ID NO: 2302334 - RNA, 13 nt, Human
acuggcucuccaa

SEQ ID NO: 2302335 - RNA, 14 nt, Human
acuggcucuccaag

SEQ ID NO: 2302336 - RNA, 15 nt, Human
acuggcucuccaagu

SEQ ID NO: 2302337 - RNA, 16 nt, Human
acuggcucuccaagug

SEQ ID NO: 2302338 - RNA, 14 nt, Human
acuggcucucucca

SEQ ID NO: 2302339 - RNA, 15 nt, Human
acuggcucucuccag

SEQ ID NO: 2302340 - RNA, 17 nt, Human
acuggcucuccaagugc

SEQ ID NO: 2302341 - RNA, 20 nt, Human
acuggcucuccaagugccag

SEQ ID NO: 2302342 - RNA, 21 nt, Human
acuggcucuccaagugccaga

SEQ ID NO: 2302343 - RNA, 22 nt, Human
acuggcucuccaagugccagag

SEQ ID NO: 2302344 - RNA, 22 nt, Human
acuggcugcaaaggguaucagg

SEQ ID NO: 2302345 - RNA, 16 nt, Human
acuggcucucuccagg

SEQ ID NO: 2302346 - RNA, 17 nt, Human
acuggcucucuccagga

SEQ ID NO: 2302347 - RNA, 23 nt, Human
acuggcucucuccaggauccaga

SEQ ID NO: 2302348 - RNA, 19 nt, Human
acuggcugccagcuauuuu

SEQ ID NO: 2302349 - RNA, 20 nt, Human
acuggcugccagcuauuuuu

SEQ ID NO: 2302350 - RNA, 12 nt, Human
acuggcugccuc

SEQ ID NO: 2302351 - RNA, 14 nt, Human
acuggcugccucca

SEQ ID NO: 2302352 - RNA, 16 nt, Human
acuggcugccuccacu

SEQ ID NO: 2302353 - RNA, 21 nt, Human
uccuuccucacaccaggcuug

SEQ ID NO: 2302354 - RNA, 16 nt, Human
uccuuccucugagccu

SEQ ID NO: 2302355 - RNA, 16 nt, Human
uccuuccucacaccag

SEQ ID NO: 2302356 - RNA, 21 nt, Human
uccuuccuacacccuuggacu

SEQ ID NO: 2302357 - RNA, 16 nt, Human
uccuuccucugaggcu

SEQ ID NO: 2302358 - RNA, 17 nt, Human
uccuuccucugagccuu

SEQ ID NO: 2302359 - RNA, 22 nt, Human
uccuuccuacacccuuggacuu

SEQ ID NO: 2302360 - RNA, 23 nt, Human
uccuuccuacacccuuggacuug

SEQ ID NO: 2302361 - RNA, 20 nt, Human
uccuuccuggagcccagagg

SEQ ID NO: 2302362 - RNA, 12 nt, Human
uccuucccucuc

SEQ ID NO: 2302363 - RNA, 17 nt, Human
uccuuccccuuucccca

SEQ ID NO: 2302364 - RNA, 20 nt, Human
uccuucccaggaguggagga

SEQ ID NO: 2302365 - RNA, 21 nt, Human
uccuuccaacaggagcuggga

SEQ ID NO: 2302366 - RNA, 20 nt, Human
uccuuccaacaggagcuggg

SEQ ID NO: 2302367 - RNA, 14 nt, Human
uccuuccaacagga

SEQ ID NO: 2302368 - RNA, 15 nt, Human
uccuucauuuccucc

SEQ ID NO: 2302369 - RNA, 15 nt, Human
uccuucccuggcuug

SEQ ID NO: 2302370 - RNA, 14 nt, Human
uccuucccuggcuu

SEQ ID NO: 2302371 - RNA, 12 nt, Human
uccuucccuggc

SEQ ID NO: 2302372 - RNA, 20 nt, Human
uccuucccugggcugugcua

SEQ ID NO: 2302373 - RNA, 15 nt, Human
uccuucccuucucca

SEQ ID NO: 2302374 - RNA, 12 nt, Human
uccuucccuggg

SEQ ID NO: 2302375 - RNA, 19 nt, Human
uccuucccugggcugugcu

SEQ ID NO: 2302376 - RNA, 12 nt, Human
uccuucagugca

SEQ ID NO: 2302377 - RNA, 18 nt, Human
uccuucagggugaugcca

SEQ ID NO: 2302378 - RNA, 23 nt, Human
uccuucagggugaugccagguuc

SEQ ID NO: 2302379 - RNA, 18 nt, Human
uccuucagcuuccauuuc

SEQ ID NO: 2302380 - RNA, 21 nt, Human
uccuucagcccucaccccugg

SEQ ID NO: 2302381 - RNA, 12 nt, Human
uccuucagugcc

SEQ ID NO: 2302382 - RNA, 11 nt, Human
uccuucagugc

SEQ ID NO: 2302383 - RNA, 13 nt, Human
uccuucagccuga

SEQ ID NO: 2302384 - RNA, 22 nt, Human
uccuucagugccuuauggaaca

SEQ ID NO: 2302385 - RNA, 14 nt, Human
uccuucauuuccuc

SEQ ID NO: 2302386 - RNA, 11 nt, Human
uccuucauuuc

SEQ ID NO: 2302387 - RNA, 13 nt, Human
uccuucagugccu

SEQ ID NO: 2302388 - RNA, 20 nt, Human
uccuucagugccuuauggaa

SEQ ID NO: 2302389 - RNA, 17 nt, Human
acugcugcuagagccag

SEQ ID NO: 2302390 - RNA, 21 nt, Human
acugcugcccagccuccaagc

SEQ ID NO: 2302391 - RNA, 16 nt, Human
acugcugcccagccuc

SEQ ID NO: 2302392 - RNA, 18 nt, Human
acugcugcccagccucca

SEQ ID NO: 2302393 - RNA, 12 nt, Human
acugcuggcugc

SEQ ID NO: 2302394 - RNA, 21 nt, Human
acugcugcuuuuugagguggc

SEQ ID NO: 2302395 - RNA, 13 nt, Human
acugcugcugccu

SEQ ID NO: 2302396 - RNA, 14 nt, Human
acugcugcuucucc

SEQ ID NO: 2302397 - RNA, 12 nt, Human
acugcugcuuuu

SEQ ID NO: 2302398 - RNA, 18 nt, Human
acugcuuccagugaggcu

SEQ ID NO: 2302399 - RNA, 21 nt, Human
acugcuuccagugaggcucug

SEQ ID NO: 2302400 - RNA, 22 nt, Human
acugcuuccagugaggcucugc

SEQ ID NO: 2302401 - RNA, 23 nt, Human
acugcuuccagugaggcucugcc

SEQ ID NO: 2302402 - RNA, 20 nt, Human
acuggcaaacuucagacuga

SEQ ID NO: 2302403 - RNA, 16 nt, Human
acuggcaaacuucaga

SEQ ID NO: 2302404 - RNA, 13 nt, Human
acuggcaaacuuc

SEQ ID NO: 2302405 - RNA, 12 nt, Human
acuggcaaaagg

SEQ ID NO: 2302406 - RNA, 22 nt, Human
acuggcaaaaggaucuuugugg

SEQ ID NO: 2302407 - RNA, 22 nt, Human
acuggauuaaacuuaaucuaaa

SEQ ID NO: 2302408 - RNA, 13 nt, Human
acugcuggcugcc

SEQ ID NO: 2302409 - RNA, 15 nt, Human
acugcuucccauccu

SEQ ID NO: 2302410 - RNA, 16 nt, Human
acugcuucccauccua

SEQ ID NO: 2302411 - RNA, 17 nt, Human
acugcuucccauccuac

SEQ ID NO: 2302412 - RNA, 19 nt, Human
acugcuucccauccuaccc

SEQ ID NO: 2302413 - RNA, 20 nt, Human
acugcuucccauccuacccu

SEQ ID NO: 2302414 - RNA, 18 nt, Human
acugcuugaggaaaacaa

SEQ ID NO: 2302415 - RNA, 15 nt, Human
acugcuugaggaaaa

SEQ ID NO: 2302416 - RNA, 14 nt, Human
acugcuugaggaaa

SEQ ID NO: 2302417 - RNA, 20 nt, Human
acugcauaccaaccugggca

SEQ ID NO: 2302418 - RNA, 16 nt, Human
acugcauaccaaccug

SEQ ID NO: 2302419 - RNA, 14 nt, Human
acugcauacaaucu

SEQ ID NO: 2302420 - RNA, 21 nt, Human
acugcagugaaagacaagcug

SEQ ID NO: 2302421 - RNA, 22 nt, Human
acugcagugaaagacaagcugc

SEQ ID NO: 2302422 - RNA, 22 nt, Human
acugcagggccaggacugagcc

SEQ ID NO: 2302423 - RNA, 15 nt, Human
acugcaggggccgag

SEQ ID NO: 2302424 - RNA, 18 nt, Human
acugccuuggcuucaggg

SEQ ID NO: 2302425 - RNA, 22 nt, Human
acugccuugaauauccccuccc

SEQ ID NO: 2302426 - RNA, 11 nt, Human
acugccuuuga

SEQ ID NO: 2302427 - RNA, 17 nt, Human
acugccuugaauauccc

SEQ ID NO: 2302428 - RNA, 18 nt, Human
acugccuugaauaucccc

SEQ ID NO: 2302429 - RNA, 21 nt, Human
acugccuugaauauccccucc

SEQ ID NO: 2302430 - RNA, 22 nt, Human
acugccuucucaacuccaaacu

SEQ ID NO: 2302431 - RNA, 19 nt, Human
acugccuuuggcagaguuc

SEQ ID NO: 2302432 - RNA, 16 nt, Human
acugccuuuggcagag

SEQ ID NO: 2302433 - RNA, 13 nt, Human
acugccuuugacc

SEQ ID NO: 2302434 - RNA, 15 nt, Human
acugcgacuuucugc

SEQ ID NO: 2302435 - RNA, 17 nt, Human
acugcgacuuucugccu

SEQ ID NO: 2302436 - RNA, 18 nt, Human
acugcgacuuucugccug

SEQ ID NO: 2302437 - RNA, 19 nt, Human
acugcgggaugguccuggg

SEQ ID NO: 2302438 - RNA, 20 nt, Human
acugcggaaaaggaaggaaa

SEQ ID NO: 2302439 - RNA, 23 nt, Human
acugcggagaaccuugugccugg

SEQ ID NO: 2302440 - RNA, 18 nt, Human
acugcgaucuucagagca

SEQ ID NO: 2302441 - RNA, 19 nt, Human
acugcgaucuucagagcag

SEQ ID NO: 2302442 - RNA, 19 nt, Human
acugcgacuuucugccugg

SEQ ID NO: 2302443 - RNA, 21 nt, Human
acugcgacuuucugccuggag

SEQ ID NO: 2302444 - RNA, 22 nt, Human
acugcgacuuucugccuggagu

SEQ ID NO: 2302445 - RNA, 23 nt, Human
acugcgacuuucugccuggagug

SEQ ID NO: 2302446 - RNA, 22 nt, Human
acugcgggaugguccuggggcu

SEQ ID NO: 2302447 - RNA, 16 nt, Human
acugcggggcuuggcu

SEQ ID NO: 2302448 - RNA, 18 nt, Human
acugcggggcuuggcuga

SEQ ID NO: 2302449 - RNA, 21 nt, Human
acugcgggaugguccuggggc

SEQ ID NO: 2302450 - RNA, 20 nt, Human
acugcgggaugguccugggg

SEQ ID NO: 2302451 - RNA, 22 nt, Human
acugcuacuguaauuuuauaug

SEQ ID NO: 2302452 - RNA, 18 nt, Human
acugcuacuguaauuuua

SEQ ID NO: 2302453 - RNA, 18 nt, Human
acugcuaggcgagugcca

SEQ ID NO: 2302454 - RNA, 19 nt, Human
acugcuaggcgagugccag

SEQ ID NO: 2302455 - RNA, 20 nt, Human
acugcuaggcgagugccagg

SEQ ID NO: 2302456 - RNA, 21 nt, Human
acugcuaggcgagugccagga

SEQ ID NO: 2302457 - RNA, 22 nt, Human
acugcuaggcgagugccaggac

SEQ ID NO: 2302458 - RNA, 23 nt, Human
acugcuaggcgagugccaggacu

SEQ ID NO: 2302459 - RNA, 21 nt, Human
acugcuaggugggccagcccc

SEQ ID NO: 2302460 - RNA, 20 nt, Human
acugcuaggugggccagccc

SEQ ID NO: 2302461 - RNA, 17 nt, Human
acugcuaggugggccag

SEQ ID NO: 2302462 - RNA, 16 nt, Human
acugcuaggugggcca

SEQ ID NO: 2302463 - RNA, 23 nt, Human
acugcuaggugggccagccccuc

SEQ ID NO: 2302464 - RNA, 22 nt, Human
acugcuaggugggccagccccu

SEQ ID NO: 2302465 - RNA, 19 nt, Human
acugcuagucuuaagaacu

SEQ ID NO: 2302466 - RNA, 18 nt, Human
acugcucaagaagacaug

SEQ ID NO: 2302467 - RNA, 16 nt, Human
acugcucaagaagaca

SEQ ID NO: 2302468 - RNA, 23 nt, Human
acugcucaucauuccuugagaaa

SEQ ID NO: 2302469 - RNA, 19 nt, Human
acugcucaucauuccuuga

SEQ ID NO: 2302470 - RNA, 18 nt, Human
acugcuccccagcccugg

SEQ ID NO: 2302471 - RNA, 12 nt, Human
acugcucugaug

SEQ ID NO: 2302472 - RNA, 15 nt, Human
acugcucuuguuucu

SEQ ID NO: 2302473 - RNA, 18 nt, Human
acugcucuuguuucuuuu

SEQ ID NO: 2302474 - RNA, 11 nt, Human
acugcugcaag

SEQ ID NO: 2302475 - RNA, 15 nt, Human
acugcugcaaggccu

SEQ ID NO: 2302476 - RNA, 18 nt, Human
acugcugcaaggccuuuc

SEQ ID NO: 2302477 - RNA, 15 nt, Human
ucgaauuuuuauuau

SEQ ID NO: 2302478 - RNA, 16 nt, Human
ucgaagcucagcccac

SEQ ID NO: 2302479 - RNA, 15 nt, Human
ucgaagcucagccca

SEQ ID NO: 2302480 - RNA, 14 nt, Human
ucgaagcucagccc

SEQ ID NO: 2302481 - RNA, 23 nt, Human
ucgaagcgcgccacucgcuuccc

SEQ ID NO: 2302482 - RNA, 15 nt, Human
uccuuucuaaacaag

SEQ ID NO: 2302483 - RNA, 15 nt, Human
ucgaacuggcugcaa

SEQ ID NO: 2302484 - RNA, 14 nt, Human
ucgaacuggcugca

SEQ ID NO: 2302485 - RNA, 13 nt, Human
ucgaacuggcugc

SEQ ID NO: 2302486 - RNA, 13 nt, Human
uccuuuccccagc

SEQ ID NO: 2302487 - RNA, 14 nt, Human
uccuuuccccagcc

SEQ ID NO: 2302488 - RNA, 15 nt, Human
uccuuuccccagccc

SEQ ID NO: 2302489 - RNA, 17 nt, Human
uccuuuccaaggcuucu

SEQ ID NO: 2302490 - RNA, 18 nt, Human
uccuuuccaaggcuucuc

SEQ ID NO: 2302491 - RNA, 16 nt, Human
uccuuucauuuacugu

SEQ ID NO: 2302492 - RNA, 20 nt, Human
uccuuucauuuacuguggcu

SEQ ID NO: 2302493 - RNA, 14 nt, Human
uccuuucccuccac

SEQ ID NO: 2302494 - RNA, 16 nt, Human
uccuuuccccagccca

SEQ ID NO: 2302495 - RNA, 17 nt, Human
uccuuuccccagcccag

SEQ ID NO: 2302496 - RNA, 20 nt, Human
uccuuuccccagcccagggu

SEQ ID NO: 2302497 - RNA, 13 nt, Human
uccuuucccucca

SEQ ID NO: 2302498 - RNA, 18 nt, Human
uccuuuccccagcccagg

SEQ ID NO: 2302499 - RNA, 14 nt, Human
uccuuucuaaacaa

SEQ ID NO: 2302500 - RNA, 22 nt, Human
uccuuucuaacaaaaaaauaua

SEQ ID NO: 2302501 - RNA, 19 nt, Human
uccuuucaaugguuugcaa

SEQ ID NO: 2302502 - RNA, 17 nt, Human
uccuuucaccccagggc

SEQ ID NO: 2302503 - RNA, 20 nt, Human
uccuuucacaaccuucugug

SEQ ID NO: 2302504 - RNA, 15 nt, Human
uccuuucaccacaug

SEQ ID NO: 2302505 - RNA, 22 nt, Human
uccuuucagggaauuucaggaa

SEQ ID NO: 2302506 - RNA, 21 nt, Human
uccuuucagggaauuucagga

SEQ ID NO: 2302507 - RNA, 23 nt, Human
uccuuucagggaauuucaggaac

SEQ ID NO: 2302508 - RNA, 21 nt, Human
uccuuucaccccagggccuga

SEQ ID NO: 2302509 - RNA, 19 nt, Human
uccuuucaccccagggccu

SEQ ID NO: 2302510 - RNA, 18 nt, Human
uccuuucaccccagggcc

SEQ ID NO: 2302511 - RNA, 16 nt, Human
uccuuuauauuuagug

SEQ ID NO: 2302512 - RNA, 21 nt, Human
uccuuuauguggaaaacagaa

SEQ ID NO: 2302513 - RNA, 16 nt, Human
uccuuucacaaccuuc

SEQ ID NO: 2302514 - RNA, 18 nt, Human
uccuuucacaaccuucug

SEQ ID NO: 2302515 - RNA, 19 nt, Human
uccuuucacaaccuucugu

SEQ ID NO: 2302516 - RNA, 14 nt, Human
uccuuccugucuuc

SEQ ID NO: 2302517 - RNA, 13 nt, Human
uccuuccugucuu

SEQ ID NO: 2302518 - RNA, 12 nt, Human
uccuuccugucu

SEQ ID NO: 2302519 - RNA, 19 nt, Human
uccuuccugucuuccugca

SEQ ID NO: 2302520 - RNA, 17 nt, Human
uccuuccugucuuccug

SEQ ID NO: 2302521 - RNA, 14 nt, Human
uccuuccuguucug

SEQ ID NO: 2302522 - RNA, 23 nt, Human
uccuuuaggagggaguuaucuaa

SEQ ID NO: 2302523 - RNA, 13 nt, Human
uccuuuauaauga

SEQ ID NO: 2302524 - RNA, 20 nt, Human
ucgaauuuuuauuauuuguu

SEQ ID NO: 2302525 - RNA, 12 nt, Human
ucgacacagagu

SEQ ID NO: 2302526 - RNA, 17 nt, Human
ucgaccaauucaacccu

SEQ ID NO: 2302527 - RNA, 14 nt, Human
ucgaccccaaagcc

SEQ ID NO: 2302528 - RNA, 19 nt, Human
ucgaccccaaagccccuug

SEQ ID NO: 2302529 - RNA, 18 nt, Human
ucgaccugauuuacaguu

SEQ ID NO: 2302530 - RNA, 19 nt, Human
ucgaccugauuuacaguuu

SEQ ID NO: 2302531 - RNA, 17 nt, Human
ucgacugugaccugugg

SEQ ID NO: 2302532 - RNA, 16 nt, Human
ucgacugugaccugug

SEQ ID NO: 2302533 - RNA, 16 nt, Human
ucgacucagccucagg

SEQ ID NO: 2302534 - RNA, 14 nt, Human
ucgacucaggaucc

SEQ ID NO: 2302535 - RNA, 16 nt, Human
ucgacucaggauccag

SEQ ID NO: 2302536 - RNA, 21 nt, Human
ucgacucaggauccagucccu

SEQ ID NO: 2302537 - RNA, 14 nt, Human
ucgacucagccuca

SEQ ID NO: 2302538 - RNA, 20 nt, Human
ucgaccugcggcugcugugu

SEQ ID NO: 2302539 - RNA, 22 nt, Human
ucgaccugcggcugcugugugc

SEQ ID NO: 2302540 - RNA, 13 nt, Human
ucgaccugccucg

SEQ ID NO: 2302541 - RNA, 21 nt, Human
ucgagcaguccugccucagcc

SEQ ID NO: 2302542 - RNA, 17 nt, Human
ucgagcaguccugccuc

SEQ ID NO: 2302543 - RNA, 14 nt, Human
ucgagcagggugcu

SEQ ID NO: 2302544 - RNA, 13 nt, Human
ucgaggacaggga

SEQ ID NO: 2302545 - RNA, 15 nt, Human
ucgagcaugccugga

SEQ ID NO: 2302546 - RNA, 14 nt, Human
ucgagcaugccugg

SEQ ID NO: 2302547 - RNA, 22 nt, Human
ucgagcaguccugccucagccu

SEQ ID NO: 2302548 - RNA, 20 nt, Human
ucgagcagggugcugugggu

SEQ ID NO: 2302549 - RNA, 19 nt, Human
ucgaggacuguauuuguga

SEQ ID NO: 2302550 - RNA, 18 nt, Human
ucgaggcccagcgaccuc

SEQ ID NO: 2302551 - RNA, 20 nt, Human
ucgaggacuguauuugugac

SEQ ID NO: 2302552 - RNA, 22 nt, Human
ucgccuuagcacuaccacuccu

SEQ ID NO: 2302553 - RNA, 14 nt, Human
ucgccuuagcaugu

SEQ ID NO: 2302554 - RNA, 16 nt, Human
ucgccuguaaucucac

SEQ ID NO: 2302555 - RNA, 14 nt, Human
ucgaggacagggag

SEQ ID NO: 2302556 - RNA, 17 nt, Human
ucgaggacagggaggug

SEQ ID NO: 2302557 - RNA, 20 nt, Human
ucgccuuagcauguuugcug

SEQ ID NO: 2302558 - RNA, 21 nt, Human
ucgccuuagcauguuugcuga

SEQ ID NO: 2302559 - RNA, 23 nt, Human
ucgccuuucccaggugcuacacc

SEQ ID NO: 2302560 - RNA, 14 nt, Human
ucgcgacaaugcaa

SEQ ID NO: 2302561 - RNA, 13 nt, Human
ucgcgacaaugca

SEQ ID NO: 2302562 - RNA, 22 nt, Human
acugggaugggaggagaggaca

SEQ ID NO: 2302563 - RNA, 22 nt, Human
acugggcuuggggaccagagcu

SEQ ID NO: 2302564 - RNA, 18 nt, Human
acugggcaaugauggcaa

SEQ ID NO: 2302565 - RNA, 13 nt, Human
acugggcaaugau

SEQ ID NO: 2302566 - RNA, 23 nt, Human
acugggagccuacccacccccag

SEQ ID NO: 2302567 - RNA, 12 nt, Human
acugggagccua

SEQ ID NO: 2302568 - RNA, 19 nt, Human
acugggagaggugccagca

SEQ ID NO: 2302569 - RNA, 22 nt, Human
acugggagaggugccagcaacu

SEQ ID NO: 2302570 - RNA, 23 nt, Human
acugggagaggugccagcaacug

SEQ ID NO: 2302571 - RNA, 12 nt, Human
ucgcuccugugu

SEQ ID NO: 2302572 - RNA, 14 nt, Human
ucgcuccugcccac

SEQ ID NO: 2302573 - RNA, 13 nt, Human
ucgcuccuguguc

SEQ ID NO: 2302574 - RNA, 17 nt, Human
acugggagaaaugaaaa

SEQ ID NO: 2302575 - RNA, 20 nt, Human
acuggguacuuguggacaca

SEQ ID NO: 2302576 - RNA, 23 nt, Human
acuggguacuuguggacacagcu

SEQ ID NO: 2302577 - RNA, 16 nt, Human
acuguaaggcaaucau

SEQ ID NO: 2302578 - RNA, 21 nt, Human
acuggggauugggugggcagg

SEQ ID NO: 2302579 - RNA, 12 nt, Human
acuggggcacuu

SEQ ID NO: 2302580 - RNA, 19 nt, Human
acuggguacuuguggacac

SEQ ID NO: 2302581 - RNA, 17 nt, Human
acuggggauuggguggg

SEQ ID NO: 2302582 - RNA, 18 nt, Human
acuggggaugugggaggg

SEQ ID NO: 2302583 - RNA, 16 nt, Human
acuggggaugugggag

SEQ ID NO: 2302584 - RNA, 17 nt, Human
acuggggaugugggagg

SEQ ID NO: 2302585 - RNA, 21 nt, Human
acuggggagcccgucucagug

SEQ ID NO: 2302586 - RNA, 13 nt, Human
acuggggagcccg

SEQ ID NO: 2302587 - RNA, 17 nt, Human
acuggggagcccgucuc

SEQ ID NO: 2302588 - RNA, 16 nt, Human
acugggaugagccgcu

SEQ ID NO: 2302589 - RNA, 13 nt, Human
acuguacuccucc

SEQ ID NO: 2302590 - RNA, 14 nt, Human
acuguacuccuccc

SEQ ID NO: 2302591 - RNA, 23 nt, Human
acuguagaaaagggaacugaaca

SEQ ID NO: 2302592 - RNA, 15 nt, Human
acuguagaaaugaug

SEQ ID NO: 2302593 - RNA, 18 nt, Human
acuguagaaugauuucau

SEQ ID NO: 2302594 - RNA, 20 nt, Human
acuguagaaugauuucaugc

SEQ ID NO: 2302595 - RNA, 19 nt, Human
acuguagaaugauuucaug

SEQ ID NO: 2302596 - RNA, 14 nt, Human
acuguacaugaaaa

SEQ ID NO: 2302597 - RNA, 13 nt, Human
acuguacaugaaa

SEQ ID NO: 2302598 - RNA, 23 nt, Human
acuguacaugaaaacacauuuuu

SEQ ID NO: 2302599 - RNA, 13 nt, Human
acuguacaaagua

SEQ ID NO: 2302600 - RNA, 19 nt, Human
acuguaauuugugauacaa

SEQ ID NO: 2302601 - RNA, 12 nt, Human
acuguaauuuag

SEQ ID NO: 2302602 - RNA, 23 nt, Human
acuguaaugaaccgcugaauaug

SEQ ID NO: 2302603 - RNA, 21 nt, Human
acuguaagacucauucccuag

SEQ ID NO: 2302604 - RNA, 22 nt, Human
acuguaaugaaccgcugaauau

SEQ ID NO: 2302605 - RNA, 16 nt, Human
acuguaauaaagauga

SEQ ID NO: 2302606 - RNA, 15 nt, Human
acuguacaaaguaga

SEQ ID NO: 2302607 - RNA, 14 nt, Human
acuguacaaaguag

SEQ ID NO: 2302608 - RNA, 17 nt, Human
acuguaauuuuauauga

SEQ ID NO: 2302609 - RNA, 20 nt, Human
acuguacagacagaaaaaac

SEQ ID NO: 2302610 - RNA, 21 nt, Human
ucccagguaccagcugcgcuu

SEQ ID NO: 2302611 - RNA, 19 nt, Human
ucccagguaccagcugcgc

SEQ ID NO: 2302612 - RNA, 15 nt, Human
ucccagugaauucuu

SEQ ID NO: 2302613 - RNA, 16 nt, Human
ucccagucucuggcag

SEQ ID NO: 2302614 - RNA, 22 nt, Human
ucccagugccgagaaggaagcc

SEQ ID NO: 2302615 - RNA, 19 nt, Human
ucccagugccgagaaggaa

SEQ ID NO: 2302616 - RNA, 15 nt, Human
ucccaguucaggagu

SEQ ID NO: 2302617 - RNA, 17 nt, Human
ucccagugucuuccugu

SEQ ID NO: 2302618 - RNA, 19 nt, Human
ucccagugucuuccugugg

SEQ ID NO: 2302619 - RNA, 21 nt, Human
ucccagugggaggggcaggcu

SEQ ID NO: 2302620 - RNA, 22 nt, Human
ucccagugggaggggcaggcug

SEQ ID NO: 2302621 - RNA, 23 nt, Human
ucccagugggaggggcaggcuga

SEQ ID NO: 2302622 - RNA, 15 nt, Human
ucccagugucuuccu

SEQ ID NO: 2302623 - RNA, 22 nt, Human
ucccaguggcugcugcccaggc

SEQ ID NO: 2302624 - RNA, 23 nt, Human
ucccaguggcugcugcccaggcc

SEQ ID NO: 2302625 - RNA, 10 nt, Human
ucccaguggg

SEQ ID NO: 2302626 - RNA, 15 nt, Human
ucccagugggaggcg

SEQ ID NO: 2302627 - RNA, 14 nt, Human
ucccagugggaggg

SEQ ID NO: 2302628 - RNA, 15 nt, Human
ucccagugggagggg

SEQ ID NO: 2302629 - RNA, 17 nt, Human
ucccagugggaggggca

SEQ ID NO: 2302630 - RNA, 20 nt, Human
ucccagugggaggggcaggc

SEQ ID NO: 2302631 - RNA, 22 nt, Human
ucccaguggccucaacccuccc

SEQ ID NO: 2302632 - RNA, 20 nt, Human
ucccaguggccucaacccuc

SEQ ID NO: 2302633 - RNA, 15 nt, Human
ucccaguggcugcug

SEQ ID NO: 2302634 - RNA, 16 nt, Human
ucccaguggcugcugc

SEQ ID NO: 2302635 - RNA, 17 nt, Human
ucccaguggcugcugcc

SEQ ID NO: 2302636 - RNA, 18 nt, Human
ucccaguggcugcugccc

SEQ ID NO: 2302637 - RNA, 19 nt, Human
ucccaguggcugcugccca

SEQ ID NO: 2302638 - RNA, 21 nt, Human
ucccaguggcugcugcccagg

SEQ ID NO: 2302639 - RNA, 19 nt, Human
ucccaguggccucaacccu

SEQ ID NO: 2302640 - RNA, 18 nt, Human
ucccaguggccucaaccc

SEQ ID NO: 2302641 - RNA, 14 nt, Human
ucccaguggccuca

SEQ ID NO: 2302642 - RNA, 20 nt, Human
ucccagugacacuucagaga

SEQ ID NO: 2302643 - RNA, 22 nt, Human
ucccagugacacuucagagagc

SEQ ID NO: 2302644 - RNA, 19 nt, Human
ucccagugacacuucagag

SEQ ID NO: 2302645 - RNA, 15 nt, Human
ucccagugacacuuc

SEQ ID NO: 2302646 - RNA, 18 nt, Human
ucccaggggaccacaccu

SEQ ID NO: 2302647 - RNA, 13 nt, Human
acuacauucauuu

SEQ ID NO: 2302648 - RNA, 18 nt, Human
ucccaggggcuggcuuca

SEQ ID NO: 2302649 - RNA, 19 nt, Human
acuacaugugguuuauaga

SEQ ID NO: 2302650 - RNA, 23 nt, Human
ucccaggguagcccgccugccag

SEQ ID NO: 2302651 - RNA, 21 nt, Human
ucccaggguagcccgccugcc

SEQ ID NO: 2302652 - RNA, 22 nt, Human
ucccaggguagcccgccugcca

SEQ ID NO: 2302653 - RNA, 21 nt, Human
ucccaggggcccaaggcggcc

SEQ ID NO: 2302654 - RNA, 22 nt, Human
ucccaggggcccaaggcggccc

SEQ ID NO: 2302655 - RNA, 16 nt, Human
ucccaggguagcccgc

SEQ ID NO: 2302656 - RNA, 18 nt, Human
ucccaggguagcccgccu

SEQ ID NO: 2302657 - RNA, 18 nt, Human
ucccagguaagcaggagg

SEQ ID NO: 2302658 - RNA, 19 nt, Human
ucccagguaagcaggagga

SEQ ID NO: 2302659 - RNA, 16 nt, Human
ucccagguaccagcug

SEQ ID NO: 2302660 - RNA, 17 nt, Human
ucccagguaccagcugc

SEQ ID NO: 2302661 - RNA, 18 nt, Human
ucccagguaccagcugcg

SEQ ID NO: 2302662 - RNA, 20 nt, Human
acuacaugcagcccaugccc

SEQ ID NO: 2302663 - RNA, 15 nt, Human
acuacaugugguuua

SEQ ID NO: 2302664 - RNA, 18 nt, Human
acuacaugugguuuauag

SEQ ID NO: 2302665 - RNA, 14 nt, Human
acuacaugcacuug

SEQ ID NO: 2302666 - RNA, 12 nt, Human
acuacaugcacu

SEQ ID NO: 2302667 - RNA, 19 nt, Human
acuacaucgcccuccacau

SEQ ID NO: 2302668 - RNA, 20 nt, Human
acuacaugagaacaaacaga

SEQ ID NO: 2302669 - RNA, 17 nt, Human
acuacaucgcccuccac

SEQ ID NO: 2302670 - RNA, 17 nt, Human
acuacauaaacugacuu

SEQ ID NO: 2302671 - RNA, 23 nt, Human
acuacauaaacugacuuuauccu

SEQ ID NO: 2302672 - RNA, 15 nt, Human
acuacagucaggaaa

SEQ ID NO: 2302673 - RNA, 13 nt, Human
acuacauaaacug

SEQ ID NO: 2302674 - RNA, 16 nt, Human
acuacauaaacugacu

SEQ ID NO: 2302675 - RNA, 16 nt, Human
acuacaguccucccau

SEQ ID NO: 2302676 - RNA, 23 nt, Human
ucccaguucaggagucccaagga

SEQ ID NO: 2302677 - RNA, 20 nt, Human
ucccaguucaggagucccaa

SEQ ID NO: 2302678 - RNA, 14 nt, Human
acuaaccccgggcg

SEQ ID NO: 2302679 - RNA, 20 nt, Human
ucccagugucuuccuguggg

SEQ ID NO: 2302680 - RNA, 18 nt, Human
ucccauaaccgcugauuc

SEQ ID NO: 2302681 - RNA, 22 nt, Human
ucccauaauuuucuucaugcaa

SEQ ID NO: 2302682 - RNA, 15 nt, Human
ucccauaagcuauag

SEQ ID NO: 2302683 - RNA, 22 nt, Human
ucccauaaccgcugauucucag

SEQ ID NO: 2302684 - RNA, 17 nt, Human
ucccauagccaggaaac

SEQ ID NO: 2302685 - RNA, 14 nt, Human
ucccauaccaccca

SEQ ID NO: 2302686 - RNA, 15 nt, Human
ucccauaggcccagu

SEQ ID NO: 2302687 - RNA, 16 nt, Human
ucccauaugccugggc

SEQ ID NO: 2302688 - RNA, 15 nt, Human
ucccauaugccuggg

SEQ ID NO: 2302689 - RNA, 13 nt, Human
ucccaucucacac

SEQ ID NO: 2302690 - RNA, 13 nt, Human
ucccaucgcuguc

SEQ ID NO: 2302691 - RNA, 15 nt, Human
ucccauauccugccu

SEQ ID NO: 2302692 - RNA, 18 nt, Human
ucccauauccugccucag

SEQ ID NO: 2302693 - RNA, 14 nt, Human
ucccaucucacaca

SEQ ID NO: 2302694 - RNA, 19 nt, Human
ucccaucucacacaugagc

SEQ ID NO: 2302695 - RNA, 22 nt, Human
uccccaaaaaccucacccgagg

SEQ ID NO: 2302696 - RNA, 16 nt, Human
uccccaaaaaccucac

SEQ ID NO: 2302697 - RNA, 20 nt, Human
ucccauuuuggaaguuuuca

SEQ ID NO: 2302698 - RNA, 18 nt, Human
uccccaaagucuuaaaau

SEQ ID NO: 2302699 - RNA, 18 nt, Human
uccccaaaucaauacacu

SEQ ID NO: 2302700 - RNA, 23 nt, Human
uccccaaaucaauacacuaguug

SEQ ID NO: 2302701 - RNA, 16 nt, Human
uccccaaaccugcaag

SEQ ID NO: 2302702 - RNA, 19 nt, Human
uccccaaauccgaaccucc

SEQ ID NO: 2302703 - RNA, 14 nt, Human
uccccaaauccgaa

SEQ ID NO: 2302704 - RNA, 23 nt, Human
uccccaacagcgacauagcccau

SEQ ID NO: 2302705 - RNA, 14 nt, Human
uccccaacagugug

SEQ ID NO: 2302706 - RNA, 18 nt, Human
uccccaacauguaauaag

SEQ ID NO: 2302707 - RNA, 20 nt, Human
uccccaacagugugaaguua

SEQ ID NO: 2302708 - RNA, 21 nt, Human
uccccaacagugugaaguuag

SEQ ID NO: 2302709 - RNA, 15 nt, Human
uccccaacaguguga

SEQ ID NO: 2302710 - RNA, 16 nt, Human
uccccaacagugugaa

SEQ ID NO: 2302711 - RNA, 18 nt, Human
uccccaacagugugaagu

SEQ ID NO: 2302712 - RNA, 19 nt, Human
uccccaacagugugaaguu

SEQ ID NO: 2302713 - RNA, 20 nt, Human
uccccaacccugccccugcc

SEQ ID NO: 2302714 - RNA, 18 nt, Human
uccccaacccugccccug

SEQ ID NO: 2302715 - RNA, 17 nt, Human
uccccaacccugccccu

SEQ ID NO: 2302716 - RNA, 16 nt, Human
uccccaacccugcccc

SEQ ID NO: 2302717 - RNA, 23 nt, Human
uccccaacagugugaaguuagaa

SEQ ID NO: 2302718 - RNA, 19 nt, Human
uccccaacccugccccugc

SEQ ID NO: 2302719 - RNA, 17 nt, Human
uccccaagaaagccuca

SEQ ID NO: 2302720 - RNA, 15 nt, Human
uccccaagccuggca

SEQ ID NO: 2302721 - RNA, 23 nt, Human
uccccaagauucacaccugacuc

SEQ ID NO: 2302722 - RNA, 21 nt, Human
uccccaauaauugcagaacua

SEQ ID NO: 2302723 - RNA, 20 nt, Human
uccccaauaauugcagaacu

SEQ ID NO: 2302724 - RNA, 14 nt, Human
uccccacacuccua

SEQ ID NO: 2302725 - RNA, 18 nt, Human
acguuuacaagccccccc

SEQ ID NO: 2302726 - RNA, 12 nt, Human
acguuucuaaag

SEQ ID NO: 2302727 - RNA, 21 nt, Human
uccagcuauuuuuauuuguuu

SEQ ID NO: 2302728 - RNA, 15 nt, Human
uccagcucaccagcc

SEQ ID NO: 2302729 - RNA, 14 nt, Human
uccagcucaccagc

SEQ ID NO: 2302730 - RNA, 12 nt, Human
uccagccugggu

SEQ ID NO: 2302731 - RNA, 20 nt, Human
uccagcuauaacaguaggga

SEQ ID NO: 2302732 - RNA, 24 nt, Human
uccagccugggugacagagcaagu

SEQ ID NO: 2302733 - RNA, 20 nt, Human
uccagccugggcgacagagc

SEQ ID NO: 2302734 - RNA, 17 nt, Human
uccagccugggcgacag

SEQ ID NO: 2302735 - RNA, 17 nt, Human
uccagccuggggucugg

SEQ ID NO: 2302736 - RNA, 13 nt, Human
uccagccugggug

SEQ ID NO: 2302737 - RNA, 12 nt, Human
acuaaaaauaca

SEQ ID NO: 2302738 - RNA, 16 nt, Human
acuaaaaagaaggaaa

SEQ ID NO: 2302739 - RNA, 11 nt, Human
acuaaaagaua

SEQ ID NO: 2302740 - RNA, 13 nt, Human
acuaaaaauauua

SEQ ID NO: 2302741 - RNA, 17 nt, Human
acuaaaaagaaggaaaa

SEQ ID NO: 2302742 - RNA, 20 nt, Human
acguuuuuaauauaaagccu

SEQ ID NO: 2302743 - RNA, 13 nt, Human
acguuuuuccuuu

SEQ ID NO: 2302744 - RNA, 14 nt, Human
acguuuuuccuuua

SEQ ID NO: 2302745 - RNA, 22 nt, Human
acguuuuuguaaauuaaucuuu

SEQ ID NO: 2302746 - RNA, 13 nt, Human
acuaaaaauacaa

SEQ ID NO: 2302747 - RNA, 12 nt, Human
acguuuccauca

SEQ ID NO: 2302748 - RNA, 16 nt, Human
acguuuacuuaucuua

SEQ ID NO: 2302749 - RNA, 14 nt, Human
acguuucuaaaggc

SEQ ID NO: 2302750 - RNA, 18 nt, Human
acguuuuauuguguuuuu

SEQ ID NO: 2302751 - RNA, 16 nt, Human
acguuuuauuguguuu

SEQ ID NO: 2302752 - RNA, 15 nt, Human
acguuuuauuguguu

SEQ ID NO: 2302753 - RNA, 14 nt, Human
acguuuuauugugu

SEQ ID NO: 2302754 - RNA, 15 nt, Human
acguuuccugagaag

SEQ ID NO: 2302755 - RNA, 23 nt, Human
acuaaacugguuuguugcagcca

SEQ ID NO: 2302756 - RNA, 23 nt, Human
acuaaacucucuuugggaauguu

SEQ ID NO: 2302757 - RNA, 15 nt, Human
acuaaacucucuuug

SEQ ID NO: 2302758 - RNA, 16 nt, Human
acuaaacucucuuugg

SEQ ID NO: 2302759 - RNA, 16 nt, Human
acuaaacucauuuaua

SEQ ID NO: 2302760 - RNA, 14 nt, Human
acuaaacucauuua

SEQ ID NO: 2302761 - RNA, 12 nt, Human
acuaaacucauu

SEQ ID NO: 2302762 - RNA, 14 nt, Human
acuaaacauuuugu

SEQ ID NO: 2302763 - RNA, 13 nt, Human
acuaaacauuuug

SEQ ID NO: 2302764 - RNA, 20 nt, Human
acuaaagcaguggacaccag

SEQ ID NO: 2302765 - RNA, 14 nt, Human
acuaaaguauguaa

SEQ ID NO: 2302766 - RNA, 22 nt, Human
acuaaaguauguaaaguaugua

SEQ ID NO: 2302767 - RNA, 12 nt, Human
acuaaaagaucg

SEQ ID NO: 2302768 - RNA, 23 nt, Human
acuaaaagauauaagugcuguau

SEQ ID NO: 2302769 - RNA, 20 nt, Human
acuaaaaguucuucuccaau

SEQ ID NO: 2302770 - RNA, 16 nt, Human
acuaaaagauauaagu

SEQ ID NO: 2302771 - RNA, 19 nt, Human
acuaaaagauauaagugcu

SEQ ID NO: 2302772 - RNA, 20 nt, Human
acuaaaagauauaagugcug

SEQ ID NO: 2302773 - RNA, 21 nt, Human
acuaaaagauauaagugcugu

SEQ ID NO: 2302774 - RNA, 14 nt, Human
acuaaaauauuuau

SEQ ID NO: 2302775 - RNA, 13 nt, Human
acuaaccacgcug

SEQ ID NO: 2302776 - RNA, 16 nt, Human
acuaaccagcagaaau

SEQ ID NO: 2302777 - RNA, 15 nt, Human
acuaaauagcaugua

SEQ ID NO: 2302778 - RNA, 16 nt, Human
acuaaauagcauguau

SEQ ID NO: 2302779 - RNA, 18 nt, Human
acuaaauagcauguauug

SEQ ID NO: 2302780 - RNA, 19 nt, Human
acuaaauagcauguauugu

SEQ ID NO: 2302781 - RNA, 20 nt, Human
acuaaauagcauguauugug

SEQ ID NO: 2302782 - RNA, 23 nt, Human
acuaaauagcauguauugugucu

SEQ ID NO: 2302783 - RNA, 23 nt, Human
acuaaccagggaagcugucccuc

SEQ ID NO: 2302784 - RNA, 14 nt, Human
acuaaaucucuaau

SEQ ID NO: 2302785 - RNA, 16 nt, Human
acuaaaucucuaauau

SEQ ID NO: 2302786 - RNA, 17 nt, Human
acuaaaucucuaauaug

SEQ ID NO: 2302787 - RNA, 15 nt, Human
acuacaguccuccca

SEQ ID NO: 2302788 - RNA, 23 nt, Human
acuacaggugugagucaccaagc

SEQ ID NO: 2302789 - RNA, 17 nt, Human
acuaaccagcagaaaug

SEQ ID NO: 2302790 - RNA, 15 nt, Human
acuauauuguacaca

SEQ ID NO: 2302791 - RNA, 18 nt, Human
acuauauuaucaugcaaa

SEQ ID NO: 2302792 - RNA, 13 nt, Human
acuauaugugaau

SEQ ID NO: 2302793 - RNA, 22 nt, Human
acuauaucuguauauaaaauau

SEQ ID NO: 2302794 - RNA, 13 nt, Human
acuauauauguga

SEQ ID NO: 2302795 - RNA, 18 nt, Human
acuauauagagauguuuu

SEQ ID NO: 2302796 - RNA, 14 nt, Human
acuauaucuguaua

SEQ ID NO: 2302797 - RNA, 17 nt, Human
acuauaucuguauauaa

SEQ ID NO: 2302798 - RNA, 18 nt, Human
acuauaucuguauauaaa

SEQ ID NO: 2302799 - RNA, 14 nt, Human
acuauagcccaggu

SEQ ID NO: 2302800 - RNA, 20 nt, Human
acuauagcccagguccucug

SEQ ID NO: 2302801 - RNA, 16 nt, Human
acuauauagagauguu

SEQ ID NO: 2302802 - RNA, 17 nt, Human
acuauauagagauguuu

SEQ ID NO: 2302803 - RNA, 17 nt, Human
acuauagccuaggugac

SEQ ID NO: 2302804 - RNA, 23 nt, Human
acuauaauuuaccugaagucuuu

SEQ ID NO: 2302805 - RNA, 19 nt, Human
uccccaggccguggcugcc

SEQ ID NO: 2302806 - RNA, 21 nt, Human
uccccaggccccaggaagccg

SEQ ID NO: 2302807 - RNA, 20 nt, Human
uccccaggccccaggaagcc

SEQ ID NO: 2302808 - RNA, 21 nt, Human
uccccaggccguggcugccca

SEQ ID NO: 2302809 - RNA, 23 nt, Human
uccccaggccguggcugcccaca

SEQ ID NO: 2302810 - RNA, 19 nt, Human
uccccaggccccaggaagc

SEQ ID NO: 2302811 - RNA, 13 nt, Human
uccccaggcccca

SEQ ID NO: 2302812 - RNA, 11 nt, Human
uccccaggccc

SEQ ID NO: 2302813 - RNA, 23 nt, Human
uccccaggccaggccaccaggau

SEQ ID NO: 2302814 - RNA, 14 nt, Human
uccccaggccaggc

SEQ ID NO: 2302815 - RNA, 16 nt, Human
uccccaggccaggcca

SEQ ID NO: 2302816 - RNA, 19 nt, Human
uccccaggccaggccacca

SEQ ID NO: 2302817 - RNA, 22 nt, Human
uccccaggccaggccaccagga

SEQ ID NO: 2302818 - RNA, 23 nt, Human
uccccaggaggccagccuugacc

SEQ ID NO: 2302819 - RNA, 16 nt, Human
uccccaggcaccucac

SEQ ID NO: 2302820 - RNA, 14 nt, Human
uccccacgcccucc

SEQ ID NO: 2302821 - RNA, 12 nt, Human
uccccaggccag

SEQ ID NO: 2302822 - RNA, 20 nt, Human
uccccaccuucuucagccac

SEQ ID NO: 2302823 - RNA, 23 nt, Human
uccccaccuucaauuccugggcc

SEQ ID NO: 2302824 - RNA, 22 nt, Human
uccccaccuucaauuccugggc

SEQ ID NO: 2302825 - RNA, 20 nt, Human
uccccaccuucaauuccugg

SEQ ID NO: 2302826 - RNA, 18 nt, Human
uccccaccuucaauuccu

SEQ ID NO: 2302827 - RNA, 13 nt, Human
uccccaccuggga

SEQ ID NO: 2302828 - RNA, 14 nt, Human
uccccaccugggac

SEQ ID NO: 2302829 - RNA, 10 nt, Human
uccccacacu

SEQ ID NO: 2302830 - RNA, 24 nt, Human
uccccaccgcagacaggaccaggg

SEQ ID NO: 2302831 - RNA, 19 nt, Human
acuauguugcccaggcagg

SEQ ID NO: 2302832 - RNA, 20 nt, Human
acuauguugcccaggcaggu

SEQ ID NO: 2302833 - RNA, 23 nt, Human
acuauguugcccaggcaggucuu

SEQ ID NO: 2302834 - RNA, 18 nt, Human
acuaugaacuucucucag

SEQ ID NO: 2302835 - RNA, 19 nt, Human
acuaugaacuucucucaga

SEQ ID NO: 2302836 - RNA, 21 nt, Human
acuaugaacuucucucagacu

SEQ ID NO: 2302837 - RNA, 13 nt, Human
acuaugaaucuau

SEQ ID NO: 2302838 - RNA, 22 nt, Human
acuaugaaucuauuauacugua

SEQ ID NO: 2302839 - RNA, 23 nt, Human
acuaugaaugggcaaaacugaau

SEQ ID NO: 2302840 - RNA, 17 nt, Human
acuauuauaauuuaaug

SEQ ID NO: 2302841 - RNA, 21 nt, Human
acuauuaagaggcagaaaauu

SEQ ID NO: 2302842 - RNA, 21 nt, Human
acuauuauaauuuaaugcaug

SEQ ID NO: 2302843 - RNA, 18 nt, Human
acuauuauccccauuucu

SEQ ID NO: 2302844 - RNA, 14 nt, Human
acuauuaagaggca

SEQ ID NO: 2302845 - RNA, 15 nt, Human
acucaacaugaguca

SEQ ID NO: 2302846 - RNA, 16 nt, Human
acucaacaugagucaa

SEQ ID NO: 2302847 - RNA, 19 nt, Human
acucaacaugagucaagag

SEQ ID NO: 2302848 - RNA, 19 nt, Human
acucaaauuaaucuuucuu

SEQ ID NO: 2302849 - RNA, 22 nt, Human
acucaacauguuacugaccagc

SEQ ID NO: 2302850 - RNA, 21 nt, Human
acucaacauguuacugaccag

SEQ ID NO: 2302851 - RNA, 20 nt, Human
acucaacauguuacugacca

SEQ ID NO: 2302852 - RNA, 17 nt, Human
acucaacauguuacuga

SEQ ID NO: 2302853 - RNA, 23 nt, Human
acucaacauguuacugaccagca

SEQ ID NO: 2302854 - RNA, 17 nt, Human
acuauguugcccaggca

SEQ ID NO: 2302855 - RNA, 18 nt, Human
acuauguugcccaggcag

SEQ ID NO: 2302856 - RNA, 18 nt, Human
acuaugaacuacaaagcu

SEQ ID NO: 2302857 - RNA, 22 nt, Human
acuaugaaguuuuuuuuauaca

SEQ ID NO: 2302858 - RNA, 22 nt, Human
acuaucaugucaaacgugaaaa

SEQ ID NO: 2302859 - RNA, 20 nt, Human
acuaucagcccaagaugcuu

SEQ ID NO: 2302860 - RNA, 22 nt, Human
acuaucaguuuguccuguagag

SEQ ID NO: 2302861 - RNA, 17 nt, Human
acuaucccggcugcccu

SEQ ID NO: 2302862 - RNA, 16 nt, Human
acuaucccggcugccc

SEQ ID NO: 2302863 - RNA, 22 nt, Human
acuaucuuuuugcuuacaguuu

SEQ ID NO: 2302864 - RNA, 16 nt, Human
acuaucuuggugaauu

SEQ ID NO: 2302865 - RNA, 18 nt, Human
acuaucccggcugcccuu

SEQ ID NO: 2302866 - RNA, 22 nt, Human
acuauccauaguggacauuguu

SEQ ID NO: 2302867 - RNA, 22 nt, Human
uccccuuuucuuuucuacccua

SEQ ID NO: 2302868 - RNA, 23 nt, Human
ucccgaaccccaaggagggagau

SEQ ID NO: 2302869 - RNA, 19 nt, Human
ucccgauucacccugucca

SEQ ID NO: 2302870 - RNA, 21 nt, Human
ucccgcaaacccccuuugugc

SEQ ID NO: 2302871 - RNA, 22 nt, Human
ucccgcaaacccccuuugugcu

SEQ ID NO: 2302872 - RNA, 18 nt, Human
ucccgccagacuguuaga

SEQ ID NO: 2302873 - RNA, 20 nt, Human
ucccgaguagcugggacuac

SEQ ID NO: 2302874 - RNA, 18 nt, Human
ucccgaauagcugggacu

SEQ ID NO: 2302875 - RNA, 21 nt, Human
ucccgccucuucuucuucaga

SEQ ID NO: 2302876 - RNA, 19 nt, Human
ucccgccucuucuucuuca

SEQ ID NO: 2302877 - RNA, 13 nt, Human
ucccgcucagccc

SEQ ID NO: 2302878 - RNA, 21 nt, Human
ucccgccccuucccacucacc

SEQ ID NO: 2302879 - RNA, 15 nt, Human
ucccgccccuucccc

SEQ ID NO: 2302880 - RNA, 14 nt, Human
ucccgcucagcccu

SEQ ID NO: 2302881 - RNA, 15 nt, Human
ucccgcucagcccuc

SEQ ID NO: 2302882 - RNA, 16 nt, Human
ucccgcucagcccucc

SEQ ID NO: 2302883 - RNA, 20 nt, Human
ucccgcucagcccucccugc

SEQ ID NO: 2302884 - RNA, 16 nt, Human
ucccucaaccccacca

SEQ ID NO: 2302885 - RNA, 16 nt, Human
ucccucaauucccccu

SEQ ID NO: 2302886 - RNA, 23 nt, Human
ucccucaacaagggagagaccuc

SEQ ID NO: 2302887 - RNA, 17 nt, Human
ucccucacccacccaca

SEQ ID NO: 2302888 - RNA, 22 nt, Human
ucccucacccacuuuggccucc

SEQ ID NO: 2302889 - RNA, 15 nt, Human
ucccucacccugagc

SEQ ID NO: 2302890 - RNA, 17 nt, Human
ucccucacccugagccc

SEQ ID NO: 2302891 - RNA, 19 nt, Human
ucccucacccugagccccu

SEQ ID NO: 2302892 - RNA, 20 nt, Human
ucccucacccugagccccuu

SEQ ID NO: 2302893 - RNA, 21 nt, Human
ucccucacccugagccccuuc

SEQ ID NO: 2302894 - RNA, 12 nt, Human
ucccucaccugu

SEQ ID NO: 2302895 - RNA, 13 nt, Human
ucccucaccugua

SEQ ID NO: 2302896 - RNA, 14 nt, Human
ucccucaccuguag

SEQ ID NO: 2302897 - RNA, 20 nt, Human
ucccucaccuguagcagcca

SEQ ID NO: 2302898 - RNA, 13 nt, Human
ucccucaaaugac

SEQ ID NO: 2302899 - RNA, 20 nt, Human
ucccucaaagcacacgucau

SEQ ID NO: 2302900 - RNA, 17 nt, Human
ucccggcacuccaugcu

SEQ ID NO: 2302901 - RNA, 19 nt, Human
ucccucaaaugacccaaag

SEQ ID NO: 2302902 - RNA, 20 nt, Human
ucccucaaaugacccaaaga

SEQ ID NO: 2302903 - RNA, 18 nt, Human
ucccucaacaagggagag

SEQ ID NO: 2302904 - RNA, 22 nt, Human
ucccucaacaagggagagaccu

SEQ ID NO: 2302905 - RNA, 23 nt, Human
ucccggcaugggaaagccaccuc

SEQ ID NO: 2302906 - RNA, 22 nt, Human
ucccuauuuuuuuucuguuaua

SEQ ID NO: 2302907 - RNA, 21 nt, Human
ucccuauuuuuuuucuguuau

SEQ ID NO: 2302908 - RNA, 18 nt, Human
ucccuauuagagaagaga

SEQ ID NO: 2302909 - RNA, 18 nt, Human
ucccggagguuggguggg

SEQ ID NO: 2302910 - RNA, 16 nt, Human
ucccggagggcccuga

SEQ ID NO: 2302911 - RNA, 21 nt, Human
ucccggagggcccugagcuga

SEQ ID NO: 2302912 - RNA, 13 nt, Human
ucccgcugcugcu

SEQ ID NO: 2302913 - RNA, 15 nt, Human
ucccgcugcugcugc

SEQ ID NO: 2302914 - RNA, 21 nt, Human
ucccggacugcaagcagggcu

SEQ ID NO: 2302915 - RNA, 19 nt, Human
acucaagaagcaggcuaca

SEQ ID NO: 2302916 - RNA, 13 nt, Human
acucaacccucuc

SEQ ID NO: 2302917 - RNA, 15 nt, Human
acucaacccucucag

SEQ ID NO: 2302918 - RNA, 13 nt, Human
acucaagaagcag

SEQ ID NO: 2302919 - RNA, 14 nt, Human
acucaagaagcagg

SEQ ID NO: 2302920 - RNA, 15 nt, Human
acucaagaagcaggc

SEQ ID NO: 2302921 - RNA, 16 nt, Human
acucaagaagcaggcu

SEQ ID NO: 2302922 - RNA, 14 nt, Human
uccccucagcucca

SEQ ID NO: 2302923 - RNA, 12 nt, Human
uccccucagcuc

SEQ ID NO: 2302924 - RNA, 21 nt, Human
uccccucacagccucugaccc

SEQ ID NO: 2302925 - RNA, 19 nt, Human
uccccucacugauggacaa

SEQ ID NO: 2302926 - RNA, 12 nt, Human
uccccucacugg

SEQ ID NO: 2302927 - RNA, 13 nt, Human
uccccucacugga

SEQ ID NO: 2302928 - RNA, 15 nt, Human
uccccucaccuccuc

SEQ ID NO: 2302929 - RNA, 17 nt, Human
uccccucaccuccucua

SEQ ID NO: 2302930 - RNA, 17 nt, Human
uccccucacagccucug

SEQ ID NO: 2302931 - RNA, 18 nt, Human
uccccucacagccucuga

SEQ ID NO: 2302932 - RNA, 19 nt, Human
uccccucacagccucugac

SEQ ID NO: 2302933 - RNA, 20 nt, Human
uccccucacagccucugacc

SEQ ID NO: 2302934 - RNA, 17 nt, Human
uccccuccgccaggcga

SEQ ID NO: 2302935 - RNA, 14 nt, Human
uccccucccuguca

SEQ ID NO: 2302936 - RNA, 16 nt, Human
uccccucccuggguuc

SEQ ID NO: 2302937 - RNA, 13 nt, Human
uccccucccuguc

SEQ ID NO: 2302938 - RNA, 13 nt, Human
uccccuccuaccc

SEQ ID NO: 2302939 - RNA, 20 nt, Human
uccccuccgccaggcgagau

SEQ ID NO: 2302940 - RNA, 14 nt, Human
uccccuccuacccc

SEQ ID NO: 2302941 - RNA, 17 nt, Human
uccccuccuaccccucc

SEQ ID NO: 2302942 - RNA, 19 nt, Human
uccccuccuaccccuccca

SEQ ID NO: 2302943 - RNA, 12 nt, Human
uccccuccucca

SEQ ID NO: 2302944 - RNA, 20 nt, Human
uccccuccuaccccucccag

SEQ ID NO: 2302945 - RNA, 22 nt, Human
uccccuccuaccccucccagcu

SEQ ID NO: 2302946 - RNA, 16 nt, Human
uccccuccaagguaug

SEQ ID NO: 2302947 - RNA, 13 nt, Human
uccccucauucag

SEQ ID NO: 2302948 - RNA, 15 nt, Human
uccccuccacuguca

SEQ ID NO: 2302949 - RNA, 12 nt, Human
uccccuccacug

SEQ ID NO: 2302950 - RNA, 13 nt, Human
uccccucccuggg

SEQ ID NO: 2302951 - RNA, 14 nt, Human
uccccucccugggu

SEQ ID NO: 2302952 - RNA, 12 nt, Human
uccccuccaacc

SEQ ID NO: 2302953 - RNA, 15 nt, Human
uccccucagcuccag

SEQ ID NO: 2302954 - RNA, 16 nt, Human
uccccucaggacugca

SEQ ID NO: 2302955 - RNA, 13 nt, Human
uccccuccaaccu

SEQ ID NO: 2302956 - RNA, 22 nt, Human
uccccuccaaccuggggggcag

SEQ ID NO: 2302957 - RNA, 14 nt, Human
uccccuccucacuc

SEQ ID NO: 2302958 - RNA, 14 nt, Human
uccccuccucuccc

SEQ ID NO: 2302959 - RNA, 16 nt, Human
uccccuccucuccccu

SEQ ID NO: 2302960 - RNA, 18 nt, Human
uccccuccucuccccuac

SEQ ID NO: 2302961 - RNA, 14 nt, Human
uccccuccuccacu

SEQ ID NO: 2302962 - RNA, 16 nt, Human
uccccuccuccacucu

SEQ ID NO: 2302963 - RNA, 13 nt, Human
uccccuucucuca

SEQ ID NO: 2302964 - RNA, 16 nt, Human
uccccuugagcugaga

SEQ ID NO: 2302965 - RNA, 15 nt, Human
uccccuugagcugag

SEQ ID NO: 2302966 - RNA, 16 nt, Human
uccccuucugaaucag

SEQ ID NO: 2302967 - RNA, 14 nt, Human
uccccuugagcuga

SEQ ID NO: 2302968 - RNA, 18 nt, Human
uccccuucucucaucucu

SEQ ID NO: 2302969 - RNA, 15 nt, Human
uccccuucucucauc

SEQ ID NO: 2302970 - RNA, 16 nt, Human
uccccuucucucaucu

SEQ ID NO: 2302971 - RNA, 15 nt, Human
ucccgaauagcuggg

SEQ ID NO: 2302972 - RNA, 16 nt, Human
ucccgaauagcuggga

SEQ ID NO: 2302973 - RNA, 21 nt, Human
uccccuuuucuuuucuacccu

SEQ ID NO: 2302974 - RNA, 16 nt, Human
uccccuugcccagggc

SEQ ID NO: 2302975 - RNA, 15 nt, Human
uccccuugcccaggg

SEQ ID NO: 2302976 - RNA, 13 nt, Human
uccccuugcccag

SEQ ID NO: 2302977 - RNA, 20 nt, Human
uccucacaacauggugucug

SEQ ID NO: 2302978 - RNA, 20 nt, Human
uccucacaucuuucacacuu

SEQ ID NO: 2302979 - RNA, 14 nt, Human
uccucaauccagcu

SEQ ID NO: 2302980 - RNA, 13 nt, Human
uccucaauccagc

SEQ ID NO: 2302981 - RNA, 12 nt, Human
uccucaauccag

SEQ ID NO: 2302982 - RNA, 21 nt, Human
uccucaaggggccauccuguc

SEQ ID NO: 2302983 - RNA, 18 nt, Human
uccucaaguccccaagau

SEQ ID NO: 2302984 - RNA, 23 nt, Human
uccucaacucaccuaauguuuau

SEQ ID NO: 2302985 - RNA, 17 nt, Human
uccucaacacccaacug

SEQ ID NO: 2302986 - RNA, 16 nt, Human
uccucaaacacugcag

SEQ ID NO: 2302987 - RNA, 23 nt, Human
uccucaagaaauaaaaggaagcc

SEQ ID NO: 2302988 - RNA, 17 nt, Human
uccucaagaaauaaaag

SEQ ID NO: 2302989 - RNA, 14 nt, Human
uccucaaggggcca

SEQ ID NO: 2302990 - RNA, 15 nt, Human
uccucaaggggccau

SEQ ID NO: 2302991 - RNA, 18 nt, Human
uccucaaggggccauccu

SEQ ID NO: 2302992 - RNA, 16 nt, Human
acucuuauugcccacg

SEQ ID NO: 2302993 - RNA, 19 nt, Human
acucuuauugcccacgcug

SEQ ID NO: 2302994 - RNA, 14 nt, Human
uccucaaacaacac

SEQ ID NO: 2302995 - RNA, 23 nt, Human
acucuuaucucagucaugcauaa

SEQ ID NO: 2302996 - RNA, 14 nt, Human
uccucaaacacugc

SEQ ID NO: 2302997 - RNA, 15 nt, Human
uccucaaacacugca

SEQ ID NO: 2302998 - RNA, 15 nt, Human
uccucacuggguggg

SEQ ID NO: 2302999 - RNA, 14 nt, Human
uccucacugggugg

SEQ ID NO: 2303000 - RNA, 13 nt, Human
uccucacugggug

SEQ ID NO: 2303001 - RNA, 22 nt, Human
uccucacuggccaucccucgug

SEQ ID NO: 2303002 - RNA, 23 nt, Human
uccucacugcucccugaagccag

SEQ ID NO: 2303003 - RNA, 13 nt, Human
uccucacuggcca

SEQ ID NO: 2303004 - RNA, 17 nt, Human
uccucacuggccauccc

SEQ ID NO: 2303005 - RNA, 18 nt, Human
uccucacuggccaucccu

SEQ ID NO: 2303006 - RNA, 21 nt, Human
uccucacucccuucccauaag

SEQ ID NO: 2303007 - RNA, 13 nt, Human
uccucacugcucc

SEQ ID NO: 2303008 - RNA, 16 nt, Human
uccucacucccuucua

SEQ ID NO: 2303009 - RNA, 15 nt, Human
uccucacugcucccu

SEQ ID NO: 2303010 - RNA, 17 nt, Human
uccucacugcucccuga

SEQ ID NO: 2303011 - RNA, 20 nt, Human
uccucacugcucccugaagc

SEQ ID NO: 2303012 - RNA, 21 nt, Human
uccucacugcucccugaagcc

SEQ ID NO: 2303013 - RNA, 19 nt, Human
uccucacucccuucccaua

SEQ ID NO: 2303014 - RNA, 17 nt, Human
uccucacucccuuccca

SEQ ID NO: 2303015 - RNA, 17 nt, Human
uccucaccccuguccuc

SEQ ID NO: 2303016 - RNA, 19 nt, Human
uccucaccccuguccucac

SEQ ID NO: 2303017 - RNA, 12 nt, Human
uccucaccccug

SEQ ID NO: 2303018 - RNA, 13 nt, Human
uccucaccccugu

SEQ ID NO: 2303019 - RNA, 14 nt, Human
uccucaccccuguc

SEQ ID NO: 2303020 - RNA, 15 nt, Human
uccucaccccugucc

SEQ ID NO: 2303021 - RNA, 20 nt, Human
uccucaccccgucugggguu

SEQ ID NO: 2303022 - RNA, 14 nt, Human
uccucaccacaugc

SEQ ID NO: 2303023 - RNA, 20 nt, Human
uccucacccccagcuuugcu

SEQ ID NO: 2303024 - RNA, 16 nt, Human
uccucacccccagcuu

SEQ ID NO: 2303025 - RNA, 13 nt, Human
uccucacccccag

SEQ ID NO: 2303026 - RNA, 22 nt, Human
uccucacuggguggggugagga

SEQ ID NO: 2303027 - RNA, 21 nt, Human
uccucacuuccauacagcucu

SEQ ID NO: 2303028 - RNA, 22 nt, Human
uccucacuuccauacagcucua

SEQ ID NO: 2303029 - RNA, 20 nt, Human
uccucagaucuucugugggu

SEQ ID NO: 2303030 - RNA, 19 nt, Human
uccucagaucauccagaag

SEQ ID NO: 2303031 - RNA, 20 nt, Human
uccucagagaauuucuacca

SEQ ID NO: 2303032 - RNA, 17 nt, Human
uccucagagaauuucua

SEQ ID NO: 2303033 - RNA, 23 nt, Human
uccucagguggccaugccucagc

SEQ ID NO: 2303034 - RNA, 20 nt, Human
uccucaguuuaauccuucua

SEQ ID NO: 2303035 - RNA, 23 nt, Human
uccucauaaaaagcaaaacaaaa

SEQ ID NO: 2303036 - RNA, 16 nt, Human
uccucauaaaaagcaa

SEQ ID NO: 2303037 - RNA, 11 nt, Human
uccucagccuu

SEQ ID NO: 2303038 - RNA, 20 nt, Human
uccucagccuccucaucugg

SEQ ID NO: 2303039 - RNA, 14 nt, Human
uccucauacccacc

SEQ ID NO: 2303040 - RNA, 18 nt, Human
uccucauacccaccccca

SEQ ID NO: 2303041 - RNA, 18 nt, Human
uccuccccuucccugcaa

SEQ ID NO: 2303042 - RNA, 17 nt, Human
uccuccccuucccugca

SEQ ID NO: 2303043 - RNA, 15 nt, Human
uccuccccuucccug

SEQ ID NO: 2303044 - RNA, 14 nt, Human
uccuccccuucccu

SEQ ID NO: 2303045 - RNA, 13 nt, Human
uccuccccuuccc

SEQ ID NO: 2303046 - RNA, 22 nt, Human
uccuccccuccuccuggacucc

SEQ ID NO: 2303047 - RNA, 20 nt, Human
uccuccccuccuccuggacu

SEQ ID NO: 2303048 - RNA, 18 nt, Human
uccuccccuccuccugga

SEQ ID NO: 2303049 - RNA, 16 nt, Human
uccuccccuccuccug

SEQ ID NO: 2303050 - RNA, 22 nt, Human
uccucauacccacccccaccca

SEQ ID NO: 2303051 - RNA, 12 nt, Human
uccucuccacug

SEQ ID NO: 2303052 - RNA, 22 nt, Human
uccucccugcaucugaccagca

SEQ ID NO: 2303053 - RNA, 14 nt, Human
uccucuccacccuc

SEQ ID NO: 2303054 - RNA, 16 nt, Human
uccucuccacccuccc

SEQ ID NO: 2303055 - RNA, 13 nt, Human
uccucuccaccua

SEQ ID NO: 2303056 - RNA, 13 nt, Human
uccucuccacugc

SEQ ID NO: 2303057 - RNA, 14 nt, Human
uccucuccacugcc

SEQ ID NO: 2303058 - RNA, 12 nt, Human
uccucuccccag

SEQ ID NO: 2303059 - RNA, 15 nt, Human
uccucuccacugccu

SEQ ID NO: 2303060 - RNA, 16 nt, Human
uccucuccacugccuu

SEQ ID NO: 2303061 - RNA, 15 nt, Human
uccucccucccucuu

SEQ ID NO: 2303062 - RNA, 17 nt, Human
uccucccucccucuuuc

SEQ ID NO: 2303063 - RNA, 13 nt, Human
uccucccuccugc

SEQ ID NO: 2303064 - RNA, 18 nt, Human
uccucccucugaggcugu

SEQ ID NO: 2303065 - RNA, 13 nt, Human
uccucuccacccu

SEQ ID NO: 2303066 - RNA, 14 nt, Human
uccucccugcaucu

SEQ ID NO: 2303067 - RNA, 19 nt, Human
uccucccucugaggcugua

SEQ ID NO: 2303068 - RNA, 19 nt, Human
uccucccucccucuuuccc

SEQ ID NO: 2303069 - RNA, 20 nt, Human
uccuagggaaaaguucauag

SEQ ID NO: 2303070 - RNA, 19 nt, Human
uccuagggaaggguggugg

SEQ ID NO: 2303071 - RNA, 17 nt, Human
uccuagggccuggguuu

SEQ ID NO: 2303072 - RNA, 22 nt, Human
uccuaggcuccaccccauccag

SEQ ID NO: 2303073 - RNA, 18 nt, Human
acucgcgacaaugcaaac

SEQ ID NO: 2303074 - RNA, 13 nt, Human
uccuaggccacac

SEQ ID NO: 2303075 - RNA, 20 nt, Human
uccuaggcuccaccccaucc

SEQ ID NO: 2303076 - RNA, 19 nt, Human
uccuaggcauuugcugaau

SEQ ID NO: 2303077 - RNA, 15 nt, Human
acucgcuucccccau

SEQ ID NO: 2303078 - RNA, 12 nt, Human
acucgcuucccc

SEQ ID NO: 2303079 - RNA, 18 nt, Human
uccuagguaggguuuaau

SEQ ID NO: 2303080 - RNA, 20 nt, Human
acucgcgacaaugcaaacca

SEQ ID NO: 2303081 - RNA, 23 nt, Human
acucgcgacaaugcaaaccauca

SEQ ID NO: 2303082 - RNA, 12 nt, Human
acucuccccaca

SEQ ID NO: 2303083 - RNA, 11 nt, Human
acucuccccac

SEQ ID NO: 2303084 - RNA, 10 nt, Human
acucucccca

SEQ ID NO: 2303085 - RNA, 15 nt, Human
acucucccauggcuu

SEQ ID NO: 2303086 - RNA, 23 nt, Human
acucucccauggcuuaaugcuuc

SEQ ID NO: 2303087 - RNA, 19 nt, Human
acucuccaaccuggacaac

SEQ ID NO: 2303088 - RNA, 14 nt, Human
acucucccauggcu

SEQ ID NO: 2303089 - RNA, 13 nt, Human
acucuccaucuua

SEQ ID NO: 2303090 - RNA, 15 nt, Human
acucuccccacacua

SEQ ID NO: 2303091 - RNA, 14 nt, Human
acucuccccacacu

SEQ ID NO: 2303092 - RNA, 10 nt, Human
acucuccccc

SEQ ID NO: 2303093 - RNA, 17 nt, Human
acucuccucugcugcug

SEQ ID NO: 2303094 - RNA, 20 nt, Human
acucgcuucccccauagcca

SEQ ID NO: 2303095 - RNA, 15 nt, Human
acucgcuugugcaga

SEQ ID NO: 2303096 - RNA, 16 nt, Human
acucggcacccugcaa

SEQ ID NO: 2303097 - RNA, 17 nt, Human
acucgcuugugcagaaa

SEQ ID NO: 2303098 - RNA, 23 nt, Human
acucgcuugugcagaaaacauug

SEQ ID NO: 2303099 - RNA, 22 nt, Human
acucgggaggcugagacaggag

SEQ ID NO: 2303100 - RNA, 20 nt, Human
acucgggaggcugagacagg

SEQ ID NO: 2303101 - RNA, 14 nt, Human
acucgggcuccugu

SEQ ID NO: 2303102 - RNA, 17 nt, Human
acucuccaaccuggaca

SEQ ID NO: 2303103 - RNA, 14 nt, Human
acucuccaaccugg

SEQ ID NO: 2303104 - RNA, 21 nt, Human
acucucauuccccagguggcu

SEQ ID NO: 2303105 - RNA, 17 nt, Human
acucucauuccccaggu

SEQ ID NO: 2303106 - RNA, 16 nt, Human
acucucauuccccagg

SEQ ID NO: 2303107 - RNA, 15 nt, Human
acucgggcuccugug

SEQ ID NO: 2303108 - RNA, 17 nt, Human
acucgggcuccugugcc

SEQ ID NO: 2303109 - RNA, 18 nt, Human
acucgggcuccugugccc

SEQ ID NO: 2303110 - RNA, 19 nt, Human
acucgggcuccugugcccu

SEQ ID NO: 2303111 - RNA, 21 nt, Human
acucugaagggcaucaugcau

SEQ ID NO: 2303112 - RNA, 20 nt, Human
acucugaagggcaucaugca

SEQ ID NO: 2303113 - RNA, 23 nt, Human
acucugaagcugacgaacuucca

SEQ ID NO: 2303114 - RNA, 12 nt, Human
acucugaagcug

SEQ ID NO: 2303115 - RNA, 18 nt, Human
acucugaagccucuggga

SEQ ID NO: 2303116 - RNA, 19 nt, Human
acucugaagccucugggaa

SEQ ID NO: 2303117 - RNA, 16 nt, Human
acucugaaaugaagau

SEQ ID NO: 2303118 - RNA, 9 nt, Human
acucugaac

SEQ ID NO: 2303119 - RNA, 14 nt, Human
acucugaagccucu

SEQ ID NO: 2303120 - RNA, 15 nt, Human
acucugaagccucug

SEQ ID NO: 2303121 - RNA, 16 nt, Human
acucugaagccucugg

SEQ ID NO: 2303122 - RNA, 17 nt, Human
acucugaagccucuggg

SEQ ID NO: 2303123 - RNA, 14 nt, Human
acucugcacauacg

SEQ ID NO: 2303124 - RNA, 11 nt, Human
acucugcacau

SEQ ID NO: 2303125 - RNA, 13 nt, Human
acucugcacaugu

SEQ ID NO: 2303126 - RNA, 17 nt, Human
acucugcacaugucuug

SEQ ID NO: 2303127 - RNA, 21 nt, Human
acucuccucugcugcuggcug

SEQ ID NO: 2303128 - RNA, 14 nt, Human
acucucccccaccc

SEQ ID NO: 2303129 - RNA, 14 nt, Human
acucugaaaucuga

SEQ ID NO: 2303130 - RNA, 17 nt, Human
acucugaaaucugaaga

SEQ ID NO: 2303131 - RNA, 18 nt, Human
acucuccucugcugcugg

SEQ ID NO: 2303132 - RNA, 19 nt, Human
acucuccucugcugcuggc

SEQ ID NO: 2303133 - RNA, 14 nt, Human
acucugcuuugacu

SEQ ID NO: 2303134 - RNA, 13 nt, Human
acucugcuuguua

SEQ ID NO: 2303135 - RNA, 22 nt, Human
acucugcuuugacugagcagac

SEQ ID NO: 2303136 - RNA, 20 nt, Human
acucugcuuugacugagcag

SEQ ID NO: 2303137 - RNA, 23 nt, Human
acucugcuuugacugagcagacu

SEQ ID NO: 2303138 - RNA, 18 nt, Human
acucugcuugauuuuugc

SEQ ID NO: 2303139 - RNA, 16 nt, Human
acucugcuugauuuuu

SEQ ID NO: 2303140 - RNA, 15 nt, Human
acucugcuugauuuu

SEQ ID NO: 2303141 - RNA, 22 nt, Human
acucugcuucucugacuucugc

SEQ ID NO: 2303142 - RNA, 12 nt, Human
acucuuaucuca

SEQ ID NO: 2303143 - RNA, 13 nt, Human
acucuuaucucag

SEQ ID NO: 2303144 - RNA, 22 nt, Human
acucuuaucucagucaugcaua

SEQ ID NO: 2303145 - RNA, 21 nt, Human
acucuggagguuuguuuagaa

SEQ ID NO: 2303146 - RNA, 14 nt, Human
acucugcacuacuc

SEQ ID NO: 2303147 - RNA, 15 nt, Human
acucugcacuacucc

SEQ ID NO: 2303148 - RNA, 19 nt, Human
acucugcacuacuccucug

SEQ ID NO: 2303149 - RNA, 23 nt, Human
acucugcacuacuccucugcagu

SEQ ID NO: 2303150 - RNA, 18 nt, Human
acucugcacaugucuugu

SEQ ID NO: 2303151 - RNA, 19 nt, Human
acucugcacaugucuugua

SEQ ID NO: 2303152 - RNA, 21 nt, Human
acucugcacaugucuuguaca

SEQ ID NO: 2303153 - RNA, 22 nt, Human
acucugcacaugucuuguacau

SEQ ID NO: 2303154 - RNA, 16 nt, Human
acucugcauucuagua

SEQ ID NO: 2303155 - RNA, 17 nt, Human
acucugcuucucugacu

SEQ ID NO: 2303156 - RNA, 18 nt, Human
acucugcuucucugacuu

SEQ ID NO: 2303157 - RNA, 20 nt, Human
acucugcuucucugacuucu

SEQ ID NO: 2303158 - RNA, 21 nt, Human
acucugcuucucugacuucug

SEQ ID NO: 2303159 - RNA, 20 nt, Human
ucccuguauuuucuuucucu

SEQ ID NO: 2303160 - RNA, 21 nt, Human
ucccuguauuuucuuucucua

SEQ ID NO: 2303161 - RNA, 21 nt, Human
ucccuguaauuguuguuugua

SEQ ID NO: 2303162 - RNA, 20 nt, Human
ucccuguaauuguuguuugu

SEQ ID NO: 2303163 - RNA, 23 nt, Human
ucccuguaaccucuucagaggcc

SEQ ID NO: 2303164 - RNA, 22 nt, Human
ucccuguaaccucuucagaggc

SEQ ID NO: 2303165 - RNA, 19 nt, Human
ucccuguaaccucuucaga

SEQ ID NO: 2303166 - RNA, 18 nt, Human
ucccuguaaccucuucag

SEQ ID NO: 2303167 - RNA, 18 nt, Human
acuccugcaaaauuuuau

SEQ ID NO: 2303168 - RNA, 12 nt, Human
ucccugguucug

SEQ ID NO: 2303169 - RNA, 14 nt, Human
ucccuguaaccucu

SEQ ID NO: 2303170 - RNA, 16 nt, Human
ucccugguucugauga

SEQ ID NO: 2303171 - RNA, 17 nt, Human
ucccugguucugaugau

SEQ ID NO: 2303172 - RNA, 23 nt, Human
acuccugcacacgcuccuuccuc

SEQ ID NO: 2303173 - RNA, 19 nt, Human
ucccuguuugaagccugcc

SEQ ID NO: 2303174 - RNA, 21 nt, Human
ucccuguuuaauauuuaaaca

SEQ ID NO: 2303175 - RNA, 22 nt, Human
ucccuguuuaauauuuaaacag

SEQ ID NO: 2303176 - RNA, 14 nt, Human
ucccuguuuaauau

SEQ ID NO: 2303177 - RNA, 15 nt, Human
ucccuguuuaauauu

SEQ ID NO: 2303178 - RNA, 16 nt, Human
ucccuguuuaauauuu

SEQ ID NO: 2303179 - RNA, 18 nt, Human
ucccuguuuaauauuuaa

SEQ ID NO: 2303180 - RNA, 18 nt, Human
ucccuguuggucgguggg

SEQ ID NO: 2303181 - RNA, 21 nt, Human
ucccuguugacgaagucucuu

SEQ ID NO: 2303182 - RNA, 11 nt, Human
ucccuguuuaa

SEQ ID NO: 2303183 - RNA, 14 nt, Human
ucccuguugaagcu

SEQ ID NO: 2303184 - RNA, 20 nt, Human
ucccuguugacgaagucucu

SEQ ID NO: 2303185 - RNA, 17 nt, Human
ucccuguuccccagaga

SEQ ID NO: 2303186 - RNA, 22 nt, Human
ucccugucaccaagcucacagu

SEQ ID NO: 2303187 - RNA, 15 nt, Human
ucccugucaccaagc

SEQ ID NO: 2303188 - RNA, 14 nt, Human
ucccugucaccaag

SEQ ID NO: 2303189 - RNA, 22 nt, Human
ucccuguauuuucuuucucuac

SEQ ID NO: 2303190 - RNA, 17 nt, Human
ucccuguguugucucua

SEQ ID NO: 2303191 - RNA, 18 nt, Human
ucccuguuccccagagaa

SEQ ID NO: 2303192 - RNA, 16 nt, Human
ucccuguuccccagag

SEQ ID NO: 2303193 - RNA, 15 nt, Human
ucccuguuccccaga

SEQ ID NO: 2303194 - RNA, 11 nt, Human
ucccuucaacc

SEQ ID NO: 2303195 - RNA, 20 nt, Human
ucccuguuugaagccugccc

SEQ ID NO: 2303196 - RNA, 21 nt, Human
ucccuucaaccauuccccaug

SEQ ID NO: 2303197 - RNA, 19 nt, Human
ucccuugguggcaagagcc

SEQ ID NO: 2303198 - RNA, 18 nt, Human
ucccuuacgugaguccug

SEQ ID NO: 2303199 - RNA, 22 nt, Human
ucccuuacgugaguccuggcau

SEQ ID NO: 2303200 - RNA, 22 nt, Human
ucccuuuccaaaugcccagcuu

SEQ ID NO: 2303201 - RNA, 21 nt, Human
ucccuuucacaaaauuuuauu

SEQ ID NO: 2303202 - RNA, 13 nt, Human
ucccuuucccuuc

SEQ ID NO: 2303203 - RNA, 15 nt, Human
ucccuuucccuucuu

SEQ ID NO: 2303204 - RNA, 13 nt, Human
ucccuugugugug

SEQ ID NO: 2303205 - RNA, 16 nt, Human
ucccuugugcgugggu

SEQ ID NO: 2303206 - RNA, 15 nt, Human
ucccuugugugugug

SEQ ID NO: 2303207 - RNA, 13 nt, Human
ucccuuguucucu

SEQ ID NO: 2303208 - RNA, 14 nt, Human
ucccuuguucucua

SEQ ID NO: 2303209 - RNA, 18 nt, Human
ucccuuguucucuaaguu

SEQ ID NO: 2303210 - RNA, 20 nt, Human
uccgugagugaaccaucauu

SEQ ID NO: 2303211 - RNA, 16 nt, Human
uccgugccuccaccac

SEQ ID NO: 2303212 - RNA, 17 nt, Human
uccgugccuccaccacc

SEQ ID NO: 2303213 - RNA, 19 nt, Human
uccguuagcuccuguggcc

SEQ ID NO: 2303214 - RNA, 21 nt, Human
uccgugccuccaccaccacug

SEQ ID NO: 2303215 - RNA, 20 nt, Human
uccgucuaagucaugagcug

SEQ ID NO: 2303216 - RNA, 22 nt, Human
uccgucuaagucaugagcugag

SEQ ID NO: 2303217 - RNA, 23 nt, Human
uccgucuaguuaacauuucaagg

SEQ ID NO: 2303218 - RNA, 18 nt, Human
uccgugaaaacggagcug

SEQ ID NO: 2303219 - RNA, 15 nt, Human
uccguauuucagacu

SEQ ID NO: 2303220 - RNA, 14 nt, Human
uccguauuucagac

SEQ ID NO: 2303221 - RNA, 17 nt, Human
ucccuuugcccagaaag

SEQ ID NO: 2303222 - RNA, 22 nt, Human
ucccuuugacgccaucccagcc

SEQ ID NO: 2303223 - RNA, 23 nt, Human
ucccuuugacgccaucccagccc

SEQ ID NO: 2303224 - RNA, 17 nt, Human
uccuaaaauaagggcag

SEQ ID NO: 2303225 - RNA, 22 nt, Human
uccuaaaauaagggcagaguca

SEQ ID NO: 2303226 - RNA, 14 nt, Human
uccuagaguagagu

SEQ ID NO: 2303227 - RNA, 23 nt, Human
uccuaaaauaagggcagagucac

SEQ ID NO: 2303228 - RNA, 15 nt, Human
uccuaaaacaaauag

SEQ ID NO: 2303229 - RNA, 22 nt, Human
uccuaaaacaaaagcucaucca

SEQ ID NO: 2303230 - RNA, 17 nt, Human
uccuaaaacaccuggua

SEQ ID NO: 2303231 - RNA, 22 nt, Human
uccguugggccccagccuucuu

SEQ ID NO: 2303232 - RNA, 13 nt, Human
uccguuggccacu

SEQ ID NO: 2303233 - RNA, 15 nt, Human
uccguuggccacucc

SEQ ID NO: 2303234 - RNA, 18 nt, Human
uccuagauggcagucacu

SEQ ID NO: 2303235 - RNA, 13 nt, Human
uccuagaugcucu

SEQ ID NO: 2303236 - RNA, 22 nt, Human
uccuagauggcagucacugaau

SEQ ID NO: 2303237 - RNA, 17 nt, Human
uccuagcacacacuuuu

SEQ ID NO: 2303238 - RNA, 19 nt, Human
uccuagcacacacuuuugg

SEQ ID NO: 2303239 - RNA, 18 nt, Human
uccuagcacacacuuuug

SEQ ID NO: 2303240 - RNA, 14 nt, Human
uccuaggcauuugc

SEQ ID NO: 2303241 - RNA, 20 nt, Human
uccuagcacuuugggaggcc

SEQ ID NO: 2303242 - RNA, 21 nt, Human
uccuagauggcagucacugaa

SEQ ID NO: 2303243 - RNA, 19 nt, Human
acuccaacagaagaacugu

SEQ ID NO: 2303244 - RNA, 18 nt, Human
acuccaacagaagaacug

SEQ ID NO: 2303245 - RNA, 20 nt, Human
acucauuuuaaaaaauggaa

SEQ ID NO: 2303246 - RNA, 19 nt, Human
acuccaagauauggacaca

SEQ ID NO: 2303247 - RNA, 21 nt, Human
acuccaauuaaggauuuuaug

SEQ ID NO: 2303248 - RNA, 17 nt, Human
acuccaauuaaggauuu

SEQ ID NO: 2303249 - RNA, 18 nt, Human
acuccagccugggcgaca

SEQ ID NO: 2303250 - RNA, 15 nt, Human
acuccagccugggcg

SEQ ID NO: 2303251 - RNA, 23 nt, Human
acuccagccugggcaacagagca

SEQ ID NO: 2303252 - RNA, 18 nt, Human
acuccagccugggcaaca

SEQ ID NO: 2303253 - RNA, 13 nt, Human
acuccacaucugc

SEQ ID NO: 2303254 - RNA, 14 nt, Human
acuccacaucugcc

SEQ ID NO: 2303255 - RNA, 15 nt, Human
acuccacaucugccu

SEQ ID NO: 2303256 - RNA, 16 nt, Human
acuccacaucugccuu

SEQ ID NO: 2303257 - RNA, 13 nt, Human
acuccaggagagg

SEQ ID NO: 2303258 - RNA, 14 nt, Human
acuccaggagagga

SEQ ID NO: 2303259 - RNA, 21 nt, Human
acuccagccugggcaacacag

SEQ ID NO: 2303260 - RNA, 20 nt, Human
acuccagccugggugacaga

SEQ ID NO: 2303261 - RNA, 20 nt, Human
acuccagccugggcgacaga

SEQ ID NO: 2303262 - RNA, 20 nt, Human
acuccagcuggguuggaaaa

SEQ ID NO: 2303263 - RNA, 15 nt, Human
acuccugaccucaag

SEQ ID NO: 2303264 - RNA, 21 nt, Human
acuccuaggcaggacaugcug

SEQ ID NO: 2303265 - RNA, 16 nt, Human
acuccuaggaaaauac

SEQ ID NO: 2303266 - RNA, 13 nt, Human
acuccuaggcagg

SEQ ID NO: 2303267 - RNA, 16 nt, Human
acuccuaggcaggaca

SEQ ID NO: 2303268 - RNA, 18 nt, Human
acuccuaggcaggacaug

SEQ ID NO: 2303269 - RNA, 20 nt, Human
acuccuaggcaggacaugcu

SEQ ID NO: 2303270 - RNA, 15 nt, Human
acuccugcaaaauuu

SEQ ID NO: 2303271 - RNA, 13 nt, Human
acuccugcaaaau

SEQ ID NO: 2303272 - RNA, 20 nt, Human
acuccugaggacagcugucc

SEQ ID NO: 2303273 - RNA, 21 nt, Human
acuccugaggacagcuguccu

SEQ ID NO: 2303274 - RNA, 23 nt, Human
acuccugagaccccuggccuccg

SEQ ID NO: 2303275 - RNA, 16 nt, Human
acuccugaggacagcu

SEQ ID NO: 2303276 - RNA, 17 nt, Human
acuccugaggacagcug

SEQ ID NO: 2303277 - RNA, 19 nt, Human
acuccugaggacagcuguc

SEQ ID NO: 2303278 - RNA, 17 nt, Human
acuccugagaccccugg

SEQ ID NO: 2303279 - RNA, 18 nt, Human
acuccugagaccccuggc

SEQ ID NO: 2303280 - RNA, 20 nt, Human
acuccugagaccccuggccu

SEQ ID NO: 2303281 - RNA, 21 nt, Human
acuccugagaccccuggccuc

SEQ ID NO: 2303282 - RNA, 17 nt, Human
acuccuaccucagccua

SEQ ID NO: 2303283 - RNA, 16 nt, Human
acuccuaccucagccu

SEQ ID NO: 2303284 - RNA, 15 nt, Human
acuccuaccucagcc

SEQ ID NO: 2303285 - RNA, 14 nt, Human
acuccuaccucagc

SEQ ID NO: 2303286 - RNA, 14 nt, Human
acuccuaccuggua

SEQ ID NO: 2303287 - RNA, 20 nt, Human
acuccuagagaacgcagccc

SEQ ID NO: 2303288 - RNA, 21 nt, Human
acuccuagagaacgcagcccu

SEQ ID NO: 2303289 - RNA, 22 nt, Human
acuccuagagaacgcagcccua

SEQ ID NO: 2303290 - RNA, 23 nt, Human
acuccuagagaacgcagcccuag

SEQ ID NO: 2303291 - RNA, 16 nt, Human
acuccuacaccuaacu

SEQ ID NO: 2303292 - RNA, 17 nt, Human
acuccuacaccuaacuc

SEQ ID NO: 2303293 - RNA, 18 nt, Human
acuccuacaccuaacuca

SEQ ID NO: 2303294 - RNA, 16 nt, Human
acucaugcugaaagcc

SEQ ID NO: 2303295 - RNA, 15 nt, Human
acucauugcugagcc

SEQ ID NO: 2303296 - RNA, 20 nt, Human
acucauugcugagccucugc

SEQ ID NO: 2303297 - RNA, 18 nt, Human
acucauugcugagccucu

SEQ ID NO: 2303298 - RNA, 16 nt, Human
acucauuuccuaugua

SEQ ID NO: 2303299 - RNA, 21 nt, Human
acucauuuauaaagcuaaaau

SEQ ID NO: 2303300 - RNA, 23 nt, Human
acucauugcugagccucugcucc

SEQ ID NO: 2303301 - RNA, 22 nt, Human
acucauugcugagccucugcuc

SEQ ID NO: 2303302 - RNA, 21 nt, Human
acucauugcugagccucugcu

SEQ ID NO: 2303303 - RNA, 17 nt, Human
acucaucauaaaauaaa

SEQ ID NO: 2303304 - RNA, 16 nt, Human
acucaucauaaaauaa

SEQ ID NO: 2303305 - RNA, 14 nt, Human
acucaugagaaguu

SEQ ID NO: 2303306 - RNA, 19 nt, Human
acucaucccuaaugcugca

SEQ ID NO: 2303307 - RNA, 21 nt, Human
acucaugaucuugugacauau

SEQ ID NO: 2303308 - RNA, 15 nt, Human
acucaugaucuugug

SEQ ID NO: 2303309 - RNA, 12 nt, Human
acucaugcugaa

SEQ ID NO: 2303310 - RNA, 13 nt, Human
acucaugcugaaa

SEQ ID NO: 2303311 - RNA, 14 nt, Human
acucaugcugaaag

SEQ ID NO: 2303312 - RNA, 15 nt, Human
acucaucauaaaaua

SEQ ID NO: 2303313 - RNA, 14 nt, Human
acucaucauaaaau

SEQ ID NO: 2303314 - RNA, 13 nt, Human
acucaucauaaaa

SEQ ID NO: 2303315 - RNA, 12 nt, Human
acucaucauaaa

SEQ ID NO: 2303316 - RNA, 9 nt, Human
acucaucau

SEQ ID NO: 2303317 - RNA, 21 nt, Human
ucccucaucugucccuccggg

SEQ ID NO: 2303318 - RNA, 23 nt, Human
ucccucauuccaccuucccaugc

SEQ ID NO: 2303319 - RNA, 16 nt, Human
acucaucuagguaaau

SEQ ID NO: 2303320 - RNA, 18 nt, Human
acucaucuagguaaauua

SEQ ID NO: 2303321 - RNA, 21 nt, Human
ucccucagucuggcccuuccu

SEQ ID NO: 2303322 - RNA, 21 nt, Human
ucccucaccuuggcaccagac

SEQ ID NO: 2303323 - RNA, 15 nt, Human
ucccucaccuuggca

SEQ ID NO: 2303324 - RNA, 22 nt, Human
ucccucacccugagccccuucc

SEQ ID NO: 2303325 - RNA, 22 nt, Human
ucccucauccucauacccaccc

SEQ ID NO: 2303326 - RNA, 20 nt, Human
ucccucaccuuggcaccaga

SEQ ID NO: 2303327 - RNA, 16 nt, Human
ucccucagugcccuca

SEQ ID NO: 2303328 - RNA, 16 nt, Human
ucccucaucugucccu

SEQ ID NO: 2303329 - RNA, 13 nt, Human
ucccucaucucuc

SEQ ID NO: 2303330 - RNA, 12 nt, Human
acacccagccuc

SEQ ID NO: 2303331 - RNA, 13 nt, Human
acacccuguacug

SEQ ID NO: 2303332 - RNA, 16 nt, Human
acaccgggccuggaga

SEQ ID NO: 2303333 - RNA, 22 nt, Human
acacccuguacuguucuguguc

SEQ ID NO: 2303334 - RNA, 19 nt, Human
acaccgggguggugggaac

SEQ ID NO: 2303335 - RNA, 17 nt, Human
acaccguguaaaccaaa

SEQ ID NO: 2303336 - RNA, 15 nt, Human
acaccuaacucaccu

SEQ ID NO: 2303337 - RNA, 14 nt, Human
acaccuaagggaca

SEQ ID NO: 2303338 - RNA, 18 nt, Human
acaccuaagggacauguu

SEQ ID NO: 2303339 - RNA, 19 nt, Human
acaccguguaaaccaaagc

SEQ ID NO: 2303340 - RNA, 20 nt, Human
acaccguguaaaccaaagcc

SEQ ID NO: 2303341 - RNA, 15 nt, Human
acaccuagcaucuca

SEQ ID NO: 2303342 - RNA, 21 nt, Human
acaccuacucuaucagagaaa

SEQ ID NO: 2303343 - RNA, 22 nt, Human
acaccuaagggacauguuuuga

SEQ ID NO: 2303344 - RNA, 18 nt, Human
acaccuaccaaaaaauaa

SEQ ID NO: 2303345 - RNA, 18 nt, Human
acaccaggcugugggccu

SEQ ID NO: 2303346 - RNA, 11 nt, Human
acacccuguga

SEQ ID NO: 2303347 - RNA, 12 nt, Human
acacccugugau

SEQ ID NO: 2303348 - RNA, 18 nt, Human
acacccugugauggggcc

SEQ ID NO: 2303349 - RNA, 21 nt, Human
acaccaggcuugccugcaggc

SEQ ID NO: 2303350 - RNA, 14 nt, Human
acaccaggcugugg

SEQ ID NO: 2303351 - RNA, 12 nt, Human
acaccaggcugu

SEQ ID NO: 2303352 - RNA, 21 nt, Human
acaccaggccguccucccggg

SEQ ID NO: 2303353 - RNA, 22 nt, Human
acaccaggccguccucccgggc

SEQ ID NO: 2303354 - RNA, 19 nt, Human
acacccagcccacuucugc

SEQ ID NO: 2303355 - RNA, 20 nt, Human
acacccagcccacuucugcc

SEQ ID NO: 2303356 - RNA, 21 nt, Human
acacccagcccacuucugcca

SEQ ID NO: 2303357 - RNA, 20 nt, Human
acaccagccuuucucccagg

SEQ ID NO: 2303358 - RNA, 19 nt, Human
acaccagccucgucuucau

SEQ ID NO: 2303359 - RNA, 21 nt, Human
acaccagccccugccccagcc

SEQ ID NO: 2303360 - RNA, 22 nt, Human
acaccagccccugccccagccc

SEQ ID NO: 2303361 - RNA, 22 nt, Human
acaccagccaggcucugugcug

SEQ ID NO: 2303362 - RNA, 13 nt, Human
acaccagccccug

SEQ ID NO: 2303363 - RNA, 15 nt, Human
acaccagccccugcc

SEQ ID NO: 2303364 - RNA, 17 nt, Human
acaccagccccugcccc

SEQ ID NO: 2303365 - RNA, 17 nt, Human
acaccaggagucccugg

SEQ ID NO: 2303366 - RNA, 15 nt, Human
acaccagcuguucug

SEQ ID NO: 2303367 - RNA, 23 nt, Human
acaccagcuguucugucccuugg

SEQ ID NO: 2303368 - RNA, 19 nt, Human
acaccaggagucccuggua

SEQ ID NO: 2303369 - RNA, 12 nt, Human
acaccaggccgu

SEQ ID NO: 2303370 - RNA, 15 nt, Human
acacaucuucccuag

SEQ ID NO: 2303371 - RNA, 14 nt, Human
acacaucuucccua

SEQ ID NO: 2303372 - RNA, 13 nt, Human
acacaucuucccu

SEQ ID NO: 2303373 - RNA, 13 nt, Human
acacaucuuuccu

SEQ ID NO: 2303374 - RNA, 16 nt, Human
acaccagccaggcucu

SEQ ID NO: 2303375 - RNA, 17 nt, Human
acaccagccaggcucug

SEQ ID NO: 2303376 - RNA, 21 nt, Human
acacaugcaaggucauuuuuu

SEQ ID NO: 2303377 - RNA, 15 nt, Human
acacaucuucaacag

SEQ ID NO: 2303378 - RNA, 14 nt, Human
acacaucuccucca

SEQ ID NO: 2303379 - RNA, 12 nt, Human
acacaucuccuc

SEQ ID NO: 2303380 - RNA, 17 nt, Human
acacaucccuaaugugu

SEQ ID NO: 2303381 - RNA, 19 nt, Human
acacaucccuaaugugugc

SEQ ID NO: 2303382 - RNA, 18 nt, Human
acacaugcaaggucauuu

SEQ ID NO: 2303383 - RNA, 20 nt, Human
acacaugcaaggucauuuuu

SEQ ID NO: 2303384 - RNA, 19 nt, Human
acacaugcaaggucauuuu

SEQ ID NO: 2303385 - RNA, 20 nt, Human
acacaucccuaaugugugcc

SEQ ID NO: 2303386 - RNA, 12 nt, Human
acacaucaguca

SEQ ID NO: 2303387 - RNA, 22 nt, Human
uauaaaauaaauauauauaaac

SEQ ID NO: 2303388 - RNA, 23 nt, Human
uauaaaauaauuuuuauauuuga

SEQ ID NO: 2303389 - RNA, 22 nt, Human
acacaucagcuugcccuguuaa

SEQ ID NO: 2303390 - RNA, 23 nt, Human
uaguuuucauacacagccugggc

SEQ ID NO: 2303391 - RNA, 11 nt, Human
uauaaaagaug

SEQ ID NO: 2303392 - RNA, 17 nt, Human
uaguuuucaguuuguau

SEQ ID NO: 2303393 - RNA, 12 nt, Human
uauaaaagccug

SEQ ID NO: 2303394 - RNA, 20 nt, Human
uauaaaagauggggucugua

SEQ ID NO: 2303395 - RNA, 21 nt, Human
uauaaaagauggggucuguaa

SEQ ID NO: 2303396 - RNA, 22 nt, Human
uauaaaagauggggucuguaaa

SEQ ID NO: 2303397 - RNA, 23 nt, Human
uauaaaagauggggucuguaaaa

SEQ ID NO: 2303398 - RNA, 14 nt, Human
uauaaaagccuguu

SEQ ID NO: 2303399 - RNA, 17 nt, Human
uauaaaagccuguuuaa

SEQ ID NO: 2303400 - RNA, 21 nt, Human
uauaaaauaauuuuuauauuu

SEQ ID NO: 2303401 - RNA, 22 nt, Human
uauaaaauaauuuuuauauuug

SEQ ID NO: 2303402 - RNA, 20 nt, Human
uagucacuuuuuuuuuccaa

SEQ ID NO: 2303403 - RNA, 17 nt, Human
uagucacuuauuucaua

SEQ ID NO: 2303404 - RNA, 13 nt, Human
uagucacuuuuuu

SEQ ID NO: 2303405 - RNA, 13 nt, Human
uagucaugugacc

SEQ ID NO: 2303406 - RNA, 22 nt, Human
uaguccaaugucuuuuuaagcu

SEQ ID NO: 2303407 - RNA, 11 nt, Human
uagucucaguu

SEQ ID NO: 2303408 - RNA, 18 nt, Human
uaguccaaugucuuuuua

SEQ ID NO: 2303409 - RNA, 19 nt, Human
uagucucaguuuguguguc

SEQ ID NO: 2303410 - RNA, 22 nt, Human
uagucucaguuugugugucuua

SEQ ID NO: 2303411 - RNA, 21 nt, Human
uagucucauuacuuuugaagu

SEQ ID NO: 2303412 - RNA, 17 nt, Human
uagucuccuuugcacug

SEQ ID NO: 2303413 - RNA, 18 nt, Human
uagucuccuuugcacuga

SEQ ID NO: 2303414 - RNA, 19 nt, Human
uagucuccuuugcacugag

SEQ ID NO: 2303415 - RNA, 18 nt, Human
uagucugugugaagguga

SEQ ID NO: 2303416 - RNA, 13 nt, Human
uagucugguuucu

SEQ ID NO: 2303417 - RNA, 12 nt, Human
uagucugguuuc

SEQ ID NO: 2303418 - RNA, 20 nt, Human
uagugacccggaggccacau

SEQ ID NO: 2303419 - RNA, 22 nt, Human
uagugagcagucaggaaagaga

SEQ ID NO: 2303420 - RNA, 21 nt, Human
uagucucuuguauuaaacucu

SEQ ID NO: 2303421 - RNA, 23 nt, Human
uagucugcaaaaugaggaaugua

SEQ ID NO: 2303422 - RNA, 20 nt, Human
uagucuccuuugcacugagg

SEQ ID NO: 2303423 - RNA, 21 nt, Human
uagucuccuuugcacugaggg

SEQ ID NO: 2303424 - RNA, 22 nt, Human
uagucuccuuugcacugagggc

SEQ ID NO: 2303425 - RNA, 20 nt, Human
uagucucuaucauuaaaguu

SEQ ID NO: 2303426 - RNA, 21 nt, Human
uagucucuaucauuaaaguuc

SEQ ID NO: 2303427 - RNA, 23 nt, Human
uagucucucuggggccacacaga

SEQ ID NO: 2303428 - RNA, 14 nt, Human
uagucucugugcuu

SEQ ID NO: 2303429 - RNA, 17 nt, Human
uagucucugugcuuuga

SEQ ID NO: 2303430 - RNA, 23 nt, Human
acaagcugcacccucaggcaggu

SEQ ID NO: 2303431 - RNA, 22 nt, Human
acaagcugcacccucaggcagg

SEQ ID NO: 2303432 - RNA, 21 nt, Human
acaagcugcacccucaggcag

SEQ ID NO: 2303433 - RNA, 19 nt, Human
acaagcugcacccucaggc

SEQ ID NO: 2303434 - RNA, 16 nt, Human
acaagcuggaagcaca

SEQ ID NO: 2303435 - RNA, 18 nt, Human
acaagcuggaagcacaug

SEQ ID NO: 2303436 - RNA, 20 nt, Human
acaagcuuuuuuacacaaau

SEQ ID NO: 2303437 - RNA, 21 nt, Human
acaaggaagucaaagcaagga

SEQ ID NO: 2303438 - RNA, 17 nt, Human
acaaggaaggugguggg

SEQ ID NO: 2303439 - RNA, 23 nt, Human
uagucacugccugcagaggucug

SEQ ID NO: 2303440 - RNA, 21 nt, Human
uagucaggugccucaagagaa

SEQ ID NO: 2303441 - RNA, 16 nt, Human
uaguuaguagcauguu

SEQ ID NO: 2303442 - RNA, 15 nt, Human
uaguuaguagcaugu

SEQ ID NO: 2303443 - RNA, 20 nt, Human
uaguuaggauagcauuuuug

SEQ ID NO: 2303444 - RNA, 23 nt, Human
uaguuaggaaauaaaaccuuuca

SEQ ID NO: 2303445 - RNA, 21 nt, Human
uaguuacuguugugaccugaa

SEQ ID NO: 2303446 - RNA, 15 nt, Human
uaguuaggauagcau

SEQ ID NO: 2303447 - RNA, 22 nt, Human
uaguuaggaaauaaaaccuuuc

SEQ ID NO: 2303448 - RNA, 21 nt, Human
uaguuaggaaauaaaaccuuu

SEQ ID NO: 2303449 - RNA, 18 nt, Human
uaguuaggaaauaaaacc

SEQ ID NO: 2303450 - RNA, 16 nt, Human
uaguuaggaaauaaaa

SEQ ID NO: 2303451 - RNA, 23 nt, Human
uaguucccugaaaacccagagag

SEQ ID NO: 2303452 - RNA, 12 nt, Human
uaguuccugcua

SEQ ID NO: 2303453 - RNA, 15 nt, Human
uaguuauaguuucag

SEQ ID NO: 2303454 - RNA, 20 nt, Human
uaguuccucauuagcauuuu

SEQ ID NO: 2303455 - RNA, 18 nt, Human
uagugaucugaacagaaa

SEQ ID NO: 2303456 - RNA, 17 nt, Human
uagugaucugaacagaa

SEQ ID NO: 2303457 - RNA, 20 nt, Human
uagugaucacagcagcuucu

SEQ ID NO: 2303458 - RNA, 14 nt, Human
uagugaucacagca

SEQ ID NO: 2303459 - RNA, 15 nt, Human
uagugaucacagcag

SEQ ID NO: 2303460 - RNA, 16 nt, Human
uagugacuuguguccc

SEQ ID NO: 2303461 - RNA, 22 nt, Human
uaguuagccaauauuuuucuua

SEQ ID NO: 2303462 - RNA, 17 nt, Human
uaguuacuguugugacc

SEQ ID NO: 2303463 - RNA, 18 nt, Human
uaguuacuguugugaccu

SEQ ID NO: 2303464 - RNA, 20 nt, Human
uaguucucacuguucccucu

SEQ ID NO: 2303465 - RNA, 19 nt, Human
uaguucucagcucuucuga

SEQ ID NO: 2303466 - RNA, 15 nt, Human
uaguucguagcuuuc

SEQ ID NO: 2303467 - RNA, 16 nt, Human
uaguuccugcuacaac

SEQ ID NO: 2303468 - RNA, 17 nt, Human
uaguuuuaucacaugua

SEQ ID NO: 2303469 - RNA, 19 nt, Human
uaguuuuaucacauguaug

SEQ ID NO: 2303470 - RNA, 20 nt, Human
uaguuuuaucacauguaugu

SEQ ID NO: 2303471 - RNA, 21 nt, Human
uaguuuuaucacauguauguu

SEQ ID NO: 2303472 - RNA, 16 nt, Human
uaguuuuauaugcuuc

SEQ ID NO: 2303473 - RNA, 13 nt, Human
uaguucuguagaa

SEQ ID NO: 2303474 - RNA, 14 nt, Human
uaguucuguagaaa

SEQ ID NO: 2303475 - RNA, 15 nt, Human
uaguucuguagaaau

SEQ ID NO: 2303476 - RNA, 16 nt, Human
uaguucuguagaaaug

SEQ ID NO: 2303477 - RNA, 18 nt, Human
uaguucuguagaaauggu

SEQ ID NO: 2303478 - RNA, 18 nt, Human
uauagguuuuaaagaccu

SEQ ID NO: 2303479 - RNA, 15 nt, Human
uauagguugugcaaa

SEQ ID NO: 2303480 - RNA, 22 nt, Human
uauagguugugcaaauuaacag

SEQ ID NO: 2303481 - RNA, 16 nt, Human
uauagguuuuguuugc

SEQ ID NO: 2303482 - RNA, 17 nt, Human
uauagguuuuguuugcu

SEQ ID NO: 2303483 - RNA, 23 nt, Human
uauaggugcuacaaaaacacagc

SEQ ID NO: 2303484 - RNA, 20 nt, Human
uauaggugcuacaaaaacac

SEQ ID NO: 2303485 - RNA, 21 nt, Human
uauaggugcuacaaaaacaca

SEQ ID NO: 2303486 - RNA, 13 nt, Human
uauauauagaauc

SEQ ID NO: 2303487 - RNA, 12 nt, Human
uauauauagaau

SEQ ID NO: 2303488 - RNA, 19 nt, Human
uauauauaauucuguacau

SEQ ID NO: 2303489 - RNA, 20 nt, Human
uauauauaauucuguacaua

SEQ ID NO: 2303490 - RNA, 13 nt, Human
uauauauacagua

SEQ ID NO: 2303491 - RNA, 13 nt, Human
uauauauaaaccu

SEQ ID NO: 2303492 - RNA, 16 nt, Human
uauauauaaaccuaaa

SEQ ID NO: 2303493 - RNA, 12 nt, Human
uauauauaaaau

SEQ ID NO: 2303494 - RNA, 13 nt, Human
uauauauaaaaua

SEQ ID NO: 2303495 - RNA, 12 nt, Human
uauauauaaacc

SEQ ID NO: 2303496 - RNA, 12 nt, Human
uauauauaaaua

SEQ ID NO: 2303497 - RNA, 14 nt, Human
uauauauaaauaaa

SEQ ID NO: 2303498 - RNA, 16 nt, Human
uauauauaauucugua

SEQ ID NO: 2303499 - RNA, 13 nt, Human
uauauauaaauaa

SEQ ID NO: 2303500 - RNA, 18 nt, Human
uauauauaauucuguaca

SEQ ID NO: 2303501 - RNA, 13 nt, Human
uauagcuauuuuu

SEQ ID NO: 2303502 - RNA, 12 nt, Human
uauagcuauuuu

SEQ ID NO: 2303503 - RNA, 13 nt, Human
uauaggaauugac

SEQ ID NO: 2303504 - RNA, 19 nt, Human
uauaggaauugacccacaa

SEQ ID NO: 2303505 - RNA, 14 nt, Human
uauaggaauugacc

SEQ ID NO: 2303506 - RNA, 22 nt, Human
uauagcuacaggaagcacccca

SEQ ID NO: 2303507 - RNA, 16 nt, Human
uauagcuacaggaagc

SEQ ID NO: 2303508 - RNA, 11 nt, Human
uauagcuauua

SEQ ID NO: 2303509 - RNA, 14 nt, Human
uauagcuauuacug

SEQ ID NO: 2303510 - RNA, 22 nt, Human
uauagcuauuacugucugguuu

SEQ ID NO: 2303511 - RNA, 13 nt, Human
uauagcaauccau

SEQ ID NO: 2303512 - RNA, 20 nt, Human
uauagccuaggugacagagu

SEQ ID NO: 2303513 - RNA, 14 nt, Human
uauagauuugaccu

SEQ ID NO: 2303514 - RNA, 14 nt, Human
acacuccaucagcu

SEQ ID NO: 2303515 - RNA, 21 nt, Human
acacuccagugccagcaauga

SEQ ID NO: 2303516 - RNA, 16 nt, Human
acacuccaagauaugg

SEQ ID NO: 2303517 - RNA, 16 nt, Human
acacuccagugccagc

SEQ ID NO: 2303518 - RNA, 19 nt, Human
acacuccagugccagcaau

SEQ ID NO: 2303519 - RNA, 14 nt, Human
acacuccaagauau

SEQ ID NO: 2303520 - RNA, 17 nt, Human
uauauccuuucuaacaa

SEQ ID NO: 2303521 - RNA, 16 nt, Human
acacuccaauuaagga

SEQ ID NO: 2303522 - RNA, 15 nt, Human
acacuccaauuaagg

SEQ ID NO: 2303523 - RNA, 21 nt, Human
acacucauugaccugaggccc

SEQ ID NO: 2303524 - RNA, 23 nt, Human
acacucauugaccugaggcccuu

SEQ ID NO: 2303525 - RNA, 19 nt, Human
uauauccauguacuguagu

SEQ ID NO: 2303526 - RNA, 18 nt, Human
uauauccauguacuguag

SEQ ID NO: 2303527 - RNA, 17 nt, Human
uauauccauguacugua

SEQ ID NO: 2303528 - RNA, 16 nt, Human
uauauccauguacugu

SEQ ID NO: 2303529 - RNA, 15 nt, Human
uauauccauguacug

SEQ ID NO: 2303530 - RNA, 14 nt, Human
uauauccauguacu

SEQ ID NO: 2303531 - RNA, 20 nt, Human
uauauccaaaagcuuuuuau

SEQ ID NO: 2303532 - RNA, 15 nt, Human
uauaucagccugagu

SEQ ID NO: 2303533 - RNA, 23 nt, Human
uauaucagccugagucuccugug

SEQ ID NO: 2303534 - RNA, 14 nt, Human
uauaucccagaaau

SEQ ID NO: 2303535 - RNA, 19 nt, Human
acacucauugaccugaggc

SEQ ID NO: 2303536 - RNA, 16 nt, Human
uauauccuuucuaaca

SEQ ID NO: 2303537 - RNA, 13 nt, Human
uauauaucaaaua

SEQ ID NO: 2303538 - RNA, 13 nt, Human
uauauauauaaaa

SEQ ID NO: 2303539 - RNA, 14 nt, Human
uauauauauaaaca

SEQ ID NO: 2303540 - RNA, 13 nt, Human
uauauauauauau

SEQ ID NO: 2303541 - RNA, 14 nt, Human
uauauauauaaaau

SEQ ID NO: 2303542 - RNA, 11 nt, Human
uauaucagccu

SEQ ID NO: 2303543 - RNA, 18 nt, Human
uauaucagaaaagggaag

SEQ ID NO: 2303544 - RNA, 22 nt, Human
uauaucaacagauaguuguguu

SEQ ID NO: 2303545 - RNA, 13 nt, Human
uauaucagaaaag

SEQ ID NO: 2303546 - RNA, 19 nt, Human
uauaucacauguuuucucu

SEQ ID NO: 2303547 - RNA, 14 nt, Human
uauauauccucugu

SEQ ID NO: 2303548 - RNA, 16 nt, Human
uauauauccucuguau

SEQ ID NO: 2303549 - RNA, 22 nt, Human
uauauaucauauugguauucac

SEQ ID NO: 2303550 - RNA, 12 nt, Human
uauacacacagc

SEQ ID NO: 2303551 - RNA, 21 nt, Human
uauacaacccuggcauuaugu

SEQ ID NO: 2303552 - RNA, 22 nt, Human
uauacaacccuggcauuauguc

SEQ ID NO: 2303553 - RNA, 15 nt, Human
uauacaauaacauaa

SEQ ID NO: 2303554 - RNA, 14 nt, Human
uauacaacagugcu

SEQ ID NO: 2303555 - RNA, 15 nt, Human
uauacaacagugcua

SEQ ID NO: 2303556 - RNA, 16 nt, Human
uauacaacagugcuaa

SEQ ID NO: 2303557 - RNA, 20 nt, Human
uauacaacagugcuaaaaau

SEQ ID NO: 2303558 - RNA, 21 nt, Human
uauacaacagugcuaaaaaug

SEQ ID NO: 2303559 - RNA, 19 nt, Human
uauaauuuugugaagcaaa

SEQ ID NO: 2303560 - RNA, 20 nt, Human
uauacaguaacuuuaugugu

SEQ ID NO: 2303561 - RNA, 21 nt, Human
uauacaguaacuuuaugugua

SEQ ID NO: 2303562 - RNA, 16 nt, Human
uauacaguaacuuuau

SEQ ID NO: 2303563 - RNA, 18 nt, Human
uauacaguaacuuuaugu

SEQ ID NO: 2303564 - RNA, 19 nt, Human
uauacaguaacuuuaugug

SEQ ID NO: 2303565 - RNA, 21 nt, Human
uauacacuuacacuuuaugca

SEQ ID NO: 2303566 - RNA, 11 nt, Human
uauacacauaa

SEQ ID NO: 2303567 - RNA, 14 nt, Human
uauacacuguaaug

SEQ ID NO: 2303568 - RNA, 14 nt, Human
uauacauaaacaag

SEQ ID NO: 2303569 - RNA, 13 nt, Human
uauacauaaacaa

SEQ ID NO: 2303570 - RNA, 17 nt, Human
uauaccagcaauauauc

SEQ ID NO: 2303571 - RNA, 22 nt, Human
uauacauucuuuaucuugacau

SEQ ID NO: 2303572 - RNA, 16 nt, Human
uauacauucuuuaucu

SEQ ID NO: 2303573 - RNA, 17 nt, Human
uauacauucuuuaucuu

SEQ ID NO: 2303574 - RNA, 14 nt, Human
uauacauuugauaa

SEQ ID NO: 2303575 - RNA, 22 nt, Human
uauacaguaacuuuauguguaa

SEQ ID NO: 2303576 - RNA, 19 nt, Human
uauaccauggugaauuaau

SEQ ID NO: 2303577 - RNA, 19 nt, Human
uauaccaguauaauugagu

SEQ ID NO: 2303578 - RNA, 16 nt, Human
uauagauuauaacuug

SEQ ID NO: 2303579 - RNA, 15 nt, Human
uauagauuauaacuu

SEQ ID NO: 2303580 - RNA, 20 nt, Human
uauaagaagcuuucaguauu

SEQ ID NO: 2303581 - RNA, 16 nt, Human
uauaagaauaaaaugu

SEQ ID NO: 2303582 - RNA, 20 nt, Human
uauaaccaguguuguggauu

SEQ ID NO: 2303583 - RNA, 19 nt, Human
uauaagaauaaaauguuga

SEQ ID NO: 2303584 - RNA, 16 nt, Human
uauaagaggcugauaa

SEQ ID NO: 2303585 - RNA, 16 nt, Human
uauaagauuagaauga

SEQ ID NO: 2303586 - RNA, 22 nt, Human
uauaauuuuaugaaugucuuug

SEQ ID NO: 2303587 - RNA, 17 nt, Human
uauaauuuuaugaaugu

SEQ ID NO: 2303588 - RNA, 14 nt, Human
uauaauuuugugaa

SEQ ID NO: 2303589 - RNA, 21 nt, Human
uauaauuuaccugaagucuuu

SEQ ID NO: 2303590 - RNA, 16 nt, Human
uauaagcccacuguua

SEQ ID NO: 2303591 - RNA, 12 nt, Human
uauaacagguua

SEQ ID NO: 2303592 - RNA, 13 nt, Human
uauaacagguuau

SEQ ID NO: 2303593 - RNA, 15 nt, Human
uauaacagguuauuu

SEQ ID NO: 2303594 - RNA, 20 nt, Human
uauaacagguuauuuuaguu

SEQ ID NO: 2303595 - RNA, 21 nt, Human
uauaacagguuauuuuaguuu

SEQ ID NO: 2303596 - RNA, 20 nt, Human
uauaaccacaaagcacaguu

SEQ ID NO: 2303597 - RNA, 23 nt, Human
acaccucaguucccuuggccuca

SEQ ID NO: 2303598 - RNA, 22 nt, Human
acaccucaguucccuuggccuc

SEQ ID NO: 2303599 - RNA, 12 nt, Human
acaccucccagg

SEQ ID NO: 2303600 - RNA, 21 nt, Human
acaccucagaggcuguucuug

SEQ ID NO: 2303601 - RNA, 20 nt, Human
acaccuccacaguucagugg

SEQ ID NO: 2303602 - RNA, 18 nt, Human
uauaacaaugcuguauuu

SEQ ID NO: 2303603 - RNA, 21 nt, Human
acaccuagcuuuauucuucag

SEQ ID NO: 2303604 - RNA, 18 nt, Human
acaccuagcuuuauucuu

SEQ ID NO: 2303605 - RNA, 20 nt, Human
acaccuaugucauuucauuu

SEQ ID NO: 2303606 - RNA, 17 nt, Human
acaccuaugucauuuca

SEQ ID NO: 2303607 - RNA, 22 nt, Human
acaccuagcuuuauucuucaga

SEQ ID NO: 2303608 - RNA, 21 nt, Human
acaccucaguucccuuggccu

SEQ ID NO: 2303609 - RNA, 18 nt, Human
acaccucaguucccuugg

SEQ ID NO: 2303610 - RNA, 20 nt, Human
acaccucagaggcuguucuu

SEQ ID NO: 2303611 - RNA, 19 nt, Human
acagcccaaagaaggaaaa

SEQ ID NO: 2303612 - RNA, 15 nt, Human
acagcccacguccug

SEQ ID NO: 2303613 - RNA, 16 nt, Human
acagcccacguccugu

SEQ ID NO: 2303614 - RNA, 13 nt, Human
acagcccaccugg

SEQ ID NO: 2303615 - RNA, 17 nt, Human
acagcccacguccuguc

SEQ ID NO: 2303616 - RNA, 19 nt, Human
acagcccacguccugucag

SEQ ID NO: 2303617 - RNA, 20 nt, Human
acagcccacguccugucagu

SEQ ID NO: 2303618 - RNA, 12 nt, Human
acagccccaccc

SEQ ID NO: 2303619 - RNA, 14 nt, Human
acagccccacccug

SEQ ID NO: 2303620 - RNA, 13 nt, Human
acagccccacccu

SEQ ID NO: 2303621 - RNA, 15 nt, Human
acagccccacccugg

SEQ ID NO: 2303622 - RNA, 13 nt, Human
acagccccagagc

SEQ ID NO: 2303623 - RNA, 14 nt, Human
acagccccagagca

SEQ ID NO: 2303624 - RNA, 15 nt, Human
acagccccagagcag

SEQ ID NO: 2303625 - RNA, 17 nt, Human
acagccccagagcaggg

SEQ ID NO: 2303626 - RNA, 16 nt, Human
acagccucccaccccc

SEQ ID NO: 2303627 - RNA, 15 nt, Human
acagccucccacccc

SEQ ID NO: 2303628 - RNA, 17 nt, Human
acagccuccccugccag

SEQ ID NO: 2303629 - RNA, 15 nt, Human
acagccuccccugcc

SEQ ID NO: 2303630 - RNA, 22 nt, Human
acagccuccccugccagggcag

SEQ ID NO: 2303631 - RNA, 21 nt, Human
acagccuccccugccagggca

SEQ ID NO: 2303632 - RNA, 19 nt, Human
acagccuccccugccaggg

SEQ ID NO: 2303633 - RNA, 18 nt, Human
acagccuccccugccagg

SEQ ID NO: 2303634 - RNA, 16 nt, Human
acagccccagagcagg

SEQ ID NO: 2303635 - RNA, 12 nt, Human
acagccuccucu

SEQ ID NO: 2303636 - RNA, 13 nt, Human
acagccuccucug

SEQ ID NO: 2303637 - RNA, 15 nt, Human
acagccuccucuguc

SEQ ID NO: 2303638 - RNA, 17 nt, Human
acagccuccucugucug

SEQ ID NO: 2303639 - RNA, 19 nt, Human
acagccuccucugucugcc

SEQ ID NO: 2303640 - RNA, 20 nt, Human
acagccuccucugucugccc

SEQ ID NO: 2303641 - RNA, 22 nt, Human
acagccuccucugucugcccuu

SEQ ID NO: 2303642 - RNA, 23 nt, Human
acagccuccucugucugcccuuc

SEQ ID NO: 2303643 - RNA, 12 nt, Human
acagccucugac

SEQ ID NO: 2303644 - RNA, 16 nt, Human
acagccucugaccccu

SEQ ID NO: 2303645 - RNA, 18 nt, Human
acagccucugaccccucc

SEQ ID NO: 2303646 - RNA, 17 nt, Human
acagcagcucaggcaca

SEQ ID NO: 2303647 - RNA, 14 nt, Human
acagcagcugaaca

SEQ ID NO: 2303648 - RNA, 12 nt, Human
acagcagcuuca

SEQ ID NO: 2303649 - RNA, 16 nt, Human
acagcagcucaggcac

SEQ ID NO: 2303650 - RNA, 15 nt, Human
acagcagcucaggca

SEQ ID NO: 2303651 - RNA, 22 nt, Human
acagcagcuucaccagagcauu

SEQ ID NO: 2303652 - RNA, 13 nt, Human
acagcagcuucac

SEQ ID NO: 2303653 - RNA, 16 nt, Human
acagcagcuucaccag

SEQ ID NO: 2303654 - RNA, 17 nt, Human
acagcagcuucaccaga

SEQ ID NO: 2303655 - RNA, 18 nt, Human
acagcagcuucaccagag

SEQ ID NO: 2303656 - RNA, 14 nt, Human
acagcagcucaggc

SEQ ID NO: 2303657 - RNA, 22 nt, Human
acagcagccuggggcuggccuc

SEQ ID NO: 2303658 - RNA, 19 nt, Human
acagauaagcaagagagau

SEQ ID NO: 2303659 - RNA, 18 nt, Human
acagauaagcaagagaga

SEQ ID NO: 2303660 - RNA, 15 nt, Human
acagauaagcaagag

SEQ ID NO: 2303661 - RNA, 18 nt, Human
acagcagccccugcacaa

SEQ ID NO: 2303662 - RNA, 20 nt, Human
acagaguuuucacucuuauu

SEQ ID NO: 2303663 - RNA, 13 nt, Human
acagauaagcaag

SEQ ID NO: 2303664 - RNA, 18 nt, Human
acagaguuuucacucuua

SEQ ID NO: 2303665 - RNA, 17 nt, Human
acagagugugcuggagg

SEQ ID NO: 2303666 - RNA, 19 nt, Human
acagagugugcuggaggac

SEQ ID NO: 2303667 - RNA, 17 nt, Human
uaucuuggacugacauu

SEQ ID NO: 2303668 - RNA, 18 nt, Human
uaugagcuuccuucugug

SEQ ID NO: 2303669 - RNA, 17 nt, Human
uaucuugcucuguaauc

SEQ ID NO: 2303670 - RNA, 15 nt, Human
uaucuugcucuguaa

SEQ ID NO: 2303671 - RNA, 15 nt, Human
uaucuugaauaaugu

SEQ ID NO: 2303672 - RNA, 15 nt, Human
uaucuugaagacuuu

SEQ ID NO: 2303673 - RNA, 16 nt, Human
uaugagcuuuauguaa

SEQ ID NO: 2303674 - RNA, 17 nt, Human
uaugaggacuugugucu

SEQ ID NO: 2303675 - RNA, 23 nt, Human
uaugaggacuugugucucugugc

SEQ ID NO: 2303676 - RNA, 17 nt, Human
uaugaggaauaauuauu

SEQ ID NO: 2303677 - RNA, 20 nt, Human
uaucuuggacugacauuuag

SEQ ID NO: 2303678 - RNA, 21 nt, Human
uaugagcuuccuucugugaaa

SEQ ID NO: 2303679 - RNA, 22 nt, Human
uaugaggcaaccacaggcagca

SEQ ID NO: 2303680 - RNA, 14 nt, Human
uaugaggaugcaga

SEQ ID NO: 2303681 - RNA, 13 nt, Human
uaugaggcauuug

SEQ ID NO: 2303682 - RNA, 21 nt, Human
uaugaucacggcucacugcag

SEQ ID NO: 2303683 - RNA, 23 nt, Human
uaugaucacggcucacugcagcc

SEQ ID NO: 2303684 - RNA, 15 nt, Human
uaugaggucuaggaa

SEQ ID NO: 2303685 - RNA, 15 nt, Human
uaugagucaaugugc

SEQ ID NO: 2303686 - RNA, 19 nt, Human
uaugaggucuaggaacaua

SEQ ID NO: 2303687 - RNA, 15 nt, Human
uaugagggaaaauga

SEQ ID NO: 2303688 - RNA, 22 nt, Human
uaugaguuguuuucagacucag

SEQ ID NO: 2303689 - RNA, 18 nt, Human
uaugaguuguuuucagac

SEQ ID NO: 2303690 - RNA, 23 nt, Human
uaugagucaaugugcaguguagc

SEQ ID NO: 2303691 - RNA, 16 nt, Human
uaugagucaaugugca

SEQ ID NO: 2303692 - RNA, 17 nt, Human
uaugagucaaugugcag

SEQ ID NO: 2303693 - RNA, 23 nt, Human
uaugaguuuuugauagcuuuauu

SEQ ID NO: 2303694 - RNA, 22 nt, Human
uaugaguuuuugauagcuuuau

SEQ ID NO: 2303695 - RNA, 21 nt, Human
uaugaguuuuugauagcuuua

SEQ ID NO: 2303696 - RNA, 17 nt, Human
uaugaguuucauagcua

SEQ ID NO: 2303697 - RNA, 21 nt, Human
uaugaguuucauagcuaagaa

SEQ ID NO: 2303698 - RNA, 14 nt, Human
uaugaucacggcuc

SEQ ID NO: 2303699 - RNA, 18 nt, Human
uaugaugugggucaagga

SEQ ID NO: 2303700 - RNA, 15 nt, Human
uaugauguguuguga

SEQ ID NO: 2303701 - RNA, 17 nt, Human
uaugauguguugugaua

SEQ ID NO: 2303702 - RNA, 18 nt, Human
uaugauguguugugauag

SEQ ID NO: 2303703 - RNA, 13 nt, Human
uaugauguauauu

SEQ ID NO: 2303704 - RNA, 15 nt, Human
uaugaugcuguugcc

SEQ ID NO: 2303705 - RNA, 22 nt, Human
uaugaugauacaagauuagaag

SEQ ID NO: 2303706 - RNA, 18 nt, Human
uaugcucugcauguuaca

SEQ ID NO: 2303707 - RNA, 14 nt, Human
uaugcucugcaugu

SEQ ID NO: 2303708 - RNA, 15 nt, Human
uaugaucgcgccacu

SEQ ID NO: 2303709 - RNA, 15 nt, Human
uaugaucccagcacu

SEQ ID NO: 2303710 - RNA, 21 nt, Human
uaugauggguguuuuuagcag

SEQ ID NO: 2303711 - RNA, 19 nt, Human
uaugaucucagguucuccu

SEQ ID NO: 2303712 - RNA, 21 nt, Human
uaugaugacucccuuaaaaua

SEQ ID NO: 2303713 - RNA, 23 nt, Human
uauggccucagcugccucacuuc

SEQ ID NO: 2303714 - RNA, 19 nt, Human
uauggccucagcugccuca

SEQ ID NO: 2303715 - RNA, 12 nt, Human
uauggccucagc

SEQ ID NO: 2303716 - RNA, 19 nt, Human
uaugcucugcauguuacau

SEQ ID NO: 2303717 - RNA, 19 nt, Human
uaugcugaaacagaauacu

SEQ ID NO: 2303718 - RNA, 22 nt, Human
uauggccugugagcuaggaauu

SEQ ID NO: 2303719 - RNA, 14 nt, Human
uauggccuguggau

SEQ ID NO: 2303720 - RNA, 16 nt, Human
uauggcuauaggugcu

SEQ ID NO: 2303721 - RNA, 22 nt, Human
uaugcugaguauguuaagcucu

SEQ ID NO: 2303722 - RNA, 15 nt, Human
uaugggagccccagg

SEQ ID NO: 2303723 - RNA, 17 nt, Human
uauggcuggccacugca

SEQ ID NO: 2303724 - RNA, 16 nt, Human
uauggcuuuugugcau

SEQ ID NO: 2303725 - RNA, 22 nt, Human
uauggcuagaauauccuacuuc

SEQ ID NO: 2303726 - RNA, 17 nt, Human
uauggcucacuaugaau

SEQ ID NO: 2303727 - RNA, 17 nt, Human
uauggcuagaauauccu

SEQ ID NO: 2303728 - RNA, 21 nt, Human
uauggcuagaauauccuacuu

SEQ ID NO: 2303729 - RNA, 17 nt, Human
uauggcuauaggugcua

SEQ ID NO: 2303730 - RNA, 16 nt, Human
uaugggagccccaggg

SEQ ID NO: 2303731 - RNA, 15 nt, Human
uaugggcaaaaaacu

SEQ ID NO: 2303732 - RNA, 17 nt, Human
uaugggcauuguaguua

SEQ ID NO: 2303733 - RNA, 18 nt, Human
uauggggauagaugugug

SEQ ID NO: 2303734 - RNA, 17 nt, Human
uauggggauagaugugu

SEQ ID NO: 2303735 - RNA, 14 nt, Human
acagccuggcacag

SEQ ID NO: 2303736 - RNA, 19 nt, Human
uauggggauagaugugugg

SEQ ID NO: 2303737 - RNA, 15 nt, Human
acagccuggcacagg

SEQ ID NO: 2303738 - RNA, 21 nt, Human
acagccuguggcggugccugg

SEQ ID NO: 2303739 - RNA, 20 nt, Human
acagccuguggcggugccug

SEQ ID NO: 2303740 - RNA, 22 nt, Human
uauggggagaaaagacaugaau

SEQ ID NO: 2303741 - RNA, 14 nt, Human
acagcuaacaugga

SEQ ID NO: 2303742 - RNA, 15 nt, Human
acagcuaacauggaa

SEQ ID NO: 2303743 - RNA, 16 nt, Human
acagcucccaccccac

SEQ ID NO: 2303744 - RNA, 15 nt, Human
acagcucccacccca

SEQ ID NO: 2303745 - RNA, 14 nt, Human
acagcucccacccc

SEQ ID NO: 2303746 - RNA, 13 nt, Human
acagcucccaccc

SEQ ID NO: 2303747 - RNA, 17 nt, Human
acagcuccacccuggcc

SEQ ID NO: 2303748 - RNA, 23 nt, Human
acagcucaguucuagucucucug

SEQ ID NO: 2303749 - RNA, 21 nt, Human
acagcucaguucuagucucuc

SEQ ID NO: 2303750 - RNA, 21 nt, Human
acagcucaggaucucuuagca

SEQ ID NO: 2303751 - RNA, 22 nt, Human
acagccuguggcggugccuggg

SEQ ID NO: 2303752 - RNA, 20 nt, Human
acagcuaaucagcauucuca

SEQ ID NO: 2303753 - RNA, 17 nt, Human
acagcuaacauggaagu

SEQ ID NO: 2303754 - RNA, 22 nt, Human
acagacucgauucauauugaau

SEQ ID NO: 2303755 - RNA, 17 nt, Human
acagacuccugaggaca

SEQ ID NO: 2303756 - RNA, 20 nt, Human
acagacucacaaccugaacc

SEQ ID NO: 2303757 - RNA, 22 nt, Human
acagacucacaaccugaaccua

SEQ ID NO: 2303758 - RNA, 20 nt, Human
acagacucaaaugcucagac

SEQ ID NO: 2303759 - RNA, 17 nt, Human
acagacuauuuaacuug

SEQ ID NO: 2303760 - RNA, 16 nt, Human
acagacagacacacac

SEQ ID NO: 2303761 - RNA, 18 nt, Human
acagacccugcccugugg

SEQ ID NO: 2303762 - RNA, 20 nt, Human
acagacccugcccugugggc

SEQ ID NO: 2303763 - RNA, 23 nt, Human
acagacugcgauuugucccaggu

SEQ ID NO: 2303764 - RNA, 14 nt, Human
acagacuggaagca

SEQ ID NO: 2303765 - RNA, 16 nt, Human
uauauugauccagaaa

SEQ ID NO: 2303766 - RNA, 17 nt, Human
acacuccccugcacugg

SEQ ID NO: 2303767 - RNA, 16 nt, Human
acacuccuacaccuaa

SEQ ID NO: 2303768 - RNA, 14 nt, Human
acacucccuugggc

SEQ ID NO: 2303769 - RNA, 15 nt, Human
acacuccccugcacu

SEQ ID NO: 2303770 - RNA, 16 nt, Human
acacuccaucagcuua

SEQ ID NO: 2303771 - RNA, 15 nt, Human
acacuccccgaaguc

SEQ ID NO: 2303772 - RNA, 11 nt, Human
acacuccuuca

SEQ ID NO: 2303773 - RNA, 23 nt, Human
acagacacaggcccggcuccagg

SEQ ID NO: 2303774 - RNA, 14 nt, Human
acacuccuagagaa

SEQ ID NO: 2303775 - RNA, 20 nt, Human
acacuccuagagaacgcagc

SEQ ID NO: 2303776 - RNA, 23 nt, Human
acacuccuagagaacgcagcccu

SEQ ID NO: 2303777 - RNA, 15 nt, Human
acagacagcccucca

SEQ ID NO: 2303778 - RNA, 13 nt, Human
acagacagcccuc

SEQ ID NO: 2303779 - RNA, 21 nt, Human
acagacacucccacuuggcau

SEQ ID NO: 2303780 - RNA, 14 nt, Human
acagacacuggcau

SEQ ID NO: 2303781 - RNA, 18 nt, Human
acagacacuaaguuauag

SEQ ID NO: 2303782 - RNA, 17 nt, Human
acagacccugcccugug

SEQ ID NO: 2303783 - RNA, 16 nt, Human
acagacccugcccugu

SEQ ID NO: 2303784 - RNA, 17 nt, Human
uaucacacuucugugag

SEQ ID NO: 2303785 - RNA, 15 nt, Human
uaucacagucuaauu

SEQ ID NO: 2303786 - RNA, 16 nt, Human
uaucacagucuaauuu

SEQ ID NO: 2303787 - RNA, 13 nt, Human
uaucacacuucug

SEQ ID NO: 2303788 - RNA, 12 nt, Human
uaucacauguuu

SEQ ID NO: 2303789 - RNA, 18 nt, Human
uaucacauguauguuuug

SEQ ID NO: 2303790 - RNA, 21 nt, Human
uaucacauguauguuuuggua

SEQ ID NO: 2303791 - RNA, 20 nt, Human
uaucacagucuaauuuuuau

SEQ ID NO: 2303792 - RNA, 12 nt, Human
uaucacauguau

SEQ ID NO: 2303793 - RNA, 16 nt, Human
uaucacauguauguuu

SEQ ID NO: 2303794 - RNA, 17 nt, Human
uaucacauguauguuuu

SEQ ID NO: 2303795 - RNA, 17 nt, Human
uaucaauccuuguucag

SEQ ID NO: 2303796 - RNA, 18 nt, Human
uaucaaucaguauaauuc

SEQ ID NO: 2303797 - RNA, 15 nt, Human
uaucaaucaguauaa

SEQ ID NO: 2303798 - RNA, 13 nt, Human
uaucaauagucaa

SEQ ID NO: 2303799 - RNA, 15 nt, Human
uaucaauagucaaga

SEQ ID NO: 2303800 - RNA, 20 nt, Human
uaucaauagucaagaaaaau

SEQ ID NO: 2303801 - RNA, 18 nt, Human
uaucacugacacaaaaag

SEQ ID NO: 2303802 - RNA, 13 nt, Human
uaucacauuauuu

SEQ ID NO: 2303803 - RNA, 18 nt, Human
uaucacauguuuucucug

SEQ ID NO: 2303804 - RNA, 15 nt, Human
uaucaccacaguaag

SEQ ID NO: 2303805 - RNA, 18 nt, Human
uaucaccagagagggacu

SEQ ID NO: 2303806 - RNA, 15 nt, Human
uaucaccagcugccu

SEQ ID NO: 2303807 - RNA, 17 nt, Human
uaucaccagcugccucu

SEQ ID NO: 2303808 - RNA, 18 nt, Human
uaucacccagaagaaaau

SEQ ID NO: 2303809 - RNA, 14 nt, Human
uaucaagugucuuc

SEQ ID NO: 2303810 - RNA, 24 nt, Human
uauauuuacagugaaaauguaagc

SEQ ID NO: 2303811 - RNA, 18 nt, Human
uaucaaguauuauaccuu

SEQ ID NO: 2303812 - RNA, 21 nt, Human
uaucaaguauuauaccuuuuu

SEQ ID NO: 2303813 - RNA, 15 nt, Human
uauauuuacaaaugg

SEQ ID NO: 2303814 - RNA, 12 nt, Human
uauauugauaac

SEQ ID NO: 2303815 - RNA, 23 nt, Human
acagacuccugaggacagcuguc

SEQ ID NO: 2303816 - RNA, 22 nt, Human
uauauugauaacagcacugacu

SEQ ID NO: 2303817 - RNA, 23 nt, Human
uauauugauaacagcacugacua

SEQ ID NO: 2303818 - RNA, 17 nt, Human
uauauugguaacauccu

SEQ ID NO: 2303819 - RNA, 18 nt, Human
uauauugguaacauccuu

SEQ ID NO: 2303820 - RNA, 19 nt, Human
uauauugguaacauccuuu

SEQ ID NO: 2303821 - RNA, 21 nt, Human
uauauugguaacauccuuucu

SEQ ID NO: 2303822 - RNA, 14 nt, Human
uauauuuacaaaug

SEQ ID NO: 2303823 - RNA, 16 nt, Human
acagacuucuccagac

SEQ ID NO: 2303824 - RNA, 15 nt, Human
acagacuucuccaga

SEQ ID NO: 2303825 - RNA, 13 nt, Human
acagacuucugaa

SEQ ID NO: 2303826 - RNA, 17 nt, Human
acagacuucuccagacc

SEQ ID NO: 2303827 - RNA, 14 nt, Human
acagacuucugaaa

SEQ ID NO: 2303828 - RNA, 18 nt, Human
uaucuccucgcaagcugg

SEQ ID NO: 2303829 - RNA, 22 nt, Human
acagacuggaagcacagcuuca

SEQ ID NO: 2303830 - RNA, 15 nt, Human
acagagaggacgugg

SEQ ID NO: 2303831 - RNA, 16 nt, Human
acagagaggacuguag

SEQ ID NO: 2303832 - RNA, 17 nt, Human
acagagacauuccuccg

SEQ ID NO: 2303833 - RNA, 19 nt, Human
acagagacauuccuccgag

SEQ ID NO: 2303834 - RNA, 14 nt, Human
acagagaccuccug

SEQ ID NO: 2303835 - RNA, 23 nt, Human
acagagacaggcccaagagauga

SEQ ID NO: 2303836 - RNA, 16 nt, Human
acagagacauuccucc

SEQ ID NO: 2303837 - RNA, 21 nt, Human
acagagacaggcccaagagau

SEQ ID NO: 2303838 - RNA, 15 nt, Human
acagagacaggccca

SEQ ID NO: 2303839 - RNA, 21 nt, Human
acagagacaccugcaccuccc

SEQ ID NO: 2303840 - RNA, 17 nt, Human
acagagacaccugcacc

SEQ ID NO: 2303841 - RNA, 16 nt, Human
acagagacaccugcac

SEQ ID NO: 2303842 - RNA, 15 nt, Human
acagagacaccugca

SEQ ID NO: 2303843 - RNA, 21 nt, Human
acagagagggggccaccuccc

SEQ ID NO: 2303844 - RNA, 18 nt, Human
acagagaggagaaacaca

SEQ ID NO: 2303845 - RNA, 20 nt, Human
acagagaggagaaacacauc

SEQ ID NO: 2303846 - RNA, 16 nt, Human
acagagaggagaaaca

SEQ ID NO: 2303847 - RNA, 14 nt, Human
acagagaggagaaa

SEQ ID NO: 2303848 - RNA, 20 nt, Human
acagagcccacgcccccacu

SEQ ID NO: 2303849 - RNA, 21 nt, Human
acagagccucgggacaucaaa

SEQ ID NO: 2303850 - RNA, 23 nt, Human
acagagccuucugaggacauucc

SEQ ID NO: 2303851 - RNA, 16 nt, Human
acagagcuacacaggg

SEQ ID NO: 2303852 - RNA, 24 nt, Human
acagaguggucuuucuggagaggu

SEQ ID NO: 2303853 - RNA, 21 nt, Human
acagaguggucuuucuggaga

SEQ ID NO: 2303854 - RNA, 19 nt, Human
acagaguggucuuucugga

SEQ ID NO: 2303855 - RNA, 18 nt, Human
acagaguggucuuucugg

SEQ ID NO: 2303856 - RNA, 19 nt, Human
acagagugauagccuuccg

SEQ ID NO: 2303857 - RNA, 22 nt, Human
acagaguggacuguucccugag

SEQ ID NO: 2303858 - RNA, 21 nt, Human
acagagcgagagucugucuca

SEQ ID NO: 2303859 - RNA, 18 nt, Human
acagagcuacacagggga

SEQ ID NO: 2303860 - RNA, 21 nt, Human
acagagugagacucugucuca

SEQ ID NO: 2303861 - RNA, 18 nt, Human
uauccauguacuguaguu

SEQ ID NO: 2303862 - RNA, 14 nt, Human
uauccauuaucaug

SEQ ID NO: 2303863 - RNA, 22 nt, Human
uauccauguacuguaguuuuuc

SEQ ID NO: 2303864 - RNA, 16 nt, Human
uauccauguacuguag

SEQ ID NO: 2303865 - RNA, 15 nt, Human
uauccauguacugua

SEQ ID NO: 2303866 - RNA, 14 nt, Human
uauccauguacugu

SEQ ID NO: 2303867 - RNA, 13 nt, Human
uauccauguacug

SEQ ID NO: 2303868 - RNA, 20 nt, Human
uauccaugggggcagggcau

SEQ ID NO: 2303869 - RNA, 19 nt, Human
uauccaugggggcagggca

SEQ ID NO: 2303870 - RNA, 18 nt, Human
uauccaugggggcagggc

SEQ ID NO: 2303871 - RNA, 17 nt, Human
uauccaugggggcaggg

SEQ ID NO: 2303872 - RNA, 21 nt, Human
uaucagaagaccacaaaaauu

SEQ ID NO: 2303873 - RNA, 18 nt, Human
uauccauggggaagggau

SEQ ID NO: 2303874 - RNA, 10 nt, Human
uaucagaauu

SEQ ID NO: 2303875 - RNA, 22 nt, Human
uauccauauugagucaaauggu

SEQ ID NO: 2303876 - RNA, 23 nt, Human
uaucagaagaccacaaaaauuga

SEQ ID NO: 2303877 - RNA, 14 nt, Human
uaucagaagaccac

SEQ ID NO: 2303878 - RNA, 16 nt, Human
uaucuagauacuguau

SEQ ID NO: 2303879 - RNA, 15 nt, Human
uaucuagauacugua

SEQ ID NO: 2303880 - RNA, 21 nt, Human
uaucuacucuccucaucucua

SEQ ID NO: 2303881 - RNA, 20 nt, Human
uaucuacugauaaagaaaga

SEQ ID NO: 2303882 - RNA, 20 nt, Human
uaucuacucuccucaucucu

SEQ ID NO: 2303883 - RNA, 14 nt, Human
uaucuacucuccuc

SEQ ID NO: 2303884 - RNA, 16 nt, Human
uauccauucuuucuga

SEQ ID NO: 2303885 - RNA, 15 nt, Human
uauccauuucucaug

SEQ ID NO: 2303886 - RNA, 14 nt, Human
uauccauucuuucu

SEQ ID NO: 2303887 - RNA, 19 nt, Human
uauccauuaucauguguaa

SEQ ID NO: 2303888 - RNA, 15 nt, Human
uauccauuaucaugu

SEQ ID NO: 2303889 - RNA, 16 nt, Human
uauccauuaucaugug

SEQ ID NO: 2303890 - RNA, 17 nt, Human
uauccauuaucaugugu

SEQ ID NO: 2303891 - RNA, 18 nt, Human
uauccauuaucaugugua

SEQ ID NO: 2303892 - RNA, 19 nt, Human
uaucuagugcagcugauuu

SEQ ID NO: 2303893 - RNA, 14 nt, Human
uaucuagugcagcu

SEQ ID NO: 2303894 - RNA, 23 nt, Human
uaucuagugcagcugauuuuaac

SEQ ID NO: 2303895 - RNA, 20 nt, Human
uaucuagugcagcugauuuu

SEQ ID NO: 2303896 - RNA, 17 nt, Human
uaucucccccagcccca

SEQ ID NO: 2303897 - RNA, 18 nt, Human
uaucucccccagccccau

SEQ ID NO: 2303898 - RNA, 17 nt, Human
uaucuaguuuaauuaau

SEQ ID NO: 2303899 - RNA, 16 nt, Human
uaucucccccagcccc

SEQ ID NO: 2303900 - RNA, 20 nt, Human
uaucuagcaaucacaacacu

SEQ ID NO: 2303901 - RNA, 19 nt, Human
uaucuagauacuguaucau

SEQ ID NO: 2303902 - RNA, 22 nt, Human
uauucuuaagggaacuuccaca

SEQ ID NO: 2303903 - RNA, 16 nt, Human
uauucuguuggccagu

SEQ ID NO: 2303904 - RNA, 15 nt, Human
uauucuuauuuaaug

SEQ ID NO: 2303905 - RNA, 14 nt, Human
uauucuucauaaca

SEQ ID NO: 2303906 - RNA, 13 nt, Human
uauucuucucuuc

SEQ ID NO: 2303907 - RNA, 14 nt, Human
uauucugauuccac

SEQ ID NO: 2303908 - RNA, 12 nt, Human
uauucuggaguu

SEQ ID NO: 2303909 - RNA, 22 nt, Human
uauucugauuacacaaaacaaa

SEQ ID NO: 2303910 - RNA, 21 nt, Human
uauucucuuaauuuuucuuaa

SEQ ID NO: 2303911 - RNA, 19 nt, Human
uauucuguagauucugugg

SEQ ID NO: 2303912 - RNA, 22 nt, Human
uauucuguagauucuguggaac

SEQ ID NO: 2303913 - RNA, 19 nt, Human
acaguuccucgcccugggu

SEQ ID NO: 2303914 - RNA, 18 nt, Human
acaguuccucgcccuggg

SEQ ID NO: 2303915 - RNA, 13 nt, Human
acaguuccuucag

SEQ ID NO: 2303916 - RNA, 13 nt, Human
acaguucugaaga

SEQ ID NO: 2303917 - RNA, 15 nt, Human
acaguucugaagaau

SEQ ID NO: 2303918 - RNA, 17 nt, Human
acaguucucuccuucuu

SEQ ID NO: 2303919 - RNA, 18 nt, Human
acaguucuuugggccaga

SEQ ID NO: 2303920 - RNA, 17 nt, Human
acaguucuuugggccag

SEQ ID NO: 2303921 - RNA, 21 nt, Human
acaguucuucgggaagagagg

SEQ ID NO: 2303922 - RNA, 24 nt, Human
acaguucuucgggaagagaggagu

SEQ ID NO: 2303923 - RNA, 17 nt, Human
acaguucuugugugguu

SEQ ID NO: 2303924 - RNA, 23 nt, Human
acaguucuugugugguuuggccc

SEQ ID NO: 2303925 - RNA, 15 nt, Human
acaguucuucgggaa

SEQ ID NO: 2303926 - RNA, 19 nt, Human
acaguucuucgggaagaga

SEQ ID NO: 2303927 - RNA, 20 nt, Human
acaguucuucgggaagagag

SEQ ID NO: 2303928 - RNA, 24 nt, Human
uauucucuccuguaccucuugagc

SEQ ID NO: 2303929 - RNA, 20 nt, Human
uauucucuccuguaccucuu

SEQ ID NO: 2303930 - RNA, 19 nt, Human
uauucucugagcugugcag

SEQ ID NO: 2303931 - RNA, 18 nt, Human
uauucucugagcugugca

SEQ ID NO: 2303932 - RNA, 19 nt, Human
acaguucuuugggccagac

SEQ ID NO: 2303933 - RNA, 12 nt, Human
uauucucugagc

SEQ ID NO: 2303934 - RNA, 16 nt, Human
acaguuccucgcccug

SEQ ID NO: 2303935 - RNA, 15 nt, Human
acaguuccucgcccu

SEQ ID NO: 2303936 - RNA, 14 nt, Human
acaguuccucgccc

SEQ ID NO: 2303937 - RNA, 12 nt, Human
acaguuccucgc

SEQ ID NO: 2303938 - RNA, 16 nt, Human
acaguucucuccuucu

SEQ ID NO: 2303939 - RNA, 23 nt, Human
acaguucggugagcuacaaaugc

SEQ ID NO: 2303940 - RNA, 22 nt, Human
acaguucggugagcuacaaaug

SEQ ID NO: 2303941 - RNA, 19 nt, Human
acaguucggugagcuacaa

SEQ ID NO: 2303942 - RNA, 22 nt, Human
acaguuaggguugaguuacuuc

SEQ ID NO: 2303943 - RNA, 23 nt, Human
acaguuagcaaacuuuguauguc

SEQ ID NO: 2303944 - RNA, 20 nt, Human
acaguuacucagaauucucu

SEQ ID NO: 2303945 - RNA, 13 nt, Human
acaguuacucaga

SEQ ID NO: 2303946 - RNA, 20 nt, Human
acaguucaauucucauuugu

SEQ ID NO: 2303947 - RNA, 20 nt, Human
acaguucaagaaagcuucaa

SEQ ID NO: 2303948 - RNA, 12 nt, Human
acaguucaagaa

SEQ ID NO: 2303949 - RNA, 20 nt, Human
acaguucauguuugcuucau

SEQ ID NO: 2303950 - RNA, 15 nt, Human
acaguucauauguac

SEQ ID NO: 2303951 - RNA, 23 nt, Human
acaguucaguggcagggcucagg

SEQ ID NO: 2303952 - RNA, 12 nt, Human
acaguucaguuc

SEQ ID NO: 2303953 - RNA, 16 nt, Human
acaguucaguuccucu

SEQ ID NO: 2303954 - RNA, 21 nt, Human
acaguucaguuccucuuugca

SEQ ID NO: 2303955 - RNA, 13 nt, Human
acaguucaguggc

SEQ ID NO: 2303956 - RNA, 20 nt, Human
acaguucaguggcagggcuc

SEQ ID NO: 2303957 - RNA, 21 nt, Human
acaguucaguggcagggcuca

SEQ ID NO: 2303958 - RNA, 16 nt, Human
acaguucaagaaagcu

SEQ ID NO: 2303959 - RNA, 15 nt, Human
uauuguaaacaugug

SEQ ID NO: 2303960 - RNA, 14 nt, Human
uauuguaaauaugu

SEQ ID NO: 2303961 - RNA, 17 nt, Human
uauuguaaacauguguu

SEQ ID NO: 2303962 - RNA, 18 nt, Human
uauuguaaacauguguuu

SEQ ID NO: 2303963 - RNA, 16 nt, Human
uauuguaaacaugugu

SEQ ID NO: 2303964 - RNA, 19 nt, Human
uauuguaagaaauacugua

SEQ ID NO: 2303965 - RNA, 17 nt, Human
uauuguaagaaauacug

SEQ ID NO: 2303966 - RNA, 11 nt, Human
uauuguaagaa

SEQ ID NO: 2303967 - RNA, 15 nt, Human
uauuguaaauauguu

SEQ ID NO: 2303968 - RNA, 15 nt, Human
uauuguaacagacau

SEQ ID NO: 2303969 - RNA, 16 nt, Human
uauuguaacagacauu

SEQ ID NO: 2303970 - RNA, 17 nt, Human
uauuguaacagacauug

SEQ ID NO: 2303971 - RNA, 18 nt, Human
uauuguaacagacauugu

SEQ ID NO: 2303972 - RNA, 19 nt, Human
uauuguaacagacauuguu

SEQ ID NO: 2303973 - RNA, 15 nt, Human
uauugguaacauccu

SEQ ID NO: 2303974 - RNA, 20 nt, Human
uauuggguucauuauuggaa

SEQ ID NO: 2303975 - RNA, 18 nt, Human
uauuggguucauuauugg

SEQ ID NO: 2303976 - RNA, 22 nt, Human
uauugguaacauccuuucuauu

SEQ ID NO: 2303977 - RNA, 18 nt, Human
uauugguaacauccuuuc

SEQ ID NO: 2303978 - RNA, 21 nt, Human
uauugguaacauccuuucuau

SEQ ID NO: 2303979 - RNA, 22 nt, Human
uauugguccagcuugcucuuca

SEQ ID NO: 2303980 - RNA, 13 nt, Human
uauugguccagcu

SEQ ID NO: 2303981 - RNA, 16 nt, Human
uauuggguucauuauu

SEQ ID NO: 2303982 - RNA, 14 nt, Human
uauuggguucauua

SEQ ID NO: 2303983 - RNA, 23 nt, Human
uauuggguagauauuuuuucuga

SEQ ID NO: 2303984 - RNA, 16 nt, Human
uauuggggucugaccc

SEQ ID NO: 2303985 - RNA, 17 nt, Human
uauuggggucugacccc

SEQ ID NO: 2303986 - RNA, 14 nt, Human
uauugacuuugucu

SEQ ID NO: 2303987 - RNA, 17 nt, Human
uauugacuuguauauuu

SEQ ID NO: 2303988 - RNA, 14 nt, Human
uauugacuuguaua

SEQ ID NO: 2303989 - RNA, 15 nt, Human
uauugacuuguauau

SEQ ID NO: 2303990 - RNA, 19 nt, Human
uauugacuucaaugauagu

SEQ ID NO: 2303991 - RNA, 18 nt, Human
uauugagaauuuuaaauu

SEQ ID NO: 2303992 - RNA, 15 nt, Human
uauugagaaagagca

SEQ ID NO: 2303993 - RNA, 14 nt, Human
uauugagucaaaug

SEQ ID NO: 2303994 - RNA, 14 nt, Human
uauuggccuggagg

SEQ ID NO: 2303995 - RNA, 23 nt, Human
uauuggcuaaauugaaaccugga

SEQ ID NO: 2303996 - RNA, 14 nt, Human
uauuggcugggagu

SEQ ID NO: 2303997 - RNA, 10 nt, Human
uauucuuuga

SEQ ID NO: 2303998 - RNA, 18 nt, Human
uauucuuugauguuaaca

SEQ ID NO: 2303999 - RNA, 20 nt, Human
uauucuuugauguuaacaca

SEQ ID NO: 2304000 - RNA, 21 nt, Human
uauucuuugauguuaacacau

SEQ ID NO: 2304001 - RNA, 22 nt, Human
uauucuuugauguuaacacauu

SEQ ID NO: 2304002 - RNA, 23 nt, Human
uauucuuugauguuaacacauuu

SEQ ID NO: 2304003 - RNA, 24 nt, Human
uauucuuugauguuaacacauuuu

SEQ ID NO: 2304004 - RNA, 22 nt, Human
uauucuucucuuccuuuuauca

SEQ ID NO: 2304005 - RNA, 18 nt, Human
uauugaacuuggaaagaa

SEQ ID NO: 2304006 - RNA, 20 nt, Human
uauugaaauuguacauauuu

SEQ ID NO: 2304007 - RNA, 12 nt, Human
uauugaagcauu

SEQ ID NO: 2304008 - RNA, 13 nt, Human
uauugaacuuuuu

SEQ ID NO: 2304009 - RNA, 14 nt, Human
uauugaacuuuuuu

SEQ ID NO: 2304010 - RNA, 16 nt, Human
uauugaaucuauuuaa

SEQ ID NO: 2304011 - RNA, 17 nt, Human
uauugaaucuauuuaag

SEQ ID NO: 2304012 - RNA, 22 nt, Human
uauugaaucauguaguaucaaa

SEQ ID NO: 2304013 - RNA, 12 nt, Human
uauugaauguuu

SEQ ID NO: 2304014 - RNA, 11 nt, Human
uauugaaucua

SEQ ID NO: 2304015 - RNA, 18 nt, Human
uauugaaucauguaguau

SEQ ID NO: 2304016 - RNA, 22 nt, Human
uauugaauauaauauauuugug

SEQ ID NO: 2304017 - RNA, 20 nt, Human
uauugaauauaauauauuug

SEQ ID NO: 2304018 - RNA, 21 nt, Human
uauugaauauaauauauuugu

SEQ ID NO: 2304019 - RNA, 19 nt, Human
uauugaagcauuuuauaaa

SEQ ID NO: 2304020 - RNA, 17 nt, Human
uauugaagcauuuuaua

SEQ ID NO: 2304021 - RNA, 16 nt, Human
uauugaagcauuuuau

SEQ ID NO: 2304022 - RNA, 15 nt, Human
uauugaagcauuuua

SEQ ID NO: 2304023 - RNA, 13 nt, Human
uauugaagcauuu

SEQ ID NO: 2304024 - RNA, 15 nt, Human
uauugacaaacucuc

SEQ ID NO: 2304025 - RNA, 14 nt, Human
uauugacaaacucu

SEQ ID NO: 2304026 - RNA, 18 nt, Human
uauugacaauaauuucag

SEQ ID NO: 2304027 - RNA, 17 nt, Human
uauugacaauaauuuca

SEQ ID NO: 2304028 - RNA, 13 nt, Human
uauugacaauaau

SEQ ID NO: 2304029 - RNA, 23 nt, Human
uauugacacagaaaauguugaga

SEQ ID NO: 2304030 - RNA, 20 nt, Human
uauugacacagaaaauguug

SEQ ID NO: 2304031 - RNA, 18 nt, Human
uauugacacagaaaaugu

SEQ ID NO: 2304032 - RNA, 16 nt, Human
uauugacacagaaaau

SEQ ID NO: 2304033 - RNA, 13 nt, Human
uauugacacagaa

SEQ ID NO: 2304034 - RNA, 21 nt, Human
uauuuagcaugacaagcccca

SEQ ID NO: 2304035 - RNA, 22 nt, Human
uauuuagauuguuaaaauaacu

SEQ ID NO: 2304036 - RNA, 11 nt, Human
uauuuagcaug

SEQ ID NO: 2304037 - RNA, 19 nt, Human
uauuuaguguucauaaaua

SEQ ID NO: 2304038 - RNA, 17 nt, Human
uauuuaggcagauugaa

SEQ ID NO: 2304039 - RNA, 15 nt, Human
uauuuaguuauaguu

SEQ ID NO: 2304040 - RNA, 17 nt, Human
uauuuaguuauaguuuc

SEQ ID NO: 2304041 - RNA, 18 nt, Human
uauuuagggaacugcuug

SEQ ID NO: 2304042 - RNA, 17 nt, Human
uauuuagggaacugcuu

SEQ ID NO: 2304043 - RNA, 13 nt, Human
uauuuauuuaaau

SEQ ID NO: 2304044 - RNA, 16 nt, Human
uauuuauuuaagcuua

SEQ ID NO: 2304045 - RNA, 12 nt, Human
uauuuauuuaau

SEQ ID NO: 2304046 - RNA, 11 nt, Human
uauuuauuuac

SEQ ID NO: 2304047 - RNA, 16 nt, Human
uauuuauuuaaauguc

SEQ ID NO: 2304048 - RNA, 18 nt, Human
uauuuauuuaaaugucua

SEQ ID NO: 2304049 - RNA, 14 nt, Human
uauuuauuuaaauu

SEQ ID NO: 2304050 - RNA, 14 nt, Human
uauuuauuuaugga

SEQ ID NO: 2304051 - RNA, 13 nt, Human
uauuuauuuaugg

SEQ ID NO: 2304052 - RNA, 17 nt, Human
uauuuauuuacugagcu

SEQ ID NO: 2304053 - RNA, 13 nt, Human
uauuuauuuacug

SEQ ID NO: 2304054 - RNA, 21 nt, Human
uauuuauuuaauaacaauugu

SEQ ID NO: 2304055 - RNA, 14 nt, Human
uauuuauuuaguau

SEQ ID NO: 2304056 - RNA, 22 nt, Human
uauuucaauuuccaagagcuga

SEQ ID NO: 2304057 - RNA, 18 nt, Human
uauuucaaauuggagcuu

SEQ ID NO: 2304058 - RNA, 14 nt, Human
uauuucaagacauu

SEQ ID NO: 2304059 - RNA, 20 nt, Human
uauuucacuuuagaugcuga

SEQ ID NO: 2304060 - RNA, 18 nt, Human
uauuuauuuuccucccca

SEQ ID NO: 2304061 - RNA, 17 nt, Human
uauuuauuuuccucccc

SEQ ID NO: 2304062 - RNA, 20 nt, Human
uauuuauuuuuuuuaaguau

SEQ ID NO: 2304063 - RNA, 20 nt, Human
uauuucaaaauauacauuca

SEQ ID NO: 2304064 - RNA, 14 nt, Human
uauuucaaauugga

SEQ ID NO: 2304065 - RNA, 14 nt, Human
uauuuauuuauuua

SEQ ID NO: 2304066 - RNA, 18 nt, Human
uauuuauuuuaauaaugu

SEQ ID NO: 2304067 - RNA, 14 nt, Human
uauuuauuuuaaua

SEQ ID NO: 2304068 - RNA, 16 nt, Human
uauuuauuuuaauaau

SEQ ID NO: 2304069 - RNA, 15 nt, Human
uauuuaauguuaugu

SEQ ID NO: 2304070 - RNA, 21 nt, Human
uauuuaaugccgauauacucu

SEQ ID NO: 2304071 - RNA, 19 nt, Human
uauuuaaugauaaguaaau

SEQ ID NO: 2304072 - RNA, 16 nt, Human
uauuuaauuagugcua

SEQ ID NO: 2304073 - RNA, 17 nt, Human
uauuuaauuagugcuaa

SEQ ID NO: 2304074 - RNA, 18 nt, Human
uauuuaauuagugcuaag

SEQ ID NO: 2304075 - RNA, 19 nt, Human
uauuuaauuagugcuaagu

SEQ ID NO: 2304076 - RNA, 21 nt, Human
uauuuaauuagugcuaagugu

SEQ ID NO: 2304077 - RNA, 14 nt, Human
uauuuaauucaugu

SEQ ID NO: 2304078 - RNA, 23 nt, Human
uauuuaauuuuuuugagacagag

SEQ ID NO: 2304079 - RNA, 16 nt, Human
uauuuacauaugaaau

SEQ ID NO: 2304080 - RNA, 14 nt, Human
uauuuacauaugaa

SEQ ID NO: 2304081 - RNA, 20 nt, Human
uauuuacagugaaaauguaa

SEQ ID NO: 2304082 - RNA, 22 nt, Human
uauuuacagugaaaauguaagc

SEQ ID NO: 2304083 - RNA, 21 nt, Human
uauuuacauaugaaauuuaau

SEQ ID NO: 2304084 - RNA, 17 nt, Human
uauuuacauaugaaauu

SEQ ID NO: 2304085 - RNA, 21 nt, Human
uauuuacaugaauugcauuuu

SEQ ID NO: 2304086 - RNA, 14 nt, Human
uauuuacgcuuuga

SEQ ID NO: 2304087 - RNA, 14 nt, Human
uauuuacugagcuu

SEQ ID NO: 2304088 - RNA, 22 nt, Human
uauuuacgcuuugauucauagu

SEQ ID NO: 2304089 - RNA, 16 nt, Human
uauuuacugagcuucu

SEQ ID NO: 2304090 - RNA, 19 nt, Human
uauuuacugagcuucucug

SEQ ID NO: 2304091 - RNA, 19 nt, Human
uauuuacgcuuugauucau

SEQ ID NO: 2304092 - RNA, 15 nt, Human
uauuuacgcuuugau

SEQ ID NO: 2304093 - RNA, 23 nt, Human
uauuuacugagcuucucugugaa

SEQ ID NO: 2304094 - RNA, 21 nt, Human
uauuuacugagcuucucugug

SEQ ID NO: 2304095 - RNA, 22 nt, Human
uauuuacugagcuucucuguga

SEQ ID NO: 2304096 - RNA, 18 nt, Human
uauuuacuucuuauacau

SEQ ID NO: 2304097 - RNA, 19 nt, Human
uauuuagauuguuaaaaua

SEQ ID NO: 2304098 - RNA, 17 nt, Human
uauuuagauuguuaaaa

SEQ ID NO: 2304099 - RNA, 20 nt, Human
uauuuagcaccagggaaggg

SEQ ID NO: 2304100 - RNA, 21 nt, Human
uauuuagacucaucuuacugu

SEQ ID NO: 2304101 - RNA, 18 nt, Human
uauuuagauauaacacua

SEQ ID NO: 2304102 - RNA, 13 nt, Human
uauuuagacaaga

SEQ ID NO: 2304103 - RNA, 15 nt, Human
uauuuagacaagaga

SEQ ID NO: 2304104 - RNA, 19 nt, Human
uauuuagacaagagauggg

SEQ ID NO: 2304105 - RNA, 20 nt, Human
uauuuagacaagagauggga

SEQ ID NO: 2304106 - RNA, 16 nt, Human
uauuuaagcuuauguc

SEQ ID NO: 2304107 - RNA, 18 nt, Human
uauuuaagccucauauuu

SEQ ID NO: 2304108 - RNA, 20 nt, Human
uauuuaagccucauauuuaa

SEQ ID NO: 2304109 - RNA, 21 nt, Human
uauuuaagccucauauuuaaa

SEQ ID NO: 2304110 - RNA, 10 nt, Human
uauuuaauaa

SEQ ID NO: 2304111 - RNA, 11 nt, Human
uauuuaauaac

SEQ ID NO: 2304112 - RNA, 17 nt, Human
uauuuaauaacaauugu

SEQ ID NO: 2304113 - RNA, 15 nt, Human
uauuuaauaacauua

SEQ ID NO: 2304114 - RNA, 13 nt, Human
uauuuaauaacau

SEQ ID NO: 2304115 - RNA, 14 nt, Human
uauuuaauaacauu

SEQ ID NO: 2304116 - RNA, 20 nt, Human
uauuuaagauaguuuugcca

SEQ ID NO: 2304117 - RNA, 21 nt, Human
uauuuaacuugaggguaauaa

SEQ ID NO: 2304118 - RNA, 17 nt, Human
uauuuaagauaauuaua

SEQ ID NO: 2304119 - RNA, 20 nt, Human
uauuuaagauaauuauaaua

SEQ ID NO: 2304120 - RNA, 21 nt, Human
uauuuaaugaaagacuguaca

SEQ ID NO: 2304121 - RNA, 15 nt, Human
uauuuaaugaaagac

SEQ ID NO: 2304122 - RNA, 19 nt, Human
uauugugaaguacauauua

SEQ ID NO: 2304123 - RNA, 17 nt, Human
uauugugaaguacauau

SEQ ID NO: 2304124 - RNA, 15 nt, Human
uauugugaaguacau

SEQ ID NO: 2304125 - RNA, 13 nt, Human
uauugugaucuau

SEQ ID NO: 2304126 - RNA, 21 nt, Human
uauugugaucuaucaauaguc

SEQ ID NO: 2304127 - RNA, 22 nt, Human
uauugugauuucccguggcccc

SEQ ID NO: 2304128 - RNA, 17 nt, Human
uauugugauuugacugu

SEQ ID NO: 2304129 - RNA, 16 nt, Human
uauugucagauauuuu

SEQ ID NO: 2304130 - RNA, 22 nt, Human
uauugucaguaucuguaucucu

SEQ ID NO: 2304131 - RNA, 15 nt, Human
uauuguccauugucc

SEQ ID NO: 2304132 - RNA, 17 nt, Human
uauugucauuaaaggua

SEQ ID NO: 2304133 - RNA, 17 nt, Human
uauuguccauuguccaa

SEQ ID NO: 2304134 - RNA, 17 nt, Human
uauugucuagugaaacu

SEQ ID NO: 2304135 - RNA, 20 nt, Human
uauuuaacuugagcuuuaaa

SEQ ID NO: 2304136 - RNA, 14 nt, Human
uauuuaacuugagg

SEQ ID NO: 2304137 - RNA, 21 nt, Human
uauuuaacugccuuguguaca

SEQ ID NO: 2304138 - RNA, 13 nt, Human
uauuuaacuugag

SEQ ID NO: 2304139 - RNA, 23 nt, Human
uauuuaacagcugaauuaucuau

SEQ ID NO: 2304140 - RNA, 21 nt, Human
uauuuaacagcugaauuaucu

SEQ ID NO: 2304141 - RNA, 15 nt, Human
uauuuaacagcugaa

SEQ ID NO: 2304142 - RNA, 18 nt, Human
uauugugauuugacuguu

SEQ ID NO: 2304143 - RNA, 19 nt, Human
uauugugauuugacuguuu

SEQ ID NO: 2304144 - RNA, 20 nt, Human
uauugugauuugacuguuuu

SEQ ID NO: 2304145 - RNA, 21 nt, Human
uauugugauuugacuguuuuu

SEQ ID NO: 2304146 - RNA, 11 nt, Human
uauuguacagu

SEQ ID NO: 2304147 - RNA, 15 nt, Human
uauuguacacuuuuu

SEQ ID NO: 2304148 - RNA, 20 nt, Human
uauuguacacuuuuuugggg

SEQ ID NO: 2304149 - RNA, 11 nt, Human
uauuguacaga

SEQ ID NO: 2304150 - RNA, 12 nt, Human
uauuguacagaa

SEQ ID NO: 2304151 - RNA, 12 nt, Human
uauuguacacuu

SEQ ID NO: 2304152 - RNA, 13 nt, Human
uauuguacacuuu

SEQ ID NO: 2304153 - RNA, 12 nt, Human
uauuguacaguu

SEQ ID NO: 2304154 - RNA, 13 nt, Human
uauuguacaguuu

SEQ ID NO: 2304155 - RNA, 14 nt, Human
uauuguacaguuuu

SEQ ID NO: 2304156 - RNA, 15 nt, Human
uauuguacaguuuuu

SEQ ID NO: 2304157 - RNA, 17 nt, Human
uauuguacaguuuuuau

SEQ ID NO: 2304158 - RNA, 11 nt, Human
uauuguaccuc

SEQ ID NO: 2304159 - RNA, 13 nt, Human
uauuguaccucuc

SEQ ID NO: 2304160 - RNA, 14 nt, Human
uauuguaccucucu

SEQ ID NO: 2304161 - RNA, 20 nt, Human
uauuguacagcuguuuaaga

SEQ ID NO: 2304162 - RNA, 13 nt, Human
uauuguaccuuuu

SEQ ID NO: 2304163 - RNA, 17 nt, Human
uauuguaccuuuuaaca

SEQ ID NO: 2304164 - RNA, 15 nt, Human
uauuguagcauuucu

SEQ ID NO: 2304165 - RNA, 16 nt, Human
uauuguagcauuucuu

SEQ ID NO: 2304166 - RNA, 17 nt, Human
uauuguagcauuucuug

SEQ ID NO: 2304167 - RNA, 16 nt, Human
uauuguauaaacuauc

SEQ ID NO: 2304168 - RNA, 21 nt, Human
uauuguauaaacuaucaguuu

SEQ ID NO: 2304169 - RNA, 22 nt, Human
uauuguauaagauuagaaugaa

SEQ ID NO: 2304170 - RNA, 18 nt, Human
uauuguauuacuagaaga

SEQ ID NO: 2304171 - RNA, 13 nt, Human
uauugucaaagug

SEQ ID NO: 2304172 - RNA, 17 nt, Human
uauugucaaagugguga

SEQ ID NO: 2304173 - RNA, 10 nt, Human
uauuguauuu

SEQ ID NO: 2304174 - RNA, 15 nt, Human
uauuguauuuauuca

SEQ ID NO: 2304175 - RNA, 16 nt, Human
uauuguauuuauucaa

SEQ ID NO: 2304176 - RNA, 17 nt, Human
uauuguauuuauucaau

SEQ ID NO: 2304177 - RNA, 18 nt, Human
uauuguauuuauucaaua

SEQ ID NO: 2304178 - RNA, 20 nt, Human
uauuguauuuauucaauaaa

SEQ ID NO: 2304179 - RNA, 15 nt, Human
uauuguauuuauucc

SEQ ID NO: 2304180 - RNA, 18 nt, Human
uauuguauuuauuccaua

SEQ ID NO: 2304181 - RNA, 15 nt, Human
uauucagcucaugga

SEQ ID NO: 2304182 - RNA, 14 nt, Human
uauucagacaagca

SEQ ID NO: 2304183 - RNA, 18 nt, Human
uauucagacaagcaacag

SEQ ID NO: 2304184 - RNA, 22 nt, Human
uauucagacaagcaacagguuu

SEQ ID NO: 2304185 - RNA, 19 nt, Human
uauucaacucauaagacuu

SEQ ID NO: 2304186 - RNA, 20 nt, Human
uauucaaguuauuguacagc

SEQ ID NO: 2304187 - RNA, 16 nt, Human
uauucaaguuauugua

SEQ ID NO: 2304188 - RNA, 18 nt, Human
uauuauaaauuauguuua

SEQ ID NO: 2304189 - RNA, 15 nt, Human
uauuauaaauuaugu

SEQ ID NO: 2304190 - RNA, 16 nt, Human
uauuauaaauuauguu

SEQ ID NO: 2304191 - RNA, 20 nt, Human
uauuauaaauuauguuuaua

SEQ ID NO: 2304192 - RNA, 12 nt, Human
uauucaggacuu

SEQ ID NO: 2304193 - RNA, 16 nt, Human
uauucaggagaguaga

SEQ ID NO: 2304194 - RNA, 18 nt, Human
uauucaggaagcucaggg

SEQ ID NO: 2304195 - RNA, 22 nt, Human
uauucaggaagcucagggccug

SEQ ID NO: 2304196 - RNA, 21 nt, Human
uauucauauuuucuuucaaaa

SEQ ID NO: 2304197 - RNA, 23 nt, Human
uauucauagcagcuuauucacaa

SEQ ID NO: 2304198 - RNA, 16 nt, Human
uauucauaguuuaauu

SEQ ID NO: 2304199 - RNA, 14 nt, Human
uauucauaauuauu

SEQ ID NO: 2304200 - RNA, 14 nt, Human
uauuaguuuugauu

SEQ ID NO: 2304201 - RNA, 14 nt, Human
uauuauaaauuaug

SEQ ID NO: 2304202 - RNA, 13 nt, Human
uauuaguuaauau

SEQ ID NO: 2304203 - RNA, 16 nt, Human
uauuaguguaugcuuu

SEQ ID NO: 2304204 - RNA, 16 nt, Human
uauuagugaugucauc

SEQ ID NO: 2304205 - RNA, 23 nt, Human
uauuagccacaaaauugggaaag

SEQ ID NO: 2304206 - RNA, 15 nt, Human
uauuagccacaaaau

SEQ ID NO: 2304207 - RNA, 13 nt, Human
uauuagccaggau

SEQ ID NO: 2304208 - RNA, 17 nt, Human
uauuagccaggaucaug

SEQ ID NO: 2304209 - RNA, 18 nt, Human
uauuagccaggaucaugg

SEQ ID NO: 2304210 - RNA, 19 nt, Human
uauuagccaggaucauggu

SEQ ID NO: 2304211 - RNA, 21 nt, Human
uauuagccagguaaugugaau

SEQ ID NO: 2304212 - RNA, 16 nt, Human
uauuagccagucuuua

SEQ ID NO: 2304213 - RNA, 23 nt, Human
uauuagccaggaucaugguguaa

SEQ ID NO: 2304214 - RNA, 23 nt, Human
uauuagaugugauuuaauagugu

SEQ ID NO: 2304215 - RNA, 22 nt, Human
uauuagauguucucuaucauuu

SEQ ID NO: 2304216 - RNA, 17 nt, Human
uauuagauguucucuau

SEQ ID NO: 2304217 - RNA, 21 nt, Human
uauuagauguucucuaucauu

SEQ ID NO: 2304218 - RNA, 12 nt, Human
uauuagauguuc

SEQ ID NO: 2304219 - RNA, 16 nt, Human
uauuagaugugauuua

SEQ ID NO: 2304220 - RNA, 20 nt, Human
uauuagaugugauuuaauag

SEQ ID NO: 2304221 - RNA, 14 nt, Human
uauuagauguucuc

SEQ ID NO: 2304222 - RNA, 15 nt, Human
uauuagauguucucu

SEQ ID NO: 2304223 - RNA, 11 nt, Human
uauuaccucug

SEQ ID NO: 2304224 - RNA, 13 nt, Human
uauuaccucugau

SEQ ID NO: 2304225 - RNA, 22 nt, Human
uauuacccccuccuucagacac

SEQ ID NO: 2304226 - RNA, 15 nt, Human
uauuagaauaccaca

SEQ ID NO: 2304227 - RNA, 15 nt, Human
uauuaccaugagaag

SEQ ID NO: 2304228 - RNA, 21 nt, Human
uauuacccccuccuucagaca

SEQ ID NO: 2304229 - RNA, 16 nt, Human
uauuaccacagacaua

SEQ ID NO: 2304230 - RNA, 14 nt, Human
uauuaccucugaua

SEQ ID NO: 2304231 - RNA, 19 nt, Human
uauuaccucugauaccuca

SEQ ID NO: 2304232 - RNA, 12 nt, Human
uauuagagaaga

SEQ ID NO: 2304233 - RNA, 16 nt, Human
uauuagagcauugaau

SEQ ID NO: 2304234 - RNA, 18 nt, Human
uauuagagugucuuucca

SEQ ID NO: 2304235 - RNA, 15 nt, Human
uauuagagugucuuu

SEQ ID NO: 2304236 - RNA, 13 nt, Human
uauuagaugugau

SEQ ID NO: 2304237 - RNA, 14 nt, Human
uauuagaugugauu

SEQ ID NO: 2304238 - RNA, 15 nt, Human
uauuagaugugauuu

SEQ ID NO: 2304239 - RNA, 16 nt, Human
acagcucccucugccu

SEQ ID NO: 2304240 - RNA, 21 nt, Human
acagcugcuccuagagggagg

SEQ ID NO: 2304241 - RNA, 23 nt, Human
acagcugcuccuagagggagggg

SEQ ID NO: 2304242 - RNA, 22 nt, Human
acagcugcuccuagagggaggg

SEQ ID NO: 2304243 - RNA, 12 nt, Human
acagcuccuccc

SEQ ID NO: 2304244 - RNA, 14 nt, Human
acagcuccucccac

SEQ ID NO: 2304245 - RNA, 22 nt, Human
acagcucccaccccacccccuu

SEQ ID NO: 2304246 - RNA, 18 nt, Human
acagcucccaccccaccc

SEQ ID NO: 2304247 - RNA, 17 nt, Human
acagcucccucugccug

SEQ ID NO: 2304248 - RNA, 14 nt, Human
acagcucccucugc

SEQ ID NO: 2304249 - RNA, 23 nt, Human
acagcugcuuucuguugucauug

SEQ ID NO: 2304250 - RNA, 13 nt, Human
acagcuggccucc

SEQ ID NO: 2304251 - RNA, 11 nt, Human
acagcugcugg

SEQ ID NO: 2304252 - RNA, 13 nt, Human
acagcugcuuucu

SEQ ID NO: 2304253 - RNA, 15 nt, Human
acagcugcuuucugu

SEQ ID NO: 2304254 - RNA, 21 nt, Human
acagcugcuuucuguugucau

SEQ ID NO: 2304255 - RNA, 13 nt, Human
acagcugggcugu

SEQ ID NO: 2304256 - RNA, 16 nt, Human
acagcuggguggcacu

SEQ ID NO: 2304257 - RNA, 21 nt, Human
uauguguguaugggugugugu

SEQ ID NO: 2304258 - RNA, 12 nt, Human
uauguguguaug

SEQ ID NO: 2304259 - RNA, 19 nt, Human
uauguguguauauguaugu

SEQ ID NO: 2304260 - RNA, 12 nt, Human
uauguguguaua

SEQ ID NO: 2304261 - RNA, 18 nt, Human
acagcuggguggcacugc

SEQ ID NO: 2304262 - RNA, 19 nt, Human
acagcuggguggcacugcc

SEQ ID NO: 2304263 - RNA, 20 nt, Human
acagcuggguggcacugcca

SEQ ID NO: 2304264 - RNA, 23 nt, Human
acagcuggguggcacugccaugc

SEQ ID NO: 2304265 - RNA, 19 nt, Human
uauguguguguauguuugc

SEQ ID NO: 2304266 - RNA, 19 nt, Human
uauguguguguaugcuacu

SEQ ID NO: 2304267 - RNA, 13 nt, Human
uauguguguguau

SEQ ID NO: 2304268 - RNA, 12 nt, Human
uaugugugugua

SEQ ID NO: 2304269 - RNA, 11 nt, Human
uaugugugugu

SEQ ID NO: 2304270 - RNA, 22 nt, Human
uauguguguguguugugugugg

SEQ ID NO: 2304271 - RNA, 14 nt, Human
uauguguguguguu

SEQ ID NO: 2304272 - RNA, 18 nt, Human
uauguuuuagcauguguu

SEQ ID NO: 2304273 - RNA, 22 nt, Human
uauuaaaaauauaaaacugcgu

SEQ ID NO: 2304274 - RNA, 16 nt, Human
uauguuuuagcaugug

SEQ ID NO: 2304275 - RNA, 14 nt, Human
uauguuuuagcaug

SEQ ID NO: 2304276 - RNA, 23 nt, Human
uauguguguguguuguguguggg

SEQ ID NO: 2304277 - RNA, 17 nt, Human
uauguuuuaagaggcag

SEQ ID NO: 2304278 - RNA, 19 nt, Human
uauguuuuaagaggcaggg

SEQ ID NO: 2304279 - RNA, 22 nt, Human
uauuaaaaaucucaaauuucua

SEQ ID NO: 2304280 - RNA, 20 nt, Human
uauuaaaaaucucaaauuuc

SEQ ID NO: 2304281 - RNA, 18 nt, Human
uauuaaaaaucucaaauu

SEQ ID NO: 2304282 - RNA, 16 nt, Human
uauuaaaaaucucaaa

SEQ ID NO: 2304283 - RNA, 17 nt, Human
uauuacaucuuucacau

SEQ ID NO: 2304284 - RNA, 16 nt, Human
uauuacauggcagugu

SEQ ID NO: 2304285 - RNA, 12 nt, Human
uauuacaucuuu

SEQ ID NO: 2304286 - RNA, 16 nt, Human
uauuaaauacaaaacu

SEQ ID NO: 2304287 - RNA, 19 nt, Human
uauuaaauacaaaacuucc

SEQ ID NO: 2304288 - RNA, 12 nt, Human
uauuaaauacag

SEQ ID NO: 2304289 - RNA, 18 nt, Human
uauuaaauacaaaacuuc

SEQ ID NO: 2304290 - RNA, 14 nt, Human
acagcgacauagcc

SEQ ID NO: 2304291 - RNA, 12 nt, Human
uauuaaagacag

SEQ ID NO: 2304292 - RNA, 22 nt, Human
uauuaaacguaugcaugugaag

SEQ ID NO: 2304293 - RNA, 20 nt, Human
uauuaaacguaugcauguga

SEQ ID NO: 2304294 - RNA, 21 nt, Human
uauuaaacguaugcaugugaa

SEQ ID NO: 2304295 - RNA, 23 nt, Human
uauuaaacagauuuuuacaaaug

SEQ ID NO: 2304296 - RNA, 20 nt, Human
uauuaaaaauauggaacuuc

SEQ ID NO: 2304297 - RNA, 22 nt, Human
uauuaaaaauauggaacuucua

SEQ ID NO: 2304298 - RNA, 23 nt, Human
uauuaaaaaucucaaauuucuaa

SEQ ID NO: 2304299 - RNA, 12 nt, Human
uauuaaaacuca

SEQ ID NO: 2304300 - RNA, 20 nt, Human
uauuaaacagauuuuuacaa

SEQ ID NO: 2304301 - RNA, 21 nt, Human
uauuaaacagauuuuuacaaa

SEQ ID NO: 2304302 - RNA, 16 nt, Human
acagggcagcugggcc

SEQ ID NO: 2304303 - RNA, 17 nt, Human
acagggcagcugggccc

SEQ ID NO: 2304304 - RNA, 18 nt, Human
acagggcagcugggccca

SEQ ID NO: 2304305 - RNA, 16 nt, Human
acagggcaucuccagg

SEQ ID NO: 2304306 - RNA, 21 nt, Human
acagggcagcugggcccaacc

SEQ ID NO: 2304307 - RNA, 17 nt, Human
acagggcaucuccagga

SEQ ID NO: 2304308 - RNA, 22 nt, Human
acagguuuuccugaagaauuga

SEQ ID NO: 2304309 - RNA, 16 nt, Human
acagggcagagccggg

SEQ ID NO: 2304310 - RNA, 22 nt, Human
acagggcacaccgggcacucag

SEQ ID NO: 2304311 - RNA, 21 nt, Human
acaggcugggcuucaguggca

SEQ ID NO: 2304312 - RNA, 14 nt, Human
acaggcugggcuuc

SEQ ID NO: 2304313 - RNA, 17 nt, Human
acaggcugggcuucagu

SEQ ID NO: 2304314 - RNA, 15 nt, Human
acaguaacuuuaugu

SEQ ID NO: 2304315 - RNA, 21 nt, Human
acaguaucacugucuuuccua

SEQ ID NO: 2304316 - RNA, 10 nt, Human
acaguaacuu

SEQ ID NO: 2304317 - RNA, 23 nt, Human
acaguaucacugucuuuccuaga

SEQ ID NO: 2304318 - RNA, 19 nt, Human
acaguaugagucaaugugc

SEQ ID NO: 2304319 - RNA, 17 nt, Human
acaguaugucccauagg

SEQ ID NO: 2304320 - RNA, 21 nt, Human
acaguaugagucaaugugcag

SEQ ID NO: 2304321 - RNA, 23 nt, Human
acaguaugagucaaugugcagug

SEQ ID NO: 2304322 - RNA, 21 nt, Human
acaguauggcagcuuuccuca

SEQ ID NO: 2304323 - RNA, 21 nt, Human
acagggcaucuccaggaaggc

SEQ ID NO: 2304324 - RNA, 22 nt, Human
acagggcaugccccggccaccu

SEQ ID NO: 2304325 - RNA, 23 nt, Human
acagggcaugccccggccaccuc

SEQ ID NO: 2304326 - RNA, 24 nt, Human
acagggcaugccccggccaccucu

SEQ ID NO: 2304327 - RNA, 12 nt, Human
acaguaaacauu

SEQ ID NO: 2304328 - RNA, 12 nt, Human
acaguaaauaaa

SEQ ID NO: 2304329 - RNA, 17 nt, Human
acaguaaauaaauuguu

SEQ ID NO: 2304330 - RNA, 18 nt, Human
acaguaaauaaauuguuu

SEQ ID NO: 2304331 - RNA, 17 nt, Human
acaguaacgcaggggaa

SEQ ID NO: 2304332 - RNA, 19 nt, Human
acaguaacgcaggggaaac

SEQ ID NO: 2304333 - RNA, 13 nt, Human
acaguaaauaaau

SEQ ID NO: 2304334 - RNA, 14 nt, Human
acaguaaauaaauu

SEQ ID NO: 2304335 - RNA, 15 nt, Human
acaguaaauaaauug

SEQ ID NO: 2304336 - RNA, 23 nt, Human
acaguaaauaaauuguuugacca

SEQ ID NO: 2304337 - RNA, 17 nt, Human
acagucaaggaguggcu

SEQ ID NO: 2304338 - RNA, 17 nt, Human
acagucaaaacagagau

SEQ ID NO: 2304339 - RNA, 16 nt, Human
acagucaaaacagaga

SEQ ID NO: 2304340 - RNA, 12 nt, Human
acagucccugcc

SEQ ID NO: 2304341 - RNA, 13 nt, Human
acagucccugcca

SEQ ID NO: 2304342 - RNA, 17 nt, Human
acaguauuuugguucuu

SEQ ID NO: 2304343 - RNA, 15 nt, Human
acaguauuacuucug

SEQ ID NO: 2304344 - RNA, 16 nt, Human
acaguauuacuucugc

SEQ ID NO: 2304345 - RNA, 17 nt, Human
acaguauuacuucugcu

SEQ ID NO: 2304346 - RNA, 19 nt, Human
acaguauuacuucugcuac

SEQ ID NO: 2304347 - RNA, 18 nt, Human
acagucaaaacagagaug

SEQ ID NO: 2304348 - RNA, 18 nt, Human
acaguccuaacugguaua

SEQ ID NO: 2304349 - RNA, 12 nt, Human
acaguccuggga

SEQ ID NO: 2304350 - RNA, 19 nt, Human
acaguccuaacugguauag

SEQ ID NO: 2304351 - RNA, 17 nt, Human
acaguccucccaucuca

SEQ ID NO: 2304352 - RNA, 18 nt, Human
acaguccuuaccagcaga

SEQ ID NO: 2304353 - RNA, 20 nt, Human
acaguccuuaccagcagagc

SEQ ID NO: 2304354 - RNA, 15 nt, Human
acagucccugccaau

SEQ ID NO: 2304355 - RNA, 13 nt, Human
acaguccucccau

SEQ ID NO: 2304356 - RNA, 14 nt, Human
acaguccucccauc

SEQ ID NO: 2304357 - RNA, 15 nt, Human
acaguccucccaucu

SEQ ID NO: 2304358 - RNA, 22 nt, Human
acagugugaaguuagaauuccu

SEQ ID NO: 2304359 - RNA, 15 nt, Human
acagugugaaguuag

SEQ ID NO: 2304360 - RNA, 16 nt, Human
acagugugaaguuaga

SEQ ID NO: 2304361 - RNA, 18 nt, Human
acagugugaaguuagaau

SEQ ID NO: 2304362 - RNA, 19 nt, Human
acagugugaaguuagaauu

SEQ ID NO: 2304363 - RNA, 14 nt, Human
acaguguuaaauga

SEQ ID NO: 2304364 - RNA, 17 nt, Human
acaguguuaggccuggc

SEQ ID NO: 2304365 - RNA, 14 nt, Human
acagugagccugaa

SEQ ID NO: 2304366 - RNA, 12 nt, Human
acagugagccug

SEQ ID NO: 2304367 - RNA, 12 nt, Human
acagugagccaa

SEQ ID NO: 2304368 - RNA, 13 nt, Human
acagugagccaag

SEQ ID NO: 2304369 - RNA, 12 nt, Human
acagugugaagu

SEQ ID NO: 2304370 - RNA, 13 nt, Human
acagugugaaguu

SEQ ID NO: 2304371 - RNA, 17 nt, Human
acagugaaggcuguccu

SEQ ID NO: 2304372 - RNA, 14 nt, Human
acagugaagcaaau

SEQ ID NO: 2304373 - RNA, 21 nt, Human
acagugaaaauguaagcuguu

SEQ ID NO: 2304374 - RNA, 18 nt, Human
acagugacucgggcuccu

SEQ ID NO: 2304375 - RNA, 19 nt, Human
acagugacucgggcuccug

SEQ ID NO: 2304376 - RNA, 20 nt, Human
acagugacucgggcuccugu

SEQ ID NO: 2304377 - RNA, 23 nt, Human
acagugacucgggcuccugugcc

SEQ ID NO: 2304378 - RNA, 18 nt, Human
acagugagacucugucuc

SEQ ID NO: 2304379 - RNA, 14 nt, Human
acagugagacucug

SEQ ID NO: 2304380 - RNA, 21 nt, Human
acaguuaaaugagaacaugaa

SEQ ID NO: 2304381 - RNA, 14 nt, Human
acaguuaacuuuca

SEQ ID NO: 2304382 - RNA, 13 nt, Human
acaguuaacuuuc

SEQ ID NO: 2304383 - RNA, 16 nt, Human
acaguuaacuuucaga

SEQ ID NO: 2304384 - RNA, 21 nt, Human
acaguuaccucugccucagaa

SEQ ID NO: 2304385 - RNA, 19 nt, Human
acaguguuucgacagcuga

SEQ ID NO: 2304386 - RNA, 23 nt, Human
acaguguuucccauaauuuucuu

SEQ ID NO: 2304387 - RNA, 17 nt, Human
acaguguuugcaauggu

SEQ ID NO: 2304388 - RNA, 16 nt, Human
acaguguuuuuguaaa

SEQ ID NO: 2304389 - RNA, 18 nt, Human
acaguguuuuuguaaagu

SEQ ID NO: 2304390 - RNA, 20 nt, Human
acaguguuuuuguaaagugu

SEQ ID NO: 2304391 - RNA, 22 nt, Human
acaguguuuuuguaaagugugg

SEQ ID NO: 2304392 - RNA, 15 nt, Human
acaguuaagagaaau

SEQ ID NO: 2304393 - RNA, 22 nt, Human
acaguguuauuuucuuugaaau

SEQ ID NO: 2304394 - RNA, 13 nt, Human
acaguguucuguu

SEQ ID NO: 2304395 - RNA, 20 nt, Human
acaguguuauuuucuuugaa

SEQ ID NO: 2304396 - RNA, 16 nt, Human
acaguguuauuuucuu

SEQ ID NO: 2304397 - RNA, 14 nt, Human
acaguguucuguuu

SEQ ID NO: 2304398 - RNA, 15 nt, Human
acaguguucuguuua

SEQ ID NO: 2304399 - RNA, 16 nt, Human
acaguguucuguuuaa

SEQ ID NO: 2304400 - RNA, 17 nt, Human
acaguguucuguuuaau

SEQ ID NO: 2304401 - RNA, 11 nt, Human
acaguguuccg

SEQ ID NO: 2304402 - RNA, 19 nt, Human
acaguguuaggccuggcac

SEQ ID NO: 2304403 - RNA, 21 nt, Human
acaguguuaggccuggcacag

SEQ ID NO: 2304404 - RNA, 22 nt, Human
acaguguuaggccuggcacagu

SEQ ID NO: 2304405 - RNA, 23 nt, Human
acaguguuaggccuggcacagug

SEQ ID NO: 2304406 - RNA, 22 nt, Human
acaguguuucccauaauuuucu

SEQ ID NO: 2304407 - RNA, 18 nt, Human
acaguguuucccauaauu

SEQ ID NO: 2304408 - RNA, 16 nt, Human
acaguguuucccauaa

SEQ ID NO: 2304409 - RNA, 15 nt, Human
acaguguuucccaua

SEQ ID NO: 2304410 - RNA, 9 nt, Human
acaguguuu

SEQ ID NO: 2304411 - RNA, 22 nt, Human
acaguguucuguuuaauacuca

SEQ ID NO: 2304412 - RNA, 21 nt, Human
acaguguugaaaauguucaga

SEQ ID NO: 2304413 - RNA, 19 nt, Human
acaguguugaaaauguuca

SEQ ID NO: 2304414 - RNA, 22 nt, Human
acagucuaauuuuuauucauaa

SEQ ID NO: 2304415 - RNA, 18 nt, Human
acagucuaauuuuuauuc

SEQ ID NO: 2304416 - RNA, 21 nt, Human
acagucuaauuuuuauucaua

SEQ ID NO: 2304417 - RNA, 14 nt, Human
acagucuaauuuuu

SEQ ID NO: 2304418 - RNA, 13 nt, Human
acagucuaauuuu

SEQ ID NO: 2304419 - RNA, 22 nt, Human
acaguccugggagaaccucagg

SEQ ID NO: 2304420 - RNA, 21 nt, Human
acaguccugggagaaccucag

SEQ ID NO: 2304421 - RNA, 23 nt, Human
acaguccugggagaaccucaggc

SEQ ID NO: 2304422 - RNA, 23 nt, Human
acaguccucuccaccuaguggcu

SEQ ID NO: 2304423 - RNA, 21 nt, Human
acaguccuuaccagcagagca

SEQ ID NO: 2304424 - RNA, 22 nt, Human
acaguccuuaccagcagagcac

SEQ ID NO: 2304425 - RNA, 16 nt, Human
acagucucaggaaauc

SEQ ID NO: 2304426 - RNA, 15 nt, Human
acagucucaggaaau

SEQ ID NO: 2304427 - RNA, 14 nt, Human
acagucucaggaaa

SEQ ID NO: 2304428 - RNA, 13 nt, Human
acagucucaggaa

SEQ ID NO: 2304429 - RNA, 15 nt, Human
acagucuuguauuaa

SEQ ID NO: 2304430 - RNA, 18 nt, Human
acagucuuguauuaaguu

SEQ ID NO: 2304431 - RNA, 22 nt, Human
acagucuuguauuaaguuguua

SEQ ID NO: 2304432 - RNA, 15 nt, Human
acagucuugcagcag

SEQ ID NO: 2304433 - RNA, 14 nt, Human
acagugaaaaugua

SEQ ID NO: 2304434 - RNA, 18 nt, Human
acagugaaaauguaagcu

SEQ ID NO: 2304435 - RNA, 20 nt, Human
acagugaaagaaaauaacaa

SEQ ID NO: 2304436 - RNA, 14 nt, Human
acagucuuguauua

SEQ ID NO: 2304437 - RNA, 19 nt, Human
acagucuuccauuugcaag

SEQ ID NO: 2304438 - RNA, 14 nt, Human
acagucuuccauuu

SEQ ID NO: 2304439 - RNA, 20 nt, Human
acagucucuuuaaucuucag

SEQ ID NO: 2304440 - RNA, 19 nt, Human
acagucugaucgugacgcu

SEQ ID NO: 2304441 - RNA, 20 nt, Human
acagucugaucgugacgcug

SEQ ID NO: 2304442 - RNA, 22 nt, Human
acagucugaucgugacgcugaa

SEQ ID NO: 2304443 - RNA, 13 nt, Human
acagucugucaug

SEQ ID NO: 2304444 - RNA, 19 nt, Human
acagucucuuuaaucuuca

SEQ ID NO: 2304445 - RNA, 14 nt, Human
acagucucuuuaau

SEQ ID NO: 2304446 - RNA, 17 nt, Human
acagucucaggaaauca

SEQ ID NO: 2304447 - RNA, 13 nt, Human
uacguaugagacg

SEQ ID NO: 2304448 - RNA, 16 nt, Human
uacguacaugugaggc

SEQ ID NO: 2304449 - RNA, 14 nt, Human
uacgucugacaggc

SEQ ID NO: 2304450 - RNA, 18 nt, Human
uacgucaaacaugaagug

SEQ ID NO: 2304451 - RNA, 15 nt, Human
uacguguagcuauau

SEQ ID NO: 2304452 - RNA, 14 nt, Human
uacguuaccaggca

SEQ ID NO: 2304453 - RNA, 15 nt, Human
uacgugugauuuuuc

SEQ ID NO: 2304454 - RNA, 14 nt, Human
uacguugugcauuu

SEQ ID NO: 2304455 - RNA, 13 nt, Human
uacguugugcauu

SEQ ID NO: 2304456 - RNA, 15 nt, Human
uacguuauuguugac

SEQ ID NO: 2304457 - RNA, 16 nt, Human
uacguuauuguugacu

SEQ ID NO: 2304458 - RNA, 15 nt, Human
uacguuccuauuguc

SEQ ID NO: 2304459 - RNA, 16 nt, Human
uacuagguaacuucau

SEQ ID NO: 2304460 - RNA, 15 nt, Human
uacuagguaacuuca

SEQ ID NO: 2304461 - RNA, 18 nt, Human
uacguuccuauugucauu

SEQ ID NO: 2304462 - RNA, 22 nt, Human
uacguuccuauugucauuaaag

SEQ ID NO: 2304463 - RNA, 19 nt, Human
uacuagguaacuucauauu

SEQ ID NO: 2304464 - RNA, 15 nt, Human
uacucaagcccgcgg

SEQ ID NO: 2304465 - RNA, 19 nt, Human
uacucaagaggcugaggca

SEQ ID NO: 2304466 - RNA, 15 nt, Human
uacucaagaggcuga

SEQ ID NO: 2304467 - RNA, 23 nt, Human
uacucaacccucucaggugacca

SEQ ID NO: 2304468 - RNA, 14 nt, Human
uacucaacccucuc

SEQ ID NO: 2304469 - RNA, 11 nt, Human
uacuauuuaaa

SEQ ID NO: 2304470 - RNA, 22 nt, Human
uacuauucaguggcgagaaaua

SEQ ID NO: 2304471 - RNA, 16 nt, Human
uacuauguaucaauga

SEQ ID NO: 2304472 - RNA, 21 nt, Human
uacuaguugugaccuuagugu

SEQ ID NO: 2304473 - RNA, 19 nt, Human
uacuaguuacacaucuuca

SEQ ID NO: 2304474 - RNA, 14 nt, Human
uacuaguuacacau

SEQ ID NO: 2304475 - RNA, 16 nt, Human
uacuauaauuuaccug

SEQ ID NO: 2304476 - RNA, 21 nt, Human
uacucuuaggaagagaaacca

SEQ ID NO: 2304477 - RNA, 21 nt, Human
uacucuuaaguuucucagcuc

SEQ ID NO: 2304478 - RNA, 12 nt, Human
uacucuuccgaa

SEQ ID NO: 2304479 - RNA, 22 nt, Human
uacucuucaguuaagccuuugg

SEQ ID NO: 2304480 - RNA, 18 nt, Human
uacucuuaggaagagaaa

SEQ ID NO: 2304481 - RNA, 15 nt, Human
uacucuuaaguuucu

SEQ ID NO: 2304482 - RNA, 20 nt, Human
uacucuuaaguuucucagcu

SEQ ID NO: 2304483 - RNA, 20 nt, Human
uacucuuaagccaucuuggu

SEQ ID NO: 2304484 - RNA, 21 nt, Human
uacucuuaagccaucuuggua

SEQ ID NO: 2304485 - RNA, 22 nt, Human
uacucuuaagccaucuugguaa

SEQ ID NO: 2304486 - RNA, 23 nt, Human
uacucuuaagccaucuugguaaa

SEQ ID NO: 2304487 - RNA, 18 nt, Human
uacucuuauagacaacau

SEQ ID NO: 2304488 - RNA, 19 nt, Human
uacucuguuccuucacauc

SEQ ID NO: 2304489 - RNA, 14 nt, Human
uacucuguuccuuc

SEQ ID NO: 2304490 - RNA, 14 nt, Human
uacucuuaagccau

SEQ ID NO: 2304491 - RNA, 15 nt, Human
uacucuuaagccauc

SEQ ID NO: 2304492 - RNA, 16 nt, Human
uacucuuaagccaucu

SEQ ID NO: 2304493 - RNA, 17 nt, Human
uacucuuaagccaucuu

SEQ ID NO: 2304494 - RNA, 21 nt, Human
uacucugugucagguggggca

SEQ ID NO: 2304495 - RNA, 22 nt, Human
uacucaauguuacuaucugcuu

SEQ ID NO: 2304496 - RNA, 14 nt, Human
uacucaauggauuu

SEQ ID NO: 2304497 - RNA, 22 nt, Human
uacucaauugauaaacauuuaa

SEQ ID NO: 2304498 - RNA, 18 nt, Human
uacucuucuugaaauuuu

SEQ ID NO: 2304499 - RNA, 17 nt, Human
uacucuucuugaaauuu

SEQ ID NO: 2304500 - RNA, 14 nt, Human
uacucuucuugaaa

SEQ ID NO: 2304501 - RNA, 22 nt, Human
uacugaagaugcagcaaaaugu

SEQ ID NO: 2304502 - RNA, 12 nt, Human
uacugaaggaaa

SEQ ID NO: 2304503 - RNA, 13 nt, Human
uacugaaggaaaa

SEQ ID NO: 2304504 - RNA, 14 nt, Human
uacugaaggaaaaa

SEQ ID NO: 2304505 - RNA, 18 nt, Human
uacugaaggaaaaacaca

SEQ ID NO: 2304506 - RNA, 19 nt, Human
uacugaaggaaaaacacaa

SEQ ID NO: 2304507 - RNA, 20 nt, Human
uacugaaggaaaaacacaag

SEQ ID NO: 2304508 - RNA, 23 nt, Human
uacugaaggaaaaacacaagcaa

SEQ ID NO: 2304509 - RNA, 19 nt, Human
uacuggugcagucauuaug

SEQ ID NO: 2304510 - RNA, 13 nt, Human
uacugacaugugg

SEQ ID NO: 2304511 - RNA, 20 nt, Human
uacugacauguggggccagg

SEQ ID NO: 2304512 - RNA, 17 nt, Human
uacugaagguaaaauug

SEQ ID NO: 2304513 - RNA, 23 nt, Human
uacugacacuuugccagaaagca

SEQ ID NO: 2304514 - RNA, 12 nt, Human
uacuguaaagaa

SEQ ID NO: 2304515 - RNA, 16 nt, Human
uacuguaaagaaagag

SEQ ID NO: 2304516 - RNA, 13 nt, Human
uacuguaaagaaa

SEQ ID NO: 2304517 - RNA, 20 nt, Human
uacuguaaagaaagagagaa

SEQ ID NO: 2304518 - RNA, 19 nt, Human
uacuguaaagaaagagaga

SEQ ID NO: 2304519 - RNA, 18 nt, Human
uacuguaaagaaagagag

SEQ ID NO: 2304520 - RNA, 17 nt, Human
uacuguaaagaaagaga

SEQ ID NO: 2304521 - RNA, 17 nt, Human
aauucuuacaaacaugu

SEQ ID NO: 2304522 - RNA, 13 nt, Human
aauucuuaaauau

SEQ ID NO: 2304523 - RNA, 13 nt, Human
aauucuuacaugu

SEQ ID NO: 2304524 - RNA, 16 nt, Human
aauucuuaaguauguu

SEQ ID NO: 2304525 - RNA, 15 nt, Human
aauucuuacauguuu

SEQ ID NO: 2304526 - RNA, 15 nt, Human
aauucuuaugcuuau

SEQ ID NO: 2304527 - RNA, 21 nt, Human
uacccugcgcccaguccuucc

SEQ ID NO: 2304528 - RNA, 23 nt, Human
uacccugcgcccaguccuuccac

SEQ ID NO: 2304529 - RNA, 18 nt, Human
uacccuggccgcccccug

SEQ ID NO: 2304530 - RNA, 20 nt, Human
uacccuuggcucaauccucu

SEQ ID NO: 2304531 - RNA, 20 nt, Human
uacccuuuagacuguagccu

SEQ ID NO: 2304532 - RNA, 17 nt, Human
uacccuuuuucuccagc

SEQ ID NO: 2304533 - RNA, 18 nt, Human
uacccuuuuucuccagcu

SEQ ID NO: 2304534 - RNA, 19 nt, Human
uacccuuuuucuccagcug

SEQ ID NO: 2304535 - RNA, 18 nt, Human
aauucuucagguggaaaa

SEQ ID NO: 2304536 - RNA, 11 nt, Human
aauucuucccu

SEQ ID NO: 2304537 - RNA, 21 nt, Human
aauucuucccuaucuuugcca

SEQ ID NO: 2304538 - RNA, 13 nt, Human
aauucuucugaac

SEQ ID NO: 2304539 - RNA, 22 nt, Human
aauucuucuccacuuucuagcc

SEQ ID NO: 2304540 - RNA, 15 nt, Human
aauucuugaaggaaa

SEQ ID NO: 2304541 - RNA, 18 nt, Human
aauucuucugaacucaaa

SEQ ID NO: 2304542 - RNA, 15 nt, Human
aauucuucugaacuc

SEQ ID NO: 2304543 - RNA, 16 nt, Human
aauucuugaaggaaaa

SEQ ID NO: 2304544 - RNA, 21 nt, Human
aauucuugaaggaaaaugaua

SEQ ID NO: 2304545 - RNA, 21 nt, Human
aauucuugccaaauauaaaua

SEQ ID NO: 2304546 - RNA, 20 nt, Human
aauucuugcaaaguaucccu

SEQ ID NO: 2304547 - RNA, 14 nt, Human
aauucuugcaaagu

SEQ ID NO: 2304548 - RNA, 23 nt, Human
aauucuucugaacucaaacugag

SEQ ID NO: 2304549 - RNA, 15 nt, Human
aauucuuggaauacu

SEQ ID NO: 2304550 - RNA, 13 nt, Human
aauucuuggaaua

SEQ ID NO: 2304551 - RNA, 14 nt, Human
aauucuuguauauu

SEQ ID NO: 2304552 - RNA, 20 nt, Human
aauucuugguugaggaaaca

SEQ ID NO: 2304553 - RNA, 19 nt, Human
aauucuugguugaggaaac

SEQ ID NO: 2304554 - RNA, 18 nt, Human
aauucuugguugaggaaa

SEQ ID NO: 2304555 - RNA, 20 nt, Human
aauucuuguauauuauggaa

SEQ ID NO: 2304556 - RNA, 14 nt, Human
aauucuuuauacaa

SEQ ID NO: 2304557 - RNA, 19 nt, Human
aauucuuuauacaacagug

SEQ ID NO: 2304558 - RNA, 20 nt, Human
aauucuuuauacaacagugc

SEQ ID NO: 2304559 - RNA, 21 nt, Human
aauucuuuauacaacagugcu

SEQ ID NO: 2304560 - RNA, 22 nt, Human
aauucuuuauacaacagugcua

SEQ ID NO: 2304561 - RNA, 16 nt, Human
aauucuuguauauuau

SEQ ID NO: 2304562 - RNA, 15 nt, Human
aauucuuguauauua

SEQ ID NO: 2304563 - RNA, 13 nt, Human
aauucuuuauaca

SEQ ID NO: 2304564 - RNA, 22 nt, Human
aauucuuugaccuguugggagu

SEQ ID NO: 2304565 - RNA, 18 nt, Human
aauucuuugaccuguugg

SEQ ID NO: 2304566 - RNA, 21 nt, Human
aauugaacuuaaauaaauguc

SEQ ID NO: 2304567 - RNA, 21 nt, Human
aauugaaaggcauucucugaa

SEQ ID NO: 2304568 - RNA, 17 nt, Human
aauugaaaggcauucuc

SEQ ID NO: 2304569 - RNA, 22 nt, Human
aauugaaaggcauucucugaag

SEQ ID NO: 2304570 - RNA, 22 nt, Human
aauugaacuuaaauaaauguca

SEQ ID NO: 2304571 - RNA, 13 nt, Human
aauugacccacaa

SEQ ID NO: 2304572 - RNA, 15 nt, Human
uacguacacauuuua

SEQ ID NO: 2304573 - RNA, 19 nt, Human
aauugacccacaagaaaug

SEQ ID NO: 2304574 - RNA, 16 nt, Human
aauugacccacaagaa

SEQ ID NO: 2304575 - RNA, 20 nt, Human
aauuguuucaaaauaaaaac

SEQ ID NO: 2304576 - RNA, 15 nt, Human
aauuguuuaaguguu

SEQ ID NO: 2304577 - RNA, 23 nt, Human
aauuguuguuucuuucuaguggu

SEQ ID NO: 2304578 - RNA, 20 nt, Human
aauuguuuaaguguuguaaa

SEQ ID NO: 2304579 - RNA, 22 nt, Human
aauuguuuggggaugagaaagg

SEQ ID NO: 2304580 - RNA, 23 nt, Human
aauuguuguuuguauguauaauu

SEQ ID NO: 2304581 - RNA, 22 nt, Human
aauuguuguuuguauguauaau

SEQ ID NO: 2304582 - RNA, 21 nt, Human
aauuguuguuuguauguauaa

SEQ ID NO: 2304583 - RNA, 19 nt, Human
aauuguuguuuguauguau

SEQ ID NO: 2304584 - RNA, 17 nt, Human
aauuguuguuuguaugu

SEQ ID NO: 2304585 - RNA, 14 nt, Human
aauuguuguuugua

SEQ ID NO: 2304586 - RNA, 13 nt, Human
aauuguuguuugu

SEQ ID NO: 2304587 - RNA, 20 nt, Human
aauuguuguuucuuucuagu

SEQ ID NO: 2304588 - RNA, 21 nt, Human
aauuguuguuucuuucuagug

SEQ ID NO: 2304589 - RNA, 23 nt, Human
aauugugugugaugugaagccaa

SEQ ID NO: 2304590 - RNA, 23 nt, Human
aauuguugcuaaucuucuuaugc

SEQ ID NO: 2304591 - RNA, 12 nt, Human
aauuguuguuuc

SEQ ID NO: 2304592 - RNA, 13 nt, Human
aauuguuguuucu

SEQ ID NO: 2304593 - RNA, 15 nt, Human
aauuguuguuucuuu

SEQ ID NO: 2304594 - RNA, 17 nt, Human
aauuguuguuucuuucu

SEQ ID NO: 2304595 - RNA, 18 nt, Human
aauuguuguuucuuucua

SEQ ID NO: 2304596 - RNA, 19 nt, Human
aauuguuguuucuuucuag

SEQ ID NO: 2304597 - RNA, 12 nt, Human
aauugcuccuug

SEQ ID NO: 2304598 - RNA, 20 nt, Human
aauugcuccuaagcuucaaa

SEQ ID NO: 2304599 - RNA, 23 nt, Human
aauugcuauguuuugacauuuuu

SEQ ID NO: 2304600 - RNA, 20 nt, Human
uacuguaaagagaccuaccu

SEQ ID NO: 2304601 - RNA, 11 nt, Human
uacuguaacac

SEQ ID NO: 2304602 - RNA, 18 nt, Human
uacuguaacacuuuacaa

SEQ ID NO: 2304603 - RNA, 23 nt, Human
uacuguaaagaaagagagaaaau

SEQ ID NO: 2304604 - RNA, 21 nt, Human
uacuguaaagaaagagagaaa

SEQ ID NO: 2304605 - RNA, 13 nt, Human
uacuguaagaaaa

SEQ ID NO: 2304606 - RNA, 23 nt, Human
aauugugugaaagguacuucaaa

SEQ ID NO: 2304607 - RNA, 12 nt, Human
aauugcugugcc

SEQ ID NO: 2304608 - RNA, 13 nt, Human
aauugcugugccu

SEQ ID NO: 2304609 - RNA, 22 nt, Human
aauugcugugccucccaaaauu

SEQ ID NO: 2304610 - RNA, 18 nt, Human
aauugcuguguaucugau

SEQ ID NO: 2304611 - RNA, 13 nt, Human
aauugcuguguau

SEQ ID NO: 2304612 - RNA, 15 nt, Human
aauugcuuacauuuu

SEQ ID NO: 2304613 - RNA, 20 nt, Human
aauugcuuacauuuuuacaa

SEQ ID NO: 2304614 - RNA, 21 nt, Human
aauugcuuacauuuuuacaau

SEQ ID NO: 2304615 - RNA, 16 nt, Human
aauuguuugucuuuaa

SEQ ID NO: 2304616 - RNA, 13 nt, Human
aauuuaaaaaaua

SEQ ID NO: 2304617 - RNA, 16 nt, Human
aauuguuuugcacuuu

SEQ ID NO: 2304618 - RNA, 17 nt, Human
aauuguuuugcacuuuu

SEQ ID NO: 2304619 - RNA, 20 nt, Human
aauuguuuugcacuuuuuua

SEQ ID NO: 2304620 - RNA, 14 nt, Human
aauuuaaaaaauaa

SEQ ID NO: 2304621 - RNA, 13 nt, Human
aauuuaaaagucu

SEQ ID NO: 2304622 - RNA, 12 nt, Human
aauuuaaagcaa

SEQ ID NO: 2304623 - RNA, 18 nt, Human
aauuuaaacccauuuuag

SEQ ID NO: 2304624 - RNA, 19 nt, Human
aauuuaaacccauuuuagu

SEQ ID NO: 2304625 - RNA, 18 nt, Human
aauuuaaaggguguacuu

SEQ ID NO: 2304626 - RNA, 9 nt, Human
aauuuaaac

SEQ ID NO: 2304627 - RNA, 10 nt, Human
aauuuaaaca

SEQ ID NO: 2304628 - RNA, 15 nt, Human
aauuuaaacaccucc

SEQ ID NO: 2304629 - RNA, 19 nt, Human
aauuuaaacaccuccucau

SEQ ID NO: 2304630 - RNA, 11 nt, Human
aauuuaaacag

SEQ ID NO: 2304631 - RNA, 18 nt, Human
aauuuaaacaggcccagc

SEQ ID NO: 2304632 - RNA, 20 nt, Human
aauuuaaacaggcccagcau

SEQ ID NO: 2304633 - RNA, 19 nt, Human
aauuuaaacaggcccagca

SEQ ID NO: 2304634 - RNA, 17 nt, Human
aauuuaaacccauuuua

SEQ ID NO: 2304635 - RNA, 18 nt, Human
aauuuaauucauguuucu

SEQ ID NO: 2304636 - RNA, 21 nt, Human
aauuuaauuagggguugcuaa

SEQ ID NO: 2304637 - RNA, 14 nt, Human
aauuuaauauagcu

SEQ ID NO: 2304638 - RNA, 14 nt, Human
aauuuaaugcaugu

SEQ ID NO: 2304639 - RNA, 20 nt, Human
aauuuaagugcguguguaga

SEQ ID NO: 2304640 - RNA, 14 nt, Human
aauuuaaauauaau

SEQ ID NO: 2304641 - RNA, 23 nt, Human
aauuuaagugcguguguagaguu

SEQ ID NO: 2304642 - RNA, 22 nt, Human
aauuuaaaggguguacuuauau

SEQ ID NO: 2304643 - RNA, 19 nt, Human
aauuuaaaggguguacuua

SEQ ID NO: 2304644 - RNA, 21 nt, Human
aauuuaaaggguguacuuaua

SEQ ID NO: 2304645 - RNA, 23 nt, Human
aauuuaauucauguuucuuaaau

SEQ ID NO: 2304646 - RNA, 19 nt, Human
aauuuaauucauguuucuu

SEQ ID NO: 2304647 - RNA, 16 nt, Human
aauuuacaaaaauaua

SEQ ID NO: 2304648 - RNA, 18 nt, Human
aauuuacaaaaauauaaa

SEQ ID NO: 2304649 - RNA, 21 nt, Human
aauuuacaaaaauauaaaaua

SEQ ID NO: 2304650 - RNA, 13 nt, Human
aauuuacaaagug

SEQ ID NO: 2304651 - RNA, 14 nt, Human
aauuuacaaagugu

SEQ ID NO: 2304652 - RNA, 17 nt, Human
aauuuacaaagugugua

SEQ ID NO: 2304653 - RNA, 19 nt, Human
aauuuacauacucugcuua

SEQ ID NO: 2304654 - RNA, 14 nt, Human
aauuuacauggcaa

SEQ ID NO: 2304655 - RNA, 15 nt, Human
aauuuacaaagugug

SEQ ID NO: 2304656 - RNA, 16 nt, Human
aauuuacaaagugugu

SEQ ID NO: 2304657 - RNA, 21 nt, Human
aauuugauaguauugugcaua

SEQ ID NO: 2304658 - RNA, 14 nt, Human
aauuugauaucaca

SEQ ID NO: 2304659 - RNA, 16 nt, Human
aauuugauaucacagu

SEQ ID NO: 2304660 - RNA, 20 nt, Human
aauuugaguuggaucaucua

SEQ ID NO: 2304661 - RNA, 14 nt, Human
aauuugaggacaac

SEQ ID NO: 2304662 - RNA, 21 nt, Human
aauuugauacauaugugaaua

SEQ ID NO: 2304663 - RNA, 20 nt, Human
aauuugauacauaugugaau

SEQ ID NO: 2304664 - RNA, 13 nt, Human
aauuugagugcuc

SEQ ID NO: 2304665 - RNA, 18 nt, Human
aauuugaucguuccaguu

SEQ ID NO: 2304666 - RNA, 18 nt, Human
aauuugauaucacagucu

SEQ ID NO: 2304667 - RNA, 20 nt, Human
uacuuauuuuugacaguguu

SEQ ID NO: 2304668 - RNA, 12 nt, Human
uacuucaaaagu

SEQ ID NO: 2304669 - RNA, 14 nt, Human
uacuucaaaaguau

SEQ ID NO: 2304670 - RNA, 16 nt, Human
uacuucaaaaguauuu

SEQ ID NO: 2304671 - RNA, 19 nt, Human
uacuucaaaaguauuuucc

SEQ ID NO: 2304672 - RNA, 14 nt, Human
uacuucaaauccuu

SEQ ID NO: 2304673 - RNA, 19 nt, Human
uacuucaaauccuugaaga

SEQ ID NO: 2304674 - RNA, 17 nt, Human
aauuugagauacaaaca

SEQ ID NO: 2304675 - RNA, 13 nt, Human
aauuugaggacaa

SEQ ID NO: 2304676 - RNA, 20 nt, Human
aauuugagagaaauaugaag

SEQ ID NO: 2304677 - RNA, 18 nt, Human
aauuugagagaaauauga

SEQ ID NO: 2304678 - RNA, 16 nt, Human
aauuugaaugaaaaau

SEQ ID NO: 2304679 - RNA, 15 nt, Human
aauuugaaugaaaaa

SEQ ID NO: 2304680 - RNA, 14 nt, Human
aauuugaaugaaaa

SEQ ID NO: 2304681 - RNA, 13 nt, Human
aauuugaaugaaa

SEQ ID NO: 2304682 - RNA, 12 nt, Human
aauuugaaugaa

SEQ ID NO: 2304683 - RNA, 15 nt, Human
aauuugaaacacuuu

SEQ ID NO: 2304684 - RNA, 13 nt, Human
aauuucuguccuu

SEQ ID NO: 2304685 - RNA, 14 nt, Human
aauuugaaauuuag

SEQ ID NO: 2304686 - RNA, 21 nt, Human
aauuucuguguugccaagcuc

SEQ ID NO: 2304687 - RNA, 20 nt, Human
aauuugaaacacuuugcaua

SEQ ID NO: 2304688 - RNA, 18 nt, Human
aauuuaucuugucucugg

SEQ ID NO: 2304689 - RNA, 19 nt, Human
aauuuaucuugucucuggg

SEQ ID NO: 2304690 - RNA, 20 nt, Human
aauuuaucuugucucugggc

SEQ ID NO: 2304691 - RNA, 23 nt, Human
aauuuauccugaaauuucagauu

SEQ ID NO: 2304692 - RNA, 19 nt, Human
aauuuauccugaaauuuca

SEQ ID NO: 2304693 - RNA, 18 nt, Human
aauuuauccugaaauuuc

SEQ ID NO: 2304694 - RNA, 20 nt, Human
aauuuagguuuuuauuagua

SEQ ID NO: 2304695 - RNA, 18 nt, Human
aauuuagguuuuuauuag

SEQ ID NO: 2304696 - RNA, 17 nt, Human
aauuuagaaauauaauu

SEQ ID NO: 2304697 - RNA, 15 nt, Human
aauuuaccugaaguc

SEQ ID NO: 2304698 - RNA, 22 nt, Human
aauuucuaaaaaacagaggcca

SEQ ID NO: 2304699 - RNA, 18 nt, Human
aauuucuaccauuucaga

SEQ ID NO: 2304700 - RNA, 16 nt, Human
aauuucuaccauuuca

SEQ ID NO: 2304701 - RNA, 17 nt, Human
aauuucuacuuugaagu

SEQ ID NO: 2304702 - RNA, 16 nt, Human
aauuucuacuuugaag

SEQ ID NO: 2304703 - RNA, 15 nt, Human
aauuucuacuuugaa

SEQ ID NO: 2304704 - RNA, 11 nt, Human
aauuucucccc

SEQ ID NO: 2304705 - RNA, 12 nt, Human
aauuucucccca

SEQ ID NO: 2304706 - RNA, 13 nt, Human
aauuucuccccag

SEQ ID NO: 2304707 - RNA, 19 nt, Human
aauuucuccccagggugga

SEQ ID NO: 2304708 - RNA, 12 nt, Human
aauuucuccucc

SEQ ID NO: 2304709 - RNA, 14 nt, Human
aauuucuccucccu

SEQ ID NO: 2304710 - RNA, 20 nt, Human
aauuucuccucccuuccuuu

SEQ ID NO: 2304711 - RNA, 20 nt, Human
aauuucucccagucauuuaa

SEQ ID NO: 2304712 - RNA, 20 nt, Human
aauuuaugaguuuuugauag

SEQ ID NO: 2304713 - RNA, 19 nt, Human
aauuuaugaguuuuugaua

SEQ ID NO: 2304714 - RNA, 14 nt, Human
aauuuaugugaugg

SEQ ID NO: 2304715 - RNA, 16 nt, Human
aauuuaugaguuuuug

SEQ ID NO: 2304716 - RNA, 23 nt, Human
aauuuaugaauugaauuaucuug

SEQ ID NO: 2304717 - RNA, 21 nt, Human
aauuuaugaauugaauuaucu

SEQ ID NO: 2304718 - RNA, 21 nt, Human
aauuucuaaaucuccaaaaua

SEQ ID NO: 2304719 - RNA, 13 nt, Human
aauuucuaaaucu

SEQ ID NO: 2304720 - RNA, 13 nt, Human
acaaaaaaaucug

SEQ ID NO: 2304721 - RNA, 20 nt, Human
acaaaaaaauauauuuaaug

SEQ ID NO: 2304722 - RNA, 21 nt, Human
acaaaaacagccucacagaag

SEQ ID NO: 2304723 - RNA, 15 nt, Human
acaaaaacagccuca

SEQ ID NO: 2304724 - RNA, 19 nt, Human
acaaaaaaaucugcagaag

SEQ ID NO: 2304725 - RNA, 16 nt, Human
acaaaaaaaucugcag

SEQ ID NO: 2304726 - RNA, 18 nt, Human
acaaaaaaaucugcagaa

SEQ ID NO: 2304727 - RNA, 13 nt, Human
acaaaaacauggc

SEQ ID NO: 2304728 - RNA, 21 nt, Human
aauuuuuuucaucuucucugg

SEQ ID NO: 2304729 - RNA, 20 nt, Human
aauuuuuuuccuuaccuuuu

SEQ ID NO: 2304730 - RNA, 19 nt, Human
aauuuuuuuauuguuuaaa

SEQ ID NO: 2304731 - RNA, 16 nt, Human
aauuuuuuucugcaac

SEQ ID NO: 2304732 - RNA, 17 nt, Human
aauuuuuuugagacaga

SEQ ID NO: 2304733 - RNA, 19 nt, Human
acaaaaaaaaaguuuuauu

SEQ ID NO: 2304734 - RNA, 21 nt, Human
acaaaaaaaaaguuuuauuuu

SEQ ID NO: 2304735 - RNA, 22 nt, Human
acaaaaaaaaaguuuuauuuuu

SEQ ID NO: 2304736 - RNA, 17 nt, Human
acaaaaaaaaaguuuua

SEQ ID NO: 2304737 - RNA, 13 nt, Human
acaaaaaaauaua

SEQ ID NO: 2304738 - RNA, 17 nt, Human
acaaaaaaauauauuua

SEQ ID NO: 2304739 - RNA, 15 nt, Human
aauuuuuuuauuacu

SEQ ID NO: 2304740 - RNA, 17 nt, Human
aauuuuuuuauuacuga

SEQ ID NO: 2304741 - RNA, 19 nt, Human
aauuuuuuucaauauuuau

SEQ ID NO: 2304742 - RNA, 15 nt, Human
aauuuuuuucaauau

SEQ ID NO: 2304743 - RNA, 16 nt, Human
aauuuuuuuauuguuu

SEQ ID NO: 2304744 - RNA, 18 nt, Human
aauuuuuuuauuguuuaa

SEQ ID NO: 2304745 - RNA, 20 nt, Human
aauuuuuuaucaugcauguc

SEQ ID NO: 2304746 - RNA, 18 nt, Human
aauuuuuuaucaugcaug

SEQ ID NO: 2304747 - RNA, 19 nt, Human
aauuuuuucucuaggaaau

SEQ ID NO: 2304748 - RNA, 14 nt, Human
aauuuuuguauuuu

SEQ ID NO: 2304749 - RNA, 16 nt, Human
aauuuuucugcacuga

SEQ ID NO: 2304750 - RNA, 23 nt, Human
aauuuuucugcacugagcagagu

SEQ ID NO: 2304751 - RNA, 20 nt, Human
aauuuuucucuaacucagaa

SEQ ID NO: 2304752 - RNA, 22 nt, Human
aauuuuucucuaacucagaaac

SEQ ID NO: 2304753 - RNA, 12 nt, Human
aauuuuucugca

SEQ ID NO: 2304754 - RNA, 23 nt, Human
aauuuuucauugauaugaaaaau

SEQ ID NO: 2304755 - RNA, 20 nt, Human
aauuuuucauugauaugaaa

SEQ ID NO: 2304756 - RNA, 19 nt, Human
aauuuuucagaugcuucug

SEQ ID NO: 2304757 - RNA, 18 nt, Human
aauuuuuauuaaauuaug

SEQ ID NO: 2304758 - RNA, 17 nt, Human
aauuuuuauuaaauuau

SEQ ID NO: 2304759 - RNA, 15 nt, Human
aauuuuucagaugcu

SEQ ID NO: 2304760 - RNA, 15 nt, Human
aauuuuuauuuuucu

SEQ ID NO: 2304761 - RNA, 16 nt, Human
aauuuuuauuuuucua

SEQ ID NO: 2304762 - RNA, 15 nt, Human
aauuuuuauucauaa

SEQ ID NO: 2304763 - RNA, 16 nt, Human
aauuuuuauucauaag

SEQ ID NO: 2304764 - RNA, 16 nt, Human
aauuuuuauuauuugu

SEQ ID NO: 2304765 - RNA, 21 nt, Human
aauuuuuauuauuuguuuucc

SEQ ID NO: 2304766 - RNA, 13 nt, Human
aauuuuuauucau

SEQ ID NO: 2304767 - RNA, 17 nt, Human
aauuuuaaauaaaagug

SEQ ID NO: 2304768 - RNA, 14 nt, Human
aauuuuaaacaaag

SEQ ID NO: 2304769 - RNA, 22 nt, Human
aauuuuaaauaaaagugaucaa

SEQ ID NO: 2304770 - RNA, 18 nt, Human
aauuuuaaauaaaaguga

SEQ ID NO: 2304771 - RNA, 19 nt, Human
aauuuuaaccuaugauauu

SEQ ID NO: 2304772 - RNA, 17 nt, Human
aauuuuaaacaaagguu

SEQ ID NO: 2304773 - RNA, 12 nt, Human
aauuuuaaauua

SEQ ID NO: 2304774 - RNA, 19 nt, Human
aauuuuuauauuugaaaua

SEQ ID NO: 2304775 - RNA, 17 nt, Human
aauuuguuugugcuucu

SEQ ID NO: 2304776 - RNA, 20 nt, Human
aauuuguaucugaaggagau

SEQ ID NO: 2304777 - RNA, 22 nt, Human
aauuuguaucugaaggagauuu

SEQ ID NO: 2304778 - RNA, 18 nt, Human
aauuuguuugugcuucua

SEQ ID NO: 2304779 - RNA, 14 nt, Human
aauuuuaaaaauga

SEQ ID NO: 2304780 - RNA, 21 nt, Human
aauuuuaaaaaugaauccuac

SEQ ID NO: 2304781 - RNA, 17 nt, Human
aauuuuaaaaaugaauc

SEQ ID NO: 2304782 - RNA, 12 nt, Human
aauuuguaucug

SEQ ID NO: 2304783 - RNA, 14 nt, Human
aauuuguaucugaa

SEQ ID NO: 2304784 - RNA, 15 nt, Human
aauuuguaucugaag

SEQ ID NO: 2304785 - RNA, 17 nt, Human
aauuuguaucugaagga

SEQ ID NO: 2304786 - RNA, 18 nt, Human
aauuuguaucugaaggag

SEQ ID NO: 2304787 - RNA, 19 nt, Human
aauuuguaucugaaggaga

SEQ ID NO: 2304788 - RNA, 20 nt, Human
aauuuguacauauguaaaau

SEQ ID NO: 2304789 - RNA, 19 nt, Human
aauuuguaauugcuuacau

SEQ ID NO: 2304790 - RNA, 15 nt, Human
aauuuguaauugcuu

SEQ ID NO: 2304791 - RNA, 22 nt, Human
uagacaguaugagucaaugugc

SEQ ID NO: 2304792 - RNA, 15 nt, Human
aauuuguaaccucag

SEQ ID NO: 2304793 - RNA, 16 nt, Human
aauuuguaaccucagc

SEQ ID NO: 2304794 - RNA, 13 nt, Human
aauuuguaaguuu

SEQ ID NO: 2304795 - RNA, 14 nt, Human
aauuuguaaguuua

SEQ ID NO: 2304796 - RNA, 15 nt, Human
aauuuguaaguuuau

SEQ ID NO: 2304797 - RNA, 14 nt, Human
aauuuguaaguuuc

SEQ ID NO: 2304798 - RNA, 16 nt, Human
aauuuguaaguuucag

SEQ ID NO: 2304799 - RNA, 18 nt, Human
aauuuguaaguuucaggu

SEQ ID NO: 2304800 - RNA, 19 nt, Human
aauuuguaaguuucaggug

SEQ ID NO: 2304801 - RNA, 23 nt, Human
aauuuguaaguuucaggugacau

SEQ ID NO: 2304802 - RNA, 12 nt, Human
uagacagucccu

SEQ ID NO: 2304803 - RNA, 14 nt, Human
uagacagucccugc

SEQ ID NO: 2304804 - RNA, 22 nt, Human
uagacaaguccagccuggcaag

SEQ ID NO: 2304805 - RNA, 16 nt, Human
uagacaauuuauuaug

SEQ ID NO: 2304806 - RNA, 21 nt, Human
uagacagagucucacuguugc

SEQ ID NO: 2304807 - RNA, 15 nt, Human
uagaauuuauucaau

SEQ ID NO: 2304808 - RNA, 19 nt, Human
uagaauuggcugaacucau

SEQ ID NO: 2304809 - RNA, 20 nt, Human
uagaauuuauucaauuccuc

SEQ ID NO: 2304810 - RNA, 22 nt, Human
uagaauuuauucaauuccucug

SEQ ID NO: 2304811 - RNA, 13 nt, Human
uagaauugcauug

SEQ ID NO: 2304812 - RNA, 15 nt, Human
uagaauugcauugac

SEQ ID NO: 2304813 - RNA, 14 nt, Human
uagaauugcauuga

SEQ ID NO: 2304814 - RNA, 15 nt, Human
uagacaacccugcaa

SEQ ID NO: 2304815 - RNA, 19 nt, Human
uagacaaauauuuggaggg

SEQ ID NO: 2304816 - RNA, 23 nt, Human
uagaauuuauucaauuccucugg

SEQ ID NO: 2304817 - RNA, 17 nt, Human
uagaagucuuagaugua

SEQ ID NO: 2304818 - RNA, 16 nt, Human
uagaagucuuagaugu

SEQ ID NO: 2304819 - RNA, 16 nt, Human
uagaagucacacagua

SEQ ID NO: 2304820 - RNA, 22 nt, Human
uagaagccccguuauaacuccu

SEQ ID NO: 2304821 - RNA, 16 nt, Human
uagaagccaagggaaa

SEQ ID NO: 2304822 - RNA, 19 nt, Human
uagaagccaagggaaaggg

SEQ ID NO: 2304823 - RNA, 19 nt, Human
uagaagucuuagauguaua

SEQ ID NO: 2304824 - RNA, 18 nt, Human
uagaagucuuagauguau

SEQ ID NO: 2304825 - RNA, 20 nt, Human
uagaagucuuagauguauau

SEQ ID NO: 2304826 - RNA, 14 nt, Human
uagaagcuggagga

SEQ ID NO: 2304827 - RNA, 18 nt, Human
uagaagauggcacuuaua

SEQ ID NO: 2304828 - RNA, 16 nt, Human
uagaagauccuacccc

SEQ ID NO: 2304829 - RNA, 21 nt, Human
uagaagacucuaccagacugu

SEQ ID NO: 2304830 - RNA, 23 nt, Human
uagaagauauuagucuuggggca

SEQ ID NO: 2304831 - RNA, 21 nt, Human
uagaacuugcagcugauguug

SEQ ID NO: 2304832 - RNA, 20 nt, Human
uagaagacucuaccagacug

SEQ ID NO: 2304833 - RNA, 15 nt, Human
uagaagucacacagu

SEQ ID NO: 2304834 - RNA, 14 nt, Human
uagaagcauuccuu

SEQ ID NO: 2304835 - RNA, 20 nt, Human
uagaagcauuccuucuuuga

SEQ ID NO: 2304836 - RNA, 21 nt, Human
uagaagcauuccuucuuugau

SEQ ID NO: 2304837 - RNA, 22 nt, Human
uagaagcauuccuucuuugaua

SEQ ID NO: 2304838 - RNA, 23 nt, Human
uagaagcauuccuucuuugauaa

SEQ ID NO: 2304839 - RNA, 12 nt, Human
uagaagccaagg

SEQ ID NO: 2304840 - RNA, 15 nt, Human
uagaagccaagggaa

SEQ ID NO: 2304841 - RNA, 23 nt, Human
uagaacucuccaucuuauuuuca

SEQ ID NO: 2304842 - RNA, 19 nt, Human
uagaacucugaaaugaaga

SEQ ID NO: 2304843 - RNA, 22 nt, Human
uagaacuggagaggcuagaacc

SEQ ID NO: 2304844 - RNA, 19 nt, Human
uagaacuguaugucagaca

SEQ ID NO: 2304845 - RNA, 16 nt, Human
uagaacuugacccccu

SEQ ID NO: 2304846 - RNA, 20 nt, Human
uagaacuguaugucagacau

SEQ ID NO: 2304847 - RNA, 19 nt, Human
uagaacuuuaagcaacaag

SEQ ID NO: 2304848 - RNA, 22 nt, Human
uagaacuuggauguaccugccc

SEQ ID NO: 2304849 - RNA, 16 nt, Human
uagaaccuggaagggc

SEQ ID NO: 2304850 - RNA, 17 nt, Human
uagaaccuggaagggcu

SEQ ID NO: 2304851 - RNA, 22 nt, Human
uagaaccuggagggcuagaacc

SEQ ID NO: 2304852 - RNA, 17 nt, Human
uagaaccuggagggcug

SEQ ID NO: 2304853 - RNA, 23 nt, Human
uagaaccuggaagggcuagaacc

SEQ ID NO: 2304854 - RNA, 13 nt, Human
uagaaccuggaga

SEQ ID NO: 2304855 - RNA, 22 nt, Human
uagaaccuggagagcuagaacc

SEQ ID NO: 2304856 - RNA, 13 nt, Human
uagaaccuggagg

SEQ ID NO: 2304857 - RNA, 19 nt, Human
uagaacucaguuuuaacua

SEQ ID NO: 2304858 - RNA, 22 nt, Human
uagaacucaguuuuaacuagaa

SEQ ID NO: 2304859 - RNA, 15 nt, Human
uagaacucccuuuca

SEQ ID NO: 2304860 - RNA, 21 nt, Human
uacuucaaguuaaagugaaua

SEQ ID NO: 2304861 - RNA, 14 nt, Human
uacuucacugucag

SEQ ID NO: 2304862 - RNA, 19 nt, Human
uacuucacugucaggaaga

SEQ ID NO: 2304863 - RNA, 15 nt, Human
uacuucacuuuaauu

SEQ ID NO: 2304864 - RNA, 22 nt, Human
uacuucacuuuaauucucaugu

SEQ ID NO: 2304865 - RNA, 16 nt, Human
uacuucaugcugucua

SEQ ID NO: 2304866 - RNA, 16 nt, Human
uacuucacuuuaauuc

SEQ ID NO: 2304867 - RNA, 19 nt, Human
uacuucacuuuaauucuca

SEQ ID NO: 2304868 - RNA, 19 nt, Human
uacuucaggggcacuucau

SEQ ID NO: 2304869 - RNA, 22 nt, Human
uacuucaggggcacuucauuga

SEQ ID NO: 2304870 - RNA, 23 nt, Human
uacuucaaguuaaagugaauaac

SEQ ID NO: 2304871 - RNA, 18 nt, Human
uacuucaaguuaaaguga

SEQ ID NO: 2304872 - RNA, 23 nt, Human
uacuucaaaaguauuuuccugua

SEQ ID NO: 2304873 - RNA, 21 nt, Human
uacuucaaauccuugaagauu

SEQ ID NO: 2304874 - RNA, 18 nt, Human
uagaggaaaaaaaugacu

SEQ ID NO: 2304875 - RNA, 17 nt, Human
uagaggaaaaaaaugac

SEQ ID NO: 2304876 - RNA, 20 nt, Human
uagagcuguauuaagccacu

SEQ ID NO: 2304877 - RNA, 19 nt, Human
uagagcugauccagagcac

SEQ ID NO: 2304878 - RNA, 17 nt, Human
uagagcuuucaaguaca

SEQ ID NO: 2304879 - RNA, 15 nt, Human
uagagcuucuggcac

SEQ ID NO: 2304880 - RNA, 21 nt, Human
uagagccaggcacacacugug

SEQ ID NO: 2304881 - RNA, 14 nt, Human
uagagcugauccag

SEQ ID NO: 2304882 - RNA, 15 nt, Human
uagagcugauccaga

SEQ ID NO: 2304883 - RNA, 18 nt, Human
uagagcugauccagagca

SEQ ID NO: 2304884 - RNA, 17 nt, Human
uagagcaguuucugucc

SEQ ID NO: 2304885 - RNA, 23 nt, Human
uagagcagggauuaaccucugca

SEQ ID NO: 2304886 - RNA, 22 nt, Human
uagagcaguuucuguccugcug

SEQ ID NO: 2304887 - RNA, 19 nt, Human
uagagcauugaauuggaga

SEQ ID NO: 2304888 - RNA, 15 nt, Human
uagagcauugccauu

SEQ ID NO: 2304889 - RNA, 16 nt, Human
uagagcauugccauuc

SEQ ID NO: 2304890 - RNA, 23 nt, Human
uagagcugacacaaaccugccug

SEQ ID NO: 2304891 - RNA, 15 nt, Human
uagagccaggcacac

SEQ ID NO: 2304892 - RNA, 19 nt, Human
uagagccaggcacacacug

SEQ ID NO: 2304893 - RNA, 19 nt, Human
uagagcauugccauucccu

SEQ ID NO: 2304894 - RNA, 12 nt, Human
uagagccaggca

SEQ ID NO: 2304895 - RNA, 14 nt, Human
uagagccaggcaca

SEQ ID NO: 2304896 - RNA, 19 nt, Human
uagagcagaugaccccucc

SEQ ID NO: 2304897 - RNA, 14 nt, Human
uagagcagcccugg

SEQ ID NO: 2304898 - RNA, 19 nt, Human
uagagcagcccuggaguca

SEQ ID NO: 2304899 - RNA, 11 nt, Human
uagagcaggcg

SEQ ID NO: 2304900 - RNA, 20 nt, Human
uagagcaggcguucagcuca

SEQ ID NO: 2304901 - RNA, 22 nt, Human
uagagcaggcguucagcucacu

SEQ ID NO: 2304902 - RNA, 16 nt, Human
acaaaaagaacaaaaa

SEQ ID NO: 2304903 - RNA, 16 nt, Human
acaaaaagcauaaaaa

SEQ ID NO: 2304904 - RNA, 22 nt, Human
uagaggaaaaaaaugacuaaaa

SEQ ID NO: 2304905 - RNA, 19 nt, Human
uagaggaaauaagaaaaau

SEQ ID NO: 2304906 - RNA, 16 nt, Human
uagaucacgagaucaa

SEQ ID NO: 2304907 - RNA, 16 nt, Human
uagaucaccagaauaa

SEQ ID NO: 2304908 - RNA, 17 nt, Human
uagaucacgagaucaag

SEQ ID NO: 2304909 - RNA, 20 nt, Human
uagaggaaauaagaaaaauc

SEQ ID NO: 2304910 - RNA, 13 nt, Human
uagaucaaauacu

SEQ ID NO: 2304911 - RNA, 14 nt, Human
uagaucaaauacuu

SEQ ID NO: 2304912 - RNA, 17 nt, Human
uagaucaaauacuuuaa

SEQ ID NO: 2304913 - RNA, 23 nt, Human
uagaucaaauacuuuaaaggaaa

SEQ ID NO: 2304914 - RNA, 16 nt, Human
uagaugcaguucugaa

SEQ ID NO: 2304915 - RNA, 17 nt, Human
uagaugcaguucugaag

SEQ ID NO: 2304916 - RNA, 19 nt, Human
uagaugcaguucugaagaa

SEQ ID NO: 2304917 - RNA, 22 nt, Human
uagauuuuagacccuauugcug

SEQ ID NO: 2304918 - RNA, 14 nt, Human
uagaucaugaagaa

SEQ ID NO: 2304919 - RNA, 13 nt, Human
uagauuuuccaaa

SEQ ID NO: 2304920 - RNA, 12 nt, Human
uagauuuuccaa

SEQ ID NO: 2304921 - RNA, 14 nt, Human
uagauuuucuuuaa

SEQ ID NO: 2304922 - RNA, 15 nt, Human
uagauuuucuuuaaa

SEQ ID NO: 2304923 - RNA, 16 nt, Human
uagauuuucuuuaaaa

SEQ ID NO: 2304924 - RNA, 19 nt, Human
uagauuuucuuuaaaagaa

SEQ ID NO: 2304925 - RNA, 16 nt, Human
uagcacagacccugcc

SEQ ID NO: 2304926 - RNA, 17 nt, Human
uagcacagacccugccc

SEQ ID NO: 2304927 - RNA, 18 nt, Human
uagcacagacccugcccu

SEQ ID NO: 2304928 - RNA, 19 nt, Human
uagcacagacccugcccug

SEQ ID NO: 2304929 - RNA, 22 nt, Human
uagcauguguuugguucugggg

SEQ ID NO: 2304930 - RNA, 21 nt, Human
uagcauguguuugguucuggg

SEQ ID NO: 2304931 - RNA, 18 nt, Human
uagcacaggggggccgcc

SEQ ID NO: 2304932 - RNA, 16 nt, Human
uagcaccagggaaggg

SEQ ID NO: 2304933 - RNA, 18 nt, Human
uagcaugucgucaaagcu

SEQ ID NO: 2304934 - RNA, 21 nt, Human
uagcaugucgucaaagcugaa

SEQ ID NO: 2304935 - RNA, 15 nt, Human
uagauuuuguuuugc

SEQ ID NO: 2304936 - RNA, 14 nt, Human
uagcaccagggaag

SEQ ID NO: 2304937 - RNA, 13 nt, Human
uagcaccagggaa

SEQ ID NO: 2304938 - RNA, 13 nt, Human
acaacaagaguuu

SEQ ID NO: 2304939 - RNA, 14 nt, Human
acaacacacacacu

SEQ ID NO: 2304940 - RNA, 12 nt, Human
acaacacucaca

SEQ ID NO: 2304941 - RNA, 15 nt, Human
acaacaaccugguca

SEQ ID NO: 2304942 - RNA, 18 nt, Human
acaaauucugucucugga

SEQ ID NO: 2304943 - RNA, 15 nt, Human
acaacaacaaaauga

SEQ ID NO: 2304944 - RNA, 23 nt, Human
acaagaaggguuuuccacccugg

SEQ ID NO: 2304945 - RNA, 20 nt, Human
acaagaagccacagaccuag

SEQ ID NO: 2304946 - RNA, 15 nt, Human
acaagaacugaaacc

SEQ ID NO: 2304947 - RNA, 18 nt, Human
acaagaaauuugauuucu

SEQ ID NO: 2304948 - RNA, 14 nt, Human
acaagaagaagggc

SEQ ID NO: 2304949 - RNA, 13 nt, Human
acaagaagaccag

SEQ ID NO: 2304950 - RNA, 22 nt, Human
acaagaaaugaaagcagggacu

SEQ ID NO: 2304951 - RNA, 20 nt, Human
acaaauuagguuuuguacaa

SEQ ID NO: 2304952 - RNA, 22 nt, Human
acaaauuagaaaauguuauuua

SEQ ID NO: 2304953 - RNA, 22 nt, Human
acaaauuauguuacaucuguuu

SEQ ID NO: 2304954 - RNA, 17 nt, Human
acaaauuauuaaugaaa

SEQ ID NO: 2304955 - RNA, 17 nt, Human
acaaauucauauucugu

SEQ ID NO: 2304956 - RNA, 22 nt, Human
acaaauguguaucggaugcuuu

SEQ ID NO: 2304957 - RNA, 13 nt, Human
uagcauuucuuga

SEQ ID NO: 2304958 - RNA, 16 nt, Human
uagcauuucuugaugu

SEQ ID NO: 2304959 - RNA, 22 nt, Human
uagcauuuaguccaaugucuuu

SEQ ID NO: 2304960 - RNA, 20 nt, Human
uagcauugugaacugacagg

SEQ ID NO: 2304961 - RNA, 13 nt, Human
uagcauuucauuc

SEQ ID NO: 2304962 - RNA, 15 nt, Human
uagcauuucauucuu

SEQ ID NO: 2304963 - RNA, 16 nt, Human
uagcauuucauucuuc

SEQ ID NO: 2304964 - RNA, 17 nt, Human
uagcauuucauucuucu

SEQ ID NO: 2304965 - RNA, 18 nt, Human
uagcauuucauucuucuc

SEQ ID NO: 2304966 - RNA, 12 nt, Human
uagcauuucuug

SEQ ID NO: 2304967 - RNA, 16 nt, Human
uagcauuaacuaaucu

SEQ ID NO: 2304968 - RNA, 20 nt, Human
uagcauguugagccaggccu

SEQ ID NO: 2304969 - RNA, 13 nt, Human
uagcauguuugcu

SEQ ID NO: 2304970 - RNA, 16 nt, Human
uagcauguuugcugaa

SEQ ID NO: 2304971 - RNA, 12 nt, Human
uagcauuaacua

SEQ ID NO: 2304972 - RNA, 17 nt, Human
uagcauguuugcugaac

SEQ ID NO: 2304973 - RNA, 13 nt, Human
acaagcaagcucc

SEQ ID NO: 2304974 - RNA, 15 nt, Human
acaagcaagcuccca

SEQ ID NO: 2304975 - RNA, 20 nt, Human
acaagagcccagcagggccu

SEQ ID NO: 2304976 - RNA, 13 nt, Human
acaagagcccagc

SEQ ID NO: 2304977 - RNA, 22 nt, Human
acaagcaauuagacaagaacuu

SEQ ID NO: 2304978 - RNA, 11 nt, Human
acaagcagagg

SEQ ID NO: 2304979 - RNA, 21 nt, Human
acaagcauucugucuugaagg

SEQ ID NO: 2304980 - RNA, 18 nt, Human
acaagcacuaaacaaaga

SEQ ID NO: 2304981 - RNA, 18 nt, Human
acaagagcagccuguggc

SEQ ID NO: 2304982 - RNA, 16 nt, Human
acaagagcagccugug

SEQ ID NO: 2304983 - RNA, 15 nt, Human
acaagagcagccugu

SEQ ID NO: 2304984 - RNA, 14 nt, Human
acaagagcagccug

SEQ ID NO: 2304985 - RNA, 21 nt, Human
acaagagcacuacauucauuu

SEQ ID NO: 2304986 - RNA, 15 nt, Human
acaagagcacuacau

SEQ ID NO: 2304987 - RNA, 20 nt, Human
acaagagcagccuguggcau

SEQ ID NO: 2304988 - RNA, 19 nt, Human
acaagagcagccuguggca

SEQ ID NO: 2304989 - RNA, 18 nt, Human
acaagagcccaggccucc

SEQ ID NO: 2304990 - RNA, 17 nt, Human
acaagagcccaggccuc

SEQ ID NO: 2304991 - RNA, 13 nt, Human
acaagccagcugg

SEQ ID NO: 2304992 - RNA, 15 nt, Human
acaagccagcuggag

SEQ ID NO: 2304993 - RNA, 15 nt, Human
acaagccccaggcag

SEQ ID NO: 2304994 - RNA, 14 nt, Human
acaagccccaggca

SEQ ID NO: 2304995 - RNA, 12 nt, Human
acaagccacccc

SEQ ID NO: 2304996 - RNA, 18 nt, Human
acaagccacgaaugaaug

SEQ ID NO: 2304997 - RNA, 18 nt, Human
acaagccacagaagccag

SEQ ID NO: 2304998 - RNA, 12 nt, Human
acaagccacaga

SEQ ID NO: 2304999 - RNA, 13 nt, Human
acaagccacagaa

SEQ ID NO: 2305000 - RNA, 14 nt, Human
acaagccaacuugu

SEQ ID NO: 2305001 - RNA, 21 nt, Human
acaagccaacuuguaaauaca

SEQ ID NO: 2305002 - RNA, 20 nt, Human
acaagcgugagccacugcac

SEQ ID NO: 2305003 - RNA, 21 nt, Human
acaagcgugagccacugcacc

SEQ ID NO: 2305004 - RNA, 18 nt, Human
acaagcgugagccacugc

SEQ ID NO: 2305005 - RNA, 14 nt, Human
acaagcuaaaauua

SEQ ID NO: 2305006 - RNA, 13 nt, Human
acaagcugcaccc

SEQ ID NO: 2305007 - RNA, 12 nt, Human
uaauguauuuua

SEQ ID NO: 2305008 - RNA, 19 nt, Human
uaauguauuuuauuguaac

SEQ ID NO: 2305009 - RNA, 21 nt, Human
uaaugugaaaaugguccagga

SEQ ID NO: 2305010 - RNA, 17 nt, Human
uaaugugccuaguucuu

SEQ ID NO: 2305011 - RNA, 13 nt, Human
uaaugugauauua

SEQ ID NO: 2305012 - RNA, 13 nt, Human
uaaugugaagugu

SEQ ID NO: 2305013 - RNA, 23 nt, Human
aaucuucugaacuuggcgcugcc

SEQ ID NO: 2305014 - RNA, 12 nt, Human
uaaugugcugug

SEQ ID NO: 2305015 - RNA, 13 nt, Human
uaaugugcugugu

SEQ ID NO: 2305016 - RNA, 14 nt, Human
uaaugugcugugua

SEQ ID NO: 2305017 - RNA, 15 nt, Human
uaaugugcuguguaa

SEQ ID NO: 2305018 - RNA, 16 nt, Human
uaaugugcuguguaaa

SEQ ID NO: 2305019 - RNA, 17 nt, Human
uaaugugcuguguaaag

SEQ ID NO: 2305020 - RNA, 18 nt, Human
uaaugugcuguguaaagu

SEQ ID NO: 2305021 - RNA, 19 nt, Human
uaaugugcuguguaaaguu

SEQ ID NO: 2305022 - RNA, 19 nt, Human
aaucuugggggguuuuuac

SEQ ID NO: 2305023 - RNA, 13 nt, Human
aaucuugcucugc

SEQ ID NO: 2305024 - RNA, 23 nt, Human
aaucuuuuacaacugccucgaaa

SEQ ID NO: 2305025 - RNA, 13 nt, Human
aaucuugaaaaug

SEQ ID NO: 2305026 - RNA, 20 nt, Human
uaaugugcuguguaaaguua

SEQ ID NO: 2305027 - RNA, 21 nt, Human
uaaugugcuguguaaaguuag

SEQ ID NO: 2305028 - RNA, 22 nt, Human
uaaugugcuguguaaaguuagu

SEQ ID NO: 2305029 - RNA, 14 nt, Human
aaucuugaaauuaa

SEQ ID NO: 2305030 - RNA, 17 nt, Human
aaucuugaaauuaagaa

SEQ ID NO: 2305031 - RNA, 22 nt, Human
aaucuugacuacagucaggaaa

SEQ ID NO: 2305032 - RNA, 14 nt, Human
aaugaaugaaacau

SEQ ID NO: 2305033 - RNA, 15 nt, Human
aaugaaugaaugaau

SEQ ID NO: 2305034 - RNA, 15 nt, Human
aaugaaugucagugu

SEQ ID NO: 2305035 - RNA, 14 nt, Human
aaugaaugucagug

SEQ ID NO: 2305036 - RNA, 18 nt, Human
aaugaaaaauuuaagcau

SEQ ID NO: 2305037 - RNA, 17 nt, Human
aaugaaaaauuuaagca

SEQ ID NO: 2305038 - RNA, 17 nt, Human
aaugaaaaauucucagu

SEQ ID NO: 2305039 - RNA, 14 nt, Human
aaugaaaaauucuc

SEQ ID NO: 2305040 - RNA, 14 nt, Human
aaugaaaaaaugua

SEQ ID NO: 2305041 - RNA, 21 nt, Human
aaucuuuuuuagcauaaaauu

SEQ ID NO: 2305042 - RNA, 18 nt, Human
aaucuuuucacaaauaaa

SEQ ID NO: 2305043 - RNA, 14 nt, Human
aaucuuuucacaaa

SEQ ID NO: 2305044 - RNA, 15 nt, Human
aaucuuuucacaaau

SEQ ID NO: 2305045 - RNA, 16 nt, Human
aaucuuuucacaaaua

SEQ ID NO: 2305046 - RNA, 17 nt, Human
aaucuuuucacaaauaa

SEQ ID NO: 2305047 - RNA, 17 nt, Human
uaauguaagcucuacug

SEQ ID NO: 2305048 - RNA, 16 nt, Human
uaauguaagcucuacu

SEQ ID NO: 2305049 - RNA, 15 nt, Human
uaauguaagacaaau

SEQ ID NO: 2305050 - RNA, 15 nt, Human
uaaugaaguuugaau

SEQ ID NO: 2305051 - RNA, 16 nt, Human
uaaugaaguuugaaug

SEQ ID NO: 2305052 - RNA, 17 nt, Human
uaaugaaguuugaaugu

SEQ ID NO: 2305053 - RNA, 18 nt, Human
uaaugaaguuugaauguu

SEQ ID NO: 2305054 - RNA, 22 nt, Human
uaaugaagggaaaggauauuuu

SEQ ID NO: 2305055 - RNA, 14 nt, Human
uaaugaagcuuuau

SEQ ID NO: 2305056 - RNA, 13 nt, Human
uaaugaaguuuga

SEQ ID NO: 2305057 - RNA, 14 nt, Human
uaaugaaguuugaa

SEQ ID NO: 2305058 - RNA, 23 nt, Human
uaaugaagaaaguggaaaacaag

SEQ ID NO: 2305059 - RNA, 22 nt, Human
uaaugaagaaaguggaaaacaa

SEQ ID NO: 2305060 - RNA, 18 nt, Human
uaaugaaccgcugaauau

SEQ ID NO: 2305061 - RNA, 14 nt, Human
uaaugaaauaucug

SEQ ID NO: 2305062 - RNA, 16 nt, Human
uaaugaaccgcugaau

SEQ ID NO: 2305063 - RNA, 17 nt, Human
uaaugaagaaaguggaa

SEQ ID NO: 2305064 - RNA, 16 nt, Human
uaaugaagaaagugga

SEQ ID NO: 2305065 - RNA, 19 nt, Human
uaaugaaauaucuguauuu

SEQ ID NO: 2305066 - RNA, 16 nt, Human
uaaugucacaggcagg

SEQ ID NO: 2305067 - RNA, 17 nt, Human
uaaugucacaggcaggu

SEQ ID NO: 2305068 - RNA, 15 nt, Human
uaaugucacaggcag

SEQ ID NO: 2305069 - RNA, 18 nt, Human
uaauguaauaacugugaa

SEQ ID NO: 2305070 - RNA, 17 nt, Human
uaauguaauaacuguga

SEQ ID NO: 2305071 - RNA, 23 nt, Human
uaaugugaaacuggauuaaacuu

SEQ ID NO: 2305072 - RNA, 22 nt, Human
uaaugugaaacuggauuaaacu

SEQ ID NO: 2305073 - RNA, 20 nt, Human
uaaugugaaacuggauuaaa

SEQ ID NO: 2305074 - RNA, 12 nt, Human
uaaugugaaacu

SEQ ID NO: 2305075 - RNA, 12 nt, Human
aauacaguguua

SEQ ID NO: 2305076 - RNA, 21 nt, Human
aauacagucuuccauuugcaa

SEQ ID NO: 2305077 - RNA, 18 nt, Human
aauacaguuguuggccuc

SEQ ID NO: 2305078 - RNA, 17 nt, Human
aauacaguacaggcagc

SEQ ID NO: 2305079 - RNA, 16 nt, Human
aauacaguacaggcag

SEQ ID NO: 2305080 - RNA, 15 nt, Human
aauacaguacaggca

SEQ ID NO: 2305081 - RNA, 17 nt, Human
uaacaagcucccaggcc

SEQ ID NO: 2305082 - RNA, 21 nt, Human
aauacaguacaggcagcacag

SEQ ID NO: 2305083 - RNA, 18 nt, Human
aauacaguacaggcagca

SEQ ID NO: 2305084 - RNA, 20 nt, Human
aauacaguaucucagggccu

SEQ ID NO: 2305085 - RNA, 19 nt, Human
uaacaaugcuguauuuuaa

SEQ ID NO: 2305086 - RNA, 19 nt, Human
aauacaguuugucacauga

SEQ ID NO: 2305087 - RNA, 18 nt, Human
uaauacagcaacaauuua

SEQ ID NO: 2305088 - RNA, 22 nt, Human
uaauacacuaauuccuuucuau

SEQ ID NO: 2305089 - RNA, 23 nt, Human
uaauacaccacuacauucuguua

SEQ ID NO: 2305090 - RNA, 21 nt, Human
uaauacaccacuacauucugu

SEQ ID NO: 2305091 - RNA, 22 nt, Human
uaauacaccacuacauucuguu

SEQ ID NO: 2305092 - RNA, 21 nt, Human
uaauagaagaacauccaagga

SEQ ID NO: 2305093 - RNA, 12 nt, Human
uaauagaagaac

SEQ ID NO: 2305094 - RNA, 19 nt, Human
uaauagaaaacugaaaauc

SEQ ID NO: 2305095 - RNA, 15 nt, Human
uaauagaaaacugaa

SEQ ID NO: 2305096 - RNA, 16 nt, Human
uaauagaaaacugaaa

SEQ ID NO: 2305097 - RNA, 18 nt, Human
uaauagaaaacugaaaau

SEQ ID NO: 2305098 - RNA, 18 nt, Human
uaauaccucugugugcuc

SEQ ID NO: 2305099 - RNA, 15 nt, Human
uaauaccugggugau

SEQ ID NO: 2305100 - RNA, 20 nt, Human
uaauaccugggugauuacau

SEQ ID NO: 2305101 - RNA, 18 nt, Human
uaauacuugcuuuggaaa

SEQ ID NO: 2305102 - RNA, 20 nt, Human
uaauacagccaaagauaauc

SEQ ID NO: 2305103 - RNA, 23 nt, Human
uaauacagcagugucaucagaag

SEQ ID NO: 2305104 - RNA, 20 nt, Human
uaauacacuaauuccuuucu

SEQ ID NO: 2305105 - RNA, 19 nt, Human
uaauacagcagugucauca

SEQ ID NO: 2305106 - RNA, 22 nt, Human
uaauacagcaacaauuuaugaa

SEQ ID NO: 2305107 - RNA, 21 nt, Human
uaauacagcaacaauuuauga

SEQ ID NO: 2305108 - RNA, 16 nt, Human
uaauaccacagcuuuu

SEQ ID NO: 2305109 - RNA, 13 nt, Human
uaauaccucccuu

SEQ ID NO: 2305110 - RNA, 22 nt, Human
uaauaccauuuuuuaaggaaac

SEQ ID NO: 2305111 - RNA, 13 nt, Human
uaauaccucugug

SEQ ID NO: 2305112 - RNA, 14 nt, Human
uaauaccucugugu

SEQ ID NO: 2305113 - RNA, 15 nt, Human
uaauaccucugugug

SEQ ID NO: 2305114 - RNA, 22 nt, Human
uaaucauuucuugggcccuccu

SEQ ID NO: 2305115 - RNA, 19 nt, Human
uaaucauuucuugggcccu

SEQ ID NO: 2305116 - RNA, 12 nt, Human
uaaucauuucuu

SEQ ID NO: 2305117 - RNA, 19 nt, Human
uaauccaauggguuuuucc

SEQ ID NO: 2305118 - RNA, 22 nt, Human
uaauccaagcaaaugugaauca

SEQ ID NO: 2305119 - RNA, 16 nt, Human
uaaucagugucucaca

SEQ ID NO: 2305120 - RNA, 17 nt, Human
uaaucagugucucacac

SEQ ID NO: 2305121 - RNA, 21 nt, Human
uaaucaugaaauuacuuauca

SEQ ID NO: 2305122 - RNA, 18 nt, Human
uaaucaugaaauuacuua

SEQ ID NO: 2305123 - RNA, 13 nt, Human
uaaucaugaaugu

SEQ ID NO: 2305124 - RNA, 20 nt, Human
uaaucauucuuauuucauga

SEQ ID NO: 2305125 - RNA, 16 nt, Human
uaaucaugaaugugua

SEQ ID NO: 2305126 - RNA, 17 nt, Human
uaaucaugaauguguaa

SEQ ID NO: 2305127 - RNA, 22 nt, Human
uaaucauucuuauuucaugaaa

SEQ ID NO: 2305128 - RNA, 14 nt, Human
uaaucauugccugg

SEQ ID NO: 2305129 - RNA, 15 nt, Human
uaaucauugccuggu

SEQ ID NO: 2305130 - RNA, 20 nt, Human
uaaucuugcucugcuugaca

SEQ ID NO: 2305131 - RNA, 15 nt, Human
uaaucuugcucugcu

SEQ ID NO: 2305132 - RNA, 14 nt, Human
uaaucuugcucugc

SEQ ID NO: 2305133 - RNA, 13 nt, Human
uaauccagcugau

SEQ ID NO: 2305134 - RNA, 22 nt, Human
uaaucuugaauuguaacuguuc

SEQ ID NO: 2305135 - RNA, 14 nt, Human
uaauccagaauaac

SEQ ID NO: 2305136 - RNA, 14 nt, Human
uaaucuucugccuu

SEQ ID NO: 2305137 - RNA, 16 nt, Human
uaaucuugaauuguaa

SEQ ID NO: 2305138 - RNA, 15 nt, Human
uaaucuucugccuuc

SEQ ID NO: 2305139 - RNA, 17 nt, Human
uaaucuuuaauuuuaca

SEQ ID NO: 2305140 - RNA, 13 nt, Human
uaaucuuucacag

SEQ ID NO: 2305141 - RNA, 16 nt, Human
uaauauuccucaguuc

SEQ ID NO: 2305142 - RNA, 16 nt, Human
uaauauugacuuguau

SEQ ID NO: 2305143 - RNA, 18 nt, Human
uaauauugacuuguauau

SEQ ID NO: 2305144 - RNA, 21 nt, Human
uaauagaauauaauuaucgga

SEQ ID NO: 2305145 - RNA, 19 nt, Human
uaauauugagaaagaaacu

SEQ ID NO: 2305146 - RNA, 14 nt, Human
uaauauugagaaag

SEQ ID NO: 2305147 - RNA, 16 nt, Human
uaauauuguggugcca

SEQ ID NO: 2305148 - RNA, 21 nt, Human
uaauauugauaugcuuauaca

SEQ ID NO: 2305149 - RNA, 13 nt, Human
uaaucagccucuu

SEQ ID NO: 2305150 - RNA, 12 nt, Human
uaaucagccucu

SEQ ID NO: 2305151 - RNA, 16 nt, Human
uaauauucauuguaua

SEQ ID NO: 2305152 - RNA, 13 nt, Human
uaauauuuaaaca

SEQ ID NO: 2305153 - RNA, 15 nt, Human
uaaucagccucuuaa

SEQ ID NO: 2305154 - RNA, 14 nt, Human
uaaucagccucuua

SEQ ID NO: 2305155 - RNA, 19 nt, Human
uaaucagggaggucauuuu

SEQ ID NO: 2305156 - RNA, 21 nt, Human
uaauauuuaaacagcaguguu

SEQ ID NO: 2305157 - RNA, 15 nt, Human
uaaucaggcugaggu

SEQ ID NO: 2305158 - RNA, 11 nt, Human
uaaucaguguc

SEQ ID NO: 2305159 - RNA, 15 nt, Human
uaaucagugucucac

SEQ ID NO: 2305160 - RNA, 22 nt, Human
uaaucagguccucagagaauuu

SEQ ID NO: 2305161 - RNA, 19 nt, Human
uaaucagguccucagagaa

SEQ ID NO: 2305162 - RNA, 17 nt, Human
uaaucagugugucuaaa

SEQ ID NO: 2305163 - RNA, 18 nt, Human
uaaucagugugucuaaau

SEQ ID NO: 2305164 - RNA, 15 nt, Human
aaugcaacaacaugu

SEQ ID NO: 2305165 - RNA, 18 nt, Human
aaugcaacaacauguaua

SEQ ID NO: 2305166 - RNA, 16 nt, Human
aaugcaaauccuaugu

SEQ ID NO: 2305167 - RNA, 14 nt, Human
aaugcaacaugugu

SEQ ID NO: 2305168 - RNA, 14 nt, Human
aaugcaauauguau

SEQ ID NO: 2305169 - RNA, 21 nt, Human
aaugcaagauuuuccacaaga

SEQ ID NO: 2305170 - RNA, 16 nt, Human
aaugcaauauuaaugc

SEQ ID NO: 2305171 - RNA, 17 nt, Human
aaugcaagcuaguggcu

SEQ ID NO: 2305172 - RNA, 18 nt, Human
aaugcacaaacagaggcc

SEQ ID NO: 2305173 - RNA, 22 nt, Human
aaugcaaaccaucauugaaauc

SEQ ID NO: 2305174 - RNA, 23 nt, Human
aaugcaaaccaucauugaaaucu

SEQ ID NO: 2305175 - RNA, 16 nt, Human
aaugaccucaagaugu

SEQ ID NO: 2305176 - RNA, 21 nt, Human
aaugaccaguaauugugaaaa

SEQ ID NO: 2305177 - RNA, 16 nt, Human
aaugacccaaagacca

SEQ ID NO: 2305178 - RNA, 18 nt, Human
aaugaccaguaauuguga

SEQ ID NO: 2305179 - RNA, 19 nt, Human
aaugaccaguaauugugaa

SEQ ID NO: 2305180 - RNA, 18 nt, Human
aaugaauccuacacaccu

SEQ ID NO: 2305181 - RNA, 20 nt, Human
aaugaaugucagugugacug

SEQ ID NO: 2305182 - RNA, 21 nt, Human
aaugaaugucagugugacuga

SEQ ID NO: 2305183 - RNA, 13 nt, Human
aaugaccuuucaa

SEQ ID NO: 2305184 - RNA, 14 nt, Human
aaugaccuuucaau

SEQ ID NO: 2305185 - RNA, 15 nt, Human
aaugaccuuucaaua

SEQ ID NO: 2305186 - RNA, 14 nt, Human
aaugcaaaccauca

SEQ ID NO: 2305187 - RNA, 16 nt, Human
aaugcaaaccaucauu

SEQ ID NO: 2305188 - RNA, 20 nt, Human
uaauuaucgggaacaguguu

SEQ ID NO: 2305189 - RNA, 19 nt, Human
uaauuaucgggaacagugu

SEQ ID NO: 2305190 - RNA, 18 nt, Human
uaauuaucgggaacagug

SEQ ID NO: 2305191 - RNA, 21 nt, Human
uaauuaucggaagcagugccu

SEQ ID NO: 2305192 - RNA, 19 nt, Human
uaauuaucggaagcagugc

SEQ ID NO: 2305193 - RNA, 18 nt, Human
uaauuaucggaagcagug

SEQ ID NO: 2305194 - RNA, 17 nt, Human
uaauuaucggaagcagu

SEQ ID NO: 2305195 - RNA, 12 nt, Human
aaugaaugaccu

SEQ ID NO: 2305196 - RNA, 13 nt, Human
uaauuaugacagu

SEQ ID NO: 2305197 - RNA, 21 nt, Human
uaauuaugacaguuauacugu

SEQ ID NO: 2305198 - RNA, 21 nt, Human
uaauuaugccuuuuuugauca

SEQ ID NO: 2305199 - RNA, 23 nt, Human
uaauuaucgggaacaguguuucc

SEQ ID NO: 2305200 - RNA, 21 nt, Human
uaauuaucgggaacaguguuu

SEQ ID NO: 2305201 - RNA, 16 nt, Human
uaauuaucuaaaguau

SEQ ID NO: 2305202 - RNA, 16 nt, Human
uaauucaccaaaguau

SEQ ID NO: 2305203 - RNA, 17 nt, Human
uaauucaccaaaguauu

SEQ ID NO: 2305204 - RNA, 18 nt, Human
uaauucagcacugauuuc

SEQ ID NO: 2305205 - RNA, 18 nt, Human
uaauucaccaaaguauuu

SEQ ID NO: 2305206 - RNA, 19 nt, Human
uaauucagcacugauuuca

SEQ ID NO: 2305207 - RNA, 21 nt, Human
uaauucagcacugauuucaca

SEQ ID NO: 2305208 - RNA, 22 nt, Human
uaauucagcacugauuucacaa

SEQ ID NO: 2305209 - RNA, 23 nt, Human
uaauuaguuccucauuagcauuu

SEQ ID NO: 2305210 - RNA, 21 nt, Human
uaauuagugcuaagugugaac

SEQ ID NO: 2305211 - RNA, 20 nt, Human
uaauuauacccccugcaaag

SEQ ID NO: 2305212 - RNA, 19 nt, Human
aaugcacuuuguucuggcu

SEQ ID NO: 2305213 - RNA, 20 nt, Human
aaugcacuuuguucuggcuc

SEQ ID NO: 2305214 - RNA, 19 nt, Human
aaugcacaaacagaggccg

SEQ ID NO: 2305215 - RNA, 20 nt, Human
aaugcacaaacagaggccgc

SEQ ID NO: 2305216 - RNA, 13 nt, Human
aaugcacuuuguu

SEQ ID NO: 2305217 - RNA, 16 nt, Human
aaugcacuuuguucug

SEQ ID NO: 2305218 - RNA, 22 nt, Human
uaauuugauaguauugugcaua

SEQ ID NO: 2305219 - RNA, 12 nt, Human
uaauuugauauc

SEQ ID NO: 2305220 - RNA, 15 nt, Human
uaauuugagagaaau

SEQ ID NO: 2305221 - RNA, 22 nt, Human
uaauuugaggacaaccauucca

SEQ ID NO: 2305222 - RNA, 18 nt, Human
uaauuugaggacaaccau

SEQ ID NO: 2305223 - RNA, 12 nt, Human
uaauuucuuugc

SEQ ID NO: 2305224 - RNA, 16 nt, Human
uaauuucuuugccugu

SEQ ID NO: 2305225 - RNA, 19 nt, Human
uaauuucuccucccuuccu

SEQ ID NO: 2305226 - RNA, 19 nt, Human
uaauuucuuacuaaacauu

SEQ ID NO: 2305227 - RNA, 17 nt, Human
uaauuucuuugccuguu

SEQ ID NO: 2305228 - RNA, 18 nt, Human
uaauuucuuugccuguuc

SEQ ID NO: 2305229 - RNA, 23 nt, Human
uaauuucuuugccuguucaguua

SEQ ID NO: 2305230 - RNA, 22 nt, Human
uaauuugaaaacauaaucugca

SEQ ID NO: 2305231 - RNA, 22 nt, Human
uaauuuuuguguuuuuaauaaa

SEQ ID NO: 2305232 - RNA, 21 nt, Human
uaauuuuuguauuuuuaguag

SEQ ID NO: 2305233 - RNA, 13 nt, Human
uaauuuuuuacua

SEQ ID NO: 2305234 - RNA, 19 nt, Human
uaauuuuuuagagagcugu

SEQ ID NO: 2305235 - RNA, 12 nt, Human
uaauuugaucuu

SEQ ID NO: 2305236 - RNA, 20 nt, Human
uaauuugcauuaaauucaca

SEQ ID NO: 2305237 - RNA, 14 nt, Human
uaauuugauguuua

SEQ ID NO: 2305238 - RNA, 12 nt, Human
uaauuugcauua

SEQ ID NO: 2305239 - RNA, 19 nt, Human
uaauuugauaucacagucu

SEQ ID NO: 2305240 - RNA, 22 nt, Human
uaauuugauaucacagucuaau

SEQ ID NO: 2305241 - RNA, 17 nt, Human
uaauuugcauuaaauuc

SEQ ID NO: 2305242 - RNA, 16 nt, Human
uaauuugcauuaaauu

SEQ ID NO: 2305243 - RNA, 21 nt, Human
uaauuuaaugcauguuaggaa

SEQ ID NO: 2305244 - RNA, 19 nt, Human
uaauuuacaaaaauauaaa

SEQ ID NO: 2305245 - RNA, 21 nt, Human
uaauuuacaaaaauauaaaau

SEQ ID NO: 2305246 - RNA, 22 nt, Human
uaauuuacaaaaauauaaaaua

SEQ ID NO: 2305247 - RNA, 14 nt, Human
uaauucauguuucu

SEQ ID NO: 2305248 - RNA, 19 nt, Human
uaauucaucccaacugucu

SEQ ID NO: 2305249 - RNA, 14 nt, Human
uaauuuaaugcaug

SEQ ID NO: 2305250 - RNA, 13 nt, Human
uaauucauguugc

SEQ ID NO: 2305251 - RNA, 15 nt, Human
uaauucagcucuuga

SEQ ID NO: 2305252 - RNA, 17 nt, Human
uaauuuccuggugugaa

SEQ ID NO: 2305253 - RNA, 13 nt, Human
uaauuucuccucc

SEQ ID NO: 2305254 - RNA, 14 nt, Human
uaauuucuccuccc

SEQ ID NO: 2305255 - RNA, 17 nt, Human
uaauuuaccugaagucu

SEQ ID NO: 2305256 - RNA, 18 nt, Human
uaauuuaccugaagucuu

SEQ ID NO: 2305257 - RNA, 19 nt, Human
uacaagcccccccuuccac

SEQ ID NO: 2305258 - RNA, 16 nt, Human
uacaagccugcacaau

SEQ ID NO: 2305259 - RNA, 13 nt, Human
uacaaguguauau

SEQ ID NO: 2305260 - RNA, 21 nt, Human
uacaagcgugagccacugcac

SEQ ID NO: 2305261 - RNA, 20 nt, Human
uacaauaaaaucuugaaaau

SEQ ID NO: 2305262 - RNA, 21 nt, Human
uacaaguguauaucagaaaag

SEQ ID NO: 2305263 - RNA, 15 nt, Human
uacaaguuagaaaac

SEQ ID NO: 2305264 - RNA, 13 nt, Human
uacaaguuagaaa

SEQ ID NO: 2305265 - RNA, 14 nt, Human
uacaaguguauauc

SEQ ID NO: 2305266 - RNA, 15 nt, Human
uacaaguguauauca

SEQ ID NO: 2305267 - RNA, 16 nt, Human
uacaagcgugagccac

SEQ ID NO: 2305268 - RNA, 18 nt, Human
uacaagcgugagccacug

SEQ ID NO: 2305269 - RNA, 19 nt, Human
uacaagcgugagccacugc

SEQ ID NO: 2305270 - RNA, 20 nt, Human
uacaagcgugagccacugca

SEQ ID NO: 2305271 - RNA, 14 nt, Human
uacaagcccccccu

SEQ ID NO: 2305272 - RNA, 15 nt, Human
uacaagcccccccuu

SEQ ID NO: 2305273 - RNA, 21 nt, Human
uacaagccauucuaaggaaau

SEQ ID NO: 2305274 - RNA, 21 nt, Human
uacaagcauucugucuugaag

SEQ ID NO: 2305275 - RNA, 18 nt, Human
uacaagccagcuggagaa

SEQ ID NO: 2305276 - RNA, 16 nt, Human
uaauuuuuuucaauau

SEQ ID NO: 2305277 - RNA, 20 nt, Human
uaauuuuuuuauuguuuaaa

SEQ ID NO: 2305278 - RNA, 16 nt, Human
uacaaaaacauggccu

SEQ ID NO: 2305279 - RNA, 14 nt, Human
uaauuuuuuuauug

SEQ ID NO: 2305280 - RNA, 14 nt, Human
uaauuuuuuuaauu

SEQ ID NO: 2305281 - RNA, 15 nt, Human
uaauuuuuuuauugu

SEQ ID NO: 2305282 - RNA, 16 nt, Human
uaauuuuuuuauuguu

SEQ ID NO: 2305283 - RNA, 17 nt, Human
uaauuuuuuuauuguuu

SEQ ID NO: 2305284 - RNA, 18 nt, Human
uaauuuuuuuauuguuua

SEQ ID NO: 2305285 - RNA, 17 nt, Human
uaauuuuuuauucaagu

SEQ ID NO: 2305286 - RNA, 17 nt, Human
uaauuuuuuuaaccaaa

SEQ ID NO: 2305287 - RNA, 20 nt, Human
uaauuuuuuuaaccaaaggu

SEQ ID NO: 2305288 - RNA, 21 nt, Human
uaauuuuuuuaaccaaaggug

SEQ ID NO: 2305289 - RNA, 22 nt, Human
uaauuuuuuuaaccaaagguga

SEQ ID NO: 2305290 - RNA, 18 nt, Human
uacaaaaacacagcaagg

SEQ ID NO: 2305291 - RNA, 17 nt, Human
uacaaaaacacagcaag

SEQ ID NO: 2305292 - RNA, 14 nt, Human
uacccgcagaguuc

SEQ ID NO: 2305293 - RNA, 18 nt, Human
uaccccuuucuggcucuc

SEQ ID NO: 2305294 - RNA, 19 nt, Human
uaccccuuagccucccuga

SEQ ID NO: 2305295 - RNA, 20 nt, Human
uacccgggaagggggcuggg

SEQ ID NO: 2305296 - RNA, 16 nt, Human
uaccccucccagcuga

SEQ ID NO: 2305297 - RNA, 19 nt, Human
uaccccucccagcugacag

SEQ ID NO: 2305298 - RNA, 13 nt, Human
uaccccugaucug

SEQ ID NO: 2305299 - RNA, 17 nt, Human
uaccccgcagacaccuu

SEQ ID NO: 2305300 - RNA, 22 nt, Human
uacccccgcccaggcuggccag

SEQ ID NO: 2305301 - RNA, 23 nt, Human
uacccccuucugggcaucuguuc

SEQ ID NO: 2305302 - RNA, 10 nt, Human
uaccccuccc

SEQ ID NO: 2305303 - RNA, 13 nt, Human
uaccccucccagc

SEQ ID NO: 2305304 - RNA, 14 nt, Human
uaccccucccagcu

SEQ ID NO: 2305305 - RNA, 15 nt, Human
uaccccucccagcug

SEQ ID NO: 2305306 - RNA, 14 nt, Human
uacccucccacccc

SEQ ID NO: 2305307 - RNA, 13 nt, Human
uacccucccaccc

SEQ ID NO: 2305308 - RNA, 15 nt, Human
uacccucauguucuu

SEQ ID NO: 2305309 - RNA, 16 nt, Human
uacccucauguucuua

SEQ ID NO: 2305310 - RNA, 15 nt, Human
uacccucccaccccc

SEQ ID NO: 2305311 - RNA, 11 nt, Human
uacccuccccc

SEQ ID NO: 2305312 - RNA, 11 nt, Human
uacccucccug

SEQ ID NO: 2305313 - RNA, 12 nt, Human
uacccucccugc

SEQ ID NO: 2305314 - RNA, 14 nt, Human
uacccucccugcug

SEQ ID NO: 2305315 - RNA, 15 nt, Human
uacccucccugcugu

SEQ ID NO: 2305316 - RNA, 12 nt, Human
uacccuccuggc

SEQ ID NO: 2305317 - RNA, 15 nt, Human
uacccuccuggcucu

SEQ ID NO: 2305318 - RNA, 17 nt, Human
uacccucccugcugucc

SEQ ID NO: 2305319 - RNA, 18 nt, Human
uacccucccugcuguccc

SEQ ID NO: 2305320 - RNA, 22 nt, Human
uacccucccugcuguccccucu

SEQ ID NO: 2305321 - RNA, 23 nt, Human
uacccucccugcuguccccucuu

SEQ ID NO: 2305322 - RNA, 15 nt, Human
uacccucgggcccac

SEQ ID NO: 2305323 - RNA, 12 nt, Human
uacccuccucca

SEQ ID NO: 2305324 - RNA, 15 nt, Human
uacccuccuguaaau

SEQ ID NO: 2305325 - RNA, 17 nt, Human
uacccucgggcccaccu

SEQ ID NO: 2305326 - RNA, 18 nt, Human
uacccucgggcccaccug

SEQ ID NO: 2305327 - RNA, 20 nt, Human
uacccucgggcccaccuggc

SEQ ID NO: 2305328 - RNA, 21 nt, Human
uacccucgggcccaccuggcc

SEQ ID NO: 2305329 - RNA, 13 nt, Human
uacccucucagcu

SEQ ID NO: 2305330 - RNA, 22 nt, Human
uacccucgggcccaccuggcca

SEQ ID NO: 2305331 - RNA, 23 nt, Human
uacccucgggcccaccuggccac

SEQ ID NO: 2305332 - RNA, 15 nt, Human
uacccucucagcucc

SEQ ID NO: 2305333 - RNA, 16 nt, Human
uacccucucagcucca

SEQ ID NO: 2305334 - RNA, 17 nt, Human
uacccucucagcuccag

SEQ ID NO: 2305335 - RNA, 20 nt, Human
uacccucucagcuccaggug

SEQ ID NO: 2305336 - RNA, 21 nt, Human
uacccucucagcuccaggugg

SEQ ID NO: 2305337 - RNA, 12 nt, Human
uacccucuggag

SEQ ID NO: 2305338 - RNA, 14 nt, Human
uacccucuggaggg

SEQ ID NO: 2305339 - RNA, 22 nt, Human
uacccucuggagggguguggcu

SEQ ID NO: 2305340 - RNA, 22 nt, Human
uacccuggcacuauaauguaag

SEQ ID NO: 2305341 - RNA, 20 nt, Human
uacccuggcacuauaaugua

SEQ ID NO: 2305342 - RNA, 22 nt, Human
uacccucuucauggauggggga

SEQ ID NO: 2305343 - RNA, 20 nt, Human
uacccugcgauuuugccugu

SEQ ID NO: 2305344 - RNA, 18 nt, Human
uacccugagcugaggcag

SEQ ID NO: 2305345 - RNA, 17 nt, Human
uacccugagcugaggca

SEQ ID NO: 2305346 - RNA, 16 nt, Human
uacccugagcugaggc

SEQ ID NO: 2305347 - RNA, 15 nt, Human
uacauuuaauacagc

SEQ ID NO: 2305348 - RNA, 13 nt, Human
uacauuuaauaca

SEQ ID NO: 2305349 - RNA, 16 nt, Human
uacauuuaugauuuaa

SEQ ID NO: 2305350 - RNA, 12 nt, Human
uacauuuaugau

SEQ ID NO: 2305351 - RNA, 14 nt, Human
uacauuuaugauuu

SEQ ID NO: 2305352 - RNA, 19 nt, Human
uacauuuauaauguuugcu

SEQ ID NO: 2305353 - RNA, 20 nt, Human
uacauuuauaguuguaacua

SEQ ID NO: 2305354 - RNA, 23 nt, Human
uacauuguuugucugucuucaua

SEQ ID NO: 2305355 - RNA, 22 nt, Human
uaccagacgguucaccagccuc

SEQ ID NO: 2305356 - RNA, 15 nt, Human
uaccagacuguguau

SEQ ID NO: 2305357 - RNA, 23 nt, Human
uaccagacgguucaccagccucu

SEQ ID NO: 2305358 - RNA, 23 nt, Human
uaccagacuguguauucauugaa

SEQ ID NO: 2305359 - RNA, 21 nt, Human
uaccagacgguucaccagccu

SEQ ID NO: 2305360 - RNA, 17 nt, Human
uaccacuuuuguucuug

SEQ ID NO: 2305361 - RNA, 15 nt, Human
uaccaugaaacaaag

SEQ ID NO: 2305362 - RNA, 20 nt, Human
uaccauaguaccauuuauac

SEQ ID NO: 2305363 - RNA, 18 nt, Human
uaccaucagggacaggau

SEQ ID NO: 2305364 - RNA, 16 nt, Human
uaccccaauuccuugu

SEQ ID NO: 2305365 - RNA, 14 nt, Human
uaccaugaacagaa

SEQ ID NO: 2305366 - RNA, 20 nt, Human
uaccaugaacagaaaacauu

SEQ ID NO: 2305367 - RNA, 20 nt, Human
uaccaugagaagagggccug

SEQ ID NO: 2305368 - RNA, 22 nt, Human
uaccaugagaagagggccugug

SEQ ID NO: 2305369 - RNA, 15 nt, Human
uaccauaauguauuu

SEQ ID NO: 2305370 - RNA, 16 nt, Human
uaccauauacagcuca

SEQ ID NO: 2305371 - RNA, 17 nt, Human
uaccauccccuguagag

SEQ ID NO: 2305372 - RNA, 22 nt, Human
uaccccaccacgauguggcccu

SEQ ID NO: 2305373 - RNA, 17 nt, Human
uaccccaauuccuugua

SEQ ID NO: 2305374 - RNA, 12 nt, Human
uaccccacccuc

SEQ ID NO: 2305375 - RNA, 13 nt, Human
uaccccacccuca

SEQ ID NO: 2305376 - RNA, 14 nt, Human
uaccccacccucag

SEQ ID NO: 2305377 - RNA, 15 nt, Human
uaccccacccucagc

SEQ ID NO: 2305378 - RNA, 22 nt, Human
uaccccacccucagcaccccuu

SEQ ID NO: 2305379 - RNA, 23 nt, Human
uaccccacccucagcaccccuuc

SEQ ID NO: 2305380 - RNA, 16 nt, Human
uacccccuaagagcca

SEQ ID NO: 2305381 - RNA, 17 nt, Human
uacccccuucugggcau

SEQ ID NO: 2305382 - RNA, 17 nt, Human
uacccccgcccaggcug

SEQ ID NO: 2305383 - RNA, 20 nt, Human
uacccccgcccaggcuggcc

SEQ ID NO: 2305384 - RNA, 15 nt, Human
uaccccccucugucu

SEQ ID NO: 2305385 - RNA, 12 nt, Human
uacccccgccca

SEQ ID NO: 2305386 - RNA, 16 nt, Human
uacccccgcccaggcu

SEQ ID NO: 2305387 - RNA, 15 nt, Human
uaccccaucauucau

SEQ ID NO: 2305388 - RNA, 16 nt, Human
uacccccaggguugag

SEQ ID NO: 2305389 - RNA, 17 nt, Human
uaccccccaaccccuga

SEQ ID NO: 2305390 - RNA, 12 nt, Human
aauuaacacugc

SEQ ID NO: 2305391 - RNA, 17 nt, Human
aauuaaauuuugugucu

SEQ ID NO: 2305392 - RNA, 18 nt, Human
aauuaaauuuugugucuc

SEQ ID NO: 2305393 - RNA, 20 nt, Human
aauguugcuuaggaugugug

SEQ ID NO: 2305394 - RNA, 19 nt, Human
aauuaacaugaauauuuag

SEQ ID NO: 2305395 - RNA, 22 nt, Human
aauuaacuuuuauaaacuuuac

SEQ ID NO: 2305396 - RNA, 20 nt, Human
aauuaacuuuuauaaacuuu

SEQ ID NO: 2305397 - RNA, 18 nt, Human
aauuaacuuuuauaaacu

SEQ ID NO: 2305398 - RNA, 23 nt, Human
aaugugaaucagacccuacccca

SEQ ID NO: 2305399 - RNA, 17 nt, Human
aaugugaauaaaauuau

SEQ ID NO: 2305400 - RNA, 17 nt, Human
aaugugaaugggaaaag

SEQ ID NO: 2305401 - RNA, 15 nt, Human
aaugugaccaggggu

SEQ ID NO: 2305402 - RNA, 17 nt, Human
aaugugaccagggguga

SEQ ID NO: 2305403 - RNA, 20 nt, Human
aaugugaacuuuauuaaaua

SEQ ID NO: 2305404 - RNA, 14 nt, Human
aaugugaaguguua

SEQ ID NO: 2305405 - RNA, 17 nt, Human
aaugugaaguguuaaua

SEQ ID NO: 2305406 - RNA, 16 nt, Human
aaugugaauaaaauua

SEQ ID NO: 2305407 - RNA, 15 nt, Human
aaugugaacuuuauu

SEQ ID NO: 2305408 - RNA, 19 nt, Human
aaugugaacagcggcugga

SEQ ID NO: 2305409 - RNA, 13 nt, Human
aaugugaaagcac

SEQ ID NO: 2305410 - RNA, 14 nt, Human
aauguugaauuuug

SEQ ID NO: 2305411 - RNA, 18 nt, Human
aauguugacaugggacau

SEQ ID NO: 2305412 - RNA, 18 nt, Human
aauguugagaaucccaaa

SEQ ID NO: 2305413 - RNA, 19 nt, Human
uacauuguuugucugucuu

SEQ ID NO: 2305414 - RNA, 23 nt, Human
uacauuguugagcuauugcuguu

SEQ ID NO: 2305415 - RNA, 13 nt, Human
uacauuguugagc

SEQ ID NO: 2305416 - RNA, 15 nt, Human
uacauuguucaauua

SEQ ID NO: 2305417 - RNA, 16 nt, Human
uacauugugaaacuuc

SEQ ID NO: 2305418 - RNA, 19 nt, Human
uacauugucucuaaauugu

SEQ ID NO: 2305419 - RNA, 17 nt, Human
uacauugucauuuauau

SEQ ID NO: 2305420 - RNA, 18 nt, Human
uacauugucauuuauaua

SEQ ID NO: 2305421 - RNA, 14 nt, Human
uacauuguucaauu

SEQ ID NO: 2305422 - RNA, 23 nt, Human
uacauugugggauguucagcacu

SEQ ID NO: 2305423 - RNA, 23 nt, Human
uacauuaauuauuauugcuguug

SEQ ID NO: 2305424 - RNA, 22 nt, Human
uacauuaauuauuauugcuguu

SEQ ID NO: 2305425 - RNA, 15 nt, Human
uacauuaauuaucua

SEQ ID NO: 2305426 - RNA, 15 nt, Human
uacauuaauguuaau

SEQ ID NO: 2305427 - RNA, 20 nt, Human
uacauuaauguuaauucagc

SEQ ID NO: 2305428 - RNA, 23 nt, Human
uacauuaauguuaauucagcacu

SEQ ID NO: 2305429 - RNA, 19 nt, Human
uacauuagcaguuugcuuu

SEQ ID NO: 2305430 - RNA, 20 nt, Human
uacauuagcaguuugcuuug

SEQ ID NO: 2305431 - RNA, 12 nt, Human
uacauuaauguu

SEQ ID NO: 2305432 - RNA, 15 nt, Human
uacauguauugcaca

SEQ ID NO: 2305433 - RNA, 12 nt, Human
uacauguauuau

SEQ ID NO: 2305434 - RNA, 22 nt, Human
uacauguauuauuucauuaugu

SEQ ID NO: 2305435 - RNA, 16 nt, Human
uacaugguugugaccu

SEQ ID NO: 2305436 - RNA, 19 nt, Human
uacauguaaaacauuaucu

SEQ ID NO: 2305437 - RNA, 13 nt, Human
uacauguaguagu

SEQ ID NO: 2305438 - RNA, 17 nt, Human
uacauguacugauuacu

SEQ ID NO: 2305439 - RNA, 22 nt, Human
aauuaaggauuuuaugcuuuaa

SEQ ID NO: 2305440 - RNA, 20 nt, Human
aauuaaggauuuuaugcuuu

SEQ ID NO: 2305441 - RNA, 16 nt, Human
aauuaaggauuuuaug

SEQ ID NO: 2305442 - RNA, 13 nt, Human
aauuaaguacuau

SEQ ID NO: 2305443 - RNA, 16 nt, Human
aauuaaggcauaagaa

SEQ ID NO: 2305444 - RNA, 18 nt, Human
uacaccuuucuccuuugu

SEQ ID NO: 2305445 - RNA, 23 nt, Human
uacaccuggcugagguuccucug

SEQ ID NO: 2305446 - RNA, 19 nt, Human
uacaccuuucuccuuugua

SEQ ID NO: 2305447 - RNA, 20 nt, Human
uacaccuuucuccuuuguac

SEQ ID NO: 2305448 - RNA, 13 nt, Human
uacacgggacuga

SEQ ID NO: 2305449 - RNA, 13 nt, Human
uacacggaaaacg

SEQ ID NO: 2305450 - RNA, 12 nt, Human
uacaccuggcug

SEQ ID NO: 2305451 - RNA, 13 nt, Human
uacaccuggcuga

SEQ ID NO: 2305452 - RNA, 14 nt, Human
uacaccuggcugag

SEQ ID NO: 2305453 - RNA, 15 nt, Human
uacaccuggcugagg

SEQ ID NO: 2305454 - RNA, 22 nt, Human
uacaccuggcugagguuccucu

SEQ ID NO: 2305455 - RNA, 21 nt, Human
uacaccuaugucauuucauuu

SEQ ID NO: 2305456 - RNA, 17 nt, Human
uacaccuaugucauuuc

SEQ ID NO: 2305457 - RNA, 14 nt, Human
uacaccuaugucau

SEQ ID NO: 2305458 - RNA, 17 nt, Human
aauguacaucuggccuu

SEQ ID NO: 2305459 - RNA, 17 nt, Human
aauguaaaauguugaau

SEQ ID NO: 2305460 - RNA, 14 nt, Human
aauguaagcuguuu

SEQ ID NO: 2305461 - RNA, 14 nt, Human
aauguacccaguau

SEQ ID NO: 2305462 - RNA, 15 nt, Human
aauguacauuaauua

SEQ ID NO: 2305463 - RNA, 23 nt, Human
aauguacagcaaggagauuuaca

SEQ ID NO: 2305464 - RNA, 21 nt, Human
aauguacagcaaggagauuua

SEQ ID NO: 2305465 - RNA, 23 nt, Human
uacagauuuugauagcaaagcga

SEQ ID NO: 2305466 - RNA, 21 nt, Human
uacagauuuugauagcaaagc

SEQ ID NO: 2305467 - RNA, 22 nt, Human
uacagauuuugauagcaaagcg

SEQ ID NO: 2305468 - RNA, 22 nt, Human
uacagcaaggagauuuacaacu

SEQ ID NO: 2305469 - RNA, 15 nt, Human
uacagauuuugauag

SEQ ID NO: 2305470 - RNA, 16 nt, Human
uacagauuuugauagc

SEQ ID NO: 2305471 - RNA, 17 nt, Human
uacagauuuugauagca

SEQ ID NO: 2305472 - RNA, 18 nt, Human
uacagauuuugauagcaa

SEQ ID NO: 2305473 - RNA, 18 nt, Human
uacagacguaugcuuauu

SEQ ID NO: 2305474 - RNA, 17 nt, Human
uacagacguaugcuuau

SEQ ID NO: 2305475 - RNA, 16 nt, Human
uacagacguaugcuua

SEQ ID NO: 2305476 - RNA, 15 nt, Human
uacagacuucuccag

SEQ ID NO: 2305477 - RNA, 14 nt, Human
uacagacuucucca

SEQ ID NO: 2305478 - RNA, 23 nt, Human
uacagagaacuaacacuauuuua

SEQ ID NO: 2305479 - RNA, 19 nt, Human
uacagagaacuaacacuau

SEQ ID NO: 2305480 - RNA, 22 nt, Human
uacagagaacuaacacuauuuu

SEQ ID NO: 2305481 - RNA, 14 nt, Human
aaugguuugaauau

SEQ ID NO: 2305482 - RNA, 17 nt, Human
aaugguuuaacuucugc

SEQ ID NO: 2305483 - RNA, 13 nt, Human
aaugguuucaaag

SEQ ID NO: 2305484 - RNA, 22 nt, Human
aaugguuuaacuucugccugug

SEQ ID NO: 2305485 - RNA, 24 nt, Human
aaugguuguauuagauguucucua

SEQ ID NO: 2305486 - RNA, 16 nt, Human
aaugguuuaaaugguc

SEQ ID NO: 2305487 - RNA, 18 nt, Human
aaugguuguauuagaugu

SEQ ID NO: 2305488 - RNA, 19 nt, Human
aaugguuguauuagauguu

SEQ ID NO: 2305489 - RNA, 21 nt, Human
aaugguuguauuagauguucu

SEQ ID NO: 2305490 - RNA, 23 nt, Human
aaugguuguauuagauguucucu

SEQ ID NO: 2305491 - RNA, 22 nt, Human
uacaaucauugcugaaaauggu

SEQ ID NO: 2305492 - RNA, 17 nt, Human
uacaaucauugcugaaa

SEQ ID NO: 2305493 - RNA, 23 nt, Human
uacaaucauugcugaaaauggua

SEQ ID NO: 2305494 - RNA, 16 nt, Human
uacaauaaauaaucug

SEQ ID NO: 2305495 - RNA, 15 nt, Human
uacaauaaauaaucu

SEQ ID NO: 2305496 - RNA, 16 nt, Human
uacaauaauucuauga

SEQ ID NO: 2305497 - RNA, 13 nt, Human
uacaauaaauaau

SEQ ID NO: 2305498 - RNA, 21 nt, Human
uacaauaaaacuuugcugcca

SEQ ID NO: 2305499 - RNA, 13 nt, Human
uacaauaacauaa

SEQ ID NO: 2305500 - RNA, 20 nt, Human
uacaaucaaaggaaaauagu

SEQ ID NO: 2305501 - RNA, 16 nt, Human
uacaauauuuaaaauu

SEQ ID NO: 2305502 - RNA, 14 nt, Human
uacaauauuuaaaa

SEQ ID NO: 2305503 - RNA, 12 nt, Human
uacaauauuuaa

SEQ ID NO: 2305504 - RNA, 17 nt, Human
aaugguuugaauauaaa

SEQ ID NO: 2305505 - RNA, 23 nt, Human
aaugguuugaauauaaacacuau

SEQ ID NO: 2305506 - RNA, 22 nt, Human
aaugguuuucuuguguguuuau

SEQ ID NO: 2305507 - RNA, 17 nt, Human
aaugguuuucuugugug

SEQ ID NO: 2305508 - RNA, 18 nt, Human
aaugguuuucuugugugu

SEQ ID NO: 2305509 - RNA, 15 nt, Human
aauguaagcucuacu

SEQ ID NO: 2305510 - RNA, 13 nt, Human
aauguaagcucua

SEQ ID NO: 2305511 - RNA, 13 nt, Human
aauguaagacaaa

SEQ ID NO: 2305512 - RNA, 20 nt, Human
aauguagguaugaauaaguu

SEQ ID NO: 2305513 - RNA, 22 nt, Human
aauguaggcuuaguuugugugu

SEQ ID NO: 2305514 - RNA, 21 nt, Human
aauguagcugguuuccucauu

SEQ ID NO: 2305515 - RNA, 21 nt, Human
aauguaggccaaauuuguagu

SEQ ID NO: 2305516 - RNA, 16 nt, Human
aauguaggcuuaguuu

SEQ ID NO: 2305517 - RNA, 19 nt, Human
aauguaggcuuaguuugug

SEQ ID NO: 2305518 - RNA, 17 nt, Human
aauguagcugguuuccu

SEQ ID NO: 2305519 - RNA, 14 nt, Human
aauguagcugguuu

SEQ ID NO: 2305520 - RNA, 13 nt, Human
aauguagccaugg

SEQ ID NO: 2305521 - RNA, 12 nt, Human
aauguagauuuu

SEQ ID NO: 2305522 - RNA, 12 nt, Human
aauguagagggg

SEQ ID NO: 2305523 - RNA, 12 nt, Human
uacauacugcug

SEQ ID NO: 2305524 - RNA, 23 nt, Human
uacauacuuucauccugacucug

SEQ ID NO: 2305525 - RNA, 13 nt, Human
uacauacugcugu

SEQ ID NO: 2305526 - RNA, 14 nt, Human
uacauagaugcuua

SEQ ID NO: 2305527 - RNA, 20 nt, Human
uacauacaccagcauuccuu

SEQ ID NO: 2305528 - RNA, 16 nt, Human
uacauacaccagcauu

SEQ ID NO: 2305529 - RNA, 15 nt, Human
uacauacaccagcau

SEQ ID NO: 2305530 - RNA, 14 nt, Human
uacauacaccagca

SEQ ID NO: 2305531 - RNA, 22 nt, Human
uacauacccuggccgcccccug

SEQ ID NO: 2305532 - RNA, 17 nt, Human
aauguaucuuauucaca

SEQ ID NO: 2305533 - RNA, 18 nt, Human
aauguaucuuauucacau

SEQ ID NO: 2305534 - RNA, 15 nt, Human
aauguaugcuucaua

SEQ ID NO: 2305535 - RNA, 17 nt, Human
aauguaugcuucauaca

SEQ ID NO: 2305536 - RNA, 16 nt, Human
aauguaugcuucauac

SEQ ID NO: 2305537 - RNA, 13 nt, Human
aauguaucuuauu

SEQ ID NO: 2305538 - RNA, 16 nt, Human
aauguaucuuauucac

SEQ ID NO: 2305539 - RNA, 22 nt, Human
aauguaucauagaaauguaacu

SEQ ID NO: 2305540 - RNA, 18 nt, Human
aauguaucaggaaauaua

SEQ ID NO: 2305541 - RNA, 15 nt, Human
aauguaucaggaaau

SEQ ID NO: 2305542 - RNA, 16 nt, Human
aauguaucauagaaau

SEQ ID NO: 2305543 - RNA, 19 nt, Human
aauguaucauagaaaugua

SEQ ID NO: 2305544 - RNA, 18 nt, Human
aauguaucauagaaaugu

SEQ ID NO: 2305545 - RNA, 14 nt, Human
aaugucacaggcag

SEQ ID NO: 2305546 - RNA, 22 nt, Human
aaugugaaacuggauuaaacuu

SEQ ID NO: 2305547 - RNA, 13 nt, Human
aaugucacaggca

SEQ ID NO: 2305548 - RNA, 14 nt, Human
aauguauuuuuccu

SEQ ID NO: 2305549 - RNA, 13 nt, Human
uacagucugucau

SEQ ID NO: 2305550 - RNA, 16 nt, Human
uacagucugucaugaa

SEQ ID NO: 2305551 - RNA, 17 nt, Human
uacaguccucccaucuc

SEQ ID NO: 2305552 - RNA, 18 nt, Human
uacaguccucccaucuca

SEQ ID NO: 2305553 - RNA, 18 nt, Human
uacaguaucucagggccu

SEQ ID NO: 2305554 - RNA, 20 nt, Human
uacagcaacaauuuaugaau

SEQ ID NO: 2305555 - RNA, 19 nt, Human
uacagcaacaauuuaugaa

SEQ ID NO: 2305556 - RNA, 22 nt, Human
uacagcaacaauuuaugaauug

SEQ ID NO: 2305557 - RNA, 12 nt, Human
uacaguccuccc

SEQ ID NO: 2305558 - RNA, 15 nt, Human
uacaguccucccauc

SEQ ID NO: 2305559 - RNA, 13 nt, Human
uacagucuuguau

SEQ ID NO: 2305560 - RNA, 17 nt, Human
uacagucuugcagcagg

SEQ ID NO: 2305561 - RNA, 15 nt, Human
uacagugaaaaugua

SEQ ID NO: 2305562 - RNA, 20 nt, Human
uacagugaaaauguaagcug

SEQ ID NO: 2305563 - RNA, 14 nt, Human
uacagugagccaag

SEQ ID NO: 2305564 - RNA, 21 nt, Human
uacagugaaaauguaagcugu

SEQ ID NO: 2305565 - RNA, 22 nt, Human
uacagugaaaauguaagcuguu

SEQ ID NO: 2305566 - RNA, 23 nt, Human
uacagugaaaauguaagcuguuu

SEQ ID NO: 2305567 - RNA, 12 nt, Human
uacagugagcca

SEQ ID NO: 2305568 - RNA, 12 nt, Human
uacagucuugua

SEQ ID NO: 2305569 - RNA, 22 nt, Human
uacagucuuccauuugcaaggg

SEQ ID NO: 2305570 - RNA, 20 nt, Human
uacagucuuccauuugcaag

SEQ ID NO: 2305571 - RNA, 19 nt, Human
uacagucuuccauuugcaa

SEQ ID NO: 2305572 - RNA, 18 nt, Human
uacagucuuccauuugca

SEQ ID NO: 2305573 - RNA, 15 nt, Human
uacagucugucauga

SEQ ID NO: 2305574 - RNA, 14 nt, Human
uacagucugucaug

SEQ ID NO: 2305575 - RNA, 11 nt, Human
uacagugguuu

SEQ ID NO: 2305576 - RNA, 16 nt, Human
uacauaaguaauucaa

SEQ ID NO: 2305577 - RNA, 17 nt, Human
uacauaaguaauucaag

SEQ ID NO: 2305578 - RNA, 15 nt, Human
uacauaaguuuagga

SEQ ID NO: 2305579 - RNA, 19 nt, Human
uacauaaguaauucaagaa

SEQ ID NO: 2305580 - RNA, 12 nt, Human
uacauaaucugu

SEQ ID NO: 2305581 - RNA, 15 nt, Human
uacauaaucuguaca

SEQ ID NO: 2305582 - RNA, 20 nt, Human
uacauaaucuguacaaugaa

SEQ ID NO: 2305583 - RNA, 15 nt, Human
uacauaaugcgugca

SEQ ID NO: 2305584 - RNA, 16 nt, Human
aaggguucccucaaga

SEQ ID NO: 2305585 - RNA, 17 nt, Human
aaggguucuggcugccc

SEQ ID NO: 2305586 - RNA, 17 nt, Human
aaggguuuguggcuggg

SEQ ID NO: 2305587 - RNA, 14 nt, Human
aaguaaaaccacag

SEQ ID NO: 2305588 - RNA, 16 nt, Human
aaguaaaaccacagca

SEQ ID NO: 2305589 - RNA, 15 nt, Human
aaguaaaaccacagc

SEQ ID NO: 2305590 - RNA, 20 nt, Human
aaggggcagucuggaggggc

SEQ ID NO: 2305591 - RNA, 19 nt, Human
aaggggcagucuggagggg

SEQ ID NO: 2305592 - RNA, 18 nt, Human
aaggggcagucuggaggg

SEQ ID NO: 2305593 - RNA, 21 nt, Human
aagggugaugggaaagcauug

SEQ ID NO: 2305594 - RNA, 20 nt, Human
aagggugcugcuucccucug

SEQ ID NO: 2305595 - RNA, 13 nt, Human
aagggugucugag

SEQ ID NO: 2305596 - RNA, 23 nt, Human
aagggugcugcuucccucugccu

SEQ ID NO: 2305597 - RNA, 14 nt, Human
aaggguuauauuuu

SEQ ID NO: 2305598 - RNA, 14 nt, Human
aaggguuaagaaaa

SEQ ID NO: 2305599 - RNA, 19 nt, Human
aagggugcugcuucccucu

SEQ ID NO: 2305600 - RNA, 16 nt, Human
aagggugcugcuuccc

SEQ ID NO: 2305601 - RNA, 20 nt, Human
aaggguuuguggcugggggc

SEQ ID NO: 2305602 - RNA, 12 nt, Human
aaguaaaacuug

SEQ ID NO: 2305603 - RNA, 16 nt, Human
aaggguuuuaauguag

SEQ ID NO: 2305604 - RNA, 18 nt, Human
aaguaaaaccacagcagu

SEQ ID NO: 2305605 - RNA, 17 nt, Human
aaguaaaaccacagcag

SEQ ID NO: 2305606 - RNA, 18 nt, Human
guuucuagcacuggccug

SEQ ID NO: 2305607 - RNA, 16 nt, Human
guuucuaccucccaga

SEQ ID NO: 2305608 - RNA, 18 nt, Human
guuucuagcuagaaauau

SEQ ID NO: 2305609 - RNA, 23 nt, Human
guuucuagcuagaaauaugauuu

SEQ ID NO: 2305610 - RNA, 15 nt, Human
guuucuaccucccag

SEQ ID NO: 2305611 - RNA, 12 nt, Human
aaguaaagcuaa

SEQ ID NO: 2305612 - RNA, 21 nt, Human
aaguaaagcuaaaaugauuuu

SEQ ID NO: 2305613 - RNA, 16 nt, Human
aaggcuggcugggcau

SEQ ID NO: 2305614 - RNA, 16 nt, Human
aagggcccagauucua

SEQ ID NO: 2305615 - RNA, 20 nt, Human
aagggcccuucacugccuuu

SEQ ID NO: 2305616 - RNA, 16 nt, Human
aaggggaggcagccgg

SEQ ID NO: 2305617 - RNA, 14 nt, Human
aaggggaggcagcc

SEQ ID NO: 2305618 - RNA, 15 nt, Human
aaggggaggagggcg

SEQ ID NO: 2305619 - RNA, 22 nt, Human
aaggggauguauccaugggggc

SEQ ID NO: 2305620 - RNA, 13 nt, Human
aaggggaggaggg

SEQ ID NO: 2305621 - RNA, 16 nt, Human
aaggggagcccacugu

SEQ ID NO: 2305622 - RNA, 13 nt, Human
aaggggagcccac

SEQ ID NO: 2305623 - RNA, 17 nt, Human
aaggguaucaggugcug

SEQ ID NO: 2305624 - RNA, 17 nt, Human
aaggggcaguggugguu

SEQ ID NO: 2305625 - RNA, 14 nt, Human
aaggggcaguggug

SEQ ID NO: 2305626 - RNA, 19 nt, Human
aaggguaucaggugcugcc

SEQ ID NO: 2305627 - RNA, 16 nt, Human
aaggguaucuggugac

SEQ ID NO: 2305628 - RNA, 20 nt, Human
aaggcugaggaaaggccagc

SEQ ID NO: 2305629 - RNA, 19 nt, Human
aaggcugaggaaaggccag

SEQ ID NO: 2305630 - RNA, 17 nt, Human
aaggcugaggaaaggcc

SEQ ID NO: 2305631 - RNA, 23 nt, Human
aaggcugaugccaaguuguuuga

SEQ ID NO: 2305632 - RNA, 16 nt, Human
aaggcugaugucaauu

SEQ ID NO: 2305633 - RNA, 23 nt, Human
aaggcugaggaaaggccagcugg

SEQ ID NO: 2305634 - RNA, 14 nt, Human
aaggcugcgucugg

SEQ ID NO: 2305635 - RNA, 16 nt, Human
aaggcugcgucuggag

SEQ ID NO: 2305636 - RNA, 19 nt, Human
aaggcugcgucuggagggg

SEQ ID NO: 2305637 - RNA, 15 nt, Human
aaggcugcuuagaau

SEQ ID NO: 2305638 - RNA, 18 nt, Human
aaggcuggagugcagugg

SEQ ID NO: 2305639 - RNA, 15 nt, Human
aagggcccagagagg

SEQ ID NO: 2305640 - RNA, 13 nt, Human
aagggcccagaga

SEQ ID NO: 2305641 - RNA, 20 nt, Human
guuguaaauauuuauguaaa

SEQ ID NO: 2305642 - RNA, 14 nt, Human
guuguaaauauuua

SEQ ID NO: 2305643 - RNA, 16 nt, Human
guuguaaauauauaaa

SEQ ID NO: 2305644 - RNA, 18 nt, Human
guuguaaauauauaaaua

SEQ ID NO: 2305645 - RNA, 14 nt, Human
guuguaaauauaua

SEQ ID NO: 2305646 - RNA, 15 nt, Human
guuguaaauauauaa

SEQ ID NO: 2305647 - RNA, 13 nt, Human
guuguaaaauaua

SEQ ID NO: 2305648 - RNA, 14 nt, Human
guuguaaaauauag

SEQ ID NO: 2305649 - RNA, 22 nt, Human
guuguaaaauauagcuguacaa

SEQ ID NO: 2305650 - RNA, 16 nt, Human
guuguaaacaggaagc

SEQ ID NO: 2305651 - RNA, 19 nt, Human
aaggcugaccaagagagaa

SEQ ID NO: 2305652 - RNA, 21 nt, Human
guuguaacuaggcucagagau

SEQ ID NO: 2305653 - RNA, 19 nt, Human
aaggcugagaggagagaga

SEQ ID NO: 2305654 - RNA, 13 nt, Human
guuguaacuaggc

SEQ ID NO: 2305655 - RNA, 18 nt, Human
guuguaacuaggcucaga

SEQ ID NO: 2305656 - RNA, 19 nt, Human
guuguaacuaggcucagag

SEQ ID NO: 2305657 - RNA, 23 nt, Human
guuuuauacuguacuuaauaaau

SEQ ID NO: 2305658 - RNA, 15 nt, Human
guuuuauacugaagg

SEQ ID NO: 2305659 - RNA, 21 nt, Human
guuuuauacugaaggaaaaac

SEQ ID NO: 2305660 - RNA, 18 nt, Human
guuuuauacuguacuuaa

SEQ ID NO: 2305661 - RNA, 15 nt, Human
guuuucugagaaaga

SEQ ID NO: 2305662 - RNA, 15 nt, Human
guuuuauaauuuugu

SEQ ID NO: 2305663 - RNA, 22 nt, Human
guuuuauaauuuugugaagcaa

SEQ ID NO: 2305664 - RNA, 18 nt, Human
guuuuacugcagcuuugu

SEQ ID NO: 2305665 - RNA, 16 nt, Human
guuuuacugcagcuuu

SEQ ID NO: 2305666 - RNA, 21 nt, Human
guuuuacuuuuaaacugugua

SEQ ID NO: 2305667 - RNA, 18 nt, Human
guuuuacuuuuaaacugu

SEQ ID NO: 2305668 - RNA, 13 nt, Human
guuuuacuuuuaa

SEQ ID NO: 2305669 - RNA, 15 nt, Human
guuuuacugcagcuu

SEQ ID NO: 2305670 - RNA, 14 nt, Human
guuuuacugugaaa

SEQ ID NO: 2305671 - RNA, 14 nt, Human
guuuuaagaggcag

SEQ ID NO: 2305672 - RNA, 22 nt, Human
guuuggcugugucuaaacugca

SEQ ID NO: 2305673 - RNA, 20 nt, Human
guuuggcugugucuaaacug

SEQ ID NO: 2305674 - RNA, 21 nt, Human
guuuggcugugucuaaacugc

SEQ ID NO: 2305675 - RNA, 15 nt, Human
guuuggcugugucua

SEQ ID NO: 2305676 - RNA, 17 nt, Human
guuuggcugugucuaaa

SEQ ID NO: 2305677 - RNA, 18 nt, Human
guuuggcugugucuaaac

SEQ ID NO: 2305678 - RNA, 19 nt, Human
guuuggcugugucuaaacu

SEQ ID NO: 2305679 - RNA, 18 nt, Human
guuuuaaggaugcuugua

SEQ ID NO: 2305680 - RNA, 16 nt, Human
guuuuaagaggcaggg

SEQ ID NO: 2305681 - RNA, 21 nt, Human
guuuggcgggccaaggacugc

SEQ ID NO: 2305682 - RNA, 18 nt, Human
guuuggcgggccaaggac

SEQ ID NO: 2305683 - RNA, 16 nt, Human
guuuggcgggccaagg

SEQ ID NO: 2305684 - RNA, 15 nt, Human
guuuggccaucucug

SEQ ID NO: 2305685 - RNA, 17 nt, Human
guuugcucaccuggggu

SEQ ID NO: 2305686 - RNA, 20 nt, Human
guuugcuaucuuaauuuugg

SEQ ID NO: 2305687 - RNA, 17 nt, Human
guuugcuauuagagcau

SEQ ID NO: 2305688 - RNA, 20 nt, Human
guuuggauucuuauguagca

SEQ ID NO: 2305689 - RNA, 15 nt, Human
guuuggcaauaguuu

SEQ ID NO: 2305690 - RNA, 17 nt, Human
guuuggcaauaguuugc

SEQ ID NO: 2305691 - RNA, 19 nt, Human
guuuggcaauaguuugcau

SEQ ID NO: 2305692 - RNA, 13 nt, Human
guuucucugcugu

SEQ ID NO: 2305693 - RNA, 12 nt, Human
guuucucugcug

SEQ ID NO: 2305694 - RNA, 20 nt, Human
guuucucccucucacugucu

SEQ ID NO: 2305695 - RNA, 22 nt, Human
guuucucccucucacugucuga

SEQ ID NO: 2305696 - RNA, 22 nt, Human
guuucugccgcagcccugcaga

SEQ ID NO: 2305697 - RNA, 18 nt, Human
guuucugccgcagcccug

SEQ ID NO: 2305698 - RNA, 16 nt, Human
guuucugccucugagg

SEQ ID NO: 2305699 - RNA, 14 nt, Human
guuucuggucucua

SEQ ID NO: 2305700 - RNA, 18 nt, Human
guuucugguggucuguug

SEQ ID NO: 2305701 - RNA, 21 nt, Human
guuucugguggucuguuggca

SEQ ID NO: 2305702 - RNA, 23 nt, Human
guuucucccccugggcucugccc

SEQ ID NO: 2305703 - RNA, 22 nt, Human
guuucucccccugggcucugcc

SEQ ID NO: 2305704 - RNA, 17 nt, Human
guuucucccccugggcu

SEQ ID NO: 2305705 - RNA, 15 nt, Human
guuucucccccuggg

SEQ ID NO: 2305706 - RNA, 14 nt, Human
guuucucccccugg

SEQ ID NO: 2305707 - RNA, 18 nt, Human
guuucuccaaacugaagc

SEQ ID NO: 2305708 - RNA, 19 nt, Human
guuucucagcucccauuuc

SEQ ID NO: 2305709 - RNA, 18 nt, Human
guuucuagggaaaugaaa

SEQ ID NO: 2305710 - RNA, 15 nt, Human
guuucuagggaaaug

SEQ ID NO: 2305711 - RNA, 21 nt, Human
guuucucagauccuuguuuca

SEQ ID NO: 2305712 - RNA, 15 nt, Human
guuucucagcuccca

SEQ ID NO: 2305713 - RNA, 14 nt, Human
guuucucagcuccc

SEQ ID NO: 2305714 - RNA, 17 nt, Human
guuugccucugccucug

SEQ ID NO: 2305715 - RNA, 19 nt, Human
guuugcaucugaaaauuga

SEQ ID NO: 2305716 - RNA, 14 nt, Human
guuugccugagggc

SEQ ID NO: 2305717 - RNA, 16 nt, Human
guuugcuaucuuaauu

SEQ ID NO: 2305718 - RNA, 18 nt, Human
guuugcuaucuuaauuuu

SEQ ID NO: 2305719 - RNA, 18 nt, Human
guuugccuucuacuuuua

SEQ ID NO: 2305720 - RNA, 13 nt, Human
guuugcuaaguga

SEQ ID NO: 2305721 - RNA, 20 nt, Human
guuugcagagcuugaacaca

SEQ ID NO: 2305722 - RNA, 21 nt, Human
guuugcagaaaagcaccugcc

SEQ ID NO: 2305723 - RNA, 22 nt, Human
guuugcacuguaugcuggacgg

SEQ ID NO: 2305724 - RNA, 19 nt, Human
guuugcagaaaagcaccug

SEQ ID NO: 2305725 - RNA, 22 nt, Human
guuugcagaaaagcaccugccg

SEQ ID NO: 2305726 - RNA, 16 nt, Human
guuugcagaugacaaa

SEQ ID NO: 2305727 - RNA, 14 nt, Human
guuugcauagguga

SEQ ID NO: 2305728 - RNA, 20 nt, Human
guuugcacuguaugcuggac

SEQ ID NO: 2305729 - RNA, 19 nt, Human
guuugcacuguaugcugga

SEQ ID NO: 2305730 - RNA, 20 nt, Human
guuucuggucucuaggcugg

SEQ ID NO: 2305731 - RNA, 23 nt, Human
guuugcacguuaugguguuucuc

SEQ ID NO: 2305732 - RNA, 19 nt, Human
guuuuuuuguauaguaaag

SEQ ID NO: 2305733 - RNA, 19 nt, Human
guuuuuuucuucuguauuu

SEQ ID NO: 2305734 - RNA, 20 nt, Human
guuuuuuuuaaauaaaagca

SEQ ID NO: 2305735 - RNA, 17 nt, Human
guuuuuuuucuaaaacu

SEQ ID NO: 2305736 - RNA, 13 nt, Human
guuuuuuuucuaa

SEQ ID NO: 2305737 - RNA, 18 nt, Human
guuuuuuuuaaauaaaag

SEQ ID NO: 2305738 - RNA, 15 nt, Human
guuuuuuuuuaaaga

SEQ ID NO: 2305739 - RNA, 23 nt, Human
guuuuuuuuuaaaaaagaaacau

SEQ ID NO: 2305740 - RNA, 19 nt, Human
guuuuuuagaucaaauacu

SEQ ID NO: 2305741 - RNA, 15 nt, Human
guuuuuuaugcuaau

SEQ ID NO: 2305742 - RNA, 21 nt, Human
guuuuuuaaaauauuuaucug

SEQ ID NO: 2305743 - RNA, 16 nt, Human
guuuuuuagaucaaau

SEQ ID NO: 2305744 - RNA, 21 nt, Human
guuuuuuccugagcuuggcca

SEQ ID NO: 2305745 - RNA, 14 nt, Human
guuuuuuccugagc

SEQ ID NO: 2305746 - RNA, 12 nt, Human
guuuuuugaaaa

SEQ ID NO: 2305747 - RNA, 9 nt, Human
guuuuuugg

SEQ ID NO: 2305748 - RNA, 10 nt, Human
guuuuuuggu

SEQ ID NO: 2305749 - RNA, 16 nt, Human
guuuuugucuuaaaaa

SEQ ID NO: 2305750 - RNA, 21 nt, Human
guuuuuguaaauuaaucuuuu

SEQ ID NO: 2305751 - RNA, 14 nt, Human
guuuuuguacugua

SEQ ID NO: 2305752 - RNA, 15 nt, Human
guuuuuguaaagugu

SEQ ID NO: 2305753 - RNA, 16 nt, Human
guuuuuguaaagugug

SEQ ID NO: 2305754 - RNA, 14 nt, Human
guuuuuguaaauua

SEQ ID NO: 2305755 - RNA, 15 nt, Human
guuuuuguucaaagc

SEQ ID NO: 2305756 - RNA, 23 nt, Human
guuuuuguucuuaauugcacucu

SEQ ID NO: 2305757 - RNA, 17 nt, Human
guuuuuguuuggagagc

SEQ ID NO: 2305758 - RNA, 18 nt, Human
guuuuugguuuuuaaaac

SEQ ID NO: 2305759 - RNA, 15 nt, Human
guuuuugcacauguu

SEQ ID NO: 2305760 - RNA, 17 nt, Human
guuuuucugcuuuugaa

SEQ ID NO: 2305761 - RNA, 16 nt, Human
guuuuucuggguggcc

SEQ ID NO: 2305762 - RNA, 14 nt, Human
guuuuucugccagg

SEQ ID NO: 2305763 - RNA, 17 nt, Human
guuuuucugccagggag

SEQ ID NO: 2305764 - RNA, 18 nt, Human
guuuuucuaggccugggg

SEQ ID NO: 2305765 - RNA, 18 nt, Human
aagugagaauaggcagcc

SEQ ID NO: 2305766 - RNA, 21 nt, Human
aagugacuuagcagaugcugg

SEQ ID NO: 2305767 - RNA, 19 nt, Human
guuuuucuacuuuuaaaga

SEQ ID NO: 2305768 - RNA, 15 nt, Human
aagugagaagauggu

SEQ ID NO: 2305769 - RNA, 19 nt, Human
aagugacuguucaagagca

SEQ ID NO: 2305770 - RNA, 19 nt, Human
aagugacuuagcagaugcu

SEQ ID NO: 2305771 - RNA, 19 nt, Human
aagugacuuuggcugcaug

SEQ ID NO: 2305772 - RNA, 23 nt, Human
aagugaauuugaaugaaaaauuu

SEQ ID NO: 2305773 - RNA, 20 nt, Human
aagugaauuugaaugaaaaa

SEQ ID NO: 2305774 - RNA, 19 nt, Human
aagugaauuugaaugaaaa

SEQ ID NO: 2305775 - RNA, 17 nt, Human
aagugaauuugaaugaa

SEQ ID NO: 2305776 - RNA, 16 nt, Human
aagugaauuugaauga

SEQ ID NO: 2305777 - RNA, 14 nt, Human
aagugaauuugaau

SEQ ID NO: 2305778 - RNA, 19 nt, Human
aagucaugcaaaggcuggg

SEQ ID NO: 2305779 - RNA, 18 nt, Human
aagugaaugcucaaguuu

SEQ ID NO: 2305780 - RNA, 19 nt, Human
aagugaauuuuucucuaac

SEQ ID NO: 2305781 - RNA, 17 nt, Human
aagugaauuuuucucua

SEQ ID NO: 2305782 - RNA, 14 nt, Human
aagugaauuuuucu

SEQ ID NO: 2305783 - RNA, 21 nt, Human
aagugacaaggccccagagac

SEQ ID NO: 2305784 - RNA, 20 nt, Human
aagugacaaggccccagaga

SEQ ID NO: 2305785 - RNA, 24 nt, Human
aagugacacagcagcuucaccaga

SEQ ID NO: 2305786 - RNA, 12 nt, Human
aagugacaggga

SEQ ID NO: 2305787 - RNA, 19 nt, Human
aagugacaaggccccagag

SEQ ID NO: 2305788 - RNA, 18 nt, Human
aagugacaaggccccaga

SEQ ID NO: 2305789 - RNA, 16 nt, Human
aagugacaaggcccca

SEQ ID NO: 2305790 - RNA, 22 nt, Human
aagugacagggaagcuacaggu

SEQ ID NO: 2305791 - RNA, 23 nt, Human
aagugacagggaagcuacagguu

SEQ ID NO: 2305792 - RNA, 15 nt, Human
aagugacagggaagc

SEQ ID NO: 2305793 - RNA, 16 nt, Human
aagugacagggaagcu

SEQ ID NO: 2305794 - RNA, 19 nt, Human
aagugacagggaagcuaca

SEQ ID NO: 2305795 - RNA, 20 nt, Human
aagugacagggaagcuacag

SEQ ID NO: 2305796 - RNA, 11 nt, Human
aagucaugagc

SEQ ID NO: 2305797 - RNA, 15 nt, Human
aagucauccaaucua

SEQ ID NO: 2305798 - RNA, 23 nt, Human
aagucaugaagcccaagugaaau

SEQ ID NO: 2305799 - RNA, 17 nt, Human
aagucaugaagcccaag

SEQ ID NO: 2305800 - RNA, 15 nt, Human
aagucaugaagccca

SEQ ID NO: 2305801 - RNA, 17 nt, Human
aagucuuagauguauau

SEQ ID NO: 2305802 - RNA, 17 nt, Human
aagucaugcaaaggcug

SEQ ID NO: 2305803 - RNA, 15 nt, Human
aagugaaugcuggga

SEQ ID NO: 2305804 - RNA, 19 nt, Human
aagucuuagauguauauau

SEQ ID NO: 2305805 - RNA, 18 nt, Human
aagucuuagauguauaua

SEQ ID NO: 2305806 - RNA, 15 nt, Human
aaguacuauguauca

SEQ ID NO: 2305807 - RNA, 22 nt, Human
guuuucugagaaagacuauuca

SEQ ID NO: 2305808 - RNA, 17 nt, Human
guuuucugagaaagacu

SEQ ID NO: 2305809 - RNA, 16 nt, Human
guuuucugagaaagac

SEQ ID NO: 2305810 - RNA, 16 nt, Human
aaguacuauguaucaa

SEQ ID NO: 2305811 - RNA, 23 nt, Human
aaguacugcuguaaauaaaugcu

SEQ ID NO: 2305812 - RNA, 20 nt, Human
aaguacugcuguaaauaaau

SEQ ID NO: 2305813 - RNA, 17 nt, Human
aaguacugcuguaaaua

SEQ ID NO: 2305814 - RNA, 21 nt, Human
aaguacuucuccacccugcuc

SEQ ID NO: 2305815 - RNA, 15 nt, Human
aaguacuggagaaaa

SEQ ID NO: 2305816 - RNA, 22 nt, Human
aaguacuucuccacccugcucu

SEQ ID NO: 2305817 - RNA, 23 nt, Human
aaguacuucuccacccugcucuc

SEQ ID NO: 2305818 - RNA, 23 nt, Human
aaguauguuagugcaaauuguca

SEQ ID NO: 2305819 - RNA, 21 nt, Human
aaguauguuagugcaaauugu

SEQ ID NO: 2305820 - RNA, 16 nt, Human
aaguauguuuuagcau

SEQ ID NO: 2305821 - RNA, 15 nt, Human
aaguauuauuuucca

SEQ ID NO: 2305822 - RNA, 19 nt, Human
aagucacaucacaggacac

SEQ ID NO: 2305823 - RNA, 17 nt, Human
aagucacaucacaggac

SEQ ID NO: 2305824 - RNA, 16 nt, Human
aagucacaucacagga

SEQ ID NO: 2305825 - RNA, 13 nt, Human
aagucacacagug

SEQ ID NO: 2305826 - RNA, 18 nt, Human
aagucaauguuuucaguu

SEQ ID NO: 2305827 - RNA, 18 nt, Human
aagucagugggaacguga

SEQ ID NO: 2305828 - RNA, 23 nt, Human
aagucaguccaggaugcuaacau

SEQ ID NO: 2305829 - RNA, 21 nt, Human
aagucagugcccaacuguuau

SEQ ID NO: 2305830 - RNA, 20 nt, Human
aagucagugcccaacuguua

SEQ ID NO: 2305831 - RNA, 12 nt, Human
aagucacugcac

SEQ ID NO: 2305832 - RNA, 14 nt, Human
aagucaccggagcu

SEQ ID NO: 2305833 - RNA, 23 nt, Human
aagucacucccaagcccccuccu

SEQ ID NO: 2305834 - RNA, 18 nt, Human
aagucaccggagcuuuca

SEQ ID NO: 2305835 - RNA, 17 nt, Human
aagucacucccaagccc

SEQ ID NO: 2305836 - RNA, 21 nt, Human
aagucaagugaaaaaggagga

SEQ ID NO: 2305837 - RNA, 24 nt, Human
aagucacacaguauuacuucugcu

SEQ ID NO: 2305838 - RNA, 19 nt, Human
aagucaaggguaggguggg

SEQ ID NO: 2305839 - RNA, 17 nt, Human
aagucaauguuuucagu

SEQ ID NO: 2305840 - RNA, 16 nt, Human
aagucaaccaauguag

SEQ ID NO: 2305841 - RNA, 22 nt, Human
aagucaaccaauguagaaagcu

SEQ ID NO: 2305842 - RNA, 16 nt, Human
aagucaaccugccuga

SEQ ID NO: 2305843 - RNA, 21 nt, Human
aaguauucuguacucuuagau

SEQ ID NO: 2305844 - RNA, 19 nt, Human
aaguauucuuauuuaauga

SEQ ID NO: 2305845 - RNA, 18 nt, Human
aaguauucuuauuuaaug

SEQ ID NO: 2305846 - RNA, 17 nt, Human
aaggccuggcccacagc

SEQ ID NO: 2305847 - RNA, 16 nt, Human
aaggccucuuccuugc

SEQ ID NO: 2305848 - RNA, 15 nt, Human
aaggccuuaauaugu

SEQ ID NO: 2305849 - RNA, 11 nt, Human
aaggccuuuaa

SEQ ID NO: 2305850 - RNA, 12 nt, Human
aaggccuucucc

SEQ ID NO: 2305851 - RNA, 15 nt, Human
aaggccuucuccucc

SEQ ID NO: 2305852 - RNA, 15 nt, Human
aaggccuuuaaaauu

SEQ ID NO: 2305853 - RNA, 16 nt, Human
aaggccuuuaaaauuu

SEQ ID NO: 2305854 - RNA, 17 nt, Human
aaggccuuuaaaauuuu

SEQ ID NO: 2305855 - RNA, 14 nt, Human
aaggccuuucugug

SEQ ID NO: 2305856 - RNA, 23 nt, Human
aaggcgaucccaucuugauaaga

SEQ ID NO: 2305857 - RNA, 18 nt, Human
aaggcgggagcaucucuu

SEQ ID NO: 2305858 - RNA, 13 nt, Human
aaggcggccccuc

SEQ ID NO: 2305859 - RNA, 14 nt, Human
aaggcguggagcug

SEQ ID NO: 2305860 - RNA, 13 nt, Human
aaggcuaccuuug

SEQ ID NO: 2305861 - RNA, 14 nt, Human
guugcccaggcugg

SEQ ID NO: 2305862 - RNA, 15 nt, Human
aaggcuaccuuugua

SEQ ID NO: 2305863 - RNA, 14 nt, Human
aaggcccccuacgc

SEQ ID NO: 2305864 - RNA, 19 nt, Human
aaggccccgcccaggcuua

SEQ ID NO: 2305865 - RNA, 14 nt, Human
aaggccccgcccag

SEQ ID NO: 2305866 - RNA, 16 nt, Human
aaggccccgcccaggc

SEQ ID NO: 2305867 - RNA, 15 nt, Human
aaggccccagagacu

SEQ ID NO: 2305868 - RNA, 22 nt, Human
aaggaugccaagaaguuuaagg

SEQ ID NO: 2305869 - RNA, 19 nt, Human
aaggaugcccaaagaugca

SEQ ID NO: 2305870 - RNA, 14 nt, Human
aaggaugcccaaag

SEQ ID NO: 2305871 - RNA, 22 nt, Human
aaggaugcacagaguuguuaca

SEQ ID NO: 2305872 - RNA, 20 nt, Human
aaggaugccaagaaguuuaa

SEQ ID NO: 2305873 - RNA, 20 nt, Human
aaggaucuuuguggccaagg

SEQ ID NO: 2305874 - RNA, 18 nt, Human
aaggaucuuuguggccaa

SEQ ID NO: 2305875 - RNA, 24 nt, Human
aaggaugcacagaguuguuacauu

SEQ ID NO: 2305876 - RNA, 21 nt, Human
guugggguggguauaaaagau

SEQ ID NO: 2305877 - RNA, 16 nt, Human
guuggggucuggcagc

SEQ ID NO: 2305878 - RNA, 19 nt, Human
guugguuccaagcccugga

SEQ ID NO: 2305879 - RNA, 23 nt, Human
guugggguggguauaaaagaugg

SEQ ID NO: 2305880 - RNA, 18 nt, Human
guugguuccaagcccugg

SEQ ID NO: 2305881 - RNA, 17 nt, Human
guugggcuggugucacc

SEQ ID NO: 2305882 - RNA, 21 nt, Human
guugggagaaugucaguaugu

SEQ ID NO: 2305883 - RNA, 14 nt, Human
guugggagaauguc

SEQ ID NO: 2305884 - RNA, 17 nt, Human
guugggaaugaggcuug

SEQ ID NO: 2305885 - RNA, 14 nt, Human
guugggaagacaug

SEQ ID NO: 2305886 - RNA, 19 nt, Human
guugggaaugaggcuugcu

SEQ ID NO: 2305887 - RNA, 21 nt, Human
guugggaaugaggcuugcuga

SEQ ID NO: 2305888 - RNA, 15 nt, Human
guugcccaggcuggc

SEQ ID NO: 2305889 - RNA, 16 nt, Human
aaggcuaaaacuuaac

SEQ ID NO: 2305890 - RNA, 19 nt, Human
aaggcguggagcugccuga

SEQ ID NO: 2305891 - RNA, 16 nt, Human
aaggcguggagcugcc

SEQ ID NO: 2305892 - RNA, 18 nt, Human
aaggcguggagcugccug

SEQ ID NO: 2305893 - RNA, 16 nt, Human
guugcccaggcuggcg

SEQ ID NO: 2305894 - RNA, 22 nt, Human
guugcuaagaagcgagcacuga

SEQ ID NO: 2305895 - RNA, 20 nt, Human
guugcucaaaucuauucaga

SEQ ID NO: 2305896 - RNA, 18 nt, Human
guugcucaaaaaaugagc

SEQ ID NO: 2305897 - RNA, 17 nt, Human
guugcuaagccccagca

SEQ ID NO: 2305898 - RNA, 22 nt, Human
guugcuaagccccagcaagcaa

SEQ ID NO: 2305899 - RNA, 22 nt, Human
guugcuccgccucugcuggcac

SEQ ID NO: 2305900 - RNA, 20 nt, Human
guugcuccgccucugcuggc

SEQ ID NO: 2305901 - RNA, 18 nt, Human
guugcuccgccucugcug

SEQ ID NO: 2305902 - RNA, 22 nt, Human
guugcucagucucccuuucccu

SEQ ID NO: 2305903 - RNA, 13 nt, Human
guugcugaauagg

SEQ ID NO: 2305904 - RNA, 23 nt, Human
guuggcugggggccucagugcca

SEQ ID NO: 2305905 - RNA, 23 nt, Human
guugcugaugaacucuuaaucaa

SEQ ID NO: 2305906 - RNA, 16 nt, Human
aaggagacucaccucu

SEQ ID NO: 2305907 - RNA, 23 nt, Human
aaggagacucaccucugccucaa

SEQ ID NO: 2305908 - RNA, 22 nt, Human
aaggagacucaccucugccuca

SEQ ID NO: 2305909 - RNA, 20 nt, Human
aaggagacucaccucugccu

SEQ ID NO: 2305910 - RNA, 17 nt, Human
aaggagacucaccucug

SEQ ID NO: 2305911 - RNA, 11 nt, Human
aaggagagaaa

SEQ ID NO: 2305912 - RNA, 12 nt, Human
aaggagagaaag

SEQ ID NO: 2305913 - RNA, 14 nt, Human
aaggagagaaagug

SEQ ID NO: 2305914 - RNA, 12 nt, Human
aaggagacacaa

SEQ ID NO: 2305915 - RNA, 21 nt, Human
aaggaagucaaagcaaggaaa

SEQ ID NO: 2305916 - RNA, 16 nt, Human
aaggaagguuuucucc

SEQ ID NO: 2305917 - RNA, 17 nt, Human
aaggaagguuuucucca

SEQ ID NO: 2305918 - RNA, 16 nt, Human
aaggaagguucuggug

SEQ ID NO: 2305919 - RNA, 18 nt, Human
aaggaagguggauggccc

SEQ ID NO: 2305920 - RNA, 13 nt, Human
aaggagagccugc

SEQ ID NO: 2305921 - RNA, 16 nt, Human
aaggagagaaaguggg

SEQ ID NO: 2305922 - RNA, 18 nt, Human
aaggagagaaggggagga

SEQ ID NO: 2305923 - RNA, 18 nt, Human
aaggagauuuacaacugg

SEQ ID NO: 2305924 - RNA, 14 nt, Human
aaggagagccugcu

SEQ ID NO: 2305925 - RNA, 18 nt, Human
aaggagauuuuccuuccu

SEQ ID NO: 2305926 - RNA, 17 nt, Human
aaggagauuuacaacug

SEQ ID NO: 2305927 - RNA, 22 nt, Human
aaggagcaagucagaauagaaa

SEQ ID NO: 2305928 - RNA, 16 nt, Human
aaggaaggaaagaaag

SEQ ID NO: 2305929 - RNA, 13 nt, Human
aaggaaggaaaga

SEQ ID NO: 2305930 - RNA, 12 nt, Human
aaggaaggaaag

SEQ ID NO: 2305931 - RNA, 20 nt, Human
aaggaaaccacagcugcugg

SEQ ID NO: 2305932 - RNA, 15 nt, Human
aaggaaaccagugca

SEQ ID NO: 2305933 - RNA, 11 nt, Human
aaggaaggaaa

SEQ ID NO: 2305934 - RNA, 16 nt, Human
aaggaaacccagcucu

SEQ ID NO: 2305935 - RNA, 22 nt, Human
aaggaaggagacucaccucugc

SEQ ID NO: 2305936 - RNA, 20 nt, Human
aaggaaggagacucaccucu

SEQ ID NO: 2305937 - RNA, 21 nt, Human
aaggaaggcucuucuccccag

SEQ ID NO: 2305938 - RNA, 22 nt, Human
aaggaagggcauccuucugccu

SEQ ID NO: 2305939 - RNA, 12 nt, Human
aaggaaggugga

SEQ ID NO: 2305940 - RNA, 17 nt, Human
aaggaagguggauggcc

SEQ ID NO: 2305941 - RNA, 15 nt, Human
aaggaaacccagcuc

SEQ ID NO: 2305942 - RNA, 19 nt, Human
guugaucuggaacccagac

SEQ ID NO: 2305943 - RNA, 13 nt, Human
aaggaaaaugauc

SEQ ID NO: 2305944 - RNA, 14 nt, Human
aaggaaaaugaucu

SEQ ID NO: 2305945 - RNA, 16 nt, Human
aaggaaaccacagcug

SEQ ID NO: 2305946 - RNA, 17 nt, Human
aaggaaaccacagcugc

SEQ ID NO: 2305947 - RNA, 18 nt, Human
aaggaaaccacagcugcu

SEQ ID NO: 2305948 - RNA, 17 nt, Human
guugaucuggaacccag

SEQ ID NO: 2305949 - RNA, 16 nt, Human
guugaucuggaaccca

SEQ ID NO: 2305950 - RNA, 14 nt, Human
guugaucagaucug

SEQ ID NO: 2305951 - RNA, 15 nt, Human
guugaucuggaaccc

SEQ ID NO: 2305952 - RNA, 14 nt, Human
aaggaaaaugauac

SEQ ID NO: 2305953 - RNA, 12 nt, Human
aaggaaaaugau

SEQ ID NO: 2305954 - RNA, 23 nt, Human
aaggaucuguuuuuaaaaaucau

SEQ ID NO: 2305955 - RNA, 21 nt, Human
aaggaucuguuuuuaaaaauc

SEQ ID NO: 2305956 - RNA, 16 nt, Human
aaggaucuuuguggcc

SEQ ID NO: 2305957 - RNA, 15 nt, Human
aaggaucuguuuuua

SEQ ID NO: 2305958 - RNA, 22 nt, Human
aaggaucucucaggagcacagg

SEQ ID NO: 2305959 - RNA, 20 nt, Human
aaggaucucucaggagcaca

SEQ ID NO: 2305960 - RNA, 21 nt, Human
aaggaucucucaggagcacag

SEQ ID NO: 2305961 - RNA, 19 nt, Human
aaggauagaugcuggccca

SEQ ID NO: 2305962 - RNA, 16 nt, Human
aaggaucucucaggag

SEQ ID NO: 2305963 - RNA, 20 nt, Human
aaggauccugagccagauuu

SEQ ID NO: 2305964 - RNA, 22 nt, Human
aaggauccugagccagauuuca

SEQ ID NO: 2305965 - RNA, 22 nt, Human
aaggauauuuacuacuuuugca

SEQ ID NO: 2305966 - RNA, 22 nt, Human
aaggaucagaacagcagagguu

SEQ ID NO: 2305967 - RNA, 11 nt, Human
aaggauaaagu

SEQ ID NO: 2305968 - RNA, 20 nt, Human
aaggauagaugcuggcccag

SEQ ID NO: 2305969 - RNA, 11 nt, Human
aaggauccuga

SEQ ID NO: 2305970 - RNA, 12 nt, Human
aaggauccugag

SEQ ID NO: 2305971 - RNA, 20 nt, Human
aaggagcccuuaucugugcu

SEQ ID NO: 2305972 - RNA, 20 nt, Human
aaggaggaagagaaaaaaua

SEQ ID NO: 2305973 - RNA, 19 nt, Human
aaggagccccauuccuggg

SEQ ID NO: 2305974 - RNA, 17 nt, Human
aaggagccccauuccug

SEQ ID NO: 2305975 - RNA, 23 nt, Human
aaggaggauuccauuuggcagag

SEQ ID NO: 2305976 - RNA, 21 nt, Human
aaggauaaaguugguaaaccu

SEQ ID NO: 2305977 - RNA, 13 nt, Human
aaggauaaugaau

SEQ ID NO: 2305978 - RNA, 23 nt, Human
aaggauaaaguugguaaaccuuu

SEQ ID NO: 2305979 - RNA, 23 nt, Human
aagcuuugcuuaugguaauaaaa

SEQ ID NO: 2305980 - RNA, 17 nt, Human
aagcuuugccagcugcu

SEQ ID NO: 2305981 - RNA, 15 nt, Human
aagcuuucugucucc

SEQ ID NO: 2305982 - RNA, 15 nt, Human
aagcuguuuccauag

SEQ ID NO: 2305983 - RNA, 23 nt, Human
aagcuguuuccauagggugacac

SEQ ID NO: 2305984 - RNA, 14 nt, Human
aagcuguuguacau

SEQ ID NO: 2305985 - RNA, 17 nt, Human
aagcuguuguacauuua

SEQ ID NO: 2305986 - RNA, 18 nt, Human
aagcuguuguacauuuau

SEQ ID NO: 2305987 - RNA, 20 nt, Human
aagcuguuguacauuuauga

SEQ ID NO: 2305988 - RNA, 16 nt, Human
aagcuuuccugcccca

SEQ ID NO: 2305989 - RNA, 21 nt, Human
aagcuguuguacauuuaugau

SEQ ID NO: 2305990 - RNA, 18 nt, Human
aagcuuuccugccccagg

SEQ ID NO: 2305991 - RNA, 21 nt, Human
aagcuuuccugccccaggccu

SEQ ID NO: 2305992 - RNA, 22 nt, Human
aagcuuuccugccccaggccug

SEQ ID NO: 2305993 - RNA, 18 nt, Human
aagcuguuacugucuuca

SEQ ID NO: 2305994 - RNA, 13 nt, Human
aagcucugcuccu

SEQ ID NO: 2305995 - RNA, 19 nt, Human
aagcuguuggccucugcaa

SEQ ID NO: 2305996 - RNA, 12 nt, Human
aagcuguuguac

SEQ ID NO: 2305997 - RNA, 13 nt, Human
aagcuguuguaca

SEQ ID NO: 2305998 - RNA, 22 nt, Human
aagcuguugaugguagguggca

SEQ ID NO: 2305999 - RNA, 19 nt, Human
aaggaaaaaagagaaguau

SEQ ID NO: 2306000 - RNA, 23 nt, Human
guuccccuaguaagugccuucca

SEQ ID NO: 2306001 - RNA, 18 nt, Human
aagcuuuuagaaauacug

SEQ ID NO: 2306002 - RNA, 14 nt, Human
aagcuuuuagaaau

SEQ ID NO: 2306003 - RNA, 13 nt, Human
aagcuuuuagaaa

SEQ ID NO: 2306004 - RNA, 16 nt, Human
aagcuuuuaugugaaa

SEQ ID NO: 2306005 - RNA, 15 nt, Human
guuccccuguucacu

SEQ ID NO: 2306006 - RNA, 17 nt, Human
guuccccuguucacucu

SEQ ID NO: 2306007 - RNA, 13 nt, Human
guuccccucacug

SEQ ID NO: 2306008 - RNA, 22 nt, Human
guuccccuccuccacucucccc

SEQ ID NO: 2306009 - RNA, 19 nt, Human
aaggaaaaaauaacaauga

SEQ ID NO: 2306010 - RNA, 16 nt, Human
aaggaaaaaauaacaa

SEQ ID NO: 2306011 - RNA, 22 nt, Human
aagcucugaagucacaucacag

SEQ ID NO: 2306012 - RNA, 16 nt, Human
aagcucugaagucaca

SEQ ID NO: 2306013 - RNA, 12 nt, Human
aagcucugaagu

SEQ ID NO: 2306014 - RNA, 15 nt, Human
aagcucuauuaagau

SEQ ID NO: 2306015 - RNA, 15 nt, Human
aagcucucugcaucu

SEQ ID NO: 2306016 - RNA, 22 nt, Human
aagcucucugcaucuacuccca

SEQ ID NO: 2306017 - RNA, 19 nt, Human
aagcuccuccucccugcau

SEQ ID NO: 2306018 - RNA, 18 nt, Human
aagcuccuccucccugca

SEQ ID NO: 2306019 - RNA, 17 nt, Human
aagcuccuccucccugc

SEQ ID NO: 2306020 - RNA, 16 nt, Human
aagcuccuccucccug

SEQ ID NO: 2306021 - RNA, 15 nt, Human
aagcuccuccucccu

SEQ ID NO: 2306022 - RNA, 13 nt, Human
aagcuccuccucc

SEQ ID NO: 2306023 - RNA, 18 nt, Human
aagcuccuagcagagaga

SEQ ID NO: 2306024 - RNA, 21 nt, Human
aagcuccuccucccugcaucu

SEQ ID NO: 2306025 - RNA, 16 nt, Human
aagcucuagugggaag

SEQ ID NO: 2306026 - RNA, 23 nt, Human
aagcucccaggcauuccccagga

SEQ ID NO: 2306027 - RNA, 16 nt, Human
aagcuccuagcagaga

SEQ ID NO: 2306028 - RNA, 14 nt, Human
aagcucccaggccg

SEQ ID NO: 2306029 - RNA, 12 nt, Human
aagcucccaggc

SEQ ID NO: 2306030 - RNA, 22 nt, Human
aagcucccaggcauuccccagg

SEQ ID NO: 2306031 - RNA, 20 nt, Human
aagcuccaucuccacuccag

SEQ ID NO: 2306032 - RNA, 10 nt, Human
guguuuauuu

SEQ ID NO: 2306033 - RNA, 13 nt, Human
guguuuauuuaua

SEQ ID NO: 2306034 - RNA, 13 nt, Human
guguuuauuguca

SEQ ID NO: 2306035 - RNA, 17 nt, Human
aagcucccaagggaugg

SEQ ID NO: 2306036 - RNA, 19 nt, Human
aagcucccaagggauggug

SEQ ID NO: 2306037 - RNA, 21 nt, Human
aagcucccaagggauggugcc

SEQ ID NO: 2306038 - RNA, 13 nt, Human
aagcucccaggaa

SEQ ID NO: 2306039 - RNA, 14 nt, Human
aagcucccaggaac

SEQ ID NO: 2306040 - RNA, 16 nt, Human
aagcucccaggaacaa

SEQ ID NO: 2306041 - RNA, 11 nt, Human
aagcucccagg

SEQ ID NO: 2306042 - RNA, 12 nt, Human
guguuuaugugu

SEQ ID NO: 2306043 - RNA, 16 nt, Human
guguuuaugugugugu

SEQ ID NO: 2306044 - RNA, 16 nt, Human
guguuuaaauaaagua

SEQ ID NO: 2306045 - RNA, 22 nt, Human
guguuuaagacauuuuuggaag

SEQ ID NO: 2306046 - RNA, 15 nt, Human
guguuuaguugcaga

SEQ ID NO: 2306047 - RNA, 18 nt, Human
guucuccguuagcuccug

SEQ ID NO: 2306048 - RNA, 19 nt, Human
guucuccguuagcuccugu

SEQ ID NO: 2306049 - RNA, 16 nt, Human
guucucugaggacacu

SEQ ID NO: 2306050 - RNA, 11 nt, Human
guucucugccc

SEQ ID NO: 2306051 - RNA, 17 nt, Human
guucugucucauaugau

SEQ ID NO: 2306052 - RNA, 18 nt, Human
guucugucccuuggagcu

SEQ ID NO: 2306053 - RNA, 11 nt, Human
guucugugcac

SEQ ID NO: 2306054 - RNA, 11 nt, Human
guucuguggaa

SEQ ID NO: 2306055 - RNA, 12 nt, Human
guucuguggaaa

SEQ ID NO: 2306056 - RNA, 14 nt, Human
guucuguggaaagu

SEQ ID NO: 2306057 - RNA, 16 nt, Human
guucuguggaaagugu

SEQ ID NO: 2306058 - RNA, 17 nt, Human
guucuguggaaagugua

SEQ ID NO: 2306059 - RNA, 19 nt, Human
guucuguggaaaguguaaa

SEQ ID NO: 2306060 - RNA, 20 nt, Human
guucuguggaaaguguaaag

SEQ ID NO: 2306061 - RNA, 21 nt, Human
guucuguggaaaguguaaagc

SEQ ID NO: 2306062 - RNA, 22 nt, Human
guucuguggaaaguguaaagca

SEQ ID NO: 2306063 - RNA, 12 nt, Human
guucucugcccu

SEQ ID NO: 2306064 - RNA, 18 nt, Human
guucuauuuggaauuuau

SEQ ID NO: 2306065 - RNA, 14 nt, Human
guucuauuuggaau

SEQ ID NO: 2306066 - RNA, 15 nt, Human
guucuauuuggaauu

SEQ ID NO: 2306067 - RNA, 13 nt, Human
guucuauuuggaa

SEQ ID NO: 2306068 - RNA, 15 nt, Human
guucuaguuuucagu

SEQ ID NO: 2306069 - RNA, 18 nt, Human
guucuauuucagugccaa

SEQ ID NO: 2306070 - RNA, 15 nt, Human
guucuauuuaaugga

SEQ ID NO: 2306071 - RNA, 13 nt, Human
guucuaguuuuca

SEQ ID NO: 2306072 - RNA, 14 nt, Human
guucuaguuuucag

SEQ ID NO: 2306073 - RNA, 18 nt, Human
guuccccuguucacucua

SEQ ID NO: 2306074 - RNA, 13 nt, Human
guuccccuuccac

SEQ ID NO: 2306075 - RNA, 14 nt, Human
guucuaguuugcau

SEQ ID NO: 2306076 - RNA, 15 nt, Human
guucuaguuugcauu

SEQ ID NO: 2306077 - RNA, 11 nt, Human
guucucaucuu

SEQ ID NO: 2306078 - RNA, 16 nt, Human
guucucaucuuucuug

SEQ ID NO: 2306079 - RNA, 17 nt, Human
guucucagguguugcca

SEQ ID NO: 2306080 - RNA, 15 nt, Human
guucucagggcuccu

SEQ ID NO: 2306081 - RNA, 23 nt, Human
guucucagggcuccugccuucug

SEQ ID NO: 2306082 - RNA, 19 nt, Human
guucucagcucccccuguc

SEQ ID NO: 2306083 - RNA, 20 nt, Human
guucucagcucccccugucc

SEQ ID NO: 2306084 - RNA, 13 nt, Human
guucucagggcuc

SEQ ID NO: 2306085 - RNA, 14 nt, Human
guucucagggcucc

SEQ ID NO: 2306086 - RNA, 12 nt, Human
guucucacaccc

SEQ ID NO: 2306087 - RNA, 12 nt, Human
guucucacuguu

SEQ ID NO: 2306088 - RNA, 16 nt, Human
guucucacacccaccg

SEQ ID NO: 2306089 - RNA, 17 nt, Human
guucucacacccaccgu

SEQ ID NO: 2306090 - RNA, 13 nt, Human
guucucagcuccc

SEQ ID NO: 2306091 - RNA, 16 nt, Human
guucucacuguucccu

SEQ ID NO: 2306092 - RNA, 19 nt, Human
guucucacuguucccucug

SEQ ID NO: 2306093 - RNA, 14 nt, Human
guucucagcucccc

SEQ ID NO: 2306094 - RNA, 15 nt, Human
guucucagcuccccc

SEQ ID NO: 2306095 - RNA, 17 nt, Human
guucucagcucccccug

SEQ ID NO: 2306096 - RNA, 18 nt, Human
guucucagcucccccugu

SEQ ID NO: 2306097 - RNA, 15 nt, Human
guucugugucugugu

SEQ ID NO: 2306098 - RNA, 23 nt, Human
guucugugguuuuccccucccug

SEQ ID NO: 2306099 - RNA, 13 nt, Human
guucugugucuuu

SEQ ID NO: 2306100 - RNA, 22 nt, Human
guucugugucuuucacagcucc

SEQ ID NO: 2306101 - RNA, 19 nt, Human
guucugugguuuuccccuc

SEQ ID NO: 2306102 - RNA, 21 nt, Human
guucugugguuuuccccuccc

SEQ ID NO: 2306103 - RNA, 23 nt, Human
guucugugucuuucacagcuccu

SEQ ID NO: 2306104 - RNA, 16 nt, Human
guucuguuuugccuga

SEQ ID NO: 2306105 - RNA, 14 nt, Human
guucuguuuacauc

SEQ ID NO: 2306106 - RNA, 16 nt, Human
guucuguuuacaucag

SEQ ID NO: 2306107 - RNA, 19 nt, Human
guucuguuuacaucaguuu

SEQ ID NO: 2306108 - RNA, 15 nt, Human
guugacacaggucuu

SEQ ID NO: 2306109 - RNA, 20 nt, Human
guugacaccucgccccugcu

SEQ ID NO: 2306110 - RNA, 20 nt, Human
guugaucacuggcaaugaaa

SEQ ID NO: 2306111 - RNA, 14 nt, Human
guugauauuucuau

SEQ ID NO: 2306112 - RNA, 20 nt, Human
guugauauuucgaaagcugc

SEQ ID NO: 2306113 - RNA, 13 nt, Human
guugagcuguuuu

SEQ ID NO: 2306114 - RNA, 24 nt, Human
guugagcucucggaacugcaugcu

SEQ ID NO: 2306115 - RNA, 12 nt, Human
guugauaguuua

SEQ ID NO: 2306116 - RNA, 23 nt, Human
guugauagcacagacccugcccu

SEQ ID NO: 2306117 - RNA, 20 nt, Human
guugagccccaaguccugaa

SEQ ID NO: 2306118 - RNA, 22 nt, Human
guugauagcacagacccugccc

SEQ ID NO: 2306119 - RNA, 15 nt, Human
guugagccccuggag

SEQ ID NO: 2306120 - RNA, 14 nt, Human
guugagccuuuucc

SEQ ID NO: 2306121 - RNA, 10 nt, Human
guugagcccc

SEQ ID NO: 2306122 - RNA, 15 nt, Human
guugagccccaaguc

SEQ ID NO: 2306123 - RNA, 16 nt, Human
guugagccccaagucc

SEQ ID NO: 2306124 - RNA, 19 nt, Human
guugagccccaaguccuga

SEQ ID NO: 2306125 - RNA, 12 nt, Human
guugacagcagg

SEQ ID NO: 2306126 - RNA, 18 nt, Human
guugacaguucauaugua

SEQ ID NO: 2306127 - RNA, 17 nt, Human
guugacaguucugaaga

SEQ ID NO: 2306128 - RNA, 16 nt, Human
guugacaguucugaag

SEQ ID NO: 2306129 - RNA, 23 nt, Human
guugagccaggccugggucugug

SEQ ID NO: 2306130 - RNA, 15 nt, Human
guugagccaggccug

SEQ ID NO: 2306131 - RNA, 20 nt, Human
guugagccagcagacauugu

SEQ ID NO: 2306132 - RNA, 22 nt, Human
guugagccagcagacauuguca

SEQ ID NO: 2306133 - RNA, 15 nt, Human
guugagccagcagac

SEQ ID NO: 2306134 - RNA, 16 nt, Human
guugagccagcagaca

SEQ ID NO: 2306135 - RNA, 18 nt, Human
guugagccagcagacauu

SEQ ID NO: 2306136 - RNA, 19 nt, Human
guugagcagggauccuggu

SEQ ID NO: 2306137 - RNA, 22 nt, Human
aaguuuucccuugaggaaacaa

SEQ ID NO: 2306138 - RNA, 13 nt, Human
aaguuuuccugag

SEQ ID NO: 2306139 - RNA, 21 nt, Human
aaguuuucccuugaggaaaca

SEQ ID NO: 2306140 - RNA, 11 nt, Human
aaguuuucagg

SEQ ID NO: 2306141 - RNA, 15 nt, Human
aaguuuucaaugaug

SEQ ID NO: 2306142 - RNA, 23 nt, Human
aaguuuucagaaccucuucccca

SEQ ID NO: 2306143 - RNA, 14 nt, Human
aaguuuguuuuuaa

SEQ ID NO: 2306144 - RNA, 21 nt, Human
aaguuuuaggacaaacagcuc

SEQ ID NO: 2306145 - RNA, 14 nt, Human
aaguuuuaggacaa

SEQ ID NO: 2306146 - RNA, 15 nt, Human
aaguuuugcauuuau

SEQ ID NO: 2306147 - RNA, 14 nt, Human
uaaaauguuaaaac

SEQ ID NO: 2306148 - RNA, 18 nt, Human
aaguuuugaaaagcuauu

SEQ ID NO: 2306149 - RNA, 12 nt, Human
aaguuuugaaaa

SEQ ID NO: 2306150 - RNA, 13 nt, Human
aaguuuugaaaag

SEQ ID NO: 2306151 - RNA, 15 nt, Human
aaguuuugaaaagcu

SEQ ID NO: 2306152 - RNA, 16 nt, Human
aaguuuugaaaagcua

SEQ ID NO: 2306153 - RNA, 14 nt, Human
uaaaauguugaaua

SEQ ID NO: 2306154 - RNA, 19 nt, Human
uaaaauguugaaaagucaa

SEQ ID NO: 2306155 - RNA, 20 nt, Human
uaaaauguugaaaagucaaa

SEQ ID NO: 2306156 - RNA, 22 nt, Human
uaaaauguucacuuuugacaaa

SEQ ID NO: 2306157 - RNA, 17 nt, Human
uaaaauguucacuuuug

SEQ ID NO: 2306158 - RNA, 14 nt, Human
uaaaauguugaaaa

SEQ ID NO: 2306159 - RNA, 15 nt, Human
uaaaauguugaaaag

SEQ ID NO: 2306160 - RNA, 17 nt, Human
uaaaauguugaaaaguc

SEQ ID NO: 2306161 - RNA, 18 nt, Human
uaaaauguugaaaaguca

SEQ ID NO: 2306162 - RNA, 21 nt, Human
aaguuugcacuguaugcugga

SEQ ID NO: 2306163 - RNA, 13 nt, Human
aaguuugcuuaga

SEQ ID NO: 2306164 - RNA, 14 nt, Human
aaguuugcacugua

SEQ ID NO: 2306165 - RNA, 15 nt, Human
aaguuugcuuagaaa

SEQ ID NO: 2306166 - RNA, 19 nt, Human
aaguuuggcaauaguuugc

SEQ ID NO: 2306167 - RNA, 16 nt, Human
aaguuugcuuagaaaa

SEQ ID NO: 2306168 - RNA, 16 nt, Human
aaguuucaguugauuu

SEQ ID NO: 2306169 - RNA, 17 nt, Human
aaguuucaggugacaug

SEQ ID NO: 2306170 - RNA, 19 nt, Human
aaguuucaggugacaugug

SEQ ID NO: 2306171 - RNA, 21 nt, Human
aaguuucaggugacaugugaa

SEQ ID NO: 2306172 - RNA, 22 nt, Human
aaguuucaggugacaugugaaa

SEQ ID NO: 2306173 - RNA, 12 nt, Human
aaguuugcaauu

SEQ ID NO: 2306174 - RNA, 20 nt, Human
aaguuucacugacuuagaac

SEQ ID NO: 2306175 - RNA, 19 nt, Human
aaguuucaggauacaugug

SEQ ID NO: 2306176 - RNA, 21 nt, Human
aaguuucagagaccauugcaa

SEQ ID NO: 2306177 - RNA, 12 nt, Human
aaguuucaggug

SEQ ID NO: 2306178 - RNA, 14 nt, Human
aaguuucaggugac

SEQ ID NO: 2306179 - RNA, 15 nt, Human
aaguuucaggugaca

SEQ ID NO: 2306180 - RNA, 16 nt, Human
aaguuucaggugacau

SEQ ID NO: 2306181 - RNA, 16 nt, Human
aaguuucaaugugauu

SEQ ID NO: 2306182 - RNA, 22 nt, Human
aaguuucaaugugauucuaaug

SEQ ID NO: 2306183 - RNA, 17 nt, Human
aaguuuaugucuaaaga

SEQ ID NO: 2306184 - RNA, 16 nt, Human
aaguuuaugucuaaag

SEQ ID NO: 2306185 - RNA, 17 nt, Human
uaaaauuuuaucucuua

SEQ ID NO: 2306186 - RNA, 17 nt, Human
uaaaauuuuuaaucuuu

SEQ ID NO: 2306187 - RNA, 15 nt, Human
uaaaauuuguugcau

SEQ ID NO: 2306188 - RNA, 14 nt, Human
uaaaauuauuccuu

SEQ ID NO: 2306189 - RNA, 14 nt, Human
uaaaauuuguugca

SEQ ID NO: 2306190 - RNA, 16 nt, Human
uaaaauuaaagcugaa

SEQ ID NO: 2306191 - RNA, 18 nt, Human
uaaaauuaaagcugaaaa

SEQ ID NO: 2306192 - RNA, 14 nt, Human
uaaaauuaaagcua

SEQ ID NO: 2306193 - RNA, 19 nt, Human
uaaaauuaaagcugaaaac

SEQ ID NO: 2306194 - RNA, 19 nt, Human
uaaaauuauagaugggaau

SEQ ID NO: 2306195 - RNA, 13 nt, Human
uaaacaaagguug

SEQ ID NO: 2306196 - RNA, 19 nt, Human
uaaaccaaggcuagaacca

SEQ ID NO: 2306197 - RNA, 17 nt, Human
uaaacaaaguuacuagg

SEQ ID NO: 2306198 - RNA, 15 nt, Human
uaaacaaaguuacua

SEQ ID NO: 2306199 - RNA, 14 nt, Human
uaaacaaaguuacu

SEQ ID NO: 2306200 - RNA, 22 nt, Human
uaaaccaccagugcccaaaguc

SEQ ID NO: 2306201 - RNA, 21 nt, Human
uaaaccacaaggcuguugcau

SEQ ID NO: 2306202 - RNA, 21 nt, Human
uaaaccagguuuagacaguau

SEQ ID NO: 2306203 - RNA, 19 nt, Human
uaaaccauaaaaagcugac

SEQ ID NO: 2306204 - RNA, 17 nt, Human
uaaaccauaaaaagcug

SEQ ID NO: 2306205 - RNA, 18 nt, Human
uaaaccauaaaaagcuga

SEQ ID NO: 2306206 - RNA, 19 nt, Human
uaaaauuuuuaaucuuuaa

SEQ ID NO: 2306207 - RNA, 16 nt, Human
uaaaauuuuuuuagaa

SEQ ID NO: 2306208 - RNA, 17 nt, Human
uaaaauuuuuuuagaaa

SEQ ID NO: 2306209 - RNA, 18 nt, Human
uaaaauuuuuuuagaaag

SEQ ID NO: 2306210 - RNA, 19 nt, Human
uaaaauuuuuuuagaaagc

SEQ ID NO: 2306211 - RNA, 23 nt, Human
uaaaauuuuuuuucauguuuuaa

SEQ ID NO: 2306212 - RNA, 18 nt, Human
uaaacaaaauagaagcug

SEQ ID NO: 2306213 - RNA, 23 nt, Human
uaaacaaaauagaagcuguagua

SEQ ID NO: 2306214 - RNA, 20 nt, Human
uaaaauuuuuuuucauguuu

SEQ ID NO: 2306215 - RNA, 19 nt, Human
uaaaauuuuuuuucauguu

SEQ ID NO: 2306216 - RNA, 17 nt, Human
uaaaauuuuuuuucaug

SEQ ID NO: 2306217 - RNA, 16 nt, Human
uaaaauuuuuuuucau

SEQ ID NO: 2306218 - RNA, 20 nt, Human
uaaaauuuuuuuagaaagca

SEQ ID NO: 2306219 - RNA, 21 nt, Human
uaaaauuuuuuuagaaagcau

SEQ ID NO: 2306220 - RNA, 14 nt, Human
aaguucauaggguc

SEQ ID NO: 2306221 - RNA, 15 nt, Human
aaguucauauuccau

SEQ ID NO: 2306222 - RNA, 21 nt, Human
aaguucauauuccauauuuau

SEQ ID NO: 2306223 - RNA, 22 nt, Human
aaguucauauuccauauuuauu

SEQ ID NO: 2306224 - RNA, 23 nt, Human
aaguucauauuccauauuuauuc

SEQ ID NO: 2306225 - RNA, 17 nt, Human
aaguucuagagaagagg

SEQ ID NO: 2306226 - RNA, 21 nt, Human
aaguucuagagaagaggcugg

SEQ ID NO: 2306227 - RNA, 18 nt, Human
aaguuauugacaaacucu

SEQ ID NO: 2306228 - RNA, 14 nt, Human
aaguuauugacaaa

SEQ ID NO: 2306229 - RNA, 14 nt, Human
aaguuauugcaguu

SEQ ID NO: 2306230 - RNA, 15 nt, Human
aaguuauugcaguuu

SEQ ID NO: 2306231 - RNA, 17 nt, Human
aaguuauugcaguuuau

SEQ ID NO: 2306232 - RNA, 23 nt, Human
aaguuauugcaguuuaucauuca

SEQ ID NO: 2306233 - RNA, 18 nt, Human
aaguucuagagaagaggc

SEQ ID NO: 2306234 - RNA, 15 nt, Human
aaguucugaguguuu

SEQ ID NO: 2306235 - RNA, 15 nt, Human
aaguucugacuugac

SEQ ID NO: 2306236 - RNA, 17 nt, Human
aaguucugcagauaaac

SEQ ID NO: 2306237 - RNA, 14 nt, Human
aaguuuaauugacu

SEQ ID NO: 2306238 - RNA, 22 nt, Human
aaguuuacaguaaauaaauugu

SEQ ID NO: 2306239 - RNA, 11 nt, Human
aaguuuagaga

SEQ ID NO: 2306240 - RNA, 19 nt, Human
aaguuuacucaacccucuc

SEQ ID NO: 2306241 - RNA, 19 nt, Human
aaguuuacauuguaaauag

SEQ ID NO: 2306242 - RNA, 20 nt, Human
aaguuuacaguaaauaaauu

SEQ ID NO: 2306243 - RNA, 21 nt, Human
aaguuuacaguaaauaaauug

SEQ ID NO: 2306244 - RNA, 19 nt, Human
aaguuuacaaucaaaggaa

SEQ ID NO: 2306245 - RNA, 18 nt, Human
aaguuuacaaucaaagga

SEQ ID NO: 2306246 - RNA, 20 nt, Human
aaguuuaauggugccuucau

SEQ ID NO: 2306247 - RNA, 18 nt, Human
aaguuuacaaguguauau

SEQ ID NO: 2306248 - RNA, 21 nt, Human
aaguuuacaaguguauaucag

SEQ ID NO: 2306249 - RNA, 18 nt, Human
aaguuuacauuguaaaua

SEQ ID NO: 2306250 - RNA, 23 nt, Human
aaguuuacaaguguauaucagaa

SEQ ID NO: 2306251 - RNA, 12 nt, Human
aaguuuacagua

SEQ ID NO: 2306252 - RNA, 18 nt, Human
aaguuuacaguaaauaaa

SEQ ID NO: 2306253 - RNA, 19 nt, Human
aaguuuacaguaaauaaau

SEQ ID NO: 2306254 - RNA, 20 nt, Human
aaguguuguaaauauuuaug

SEQ ID NO: 2306255 - RNA, 18 nt, Human
aaguguuguaaauauuua

SEQ ID NO: 2306256 - RNA, 22 nt, Human
aaguguuguaaauauuuaugua

SEQ ID NO: 2306257 - RNA, 15 nt, Human
aaguguuuauuuuuc

SEQ ID NO: 2306258 - RNA, 16 nt, Human
aaguguuuauuuuuca

SEQ ID NO: 2306259 - RNA, 19 nt, Human
aaguguuuauuuuucauau

SEQ ID NO: 2306260 - RNA, 23 nt, Human
aaguguuggcuaaugaagggaaa

SEQ ID NO: 2306261 - RNA, 17 nt, Human
aaguguuguaaauauuu

SEQ ID NO: 2306262 - RNA, 14 nt, Human
aaguguuucuguua

SEQ ID NO: 2306263 - RNA, 21 nt, Human
aaguguuuauuuuucauauug

SEQ ID NO: 2306264 - RNA, 21 nt, Human
aaguguuucuguuauuaacaa

SEQ ID NO: 2306265 - RNA, 23 nt, Human
aaguguuucuguuauuaacaaac

SEQ ID NO: 2306266 - RNA, 23 nt, Human
aaguguuuuguucuuucuggagu

SEQ ID NO: 2306267 - RNA, 20 nt, Human
guuuuuuuuuccuguccuuc

SEQ ID NO: 2306268 - RNA, 23 nt, Human
guuuuuuuuuauacacuguaaug

SEQ ID NO: 2306269 - RNA, 19 nt, Human
guuuuuuuuuccuguccuu

SEQ ID NO: 2306270 - RNA, 14 nt, Human
guuuuuuuucuucu

SEQ ID NO: 2306271 - RNA, 20 nt, Human
guuuuuuuuuauacacugua

SEQ ID NO: 2306272 - RNA, 17 nt, Human
guuuuuuuuuaaagacu

SEQ ID NO: 2306273 - RNA, 17 nt, Human
aaguuacacauuuuuca

SEQ ID NO: 2306274 - RNA, 17 nt, Human
aaguuaaagugaauaac

SEQ ID NO: 2306275 - RNA, 18 nt, Human
aaguuaaacauugaagua

SEQ ID NO: 2306276 - RNA, 14 nt, Human
aaguuaaauaaauc

SEQ ID NO: 2306277 - RNA, 12 nt, Human
aaguuaaauaaa

SEQ ID NO: 2306278 - RNA, 19 nt, Human
aaguuauuaauauuuuaau

SEQ ID NO: 2306279 - RNA, 19 nt, Human
aaguuacuuugucagaggc

SEQ ID NO: 2306280 - RNA, 14 nt, Human
aaguuagaauuccu

SEQ ID NO: 2306281 - RNA, 16 nt, Human
aaguuacuuauucuag

SEQ ID NO: 2306282 - RNA, 15 nt, Human
aaguuacuuauucua

SEQ ID NO: 2306283 - RNA, 23 nt, Human
aaguuacuucacuuuaauucuca

SEQ ID NO: 2306284 - RNA, 12 nt, Human
aaguuacuuugu

SEQ ID NO: 2306285 - RNA, 22 nt, Human
aaguuacuucacuuuaauucuc

SEQ ID NO: 2306286 - RNA, 12 nt, Human
aaguuacugaau

SEQ ID NO: 2306287 - RNA, 14 nt, Human
aaguuacugaaugc

SEQ ID NO: 2306288 - RNA, 15 nt, Human
aaguuacugaaugca

SEQ ID NO: 2306289 - RNA, 21 nt, Human
aaguuacuagguaacuucaua

SEQ ID NO: 2306290 - RNA, 20 nt, Human
aaguuacuagguaacuucau

SEQ ID NO: 2306291 - RNA, 19 nt, Human
aaguuacuagguaacuuca

SEQ ID NO: 2306292 - RNA, 18 nt, Human
aaguuacuagguaacuuc

SEQ ID NO: 2306293 - RNA, 18 nt, Human
uaaagaguuaguuugagu

SEQ ID NO: 2306294 - RNA, 20 nt, Human
uaaagaggcugaaagaggcc

SEQ ID NO: 2306295 - RNA, 17 nt, Human
uaaagaggcugaaagag

SEQ ID NO: 2306296 - RNA, 19 nt, Human
uaaagagcccuugccuccc

SEQ ID NO: 2306297 - RNA, 21 nt, Human
uaaagagcccuugccucccca

SEQ ID NO: 2306298 - RNA, 18 nt, Human
uaaagagauucacacaca

SEQ ID NO: 2306299 - RNA, 15 nt, Human
uaaagagcccuugcc

SEQ ID NO: 2306300 - RNA, 16 nt, Human
uaaagagcccuugccu

SEQ ID NO: 2306301 - RNA, 17 nt, Human
uaaagagcccuugccuc

SEQ ID NO: 2306302 - RNA, 12 nt, Human
uaaagagagaau

SEQ ID NO: 2306303 - RNA, 13 nt, Human
uaaagagagguua

SEQ ID NO: 2306304 - RNA, 19 nt, Human
uaaagagaccuaccucagg

SEQ ID NO: 2306305 - RNA, 20 nt, Human
uaaagagaccuaccucaggu

SEQ ID NO: 2306306 - RNA, 22 nt, Human
uaaagagaccuaccucagguug

SEQ ID NO: 2306307 - RNA, 13 nt, Human
uaaagauggaaaa

SEQ ID NO: 2306308 - RNA, 22 nt, Human
uaaagaugcaaggaccaggacu

SEQ ID NO: 2306309 - RNA, 21 nt, Human
uaaagaugcaaggaccaggac

SEQ ID NO: 2306310 - RNA, 13 nt, Human
uaaagaugaucua

SEQ ID NO: 2306311 - RNA, 21 nt, Human
uaaagaugaucuacucagaaa

SEQ ID NO: 2306312 - RNA, 11 nt, Human
uaaagaugauc

SEQ ID NO: 2306313 - RNA, 12 nt, Human
uaaagaguucuu

SEQ ID NO: 2306314 - RNA, 23 nt, Human
uaaagauacagaacucuuucaaa

SEQ ID NO: 2306315 - RNA, 22 nt, Human
uaaagauauuuuuaucuuuaua

SEQ ID NO: 2306316 - RNA, 21 nt, Human
uaaagauauuuuuaucuuuau

SEQ ID NO: 2306317 - RNA, 18 nt, Human
uaaagauauuuuuaucuu

SEQ ID NO: 2306318 - RNA, 20 nt, Human
uaaaggcuauacuugucuug

SEQ ID NO: 2306319 - RNA, 21 nt, Human
uaaagcaacugucuauuucug

SEQ ID NO: 2306320 - RNA, 17 nt, Human
uaaaggcucgauuuugu

SEQ ID NO: 2306321 - RNA, 18 nt, Human
uaaaggcucgauuuugua

SEQ ID NO: 2306322 - RNA, 19 nt, Human
uaaaggcucgauuuuguau

SEQ ID NO: 2306323 - RNA, 22 nt, Human
uaaaggcucgauuuuguaucug

SEQ ID NO: 2306324 - RNA, 14 nt, Human
uaaaggcuucucuc

SEQ ID NO: 2306325 - RNA, 15 nt, Human
uaaaggcuucucucu

SEQ ID NO: 2306326 - RNA, 21 nt, Human
uaaaggcuaccuuuguauucu

SEQ ID NO: 2306327 - RNA, 16 nt, Human
uaaagcaacugucuau

SEQ ID NO: 2306328 - RNA, 20 nt, Human
uaaagcaacugucuauuucu

SEQ ID NO: 2306329 - RNA, 19 nt, Human
uaaaggcuaccuuuguauu

SEQ ID NO: 2306330 - RNA, 14 nt, Human
uaaagauuucuuga

SEQ ID NO: 2306331 - RNA, 15 nt, Human
uaaagauuuaucaaa

SEQ ID NO: 2306332 - RNA, 22 nt, Human
uaaagauuuaucaaaucaguca

SEQ ID NO: 2306333 - RNA, 15 nt, Human
uaaagauguuaaaaa

SEQ ID NO: 2306334 - RNA, 10 nt, Human
uaaagacaga

SEQ ID NO: 2306335 - RNA, 15 nt, Human
uaaagacagaggcag

SEQ ID NO: 2306336 - RNA, 21 nt, Human
uaaagacagggaagagcagaa

SEQ ID NO: 2306337 - RNA, 19 nt, Human
uaaagacaggguuucacca

SEQ ID NO: 2306338 - RNA, 9 nt, Human
uaaagacag

SEQ ID NO: 2306339 - RNA, 22 nt, Human
uaaagacaaagacaaauucugu

SEQ ID NO: 2306340 - RNA, 20 nt, Human
uaaagacaaagacaaauucu

SEQ ID NO: 2306341 - RNA, 19 nt, Human
uaaagacaaagacaaauuc

SEQ ID NO: 2306342 - RNA, 15 nt, Human
uaaagacaccuacug

SEQ ID NO: 2306343 - RNA, 20 nt, Human
uaaagacuggcuuuuauuaa

SEQ ID NO: 2306344 - RNA, 15 nt, Human
uaaagacuggcuuuu

SEQ ID NO: 2306345 - RNA, 15 nt, Human
uaaagagaccuaccu

SEQ ID NO: 2306346 - RNA, 14 nt, Human
uaaagacuggcuuu

SEQ ID NO: 2306347 - RNA, 16 nt, Human
uaaagacuuuuaugau

SEQ ID NO: 2306348 - RNA, 14 nt, Human
uaaagaagguuuca

SEQ ID NO: 2306349 - RNA, 15 nt, Human
uaaagaauaauaugc

SEQ ID NO: 2306350 - RNA, 15 nt, Human
uaaagacaaagacaa

SEQ ID NO: 2306351 - RNA, 11 nt, Human
uaaagacaaag

SEQ ID NO: 2306352 - RNA, 16 nt, Human
uaaagaaauugcaaua

SEQ ID NO: 2306353 - RNA, 17 nt, Human
uaaagaaauugcaauaa

SEQ ID NO: 2306354 - RNA, 19 nt, Human
uaaagaacacccuauauuu

SEQ ID NO: 2306355 - RNA, 15 nt, Human
uaaagaacauaaaua

SEQ ID NO: 2306356 - RNA, 13 nt, Human
uaaagaagauguu

SEQ ID NO: 2306357 - RNA, 18 nt, Human
uaaagaagauguuuaacu

SEQ ID NO: 2306358 - RNA, 13 nt, Human
uaaagaagcaaua

SEQ ID NO: 2306359 - RNA, 21 nt, Human
uaaagaagcaauaaagaagag

SEQ ID NO: 2306360 - RNA, 14 nt, Human
uaaacccauuuuag

SEQ ID NO: 2306361 - RNA, 23 nt, Human
uaaacccauuuuagucacuuuuu

SEQ ID NO: 2306362 - RNA, 19 nt, Human
uaaacccaguaguggugac

SEQ ID NO: 2306363 - RNA, 18 nt, Human
uaaaccgccaaggcuggg

SEQ ID NO: 2306364 - RNA, 16 nt, Human
uaaaccgccaaggcug

SEQ ID NO: 2306365 - RNA, 18 nt, Human
uaaaccuaaaaaagauau

SEQ ID NO: 2306366 - RNA, 15 nt, Human
uaaaccuaaaaaaga

SEQ ID NO: 2306367 - RNA, 16 nt, Human
uaaaccuaaaaaagau

SEQ ID NO: 2306368 - RNA, 13 nt, Human
uaaaccuaaaaaa

SEQ ID NO: 2306369 - RNA, 18 nt, Human
uaaaccucaaaaugucua

SEQ ID NO: 2306370 - RNA, 19 nt, Human
uaaaccucaaaaugucuaa

SEQ ID NO: 2306371 - RNA, 17 nt, Human
uaaacgugaugaucagc

SEQ ID NO: 2306372 - RNA, 20 nt, Human
uaaacguaugcaugugaaga

SEQ ID NO: 2306373 - RNA, 23 nt, Human
uaaacggauuauuuuuucagacc

SEQ ID NO: 2306374 - RNA, 15 nt, Human
uaaacguaugcaugu

SEQ ID NO: 2306375 - RNA, 22 nt, Human
uaaacgugaugaucagcuguuu

SEQ ID NO: 2306376 - RNA, 17 nt, Human
uaaacgugcagacuaug

SEQ ID NO: 2306377 - RNA, 15 nt, Human
uaaacggauuccaaa

SEQ ID NO: 2306378 - RNA, 19 nt, Human
uaaacggauuauuuuuuca

SEQ ID NO: 2306379 - RNA, 20 nt, Human
uaaacggauuauuuuuucag

SEQ ID NO: 2306380 - RNA, 21 nt, Human
uaaacggauuauuuuuucaga

SEQ ID NO: 2306381 - RNA, 22 nt, Human
uaaacggauuauuuuuucagac

SEQ ID NO: 2306382 - RNA, 13 nt, Human
uaaacggauuauu

SEQ ID NO: 2306383 - RNA, 14 nt, Human
uaaacggauuauuu

SEQ ID NO: 2306384 - RNA, 15 nt, Human
uaaacggauuauuuu

SEQ ID NO: 2306385 - RNA, 16 nt, Human
uaaacggauuauuuuu

SEQ ID NO: 2306386 - RNA, 17 nt, Human
uaaacggauuauuuuuu

SEQ ID NO: 2306387 - RNA, 18 nt, Human
uaaacggauuauuuuuuc

SEQ ID NO: 2306388 - RNA, 16 nt, Human
uaaaccuuaguacuga

SEQ ID NO: 2306389 - RNA, 15 nt, Human
uaaaccuuaaguaag

SEQ ID NO: 2306390 - RNA, 18 nt, Human
uaaaccucuaauuuauuu

SEQ ID NO: 2306391 - RNA, 22 nt, Human
uaaacgauuuaauucucuugaa

SEQ ID NO: 2306392 - RNA, 18 nt, Human
uaaacgauuuaauucucu

SEQ ID NO: 2306393 - RNA, 15 nt, Human
uaaacuauuugucuu

SEQ ID NO: 2306394 - RNA, 15 nt, Human
uaaacucaaaacuua

SEQ ID NO: 2306395 - RNA, 19 nt, Human
uaaacucaaaacuuaacau

SEQ ID NO: 2306396 - RNA, 22 nt, Human
uaaacuaucuuggugaauuuuu

SEQ ID NO: 2306397 - RNA, 17 nt, Human
uaaacuaucaguuuguc

SEQ ID NO: 2306398 - RNA, 14 nt, Human
uaaacuaucuuuuu

SEQ ID NO: 2306399 - RNA, 21 nt, Human
uaaacuaucuuggugaauuuu

SEQ ID NO: 2306400 - RNA, 20 nt, Human
uaaacuaucuuggugaauuu

SEQ ID NO: 2306401 - RNA, 13 nt, Human
uaaacuaucaguu

SEQ ID NO: 2306402 - RNA, 14 nt, Human
uaaacuauauuuuc

SEQ ID NO: 2306403 - RNA, 23 nt, Human
uaaacuagcauaucugccuuuau

SEQ ID NO: 2306404 - RNA, 21 nt, Human
uaaacuagcauaucugccuuu

SEQ ID NO: 2306405 - RNA, 22 nt, Human
uaaacuagcauaucugccuuua

SEQ ID NO: 2306406 - RNA, 17 nt, Human
uaaacuagcauaucugc

SEQ ID NO: 2306407 - RNA, 19 nt, Human
uaaacuagcauaucugccu

SEQ ID NO: 2306408 - RNA, 14 nt, Human
uaaacucauuuaua

SEQ ID NO: 2306409 - RNA, 14 nt, Human
uaaacuccuguccu

SEQ ID NO: 2306410 - RNA, 15 nt, Human
uaaacuccuguccuu

SEQ ID NO: 2306411 - RNA, 14 nt, Human
uaaacucuaaacau

SEQ ID NO: 2306412 - RNA, 15 nt, Human
uaaacucuaaacauu

SEQ ID NO: 2306413 - RNA, 22 nt, Human
uaaacucuaaacauuaaucaau

SEQ ID NO: 2306414 - RNA, 23 nt, Human
uaaacucaaaauauuuguacaua

SEQ ID NO: 2306415 - RNA, 22 nt, Human
uaaacucaaaauauuuguacau

SEQ ID NO: 2306416 - RNA, 20 nt, Human
uaaacucaaaacuuaacaua

SEQ ID NO: 2306417 - RNA, 11 nt, Human
uaaacucaggg

SEQ ID NO: 2306418 - RNA, 19 nt, Human
uaaacucagggacagagcc

SEQ ID NO: 2306419 - RNA, 20 nt, Human
uaaacucagggacagagcca

SEQ ID NO: 2306420 - RNA, 21 nt, Human
uaaacucaaaauauuuguaca

SEQ ID NO: 2306421 - RNA, 19 nt, Human
uaaacucaaaauauuugua

SEQ ID NO: 2306422 - RNA, 16 nt, Human
uaaacucaaaauauuu

SEQ ID NO: 2306423 - RNA, 14 nt, Human
uaaacucaaaauau

SEQ ID NO: 2306424 - RNA, 16 nt, Human
uaaacugcauuagaaa

SEQ ID NO: 2306425 - RNA, 15 nt, Human
uaaagaaagagagaa

SEQ ID NO: 2306426 - RNA, 17 nt, Human
uaaagaaagagagaaaa

SEQ ID NO: 2306427 - RNA, 16 nt, Human
uaaagaaagagagaaa

SEQ ID NO: 2306428 - RNA, 12 nt, Human
uaaacugccccc

SEQ ID NO: 2306429 - RNA, 14 nt, Human
uaaacugacuuuau

SEQ ID NO: 2306430 - RNA, 15 nt, Human
uaaacugacuuuauc

SEQ ID NO: 2306431 - RNA, 16 nt, Human
uaaacugacuuuaucc

SEQ ID NO: 2306432 - RNA, 10 nt, Human
uaaacugcau

SEQ ID NO: 2306433 - RNA, 18 nt, Human
uaaacucucuuugggaau

SEQ ID NO: 2306434 - RNA, 21 nt, Human
uaaacucucuuugggaauguu

SEQ ID NO: 2306435 - RNA, 20 nt, Human
uaaacucuucacaaaaucug

SEQ ID NO: 2306436 - RNA, 15 nt, Human
uaaacucuguugcaa

SEQ ID NO: 2306437 - RNA, 11 nt, Human
uaaagaaaguc

SEQ ID NO: 2306438 - RNA, 17 nt, Human
uaaagaaagucgaauua

SEQ ID NO: 2306439 - RNA, 21 nt, Human
uaaagaaagucgaauuaauag

SEQ ID NO: 2306440 - RNA, 23 nt, Human
uaaagaaagagagaaaauaaaaa

SEQ ID NO: 2306441 - RNA, 22 nt, Human
uaaagaaagagagaaaauaaaa

SEQ ID NO: 2306442 - RNA, 11 nt, Human
uaaagaaagau

SEQ ID NO: 2306443 - RNA, 21 nt, Human
uaaagaaagagagaaaauaaa

SEQ ID NO: 2306444 - RNA, 20 nt, Human
uaaagaaagagagaaaauaa

SEQ ID NO: 2306445 - RNA, 19 nt, Human
uaaagaaagagagaaaaua

SEQ ID NO: 2306446 - RNA, 18 nt, Human
uaaagaaagagagaaaau

SEQ ID NO: 2306447 - RNA, 19 nt, Human
aauaaaaugaggacauguu

SEQ ID NO: 2306448 - RNA, 18 nt, Human
aauaaaaucauguacauu

SEQ ID NO: 2306449 - RNA, 11 nt, Human
aauaaaaucau

SEQ ID NO: 2306450 - RNA, 18 nt, Human
aauaaaggaugugauugu

SEQ ID NO: 2306451 - RNA, 14 nt, Human
aauaaaguaauuau

SEQ ID NO: 2306452 - RNA, 15 nt, Human
aauaaaguauauaua

SEQ ID NO: 2306453 - RNA, 11 nt, Human
aauaaaguauc

SEQ ID NO: 2306454 - RNA, 15 nt, Human
aauaaaguaucaugc

SEQ ID NO: 2306455 - RNA, 16 nt, Human
aauaaaguacaagagc

SEQ ID NO: 2306456 - RNA, 15 nt, Human
aauaaaauaauucua

SEQ ID NO: 2306457 - RNA, 14 nt, Human
aauaaaauaaaaau

SEQ ID NO: 2306458 - RNA, 16 nt, Human
aauaaaauaauucuaa

SEQ ID NO: 2306459 - RNA, 17 nt, Human
aauaaaauaauucuaaa

SEQ ID NO: 2306460 - RNA, 16 nt, Human
aauaaaaucuugaaaa

SEQ ID NO: 2306461 - RNA, 22 nt, Human
aauaaaauccauacauuugugu

SEQ ID NO: 2306462 - RNA, 13 nt, Human
aauaaaaauggau

SEQ ID NO: 2306463 - RNA, 15 nt, Human
aauaaaaauguuuaa

SEQ ID NO: 2306464 - RNA, 14 nt, Human
aauaaaaauguuua

SEQ ID NO: 2306465 - RNA, 16 nt, Human
aauaaaagauauaaau

SEQ ID NO: 2306466 - RNA, 21 nt, Human
aauaaaagcagcaucugcuaa

SEQ ID NO: 2306467 - RNA, 18 nt, Human
aauaaaagcagcaucugc

SEQ ID NO: 2306468 - RNA, 22 nt, Human
uaaagcaacugucuauuucugc

SEQ ID NO: 2306469 - RNA, 12 nt, Human
aauaaaaggaaa

SEQ ID NO: 2306470 - RNA, 13 nt, Human
aauaaaaggaaaa

SEQ ID NO: 2306471 - RNA, 14 nt, Human
aauaaaaggaaaag

SEQ ID NO: 2306472 - RNA, 17 nt, Human
aauaaaaggaaaagcaa

SEQ ID NO: 2306473 - RNA, 16 nt, Human
aauaaaagugaccuuu

SEQ ID NO: 2306474 - RNA, 21 nt, Human
aauaaaaggaagccaaagagu

SEQ ID NO: 2306475 - RNA, 20 nt, Human
aauaaaaggaagccaaagag

SEQ ID NO: 2306476 - RNA, 21 nt, Human
aauaaaaacugacuccuuaga

SEQ ID NO: 2306477 - RNA, 19 nt, Human
aauaaaaacugacuccuua

SEQ ID NO: 2306478 - RNA, 14 nt, Human
aauaaaaaccaaga

SEQ ID NO: 2306479 - RNA, 22 nt, Human
aauaaaaaccaagaagaugucu

SEQ ID NO: 2306480 - RNA, 12 nt, Human
aauaaaaacaaa

SEQ ID NO: 2306481 - RNA, 16 nt, Human
aauaaaaauaaauuug

SEQ ID NO: 2306482 - RNA, 15 nt, Human
aauaaaaauaaauuc

SEQ ID NO: 2306483 - RNA, 22 nt, Human
aauaaaaauauuguguugugaa

SEQ ID NO: 2306484 - RNA, 12 nt, Human
aauaaaaauaau

SEQ ID NO: 2306485 - RNA, 18 nt, Human
aauaaaaaaaagaaaaaa

SEQ ID NO: 2306486 - RNA, 17 nt, Human
aauaaaaaaaagaaaaa

SEQ ID NO: 2306487 - RNA, 13 nt, Human
aauaaaaaaugga

SEQ ID NO: 2306488 - RNA, 22 nt, Human
uaaaguguaaauccuuuuucuu

SEQ ID NO: 2306489 - RNA, 16 nt, Human
uaaaguguaaauccuu

SEQ ID NO: 2306490 - RNA, 21 nt, Human
uaaaguggguuauucuggagu

SEQ ID NO: 2306491 - RNA, 22 nt, Human
uaaaguggguuauucuggaguu

SEQ ID NO: 2306492 - RNA, 14 nt, Human
uaaaguguauuuuu

SEQ ID NO: 2306493 - RNA, 19 nt, Human
uaaaguguauuuuuuuacu

SEQ ID NO: 2306494 - RNA, 15 nt, Human
uaaaguguauuuuuu

SEQ ID NO: 2306495 - RNA, 13 nt, Human
uaaagucccaggu

SEQ ID NO: 2306496 - RNA, 18 nt, Human
uaaagucagguccaauuu

SEQ ID NO: 2306497 - RNA, 20 nt, Human
uaaagucgagcuuuucuaaa

SEQ ID NO: 2306498 - RNA, 17 nt, Human
uaaagucagguccaauu

SEQ ID NO: 2306499 - RNA, 21 nt, Human
uaaagggaaaggauucaugug

SEQ ID NO: 2306500 - RNA, 17 nt, Human
uaaaggcuucucucuca

SEQ ID NO: 2306501 - RNA, 19 nt, Human
uaaaggcuucucucucacc

SEQ ID NO: 2306502 - RNA, 13 nt, Human
uaaagucaggggu

SEQ ID NO: 2306503 - RNA, 16 nt, Human
uaaagugauaauuucu

SEQ ID NO: 2306504 - RNA, 15 nt, Human
uaaagugauauuucc

SEQ ID NO: 2306505 - RNA, 20 nt, Human
uaaagugagcucuaugggca

SEQ ID NO: 2306506 - RNA, 16 nt, Human
uaaagugauauuuccc

SEQ ID NO: 2306507 - RNA, 19 nt, Human
uaaagucgagcuuuucuaa

SEQ ID NO: 2306508 - RNA, 11 nt, Human
uaaagugauua

SEQ ID NO: 2306509 - RNA, 22 nt, Human
uaaagugauuaaacgugcagac

SEQ ID NO: 2306510 - RNA, 16 nt, Human
uaaagugauuaaacgu

SEQ ID NO: 2306511 - RNA, 18 nt, Human
uaaagugauuaaacgugc

SEQ ID NO: 2306512 - RNA, 17 nt, Human
aauaaggccuuaauaug

SEQ ID NO: 2306513 - RNA, 14 nt, Human
aauaagguugaaca

SEQ ID NO: 2306514 - RNA, 16 nt, Human
aauaaggucaaugcca

SEQ ID NO: 2306515 - RNA, 15 nt, Human
aauaacuaaaaggua

SEQ ID NO: 2306516 - RNA, 20 nt, Human
aauaacauaauuuguacaua

SEQ ID NO: 2306517 - RNA, 15 nt, Human
aauaacagugcauau

SEQ ID NO: 2306518 - RNA, 19 nt, Human
aauaacuaguguugcuugg

SEQ ID NO: 2306519 - RNA, 14 nt, Human
aauaacuccuucuu

SEQ ID NO: 2306520 - RNA, 16 nt, Human
aauaacuacuguguuc

SEQ ID NO: 2306521 - RNA, 15 nt, Human
aauaacuacuguguu

SEQ ID NO: 2306522 - RNA, 14 nt, Human
aauaacuacugugu

SEQ ID NO: 2306523 - RNA, 13 nt, Human
aauaacuacugug

SEQ ID NO: 2306524 - RNA, 18 nt, Human
aauaacuacuguguuccu

SEQ ID NO: 2306525 - RNA, 17 nt, Human
aauaacuacuguguucc

SEQ ID NO: 2306526 - RNA, 19 nt, Human
aauaacuacuguguuccug

SEQ ID NO: 2306527 - RNA, 14 nt, Human
aauaagcuaaagag

SEQ ID NO: 2306528 - RNA, 17 nt, Human
aauaagcaucaaacucu

SEQ ID NO: 2306529 - RNA, 13 nt, Human
aauaagcuaaaga

SEQ ID NO: 2306530 - RNA, 12 nt, Human
aauaaauaaaug

SEQ ID NO: 2306531 - RNA, 14 nt, Human
aauaaauaaaugca

SEQ ID NO: 2306532 - RNA, 19 nt, Human
aauaaaguuugcuuagaaa

SEQ ID NO: 2306533 - RNA, 16 nt, Human
aauaaaguaucaugca

SEQ ID NO: 2306534 - RNA, 17 nt, Human
aauaaaguaucaugcau

SEQ ID NO: 2306535 - RNA, 18 nt, Human
aauaaaguaucaugcauu

SEQ ID NO: 2306536 - RNA, 19 nt, Human
aauaaaguaucaugcauuc

SEQ ID NO: 2306537 - RNA, 21 nt, Human
aauaaauagcuauauccaugu

SEQ ID NO: 2306538 - RNA, 19 nt, Human
aauaaauagcuauauccau

SEQ ID NO: 2306539 - RNA, 20 nt, Human
aauaaauaccucuuagcuga

SEQ ID NO: 2306540 - RNA, 11 nt, Human
aauaaauauau

SEQ ID NO: 2306541 - RNA, 12 nt, Human
aauaaauauaua

SEQ ID NO: 2306542 - RNA, 13 nt, Human
aauaaauauauau

SEQ ID NO: 2306543 - RNA, 15 nt, Human
aauaaauauauauau

SEQ ID NO: 2306544 - RNA, 16 nt, Human
aauaaauauauauauc

SEQ ID NO: 2306545 - RNA, 14 nt, Human
aauaaauauauaua

SEQ ID NO: 2306546 - RNA, 15 nt, Human
aauaaauauauauaa

SEQ ID NO: 2306547 - RNA, 16 nt, Human
aauaaauauauauaaa

SEQ ID NO: 2306548 - RNA, 19 nt, Human
aauaaauauauauaaaccu

SEQ ID NO: 2306549 - RNA, 17 nt, Human
aauaaauuauuuauuau

SEQ ID NO: 2306550 - RNA, 18 nt, Human
aauaaauuaaaacaugca

SEQ ID NO: 2306551 - RNA, 20 nt, Human
aauaaaugugaaauucuguc

SEQ ID NO: 2306552 - RNA, 12 nt, Human
aauaaauuauuu

SEQ ID NO: 2306553 - RNA, 21 nt, Human
aauaaaugugccuucauuuuu

SEQ ID NO: 2306554 - RNA, 12 nt, Human
aauaaaugugcc

SEQ ID NO: 2306555 - RNA, 22 nt, Human
aauaacauguaauuaaguacua

SEQ ID NO: 2306556 - RNA, 19 nt, Human
aauaacauguaauuaagua

SEQ ID NO: 2306557 - RNA, 12 nt, Human
aauaacauguaa

SEQ ID NO: 2306558 - RNA, 16 nt, Human
aauaacaagucgauga

SEQ ID NO: 2306559 - RNA, 14 nt, Human
aauaaauucagaua

SEQ ID NO: 2306560 - RNA, 21 nt, Human
aauaaauuugguucuaauaga

SEQ ID NO: 2306561 - RNA, 18 nt, Human
aauaaauuugguucuaau

SEQ ID NO: 2306562 - RNA, 15 nt, Human
aauaacaauaaaaga

SEQ ID NO: 2306563 - RNA, 21 nt, Human
uaaauaaauuguauauucacu

SEQ ID NO: 2306564 - RNA, 22 nt, Human
uaaauaaauuguauauucacuu

SEQ ID NO: 2306565 - RNA, 20 nt, Human
uaaauaaauuguuugaccau

SEQ ID NO: 2306566 - RNA, 13 nt, Human
uaaauaaauuguu

SEQ ID NO: 2306567 - RNA, 15 nt, Human
uaaauaaauuguuug

SEQ ID NO: 2306568 - RNA, 18 nt, Human
uaaauaaaugucauuaaa

SEQ ID NO: 2306569 - RNA, 12 nt, Human
uaaauaaauugu

SEQ ID NO: 2306570 - RNA, 14 nt, Human
uaaauaaauuguau

SEQ ID NO: 2306571 - RNA, 15 nt, Human
uaaauaaauuguaua

SEQ ID NO: 2306572 - RNA, 16 nt, Human
uaaauaaauuguauau

SEQ ID NO: 2306573 - RNA, 17 nt, Human
uaaauaaauuguauauu

SEQ ID NO: 2306574 - RNA, 18 nt, Human
uaaauaaauuguauauuc

SEQ ID NO: 2306575 - RNA, 19 nt, Human
uaaauaaauuguauauuca

SEQ ID NO: 2306576 - RNA, 20 nt, Human
uaaauaaauuguauauucac

SEQ ID NO: 2306577 - RNA, 16 nt, Human
uaaauaaaugucauua

SEQ ID NO: 2306578 - RNA, 22 nt, Human
aauacaccaccucacuccuguu

SEQ ID NO: 2306579 - RNA, 22 nt, Human
uaaauaaauguaucuuauucac

SEQ ID NO: 2306580 - RNA, 22 nt, Human
uaaauaaaugaaguauuucuca

SEQ ID NO: 2306581 - RNA, 20 nt, Human
aauacaccacuacauucugu

SEQ ID NO: 2306582 - RNA, 18 nt, Human
aauacaccacuacauucu

SEQ ID NO: 2306583 - RNA, 16 nt, Human
aauacaccacuacauu

SEQ ID NO: 2306584 - RNA, 14 nt, Human
aauacaauaaguua

SEQ ID NO: 2306585 - RNA, 18 nt, Human
aauaauuauccagaguuu

SEQ ID NO: 2306586 - RNA, 20 nt, Human
aauaauuaugaguuugcuua

SEQ ID NO: 2306587 - RNA, 23 nt, Human
aauacacauagcauguaauggua

SEQ ID NO: 2306588 - RNA, 20 nt, Human
aauacaccaccucacuccug

SEQ ID NO: 2306589 - RNA, 21 nt, Human
aauacaccaccucacuccugu

SEQ ID NO: 2306590 - RNA, 15 nt, Human
aauacacaaguaaac

SEQ ID NO: 2306591 - RNA, 17 nt, Human
aauacacaaguaaacau

SEQ ID NO: 2306592 - RNA, 15 nt, Human
aauacaccacuacau

SEQ ID NO: 2306593 - RNA, 14 nt, Human
aauacacacucaaa

SEQ ID NO: 2306594 - RNA, 20 nt, Human
uaaauagcuauauccaugua

SEQ ID NO: 2306595 - RNA, 19 nt, Human
uaaauagcuauauccaugu

SEQ ID NO: 2306596 - RNA, 22 nt, Human
uaaauagcuauauccauguacu

SEQ ID NO: 2306597 - RNA, 16 nt, Human
uaaauaggagaggaug

SEQ ID NO: 2306598 - RNA, 21 nt, Human
uaaauaggagaggaugagagc

SEQ ID NO: 2306599 - RNA, 17 nt, Human
uaaauacagacacuaag

SEQ ID NO: 2306600 - RNA, 19 nt, Human
uaaauaguaaaaauaaaau

SEQ ID NO: 2306601 - RNA, 20 nt, Human
uaaauaguaaaaauaaaauu

SEQ ID NO: 2306602 - RNA, 14 nt, Human
uaaauagcuauauc

SEQ ID NO: 2306603 - RNA, 16 nt, Human
uaaauacagacacuaa

SEQ ID NO: 2306604 - RNA, 14 nt, Human
uaaauacagacacu

SEQ ID NO: 2306605 - RNA, 15 nt, Human
uaaauacagacacua

SEQ ID NO: 2306606 - RNA, 18 nt, Human
uaaauagcuauauccaug

SEQ ID NO: 2306607 - RNA, 17 nt, Human
uaaauagcuauauccau

SEQ ID NO: 2306608 - RNA, 16 nt, Human
uaaauagcuauaucca

SEQ ID NO: 2306609 - RNA, 15 nt, Human
uaaauagcuauaucc

SEQ ID NO: 2306610 - RNA, 23 nt, Human
uaaauacaccaccucacuccugu

SEQ ID NO: 2306611 - RNA, 19 nt, Human
uaaauacacauagcaugua

SEQ ID NO: 2306612 - RNA, 18 nt, Human
uaaauacacaacacacac

SEQ ID NO: 2306613 - RNA, 17 nt, Human
uaaauacaaaacuucca

SEQ ID NO: 2306614 - RNA, 17 nt, Human
uaaauccuuuuucuuua

SEQ ID NO: 2306615 - RNA, 15 nt, Human
uaaaucccauucaua

SEQ ID NO: 2306616 - RNA, 18 nt, Human
uaaaucgcuuuugauaau

SEQ ID NO: 2306617 - RNA, 19 nt, Human
uaaaucgcuuuugauaauc

SEQ ID NO: 2306618 - RNA, 23 nt, Human
uaaaucccauucauaacuuucau

SEQ ID NO: 2306619 - RNA, 17 nt, Human
uaaauccuuuacuguua

SEQ ID NO: 2306620 - RNA, 19 nt, Human
uaaauccuuuuucuuuaua

SEQ ID NO: 2306621 - RNA, 15 nt, Human
uaaaucuagacucaa

SEQ ID NO: 2306622 - RNA, 18 nt, Human
uaaaucuaguauacauug

SEQ ID NO: 2306623 - RNA, 19 nt, Human
uaaaucuccaaaauaaaac

SEQ ID NO: 2306624 - RNA, 18 nt, Human
uaaauaguauuugagagu

SEQ ID NO: 2306625 - RNA, 16 nt, Human
uaaauauaauucugua

SEQ ID NO: 2306626 - RNA, 18 nt, Human
uaaauauaauucuguaaa

SEQ ID NO: 2306627 - RNA, 19 nt, Human
uaaauauaauucuguaaau

SEQ ID NO: 2306628 - RNA, 13 nt, Human
uaaauauaauucu

SEQ ID NO: 2306629 - RNA, 15 nt, Human
uaaauauaauucugu

SEQ ID NO: 2306630 - RNA, 12 nt, Human
uaacaaauuaug

SEQ ID NO: 2306631 - RNA, 18 nt, Human
uaacaaaaacuacacaua

SEQ ID NO: 2306632 - RNA, 22 nt, Human
uaacaaaacacucggcauuuca

SEQ ID NO: 2306633 - RNA, 20 nt, Human
uaacaaaaaaauauauuuaa

SEQ ID NO: 2306634 - RNA, 23 nt, Human
uaacaaaaaaauauauuuaauga

SEQ ID NO: 2306635 - RNA, 19 nt, Human
uaaauuuuuuuuguuucau

SEQ ID NO: 2306636 - RNA, 16 nt, Human
uaaauuuuuuuccuua

SEQ ID NO: 2306637 - RNA, 16 nt, Human
uaaauuuugaguucua

SEQ ID NO: 2306638 - RNA, 15 nt, Human
uaaauuuuaauuuau

SEQ ID NO: 2306639 - RNA, 16 nt, Human
uaaauuuuacccuuua

SEQ ID NO: 2306640 - RNA, 18 nt, Human
uaaauuuuacccuuuaga

SEQ ID NO: 2306641 - RNA, 13 nt, Human
uaacaagccaccc

SEQ ID NO: 2306642 - RNA, 15 nt, Human
uaacaagcucccagg

SEQ ID NO: 2306643 - RNA, 16 nt, Human
uaacaagguccaagau

SEQ ID NO: 2306644 - RNA, 20 nt, Human
uaacaagucgaugaacuauu

SEQ ID NO: 2306645 - RNA, 15 nt, Human
uaacaaugcuguauu

SEQ ID NO: 2306646 - RNA, 17 nt, Human
uaacaaugcuguauuuu

SEQ ID NO: 2306647 - RNA, 16 nt, Human
uaacaacuaugauuug

SEQ ID NO: 2306648 - RNA, 21 nt, Human
uaacaacuaugauuuggaaaa

SEQ ID NO: 2306649 - RNA, 22 nt, Human
uaacaacuaugauuuggaaaau

SEQ ID NO: 2306650 - RNA, 14 nt, Human
uaacaaccuggaga

SEQ ID NO: 2306651 - RNA, 13 nt, Human
uaacaacuaggga

SEQ ID NO: 2306652 - RNA, 14 nt, Human
uaacaagaaacuca

SEQ ID NO: 2306653 - RNA, 18 nt, Human
uaacaagaucuuucagga

SEQ ID NO: 2306654 - RNA, 17 nt, Human
uaacaagaucuuucagg

SEQ ID NO: 2306655 - RNA, 16 nt, Human
uaacaagaucuuucag

SEQ ID NO: 2306656 - RNA, 18 nt, Human
uaacaagaaacucacccc

SEQ ID NO: 2306657 - RNA, 22 nt, Human
uaaauuaggaauaaauaaaaau

SEQ ID NO: 2306658 - RNA, 21 nt, Human
uaaauuaggaauaaauaaaaa

SEQ ID NO: 2306659 - RNA, 18 nt, Human
uaaauuaguauuuauuua

SEQ ID NO: 2306660 - RNA, 17 nt, Human
uaaauuaggaauaaaua

SEQ ID NO: 2306661 - RNA, 14 nt, Human
uaaauuaggaauaa

SEQ ID NO: 2306662 - RNA, 13 nt, Human
uaaauuaagacau

SEQ ID NO: 2306663 - RNA, 13 nt, Human
uaaauuaaucuuu

SEQ ID NO: 2306664 - RNA, 19 nt, Human
uaaauuacaauugucauuu

SEQ ID NO: 2306665 - RNA, 20 nt, Human
uaaauguuuuuuuuuaaaga

SEQ ID NO: 2306666 - RNA, 18 nt, Human
uaaauguuuuucuaugua

SEQ ID NO: 2306667 - RNA, 20 nt, Human
uaaauguuuuucuauguagu

SEQ ID NO: 2306668 - RNA, 12 nt, Human
uaaauuaagaca

SEQ ID NO: 2306669 - RNA, 15 nt, Human
uaaauuaagacaugc

SEQ ID NO: 2306670 - RNA, 22 nt, Human
uaaauuaacuuuuauaaacuuu

SEQ ID NO: 2306671 - RNA, 17 nt, Human
uaaaugaggggccucag

SEQ ID NO: 2306672 - RNA, 21 nt, Human
uaaaugauguggugccugagg

SEQ ID NO: 2306673 - RNA, 17 nt, Human
uaaaugauucuuaguga

SEQ ID NO: 2306674 - RNA, 17 nt, Human
uaaaugauuucauucaa

SEQ ID NO: 2306675 - RNA, 15 nt, Human
uaaauguugacaugg

SEQ ID NO: 2306676 - RNA, 13 nt, Human
uaaaugaauguuu

SEQ ID NO: 2306677 - RNA, 19 nt, Human
uaaaucuaguauacauugu

SEQ ID NO: 2306678 - RNA, 12 nt, Human
uaaaugaauguu

SEQ ID NO: 2306679 - RNA, 16 nt, Human
uaaaugagcuauguau

SEQ ID NO: 2306680 - RNA, 18 nt, Human
uaaaugagcuauguauua

SEQ ID NO: 2306681 - RNA, 21 nt, Human
uaaaucuccaaaauaaaacuu

SEQ ID NO: 2306682 - RNA, 20 nt, Human
uaaaucuccaaaauaaaacu

SEQ ID NO: 2306683 - RNA, 21 nt, Human
guggcaagcugugacuucucc

SEQ ID NO: 2306684 - RNA, 22 nt, Human
guggcaaagccuucauugccuu

SEQ ID NO: 2306685 - RNA, 22 nt, Human
guggcacacaccuguaguccca

SEQ ID NO: 2306686 - RNA, 16 nt, Human
guggcaaggcugugcu

SEQ ID NO: 2306687 - RNA, 12 nt, Human
guggcacaggcc

SEQ ID NO: 2306688 - RNA, 13 nt, Human
guggcaaggcugu

SEQ ID NO: 2306689 - RNA, 15 nt, Human
guggcaaggcugugc

SEQ ID NO: 2306690 - RNA, 23 nt, Human
guggauuuaacagaaauguacag

SEQ ID NO: 2306691 - RNA, 21 nt, Human
guggauuuugguuuuguuccc

SEQ ID NO: 2306692 - RNA, 15 nt, Human
guggacuggccccug

SEQ ID NO: 2306693 - RNA, 16 nt, Human
guggacuggccccugg

SEQ ID NO: 2306694 - RNA, 20 nt, Human
guggauuuaacagaaaugua

SEQ ID NO: 2306695 - RNA, 14 nt, Human
guggacuccagacu

SEQ ID NO: 2306696 - RNA, 14 nt, Human
guggacucugcaca

SEQ ID NO: 2306697 - RNA, 17 nt, Human
guggacucugcacaugu

SEQ ID NO: 2306698 - RNA, 21 nt, Human
guggacuccagacucucugug

SEQ ID NO: 2306699 - RNA, 21 nt, Human
guggacucagggcagcgccag

SEQ ID NO: 2306700 - RNA, 16 nt, Human
guggacucagggcagc

SEQ ID NO: 2306701 - RNA, 15 nt, Human
guggacucagggcag

SEQ ID NO: 2306702 - RNA, 14 nt, Human
guggacucagggca

SEQ ID NO: 2306703 - RNA, 13 nt, Human
guggacuggaagg

SEQ ID NO: 2306704 - RNA, 17 nt, Human
guggacucuuugguggc

SEQ ID NO: 2306705 - RNA, 18 nt, Human
guggacucuuugguggcu

SEQ ID NO: 2306706 - RNA, 23 nt, Human
guggacucuuugguggcuuugca

SEQ ID NO: 2306707 - RNA, 21 nt, Human
guggauuuaacagaaauguac

SEQ ID NO: 2306708 - RNA, 14 nt, Human
guggcaccagcagc

SEQ ID NO: 2306709 - RNA, 13 nt, Human
guggcaccagcag

SEQ ID NO: 2306710 - RNA, 16 nt, Human
guggcacaggcccccu

SEQ ID NO: 2306711 - RNA, 23 nt, Human
guggcagauaaucagccucuuaa

SEQ ID NO: 2306712 - RNA, 21 nt, Human
guggcagauaaucagccucuu

SEQ ID NO: 2306713 - RNA, 20 nt, Human
guggcagauaaucagccucu

SEQ ID NO: 2306714 - RNA, 19 nt, Human
guggcacuuuuucauuugc

SEQ ID NO: 2306715 - RNA, 15 nt, Human
guggcagagcuugga

SEQ ID NO: 2306716 - RNA, 23 nt, Human
guggcagagcuuggacuggaugc

SEQ ID NO: 2306717 - RNA, 14 nt, Human
guggcagcugcggu

SEQ ID NO: 2306718 - RNA, 22 nt, Human
guggcagcucaccucucccuug

SEQ ID NO: 2306719 - RNA, 23 nt, Human
aagaccagagauaguggggagac

SEQ ID NO: 2306720 - RNA, 13 nt, Human
aagacccaaaagg

SEQ ID NO: 2306721 - RNA, 22 nt, Human
aagaauuuucagaccccagcgg

SEQ ID NO: 2306722 - RNA, 19 nt, Human
aagaauuuuaaaaaugaau

SEQ ID NO: 2306723 - RNA, 20 nt, Human
aagaauuuuaaaaaugaauc

SEQ ID NO: 2306724 - RNA, 13 nt, Human
aagaauuuuuaaa

SEQ ID NO: 2306725 - RNA, 20 nt, Human
aagaauuuucagaccccagc

SEQ ID NO: 2306726 - RNA, 13 nt, Human
aagaauuuuaaaa

SEQ ID NO: 2306727 - RNA, 14 nt, Human
aagaauuuuaaaaa

SEQ ID NO: 2306728 - RNA, 15 nt, Human
aagaauuuuaaaaau

SEQ ID NO: 2306729 - RNA, 16 nt, Human
aagaauuuuaaaaaug

SEQ ID NO: 2306730 - RNA, 17 nt, Human
aagaauuuuaaaaauga

SEQ ID NO: 2306731 - RNA, 18 nt, Human
aagaauuuuaaaaaugaa

SEQ ID NO: 2306732 - RNA, 19 nt, Human
aagaauucaaacuggggcc

SEQ ID NO: 2306733 - RNA, 16 nt, Human
aagaauuauuuugaug

SEQ ID NO: 2306734 - RNA, 23 nt, Human
aagaauuucuugguaagaagccg

SEQ ID NO: 2306735 - RNA, 22 nt, Human
aagaauuucuugguaagaagcc

SEQ ID NO: 2306736 - RNA, 20 nt, Human
aagaauuucuugguaagaag

SEQ ID NO: 2306737 - RNA, 18 nt, Human
aagaauugaacccaggag

SEQ ID NO: 2306738 - RNA, 16 nt, Human
aagaauugaacccagg

SEQ ID NO: 2306739 - RNA, 15 nt, Human
aagaauguuuauagc

SEQ ID NO: 2306740 - RNA, 15 nt, Human
aagaauauuugaaug

SEQ ID NO: 2306741 - RNA, 21 nt, Human
aagaaucacaauaauuuucua

SEQ ID NO: 2306742 - RNA, 13 nt, Human
aagaauauuuuaa

SEQ ID NO: 2306743 - RNA, 19 nt, Human
guggcagagcuuggacugg

SEQ ID NO: 2306744 - RNA, 17 nt, Human
guggcagcugcggucca

SEQ ID NO: 2306745 - RNA, 11 nt, Human
aagaauauuug

SEQ ID NO: 2306746 - RNA, 13 nt, Human
aagaauauucagg

SEQ ID NO: 2306747 - RNA, 15 nt, Human
aagaaguaggcauga

SEQ ID NO: 2306748 - RNA, 21 nt, Human
aagaagguuaccaagaagccu

SEQ ID NO: 2306749 - RNA, 18 nt, Human
aagaagguuuguguuuuu

SEQ ID NO: 2306750 - RNA, 18 nt, Human
gugcugcccugcccaccu

SEQ ID NO: 2306751 - RNA, 24 nt, Human
aagaaggguccuucccucucccca

SEQ ID NO: 2306752 - RNA, 21 nt, Human
aagaaggguccuucccucucc

SEQ ID NO: 2306753 - RNA, 17 nt, Human
aagaaggguccuucccu

SEQ ID NO: 2306754 - RNA, 23 nt, Human
aagaagguuucagaaagaagugg

SEQ ID NO: 2306755 - RNA, 13 nt, Human
aagaagggaugga

SEQ ID NO: 2306756 - RNA, 22 nt, Human
aagaagggcuagaaccuggagg

SEQ ID NO: 2306757 - RNA, 14 nt, Human
aagaagggagaaga

SEQ ID NO: 2306758 - RNA, 15 nt, Human
aagaagggagaagaa

SEQ ID NO: 2306759 - RNA, 17 nt, Human
aagaagggagaagaaag

SEQ ID NO: 2306760 - RNA, 13 nt, Human
gugcugcuucccu

SEQ ID NO: 2306761 - RNA, 16 nt, Human
gugcugcuucccucug

SEQ ID NO: 2306762 - RNA, 18 nt, Human
gugcuggaauucuaacaa

SEQ ID NO: 2306763 - RNA, 21 nt, Human
gugcugcccugcccaccuggc

SEQ ID NO: 2306764 - RNA, 19 nt, Human
gugcugcccugcccaccug

SEQ ID NO: 2306765 - RNA, 20 nt, Human
gugcugcccugcccaccugg

SEQ ID NO: 2306766 - RNA, 19 nt, Human
gugcugggccccugccucu

SEQ ID NO: 2306767 - RNA, 20 nt, Human
gugcuggauggagcccaggc

SEQ ID NO: 2306768 - RNA, 13 nt, Human
gugcuguauaaaa

SEQ ID NO: 2306769 - RNA, 15 nt, Human
gugcuguauaaaauc

SEQ ID NO: 2306770 - RNA, 16 nt, Human
gugcugguguccugac

SEQ ID NO: 2306771 - RNA, 19 nt, Human
gugcugguguccugaccac

SEQ ID NO: 2306772 - RNA, 20 nt, Human
gugcugguguccugaccacc

SEQ ID NO: 2306773 - RNA, 23 nt, Human
gugcugguguccugaccacccuc

SEQ ID NO: 2306774 - RNA, 13 nt, Human
gugcugguguccu

SEQ ID NO: 2306775 - RNA, 15 nt, Human
gugcugguguccuga

SEQ ID NO: 2306776 - RNA, 12 nt, Human
gugcuggagcca

SEQ ID NO: 2306777 - RNA, 15 nt, Human
gugcuggagccacua

SEQ ID NO: 2306778 - RNA, 18 nt, Human
gugcuggagccacuaacu

SEQ ID NO: 2306779 - RNA, 19 nt, Human
gugcuggagccacuaacua

SEQ ID NO: 2306780 - RNA, 14 nt, Human
gugcuggaggacug

SEQ ID NO: 2306781 - RNA, 16 nt, Human
gugcuggaggacugag

SEQ ID NO: 2306782 - RNA, 16 nt, Human
gugcuggaggugggag

SEQ ID NO: 2306783 - RNA, 17 nt, Human
gugcuggaggugggagc

SEQ ID NO: 2306784 - RNA, 19 nt, Human
gugcuggaggugggagcag

SEQ ID NO: 2306785 - RNA, 21 nt, Human
gugcuggaggugggagcagga

SEQ ID NO: 2306786 - RNA, 24 nt, Human
gugcuggaggugggagcaggagau

SEQ ID NO: 2306787 - RNA, 16 nt, Human
gugcugggccccugcc

SEQ ID NO: 2306788 - RNA, 15 nt, Human
gugcuggcaaccacu

SEQ ID NO: 2306789 - RNA, 18 nt, Human
gugcuggcaccaccaggc

SEQ ID NO: 2306790 - RNA, 18 nt, Human
gugcuggauggagcccag

SEQ ID NO: 2306791 - RNA, 19 nt, Human
gugcuggauggagcccagg

SEQ ID NO: 2306792 - RNA, 18 nt, Human
gugcuguccucagguggc

SEQ ID NO: 2306793 - RNA, 21 nt, Human
gugcuguauaaaaucagccaa

SEQ ID NO: 2306794 - RNA, 16 nt, Human
gugcuguauaaaauca

SEQ ID NO: 2306795 - RNA, 17 nt, Human
gugcuguauaaaaucag

SEQ ID NO: 2306796 - RNA, 12 nt, Human
gugcugugaaaa

SEQ ID NO: 2306797 - RNA, 20 nt, Human
gugcugucugaucugugcuu

SEQ ID NO: 2306798 - RNA, 15 nt, Human
gugcugugcccaagu

SEQ ID NO: 2306799 - RNA, 16 nt, Human
gugcugugcccaaguu

SEQ ID NO: 2306800 - RNA, 13 nt, Human
gugcuguggaagc

SEQ ID NO: 2306801 - RNA, 11 nt, Human
gugcuguggcc

SEQ ID NO: 2306802 - RNA, 14 nt, Human
gugcuguggaagca

SEQ ID NO: 2306803 - RNA, 14 nt, Human
gugcuguggccagg

SEQ ID NO: 2306804 - RNA, 15 nt, Human
gugcuguggccaggg

SEQ ID NO: 2306805 - RNA, 16 nt, Human
gugcuguggccagggu

SEQ ID NO: 2306806 - RNA, 17 nt, Human
gugcuguggccagggug

SEQ ID NO: 2306807 - RNA, 18 nt, Human
gugcuguggccaggguga

SEQ ID NO: 2306808 - RNA, 17 nt, Human
gugcuguggccugggca

SEQ ID NO: 2306809 - RNA, 16 nt, Human
gugcuguggccugggc

SEQ ID NO: 2306810 - RNA, 19 nt, Human
gugcuguggccugggcaag

SEQ ID NO: 2306811 - RNA, 23 nt, Human
gugcuguggccagggugagagcu

SEQ ID NO: 2306812 - RNA, 16 nt, Human
guggaagaagagggag

SEQ ID NO: 2306813 - RNA, 14 nt, Human
guggaagcccuccu

SEQ ID NO: 2306814 - RNA, 13 nt, Human
guggaagcccucc

SEQ ID NO: 2306815 - RNA, 20 nt, Human
guggaagaggggacaggucc

SEQ ID NO: 2306816 - RNA, 17 nt, Human
guggaagcccuccuucc

SEQ ID NO: 2306817 - RNA, 16 nt, Human
guggaagcccuccuuc

SEQ ID NO: 2306818 - RNA, 18 nt, Human
guggaagcccuccuucca

SEQ ID NO: 2306819 - RNA, 20 nt, Human
guggaauuauuuuaaaagau

SEQ ID NO: 2306820 - RNA, 17 nt, Human
guggaagagggcugcaa

SEQ ID NO: 2306821 - RNA, 20 nt, Human
guggaagaagggagaagaaa

SEQ ID NO: 2306822 - RNA, 15 nt, Human
guggaagaggggaca

SEQ ID NO: 2306823 - RNA, 16 nt, Human
guggaagaggggacag

SEQ ID NO: 2306824 - RNA, 17 nt, Human
guggaagaggggacagg

SEQ ID NO: 2306825 - RNA, 14 nt, Human
guggaagagggcug

SEQ ID NO: 2306826 - RNA, 17 nt, Human
guggaagaagagggaga

SEQ ID NO: 2306827 - RNA, 15 nt, Human
guggaagaagggaga

SEQ ID NO: 2306828 - RNA, 16 nt, Human
guggaagaagggagaa

SEQ ID NO: 2306829 - RNA, 18 nt, Human
guggaagaagggagaaga

SEQ ID NO: 2306830 - RNA, 15 nt, Human
guggacaccaggagu

SEQ ID NO: 2306831 - RNA, 20 nt, Human
guggaaggcaucagucccua

SEQ ID NO: 2306832 - RNA, 22 nt, Human
guggacaccaggagucccuggu

SEQ ID NO: 2306833 - RNA, 21 nt, Human
guggacaccaggagucccugg

SEQ ID NO: 2306834 - RNA, 15 nt, Human
guggacuaaaagaua

SEQ ID NO: 2306835 - RNA, 23 nt, Human
guggacuaaaagauauaagugcu

SEQ ID NO: 2306836 - RNA, 14 nt, Human
guggacuaaaagau

SEQ ID NO: 2306837 - RNA, 14 nt, Human
guggacacagcucu

SEQ ID NO: 2306838 - RNA, 15 nt, Human
guggacacagcucuu

SEQ ID NO: 2306839 - RNA, 17 nt, Human
guggacacagcucuucu

SEQ ID NO: 2306840 - RNA, 24 nt, Human
guggacacagcucuucuccaggcu

SEQ ID NO: 2306841 - RNA, 19 nt, Human
aagaaggcagcagguggca

SEQ ID NO: 2306842 - RNA, 14 nt, Human
aagaagcuguugua

SEQ ID NO: 2306843 - RNA, 17 nt, Human
aagaagccgggaacaga

SEQ ID NO: 2306844 - RNA, 15 nt, Human
aagaagcucucuccu

SEQ ID NO: 2306845 - RNA, 14 nt, Human
aagaagcucucucc

SEQ ID NO: 2306846 - RNA, 19 nt, Human
aagaagcccccagcuaaga

SEQ ID NO: 2306847 - RNA, 16 nt, Human
aagaagcccccagcua

SEQ ID NO: 2306848 - RNA, 15 nt, Human
aagaagcccccagcu

SEQ ID NO: 2306849 - RNA, 19 nt, Human
aagaagccacagaccuagg

SEQ ID NO: 2306850 - RNA, 12 nt, Human
aagaagcaggcu

SEQ ID NO: 2306851 - RNA, 14 nt, Human
aagaagcaggcuac

SEQ ID NO: 2306852 - RNA, 19 nt, Human
aagaagcaggcuacacuga

SEQ ID NO: 2306853 - RNA, 22 nt, Human
aagaagcaccaaucaugaauua

SEQ ID NO: 2306854 - RNA, 16 nt, Human
aagaagcccaggaaag

SEQ ID NO: 2306855 - RNA, 17 nt, Human
aagaagcccaggaaagg

SEQ ID NO: 2306856 - RNA, 23 nt, Human
aagaaaaucagauggagcaugaa

SEQ ID NO: 2306857 - RNA, 20 nt, Human
aagaaaauauuuugucuaaa

SEQ ID NO: 2306858 - RNA, 15 nt, Human
aagaaaaucauauug

SEQ ID NO: 2306859 - RNA, 13 nt, Human
aagaaaaucacuu

SEQ ID NO: 2306860 - RNA, 14 nt, Human
aagaaaauauuuug

SEQ ID NO: 2306861 - RNA, 15 nt, Human
aagaaaauauuuugu

SEQ ID NO: 2306862 - RNA, 22 nt, Human
aagaaaaucuauuuuguaacuu

SEQ ID NO: 2306863 - RNA, 17 nt, Human
aagaaaaucauauugcu

SEQ ID NO: 2306864 - RNA, 20 nt, Human
aagaaaaucauauugcuucu

SEQ ID NO: 2306865 - RNA, 13 nt, Human
aagaaaauaugca

SEQ ID NO: 2306866 - RNA, 11 nt, Human
aagaaaauauu

SEQ ID NO: 2306867 - RNA, 13 nt, Human
aagaaaauauuuu

SEQ ID NO: 2306868 - RNA, 13 nt, Human
aagaaaauaucac

SEQ ID NO: 2306869 - RNA, 16 nt, Human
aagaaaggguguuuuu

SEQ ID NO: 2306870 - RNA, 16 nt, Human
aagaaaauugcugugc

SEQ ID NO: 2306871 - RNA, 21 nt, Human
aagaaauaaaaggaagccaaa

SEQ ID NO: 2306872 - RNA, 23 nt, Human
aagaaauaaaaggaagccaaaga

SEQ ID NO: 2306873 - RNA, 20 nt, Human
aagaaaguugcacggcugcu

SEQ ID NO: 2306874 - RNA, 22 nt, Human
aagaaaguugcacggcugcuga

SEQ ID NO: 2306875 - RNA, 19 nt, Human
aagaaaauacauaagacca

SEQ ID NO: 2306876 - RNA, 23 nt, Human
aagaaaauaaaaaaaagaaaaaa

SEQ ID NO: 2306877 - RNA, 22 nt, Human
aagaaaauaaaaaaaagaaaaa

SEQ ID NO: 2306878 - RNA, 16 nt, Human
aagaaaagugggccag

SEQ ID NO: 2306879 - RNA, 16 nt, Human
aagaaaagugguuguu

SEQ ID NO: 2306880 - RNA, 13 nt, Human
aagaaaauaaaaa

SEQ ID NO: 2306881 - RNA, 21 nt, Human
aagaaaauaaaaaaaagaaaa

SEQ ID NO: 2306882 - RNA, 18 nt, Human
aagaaaauaaaaaaaaga

SEQ ID NO: 2306883 - RNA, 15 nt, Human
aagaaaagugggcca

SEQ ID NO: 2306884 - RNA, 15 nt, Human
aagaaaagauaaaga

SEQ ID NO: 2306885 - RNA, 19 nt, Human
aagaaaagugaaugcucaa

SEQ ID NO: 2306886 - RNA, 22 nt, Human
aagaaaaguagguuuacauuca

SEQ ID NO: 2306887 - RNA, 22 nt, Human
aagaaaagauuuuaaucaaguu

SEQ ID NO: 2306888 - RNA, 12 nt, Human
aagaaaagauuu

SEQ ID NO: 2306889 - RNA, 14 nt, Human
aagaaaacccaccc

SEQ ID NO: 2306890 - RNA, 23 nt, Human
aagaaaagagauauuuuaaaaug

SEQ ID NO: 2306891 - RNA, 16 nt, Human
aagaaaagagcuuucu

SEQ ID NO: 2306892 - RNA, 11 nt, Human
aagaaaagaua

SEQ ID NO: 2306893 - RNA, 13 nt, Human
aagaaaaaucaug

SEQ ID NO: 2306894 - RNA, 14 nt, Human
aagaaaaaucaugu

SEQ ID NO: 2306895 - RNA, 18 nt, Human
aagaaaacaucuauucuc

SEQ ID NO: 2306896 - RNA, 17 nt, Human
aacuuguauuaaagaca

SEQ ID NO: 2306897 - RNA, 20 nt, Human
aacuugucuuuuucuggacu

SEQ ID NO: 2306898 - RNA, 18 nt, Human
aacuuguuacuaaagaaa

SEQ ID NO: 2306899 - RNA, 13 nt, Human
aacuuguuuucug

SEQ ID NO: 2306900 - RNA, 20 nt, Human
aagaaaaaggaugcacagag

SEQ ID NO: 2306901 - RNA, 19 nt, Human
aagaaaaaggaugcacaga

SEQ ID NO: 2306902 - RNA, 20 nt, Human
aagaaaaagucauccaaucu

SEQ ID NO: 2306903 - RNA, 22 nt, Human
aagaaaaaggaugcacagaguu

SEQ ID NO: 2306904 - RNA, 14 nt, Human
aacuuggaaauagu

SEQ ID NO: 2306905 - RNA, 23 nt, Human
aacuuggaaaaauccagaaagaa

SEQ ID NO: 2306906 - RNA, 18 nt, Human
gugccuggguggggcugc

SEQ ID NO: 2306907 - RNA, 17 nt, Human
gugccuggguggggcug

SEQ ID NO: 2306908 - RNA, 22 nt, Human
gugccuggguggacauggcccc

SEQ ID NO: 2306909 - RNA, 15 nt, Human
aacuuggagccccag

SEQ ID NO: 2306910 - RNA, 23 nt, Human
aacuuggaauuuguaaccucagc

SEQ ID NO: 2306911 - RNA, 12 nt, Human
aacuuggagccg

SEQ ID NO: 2306912 - RNA, 15 nt, Human
aacuuggauuuuuga

SEQ ID NO: 2306913 - RNA, 14 nt, Human
aacuuggcgcugcc

SEQ ID NO: 2306914 - RNA, 14 nt, Human
aacuuguaaauaca

SEQ ID NO: 2306915 - RNA, 23 nt, Human
aacuugguucccauuugcuccuu

SEQ ID NO: 2306916 - RNA, 18 nt, Human
aacuuguaaaugcuguca

SEQ ID NO: 2306917 - RNA, 15 nt, Human
aacuuguaaaugcug

SEQ ID NO: 2306918 - RNA, 15 nt, Human
aacuuguaaauacac

SEQ ID NO: 2306919 - RNA, 15 nt, Human
aacuuguaaaugugg

SEQ ID NO: 2306920 - RNA, 20 nt, Human
aacuuguaauuuuuuuaauu

SEQ ID NO: 2306921 - RNA, 12 nt, Human
gugccugagagu

SEQ ID NO: 2306922 - RNA, 18 nt, Human
gugccugagaggcaggca

SEQ ID NO: 2306923 - RNA, 20 nt, Human
gugccugauccagccucucc

SEQ ID NO: 2306924 - RNA, 23 nt, Human
gugccugauccagccucuccccu

SEQ ID NO: 2306925 - RNA, 18 nt, Human
gugccugauucggcuguc

SEQ ID NO: 2306926 - RNA, 19 nt, Human
gugccugauucggcugucu

SEQ ID NO: 2306927 - RNA, 21 nt, Human
gugccugauucggcugucuca

SEQ ID NO: 2306928 - RNA, 22 nt, Human
gugccugauucggcugucucag

SEQ ID NO: 2306929 - RNA, 22 nt, Human
gugccaauggaaccuccuuucu

SEQ ID NO: 2306930 - RNA, 20 nt, Human
gugccaauauguauuguaaa

SEQ ID NO: 2306931 - RNA, 21 nt, Human
gugccaauauguauuguaaac

SEQ ID NO: 2306932 - RNA, 14 nt, Human
gugccugagaggca

SEQ ID NO: 2306933 - RNA, 15 nt, Human
gugccugagaggcag

SEQ ID NO: 2306934 - RNA, 16 nt, Human
gugccugagaggcagg

SEQ ID NO: 2306935 - RNA, 17 nt, Human
gugccugagaggcaggc

SEQ ID NO: 2306936 - RNA, 15 nt, Human
gugccucugggacug

SEQ ID NO: 2306937 - RNA, 14 nt, Human
gugccucugggacu

SEQ ID NO: 2306938 - RNA, 15 nt, Human
gugccaauauguauu

SEQ ID NO: 2306939 - RNA, 17 nt, Human
gugccaauauguauugu

SEQ ID NO: 2306940 - RNA, 19 nt, Human
gugccaauauguauuguaa

SEQ ID NO: 2306941 - RNA, 17 nt, Human
gugccugggaauguauu

SEQ ID NO: 2306942 - RNA, 16 nt, Human
gugccugggaauguau

SEQ ID NO: 2306943 - RNA, 20 nt, Human
gugccuggcucagagccagu

SEQ ID NO: 2306944 - RNA, 15 nt, Human
gugccugggaaugua

SEQ ID NO: 2306945 - RNA, 16 nt, Human
gugccuggcucagagc

SEQ ID NO: 2306946 - RNA, 18 nt, Human
gugccuggcucagagcca

SEQ ID NO: 2306947 - RNA, 12 nt, Human
gugccuggccug

SEQ ID NO: 2306948 - RNA, 15 nt, Human
gugccuggccuggca

SEQ ID NO: 2306949 - RNA, 19 nt, Human
gugccuggccuggcacaca

SEQ ID NO: 2306950 - RNA, 12 nt, Human
gugccuggcuca

SEQ ID NO: 2306951 - RNA, 14 nt, Human
gugccuggcucaga

SEQ ID NO: 2306952 - RNA, 22 nt, Human
gugccuggacauuugccuugcu

SEQ ID NO: 2306953 - RNA, 16 nt, Human
gugccuggccacgccc

SEQ ID NO: 2306954 - RNA, 11 nt, Human
gugccugcagc

SEQ ID NO: 2306955 - RNA, 23 nt, Human
gugccugccugggaguuuuguau

SEQ ID NO: 2306956 - RNA, 19 nt, Human
gugccaagcacagugccug

SEQ ID NO: 2306957 - RNA, 18 nt, Human
gugccaagcacagugccu

SEQ ID NO: 2306958 - RNA, 17 nt, Human
gugccaagcacagugcc

SEQ ID NO: 2306959 - RNA, 14 nt, Human
gugccaagcagagg

SEQ ID NO: 2306960 - RNA, 16 nt, Human
gugccaagcacagugc

SEQ ID NO: 2306961 - RNA, 14 nt, Human
gugccaagcacagu

SEQ ID NO: 2306962 - RNA, 21 nt, Human
gugccaacaguguuaggccug

SEQ ID NO: 2306963 - RNA, 18 nt, Human
gugcacguggcauguggc

SEQ ID NO: 2306964 - RNA, 23 nt, Human
gugccaacacucaagaagcaggc

SEQ ID NO: 2306965 - RNA, 15 nt, Human
gugcauuuggugguu

SEQ ID NO: 2306966 - RNA, 21 nt, Human
gugcacguggagagcuggugc

SEQ ID NO: 2306967 - RNA, 21 nt, Human
gugcacguggcauguggccug

SEQ ID NO: 2306968 - RNA, 20 nt, Human
gugcauuugaggucuguucu

SEQ ID NO: 2306969 - RNA, 22 nt, Human
gugcauuugaggucuguucuuu

SEQ ID NO: 2306970 - RNA, 21 nt, Human
gugcauuugaggucuguucuu

SEQ ID NO: 2306971 - RNA, 21 nt, Human
aacugcauuaccgcguuguaa

SEQ ID NO: 2306972 - RNA, 16 nt, Human
aacugcaugcugcugg

SEQ ID NO: 2306973 - RNA, 22 nt, Human
aacugcauuaccgcguuguaaa

SEQ ID NO: 2306974 - RNA, 14 nt, Human
aacugcaugcugcu

SEQ ID NO: 2306975 - RNA, 23 nt, Human
aacugcagggaaaauuauuugca

SEQ ID NO: 2306976 - RNA, 14 nt, Human
aacugcagggaaaa

SEQ ID NO: 2306977 - RNA, 23 nt, Human
aacugcaggcccuggccuccccu

SEQ ID NO: 2306978 - RNA, 12 nt, Human
gugcacacacca

SEQ ID NO: 2306979 - RNA, 14 nt, Human
gugcacacaccaga

SEQ ID NO: 2306980 - RNA, 18 nt, Human
gugcacguggagagcugg

SEQ ID NO: 2306981 - RNA, 16 nt, Human
gugcacguggagagcu

SEQ ID NO: 2306982 - RNA, 15 nt, Human
gugcacguggagagc

SEQ ID NO: 2306983 - RNA, 18 nt, Human
gugcacguacacacacau

SEQ ID NO: 2306984 - RNA, 17 nt, Human
gugcacacaccagagcc

SEQ ID NO: 2306985 - RNA, 23 nt, Human
aacugcauuaccgcguuguaaaa

SEQ ID NO: 2306986 - RNA, 18 nt, Human
gugcacgcaguggccuuc

SEQ ID NO: 2306987 - RNA, 14 nt, Human
gugggucaaggaau

SEQ ID NO: 2306988 - RNA, 16 nt, Human
guggguauaaaagaug

SEQ ID NO: 2306989 - RNA, 16 nt, Human
guggguccaggggccc

SEQ ID NO: 2306990 - RNA, 19 nt, Human
guggguccaggggccccuc

SEQ ID NO: 2306991 - RNA, 22 nt, Human
guggguccaugggcagagccca

SEQ ID NO: 2306992 - RNA, 20 nt, Human
guggguccaugggcagagcc

SEQ ID NO: 2306993 - RNA, 18 nt, Human
guggguccaugggcagag

SEQ ID NO: 2306994 - RNA, 20 nt, Human
guggguccaggggccccucc

SEQ ID NO: 2306995 - RNA, 23 nt, Human
guggguccaggggccccuccagc

SEQ ID NO: 2306996 - RNA, 20 nt, Human
guggguagaucacgagauca

SEQ ID NO: 2306997 - RNA, 22 nt, Human
guggggguggaauaaaauacua

SEQ ID NO: 2306998 - RNA, 23 nt, Human
gugggggugcagaugagguugcu

SEQ ID NO: 2306999 - RNA, 14 nt, Human
guggguagacacac

SEQ ID NO: 2307000 - RNA, 12 nt, Human
guggguauaaaa

SEQ ID NO: 2307001 - RNA, 15 nt, Human
guggggguggaggcu

SEQ ID NO: 2307002 - RNA, 21 nt, Human
guggguagguuggacuggaaa

SEQ ID NO: 2307003 - RNA, 13 nt, Human
guggguauaaaag

SEQ ID NO: 2307004 - RNA, 15 nt, Human
guggguauaaaagau

SEQ ID NO: 2307005 - RNA, 24 nt, Human
gugggauguucagcacugucccuu

SEQ ID NO: 2307006 - RNA, 18 nt, Human
guggggggggugcugggc

SEQ ID NO: 2307007 - RNA, 19 nt, Human
guggggguagagcugaucc

SEQ ID NO: 2307008 - RNA, 14 nt, Human
gugggggucugugu

SEQ ID NO: 2307009 - RNA, 16 nt, Human
gugggggucugugugu

SEQ ID NO: 2307010 - RNA, 15 nt, Human
gugggggucugugug

SEQ ID NO: 2307011 - RNA, 20 nt, Human
gugguguuuccugcaggcca

SEQ ID NO: 2307012 - RNA, 23 nt, Human
guggugugucccccucuguccag

SEQ ID NO: 2307013 - RNA, 14 nt, Human
gugguguggagaag

SEQ ID NO: 2307014 - RNA, 22 nt, Human
gugguguggagaagccacaggc

SEQ ID NO: 2307015 - RNA, 15 nt, Human
gugguguuuccuggc

SEQ ID NO: 2307016 - RNA, 16 nt, Human
gugguguuuccuggca

SEQ ID NO: 2307017 - RNA, 23 nt, Human
gugguggcauacgccuguagucc

SEQ ID NO: 2307018 - RNA, 23 nt, Human
gugguggcagggccuagcugcua

SEQ ID NO: 2307019 - RNA, 15 nt, Human
gugguggcagggccu

SEQ ID NO: 2307020 - RNA, 17 nt, Human
gugguggcagggccuag

SEQ ID NO: 2307021 - RNA, 21 nt, Human
gugguggcagggccuagcugc

SEQ ID NO: 2307022 - RNA, 18 nt, Human
gugguggcucacgccugu

SEQ ID NO: 2307023 - RNA, 18 nt, Human
gugguggcucaugccugu

SEQ ID NO: 2307024 - RNA, 18 nt, Human
gugguggcccacgccugu

SEQ ID NO: 2307025 - RNA, 18 nt, Human
gugguggcgggcgccugu

SEQ ID NO: 2307026 - RNA, 18 nt, Human
gugguggaagaggggaca

SEQ ID NO: 2307027 - RNA, 15 nt, Human
guggugcugacaaag

SEQ ID NO: 2307028 - RNA, 14 nt, Human
guggugcugggacu

SEQ ID NO: 2307029 - RNA, 18 nt, Human
guggugcucaguuguaga

SEQ ID NO: 2307030 - RNA, 20 nt, Human
gugggucccacuuccccucc

SEQ ID NO: 2307031 - RNA, 21 nt, Human
gugggucccacuuccccuccu

SEQ ID NO: 2307032 - RNA, 16 nt, Human
gugguggcacaggccc

SEQ ID NO: 2307033 - RNA, 14 nt, Human
gugguggagccagu

SEQ ID NO: 2307034 - RNA, 20 nt, Human
gugguggaucuguccaagga

SEQ ID NO: 2307035 - RNA, 19 nt, Human
gugguggaagaggggacag

SEQ ID NO: 2307036 - RNA, 12 nt, Human
gugguggagcca

SEQ ID NO: 2307037 - RNA, 22 nt, Human
gugguggagccaguaaacagag

SEQ ID NO: 2307038 - RNA, 23 nt, Human
gugggaaagauuacuuuuucuuu

SEQ ID NO: 2307039 - RNA, 17 nt, Human
gugggaacgacugggca

SEQ ID NO: 2307040 - RNA, 18 nt, Human
guggcuuugcauuuuaaa

SEQ ID NO: 2307041 - RNA, 22 nt, Human
guggcuuugcauuuuaaaaaug

SEQ ID NO: 2307042 - RNA, 23 nt, Human
guggcuuugcauuuuaaaaauga

SEQ ID NO: 2307043 - RNA, 20 nt, Human
guggcuuuuuuccuccugug

SEQ ID NO: 2307044 - RNA, 16 nt, Human
guggcuuucagccucu

SEQ ID NO: 2307045 - RNA, 22 nt, Human
guggcuugagaaauauggacac

SEQ ID NO: 2307046 - RNA, 16 nt, Human
guggcuuugcauuuua

SEQ ID NO: 2307047 - RNA, 18 nt, Human
guggcuuucagccucugg

SEQ ID NO: 2307048 - RNA, 14 nt, Human
guggcuucuuaauc

SEQ ID NO: 2307049 - RNA, 21 nt, Human
guggcuucccgcucagcccuc

SEQ ID NO: 2307050 - RNA, 15 nt, Human
guggccucccaacuc

SEQ ID NO: 2307051 - RNA, 12 nt, Human
guggccucagaa

SEQ ID NO: 2307052 - RNA, 11 nt, Human
guggccucaga

SEQ ID NO: 2307053 - RNA, 13 nt, Human
guggccucagaau

SEQ ID NO: 2307054 - RNA, 21 nt, Human
guggccucaacccucccucag

SEQ ID NO: 2307055 - RNA, 20 nt, Human
guggccucaacccucccuca

SEQ ID NO: 2307056 - RNA, 23 nt, Human
guggccccguuucugguggucug

SEQ ID NO: 2307057 - RNA, 17 nt, Human
guggcccgacagccugg

SEQ ID NO: 2307058 - RNA, 13 nt, Human
guggccucccaac

SEQ ID NO: 2307059 - RNA, 14 nt, Human
guggccucccaacu

SEQ ID NO: 2307060 - RNA, 17 nt, Human
gugggaacgugacugcc

SEQ ID NO: 2307061 - RNA, 21 nt, Human
gugggaacgagaggggaagag

SEQ ID NO: 2307062 - RNA, 12 nt, Human
gugggaaaacac

SEQ ID NO: 2307063 - RNA, 23 nt, Human
gugggaacgacugggcacugcca

SEQ ID NO: 2307064 - RNA, 18 nt, Human
gugggaacgagaggggaa

SEQ ID NO: 2307065 - RNA, 20 nt, Human
gugggaacgagaggggaaga

SEQ ID NO: 2307066 - RNA, 15 nt, Human
gugggagagcccagc

SEQ ID NO: 2307067 - RNA, 13 nt, Human
gugggagaggucu

SEQ ID NO: 2307068 - RNA, 14 nt, Human
gugggagagcccag

SEQ ID NO: 2307069 - RNA, 13 nt, Human
gugggagagccca

SEQ ID NO: 2307070 - RNA, 19 nt, Human
gugggagcagcgguuuggg

SEQ ID NO: 2307071 - RNA, 12 nt, Human
gugggagcagga

SEQ ID NO: 2307072 - RNA, 13 nt, Human
gugggagcaggag

SEQ ID NO: 2307073 - RNA, 14 nt, Human
gugggagcaggaga

SEQ ID NO: 2307074 - RNA, 15 nt, Human
gugggagcaggagau

SEQ ID NO: 2307075 - RNA, 22 nt, Human
gugggagcaggagauugagaag

SEQ ID NO: 2307076 - RNA, 12 nt, Human
gugggagcugag

SEQ ID NO: 2307077 - RNA, 17 nt, Human
gugggauggaggagaag

SEQ ID NO: 2307078 - RNA, 23 nt, Human
gugggauguucagcacugucccu

SEQ ID NO: 2307079 - RNA, 16 nt, Human
gugggauggaggagaa

SEQ ID NO: 2307080 - RNA, 19 nt, Human
gugggaucugccccucccu

SEQ ID NO: 2307081 - RNA, 14 nt, Human
gugggauggaggag

SEQ ID NO: 2307082 - RNA, 18 nt, Human
gugggaucugccccuccc

SEQ ID NO: 2307083 - RNA, 16 nt, Human
gugggagcgugggagg

SEQ ID NO: 2307084 - RNA, 15 nt, Human
gugggauccuccagg

SEQ ID NO: 2307085 - RNA, 18 nt, Human
gugggauccuccaggugc

SEQ ID NO: 2307086 - RNA, 11 nt, Human
aagagcugagg

SEQ ID NO: 2307087 - RNA, 18 nt, Human
aagagcugaggcaauucu

SEQ ID NO: 2307088 - RNA, 18 nt, Human
aagagcuguucacagcca

SEQ ID NO: 2307089 - RNA, 20 nt, Human
aagagcuagcgcugccgcac

SEQ ID NO: 2307090 - RNA, 19 nt, Human
aagagcuagcgcugccgca

SEQ ID NO: 2307091 - RNA, 16 nt, Human
aagagcuagcgcugcc

SEQ ID NO: 2307092 - RNA, 13 nt, Human
aagagcccuugcc

SEQ ID NO: 2307093 - RNA, 21 nt, Human
aagagccauguagaagcugca

SEQ ID NO: 2307094 - RNA, 16 nt, Human
guggcccgacagccug

SEQ ID NO: 2307095 - RNA, 16 nt, Human
guggccccguuucugg

SEQ ID NO: 2307096 - RNA, 17 nt, Human
guggccccguuucuggu

SEQ ID NO: 2307097 - RNA, 15 nt, Human
guggccccagccugg

SEQ ID NO: 2307098 - RNA, 16 nt, Human
guggccccagccuggc

SEQ ID NO: 2307099 - RNA, 17 nt, Human
guggccccagccuggcc

SEQ ID NO: 2307100 - RNA, 18 nt, Human
guggccccagccuggccc

SEQ ID NO: 2307101 - RNA, 19 nt, Human
guggccccagccuggccca

SEQ ID NO: 2307102 - RNA, 20 nt, Human
guggccccagccuggcccag

SEQ ID NO: 2307103 - RNA, 21 nt, Human
guggccccagccuggcccagc

SEQ ID NO: 2307104 - RNA, 22 nt, Human
guggccccagccuggcccagcu

SEQ ID NO: 2307105 - RNA, 12 nt, Human
guggccccagcc

SEQ ID NO: 2307106 - RNA, 13 nt, Human
guggccccagccu

SEQ ID NO: 2307107 - RNA, 14 nt, Human
guggccccagccug

SEQ ID NO: 2307108 - RNA, 13 nt, Human
aagagcugcccuc

SEQ ID NO: 2307109 - RNA, 23 nt, Human
guggccccacccugggcccuggg

SEQ ID NO: 2307110 - RNA, 16 nt, Human
aagagcuguccuggua

SEQ ID NO: 2307111 - RNA, 21 nt, Human
guggccccacccugggcccug

SEQ ID NO: 2307112 - RNA, 19 nt, Human
aagagcuguucacagccag

SEQ ID NO: 2307113 - RNA, 15 nt, Human
aagagauuccugagc

SEQ ID NO: 2307114 - RNA, 20 nt, Human
aagagaugggcuuguuuucu

SEQ ID NO: 2307115 - RNA, 18 nt, Human
aagagaugggcuuguuuu

SEQ ID NO: 2307116 - RNA, 16 nt, Human
aagagcccaggccucc

SEQ ID NO: 2307117 - RNA, 12 nt, Human
aagagcccaggc

SEQ ID NO: 2307118 - RNA, 14 nt, Human
aagagcccaggccu

SEQ ID NO: 2307119 - RNA, 19 nt, Human
aagagauugugguuucauu

SEQ ID NO: 2307120 - RNA, 16 nt, Human
aagagauugugguuuc

SEQ ID NO: 2307121 - RNA, 17 nt, Human
aagagauggccugagaa

SEQ ID NO: 2307122 - RNA, 17 nt, Human
aagagaugggcuuguuu

SEQ ID NO: 2307123 - RNA, 20 nt, Human
aagagaugaugaaaauauuu

SEQ ID NO: 2307124 - RNA, 16 nt, Human
aagacuguacaaagua

SEQ ID NO: 2307125 - RNA, 22 nt, Human
aagacuggcuuuuauuaaugca

SEQ ID NO: 2307126 - RNA, 13 nt, Human
aagacuguaauga

SEQ ID NO: 2307127 - RNA, 16 nt, Human
aagacuguaaugaauc

SEQ ID NO: 2307128 - RNA, 13 nt, Human
aagaccccaccca

SEQ ID NO: 2307129 - RNA, 13 nt, Human
aagaccauuuuuc

SEQ ID NO: 2307130 - RNA, 12 nt, Human
aagaccagucca

SEQ ID NO: 2307131 - RNA, 23 nt, Human
aagaccccuuaccacugcucuga

SEQ ID NO: 2307132 - RNA, 16 nt, Human
aagaccccacccaagc

SEQ ID NO: 2307133 - RNA, 22 nt, Human
aagaccccacccaagcuuggca

SEQ ID NO: 2307134 - RNA, 21 nt, Human
aagacgcugugcugcccugcc

SEQ ID NO: 2307135 - RNA, 22 nt, Human
aagacgcugugcugcccugccc

SEQ ID NO: 2307136 - RNA, 20 nt, Human
aagacgcugugcugcccugc

SEQ ID NO: 2307137 - RNA, 23 nt, Human
aagacgcugugcugcccugccca

SEQ ID NO: 2307138 - RNA, 14 nt, Human
aagacuauucaaac

SEQ ID NO: 2307139 - RNA, 21 nt, Human
aagacucaagugggaacgacu

SEQ ID NO: 2307140 - RNA, 14 nt, Human
aagacucaguguuc

SEQ ID NO: 2307141 - RNA, 23 nt, Human
aagacucaagugggaacgacugg

SEQ ID NO: 2307142 - RNA, 17 nt, Human
aagacucauucccuaga

SEQ ID NO: 2307143 - RNA, 16 nt, Human
aagacuccucggccug

SEQ ID NO: 2307144 - RNA, 23 nt, Human
aagacuggaagcuaauuugcauu

SEQ ID NO: 2307145 - RNA, 22 nt, Human
aagacuggaagcuaauuugcau

SEQ ID NO: 2307146 - RNA, 20 nt, Human
aagacuggaagcuaauuugc

SEQ ID NO: 2307147 - RNA, 21 nt, Human
aagacuggaagguggggacag

SEQ ID NO: 2307148 - RNA, 11 nt, Human
aagacuggcuu

SEQ ID NO: 2307149 - RNA, 23 nt, Human
aagacuggcuuuuauuaaugcac

SEQ ID NO: 2307150 - RNA, 17 nt, Human
aagacucauucuucugu

SEQ ID NO: 2307151 - RNA, 14 nt, Human
aagacuccaaagaa

SEQ ID NO: 2307152 - RNA, 17 nt, Human
aagacuccaaagaaaug

SEQ ID NO: 2307153 - RNA, 16 nt, Human
aagacuccaaagaaau

SEQ ID NO: 2307154 - RNA, 16 nt, Human
guguugaaaauguuca

SEQ ID NO: 2307155 - RNA, 18 nt, Human
guguguucugauuagaaa

SEQ ID NO: 2307156 - RNA, 15 nt, Human
guguguuccaacugc

SEQ ID NO: 2307157 - RNA, 18 nt, Human
guguguuccaacugcccc

SEQ ID NO: 2307158 - RNA, 13 nt, Human
guguucugugaua

SEQ ID NO: 2307159 - RNA, 14 nt, Human
guguguuauuuaaa

SEQ ID NO: 2307160 - RNA, 17 nt, Human
guguugaaaauguucag

SEQ ID NO: 2307161 - RNA, 19 nt, Human
guguugagccuuuucccuc

SEQ ID NO: 2307162 - RNA, 14 nt, Human
guguuuaagacauu

SEQ ID NO: 2307163 - RNA, 13 nt, Human
guguuuaagacau

SEQ ID NO: 2307164 - RNA, 11 nt, Human
guguuuaaaua

SEQ ID NO: 2307165 - RNA, 18 nt, Human
guguuuaaagagagguua

SEQ ID NO: 2307166 - RNA, 21 nt, Human
gugugguuugguguguucccg

SEQ ID NO: 2307167 - RNA, 18 nt, Human
guguggugcagugugaaa

SEQ ID NO: 2307168 - RNA, 23 nt, Human
gugugguggguucuuuggaagga

SEQ ID NO: 2307169 - RNA, 14 nt, Human
guguggugcagugu

SEQ ID NO: 2307170 - RNA, 13 nt, Human
guguggugcagug

SEQ ID NO: 2307171 - RNA, 19 nt, Human
gugugguguuuccuggcac

SEQ ID NO: 2307172 - RNA, 21 nt, Human
guguguggguggauauaaaua

SEQ ID NO: 2307173 - RNA, 13 nt, Human
guguguguaugug

SEQ ID NO: 2307174 - RNA, 13 nt, Human
gugugugugugug

SEQ ID NO: 2307175 - RNA, 13 nt, Human
gugugugugugcg

SEQ ID NO: 2307176 - RNA, 12 nt, Human
gugugugugugu

SEQ ID NO: 2307177 - RNA, 14 nt, Human
guguguguguccuu

SEQ ID NO: 2307178 - RNA, 15 nt, Human
gugugugugcguguu

SEQ ID NO: 2307179 - RNA, 14 nt, Human
gugugugugugugu

SEQ ID NO: 2307180 - RNA, 14 nt, Human
gugugugugugugc

SEQ ID NO: 2307181 - RNA, 15 nt, Human
gugugugugugugug

SEQ ID NO: 2307182 - RNA, 17 nt, Human
guguguguugugugugg

SEQ ID NO: 2307183 - RNA, 12 nt, Human
guguguguaugu

SEQ ID NO: 2307184 - RNA, 17 nt, Human
guguguguauguuugca

SEQ ID NO: 2307185 - RNA, 13 nt, Human
gugugugugaaug

SEQ ID NO: 2307186 - RNA, 9 nt, Human
gugugugug

SEQ ID NO: 2307187 - RNA, 14 nt, Human
gugugugugcgugu

SEQ ID NO: 2307188 - RNA, 19 nt, Human
guguguguaugcgugugug

SEQ ID NO: 2307189 - RNA, 14 nt, Human
guguguguaugugg

SEQ ID NO: 2307190 - RNA, 13 nt, Human
gugugagucacca

SEQ ID NO: 2307191 - RNA, 18 nt, Human
gugugagucaccaagccc

SEQ ID NO: 2307192 - RNA, 15 nt, Human
gugugguguuuccug

SEQ ID NO: 2307193 - RNA, 19 nt, Human
guguggugcagugugaaaa

SEQ ID NO: 2307194 - RNA, 17 nt, Human
gugugaggccagggcag

SEQ ID NO: 2307195 - RNA, 17 nt, Human
gugugaguaagagcugg

SEQ ID NO: 2307196 - RNA, 15 nt, Human
gugugaggccagggc

SEQ ID NO: 2307197 - RNA, 14 nt, Human
gugugaggccaggg

SEQ ID NO: 2307198 - RNA, 21 nt, Human
guguccauugacauguacaga

SEQ ID NO: 2307199 - RNA, 12 nt, Human
gugugaggccag

SEQ ID NO: 2307200 - RNA, 21 nt, Human
gugucuugcaauggcagccuu

SEQ ID NO: 2307201 - RNA, 16 nt, Human
gugucuugggcagagc

SEQ ID NO: 2307202 - RNA, 17 nt, Human
gugucuugggcagagcu

SEQ ID NO: 2307203 - RNA, 20 nt, Human
gugucuugggcagagcuggc

SEQ ID NO: 2307204 - RNA, 23 nt, Human
gugucuugggcagagcuggcucu

SEQ ID NO: 2307205 - RNA, 18 nt, Human
guguccacgacugucucc

SEQ ID NO: 2307206 - RNA, 22 nt, Human
aagcaagugauugggacagagg

SEQ ID NO: 2307207 - RNA, 16 nt, Human
aagcaaguauuagaau

SEQ ID NO: 2307208 - RNA, 16 nt, Human
guguccaugugugugc

SEQ ID NO: 2307209 - RNA, 16 nt, Human
guguccauugacaugu

SEQ ID NO: 2307210 - RNA, 15 nt, Human
guguccaugugugug

SEQ ID NO: 2307211 - RNA, 14 nt, Human
guguccaugugugu

SEQ ID NO: 2307212 - RNA, 19 nt, Human
guguccauugacauguaca

SEQ ID NO: 2307213 - RNA, 20 nt, Human
guguccauugacauguacag

SEQ ID NO: 2307214 - RNA, 23 nt, Human
guguccauugacauguacagaga

SEQ ID NO: 2307215 - RNA, 18 nt, Human
guguccaugcgcucaggg

SEQ ID NO: 2307216 - RNA, 19 nt, Human
guguccaugcgcucagggc

SEQ ID NO: 2307217 - RNA, 20 nt, Human
guguccaugcgcucagggcc

SEQ ID NO: 2307218 - RNA, 21 nt, Human
guguccaugcgcucagggcca

SEQ ID NO: 2307219 - RNA, 19 nt, Human
gugucuugcaauggcagcc

SEQ ID NO: 2307220 - RNA, 20 nt, Human
gugucccaaaaagaaaggag

SEQ ID NO: 2307221 - RNA, 14 nt, Human
gugguuauuucuca

SEQ ID NO: 2307222 - RNA, 22 nt, Human
gugguuauuucucaacaaagca

SEQ ID NO: 2307223 - RNA, 23 nt, Human
gugguuaaugccauggacagaag

SEQ ID NO: 2307224 - RNA, 21 nt, Human
gugguucacucuuggagccug

SEQ ID NO: 2307225 - RNA, 20 nt, Human
gugguucacucuuggagccu

SEQ ID NO: 2307226 - RNA, 18 nt, Human
gugguuauggagagggug

SEQ ID NO: 2307227 - RNA, 19 nt, Human
gugguguuuccuggcacug

SEQ ID NO: 2307228 - RNA, 16 nt, Human
aagaguaggaagacuu

SEQ ID NO: 2307229 - RNA, 18 nt, Human
aagaguaggaagacuuug

SEQ ID NO: 2307230 - RNA, 19 nt, Human
aagaguaggaagacuuugg

SEQ ID NO: 2307231 - RNA, 15 nt, Human
aagauauuuugcuuu

SEQ ID NO: 2307232 - RNA, 17 nt, Human
aagaucaaaauaaaaag

SEQ ID NO: 2307233 - RNA, 21 nt, Human
aagaucaaaauaaaaagugac

SEQ ID NO: 2307234 - RNA, 22 nt, Human
aagauauuuugcuuugugauuu

SEQ ID NO: 2307235 - RNA, 20 nt, Human
aagauauuuugcuuugugau

SEQ ID NO: 2307236 - RNA, 17 nt, Human
aagauauuuugcuuugu

SEQ ID NO: 2307237 - RNA, 21 nt, Human
aagauccugucuuuaaggaaa

SEQ ID NO: 2307238 - RNA, 23 nt, Human
aagauccuaccccaauuccuugu

SEQ ID NO: 2307239 - RNA, 15 nt, Human
aagaugacauugcua

SEQ ID NO: 2307240 - RNA, 16 nt, Human
aagaugacauugcuaa

SEQ ID NO: 2307241 - RNA, 17 nt, Human
aagaugacauugcuaag

SEQ ID NO: 2307242 - RNA, 20 nt, Human
aagaugacauugcuaagaug

SEQ ID NO: 2307243 - RNA, 17 nt, Human
aagaucauauacgugaa

SEQ ID NO: 2307244 - RNA, 16 nt, Human
aagaucauguacccca

SEQ ID NO: 2307245 - RNA, 15 nt, Human
aagauccccucagga

SEQ ID NO: 2307246 - RNA, 16 nt, Human
aagauccccucaggac

SEQ ID NO: 2307247 - RNA, 22 nt, Human
aagauccuaaaacaaaagcuca

SEQ ID NO: 2307248 - RNA, 19 nt, Human
aagaucacgcuccccgccu

SEQ ID NO: 2307249 - RNA, 16 nt, Human
aagaucacgcuccccg

SEQ ID NO: 2307250 - RNA, 22 nt, Human
aagaucaaaauaaaaagugaca

SEQ ID NO: 2307251 - RNA, 17 nt, Human
aagaucacgcuccccgc

SEQ ID NO: 2307252 - RNA, 23 nt, Human
aagaucacuuucucaguuuucau

SEQ ID NO: 2307253 - RNA, 17 nt, Human
aagaucacuuucucagu

SEQ ID NO: 2307254 - RNA, 15 nt, Human
aagaucacuuucuca

SEQ ID NO: 2307255 - RNA, 19 nt, Human
aagaucacuuguuguuuua

SEQ ID NO: 2307256 - RNA, 21 nt, Human
aagaucacuuguuguuuuacu

SEQ ID NO: 2307257 - RNA, 14 nt, Human
aagcaaacacauua

SEQ ID NO: 2307258 - RNA, 17 nt, Human
aagcaaaucagaaacuu

SEQ ID NO: 2307259 - RNA, 13 nt, Human
aagcaaacacauu

SEQ ID NO: 2307260 - RNA, 12 nt, Human
aagcaaacacau

SEQ ID NO: 2307261 - RNA, 16 nt, Human
aagaugucagacuggc

SEQ ID NO: 2307262 - RNA, 19 nt, Human
aagcaaaauuuuuucucua

SEQ ID NO: 2307263 - RNA, 16 nt, Human
aagcaagauuucagau

SEQ ID NO: 2307264 - RNA, 14 nt, Human
aagcaaaugugaau

SEQ ID NO: 2307265 - RNA, 12 nt, Human
aagcaaaugucu

SEQ ID NO: 2307266 - RNA, 13 nt, Human
aagcaaaugugaa

SEQ ID NO: 2307267 - RNA, 20 nt, Human
aagaugcaaggaccaggacu

SEQ ID NO: 2307268 - RNA, 15 nt, Human
aagaugcaaggacca

SEQ ID NO: 2307269 - RNA, 15 nt, Human
aagaugaucagaccu

SEQ ID NO: 2307270 - RNA, 14 nt, Human
aagaugaucauuug

SEQ ID NO: 2307271 - RNA, 18 nt, Human
aagaugaucuacucagaa

SEQ ID NO: 2307272 - RNA, 19 nt, Human
aagauguagaggagaaacu

SEQ ID NO: 2307273 - RNA, 18 nt, Human
aagaugagagaacuggag

SEQ ID NO: 2307274 - RNA, 17 nt, Human
aagaugagagaacugga

SEQ ID NO: 2307275 - RNA, 23 nt, Human
aagaugacauugcuaagaugcuc

SEQ ID NO: 2307276 - RNA, 21 nt, Human
aagaugacauugcuaagaugc

SEQ ID NO: 2307277 - RNA, 22 nt, Human
aagaugacauugcuaagaugcu

SEQ ID NO: 2307278 - RNA, 22 nt, Human
aagauguagaggagaaacugga

SEQ ID NO: 2307279 - RNA, 16 nt, Human
aagauguagauuuauu

SEQ ID NO: 2307280 - RNA, 17 nt, Human
aagaugaucuacucaga

SEQ ID NO: 2307281 - RNA, 15 nt, Human
aagaugcaauguaga

SEQ ID NO: 2307282 - RNA, 22 nt, Human
aagauguagauuuauuucauca

SEQ ID NO: 2307283 - RNA, 19 nt, Human
aagauguagauuuauuuca

SEQ ID NO: 2307284 - RNA, 13 nt, Human
aagcaaaauguga

SEQ ID NO: 2307285 - RNA, 14 nt, Human
guagccuuccucca

SEQ ID NO: 2307286 - RNA, 23 nt, Human
guagccuugcccggauucuggga

SEQ ID NO: 2307287 - RNA, 15 nt, Human
guagccuugcccgga

SEQ ID NO: 2307288 - RNA, 21 nt, Human
guagccucgccgucugugaau

SEQ ID NO: 2307289 - RNA, 12 nt, Human
guagccugugca

SEQ ID NO: 2307290 - RNA, 22 nt, Human
guagccuggauauuauucuugu

SEQ ID NO: 2307291 - RNA, 23 nt, Human
guagcuccucaacucaccuaaug

SEQ ID NO: 2307292 - RNA, 12 nt, Human
guagcucaggug

SEQ ID NO: 2307293 - RNA, 14 nt, Human
guagcucagguggg

SEQ ID NO: 2307294 - RNA, 14 nt, Human
guccauggaaugcu

SEQ ID NO: 2307295 - RNA, 15 nt, Human
guccauggaaugcuu

SEQ ID NO: 2307296 - RNA, 18 nt, Human
guccauggaaugcuugaa

SEQ ID NO: 2307297 - RNA, 17 nt, Human
guagcuagaggaaccaa

SEQ ID NO: 2307298 - RNA, 13 nt, Human
guagcuauaucua

SEQ ID NO: 2307299 - RNA, 16 nt, Human
guagcuauaucuauau

SEQ ID NO: 2307300 - RNA, 11 nt, Human
guagcucaggu

SEQ ID NO: 2307301 - RNA, 15 nt, Human
guagcuagaggaacc

SEQ ID NO: 2307302 - RNA, 14 nt, Human
guagcuagaggaac

SEQ ID NO: 2307303 - RNA, 22 nt, Human
guagcucuaggagggcuggcaa

SEQ ID NO: 2307304 - RNA, 19 nt, Human
gucccaccuuggcugcagg

SEQ ID NO: 2307305 - RNA, 22 nt, Human
guccccccacccucauucuacu

SEQ ID NO: 2307306 - RNA, 13 nt, Human
guccauucuccca

SEQ ID NO: 2307307 - RNA, 15 nt, Human
guccauucucccagg

SEQ ID NO: 2307308 - RNA, 14 nt, Human
guccauugacaugu

SEQ ID NO: 2307309 - RNA, 15 nt, Human
guccauugacaugua

SEQ ID NO: 2307310 - RNA, 19 nt, Human
guccauugacauguacaga

SEQ ID NO: 2307311 - RNA, 17 nt, Human
guccauugacauguaca

SEQ ID NO: 2307312 - RNA, 18 nt, Human
guccauugacauguacag

SEQ ID NO: 2307313 - RNA, 14 nt, Human
gucccccucuggcu

SEQ ID NO: 2307314 - RNA, 12 nt, Human
gucccccucugg

SEQ ID NO: 2307315 - RNA, 17 nt, Human
gucccaccuuggcugca

SEQ ID NO: 2307316 - RNA, 18 nt, Human
gucccaccuuggcugcag

SEQ ID NO: 2307317 - RNA, 13 nt, Human
guccaugugugug

SEQ ID NO: 2307318 - RNA, 19 nt, Human
guccaugugguucuucaaa

SEQ ID NO: 2307319 - RNA, 14 nt, Human
guccaugugugugc

SEQ ID NO: 2307320 - RNA, 23 nt, Human
guccaugggcagagcccaaggga

SEQ ID NO: 2307321 - RNA, 18 nt, Human
guccaugggcagagccca

SEQ ID NO: 2307322 - RNA, 16 nt, Human
guccaugggcagagcc

SEQ ID NO: 2307323 - RNA, 14 nt, Human
guccaugggcagag

SEQ ID NO: 2307324 - RNA, 13 nt, Human
guccaugggcaga

SEQ ID NO: 2307325 - RNA, 20 nt, Human
guccauggaaugcuugaaaa

SEQ ID NO: 2307326 - RNA, 21 nt, Human
guccauggaaugcuugaaaaa

SEQ ID NO: 2307327 - RNA, 22 nt, Human
gucccuuucuuggccaguuauc

SEQ ID NO: 2307328 - RNA, 14 nt, Human
guccguuuacucca

SEQ ID NO: 2307329 - RNA, 13 nt, Human
guccuaaaacacc

SEQ ID NO: 2307330 - RNA, 22 nt, Human
guccuaagaaagaggagugcuu

SEQ ID NO: 2307331 - RNA, 16 nt, Human
guccuaacugguauag

SEQ ID NO: 2307332 - RNA, 14 nt, Human
guccuaagaaagag

SEQ ID NO: 2307333 - RNA, 19 nt, Human
guccuaaggacacacuaau

SEQ ID NO: 2307334 - RNA, 23 nt, Human
guccccuuuucuuuucuacccua

SEQ ID NO: 2307335 - RNA, 22 nt, Human
guccgaaagggacuuggaagcu

SEQ ID NO: 2307336 - RNA, 21 nt, Human
guccgaaagggacuuggaagc

SEQ ID NO: 2307337 - RNA, 13 nt, Human
gucccuuuuccuu

SEQ ID NO: 2307338 - RNA, 12 nt, Human
guccccuucucu

SEQ ID NO: 2307339 - RNA, 13 nt, Human
guccccuucucuc

SEQ ID NO: 2307340 - RNA, 14 nt, Human
guccccuucucuca

SEQ ID NO: 2307341 - RNA, 17 nt, Human
guccccuucucucaucu

SEQ ID NO: 2307342 - RNA, 18 nt, Human
guccccuucucucaucuc

SEQ ID NO: 2307343 - RNA, 19 nt, Human
guccccuucucucaucucu

SEQ ID NO: 2307344 - RNA, 20 nt, Human
guccccuucucucaucucuu

SEQ ID NO: 2307345 - RNA, 22 nt, Human
guccccuuuguauuccuuaaau

SEQ ID NO: 2307346 - RNA, 22 nt, Human
guccccuuuucuuuucuacccu

SEQ ID NO: 2307347 - RNA, 15 nt, Human
guccccucagcucca

SEQ ID NO: 2307348 - RNA, 18 nt, Human
guccccucagcuccagac

SEQ ID NO: 2307349 - RNA, 12 nt, Human
guccccucaccu

SEQ ID NO: 2307350 - RNA, 13 nt, Human
guccccucagcuc

SEQ ID NO: 2307351 - RNA, 14 nt, Human
guccccucagcucc

SEQ ID NO: 2307352 - RNA, 21 nt, Human
gucccccucuguccaggcacu

SEQ ID NO: 2307353 - RNA, 22 nt, Human
guccccgugccccgccuccccg

SEQ ID NO: 2307354 - RNA, 15 nt, Human
guccccgugccccgc

SEQ ID NO: 2307355 - RNA, 23 nt, Human
guccccuguuuguuucugaaagg

SEQ ID NO: 2307356 - RNA, 13 nt, Human
guccccuuccauc

SEQ ID NO: 2307357 - RNA, 11 nt, Human
guccccuucuc

SEQ ID NO: 2307358 - RNA, 12 nt, Human
guccccucccau

SEQ ID NO: 2307359 - RNA, 14 nt, Human
guccccucccaucu

SEQ ID NO: 2307360 - RNA, 15 nt, Human
guccccucccaucug

SEQ ID NO: 2307361 - RNA, 16 nt, Human
guccccucccaucugg

SEQ ID NO: 2307362 - RNA, 13 nt, Human
gucccccugacaa

SEQ ID NO: 2307363 - RNA, 19 nt, Human
gucccccucuguccaggca

SEQ ID NO: 2307364 - RNA, 13 nt, Human
gucccccucuguc

SEQ ID NO: 2307365 - RNA, 15 nt, Human
guccccgcacugggc

SEQ ID NO: 2307366 - RNA, 16 nt, Human
guccccgcacugggcu

SEQ ID NO: 2307367 - RNA, 21 nt, Human
aacauaaccauuacagggagc

SEQ ID NO: 2307368 - RNA, 20 nt, Human
aacauaaucuucugccuucu

SEQ ID NO: 2307369 - RNA, 13 nt, Human
aacagugagccug

SEQ ID NO: 2307370 - RNA, 21 nt, Human
aacagugagccugaauuuugu

SEQ ID NO: 2307371 - RNA, 18 nt, Human
aacauaaauaaaaugacc

SEQ ID NO: 2307372 - RNA, 18 nt, Human
aacauacucccaucugug

SEQ ID NO: 2307373 - RNA, 16 nt, Human
aacauacucccaucug

SEQ ID NO: 2307374 - RNA, 17 nt, Human
aacauacuggcugguga

SEQ ID NO: 2307375 - RNA, 22 nt, Human
aacauaaucuucugccuucuca

SEQ ID NO: 2307376 - RNA, 12 nt, Human
aacauaauuaaa

SEQ ID NO: 2307377 - RNA, 20 nt, Human
aacauacucccaucugugaa

SEQ ID NO: 2307378 - RNA, 20 nt, Human
aacauguuuacuuuucaggg

SEQ ID NO: 2307379 - RNA, 16 nt, Human
aacauguuacugacca

SEQ ID NO: 2307380 - RNA, 22 nt, Human
aacauauuuguuaaauauuuac

SEQ ID NO: 2307381 - RNA, 20 nt, Human
aacauauuuguuaaauauuu

SEQ ID NO: 2307382 - RNA, 13 nt, Human
aacauauuuguua

SEQ ID NO: 2307383 - RNA, 14 nt, Human
aacauauuguugaa

SEQ ID NO: 2307384 - RNA, 17 nt, Human
aacauguuacugaccag

SEQ ID NO: 2307385 - RNA, 13 nt, Human
aacauguuccuga

SEQ ID NO: 2307386 - RNA, 11 nt, Human
aacauguuucc

SEQ ID NO: 2307387 - RNA, 22 nt, Human
aacauguuuuucuucucccuca

SEQ ID NO: 2307388 - RNA, 17 nt, Human
aacauaugaaaauacaa

SEQ ID NO: 2307389 - RNA, 14 nt, Human
aacaucaacaucuu

SEQ ID NO: 2307390 - RNA, 22 nt, Human
aacauagaaauugccugacgaa

SEQ ID NO: 2307391 - RNA, 16 nt, Human
aacauauauaacaaug

SEQ ID NO: 2307392 - RNA, 13 nt, Human
guccuacccaccc

SEQ ID NO: 2307393 - RNA, 20 nt, Human
aacagacuggaagcacagcu

SEQ ID NO: 2307394 - RNA, 13 nt, Human
aacagagaaggca

SEQ ID NO: 2307395 - RNA, 16 nt, Human
guccuaccaauagauu

SEQ ID NO: 2307396 - RNA, 16 nt, Human
aacagagaaggcagga

SEQ ID NO: 2307397 - RNA, 15 nt, Human
aacagagaaggcagg

SEQ ID NO: 2307398 - RNA, 19 nt, Human
aacagagacaggcccaaga

SEQ ID NO: 2307399 - RNA, 13 nt, Human
aacagagauguga

SEQ ID NO: 2307400 - RNA, 20 nt, Human
aacagaggaagaauuuguua

SEQ ID NO: 2307401 - RNA, 21 nt, Human
aacagaggccauggcagaaua

SEQ ID NO: 2307402 - RNA, 17 nt, Human
aacagaggccauggcag

SEQ ID NO: 2307403 - RNA, 19 nt, Human
aacagagugagacccuguc

SEQ ID NO: 2307404 - RNA, 22 nt, Human
aacagaugcaaugugcuacuga

SEQ ID NO: 2307405 - RNA, 21 nt, Human
aacagaugcaaugugcuacug

SEQ ID NO: 2307406 - RNA, 23 nt, Human
aacagaugcaaugugcuacugau

SEQ ID NO: 2307407 - RNA, 14 nt, Human
aacagaugcuuuuc

SEQ ID NO: 2307408 - RNA, 19 nt, Human
aacagauuauuaccuuaca

SEQ ID NO: 2307409 - RNA, 17 nt, Human
aacagucuucaggcaaa

SEQ ID NO: 2307410 - RNA, 23 nt, Human
aacagucugaucgugacgcugaa

SEQ ID NO: 2307411 - RNA, 16 nt, Human
aacagguuuuauaauu

SEQ ID NO: 2307412 - RNA, 22 nt, Human
aacagguuauuuuaguuucugu

SEQ ID NO: 2307413 - RNA, 12 nt, Human
aacagucugauc

SEQ ID NO: 2307414 - RNA, 19 nt, Human
aacagucucaggaaaucaa

SEQ ID NO: 2307415 - RNA, 19 nt, Human
aacagguuuuccugaagaa

SEQ ID NO: 2307416 - RNA, 16 nt, Human
aacagguuauuuuagu

SEQ ID NO: 2307417 - RNA, 20 nt, Human
aacagguuauuuuaguuucu

SEQ ID NO: 2307418 - RNA, 21 nt, Human
aacagguuauuuuaguuucug

SEQ ID NO: 2307419 - RNA, 17 nt, Human
aacagucucaggaaauc

SEQ ID NO: 2307420 - RNA, 20 nt, Human
aacaggucuccucuuaaaaa

SEQ ID NO: 2307421 - RNA, 16 nt, Human
aacagguggcaggacc

SEQ ID NO: 2307422 - RNA, 14 nt, Human
aacagguggagaaa

SEQ ID NO: 2307423 - RNA, 19 nt, Human
aacagguggcaggaccagg

SEQ ID NO: 2307424 - RNA, 21 nt, Human
aacagguggcaggaccaggac

SEQ ID NO: 2307425 - RNA, 22 nt, Human
aacagguggcaggaccaggacu

SEQ ID NO: 2307426 - RNA, 23 nt, Human
aacagguggcaggaccaggacua

SEQ ID NO: 2307427 - RNA, 19 nt, Human
aacaggucuccucuuaaaa

SEQ ID NO: 2307428 - RNA, 18 nt, Human
aacaggucuccucuuaaa

SEQ ID NO: 2307429 - RNA, 17 nt, Human
aacaggucuccucuuaa

SEQ ID NO: 2307430 - RNA, 15 nt, Human
aacaggucuccucuu

SEQ ID NO: 2307431 - RNA, 13 nt, Human
aacaggucuccuc

SEQ ID NO: 2307432 - RNA, 12 nt, Human
aacaggucuccu

SEQ ID NO: 2307433 - RNA, 18 nt, Human
aacagauucacacugucu

SEQ ID NO: 2307434 - RNA, 20 nt, Human
aacagauguuucuuuuguau

SEQ ID NO: 2307435 - RNA, 17 nt, Human
aacagauguuucuuuug

SEQ ID NO: 2307436 - RNA, 24 nt, Human
aacagauguuucuuuuguauguaa

SEQ ID NO: 2307437 - RNA, 15 nt, Human
aacagauucacacug

SEQ ID NO: 2307438 - RNA, 16 nt, Human
aacagauucacacugu

SEQ ID NO: 2307439 - RNA, 15 nt, Human
gucgcccucccaggc

SEQ ID NO: 2307440 - RNA, 18 nt, Human
gucgcccuggacugugug

SEQ ID NO: 2307441 - RNA, 20 nt, Human
gucuaccugaggggccucuu

SEQ ID NO: 2307442 - RNA, 23 nt, Human
gucgcccagucuggaaugcagug

SEQ ID NO: 2307443 - RNA, 14 nt, Human
gucgcccuggacug

SEQ ID NO: 2307444 - RNA, 17 nt, Human
gucuauaugaaaaacaa

SEQ ID NO: 2307445 - RNA, 14 nt, Human
gucuauauguuugu

SEQ ID NO: 2307446 - RNA, 21 nt, Human
gucuauaaucccagcacuuug

SEQ ID NO: 2307447 - RNA, 20 nt, Human
gucuauaaucccagcacuuu

SEQ ID NO: 2307448 - RNA, 18 nt, Human
gucuagauggcuccucuc

SEQ ID NO: 2307449 - RNA, 17 nt, Human
gucuagauggcuccucu

SEQ ID NO: 2307450 - RNA, 19 nt, Human
gucuagauggcuccucuca

SEQ ID NO: 2307451 - RNA, 16 nt, Human
gucuagauggcuccuc

SEQ ID NO: 2307452 - RNA, 15 nt, Human
gucuagauggcuccu

SEQ ID NO: 2307453 - RNA, 21 nt, Human
gucuagagagggaggcaagcc

SEQ ID NO: 2307454 - RNA, 16 nt, Human
gucuagagagggaggc

SEQ ID NO: 2307455 - RNA, 15 nt, Human
gucuagagagggagg

SEQ ID NO: 2307456 - RNA, 14 nt, Human
gucuagagagggag

SEQ ID NO: 2307457 - RNA, 13 nt, Human
gucuagagaggga

SEQ ID NO: 2307458 - RNA, 17 nt, Human
gucuagaaguuguuugu

SEQ ID NO: 2307459 - RNA, 23 nt, Human
gucuacucuuaagccaucuuggu

SEQ ID NO: 2307460 - RNA, 21 nt, Human
gucuagaaguuguuugucauc

SEQ ID NO: 2307461 - RNA, 20 nt, Human
gucuacucauuccccggggc

SEQ ID NO: 2307462 - RNA, 17 nt, Human
gucuacucuuaagccau

SEQ ID NO: 2307463 - RNA, 18 nt, Human
gucuacucuuaagccauc

SEQ ID NO: 2307464 - RNA, 19 nt, Human
gucuacucuuaagccaucu

SEQ ID NO: 2307465 - RNA, 16 nt, Human
gucgaauuuuuauuau

SEQ ID NO: 2307466 - RNA, 23 nt, Human
gucgagcuggaugucccaccucu

SEQ ID NO: 2307467 - RNA, 12 nt, Human
gucgagacacuu

SEQ ID NO: 2307468 - RNA, 14 nt, Human
gucgaggacaggga

SEQ ID NO: 2307469 - RNA, 17 nt, Human
guccuuuuguaccaugg

SEQ ID NO: 2307470 - RNA, 20 nt, Human
guccuuuauguggaaaacag

SEQ ID NO: 2307471 - RNA, 21 nt, Human
guccuuuauguggaaaacaga

SEQ ID NO: 2307472 - RNA, 22 nt, Human
guccuuuuguaccaugguguga

SEQ ID NO: 2307473 - RNA, 17 nt, Human
gucgaauuaauagcuuu

SEQ ID NO: 2307474 - RNA, 19 nt, Human
guccuuuuuuuccaucuuu

SEQ ID NO: 2307475 - RNA, 16 nt, Human
guccuuuuuuuccauc

SEQ ID NO: 2307476 - RNA, 13 nt, Human
gucgcccaggaga

SEQ ID NO: 2307477 - RNA, 12 nt, Human
gucgcccaggag

SEQ ID NO: 2307478 - RNA, 14 nt, Human
gucgcccaggcugg

SEQ ID NO: 2307479 - RNA, 15 nt, Human
gucgcccaggcugga

SEQ ID NO: 2307480 - RNA, 20 nt, Human
gucgcccaggcuggagugca

SEQ ID NO: 2307481 - RNA, 13 nt, Human
gucgcccagucug

SEQ ID NO: 2307482 - RNA, 14 nt, Human
gucgcccagucugg

SEQ ID NO: 2307483 - RNA, 18 nt, Human
guccuugcaccugcaucc

SEQ ID NO: 2307484 - RNA, 12 nt, Human
guccuugcccuu

SEQ ID NO: 2307485 - RNA, 17 nt, Human
guccuugcaccugcauc

SEQ ID NO: 2307486 - RNA, 16 nt, Human
guccuugcaccugcau

SEQ ID NO: 2307487 - RNA, 15 nt, Human
guccuugcaccugca

SEQ ID NO: 2307488 - RNA, 14 nt, Human
guccuugcaccugc

SEQ ID NO: 2307489 - RNA, 18 nt, Human
guccuugcaccccucacu

SEQ ID NO: 2307490 - RNA, 19 nt, Human
guccuugcaccccucacuc

SEQ ID NO: 2307491 - RNA, 22 nt, Human
guccuugcacacuccccugcac

SEQ ID NO: 2307492 - RNA, 16 nt, Human
guccuugcaccccuca

SEQ ID NO: 2307493 - RNA, 12 nt, Human
guccuugcacac

SEQ ID NO: 2307494 - RNA, 17 nt, Human
guccugcugcaguugcc

SEQ ID NO: 2307495 - RNA, 14 nt, Human
guccuuggugugac

SEQ ID NO: 2307496 - RNA, 17 nt, Human
guccuuggaaguuucau

SEQ ID NO: 2307497 - RNA, 22 nt, Human
guccuuggugugacccucugaa

SEQ ID NO: 2307498 - RNA, 22 nt, Human
guccuugcugguuuucuggaug

SEQ ID NO: 2307499 - RNA, 14 nt, Human
guccuugcuuggcu

SEQ ID NO: 2307500 - RNA, 21 nt, Human
guccuuuacacucaggcuuuc

SEQ ID NO: 2307501 - RNA, 14 nt, Human
guccuuuaguaccu

SEQ ID NO: 2307502 - RNA, 13 nt, Human
guccuuuaugugg

SEQ ID NO: 2307503 - RNA, 16 nt, Human
guccuuuauguggaaa

SEQ ID NO: 2307504 - RNA, 19 nt, Human
guccugcgucgaagcuuug

SEQ ID NO: 2307505 - RNA, 14 nt, Human
guccugcuccacag

SEQ ID NO: 2307506 - RNA, 16 nt, Human
guccugcuccacagug

SEQ ID NO: 2307507 - RNA, 17 nt, Human
guccugcuccacagugu

SEQ ID NO: 2307508 - RNA, 19 nt, Human
guccugcuccacaguguug

SEQ ID NO: 2307509 - RNA, 20 nt, Human
guccugauggucagcucccu

SEQ ID NO: 2307510 - RNA, 23 nt, Human
guccugauggucagcucccuucu

SEQ ID NO: 2307511 - RNA, 22 nt, Human
guccugccuguggcgccgucuc

SEQ ID NO: 2307512 - RNA, 13 nt, Human
guccugcugcagu

SEQ ID NO: 2307513 - RNA, 16 nt, Human
guccugcugcaguugc

SEQ ID NO: 2307514 - RNA, 21 nt, Human
aacauuaaaacaauauuguuu

SEQ ID NO: 2307515 - RNA, 23 nt, Human
aacauuaaaacaauauuguuucu

SEQ ID NO: 2307516 - RNA, 13 nt, Human
aacauuaagaaaa

SEQ ID NO: 2307517 - RNA, 14 nt, Human
aacauuaagaaaau

SEQ ID NO: 2307518 - RNA, 20 nt, Human
aacauuacagggaaugccug

SEQ ID NO: 2307519 - RNA, 22 nt, Human
aacauuacagggaaugccugag

SEQ ID NO: 2307520 - RNA, 16 nt, Human
aacauuaccuuacugu

SEQ ID NO: 2307521 - RNA, 16 nt, Human
aacauuaagaaaauca

SEQ ID NO: 2307522 - RNA, 18 nt, Human
aacauuaagaaaaucaua

SEQ ID NO: 2307523 - RNA, 19 nt, Human
aacauuaagaaaaucauau

SEQ ID NO: 2307524 - RNA, 21 nt, Human
aacauuaagauugaggccugc

SEQ ID NO: 2307525 - RNA, 17 nt, Human
guccugaucagagccgu

SEQ ID NO: 2307526 - RNA, 15 nt, Human
guccugauggucagc

SEQ ID NO: 2307527 - RNA, 17 nt, Human
guccugauggucagcuc

SEQ ID NO: 2307528 - RNA, 18 nt, Human
guccugauggucagcucc

SEQ ID NO: 2307529 - RNA, 19 nt, Human
guccugauggucagcuccc

SEQ ID NO: 2307530 - RNA, 17 nt, Human
aacauuaccuuacugug

SEQ ID NO: 2307531 - RNA, 19 nt, Human
aacauuaccuuacugugga

SEQ ID NO: 2307532 - RNA, 17 nt, Human
aacauuuuacccacaca

SEQ ID NO: 2307533 - RNA, 15 nt, Human
aacauuuuacccaca

SEQ ID NO: 2307534 - RNA, 13 nt, Human
aacauuuucacac

SEQ ID NO: 2307535 - RNA, 16 nt, Human
aacauuuugucauaua

SEQ ID NO: 2307536 - RNA, 22 nt, Human
aacauuuguucuauagcuuuuc

SEQ ID NO: 2307537 - RNA, 14 nt, Human
gucuccauggcccu

SEQ ID NO: 2307538 - RNA, 19 nt, Human
gucuccagugguugcuguu

SEQ ID NO: 2307539 - RNA, 20 nt, Human
gucuccagugguugcuguug

SEQ ID NO: 2307540 - RNA, 14 nt, Human
aacauuuuaauuca

SEQ ID NO: 2307541 - RNA, 18 nt, Human
aacauuuuaaauggacag

SEQ ID NO: 2307542 - RNA, 15 nt, Human
aacauuuuaaaugga

SEQ ID NO: 2307543 - RNA, 17 nt, Human
aacauuuuaaauggaca

SEQ ID NO: 2307544 - RNA, 15 nt, Human
aacauuuuaaauaaa

SEQ ID NO: 2307545 - RNA, 19 nt, Human
aacauuuuaaauaaaagaa

SEQ ID NO: 2307546 - RNA, 20 nt, Human
aacauuuuaaauaaaagaaa

SEQ ID NO: 2307547 - RNA, 13 nt, Human
aacauuuuaaaug

SEQ ID NO: 2307548 - RNA, 20 nt, Human
gucuccagccccuucucaga

SEQ ID NO: 2307549 - RNA, 20 nt, Human
gucuccagacccccaccccu

SEQ ID NO: 2307550 - RNA, 17 nt, Human
gucuccagacccccacc

SEQ ID NO: 2307551 - RNA, 15 nt, Human
gucuccaggggcugc

SEQ ID NO: 2307552 - RNA, 22 nt, Human
gucuccagccccuucucagaau

SEQ ID NO: 2307553 - RNA, 16 nt, Human
gucuccaggggcugcu

SEQ ID NO: 2307554 - RNA, 19 nt, Human
gucuccaggggcugcuucc

SEQ ID NO: 2307555 - RNA, 20 nt, Human
gucuccaggggcugcuuccu

SEQ ID NO: 2307556 - RNA, 21 nt, Human
gucuccaggggcugcuuccuc

SEQ ID NO: 2307557 - RNA, 13 nt, Human
gucuccauguuug

SEQ ID NO: 2307558 - RNA, 21 nt, Human
gucuccaguauccacuuugca

SEQ ID NO: 2307559 - RNA, 18 nt, Human
gucuccagugguugcugu

SEQ ID NO: 2307560 - RNA, 22 nt, Human
gucuccaggggcugcuuccucc

SEQ ID NO: 2307561 - RNA, 23 nt, Human
gucuccaggggcugcuuccuccu

SEQ ID NO: 2307562 - RNA, 13 nt, Human
aaccacaucuugc

SEQ ID NO: 2307563 - RNA, 15 nt, Human
aaccacagcccuguc

SEQ ID NO: 2307564 - RNA, 14 nt, Human
aaccacagcccugu

SEQ ID NO: 2307565 - RNA, 13 nt, Human
aaccacagcccug

SEQ ID NO: 2307566 - RNA, 12 nt, Human
aaccacagcccu

SEQ ID NO: 2307567 - RNA, 16 nt, Human
aaccacagcccuguca

SEQ ID NO: 2307568 - RNA, 18 nt, Human
aaccacagcugcuggaga

SEQ ID NO: 2307569 - RNA, 13 nt, Human
aaccacagcugcu

SEQ ID NO: 2307570 - RNA, 14 nt, Human
aaccacagcugcug

SEQ ID NO: 2307571 - RNA, 15 nt, Human
aaccacagcugcugg

SEQ ID NO: 2307572 - RNA, 16 nt, Human
aaccacagcugcugga

SEQ ID NO: 2307573 - RNA, 16 nt, Human
aaccaaauauuccaga

SEQ ID NO: 2307574 - RNA, 22 nt, Human
aaccaaaucacugaacuuugcu

SEQ ID NO: 2307575 - RNA, 15 nt, Human
aaccaaaucuggaag

SEQ ID NO: 2307576 - RNA, 10 nt, Human
aaccaaaggu

SEQ ID NO: 2307577 - RNA, 14 nt, Human
aaccaaaggugaag

SEQ ID NO: 2307578 - RNA, 16 nt, Human
aaccaaaggugaagga

SEQ ID NO: 2307579 - RNA, 20 nt, Human
aaccaaaggugaaggaauau

SEQ ID NO: 2307580 - RNA, 21 nt, Human
aaccaaaggugaaggaauaua

SEQ ID NO: 2307581 - RNA, 23 nt, Human
aaccaaaggugaaggaauauaug

SEQ ID NO: 2307582 - RNA, 14 nt, Human
aaccaagaagggcu

SEQ ID NO: 2307583 - RNA, 17 nt, Human
aaccaacuacaaccaag

SEQ ID NO: 2307584 - RNA, 23 nt, Human
aaccaaaguaaccuuuugcaccu

SEQ ID NO: 2307585 - RNA, 16 nt, Human
gucucaaacuccugac

SEQ ID NO: 2307586 - RNA, 19 nt, Human
gucucaaaaaaagaaaaag

SEQ ID NO: 2307587 - RNA, 22 nt, Human
gucucaaacucuugaccucagg

SEQ ID NO: 2307588 - RNA, 14 nt, Human
gucuaugggacuca

SEQ ID NO: 2307589 - RNA, 15 nt, Human
gucuaugggacucaa

SEQ ID NO: 2307590 - RNA, 13 nt, Human
gucuauccacaga

SEQ ID NO: 2307591 - RNA, 14 nt, Human
gucuauccacagag

SEQ ID NO: 2307592 - RNA, 15 nt, Human
gucuauccacagaga

SEQ ID NO: 2307593 - RNA, 20 nt, Human
gucucaagagggcacuggug

SEQ ID NO: 2307594 - RNA, 22 nt, Human
gucucaagagggcacugguggc

SEQ ID NO: 2307595 - RNA, 12 nt, Human
gucucaaugcuc

SEQ ID NO: 2307596 - RNA, 14 nt, Human
gucucaaugcucau

SEQ ID NO: 2307597 - RNA, 21 nt, Human
gucucaacccuuuugucugcc

SEQ ID NO: 2307598 - RNA, 19 nt, Human
gucucaagggcuagcaucc

SEQ ID NO: 2307599 - RNA, 15 nt, Human
gucucaagagggcac

SEQ ID NO: 2307600 - RNA, 17 nt, Human
gucucaagagggcacug

SEQ ID NO: 2307601 - RNA, 16 nt, Human
gucucaaacuccuggg

SEQ ID NO: 2307602 - RNA, 21 nt, Human
gucuaugacuuauuuccuuca

SEQ ID NO: 2307603 - RNA, 20 nt, Human
gucucaaacuccugggcuca

SEQ ID NO: 2307604 - RNA, 16 nt, Human
gucucaguccaccuga

SEQ ID NO: 2307605 - RNA, 18 nt, Human
gucucaggcuggugggag

SEQ ID NO: 2307606 - RNA, 22 nt, Human
gucucaggcuggugggaggggc

SEQ ID NO: 2307607 - RNA, 16 nt, Human
gucuccaaccccccag

SEQ ID NO: 2307608 - RNA, 17 nt, Human
gucuccaaccccccagc

SEQ ID NO: 2307609 - RNA, 20 nt, Human
gucuccaaccccccagcacu

SEQ ID NO: 2307610 - RNA, 21 nt, Human
gucuccaaccccccagcacug

SEQ ID NO: 2307611 - RNA, 15 nt, Human
gucuccagaccccca

SEQ ID NO: 2307612 - RNA, 21 nt, Human
gucuccaccaggaaccucuuc

SEQ ID NO: 2307613 - RNA, 20 nt, Human
gucuccaccaggaaccucuu

SEQ ID NO: 2307614 - RNA, 19 nt, Human
gucuccaccaggaaccucu

SEQ ID NO: 2307615 - RNA, 17 nt, Human
gucuccaccaggaaccu

SEQ ID NO: 2307616 - RNA, 16 nt, Human
gucuccaccaggaacc

SEQ ID NO: 2307617 - RNA, 15 nt, Human
gucuccaccaggaac

SEQ ID NO: 2307618 - RNA, 12 nt, Human
gucuccaccagg

SEQ ID NO: 2307619 - RNA, 22 nt, Human
gucuccaaccccccagcacuga

SEQ ID NO: 2307620 - RNA, 20 nt, Human
gucuccacacacagcugggc

SEQ ID NO: 2307621 - RNA, 23 nt, Human
gucuccacacacagcugggcugu

SEQ ID NO: 2307622 - RNA, 16 nt, Human
gucucaggucccugca

SEQ ID NO: 2307623 - RNA, 23 nt, Human
gucucaguccaugaagauguaga

SEQ ID NO: 2307624 - RNA, 23 nt, Human
gucucacaguguugcccaggcug

SEQ ID NO: 2307625 - RNA, 19 nt, Human
gucucacaguguugcccag

SEQ ID NO: 2307626 - RNA, 17 nt, Human
gucucaaugcucauaac

SEQ ID NO: 2307627 - RNA, 15 nt, Human
gucucacacuggcgu

SEQ ID NO: 2307628 - RNA, 13 nt, Human
gucucacagcccu

SEQ ID NO: 2307629 - RNA, 15 nt, Human
gucucaggucccugc

SEQ ID NO: 2307630 - RNA, 13 nt, Human
gucucaggcuggu

SEQ ID NO: 2307631 - RNA, 17 nt, Human
gucucaggcugguggga

SEQ ID NO: 2307632 - RNA, 23 nt, Human
aaccaugaguggcauggccacca

SEQ ID NO: 2307633 - RNA, 13 nt, Human
gucucuuguaauc

SEQ ID NO: 2307634 - RNA, 13 nt, Human
gucucuugguccu

SEQ ID NO: 2307635 - RNA, 20 nt, Human
gucucuugguccugcugcag

SEQ ID NO: 2307636 - RNA, 18 nt, Human
gucucuugguccugcugc

SEQ ID NO: 2307637 - RNA, 19 nt, Human
gucucuugguccugcugca

SEQ ID NO: 2307638 - RNA, 22 nt, Human
aaccaucccugaugucugucug

SEQ ID NO: 2307639 - RNA, 19 nt, Human
aaccauccccuccguggca

SEQ ID NO: 2307640 - RNA, 21 nt, Human
aaccaugaagagauuuuucau

SEQ ID NO: 2307641 - RNA, 23 nt, Human
aaccaugaagagauuuuucauga

SEQ ID NO: 2307642 - RNA, 20 nt, Human
aaccaucugucccugccuca

SEQ ID NO: 2307643 - RNA, 15 nt, Human
aaccaugaagacagg

SEQ ID NO: 2307644 - RNA, 16 nt, Human
aaccaugaagacagga

SEQ ID NO: 2307645 - RNA, 17 nt, Human
aaccaugaagacaggau

SEQ ID NO: 2307646 - RNA, 17 nt, Human
gucucuugguccugcug

SEQ ID NO: 2307647 - RNA, 22 nt, Human
aaccaugagaccacuguuauca

SEQ ID NO: 2307648 - RNA, 24 nt, Human
aaccaugaagagauuuuucaugau

SEQ ID NO: 2307649 - RNA, 19 nt, Human
aaccaugcaaaugcuauga

SEQ ID NO: 2307650 - RNA, 17 nt, Human
gucucuuuaaucuucag

SEQ ID NO: 2307651 - RNA, 19 nt, Human
gucucuuguauuaaacucu

SEQ ID NO: 2307652 - RNA, 16 nt, Human
gucucuuguauuaaac

SEQ ID NO: 2307653 - RNA, 18 nt, Human
gucucuuuaaugucacag

SEQ ID NO: 2307654 - RNA, 19 nt, Human
gucucuuuaaugucacagg

SEQ ID NO: 2307655 - RNA, 20 nt, Human
gucucuuuaaugucacaggc

SEQ ID NO: 2307656 - RNA, 16 nt, Human
gucugaagucacugca

SEQ ID NO: 2307657 - RNA, 14 nt, Human
gucugaaggcuggg

SEQ ID NO: 2307658 - RNA, 19 nt, Human
gucugaaggcuggguucug

SEQ ID NO: 2307659 - RNA, 22 nt, Human
gucucuuuaaugucacaggcag

SEQ ID NO: 2307660 - RNA, 23 nt, Human
gucucuuuaaugucacaggcagg

SEQ ID NO: 2307661 - RNA, 19 nt, Human
gucuggagaagcagugagc

SEQ ID NO: 2307662 - RNA, 21 nt, Human
gucuggagaagcucccaggaa

SEQ ID NO: 2307663 - RNA, 22 nt, Human
gucuggagaagcucccaggaac

SEQ ID NO: 2307664 - RNA, 23 nt, Human
gucuggagaagcucccaggaaca

SEQ ID NO: 2307665 - RNA, 17 nt, Human
gucuggagaagcaguga

SEQ ID NO: 2307666 - RNA, 14 nt, Human
gucuggagaagcag

SEQ ID NO: 2307667 - RNA, 18 nt, Human
gucucuuuaaucuucagu

SEQ ID NO: 2307668 - RNA, 16 nt, Human
gucugaagugguuguu

SEQ ID NO: 2307669 - RNA, 17 nt, Human
gucuggaggggccccug

SEQ ID NO: 2307670 - RNA, 10 nt, Human
gucuggaggg

SEQ ID NO: 2307671 - RNA, 21 nt, Human
gucuggaguugaucuggaacc

SEQ ID NO: 2307672 - RNA, 23 nt, Human
gucuggaggggccccugcuucuc

SEQ ID NO: 2307673 - RNA, 18 nt, Human
gucuggaggggccccugc

SEQ ID NO: 2307674 - RNA, 21 nt, Human
gucugacaggcaaugcuggcu

SEQ ID NO: 2307675 - RNA, 17 nt, Human
gucugaagucacugcac

SEQ ID NO: 2307676 - RNA, 19 nt, Human
gucugaagucacugcacag

SEQ ID NO: 2307677 - RNA, 22 nt, Human
gucugacaggcaaugcuggcug

SEQ ID NO: 2307678 - RNA, 23 nt, Human
gucugacaggcaaugcuggcugu

SEQ ID NO: 2307679 - RNA, 14 nt, Human
gucugguuucuaga

SEQ ID NO: 2307680 - RNA, 13 nt, Human
gucuucacaacag

SEQ ID NO: 2307681 - RNA, 16 nt, Human
gucuucacagcucugu

SEQ ID NO: 2307682 - RNA, 22 nt, Human
gucugguuucaccgaggacaug

SEQ ID NO: 2307683 - RNA, 17 nt, Human
gucugguuucaccgagg

SEQ ID NO: 2307684 - RNA, 13 nt, Human
gucuggugggagg

SEQ ID NO: 2307685 - RNA, 12 nt, Human
gucuucagccua

SEQ ID NO: 2307686 - RNA, 15 nt, Human
gucuucacggcagga

SEQ ID NO: 2307687 - RNA, 17 nt, Human
gucuucacagcucugug

SEQ ID NO: 2307688 - RNA, 13 nt, Human
gucugguuucuag

SEQ ID NO: 2307689 - RNA, 20 nt, Human
gucuucaccugauucaacua

SEQ ID NO: 2307690 - RNA, 15 nt, Human
gucuucagccuagcc

SEQ ID NO: 2307691 - RNA, 13 nt, Human
gucuucagccuag

SEQ ID NO: 2307692 - RNA, 23 nt, Human
gucuucagccuagccgaccucag

SEQ ID NO: 2307693 - RNA, 14 nt, Human
gucuucagccucuu

SEQ ID NO: 2307694 - RNA, 23 nt, Human
gucugggguucagccccuccucu

SEQ ID NO: 2307695 - RNA, 20 nt, Human
gucugggguucagccccucc

SEQ ID NO: 2307696 - RNA, 15 nt, Human
gucuggugaagcuca

SEQ ID NO: 2307697 - RNA, 18 nt, Human
gucuggucuccucagccu

SEQ ID NO: 2307698 - RNA, 13 nt, Human
gucugguggcccc

SEQ ID NO: 2307699 - RNA, 20 nt, Human
gucugguggccccguuucug

SEQ ID NO: 2307700 - RNA, 18 nt, Human
gucugggguucagccccu

SEQ ID NO: 2307701 - RNA, 17 nt, Human
gucugggguucagcccc

SEQ ID NO: 2307702 - RNA, 16 nt, Human
gucugggguucagccc

SEQ ID NO: 2307703 - RNA, 22 nt, Human
gucuggaucugggacccuuucc

SEQ ID NO: 2307704 - RNA, 22 nt, Human
gucuuuguaaugucaccaccuu

SEQ ID NO: 2307705 - RNA, 16 nt, Human
gucuuuguacagacaa

SEQ ID NO: 2307706 - RNA, 21 nt, Human
gucuuuguaaugucaccaccu

SEQ ID NO: 2307707 - RNA, 15 nt, Human
gucuucccuaccuca

SEQ ID NO: 2307708 - RNA, 13 nt, Human
gucuucccagggu

SEQ ID NO: 2307709 - RNA, 15 nt, Human
gucuucccaggguag

SEQ ID NO: 2307710 - RNA, 17 nt, Human
gucuuccauaauguaua

SEQ ID NO: 2307711 - RNA, 12 nt, Human
gucuucccaggg

SEQ ID NO: 2307712 - RNA, 15 nt, Human
gucuuccauuugcaa

SEQ ID NO: 2307713 - RNA, 15 nt, Human
gucuuuguacagaca

SEQ ID NO: 2307714 - RNA, 18 nt, Human
gucuucagggggccaggu

SEQ ID NO: 2307715 - RNA, 23 nt, Human
gucuucauaccuacauguauuug

SEQ ID NO: 2307716 - RNA, 23 nt, Human
gucuucagccucuuucugucccu

SEQ ID NO: 2307717 - RNA, 22 nt, Human
gucuucagccucuuucuguccc

SEQ ID NO: 2307718 - RNA, 16 nt, Human
gucuucaguaagccgu

SEQ ID NO: 2307719 - RNA, 15 nt, Human
gucuuccauaaugua

SEQ ID NO: 2307720 - RNA, 13 nt, Human
gucuuccauaaug

SEQ ID NO: 2307721 - RNA, 21 nt, Human
gucuucauuaagcccucuucc

SEQ ID NO: 2307722 - RNA, 22 nt, Human
gucuucauuaagcccucuucca

SEQ ID NO: 2307723 - RNA, 16 nt, Human
gucuucauuucauugu

SEQ ID NO: 2307724 - RNA, 17 nt, Human
gucuucauuucauugua

SEQ ID NO: 2307725 - RNA, 24 nt, Human
gucuuuuaggacccuucccuugag

SEQ ID NO: 2307726 - RNA, 11 nt, Human
gucuuuucauc

SEQ ID NO: 2307727 - RNA, 18 nt, Human
aaccugauugugucucuu

SEQ ID NO: 2307728 - RNA, 18 nt, Human
aaccugauguuaaaauuc

SEQ ID NO: 2307729 - RNA, 19 nt, Human
aaccugcaagggcucccca

SEQ ID NO: 2307730 - RNA, 17 nt, Human
aaccugauguuaaaauu

SEQ ID NO: 2307731 - RNA, 15 nt, Human
aaccugaugcugacu

SEQ ID NO: 2307732 - RNA, 17 nt, Human
aaccugaugcagucacg

SEQ ID NO: 2307733 - RNA, 19 nt, Human
aaccugauugugucucuug

SEQ ID NO: 2307734 - RNA, 19 nt, Human
aaccuguuuaaauauuuca

SEQ ID NO: 2307735 - RNA, 21 nt, Human
aaccuguugauagcaagugaa

SEQ ID NO: 2307736 - RNA, 24 nt, Human
aaccuguuaccuacuuugacuuuu

SEQ ID NO: 2307737 - RNA, 17 nt, Human
aaccuguucugcuuucc

SEQ ID NO: 2307738 - RNA, 13 nt, Human
aaccuguucugcu

SEQ ID NO: 2307739 - RNA, 21 nt, Human
aaccuguuaccuacuuugacu

SEQ ID NO: 2307740 - RNA, 22 nt, Human
aaccugcaagggcuccccacug

SEQ ID NO: 2307741 - RNA, 15 nt, Human
aaccugccagggaga

SEQ ID NO: 2307742 - RNA, 19 nt, Human
aaccugccagggagacaga

SEQ ID NO: 2307743 - RNA, 11 nt, Human
aaccugcccug

SEQ ID NO: 2307744 - RNA, 13 nt, Human
aaccugcccugcc

SEQ ID NO: 2307745 - RNA, 15 nt, Human
aaccugcccugccug

SEQ ID NO: 2307746 - RNA, 16 nt, Human
aaccugcccugccuga

SEQ ID NO: 2307747 - RNA, 16 nt, Human
aacuagaaaucugcca

SEQ ID NO: 2307748 - RNA, 19 nt, Human
aacuagaauuuauucaauu

SEQ ID NO: 2307749 - RNA, 22 nt, Human
aacuagaauuuauucaauuccu

SEQ ID NO: 2307750 - RNA, 17 nt, Human
aacuagaauuuauucaa

SEQ ID NO: 2307751 - RNA, 15 nt, Human
aacuaauaaaagcau

SEQ ID NO: 2307752 - RNA, 14 nt, Human
aacuaauaaaagca

SEQ ID NO: 2307753 - RNA, 17 nt, Human
aacuaagcccccgcugu

SEQ ID NO: 2307754 - RNA, 19 nt, Human
aacuaagcccccgcuguaa

SEQ ID NO: 2307755 - RNA, 17 nt, Human
aacuacuguguuccugg

SEQ ID NO: 2307756 - RNA, 16 nt, Human
aacuacuguguuccug

SEQ ID NO: 2307757 - RNA, 14 nt, Human
gucuuuucaucugg

SEQ ID NO: 2307758 - RNA, 16 nt, Human
aacguugcugugggaa

SEQ ID NO: 2307759 - RNA, 14 nt, Human
aacguugcucccca

SEQ ID NO: 2307760 - RNA, 13 nt, Human
aacguugcugugg

SEQ ID NO: 2307761 - RNA, 14 nt, Human
aacguugcuguggg

SEQ ID NO: 2307762 - RNA, 16 nt, Human
aacuaacacuauuuua

SEQ ID NO: 2307763 - RNA, 23 nt, Human
aacuaagaaauaugcacaauagc

SEQ ID NO: 2307764 - RNA, 12 nt, Human
aacuaacacuau

SEQ ID NO: 2307765 - RNA, 22 nt, Human
aacguggggcagcacagagagg

SEQ ID NO: 2307766 - RNA, 17 nt, Human
aacguggggcagcacag

SEQ ID NO: 2307767 - RNA, 18 nt, Human
aacguggggcagcacaga

SEQ ID NO: 2307768 - RNA, 19 nt, Human
aacguguugccuugaacca

SEQ ID NO: 2307769 - RNA, 23 nt, Human
aacguggcugcuucaaggauccu

SEQ ID NO: 2307770 - RNA, 23 nt, Human
aaccuugucucuaugccagcuca

SEQ ID NO: 2307771 - RNA, 19 nt, Human
aaccuugucucuaugccag

SEQ ID NO: 2307772 - RNA, 18 nt, Human
aaccuuguuauuucucag

SEQ ID NO: 2307773 - RNA, 15 nt, Human
aaccuugugccuggc

SEQ ID NO: 2307774 - RNA, 21 nt, Human
aaccuugugccuggcucagag

SEQ ID NO: 2307775 - RNA, 23 nt, Human
aaccuuagauguucuaagucuuu

SEQ ID NO: 2307776 - RNA, 22 nt, Human
aaccuugguguaguugaacuga

SEQ ID NO: 2307777 - RNA, 14 nt, Human
aaccuuucaaauuu

SEQ ID NO: 2307778 - RNA, 16 nt, Human
aaccuuuagggcagcu

SEQ ID NO: 2307779 - RNA, 19 nt, Human
aaccuuuagggcagcuugc

SEQ ID NO: 2307780 - RNA, 18 nt, Human
aaccuuucaaauuucaca

SEQ ID NO: 2307781 - RNA, 17 nt, Human
aaccuuguuauuucuca

SEQ ID NO: 2307782 - RNA, 14 nt, Human
aaccuuuagggcag

SEQ ID NO: 2307783 - RNA, 15 nt, Human
aaccuuuagggcagc

SEQ ID NO: 2307784 - RNA, 14 nt, Human
gugaaggcuucucu

SEQ ID NO: 2307785 - RNA, 22 nt, Human
gugaaggcuucucucuguggga

SEQ ID NO: 2307786 - RNA, 17 nt, Human
gugaaggcuucucucug

SEQ ID NO: 2307787 - RNA, 17 nt, Human
gugaagguccugcuauu

SEQ ID NO: 2307788 - RNA, 20 nt, Human
gugaagguccugcuauuacu

SEQ ID NO: 2307789 - RNA, 19 nt, Human
gugaaguauacuguauuuu

SEQ ID NO: 2307790 - RNA, 17 nt, Human
gugaaguauacuguauu

SEQ ID NO: 2307791 - RNA, 16 nt, Human
gugaagugaaugaaac

SEQ ID NO: 2307792 - RNA, 14 nt, Human
gugaagugaagaca

SEQ ID NO: 2307793 - RNA, 20 nt, Human
gugaaggccgagaagcaaga

SEQ ID NO: 2307794 - RNA, 13 nt, Human
gugaaggacccuu

SEQ ID NO: 2307795 - RNA, 12 nt, Human
gugaaggacccu

SEQ ID NO: 2307796 - RNA, 15 nt, Human
gugaaggaauauaug

SEQ ID NO: 2307797 - RNA, 22 nt, Human
gugaagccaauucagacaggca

SEQ ID NO: 2307798 - RNA, 20 nt, Human
gugaagccaauucagacagg

SEQ ID NO: 2307799 - RNA, 10 nt, Human
gugaagccaa

SEQ ID NO: 2307800 - RNA, 17 nt, Human
gugaagcaccaagcuca

SEQ ID NO: 2307801 - RNA, 18 nt, Human
gugaagcaccaagcucaa

SEQ ID NO: 2307802 - RNA, 16 nt, Human
aacuagaaccuggagg

SEQ ID NO: 2307803 - RNA, 15 nt, Human
aacuagaauuugauu

SEQ ID NO: 2307804 - RNA, 16 nt, Human
aacuagaauuugauua

SEQ ID NO: 2307805 - RNA, 13 nt, Human
aacuauauuguuu

SEQ ID NO: 2307806 - RNA, 20 nt, Human
aacuaucucauuuccaagca

SEQ ID NO: 2307807 - RNA, 23 nt, Human
aacuaucucauuuccaagcaagu

SEQ ID NO: 2307808 - RNA, 19 nt, Human
gugaagagggagaagcaug

SEQ ID NO: 2307809 - RNA, 12 nt, Human
gugaagaggggc

SEQ ID NO: 2307810 - RNA, 13 nt, Human
gugaagaggggca

SEQ ID NO: 2307811 - RNA, 14 nt, Human
gugaagaggggcag

SEQ ID NO: 2307812 - RNA, 15 nt, Human
gugaagaggggcagc

SEQ ID NO: 2307813 - RNA, 16 nt, Human
gugaagaggggcagcc

SEQ ID NO: 2307814 - RNA, 17 nt, Human
gugaagaggggcagccc

SEQ ID NO: 2307815 - RNA, 19 nt, Human
gugaagaggggcagcccuu

SEQ ID NO: 2307816 - RNA, 23 nt, Human
gugaagacaaugacuuacuguac

SEQ ID NO: 2307817 - RNA, 16 nt, Human
aacuagacauucuguc

SEQ ID NO: 2307818 - RNA, 18 nt, Human
aacuagacauucugucgc

SEQ ID NO: 2307819 - RNA, 13 nt, Human
aacuauauuuucu

SEQ ID NO: 2307820 - RNA, 16 nt, Human
aacuauauuuucuuua

SEQ ID NO: 2307821 - RNA, 16 nt, Human
gugaaguccuucaccu

SEQ ID NO: 2307822 - RNA, 14 nt, Human
gugaaguuagaauu

SEQ ID NO: 2307823 - RNA, 17 nt, Human
gugaaguuagaauuccu

SEQ ID NO: 2307824 - RNA, 18 nt, Human
gugaaguuagaauuccuu

SEQ ID NO: 2307825 - RNA, 16 nt, Human
gugacagaggcagccc

SEQ ID NO: 2307826 - RNA, 18 nt, Human
gugacagaggcagcccca

SEQ ID NO: 2307827 - RNA, 19 nt, Human
gugacagaggcagccccau

SEQ ID NO: 2307828 - RNA, 16 nt, Human
gugacaugcgggcugg

SEQ ID NO: 2307829 - RNA, 20 nt, Human
gugacaugcgggcugggcag

SEQ ID NO: 2307830 - RNA, 21 nt, Human
gugacaugcgggcugggcagc

SEQ ID NO: 2307831 - RNA, 18 nt, Human
gugacaucaguggcaugg

SEQ ID NO: 2307832 - RNA, 22 nt, Human
gugacaugcgggcugggcagcu

SEQ ID NO: 2307833 - RNA, 14 nt, Human
gugacaucucuuac

SEQ ID NO: 2307834 - RNA, 15 nt, Human
gugacauggugccug

SEQ ID NO: 2307835 - RNA, 16 nt, Human
gugacauggugccuga

SEQ ID NO: 2307836 - RNA, 19 nt, Human
gugacauggugccugagag

SEQ ID NO: 2307837 - RNA, 20 nt, Human
gugacauggugccugagagg

SEQ ID NO: 2307838 - RNA, 22 nt, Human
gugacauggugccugagaggca

SEQ ID NO: 2307839 - RNA, 14 nt, Human
gugacaugucuuuu

SEQ ID NO: 2307840 - RNA, 19 nt, Human
gugaccaaguuauaaauca

SEQ ID NO: 2307841 - RNA, 23 nt, Human
gugaccaacuagacauucugucg

SEQ ID NO: 2307842 - RNA, 16 nt, Human
gugaccaaugucuuga

SEQ ID NO: 2307843 - RNA, 15 nt, Human
gugaccaaugucuug

SEQ ID NO: 2307844 - RNA, 17 nt, Human
gugaccaaugaugguca

SEQ ID NO: 2307845 - RNA, 13 nt, Human
gugacauguaaca

SEQ ID NO: 2307846 - RNA, 23 nt, Human
gugacauggugccugagaggcag

SEQ ID NO: 2307847 - RNA, 24 nt, Human
gugacauggugccugagaggcagg

SEQ ID NO: 2307848 - RNA, 16 nt, Human
gugaccaaaauccccu

SEQ ID NO: 2307849 - RNA, 19 nt, Human
gugaccaacuagacauucu

SEQ ID NO: 2307850 - RNA, 22 nt, Human
gugaccaacuagacauucuguc

SEQ ID NO: 2307851 - RNA, 14 nt, Human
gugacccaaugauu

SEQ ID NO: 2307852 - RNA, 14 nt, Human
gugaccagggguga

SEQ ID NO: 2307853 - RNA, 17 nt, Human
gugaccaggcauccucc

SEQ ID NO: 2307854 - RNA, 17 nt, Human
gugaccacucugucuug

SEQ ID NO: 2307855 - RNA, 18 nt, Human
gugaccauguuuuguuua

SEQ ID NO: 2307856 - RNA, 18 nt, Human
gugaccagcaccaucucu

SEQ ID NO: 2307857 - RNA, 21 nt, Human
gugaccagcaccaucucuccu

SEQ ID NO: 2307858 - RNA, 15 nt, Human
gugaguccauucucc

SEQ ID NO: 2307859 - RNA, 17 nt, Human
gugaguccuggcauggg

SEQ ID NO: 2307860 - RNA, 16 nt, Human
gugaguaagagcuggu

SEQ ID NO: 2307861 - RNA, 15 nt, Human
gugaguaagagcugg

SEQ ID NO: 2307862 - RNA, 14 nt, Human
gugaguaagagcug

SEQ ID NO: 2307863 - RNA, 20 nt, Human
gugagguggguuuucuuccc

SEQ ID NO: 2307864 - RNA, 21 nt, Human
gugaguacuacaguccuccca

SEQ ID NO: 2307865 - RNA, 19 nt, Human
gugaguacuacaguccucc

SEQ ID NO: 2307866 - RNA, 15 nt, Human
gugagucgaggacag

SEQ ID NO: 2307867 - RNA, 15 nt, Human
aacucugcacuacuc

SEQ ID NO: 2307868 - RNA, 20 nt, Human
gugaguccuggcaugggaau

SEQ ID NO: 2307869 - RNA, 14 nt, Human
aacucugccagcca

SEQ ID NO: 2307870 - RNA, 16 nt, Human
aacucugcauucuagu

SEQ ID NO: 2307871 - RNA, 11 nt, Human
aacucugcugu

SEQ ID NO: 2307872 - RNA, 16 nt, Human
aacucugcuugauuuu

SEQ ID NO: 2307873 - RNA, 22 nt, Human
aacucugcugucuaaccuguga

SEQ ID NO: 2307874 - RNA, 16 nt, Human
aacucuggcuuccagg

SEQ ID NO: 2307875 - RNA, 17 nt, Human
aacucuggcuuccaggu

SEQ ID NO: 2307876 - RNA, 18 nt, Human
aacucuggcuuccaggua

SEQ ID NO: 2307877 - RNA, 20 nt, Human
aacucuggcuuccagguauc

SEQ ID NO: 2307878 - RNA, 14 nt, Human
aacugcaggcccug

SEQ ID NO: 2307879 - RNA, 16 nt, Human
aacugcaggcccuggc

SEQ ID NO: 2307880 - RNA, 17 nt, Human
aacugcaggcccuggcc

SEQ ID NO: 2307881 - RNA, 18 nt, Human
aacugcaggcccuggccu

SEQ ID NO: 2307882 - RNA, 19 nt, Human
aacugcaggcccuggccuc

SEQ ID NO: 2307883 - RNA, 20 nt, Human
aacugcaggcccuggccucc

SEQ ID NO: 2307884 - RNA, 21 nt, Human
aacugcaggcccuggccuccc

SEQ ID NO: 2307885 - RNA, 20 nt, Human
gugagacaguccagccugga

SEQ ID NO: 2307886 - RNA, 15 nt, Human
aacugaacauuccag

SEQ ID NO: 2307887 - RNA, 22 nt, Human
aacucugggcugcuacccagaa

SEQ ID NO: 2307888 - RNA, 21 nt, Human
aacucugggcugcuacccaga

SEQ ID NO: 2307889 - RNA, 16 nt, Human
aacucuguggcauuau

SEQ ID NO: 2307890 - RNA, 23 nt, Human
aacucugucuucaccugauucaa

SEQ ID NO: 2307891 - RNA, 20 nt, Human
aacucuguguugugaauguc

SEQ ID NO: 2307892 - RNA, 20 nt, Human
aacucugucuucaccugauu

SEQ ID NO: 2307893 - RNA, 17 nt, Human
aacucugucuucaccug

SEQ ID NO: 2307894 - RNA, 13 nt, Human
aacugaaaucaua

SEQ ID NO: 2307895 - RNA, 20 nt, Human
aacugaaaucauacuucuua

SEQ ID NO: 2307896 - RNA, 12 nt, Human
gugagagcuggg

SEQ ID NO: 2307897 - RNA, 17 nt, Human
gugagaauaggcagccc

SEQ ID NO: 2307898 - RNA, 14 nt, Human
gugagaauaagaga

SEQ ID NO: 2307899 - RNA, 21 nt, Human
gugagaagugaaugcugggac

SEQ ID NO: 2307900 - RNA, 22 nt, Human
gugagaagugaaugcugggacu

SEQ ID NO: 2307901 - RNA, 20 nt, Human
gugagaagugaaugcuggga

SEQ ID NO: 2307902 - RNA, 15 nt, Human
gugagaacuacucag

SEQ ID NO: 2307903 - RNA, 17 nt, Human
gugagaaaaagcuccug

SEQ ID NO: 2307904 - RNA, 22 nt, Human
gugagaaaaagcuccuguccuc

SEQ ID NO: 2307905 - RNA, 15 nt, Human
gugacccagucagag

SEQ ID NO: 2307906 - RNA, 14 nt, Human
gugacccagguccu

SEQ ID NO: 2307907 - RNA, 12 nt, Human
gugaccccaggu

SEQ ID NO: 2307908 - RNA, 20 nt, Human
gugacuuuggcugcaugcga

SEQ ID NO: 2307909 - RNA, 22 nt, Human
gugaccccuuuucagcuucugc

SEQ ID NO: 2307910 - RNA, 23 nt, Human
gugaccccuuuucagcuucugcu

SEQ ID NO: 2307911 - RNA, 16 nt, Human
gugacccccagcuccg

SEQ ID NO: 2307912 - RNA, 19 nt, Human
gugaccccuuuucagcuuc

SEQ ID NO: 2307913 - RNA, 20 nt, Human
gugaccccuuuucagcuucu

SEQ ID NO: 2307914 - RNA, 17 nt, Human
gugacccccagcuccgg

SEQ ID NO: 2307915 - RNA, 15 nt, Human
gugacccccagcucc

SEQ ID NO: 2307916 - RNA, 15 nt, Human
gugagcaggcuguga

SEQ ID NO: 2307917 - RNA, 17 nt, Human
gugaguacuacaguccu

SEQ ID NO: 2307918 - RNA, 17 nt, Human
gugagcagacugguggg

SEQ ID NO: 2307919 - RNA, 20 nt, Human
gugagcagaaguggagcugg

SEQ ID NO: 2307920 - RNA, 21 nt, Human
gugagcacggccaacaaagcu

SEQ ID NO: 2307921 - RNA, 16 nt, Human
gugagcacucccaagu

SEQ ID NO: 2307922 - RNA, 19 nt, Human
gugagcacucccaagucua

SEQ ID NO: 2307923 - RNA, 19 nt, Human
gugagcagaaguggagcug

SEQ ID NO: 2307924 - RNA, 21 nt, Human
gugagcacuaaggugugcucu

SEQ ID NO: 2307925 - RNA, 13 nt, Human
gugagagugagcu

SEQ ID NO: 2307926 - RNA, 14 nt, Human
gugagcacagccua

SEQ ID NO: 2307927 - RNA, 15 nt, Human
gugagcaauccugca

SEQ ID NO: 2307928 - RNA, 23 nt, Human
gugagagggcaugcgcacaaggc

SEQ ID NO: 2307929 - RNA, 18 nt, Human
gugagacaguccagccug

SEQ ID NO: 2307930 - RNA, 19 nt, Human
gugagacaguccagccugg

SEQ ID NO: 2307931 - RNA, 22 nt, Human
gugagaauaagagagucauaaa

SEQ ID NO: 2307932 - RNA, 18 nt, Human
gugagaaucccuggcaaa

SEQ ID NO: 2307933 - RNA, 13 nt, Human
gugagagcugggu

SEQ ID NO: 2307934 - RNA, 16 nt, Human
gugagaggggaacaga

SEQ ID NO: 2307935 - RNA, 17 nt, Human
aaaaacagcauugcuuu

SEQ ID NO: 2307936 - RNA, 15 nt, Human
aaaaacagcauugcu

SEQ ID NO: 2307937 - RNA, 14 nt, Human
aaaaacagaggcca

SEQ ID NO: 2307938 - RNA, 13 nt, Human
aaaaacuacacau

SEQ ID NO: 2307939 - RNA, 14 nt, Human
aaaaacuaaauugu

SEQ ID NO: 2307940 - RNA, 20 nt, Human
aaaaacuaaaucucuaauau

SEQ ID NO: 2307941 - RNA, 22 nt, Human
aaaaaccuuguauaucuuguuu

SEQ ID NO: 2307942 - RNA, 22 nt, Human
aaaaaauuagaaauuggcugga

SEQ ID NO: 2307943 - RNA, 13 nt, Human
aaaaacacagcaa

SEQ ID NO: 2307944 - RNA, 18 nt, Human
aaaaacacagcaagggug

SEQ ID NO: 2307945 - RNA, 15 nt, Human
aaaaacaccuagcuu

SEQ ID NO: 2307946 - RNA, 17 nt, Human
aaaaacaccuagcuuua

SEQ ID NO: 2307947 - RNA, 18 nt, Human
aaaaacaccuagcuuuau

SEQ ID NO: 2307948 - RNA, 12 nt, Human
aaaaacacuagu

SEQ ID NO: 2307949 - RNA, 15 nt, Human
aaaaaaucugcagaa

SEQ ID NO: 2307950 - RNA, 13 nt, Human
aaaaaaucugcag

SEQ ID NO: 2307951 - RNA, 11 nt, Human
aaaaaaugucc

SEQ ID NO: 2307952 - RNA, 16 nt, Human
aaaaaauguauaugca

SEQ ID NO: 2307953 - RNA, 22 nt, Human
aaaaaaugcugaacauugcaua

SEQ ID NO: 2307954 - RNA, 20 nt, Human
aaaaaaugcugaacauugca

SEQ ID NO: 2307955 - RNA, 15 nt, Human
aaaaaauauuuuccu

SEQ ID NO: 2307956 - RNA, 22 nt, Human
aucagcuggucaaacaaacucu

SEQ ID NO: 2307957 - RNA, 17 nt, Human
aucagcuccuuccugga

SEQ ID NO: 2307958 - RNA, 15 nt, Human
aucaugugaaaucau

SEQ ID NO: 2307959 - RNA, 23 nt, Human
aucagcugcugaaacaacaaaua

SEQ ID NO: 2307960 - RNA, 22 nt, Human
aucagcugcugaaacaacaaau

SEQ ID NO: 2307961 - RNA, 21 nt, Human
aucauguguaaucaauaaacg

SEQ ID NO: 2307962 - RNA, 13 nt, Human
aucauguguaauc

SEQ ID NO: 2307963 - RNA, 15 nt, Human
aucauguguaaucaa

SEQ ID NO: 2307964 - RNA, 19 nt, Human
aucauguguaaucaauaaa

SEQ ID NO: 2307965 - RNA, 20 nt, Human
aucauguguaaucaauaaac

SEQ ID NO: 2307966 - RNA, 21 nt, Human
aucaugugaacccgggacgca

SEQ ID NO: 2307967 - RNA, 14 nt, Human
aucaugugaaauca

SEQ ID NO: 2307968 - RNA, 16 nt, Human
aucaugugaaaucauu

SEQ ID NO: 2307969 - RNA, 18 nt, Human
aucagcuccacuuucagu

SEQ ID NO: 2307970 - RNA, 15 nt, Human
aucagcuccuuccug

SEQ ID NO: 2307971 - RNA, 13 nt, Human
aucagcuccuucc

SEQ ID NO: 2307972 - RNA, 21 nt, Human
aucagcugcugaaacaacaaa

SEQ ID NO: 2307973 - RNA, 14 nt, Human
aucagcuauuuacu

SEQ ID NO: 2307974 - RNA, 15 nt, Human
aucagcuauuuacug

SEQ ID NO: 2307975 - RNA, 23 nt, Human
aucagcggccccuugacucuggg

SEQ ID NO: 2307976 - RNA, 14 nt, Human
aucagccugugcca

SEQ ID NO: 2307977 - RNA, 18 nt, Human
aucagccugcuccagcug

SEQ ID NO: 2307978 - RNA, 17 nt, Human
aucagccugcuccagcu

SEQ ID NO: 2307979 - RNA, 19 nt, Human
aucagccugcuccagcugu

SEQ ID NO: 2307980 - RNA, 20 nt, Human
aucagccugcuccagcuguu

SEQ ID NO: 2307981 - RNA, 18 nt, Human
aucagccugucucuucca

SEQ ID NO: 2307982 - RNA, 19 nt, Human
aucagccugucucuuccau

SEQ ID NO: 2307983 - RNA, 21 nt, Human
aucagccugucucuuccauau

SEQ ID NO: 2307984 - RNA, 16 nt, Human
aucacauuauuugcau

SEQ ID NO: 2307985 - RNA, 15 nt, Human
aucacauuauuugca

SEQ ID NO: 2307986 - RNA, 16 nt, Human
aucacauguauguuuu

SEQ ID NO: 2307987 - RNA, 17 nt, Human
aucacauguauguuuug

SEQ ID NO: 2307988 - RNA, 22 nt, Human
aucacauuauuugcauguuacc

SEQ ID NO: 2307989 - RNA, 14 nt, Human
aucaccgaaaacgu

SEQ ID NO: 2307990 - RNA, 19 nt, Human
aucaccgaaaacguggcug

SEQ ID NO: 2307991 - RNA, 21 nt, Human
aucaccgaaaacguggcugcu

SEQ ID NO: 2307992 - RNA, 23 nt, Human
aucagcacgauuucuguuuagau

SEQ ID NO: 2307993 - RNA, 12 nt, Human
aucagccaauua

SEQ ID NO: 2307994 - RNA, 23 nt, Human
aucacccuuaccaugugccugau

SEQ ID NO: 2307995 - RNA, 19 nt, Human
aucacccuuaccaugugcc

SEQ ID NO: 2307996 - RNA, 20 nt, Human
aucagcacgauuucuguuua

SEQ ID NO: 2307997 - RNA, 19 nt, Human
aucagcacgauuucuguuu

SEQ ID NO: 2307998 - RNA, 22 nt, Human
auauuuauuguuuauuuaucag

SEQ ID NO: 2307999 - RNA, 14 nt, Human
auauuuauugugcu

SEQ ID NO: 2308000 - RNA, 18 nt, Human
auauuuauugcuuuauaa

SEQ ID NO: 2308001 - RNA, 21 nt, Human
auauuuauugcuuuauaaaua

SEQ ID NO: 2308002 - RNA, 23 nt, Human
auauuuauuguuuauuuaucagu

SEQ ID NO: 2308003 - RNA, 17 nt, Human
auauuuauuuuaauaau

SEQ ID NO: 2308004 - RNA, 14 nt, Human
auauuuauuuuaau

SEQ ID NO: 2308005 - RNA, 15 nt, Human
auauuuauuuuaaua

SEQ ID NO: 2308006 - RNA, 17 nt, Human
auauuuauuuauuuauu

SEQ ID NO: 2308007 - RNA, 20 nt, Human
aucacagggcagagccggga

SEQ ID NO: 2308008 - RNA, 14 nt, Human
aucacauguauguu

SEQ ID NO: 2308009 - RNA, 19 nt, Human
aucacagggcagagccggg

SEQ ID NO: 2308010 - RNA, 15 nt, Human
aucacauguggacuu

SEQ ID NO: 2308011 - RNA, 18 nt, Human
aucaccaacgucugugcc

SEQ ID NO: 2308012 - RNA, 19 nt, Human
aucaccaacgucugugcca

SEQ ID NO: 2308013 - RNA, 23 nt, Human
aucacccgcuaagagggagggag

SEQ ID NO: 2308014 - RNA, 14 nt, Human
aucacagcuucagc

SEQ ID NO: 2308015 - RNA, 18 nt, Human
aucacagcuucagccagg

SEQ ID NO: 2308016 - RNA, 12 nt, Human
aucacagcugcu

SEQ ID NO: 2308017 - RNA, 21 nt, Human
aucacagccucugaaaaccaa

SEQ ID NO: 2308018 - RNA, 21 nt, Human
aucacagcuucagccaggagc

SEQ ID NO: 2308019 - RNA, 22 nt, Human
aucacagcuucagccaggagcu

SEQ ID NO: 2308020 - RNA, 16 nt, Human
aucacagcugcuuucu

SEQ ID NO: 2308021 - RNA, 15 nt, Human
aucacagggcagagc

SEQ ID NO: 2308022 - RNA, 12 nt, Human
aucacagggcag

SEQ ID NO: 2308023 - RNA, 23 nt, Human
auccccucuccccccccccucca

SEQ ID NO: 2308024 - RNA, 19 nt, Human
auccccucccugucaaagc

SEQ ID NO: 2308025 - RNA, 14 nt, Human
auccccuccuuggg

SEQ ID NO: 2308026 - RNA, 15 nt, Human
auccccuccuugggc

SEQ ID NO: 2308027 - RNA, 15 nt, Human
auccccucucccccc

SEQ ID NO: 2308028 - RNA, 15 nt, Human
auccccuguagagug

SEQ ID NO: 2308029 - RNA, 13 nt, Human
auccccucaggac

SEQ ID NO: 2308030 - RNA, 13 nt, Human
auccccucccagu

SEQ ID NO: 2308031 - RNA, 15 nt, Human
auccccucccuguca

SEQ ID NO: 2308032 - RNA, 16 nt, Human
auccccaagccuggca

SEQ ID NO: 2308033 - RNA, 18 nt, Human
auccccgcagugugcacu

SEQ ID NO: 2308034 - RNA, 22 nt, Human
auccccgcagugugcacuaagg

SEQ ID NO: 2308035 - RNA, 20 nt, Human
auccuauucucaccaggaag

SEQ ID NO: 2308036 - RNA, 15 nt, Human
auccucaaacacugc

SEQ ID NO: 2308037 - RNA, 16 nt, Human
auccucaaacacugca

SEQ ID NO: 2308038 - RNA, 17 nt, Human
auccucaaacacugcag

SEQ ID NO: 2308039 - RNA, 19 nt, Human
auccucaaacacugcaggc

SEQ ID NO: 2308040 - RNA, 21 nt, Human
auccccuucucaucacucccc

SEQ ID NO: 2308041 - RNA, 14 nt, Human
auccuaugugauuu

SEQ ID NO: 2308042 - RNA, 12 nt, Human
auccuaugugau

SEQ ID NO: 2308043 - RNA, 18 nt, Human
auccccuggacugggagg

SEQ ID NO: 2308044 - RNA, 23 nt, Human
auccuaugugauuuuaacucugu

SEQ ID NO: 2308045 - RNA, 18 nt, Human
auccuauucucaccagga

SEQ ID NO: 2308046 - RNA, 20 nt, Human
auccuauguuuuuguucaaa

SEQ ID NO: 2308047 - RNA, 17 nt, Human
auccuaugugauuuuaa

SEQ ID NO: 2308048 - RNA, 16 nt, Human
auccuaugugauuuua

SEQ ID NO: 2308049 - RNA, 12 nt, Human
auccuauguuuu

SEQ ID NO: 2308050 - RNA, 23 nt, Human
auccucauuugggguagcuagag

SEQ ID NO: 2308051 - RNA, 19 nt, Human
auccuccacguucugcuca

SEQ ID NO: 2308052 - RNA, 21 nt, Human
auccucaaacacugcaggcau

SEQ ID NO: 2308053 - RNA, 16 nt, Human
auccucauauggccca

SEQ ID NO: 2308054 - RNA, 20 nt, Human
auccucauauggcccagugu

SEQ ID NO: 2308055 - RNA, 21 nt, Human
auccucauauggcccaguguc

SEQ ID NO: 2308056 - RNA, 23 nt, Human
auccuccaacuucauuugaugcu

SEQ ID NO: 2308057 - RNA, 11 nt, Human
auccuccagca

SEQ ID NO: 2308058 - RNA, 15 nt, Human
auccuccagcaggga

SEQ ID NO: 2308059 - RNA, 13 nt, Human
auccuccagcagg

SEQ ID NO: 2308060 - RNA, 11 nt, Human
auccuccagcu

SEQ ID NO: 2308061 - RNA, 12 nt, Human
auccuccagcuu

SEQ ID NO: 2308062 - RNA, 13 nt, Human
auccuccagcuuc

SEQ ID NO: 2308063 - RNA, 14 nt, Human
auccuccagcuucu

SEQ ID NO: 2308064 - RNA, 11 nt, Human
auccuccaggu

SEQ ID NO: 2308065 - RNA, 15 nt, Human
auccucccaccucag

SEQ ID NO: 2308066 - RNA, 15 nt, Human
auccuccagguuuuu

SEQ ID NO: 2308067 - RNA, 16 nt, Human
auccuccagguuuuuc

SEQ ID NO: 2308068 - RNA, 17 nt, Human
auccuccagguuuuuca

SEQ ID NO: 2308069 - RNA, 18 nt, Human
auccuccagguuuuucaa

SEQ ID NO: 2308070 - RNA, 19 nt, Human
auccuccagguuuuucaau

SEQ ID NO: 2308071 - RNA, 20 nt, Human
auccuccagguuuuucaauu

SEQ ID NO: 2308072 - RNA, 21 nt, Human
auccuccagguuuuucaauua

SEQ ID NO: 2308073 - RNA, 22 nt, Human
auccuccagguuuuucaauuaa

SEQ ID NO: 2308074 - RNA, 12 nt, Human
auccuccagguu

SEQ ID NO: 2308075 - RNA, 13 nt, Human
auccuccagguuu

SEQ ID NO: 2308076 - RNA, 14 nt, Human
auccuccagguuuu

SEQ ID NO: 2308077 - RNA, 23 nt, Human
auccuccagcuucugguacucuc

SEQ ID NO: 2308078 - RNA, 23 nt, Human
auccuccaggugcacaagcucca

SEQ ID NO: 2308079 - RNA, 15 nt, Human
auccagacccggcug

SEQ ID NO: 2308080 - RNA, 18 nt, Human
auccagaaagaaaacuug

SEQ ID NO: 2308081 - RNA, 16 nt, Human
auccagaaagaaaacu

SEQ ID NO: 2308082 - RNA, 13 nt, Human
auccaggacucug

SEQ ID NO: 2308083 - RNA, 15 nt, Human
auccaggacucuguc

SEQ ID NO: 2308084 - RNA, 23 nt, Human
auccaggacuauauuugggccug

SEQ ID NO: 2308085 - RNA, 22 nt, Human
auccaggacuauauuugggccu

SEQ ID NO: 2308086 - RNA, 20 nt, Human
auccagaauugaccuuuuga

SEQ ID NO: 2308087 - RNA, 15 nt, Human
auccagcuauguuau

SEQ ID NO: 2308088 - RNA, 15 nt, Human
auccagaaagaaaaa

SEQ ID NO: 2308089 - RNA, 14 nt, Human
auccagaaagaaaa

SEQ ID NO: 2308090 - RNA, 13 nt, Human
auccagaaagaaa

SEQ ID NO: 2308091 - RNA, 22 nt, Human
auccagcuccccuucugaauca

SEQ ID NO: 2308092 - RNA, 14 nt, Human
auccagcuggugag

SEQ ID NO: 2308093 - RNA, 15 nt, Human
aucccauuuaaaaaa

SEQ ID NO: 2308094 - RNA, 17 nt, Human
aucccauugcccugguu

SEQ ID NO: 2308095 - RNA, 16 nt, Human
aucccauugcccuggu

SEQ ID NO: 2308096 - RNA, 14 nt, Human
aucccauugcccug

SEQ ID NO: 2308097 - RNA, 13 nt, Human
auccccaagccug

SEQ ID NO: 2308098 - RNA, 14 nt, Human
auccaggcagaucc

SEQ ID NO: 2308099 - RNA, 16 nt, Human
auccaggcagauccag

SEQ ID NO: 2308100 - RNA, 15 nt, Human
auccaggcagaucca

SEQ ID NO: 2308101 - RNA, 14 nt, Human
aucccauuuaaaaa

SEQ ID NO: 2308102 - RNA, 22 nt, Human
aucggaagcagugccuuccaua

SEQ ID NO: 2308103 - RNA, 14 nt, Human
aucggaagcagugc

SEQ ID NO: 2308104 - RNA, 13 nt, Human
aucggagacagug

SEQ ID NO: 2308105 - RNA, 18 nt, Human
aucggaagcagugccuuc

SEQ ID NO: 2308106 - RNA, 16 nt, Human
aucggagccuccucuc

SEQ ID NO: 2308107 - RNA, 15 nt, Human
aucggagccuccucu

SEQ ID NO: 2308108 - RNA, 17 nt, Human
aucgcuucauguaacua

SEQ ID NO: 2308109 - RNA, 23 nt, Human
aucgcuguguguuaguucccaac

SEQ ID NO: 2308110 - RNA, 22 nt, Human
aucgcuguguguuaguucccaa

SEQ ID NO: 2308111 - RNA, 22 nt, Human
aucggaggcuugucagagcugg

SEQ ID NO: 2308112 - RNA, 21 nt, Human
aucggaggcuugucagagcug

SEQ ID NO: 2308113 - RNA, 20 nt, Human
aucggaggcuugucagagcu

SEQ ID NO: 2308114 - RNA, 18 nt, Human
aucggaggcuugucagag

SEQ ID NO: 2308115 - RNA, 23 nt, Human
aucggaggcuugucagagcuggg

SEQ ID NO: 2308116 - RNA, 21 nt, Human
aucggaucuggggcucuggga

SEQ ID NO: 2308117 - RNA, 23 nt, Human
aucggcccacagcucccacccca

SEQ ID NO: 2308118 - RNA, 20 nt, Human
aucggcccacagcucccacc

SEQ ID NO: 2308119 - RNA, 19 nt, Human
aucggcccacagcucccac

SEQ ID NO: 2308120 - RNA, 20 nt, Human
auccucccaccucagccucc

SEQ ID NO: 2308121 - RNA, 23 nt, Human
auccuccagguuuuucaauuaaa

SEQ ID NO: 2308122 - RNA, 18 nt, Human
auccucccaccucagccu

SEQ ID NO: 2308123 - RNA, 19 nt, Human
auccucccaccucagccuc

SEQ ID NO: 2308124 - RNA, 18 nt, Human
aucuccugugcaugggug

SEQ ID NO: 2308125 - RNA, 15 nt, Human
aucuccugugcaugg

SEQ ID NO: 2308126 - RNA, 14 nt, Human
aucuccugugcaug

SEQ ID NO: 2308127 - RNA, 21 nt, Human
aucucgccaccccuccuuccu

SEQ ID NO: 2308128 - RNA, 20 nt, Human
aucucgccaccccuccuucc

SEQ ID NO: 2308129 - RNA, 15 nt, Human
aucuccuuucaggga

SEQ ID NO: 2308130 - RNA, 19 nt, Human
aucuccugugcauggguga

SEQ ID NO: 2308131 - RNA, 15 nt, Human
aucucggcucacugc

SEQ ID NO: 2308132 - RNA, 14 nt, Human
aucucggcucacug

SEQ ID NO: 2308133 - RNA, 14 nt, Human
aucucgugggagag

SEQ ID NO: 2308134 - RNA, 16 nt, Human
aucucggcucacugca

SEQ ID NO: 2308135 - RNA, 17 nt, Human
aucucugcuuuggaaau

SEQ ID NO: 2308136 - RNA, 15 nt, Human
aucucgugggagagc

SEQ ID NO: 2308137 - RNA, 13 nt, Human
aucucguuucaaa

SEQ ID NO: 2308138 - RNA, 19 nt, Human
aucucugugugcacaaaua

SEQ ID NO: 2308139 - RNA, 17 nt, Human
aucucugugugcacaaa

SEQ ID NO: 2308140 - RNA, 15 nt, Human
aucucugugugcaca

SEQ ID NO: 2308141 - RNA, 13 nt, Human
aucucugugccuu

SEQ ID NO: 2308142 - RNA, 14 nt, Human
aucucugugccuuc

SEQ ID NO: 2308143 - RNA, 15 nt, Human
aucucugugccuucg

SEQ ID NO: 2308144 - RNA, 18 nt, Human
aucucugugccuucgucu

SEQ ID NO: 2308145 - RNA, 22 nt, Human
aucugcuuuuuaaagaaugcuc

SEQ ID NO: 2308146 - RNA, 15 nt, Human
aucugcuuaugcagu

SEQ ID NO: 2308147 - RNA, 19 nt, Human
aucugcuuacaauucccug

SEQ ID NO: 2308148 - RNA, 21 nt, Human
aucugcuuacaauucccugcu

SEQ ID NO: 2308149 - RNA, 14 nt, Human
aucugcuucagugg

SEQ ID NO: 2308150 - RNA, 12 nt, Human
aucugcuucagu

SEQ ID NO: 2308151 - RNA, 22 nt, Human
aucuggaccccaucugugaaua

SEQ ID NO: 2308152 - RNA, 18 nt, Human
aucuggaacccagacuca

SEQ ID NO: 2308153 - RNA, 17 nt, Human
aucuggaacccagacuc

SEQ ID NO: 2308154 - RNA, 16 nt, Human
aucuggaacccagacu

SEQ ID NO: 2308155 - RNA, 15 nt, Human
aucuggaacccagac

SEQ ID NO: 2308156 - RNA, 14 nt, Human
aucuggaacccaga

SEQ ID NO: 2308157 - RNA, 11 nt, Human
aucuggaaccc

SEQ ID NO: 2308158 - RNA, 18 nt, Human
aucuggaaccaucagaaa

SEQ ID NO: 2308159 - RNA, 15 nt, Human
aucuggacuccucug

SEQ ID NO: 2308160 - RNA, 16 nt, Human
aucuggacuccucugu

SEQ ID NO: 2308161 - RNA, 17 nt, Human
aucuggacuccucuguc

SEQ ID NO: 2308162 - RNA, 18 nt, Human
aucuggacuccucugucc

SEQ ID NO: 2308163 - RNA, 12 nt, Human
aucuggcagggu

SEQ ID NO: 2308164 - RNA, 21 nt, Human
aucuggaccccaucugugaau

SEQ ID NO: 2308165 - RNA, 23 nt, Human
aucuggccguugauguuggcugg

SEQ ID NO: 2308166 - RNA, 19 nt, Human
aucuggacuccucugucca

SEQ ID NO: 2308167 - RNA, 17 nt, Human
aucuggcaacaucuuua

SEQ ID NO: 2308168 - RNA, 21 nt, Human
aucuaugccaaagaucacuug

SEQ ID NO: 2308169 - RNA, 14 nt, Human
aucuauuauacugu

SEQ ID NO: 2308170 - RNA, 16 nt, Human
aucuauuauacuguau

SEQ ID NO: 2308171 - RNA, 19 nt, Human
aucuauuccugguagaaua

SEQ ID NO: 2308172 - RNA, 21 nt, Human
aucuauucagacaagcaacag

SEQ ID NO: 2308173 - RNA, 22 nt, Human
aucuauucagacaagcaacagg

SEQ ID NO: 2308174 - RNA, 17 nt, Human
aucuauuauacuguauu

SEQ ID NO: 2308175 - RNA, 18 nt, Human
aucuauuauacuguauua

SEQ ID NO: 2308176 - RNA, 15 nt, Human
aucuauucagacaag

SEQ ID NO: 2308177 - RNA, 17 nt, Human
aucuauucagacaagca

SEQ ID NO: 2308178 - RNA, 18 nt, Human
aucuaucuuauauaguuu

SEQ ID NO: 2308179 - RNA, 15 nt, Human
aucuaugaaguauau

SEQ ID NO: 2308180 - RNA, 18 nt, Human
aucuaugaaguauauaau

SEQ ID NO: 2308181 - RNA, 19 nt, Human
aucuaugaaguauauaaug

SEQ ID NO: 2308182 - RNA, 20 nt, Human
aucuaugaaguauauaaugg

SEQ ID NO: 2308183 - RNA, 18 nt, Human
aucuaugcauuuucugga

SEQ ID NO: 2308184 - RNA, 16 nt, Human
aucuaugcauuuucug

SEQ ID NO: 2308185 - RNA, 17 nt, Human
aucuauggucgggagac

SEQ ID NO: 2308186 - RNA, 17 nt, Human
aucuaugccaaagauca

SEQ ID NO: 2308187 - RNA, 19 nt, Human
aucuaugccaaagaucacu

SEQ ID NO: 2308188 - RNA, 14 nt, Human
aucucccucccaca

SEQ ID NO: 2308189 - RNA, 12 nt, Human
aucucccugccg

SEQ ID NO: 2308190 - RNA, 19 nt, Human
aucucccugccgccucaau

SEQ ID NO: 2308191 - RNA, 15 nt, Human
aucucccugccgccu

SEQ ID NO: 2308192 - RNA, 23 nt, Human
aucuauugcuggcaaagacagaa

SEQ ID NO: 2308193 - RNA, 23 nt, Human
aucuccccuugcacuaaaguaug

SEQ ID NO: 2308194 - RNA, 15 nt, Human
aucucccgcugcugc

SEQ ID NO: 2308195 - RNA, 21 nt, Human
aucucccucacugaaaccagg

SEQ ID NO: 2308196 - RNA, 21 nt, Human
aucucccccagccccauccuc

SEQ ID NO: 2308197 - RNA, 23 nt, Human
aucuauucucuccaaaaaugcac

SEQ ID NO: 2308198 - RNA, 15 nt, Human
aucuaucaauaguca

SEQ ID NO: 2308199 - RNA, 17 nt, Human
aucuaucaauagucaag

SEQ ID NO: 2308200 - RNA, 20 nt, Human
aucuaucaauagucaagaaa

SEQ ID NO: 2308201 - RNA, 22 nt, Human
aucuaucaauagucaagaaaaa

SEQ ID NO: 2308202 - RNA, 19 nt, Human
aucuaucucaucuaucuca

SEQ ID NO: 2308203 - RNA, 19 nt, Human
aucuaucugcuuaugcagu

SEQ ID NO: 2308204 - RNA, 20 nt, Human
aucuaucugcuuaugcaguu

SEQ ID NO: 2308205 - RNA, 14 nt, Human
aucuucuuuauaau

SEQ ID NO: 2308206 - RNA, 17 nt, Human
aucuucuuaugcaauuu

SEQ ID NO: 2308207 - RNA, 18 nt, Human
aucuucuggagucuccag

SEQ ID NO: 2308208 - RNA, 20 nt, Human
aucuucuggagucuccagug

SEQ ID NO: 2308209 - RNA, 18 nt, Human
aucuucugccuucucaug

SEQ ID NO: 2308210 - RNA, 16 nt, Human
aucuucugccuucuca

SEQ ID NO: 2308211 - RNA, 12 nt, Human
aucuugaaggaa

SEQ ID NO: 2308212 - RNA, 14 nt, Human
aucuucuucaccau

SEQ ID NO: 2308213 - RNA, 20 nt, Human
aucuucuuaugcaauuuccu

SEQ ID NO: 2308214 - RNA, 18 nt, Human
aucuugaagacuuuucuu

SEQ ID NO: 2308215 - RNA, 22 nt, Human
aucugggaaaauaccccaucau

SEQ ID NO: 2308216 - RNA, 16 nt, Human
aucugggacccuuucc

SEQ ID NO: 2308217 - RNA, 14 nt, Human
aucugggaaagaca

SEQ ID NO: 2308218 - RNA, 17 nt, Human
aucuucugcaauugcuu

SEQ ID NO: 2308219 - RNA, 14 nt, Human
aucuucugccuucu

SEQ ID NO: 2308220 - RNA, 21 nt, Human
aucuucugccuuagucucagu

SEQ ID NO: 2308221 - RNA, 16 nt, Human
aucugggaagauuucu

SEQ ID NO: 2308222 - RNA, 11 nt, Human
aucugggaaag

SEQ ID NO: 2308223 - RNA, 22 nt, Human
aucuucugaacuuggcgcugcc

SEQ ID NO: 2308224 - RNA, 18 nt, Human
aucuugaauaauguaaga

SEQ ID NO: 2308225 - RNA, 16 nt, Human
aucuugaauuguaacu

SEQ ID NO: 2308226 - RNA, 17 nt, Human
aucuugaauuguaagga

SEQ ID NO: 2308227 - RNA, 19 nt, Human
augaagguuucugaaaauu

SEQ ID NO: 2308228 - RNA, 17 nt, Human
augaagguuucugaaaa

SEQ ID NO: 2308229 - RNA, 21 nt, Human
augaagguuaggauuuaacag

SEQ ID NO: 2308230 - RNA, 22 nt, Human
augaagguuaggauuuaacagu

SEQ ID NO: 2308231 - RNA, 17 nt, Human
augaagggaaaggauau

SEQ ID NO: 2308232 - RNA, 18 nt, Human
augaaggugucauacaga

SEQ ID NO: 2308233 - RNA, 16 nt, Human
augaagguuaggauuu

SEQ ID NO: 2308234 - RNA, 20 nt, Human
augaagguuaggauuuaaca

SEQ ID NO: 2308235 - RNA, 16 nt, Human
augaaggcaaaaaaau

SEQ ID NO: 2308236 - RNA, 21 nt, Human
augaaaaauuuaagcauuguu

SEQ ID NO: 2308237 - RNA, 22 nt, Human
augaaggcagaaaaaugucauu

SEQ ID NO: 2308238 - RNA, 20 nt, Human
augaaaaauuuaagcauugu

SEQ ID NO: 2308239 - RNA, 19 nt, Human
augaaaaauuuaagcauug

SEQ ID NO: 2308240 - RNA, 21 nt, Human
augaaggagaggcaacaucca

SEQ ID NO: 2308241 - RNA, 22 nt, Human
augaagcuuuuaugugaaacau

SEQ ID NO: 2308242 - RNA, 23 nt, Human
augaaguuuccuuggcuggugca

SEQ ID NO: 2308243 - RNA, 13 nt, Human
augaaguuugaau

SEQ ID NO: 2308244 - RNA, 18 nt, Human
augaaguuugaacuucau

SEQ ID NO: 2308245 - RNA, 19 nt, Human
augaaguuugaacuucaua

SEQ ID NO: 2308246 - RNA, 14 nt, Human
augaaguuugaaug

SEQ ID NO: 2308247 - RNA, 15 nt, Human
augaaguuugaaugu

SEQ ID NO: 2308248 - RNA, 16 nt, Human
augaaguuugaauguu

SEQ ID NO: 2308249 - RNA, 18 nt, Human
augaaguuugaauguuaa

SEQ ID NO: 2308250 - RNA, 19 nt, Human
augaaguuuuuuuuauaca

SEQ ID NO: 2308251 - RNA, 16 nt, Human
augaaguuuuacauug

SEQ ID NO: 2308252 - RNA, 14 nt, Human
augaaguuuuacau

SEQ ID NO: 2308253 - RNA, 19 nt, Human
augaaguuugaauguuaaa

SEQ ID NO: 2308254 - RNA, 20 nt, Human
augaaguuugaauguuaaau

SEQ ID NO: 2308255 - RNA, 13 nt, Human
augaaaaauucuc

SEQ ID NO: 2308256 - RNA, 13 nt, Human
augaaaaauauga

SEQ ID NO: 2308257 - RNA, 18 nt, Human
augaaaaauuuaagcauu

SEQ ID NO: 2308258 - RNA, 17 nt, Human
augaaaaauuuaagcau

SEQ ID NO: 2308259 - RNA, 16 nt, Human
augaaaaauuuaagca

SEQ ID NO: 2308260 - RNA, 13 nt, Human
augaaaaauagca

SEQ ID NO: 2308261 - RNA, 19 nt, Human
augaaaaagcauguacagu

SEQ ID NO: 2308262 - RNA, 21 nt, Human
augaaaaagcauguacagugu

SEQ ID NO: 2308263 - RNA, 15 nt, Human
augaaaaagcaugua

SEQ ID NO: 2308264 - RNA, 16 nt, Human
augaaaaagcauguac

SEQ ID NO: 2308265 - RNA, 18 nt, Human
augaaaaagcauguacag

SEQ ID NO: 2308266 - RNA, 23 nt, Human
augaaaaaauauauaucaaauau

SEQ ID NO: 2308267 - RNA, 16 nt, Human
augaaaaaauguauau

SEQ ID NO: 2308268 - RNA, 20 nt, Human
augaaaaacaaaaauaacau

SEQ ID NO: 2308269 - RNA, 14 nt, Human
augaaaaagcaugu

SEQ ID NO: 2308270 - RNA, 19 nt, Human
augaaagacuguacaaagu

SEQ ID NO: 2308271 - RNA, 17 nt, Human
augaaagacuguacaaa

SEQ ID NO: 2308272 - RNA, 16 nt, Human
augaaagacuguacaa

SEQ ID NO: 2308273 - RNA, 13 nt, Human
augaaagacugua

SEQ ID NO: 2308274 - RNA, 20 nt, Human
augagcuccagacccccagc

SEQ ID NO: 2308275 - RNA, 17 nt, Human
augagcuccagaccccc

SEQ ID NO: 2308276 - RNA, 16 nt, Human
augagcuccagacccc

SEQ ID NO: 2308277 - RNA, 15 nt, Human
augagcuccagaccc

SEQ ID NO: 2308278 - RNA, 15 nt, Human
augacggaagaacau

SEQ ID NO: 2308279 - RNA, 22 nt, Human
augagcuccucuuccuggcuuc

SEQ ID NO: 2308280 - RNA, 14 nt, Human
augagcuccucuuc

SEQ ID NO: 2308281 - RNA, 22 nt, Human
augagcuccagacccccagcaa

SEQ ID NO: 2308282 - RNA, 21 nt, Human
augagcuccagacccccagca

SEQ ID NO: 2308283 - RNA, 22 nt, Human
augagcucgcauuugucaauga

SEQ ID NO: 2308284 - RNA, 21 nt, Human
augagcucgcauuugucaaug

SEQ ID NO: 2308285 - RNA, 19 nt, Human
augagcucuacccagggcc

SEQ ID NO: 2308286 - RNA, 18 nt, Human
augagcucuacccagggc

SEQ ID NO: 2308287 - RNA, 16 nt, Human
augagcucuacccagg

SEQ ID NO: 2308288 - RNA, 15 nt, Human
augagcucuacccag

SEQ ID NO: 2308289 - RNA, 21 nt, Human
augaccuuucaauaggaaaaa

SEQ ID NO: 2308290 - RNA, 22 nt, Human
augaccuuucaauaggaaaaac

SEQ ID NO: 2308291 - RNA, 23 nt, Human
augaccuuucaauaggaaaaacu

SEQ ID NO: 2308292 - RNA, 14 nt, Human
augaggaggaagga

SEQ ID NO: 2308293 - RNA, 15 nt, Human
augaggaauguauau

SEQ ID NO: 2308294 - RNA, 17 nt, Human
augaggaauguauaugu

SEQ ID NO: 2308295 - RNA, 22 nt, Human
augagcucuacccagggccugc

SEQ ID NO: 2308296 - RNA, 14 nt, Human
augaggaauaauua

SEQ ID NO: 2308297 - RNA, 23 nt, Human
augaggaauaauuauuuauuuaa

SEQ ID NO: 2308298 - RNA, 12 nt, Human
augaggaaugua

SEQ ID NO: 2308299 - RNA, 21 nt, Human
augaggaugcagagucagcag

SEQ ID NO: 2308300 - RNA, 20 nt, Human
augaggaugcagagucagca

SEQ ID NO: 2308301 - RNA, 14 nt, Human
augaggaguugcug

SEQ ID NO: 2308302 - RNA, 13 nt, Human
augaggacauguu

SEQ ID NO: 2308303 - RNA, 18 nt, Human
augaggcaaugucaggaa

SEQ ID NO: 2308304 - RNA, 22 nt, Human
augaggaugcagagucagcaga

SEQ ID NO: 2308305 - RNA, 21 nt, Human
augaggcaaugucaggaacag

SEQ ID NO: 2308306 - RNA, 13 nt, Human
augaggcagagga

SEQ ID NO: 2308307 - RNA, 14 nt, Human
augaggcauuuggc

SEQ ID NO: 2308308 - RNA, 17 nt, Human
auguauuuuuguacccu

SEQ ID NO: 2308309 - RNA, 13 nt, Human
auguauuggccug

SEQ ID NO: 2308310 - RNA, 15 nt, Human
auguauuggccugga

SEQ ID NO: 2308311 - RNA, 16 nt, Human
auguauuggccuggag

SEQ ID NO: 2308312 - RNA, 14 nt, Human
auguauuuguuugc

SEQ ID NO: 2308313 - RNA, 14 nt, Human
auguauuuuauugu

SEQ ID NO: 2308314 - RNA, 15 nt, Human
auguauuuuauugua

SEQ ID NO: 2308315 - RNA, 16 nt, Human
auguauuuuauuguaa

SEQ ID NO: 2308316 - RNA, 20 nt, Human
auguauuuuauuguaacaga

SEQ ID NO: 2308317 - RNA, 23 nt, Human
auguauuuuauuguaacagacau

SEQ ID NO: 2308318 - RNA, 23 nt, Human
auguaauuaaguacuauguauca

SEQ ID NO: 2308319 - RNA, 20 nt, Human
auguauuauucugcagcaug

SEQ ID NO: 2308320 - RNA, 19 nt, Human
auguauucuagcuaaugua

SEQ ID NO: 2308321 - RNA, 15 nt, Human
auguauuauuucauu

SEQ ID NO: 2308322 - RNA, 22 nt, Human
auguauuauuucauuauguaaa

SEQ ID NO: 2308323 - RNA, 24 nt, Human
auguauucagcuuuaguagauauu

SEQ ID NO: 2308324 - RNA, 20 nt, Human
auguauucuagcuaauguaa

SEQ ID NO: 2308325 - RNA, 14 nt, Human
auguauugauaaga

SEQ ID NO: 2308326 - RNA, 16 nt, Human
auguauugcacauugu

SEQ ID NO: 2308327 - RNA, 17 nt, Human
auguauugcacauugua

SEQ ID NO: 2308328 - RNA, 22 nt, Human
auguauugcacauuguaaaaag

SEQ ID NO: 2308329 - RNA, 17 nt, Human
auguaauuaaguacuau

SEQ ID NO: 2308330 - RNA, 15 nt, Human
auguaauuaaguacu

SEQ ID NO: 2308331 - RNA, 19 nt, Human
auguaagggaaacugccag

SEQ ID NO: 2308332 - RNA, 22 nt, Human
auguaagcuguuuauuuuauau

SEQ ID NO: 2308333 - RNA, 14 nt, Human
auguaagcuguuua

SEQ ID NO: 2308334 - RNA, 15 nt, Human
auguaagcuguuuau

SEQ ID NO: 2308335 - RNA, 17 nt, Human
auguaagcugaaaauau

SEQ ID NO: 2308336 - RNA, 16 nt, Human
auguaagcugaaaaua

SEQ ID NO: 2308337 - RNA, 16 nt, Human
auggucgcccaggaga

SEQ ID NO: 2308338 - RNA, 15 nt, Human
auggucgcccaggag

SEQ ID NO: 2308339 - RNA, 15 nt, Human
auggucggaaaacau

SEQ ID NO: 2308340 - RNA, 16 nt, Human
auguaagggaaacugc

SEQ ID NO: 2308341 - RNA, 14 nt, Human
auguaagggaaacu

SEQ ID NO: 2308342 - RNA, 19 nt, Human
augguauaaugguugacug

SEQ ID NO: 2308343 - RNA, 20 nt, Human
auggucaacacuuaaggguu

SEQ ID NO: 2308344 - RNA, 14 nt, Human
auggucacacacug

SEQ ID NO: 2308345 - RNA, 14 nt, Human
augguaugagcuga

SEQ ID NO: 2308346 - RNA, 20 nt, Human
augguaugagcugagggggg

SEQ ID NO: 2308347 - RNA, 21 nt, Human
augguauauuugguacuguau

SEQ ID NO: 2308348 - RNA, 19 nt, Human
augguauagcaaauguuuu

SEQ ID NO: 2308349 - RNA, 16 nt, Human
auggucagcguugcau

SEQ ID NO: 2308350 - RNA, 18 nt, Human
auggucagcguugcaugu

SEQ ID NO: 2308351 - RNA, 19 nt, Human
auggucagcguugcauguc

SEQ ID NO: 2308352 - RNA, 18 nt, Human
auggucagcccuagggug

SEQ ID NO: 2308353 - RNA, 20 nt, Human
auggucacacacugaugcuu

SEQ ID NO: 2308354 - RNA, 17 nt, Human
auggucacgcaccuggg

SEQ ID NO: 2308355 - RNA, 19 nt, Human
auggucaccaaaucagcug

SEQ ID NO: 2308356 - RNA, 19 nt, Human
auggucacacacugaugcu

SEQ ID NO: 2308357 - RNA, 18 nt, Human
auggucacacacugaugc

SEQ ID NO: 2308358 - RNA, 16 nt, Human
auggucacacacugau

SEQ ID NO: 2308359 - RNA, 15 nt, Human
auggucacacacuga

SEQ ID NO: 2308360 - RNA, 14 nt, Human
auggucgcccagga

SEQ ID NO: 2308361 - RNA, 20 nt, Human
augguccuggggcucugugc

SEQ ID NO: 2308362 - RNA, 19 nt, Human
augguccuggggcucugug

SEQ ID NO: 2308363 - RNA, 17 nt, Human
augguccuggggcucug

SEQ ID NO: 2308364 - RNA, 14 nt, Human
augguccuggggcu

SEQ ID NO: 2308365 - RNA, 12 nt, Human
augguccugggg

SEQ ID NO: 2308366 - RNA, 22 nt, Human
auggucaucuuuuucucuaaaa

SEQ ID NO: 2308367 - RNA, 22 nt, Human
auggucaucuuggagggaccaa

SEQ ID NO: 2308368 - RNA, 20 nt, Human
auggucagcucccuucucug

SEQ ID NO: 2308369 - RNA, 12 nt, Human
auggucagcucc

SEQ ID NO: 2308370 - RNA, 13 nt, Human
auggucagcuccc

SEQ ID NO: 2308371 - RNA, 17 nt, Human
augugaacuuuauuaaa

SEQ ID NO: 2308372 - RNA, 16 nt, Human
augugaacccgggacg

SEQ ID NO: 2308373 - RNA, 15 nt, Human
augugaacuuuauua

SEQ ID NO: 2308374 - RNA, 22 nt, Human
augugaagccaauucagacagg

SEQ ID NO: 2308375 - RNA, 21 nt, Human
augugaagccaauucagacag

SEQ ID NO: 2308376 - RNA, 12 nt, Human
augugaagccaa

SEQ ID NO: 2308377 - RNA, 13 nt, Human
augugaacccggg

SEQ ID NO: 2308378 - RNA, 12 nt, Human
augugaaagcac

SEQ ID NO: 2308379 - RNA, 20 nt, Human
augucuuuguuggaaaagaa

SEQ ID NO: 2308380 - RNA, 15 nt, Human
augugaaacauguuu

SEQ ID NO: 2308381 - RNA, 15 nt, Human
augucuuuugaauau

SEQ ID NO: 2308382 - RNA, 12 nt, Human
augugaaaccuu

SEQ ID NO: 2308383 - RNA, 13 nt, Human
augugaaaccuuu

SEQ ID NO: 2308384 - RNA, 15 nt, Human
augugaaaccuuuuu

SEQ ID NO: 2308385 - RNA, 18 nt, Human
augugaaaccuuuuuuaa

SEQ ID NO: 2308386 - RNA, 19 nt, Human
augugaaaccuuuuuuaag

SEQ ID NO: 2308387 - RNA, 22 nt, Human
augugaaacuggauuaaacuua

SEQ ID NO: 2308388 - RNA, 20 nt, Human
augugaaaccuuuuuuaaga

SEQ ID NO: 2308389 - RNA, 21 nt, Human
augugaaaccuuuuuuaagau

SEQ ID NO: 2308390 - RNA, 22 nt, Human
augugaaaccuuuuuuaagauu

SEQ ID NO: 2308391 - RNA, 23 nt, Human
augugaaaccuuuuuuaagauuu

SEQ ID NO: 2308392 - RNA, 22 nt, Human
augucuuuaggcagcagcuuuu

SEQ ID NO: 2308393 - RNA, 11 nt, Human
augucuugugu

SEQ ID NO: 2308394 - RNA, 10 nt, Human
augucuugug

SEQ ID NO: 2308395 - RNA, 20 nt, Human
augucuucguacaguucuuc

SEQ ID NO: 2308396 - RNA, 22 nt, Human
augucuucguacaguucuucgg

SEQ ID NO: 2308397 - RNA, 23 nt, Human
augucuuuguuggaaaagaauac

SEQ ID NO: 2308398 - RNA, 14 nt, Human
augucuuuucuugc

SEQ ID NO: 2308399 - RNA, 20 nt, Human
augucuuaaugaaguuugaa

SEQ ID NO: 2308400 - RNA, 21 nt, Human
augucuuaaugaaguuugaau

SEQ ID NO: 2308401 - RNA, 19 nt, Human
augucuuaaugaaguuuga

SEQ ID NO: 2308402 - RNA, 13 nt, Human
augucuuccugga

SEQ ID NO: 2308403 - RNA, 20 nt, Human
augucuucauuucauuguau

SEQ ID NO: 2308404 - RNA, 19 nt, Human
augucuucauuucauugua

SEQ ID NO: 2308405 - RNA, 17 nt, Human
augucuucguacaguuc

SEQ ID NO: 2308406 - RNA, 23 nt, Human
augucuuaaugaaguuugaaugu

SEQ ID NO: 2308407 - RNA, 21 nt, Human
augucuucauaccuacaugua

SEQ ID NO: 2308408 - RNA, 22 nt, Human
augucuucauaccuacauguau

SEQ ID NO: 2308409 - RNA, 17 nt, Human
augucuucauuucauug

SEQ ID NO: 2308410 - RNA, 18 nt, Human
augucuucauuucauugu

SEQ ID NO: 2308411 - RNA, 20 nt, Human
augugaaugaucucucugaa

SEQ ID NO: 2308412 - RNA, 16 nt, Human
augugaaugggaaaag

SEQ ID NO: 2308413 - RNA, 18 nt, Human
augugaauugccugcaga

SEQ ID NO: 2308414 - RNA, 21 nt, Human
augugaaucagacccuacccc

SEQ ID NO: 2308415 - RNA, 16 nt, Human
augugaaucagacccu

SEQ ID NO: 2308416 - RNA, 15 nt, Human
augugaaucagaccc

SEQ ID NO: 2308417 - RNA, 12 nt, Human
augugaaucaga

SEQ ID NO: 2308418 - RNA, 16 nt, Human
augugaaguguuaaua

SEQ ID NO: 2308419 - RNA, 19 nt, Human
augugaaguguuaauacua

SEQ ID NO: 2308420 - RNA, 20 nt, Human
augugaaguguuaauacuag

SEQ ID NO: 2308421 - RNA, 21 nt, Human
augugaauaaaauuauuuugg

SEQ ID NO: 2308422 - RNA, 13 nt, Human
augugaaguguua

SEQ ID NO: 2308423 - RNA, 14 nt, Human
augugaaguguuaa

SEQ ID NO: 2308424 - RNA, 23 nt, Human
auguuccugaauucuauuugcug

SEQ ID NO: 2308425 - RNA, 20 nt, Human
auguuccuucaagaucaugu

SEQ ID NO: 2308426 - RNA, 17 nt, Human
auguucuaagaagugaa

SEQ ID NO: 2308427 - RNA, 19 nt, Human
augugugcgagugugugca

SEQ ID NO: 2308428 - RNA, 18 nt, Human
augugugcgagugugugc

SEQ ID NO: 2308429 - RNA, 17 nt, Human
augugugcucuucuucu

SEQ ID NO: 2308430 - RNA, 19 nt, Human
auguuccugaauucuauuu

SEQ ID NO: 2308431 - RNA, 15 nt, Human
augugugcgagugug

SEQ ID NO: 2308432 - RNA, 12 nt, Human
augugugcaugu

SEQ ID NO: 2308433 - RNA, 15 nt, Human
augugugcaugugug

SEQ ID NO: 2308434 - RNA, 11 nt, Human
augugugccau

SEQ ID NO: 2308435 - RNA, 18 nt, Human
augugugccauagaguuu

SEQ ID NO: 2308436 - RNA, 20 nt, Human
augugugccauagaguuuaa

SEQ ID NO: 2308437 - RNA, 22 nt, Human
augugugccauagaguuuaaca

SEQ ID NO: 2308438 - RNA, 20 nt, Human
augugggcuaguugggcuuc

SEQ ID NO: 2308439 - RNA, 18 nt, Human
augugggcagugauguca

SEQ ID NO: 2308440 - RNA, 19 nt, Human
augugugaggagcugcugg

SEQ ID NO: 2308441 - RNA, 15 nt, Human
augugugaggagcug

SEQ ID NO: 2308442 - RNA, 17 nt, Human
augugugagugugugca

SEQ ID NO: 2308443 - RNA, 16 nt, Human
augugugagugugugc

SEQ ID NO: 2308444 - RNA, 22 nt, Human
augugugcaacaggguauggac

SEQ ID NO: 2308445 - RNA, 22 nt, Human
augugugaggagcugcuggcuu

SEQ ID NO: 2308446 - RNA, 13 nt, Human
augugugagugug

SEQ ID NO: 2308447 - RNA, 13 nt, Human
auguucugcuuuc

SEQ ID NO: 2308448 - RNA, 13 nt, Human
auguucuggcccu

SEQ ID NO: 2308449 - RNA, 18 nt, Human
auguucucuaucauuuaa

SEQ ID NO: 2308450 - RNA, 19 nt, Human
auguucucuaucauuuaau

SEQ ID NO: 2308451 - RNA, 20 nt, Human
auguucucuaucauuuaaua

SEQ ID NO: 2308452 - RNA, 21 nt, Human
auguucucuaucauuuaauaa

SEQ ID NO: 2308453 - RNA, 11 nt, Human
auguucuggga

SEQ ID NO: 2308454 - RNA, 12 nt, Human
auguucugggac

SEQ ID NO: 2308455 - RNA, 14 nt, Human
auguucucuaucau

SEQ ID NO: 2308456 - RNA, 15 nt, Human
auguucucuaucauu

SEQ ID NO: 2308457 - RNA, 16 nt, Human
auguucucuaucauuu

SEQ ID NO: 2308458 - RNA, 22 nt, Human
auguucuauuucagugccaaua

SEQ ID NO: 2308459 - RNA, 19 nt, Human
auguucuaagucuuuccau

SEQ ID NO: 2308460 - RNA, 18 nt, Human
auguucuaagucuuucca

SEQ ID NO: 2308461 - RNA, 15 nt, Human
auuaaauauaauaug

SEQ ID NO: 2308462 - RNA, 20 nt, Human
auuaaauauguuagcaaaga

SEQ ID NO: 2308463 - RNA, 22 nt, Human
auuaaauauguuagcaaagagu

SEQ ID NO: 2308464 - RNA, 18 nt, Human
auuaaaucuaugaaguau

SEQ ID NO: 2308465 - RNA, 16 nt, Human
auuaaauacaaaacuu

SEQ ID NO: 2308466 - RNA, 19 nt, Human
auuaaauacaaaacuucca

SEQ ID NO: 2308467 - RNA, 17 nt, Human
auuaaauacaaaacuuc

SEQ ID NO: 2308468 - RNA, 12 nt, Human
auuaaauacaga

SEQ ID NO: 2308469 - RNA, 14 nt, Human
auuaaauacagaca

SEQ ID NO: 2308470 - RNA, 17 nt, Human
auuaaauacagacacua

SEQ ID NO: 2308471 - RNA, 19 nt, Human
auuaaauacagacacuaag

SEQ ID NO: 2308472 - RNA, 20 nt, Human
auuaaauacagacacuaagu

SEQ ID NO: 2308473 - RNA, 18 nt, Human
auguuugcuucauaaaug

SEQ ID NO: 2308474 - RNA, 20 nt, Human
auguuugcuucauaaaugaa

SEQ ID NO: 2308475 - RNA, 19 nt, Human
auguuuuaauuccaugaau

SEQ ID NO: 2308476 - RNA, 19 nt, Human
auguuuuagaguuaacaau

SEQ ID NO: 2308477 - RNA, 23 nt, Human
auguuuuagacaaauacucaugu

SEQ ID NO: 2308478 - RNA, 14 nt, Human
auguuuuagaguua

SEQ ID NO: 2308479 - RNA, 20 nt, Human
auguuuuaccguaauaauua

SEQ ID NO: 2308480 - RNA, 16 nt, Human
auguuuuacugugaaa

SEQ ID NO: 2308481 - RNA, 19 nt, Human
auguuuuagacaaauacuc

SEQ ID NO: 2308482 - RNA, 22 nt, Human
auguuuuagacaaauacucaug

SEQ ID NO: 2308483 - RNA, 12 nt, Human
auguuuuagcau

SEQ ID NO: 2308484 - RNA, 22 nt, Human
auguuugccucugccucugaca

SEQ ID NO: 2308485 - RNA, 16 nt, Human
auguuugcuauugaca

SEQ ID NO: 2308486 - RNA, 22 nt, Human
auguuucauguuuugugacuau

SEQ ID NO: 2308487 - RNA, 19 nt, Human
auguuucacgaaguuuguu

SEQ ID NO: 2308488 - RNA, 15 nt, Human
auguuuccagacuuc

SEQ ID NO: 2308489 - RNA, 21 nt, Human
auguuucacauaaaaccucau

SEQ ID NO: 2308490 - RNA, 13 nt, Human
auguuuccaaccu

SEQ ID NO: 2308491 - RNA, 19 nt, Human
auguuugccucugccucug

SEQ ID NO: 2308492 - RNA, 13 nt, Human
auguucugggaca

SEQ ID NO: 2308493 - RNA, 10 nt, Human
augugggagg

SEQ ID NO: 2308494 - RNA, 11 nt, Human
augugggaggg

SEQ ID NO: 2308495 - RNA, 21 nt, Human
auguggcuugagaaauaugga

SEQ ID NO: 2308496 - RNA, 16 nt, Human
auguggcuugagaaau

SEQ ID NO: 2308497 - RNA, 17 nt, Human
augauggagcgcaccug

SEQ ID NO: 2308498 - RNA, 17 nt, Human
augaugccaaccucugg

SEQ ID NO: 2308499 - RNA, 18 nt, Human
augaugccaaccucugga

SEQ ID NO: 2308500 - RNA, 12 nt, Human
augaugccacac

SEQ ID NO: 2308501 - RNA, 18 nt, Human
augaugccacaccaagcu

SEQ ID NO: 2308502 - RNA, 22 nt, Human
augaugccacaccaagcugugc

SEQ ID NO: 2308503 - RNA, 24 nt, Human
augaugccacaccaagcugugcca

SEQ ID NO: 2308504 - RNA, 14 nt, Human
augauguguuguga

SEQ ID NO: 2308505 - RNA, 15 nt, Human
augauguguugugau

SEQ ID NO: 2308506 - RNA, 24 nt, Human
augauguuuuccaugaguccccug

SEQ ID NO: 2308507 - RNA, 20 nt, Human
augcaauuuugcauuugaau

SEQ ID NO: 2308508 - RNA, 17 nt, Human
augcaauuuccuuuuuu

SEQ ID NO: 2308509 - RNA, 16 nt, Human
augcacaaaaagaugc

SEQ ID NO: 2308510 - RNA, 15 nt, Human
augcacaaacagagg

SEQ ID NO: 2308511 - RNA, 21 nt, Human
augauguuucgugaaguauac

SEQ ID NO: 2308512 - RNA, 15 nt, Human
augauguuucacaua

SEQ ID NO: 2308513 - RNA, 16 nt, Human
augaugccaugaggaa

SEQ ID NO: 2308514 - RNA, 17 nt, Human
augaugccaugaggaac

SEQ ID NO: 2308515 - RNA, 22 nt, Human
augcauaguucccauguuaaau

SEQ ID NO: 2308516 - RNA, 11 nt, Human
augcauauacu

SEQ ID NO: 2308517 - RNA, 18 nt, Human
augcacagaguuguuaca

SEQ ID NO: 2308518 - RNA, 17 nt, Human
augcacagaguuguuac

SEQ ID NO: 2308519 - RNA, 22 nt, Human
augcacacuagccucuccagga

SEQ ID NO: 2308520 - RNA, 20 nt, Human
augcacacuagccucuccag

SEQ ID NO: 2308521 - RNA, 16 nt, Human
augcacaccucccccu

SEQ ID NO: 2308522 - RNA, 16 nt, Human
augcacagaguuguua

SEQ ID NO: 2308523 - RNA, 16 nt, Human
augcacaaacagaggc

SEQ ID NO: 2308524 - RNA, 17 nt, Human
augcacaaacagaggcc

SEQ ID NO: 2308525 - RNA, 18 nt, Human
augcauauccugagccau

SEQ ID NO: 2308526 - RNA, 17 nt, Human
augcauauccugagcca

SEQ ID NO: 2308527 - RNA, 22 nt, Human
augcaucucacuggaugcaaag

SEQ ID NO: 2308528 - RNA, 16 nt, Human
augcauauuauuuuau

SEQ ID NO: 2308529 - RNA, 16 nt, Human
augcaucuuacugaag

SEQ ID NO: 2308530 - RNA, 14 nt, Human
augcaucuuacuga

SEQ ID NO: 2308531 - RNA, 18 nt, Human
augcaucuuacugaaggu

SEQ ID NO: 2308532 - RNA, 14 nt, Human
augcaucuccaccu

SEQ ID NO: 2308533 - RNA, 17 nt, Human
augcaucuccaccugcu

SEQ ID NO: 2308534 - RNA, 20 nt, Human
augcaucuggcucaccgggu

SEQ ID NO: 2308535 - RNA, 19 nt, Human
augcaucuccaccugcucc

SEQ ID NO: 2308536 - RNA, 15 nt, Human
augcaucuguccuca

SEQ ID NO: 2308537 - RNA, 17 nt, Human
augccucucucaggcca

SEQ ID NO: 2308538 - RNA, 16 nt, Human
augcaugaaguaauau

SEQ ID NO: 2308539 - RNA, 19 nt, Human
augccucucucaggccaaa

SEQ ID NO: 2308540 - RNA, 18 nt, Human
augccucugccaaaggau

SEQ ID NO: 2308541 - RNA, 22 nt, Human
augccucugccaaaggauguga

SEQ ID NO: 2308542 - RNA, 15 nt, Human
augccugagggugga

SEQ ID NO: 2308543 - RNA, 12 nt, Human
augccugagggu

SEQ ID NO: 2308544 - RNA, 14 nt, Human
augccugagggugg

SEQ ID NO: 2308545 - RNA, 13 nt, Human
auggaaacugaau

SEQ ID NO: 2308546 - RNA, 23 nt, Human
auggaaaccugaaaaaaaguuua

SEQ ID NO: 2308547 - RNA, 13 nt, Human
auggaaacgguga

SEQ ID NO: 2308548 - RNA, 20 nt, Human
auggaaacuguugccagaga

SEQ ID NO: 2308549 - RNA, 16 nt, Human
auggaaacugaaugcu

SEQ ID NO: 2308550 - RNA, 14 nt, Human
auggaaacugaaug

SEQ ID NO: 2308551 - RNA, 15 nt, Human
auggaaacugaaugc

SEQ ID NO: 2308552 - RNA, 22 nt, Human
auggaaacuguugccagagaug

SEQ ID NO: 2308553 - RNA, 11 nt, Human
auggaaagaau

SEQ ID NO: 2308554 - RNA, 17 nt, Human
auggaaagaaucuaaua

SEQ ID NO: 2308555 - RNA, 15 nt, Human
auggaaaggagagga

SEQ ID NO: 2308556 - RNA, 19 nt, Human
auggaaaggagaggaaaga

SEQ ID NO: 2308557 - RNA, 22 nt, Human
auggaaaggagaggaaagaacu

SEQ ID NO: 2308558 - RNA, 14 nt, Human
auggaaaaggaaga

SEQ ID NO: 2308559 - RNA, 20 nt, Human
auggaaaaggaagacuagag

SEQ ID NO: 2308560 - RNA, 16 nt, Human
auggaaaccugaaaaa

SEQ ID NO: 2308561 - RNA, 15 nt, Human
augcuuggcuucuca

SEQ ID NO: 2308562 - RNA, 12 nt, Human
augcugcccugu

SEQ ID NO: 2308563 - RNA, 12 nt, Human
augcuuguacau

SEQ ID NO: 2308564 - RNA, 14 nt, Human
augcuuguacauaa

SEQ ID NO: 2308565 - RNA, 13 nt, Human
augcuuguacaua

SEQ ID NO: 2308566 - RNA, 16 nt, Human
auggaggaaaaccaag

SEQ ID NO: 2308567 - RNA, 22 nt, Human
auggaggaaaaccaagccgugg

SEQ ID NO: 2308568 - RNA, 13 nt, Human
auggaggaauaug

SEQ ID NO: 2308569 - RNA, 12 nt, Human
auggaggcacac

SEQ ID NO: 2308570 - RNA, 16 nt, Human
auggaggauggagaga

SEQ ID NO: 2308571 - RNA, 15 nt, Human
auggaggaggaggca

SEQ ID NO: 2308572 - RNA, 16 nt, Human
auggaggaggaggcaa

SEQ ID NO: 2308573 - RNA, 14 nt, Human
auggaggaggaggc

SEQ ID NO: 2308574 - RNA, 17 nt, Human
auggaggagaagaauuu

SEQ ID NO: 2308575 - RNA, 15 nt, Human
auggaggagaagaau

SEQ ID NO: 2308576 - RNA, 13 nt, Human
auggaggagaaga

SEQ ID NO: 2308577 - RNA, 11 nt, Human
auggaggagaa

SEQ ID NO: 2308578 - RNA, 18 nt, Human
auggaggauggagagagg

SEQ ID NO: 2308579 - RNA, 16 nt, Human
auggauucucagauau

SEQ ID NO: 2308580 - RNA, 14 nt, Human
auggauucucagau

SEQ ID NO: 2308581 - RNA, 22 nt, Human
auggauucucagauauuuauau

SEQ ID NO: 2308582 - RNA, 19 nt, Human
auggauucucagauauuua

SEQ ID NO: 2308583 - RNA, 18 nt, Human
auggauucucagauauuu

SEQ ID NO: 2308584 - RNA, 17 nt, Human
auggauucucagauauu

SEQ ID NO: 2308585 - RNA, 19 nt, Human
auggauucuccacucaguu

SEQ ID NO: 2308586 - RNA, 18 nt, Human
auggauugauaauugcau

SEQ ID NO: 2308587 - RNA, 20 nt, Human
auggauugauaauugcauuc

SEQ ID NO: 2308588 - RNA, 15 nt, Human
auggauuggauuauu

SEQ ID NO: 2308589 - RNA, 15 nt, Human
auggauuuccagcca

SEQ ID NO: 2308590 - RNA, 18 nt, Human
auggcugugccucugccu

SEQ ID NO: 2308591 - RNA, 20 nt, Human
auggauuggauuauuuaaua

SEQ ID NO: 2308592 - RNA, 22 nt, Human
auggauuggauuauuuaauaac

SEQ ID NO: 2308593 - RNA, 16 nt, Human
augcucuuuacuucau

SEQ ID NO: 2308594 - RNA, 15 nt, Human
augcugaaacaggag

SEQ ID NO: 2308595 - RNA, 17 nt, Human
augcugaaaaaacaccu

SEQ ID NO: 2308596 - RNA, 18 nt, Human
augcugaaacaggagaga

SEQ ID NO: 2308597 - RNA, 16 nt, Human
augcugaaacaggaga

SEQ ID NO: 2308598 - RNA, 17 nt, Human
augcugaacauugcaua

SEQ ID NO: 2308599 - RNA, 23 nt, Human
augcugaacauugcauauaacuu

SEQ ID NO: 2308600 - RNA, 14 nt, Human
augcugaaaccaag

SEQ ID NO: 2308601 - RNA, 19 nt, Human
augcugaagccaaagccaa

SEQ ID NO: 2308602 - RNA, 15 nt, Human
augcucuucugugga

SEQ ID NO: 2308603 - RNA, 14 nt, Human
augcugccaaauuu

SEQ ID NO: 2308604 - RNA, 19 nt, Human
augcugcaggacuugagaa

SEQ ID NO: 2308605 - RNA, 24 nt, Human
augcugauguucaguguaauuucu

SEQ ID NO: 2308606 - RNA, 23 nt, Human
augcugcauuuuaauuuuaacca

SEQ ID NO: 2308607 - RNA, 18 nt, Human
augcugcaggacuugaga

SEQ ID NO: 2308608 - RNA, 20 nt, Human
augcugcagauuugggcugg

SEQ ID NO: 2308609 - RNA, 12 nt, Human
augcugaaggga

SEQ ID NO: 2308610 - RNA, 21 nt, Human
augcugauguucaguguaauu

SEQ ID NO: 2308611 - RNA, 22 nt, Human
augcugauguucaguguaauuu

SEQ ID NO: 2308612 - RNA, 11 nt, Human
augcugcccug

SEQ ID NO: 2308613 - RNA, 12 nt, Human
augcugccccuc

SEQ ID NO: 2308614 - RNA, 15 nt, Human
augcugcccaugcca

SEQ ID NO: 2308615 - RNA, 17 nt, Human
augcugcccaugccacc

SEQ ID NO: 2308616 - RNA, 22 nt, Human
augcugcccaugccaccgcuuc

SEQ ID NO: 2308617 - RNA, 16 nt, Human
auggcuuaguuuucau

SEQ ID NO: 2308618 - RNA, 21 nt, Human
auggcuuaauguuuauuccug

SEQ ID NO: 2308619 - RNA, 17 nt, Human
auggcuuauccagcugg

SEQ ID NO: 2308620 - RNA, 18 nt, Human
auggcuuauccagcuggu

SEQ ID NO: 2308621 - RNA, 19 nt, Human
auggcuuauccagcuggug

SEQ ID NO: 2308622 - RNA, 16 nt, Human
auggcuuccaaggugg

SEQ ID NO: 2308623 - RNA, 21 nt, Human
auggcuuccaagguggucugc

SEQ ID NO: 2308624 - RNA, 12 nt, Human
auggcuuccucc

SEQ ID NO: 2308625 - RNA, 17 nt, Human
auggcuuccuccucccu

SEQ ID NO: 2308626 - RNA, 15 nt, Human
auggcuuccuccucc

SEQ ID NO: 2308627 - RNA, 16 nt, Human
auggcuuccuccuccc

SEQ ID NO: 2308628 - RNA, 19 nt, Human
auggcugugccucugccug

SEQ ID NO: 2308629 - RNA, 20 nt, Human
auggcugugccucugccugu

SEQ ID NO: 2308630 - RNA, 16 nt, Human
auggcuguggagugug

SEQ ID NO: 2308631 - RNA, 14 nt, Human
auggcuuaauguuu

SEQ ID NO: 2308632 - RNA, 16 nt, Human
auggcuuaauguuuau

SEQ ID NO: 2308633 - RNA, 16 nt, Human
agucugcuauauuuuc

SEQ ID NO: 2308634 - RNA, 17 nt, Human
agucugcuauauuuuca

SEQ ID NO: 2308635 - RNA, 17 nt, Human
agucugcugcccuccau

SEQ ID NO: 2308636 - RNA, 16 nt, Human
agucugcugcccucca

SEQ ID NO: 2308637 - RNA, 15 nt, Human
agucugcugcccucc

SEQ ID NO: 2308638 - RNA, 13 nt, Human
agucugcugcccu

SEQ ID NO: 2308639 - RNA, 17 nt, Human
agucuggaaugcagugg

SEQ ID NO: 2308640 - RNA, 20 nt, Human
agugaacuugggccacugug

SEQ ID NO: 2308641 - RNA, 18 nt, Human
agucugcugcccuccauc

SEQ ID NO: 2308642 - RNA, 20 nt, Human
agucugcugcccuccauccc

SEQ ID NO: 2308643 - RNA, 18 nt, Human
agucuggaaugcaguggu

SEQ ID NO: 2308644 - RNA, 19 nt, Human
agucugaugauuucuugaa

SEQ ID NO: 2308645 - RNA, 22 nt, Human
agucugaucgugacgcugaaua

SEQ ID NO: 2308646 - RNA, 23 nt, Human
agucugaucgugacgcugaauaa

SEQ ID NO: 2308647 - RNA, 15 nt, Human
aguccugggaugugg

SEQ ID NO: 2308648 - RNA, 18 nt, Human
agucugaucgugacgcug

SEQ ID NO: 2308649 - RNA, 20 nt, Human
agucugaucgugacgcugaa

SEQ ID NO: 2308650 - RNA, 21 nt, Human
agucugaucgugacgcugaau

SEQ ID NO: 2308651 - RNA, 16 nt, Human
agucugauucccaagc

SEQ ID NO: 2308652 - RNA, 18 nt, Human
agucugauucccaagcuc

SEQ ID NO: 2308653 - RNA, 23 nt, Human
agugaagguuuacaauuuacaaa

SEQ ID NO: 2308654 - RNA, 15 nt, Human
agugaagguuuacaa

SEQ ID NO: 2308655 - RNA, 21 nt, Human
agugaagaggggcagcccuug

SEQ ID NO: 2308656 - RNA, 18 nt, Human
agugaagguuuacaauuu

SEQ ID NO: 2308657 - RNA, 16 nt, Human
agugacagggaagcua

SEQ ID NO: 2308658 - RNA, 13 nt, Human
agugacagggaag

SEQ ID NO: 2308659 - RNA, 19 nt, Human
agugaagagggagaaggga

SEQ ID NO: 2308660 - RNA, 16 nt, Human
agugaagacuggaagc

SEQ ID NO: 2308661 - RNA, 13 nt, Human
agugaagaggggc

SEQ ID NO: 2308662 - RNA, 14 nt, Human
agugaagaggggca

SEQ ID NO: 2308663 - RNA, 15 nt, Human
agugaagaggggcag

SEQ ID NO: 2308664 - RNA, 21 nt, Human
agugaaggcuucucucugugg

SEQ ID NO: 2308665 - RNA, 15 nt, Human
agugaaggcuucucu

SEQ ID NO: 2308666 - RNA, 16 nt, Human
agugaagaggggcagc

SEQ ID NO: 2308667 - RNA, 17 nt, Human
agugaagaggggcagcc

SEQ ID NO: 2308668 - RNA, 19 nt, Human
agugaagaggggcagcccu

SEQ ID NO: 2308669 - RNA, 20 nt, Human
agugaagaggggcagcccuu

SEQ ID NO: 2308670 - RNA, 16 nt, Human
agugaagacaaugacu

SEQ ID NO: 2308671 - RNA, 14 nt, Human
agugaagacaauga

SEQ ID NO: 2308672 - RNA, 16 nt, Human
agugaagaaaagugaa

SEQ ID NO: 2308673 - RNA, 19 nt, Human
agugaagaaaagugaaugc

SEQ ID NO: 2308674 - RNA, 22 nt, Human
agugaagaaaagugaaugcuca

SEQ ID NO: 2308675 - RNA, 23 nt, Human
agugaagaaaagugaaugcucaa

SEQ ID NO: 2308676 - RNA, 21 nt, Human
aguccugggagaaccucaggc

SEQ ID NO: 2308677 - RNA, 18 nt, Human
aguccuggccuggcuucu

SEQ ID NO: 2308678 - RNA, 20 nt, Human
aguccuggccuggcuucucc

SEQ ID NO: 2308679 - RNA, 13 nt, Human
aguccuggccugg

SEQ ID NO: 2308680 - RNA, 14 nt, Human
aguccuggccuggc

SEQ ID NO: 2308681 - RNA, 22 nt, Human
aguccuggcaugggaaugaaug

SEQ ID NO: 2308682 - RNA, 20 nt, Human
aguccuggcaugggaaugaa

SEQ ID NO: 2308683 - RNA, 21 nt, Human
aguccuggcaugggaaugaau

SEQ ID NO: 2308684 - RNA, 22 nt, Human
aguccugggagaaccucaggcu

SEQ ID NO: 2308685 - RNA, 13 nt, Human
aguccugugaaug

SEQ ID NO: 2308686 - RNA, 18 nt, Human
aguccugugaaugccacu

SEQ ID NO: 2308687 - RNA, 19 nt, Human
aguccugugaaugccacug

SEQ ID NO: 2308688 - RNA, 20 nt, Human
aguccugugaaugccacugc

SEQ ID NO: 2308689 - RNA, 12 nt, Human
aguccuguaaug

SEQ ID NO: 2308690 - RNA, 17 nt, Human
agucugaaggcuggguu

SEQ ID NO: 2308691 - RNA, 16 nt, Human
agucugaaggcugggu

SEQ ID NO: 2308692 - RNA, 13 nt, Human
agucugaaggcug

SEQ ID NO: 2308693 - RNA, 15 nt, Human
agucugaaggcuggg

SEQ ID NO: 2308694 - RNA, 19 nt, Human
agugacaguggauugcauu

SEQ ID NO: 2308695 - RNA, 20 nt, Human
agugacaguggauugcauuu

SEQ ID NO: 2308696 - RNA, 19 nt, Human
agugacagggaagcuacag

SEQ ID NO: 2308697 - RNA, 20 nt, Human
agugacagggaagcuacagg

SEQ ID NO: 2308698 - RNA, 22 nt, Human
agugacagggaagcuacagguu

SEQ ID NO: 2308699 - RNA, 23 nt, Human
agugacagggaagcuacagguua

SEQ ID NO: 2308700 - RNA, 22 nt, Human
agugacaucucuuugaugucau

SEQ ID NO: 2308701 - RNA, 18 nt, Human
agugaccauacuaauuau

SEQ ID NO: 2308702 - RNA, 15 nt, Human
agugacaguauuuug

SEQ ID NO: 2308703 - RNA, 15 nt, Human
agugacccggaggcc

SEQ ID NO: 2308704 - RNA, 16 nt, Human
agugacccggaggcca

SEQ ID NO: 2308705 - RNA, 17 nt, Human
agugacccggaggccac

SEQ ID NO: 2308706 - RNA, 18 nt, Human
agugacccggaggccaca

SEQ ID NO: 2308707 - RNA, 19 nt, Human
agugacccggaggccacau

SEQ ID NO: 2308708 - RNA, 23 nt, Human
agugacccggaggccacaugagu

SEQ ID NO: 2308709 - RNA, 15 nt, Human
aguaucucagggccu

SEQ ID NO: 2308710 - RNA, 19 nt, Human
aguaucuccucgcaagcug

SEQ ID NO: 2308711 - RNA, 18 nt, Human
aguaucuccucgcaagcu

SEQ ID NO: 2308712 - RNA, 22 nt, Human
aguaucucggaccuuucagcug

SEQ ID NO: 2308713 - RNA, 23 nt, Human
aguaucucggaccuuucagcugu

SEQ ID NO: 2308714 - RNA, 14 nt, Human
aguaucugggaacu

SEQ ID NO: 2308715 - RNA, 14 nt, Human
aguaucuucaugua

SEQ ID NO: 2308716 - RNA, 15 nt, Human
aguaucuguaucucu

SEQ ID NO: 2308717 - RNA, 18 nt, Human
aguaucuguaucucucuc

SEQ ID NO: 2308718 - RNA, 11 nt, Human
aguaucuugaa

SEQ ID NO: 2308719 - RNA, 12 nt, Human
aguaucuugaag

SEQ ID NO: 2308720 - RNA, 15 nt, Human
aguaucuugaagacu

SEQ ID NO: 2308721 - RNA, 16 nt, Human
aguaugaauaaagaca

SEQ ID NO: 2308722 - RNA, 13 nt, Human
aguaugaaaauaa

SEQ ID NO: 2308723 - RNA, 17 nt, Human
aguaucuuuuuucaaaa

SEQ ID NO: 2308724 - RNA, 13 nt, Human
aguaugaaucuau

SEQ ID NO: 2308725 - RNA, 15 nt, Human
aguaugaaucuaugc

SEQ ID NO: 2308726 - RNA, 16 nt, Human
aguaugaaucuaugcc

SEQ ID NO: 2308727 - RNA, 17 nt, Human
aguaugaaucuaugcca

SEQ ID NO: 2308728 - RNA, 18 nt, Human
aguaugaaucuaugccaa

SEQ ID NO: 2308729 - RNA, 16 nt, Human
aguaucuuuuuauuca

SEQ ID NO: 2308730 - RNA, 12 nt, Human
aguaugaaaaua

SEQ ID NO: 2308731 - RNA, 20 nt, Human
aguaugcuuggacugaaggg

SEQ ID NO: 2308732 - RNA, 14 nt, Human
aguauggagcucag

SEQ ID NO: 2308733 - RNA, 19 nt, Human
aguauggagcucagagagg

SEQ ID NO: 2308734 - RNA, 23 nt, Human
aguaugcuugaaaagauaaauua

SEQ ID NO: 2308735 - RNA, 16 nt, Human
aguaugaggcauuugu

SEQ ID NO: 2308736 - RNA, 15 nt, Human
aguaugaggcauuug

SEQ ID NO: 2308737 - RNA, 22 nt, Human
agucaaauuaauaaucuuauua

SEQ ID NO: 2308738 - RNA, 20 nt, Human
agucaaauuaauaaucuuau

SEQ ID NO: 2308739 - RNA, 22 nt, Human
agucaaauuugaaaauaauugu

SEQ ID NO: 2308740 - RNA, 16 nt, Human
agucaacaaacuauuu

SEQ ID NO: 2308741 - RNA, 21 nt, Human
agucaaaguaaaacuugcugc

SEQ ID NO: 2308742 - RNA, 12 nt, Human
agucaaaguaaa

SEQ ID NO: 2308743 - RNA, 22 nt, Human
agucaaaugguaggcauuuccu

SEQ ID NO: 2308744 - RNA, 15 nt, Human
agucaaacugugcca

SEQ ID NO: 2308745 - RNA, 23 nt, Human
agucaaaugguaggcauuuccua

SEQ ID NO: 2308746 - RNA, 14 nt, Human
agucaaauuaauaa

SEQ ID NO: 2308747 - RNA, 18 nt, Human
agucaaauuaauaaucuu

SEQ ID NO: 2308748 - RNA, 15 nt, Human
agucaaauuaauaau

SEQ ID NO: 2308749 - RNA, 23 nt, Human
agucaaauugugugaaagguacu

SEQ ID NO: 2308750 - RNA, 19 nt, Human
agucaaauugugugaaagg

SEQ ID NO: 2308751 - RNA, 21 nt, Human
agucaaaaggugccugugagg

SEQ ID NO: 2308752 - RNA, 13 nt, Human
agucaaagacauu

SEQ ID NO: 2308753 - RNA, 18 nt, Human
agucaaaccauaaacuuc

SEQ ID NO: 2308754 - RNA, 20 nt, Human
agucaaaccauaaacuucau

SEQ ID NO: 2308755 - RNA, 13 nt, Human
agucaaaccauaa

SEQ ID NO: 2308756 - RNA, 17 nt, Human
agucaaaccauaaacuu

SEQ ID NO: 2308757 - RNA, 20 nt, Human
aguaugggacuggccucugc

SEQ ID NO: 2308758 - RNA, 17 nt, Human
aguaugggacuggccuc

SEQ ID NO: 2308759 - RNA, 22 nt, Human
aguauggugagagaagccugug

SEQ ID NO: 2308760 - RNA, 18 nt, Human
aguauggguuagggaaaa

SEQ ID NO: 2308761 - RNA, 23 nt, Human
aguggcuguccagugcccauucc

SEQ ID NO: 2308762 - RNA, 15 nt, Human
aguggcuucaaaaua

SEQ ID NO: 2308763 - RNA, 17 nt, Human
aguggcuucaucuguca

SEQ ID NO: 2308764 - RNA, 19 nt, Human
aguggcuucauuagagcag

SEQ ID NO: 2308765 - RNA, 19 nt, Human
aguggcuuacuacaugugg

SEQ ID NO: 2308766 - RNA, 18 nt, Human
aguggcuguccagugccc

SEQ ID NO: 2308767 - RNA, 19 nt, Human
aguggcuguccagugccca

SEQ ID NO: 2308768 - RNA, 12 nt, Human
aguggcugucca

SEQ ID NO: 2308769 - RNA, 13 nt, Human
aguggcuguccag

SEQ ID NO: 2308770 - RNA, 17 nt, Human
aguggcuguccagugcc

SEQ ID NO: 2308771 - RNA, 17 nt, Human
aguggcugucaucagcc

SEQ ID NO: 2308772 - RNA, 16 nt, Human
aguggcugucaucagc

SEQ ID NO: 2308773 - RNA, 18 nt, Human
aguggcugguccagggcu

SEQ ID NO: 2308774 - RNA, 19 nt, Human
aguggcugguccagggcua

SEQ ID NO: 2308775 - RNA, 23 nt, Human
aguggcuuaaaacaacacucaca

SEQ ID NO: 2308776 - RNA, 13 nt, Human
aguggcuccuccc

SEQ ID NO: 2308777 - RNA, 17 nt, Human
aguggcuccucccggug

SEQ ID NO: 2308778 - RNA, 14 nt, Human
aguggcugcugacu

SEQ ID NO: 2308779 - RNA, 12 nt, Human
aguggcugcugc

SEQ ID NO: 2308780 - RNA, 11 nt, Human
aguggcugcug

SEQ ID NO: 2308781 - RNA, 21 nt, Human
aguggcuccucccggugccca

SEQ ID NO: 2308782 - RNA, 16 nt, Human
aguggcuggaucugug

SEQ ID NO: 2308783 - RNA, 13 nt, Human
aguggcugcugcc

SEQ ID NO: 2308784 - RNA, 14 nt, Human
aguggcugcugccc

SEQ ID NO: 2308785 - RNA, 16 nt, Human
aguggcugcugcccag

SEQ ID NO: 2308786 - RNA, 17 nt, Human
aguggcugcugcccagg

SEQ ID NO: 2308787 - RNA, 19 nt, Human
aguggcugcugcccaggcc

SEQ ID NO: 2308788 - RNA, 22 nt, Human
aguggcugcugcccaggcccag

SEQ ID NO: 2308789 - RNA, 15 nt, Human
aguggcugguccagg

SEQ ID NO: 2308790 - RNA, 17 nt, Human
aguggcugguccagggc

SEQ ID NO: 2308791 - RNA, 14 nt, Human
aguggcucacgccu

SEQ ID NO: 2308792 - RNA, 14 nt, Human
aguggcucaacauu

SEQ ID NO: 2308793 - RNA, 21 nt, Human
aguguccccuccacugucaca

SEQ ID NO: 2308794 - RNA, 15 nt, Human
agugucuuaauuaaa

SEQ ID NO: 2308795 - RNA, 21 nt, Human
aguguccaaagcagggucugg

SEQ ID NO: 2308796 - RNA, 20 nt, Human
aguguccauugacauguaca

SEQ ID NO: 2308797 - RNA, 21 nt, Human
aguguccauugacauguacag

SEQ ID NO: 2308798 - RNA, 22 nt, Human
aguguccauugacauguacaga

SEQ ID NO: 2308799 - RNA, 23 nt, Human
aguguccauugacauguacagag

SEQ ID NO: 2308800 - RNA, 13 nt, Human
aguguccccucca

SEQ ID NO: 2308801 - RNA, 14 nt, Human
aguguccccuccac

SEQ ID NO: 2308802 - RNA, 15 nt, Human
aguguccccuccacu

SEQ ID NO: 2308803 - RNA, 17 nt, Human
aguguccccuccacugu

SEQ ID NO: 2308804 - RNA, 19 nt, Human
aguguccccuccacuguca

SEQ ID NO: 2308805 - RNA, 16 nt, Human
aguguauuuuucaaua

SEQ ID NO: 2308806 - RNA, 14 nt, Human
aguguauuuguauu

SEQ ID NO: 2308807 - RNA, 21 nt, Human
aguguauuuuucaauaaagca

SEQ ID NO: 2308808 - RNA, 15 nt, Human
agugucaaauaaaca

SEQ ID NO: 2308809 - RNA, 17 nt, Human
agugucaaauaaacacu

SEQ ID NO: 2308810 - RNA, 19 nt, Human
agugucaaauaaacacugu

SEQ ID NO: 2308811 - RNA, 21 nt, Human
agugucaaauaaacacugugu

SEQ ID NO: 2308812 - RNA, 20 nt, Human
agugucaaauaaacacugug

SEQ ID NO: 2308813 - RNA, 14 nt, Human
agugucaaguugug

SEQ ID NO: 2308814 - RNA, 15 nt, Human
agugucaaguugugc

SEQ ID NO: 2308815 - RNA, 17 nt, Human
agugucaaguugugcuu

SEQ ID NO: 2308816 - RNA, 17 nt, Human
aguguccaaagcagggu

SEQ ID NO: 2308817 - RNA, 20 nt, Human
aguguccaaagcagggucug

SEQ ID NO: 2308818 - RNA, 18 nt, Human
aguguauuuuuuuacuaa

SEQ ID NO: 2308819 - RNA, 17 nt, Human
aguguauuuuuuuacua

SEQ ID NO: 2308820 - RNA, 14 nt, Human
agugggagaaaaca

SEQ ID NO: 2308821 - RNA, 14 nt, Human
aguguauaucagaa

SEQ ID NO: 2308822 - RNA, 14 nt, Human
agugggagccaggg

SEQ ID NO: 2308823 - RNA, 16 nt, Human
agugggagcugccugu

SEQ ID NO: 2308824 - RNA, 15 nt, Human
agugggagcugccug

SEQ ID NO: 2308825 - RNA, 17 nt, Human
agugggagaaaacacuu

SEQ ID NO: 2308826 - RNA, 13 nt, Human
agugggagaaaac

SEQ ID NO: 2308827 - RNA, 12 nt, Human
agugggagaaaa

SEQ ID NO: 2308828 - RNA, 20 nt, Human
aguggcuucauuagagcagg

SEQ ID NO: 2308829 - RNA, 21 nt, Human
aguggcuucauuagagcaggc

SEQ ID NO: 2308830 - RNA, 22 nt, Human
aguggcuucauuagagcaggcg

SEQ ID NO: 2308831 - RNA, 14 nt, Human
agugggagcugccu

SEQ ID NO: 2308832 - RNA, 17 nt, Human
aguguaugcacgugugc

SEQ ID NO: 2308833 - RNA, 22 nt, Human
aguguauggaaauaaauguauc

SEQ ID NO: 2308834 - RNA, 21 nt, Human
aguguauggaaauaaauguau

SEQ ID NO: 2308835 - RNA, 20 nt, Human
aguguauggaaauaaaugua

SEQ ID NO: 2308836 - RNA, 18 nt, Human
aguguaugacugcacaug

SEQ ID NO: 2308837 - RNA, 16 nt, Human
aguguauggaaauaaa

SEQ ID NO: 2308838 - RNA, 14 nt, Human
aguguccuuagaac

SEQ ID NO: 2308839 - RNA, 21 nt, Human
agugucuuaauuaaaagaaua

SEQ ID NO: 2308840 - RNA, 18 nt, Human
agugucuuaauuaaaaga

SEQ ID NO: 2308841 - RNA, 17 nt, Human
agugucuuaauuaaaag

SEQ ID NO: 2308842 - RNA, 17 nt, Human
aguucauguuugcuuca

SEQ ID NO: 2308843 - RNA, 19 nt, Human
aguucaguuuuaccagaug

SEQ ID NO: 2308844 - RNA, 23 nt, Human
aguucauguuugcuucauaaaug

SEQ ID NO: 2308845 - RNA, 21 nt, Human
aguucaugagaaucuauauuu

SEQ ID NO: 2308846 - RNA, 13 nt, Human
aguucaugagaau

SEQ ID NO: 2308847 - RNA, 21 nt, Human
aguugaaaagacuccaaagaa

SEQ ID NO: 2308848 - RNA, 22 nt, Human
aguugaaaaucuuauaauuuaa

SEQ ID NO: 2308849 - RNA, 14 nt, Human
aguucaguaccugg

SEQ ID NO: 2308850 - RNA, 15 nt, Human
aguucaguaccugga

SEQ ID NO: 2308851 - RNA, 16 nt, Human
aguucaguaccuggag

SEQ ID NO: 2308852 - RNA, 17 nt, Human
aguucaguaccuggagg

SEQ ID NO: 2308853 - RNA, 19 nt, Human
aguucaguaccuggaggag

SEQ ID NO: 2308854 - RNA, 20 nt, Human
aguucaguaccuggaggagg

SEQ ID NO: 2308855 - RNA, 11 nt, Human
aguucaguggc

SEQ ID NO: 2308856 - RNA, 19 nt, Human
aguucaguggcacucaaca

SEQ ID NO: 2308857 - RNA, 13 nt, Human
aguucaguggcag

SEQ ID NO: 2308858 - RNA, 18 nt, Human
aguucaguggcagggcuc

SEQ ID NO: 2308859 - RNA, 19 nt, Human
aguucaguggcagggcuca

SEQ ID NO: 2308860 - RNA, 21 nt, Human
aguucaguggcagggcucagg

SEQ ID NO: 2308861 - RNA, 22 nt, Human
aguucaguggcagggcucagga

SEQ ID NO: 2308862 - RNA, 23 nt, Human
aguucaguggcagggcucaggau

SEQ ID NO: 2308863 - RNA, 16 nt, Human
aguucaguuccucuuu

SEQ ID NO: 2308864 - RNA, 20 nt, Human
aguucaguuccucuuugcau

SEQ ID NO: 2308865 - RNA, 23 nt, Human
aguucaguuccucuuugcaugga

SEQ ID NO: 2308866 - RNA, 24 nt, Human
aguucaguuccucuuugcauggaa

SEQ ID NO: 2308867 - RNA, 18 nt, Human
aguucauaaauuuauggu

SEQ ID NO: 2308868 - RNA, 21 nt, Human
aguucagguagcugccccugg

SEQ ID NO: 2308869 - RNA, 20 nt, Human
aguucagguagcugccccug

SEQ ID NO: 2308870 - RNA, 19 nt, Human
aguucagguagcugccccu

SEQ ID NO: 2308871 - RNA, 12 nt, Human
aguuacagaaag

SEQ ID NO: 2308872 - RNA, 13 nt, Human
aguuacagaaagu

SEQ ID NO: 2308873 - RNA, 15 nt, Human
aguuacagaaagugg

SEQ ID NO: 2308874 - RNA, 16 nt, Human
aguuacagaaaguggu

SEQ ID NO: 2308875 - RNA, 20 nt, Human
aguucagguaacaggcagau

SEQ ID NO: 2308876 - RNA, 19 nt, Human
aguucagguaacaggcaga

SEQ ID NO: 2308877 - RNA, 17 nt, Human
aguuacagacaaagcgu

SEQ ID NO: 2308878 - RNA, 20 nt, Human
aguuaaugaugguugauggg

SEQ ID NO: 2308879 - RNA, 18 nt, Human
aguuacacuaaaagguga

SEQ ID NO: 2308880 - RNA, 14 nt, Human
aguuacagacaaag

SEQ ID NO: 2308881 - RNA, 16 nt, Human
aguuacagacaaagcg

SEQ ID NO: 2308882 - RNA, 12 nt, Human
aguuaaauaaau

SEQ ID NO: 2308883 - RNA, 16 nt, Human
aguuaaagugaauaac

SEQ ID NO: 2308884 - RNA, 13 nt, Human
aguuaagccuuug

SEQ ID NO: 2308885 - RNA, 15 nt, Human
aguuaauauugugaa

SEQ ID NO: 2308886 - RNA, 20 nt, Human
aguuaauauaucccagaaau

SEQ ID NO: 2308887 - RNA, 21 nt, Human
aguuaauauaucccagaaauu

SEQ ID NO: 2308888 - RNA, 15 nt, Human
aguuaagugaauguc

SEQ ID NO: 2308889 - RNA, 14 nt, Human
aguuaagccuuugg

SEQ ID NO: 2308890 - RNA, 18 nt, Human
aguguuuuuguaaagugu

SEQ ID NO: 2308891 - RNA, 14 nt, Human
aguguuuuuguaaa

SEQ ID NO: 2308892 - RNA, 15 nt, Human
aguguuuuuguaaag

SEQ ID NO: 2308893 - RNA, 13 nt, Human
aguuaaagcagug

SEQ ID NO: 2308894 - RNA, 14 nt, Human
aguuaaacauaaau

SEQ ID NO: 2308895 - RNA, 16 nt, Human
aguguuuuuaccucug

SEQ ID NO: 2308896 - RNA, 17 nt, Human
aguguuuuuaccucugu

SEQ ID NO: 2308897 - RNA, 21 nt, Human
aguguuuuuaccucugucuug

SEQ ID NO: 2308898 - RNA, 20 nt, Human
aguguuuuuguaaagugugg

SEQ ID NO: 2308899 - RNA, 13 nt, Human
aguugaacugaua

SEQ ID NO: 2308900 - RNA, 23 nt, Human
aguugaacugauaguuacuguug

SEQ ID NO: 2308901 - RNA, 22 nt, Human
aguugaaaagacuccaaagaaa

SEQ ID NO: 2308902 - RNA, 23 nt, Human
aguugaaaaucuuauaauuuaaa

SEQ ID NO: 2308903 - RNA, 20 nt, Human
aguuguggugcugacaaagc

SEQ ID NO: 2308904 - RNA, 20 nt, Human
aguuguggagagugcaacag

SEQ ID NO: 2308905 - RNA, 17 nt, Human
aguugugggugggagag

SEQ ID NO: 2308906 - RNA, 19 nt, Human
aguuguggugcugacaaag

SEQ ID NO: 2308907 - RNA, 21 nt, Human
aguuguggaaagccucugcug

SEQ ID NO: 2308908 - RNA, 20 nt, Human
aguuguggaaagccucugcu

SEQ ID NO: 2308909 - RNA, 19 nt, Human
aguuguggaaagccucugc

SEQ ID NO: 2308910 - RNA, 18 nt, Human
aguuguggaaagccucug

SEQ ID NO: 2308911 - RNA, 14 nt, Human
aguugaagacagag

SEQ ID NO: 2308912 - RNA, 15 nt, Human
aguuguugcccuggg

SEQ ID NO: 2308913 - RNA, 13 nt, Human
aguuguuggccuc

SEQ ID NO: 2308914 - RNA, 14 nt, Human
aguuguuggccucc

SEQ ID NO: 2308915 - RNA, 15 nt, Human
aguuguuggccuccg

SEQ ID NO: 2308916 - RNA, 15 nt, Human
aguuguuucauugac

SEQ ID NO: 2308917 - RNA, 13 nt, Human
aguuguuucauug

SEQ ID NO: 2308918 - RNA, 19 nt, Human
aguuguuggccuccggccu

SEQ ID NO: 2308919 - RNA, 19 nt, Human
aguuguuucauugacuauc

SEQ ID NO: 2308920 - RNA, 16 nt, Human
aguuguuucauugacu

SEQ ID NO: 2308921 - RNA, 13 nt, Human
aguuguuugaugc

SEQ ID NO: 2308922 - RNA, 11 nt, Human
aguuguuugau

SEQ ID NO: 2308923 - RNA, 20 nt, Human
aguuguuugauucagacagc

SEQ ID NO: 2308924 - RNA, 14 nt, Human
auauuuacguauga

SEQ ID NO: 2308925 - RNA, 21 nt, Human
auauuuacaugaauugcauuu

SEQ ID NO: 2308926 - RNA, 20 nt, Human
auauuuacauaugaaauuua

SEQ ID NO: 2308927 - RNA, 19 nt, Human
auauuuacauaugaaauuu

SEQ ID NO: 2308928 - RNA, 18 nt, Human
auauuuacauaugaaauu

SEQ ID NO: 2308929 - RNA, 16 nt, Human
auauuuacauaugaaa

SEQ ID NO: 2308930 - RNA, 14 nt, Human
auauuauuucuagg

SEQ ID NO: 2308931 - RNA, 20 nt, Human
auauuauuucuaggaagaau

SEQ ID NO: 2308932 - RNA, 22 nt, Human
auauuauuucuaggaagaauuu

SEQ ID NO: 2308933 - RNA, 23 nt, Human
auauuuauuauuuucaccuguuu

SEQ ID NO: 2308934 - RNA, 23 nt, Human
auauuuacuaagccacaagaaau

SEQ ID NO: 2308935 - RNA, 19 nt, Human
auauuuacuucuuauacau

SEQ ID NO: 2308936 - RNA, 12 nt, Human
auauuuauugcu

SEQ ID NO: 2308937 - RNA, 13 nt, Human
auauuuauugcuu

SEQ ID NO: 2308938 - RNA, 14 nt, Human
auauuuauugcuuu

SEQ ID NO: 2308939 - RNA, 13 nt, Human
auauuuauuuuaa

SEQ ID NO: 2308940 - RNA, 17 nt, Human
auauuauucauucauuu

SEQ ID NO: 2308941 - RNA, 13 nt, Human
auauuauuucuag

SEQ ID NO: 2308942 - RNA, 19 nt, Human
auauuauuaguuuugauuu

SEQ ID NO: 2308943 - RNA, 22 nt, Human
auauuauuaguuuugauuuaau

SEQ ID NO: 2308944 - RNA, 16 nt, Human
auauuauggaagauuu

SEQ ID NO: 2308945 - RNA, 13 nt, Human
auauuauguguuu

SEQ ID NO: 2308946 - RNA, 21 nt, Human
auauuauguauuuauauuuug

SEQ ID NO: 2308947 - RNA, 16 nt, Human
auauuauguuaaaacu

SEQ ID NO: 2308948 - RNA, 21 nt, Human
auauuaucaugcaaaugcugu

SEQ ID NO: 2308949 - RNA, 19 nt, Human
auauuaucaugcaaaugcu

SEQ ID NO: 2308950 - RNA, 23 nt, Human
auauuaugaagcuuuuaugugaa

SEQ ID NO: 2308951 - RNA, 14 nt, Human
auauuagaaguguu

SEQ ID NO: 2308952 - RNA, 15 nt, Human
auauuauauauauau

SEQ ID NO: 2308953 - RNA, 16 nt, Human
auauuacuagcauaug

SEQ ID NO: 2308954 - RNA, 22 nt, Human
auauuaccacagacauacuaac

SEQ ID NO: 2308955 - RNA, 19 nt, Human
auauuaccacagacauacu

SEQ ID NO: 2308956 - RNA, 21 nt, Human
auaugcuuauacacuuacacu

SEQ ID NO: 2308957 - RNA, 20 nt, Human
auaugcuucuguuuuauaau

SEQ ID NO: 2308958 - RNA, 22 nt, Human
auaugcuucuguuuuauaauuu

SEQ ID NO: 2308959 - RNA, 21 nt, Human
auaucauuuauuuuuuacauu

SEQ ID NO: 2308960 - RNA, 23 nt, Human
auaucauuuauuuuuuacauuau

SEQ ID NO: 2308961 - RNA, 14 nt, Human
auauccaccaccuc

SEQ ID NO: 2308962 - RNA, 19 nt, Human
auauccaaaagcuuuuuau

SEQ ID NO: 2308963 - RNA, 12 nt, Human
auauccaaaagc

SEQ ID NO: 2308964 - RNA, 23 nt, Human
auaucauuauaacugaaggagaa

SEQ ID NO: 2308965 - RNA, 21 nt, Human
auaucaugagugaauaaaugu

SEQ ID NO: 2308966 - RNA, 22 nt, Human
auaucaucaguauugaagcauu

SEQ ID NO: 2308967 - RNA, 17 nt, Human
auaucaucaguauugaa

SEQ ID NO: 2308968 - RNA, 21 nt, Human
auaucaacagauaguuguguu

SEQ ID NO: 2308969 - RNA, 16 nt, Human
auaucaaauauauuca

SEQ ID NO: 2308970 - RNA, 14 nt, Human
auaucaaaaagacu

SEQ ID NO: 2308971 - RNA, 15 nt, Human
auagccaaggccaaa

SEQ ID NO: 2308972 - RNA, 21 nt, Human
auagccaaggccaaaggaagc

SEQ ID NO: 2308973 - RNA, 22 nt, Human
auagccacauuuggaauacuuu

SEQ ID NO: 2308974 - RNA, 21 nt, Human
auagccacauuuggaauacuu

SEQ ID NO: 2308975 - RNA, 16 nt, Human
auagccacauuuggaa

SEQ ID NO: 2308976 - RNA, 13 nt, Human
auagccacauuug

SEQ ID NO: 2308977 - RNA, 23 nt, Human
auagccacuuaccuucaauaaag

SEQ ID NO: 2308978 - RNA, 21 nt, Human
auagccacuuaccuucaauaa

SEQ ID NO: 2308979 - RNA, 19 nt, Human
auagccacuuaccuucaau

SEQ ID NO: 2308980 - RNA, 16 nt, Human
auagccaccccagaaa

SEQ ID NO: 2308981 - RNA, 23 nt, Human
auagccacauuuggaauacuuuu

SEQ ID NO: 2308982 - RNA, 22 nt, Human
auagccacaucccuuugaaaca

SEQ ID NO: 2308983 - RNA, 14 nt, Human
auagcccagguccu

SEQ ID NO: 2308984 - RNA, 16 nt, Human
auagcccaucccugcc

SEQ ID NO: 2308985 - RNA, 14 nt, Human
auagcccagaucag

SEQ ID NO: 2308986 - RNA, 13 nt, Human
auagcccagacac

SEQ ID NO: 2308987 - RNA, 17 nt, Human
auagcccagacacagaa

SEQ ID NO: 2308988 - RNA, 12 nt, Human
auagcccagaca

SEQ ID NO: 2308989 - RNA, 18 nt, Human
auagcagcuuauucacaa

SEQ ID NO: 2308990 - RNA, 17 nt, Human
auaguaugguggcuggg

SEQ ID NO: 2308991 - RNA, 18 nt, Human
auaguaugguggcugggu

SEQ ID NO: 2308992 - RNA, 22 nt, Human
auaguauuccauugugugagug

SEQ ID NO: 2308993 - RNA, 21 nt, Human
auaguauuccauugugugagu

SEQ ID NO: 2308994 - RNA, 20 nt, Human
auaguauuugagaguucuaa

SEQ ID NO: 2308995 - RNA, 21 nt, Human
auaguauuugagaguucuaaa

SEQ ID NO: 2308996 - RNA, 18 nt, Human
auagguuguaaauguguu

SEQ ID NO: 2308997 - RNA, 20 nt, Human
auagguugccaauaauacac

SEQ ID NO: 2308998 - RNA, 15 nt, Human
auagguuuaauaauu

SEQ ID NO: 2308999 - RNA, 16 nt, Human
auaggucacuccuggg

SEQ ID NO: 2309000 - RNA, 15 nt, Human
auaggucacuccugg

SEQ ID NO: 2309001 - RNA, 15 nt, Human
auaggucacuggcuc

SEQ ID NO: 2309002 - RNA, 16 nt, Human
auaggucacuggcucu

SEQ ID NO: 2309003 - RNA, 17 nt, Human
auaggucacuggcucuc

SEQ ID NO: 2309004 - RNA, 19 nt, Human
auaggucacuggcucucca

SEQ ID NO: 2309005 - RNA, 20 nt, Human
auaggucacuggcucuccaa

SEQ ID NO: 2309006 - RNA, 21 nt, Human
auaggucacuggcucuccaag

SEQ ID NO: 2309007 - RNA, 17 nt, Human
auagcccaucccugccu

SEQ ID NO: 2309008 - RNA, 18 nt, Human
auagcccaucccugccug

SEQ ID NO: 2309009 - RNA, 21 nt, Human
auagguauaaguggugugugu

SEQ ID NO: 2309010 - RNA, 23 nt, Human
auaggucagugaggcccagggag

SEQ ID NO: 2309011 - RNA, 22 nt, Human
auaggucacuggcucuccaagu

SEQ ID NO: 2309012 - RNA, 14 nt, Human
auaggugcuacaaa

SEQ ID NO: 2309013 - RNA, 13 nt, Human
auagguggccucu

SEQ ID NO: 2309014 - RNA, 23 nt, Human
auaggugcuacaaaaacacagca

SEQ ID NO: 2309015 - RNA, 21 nt, Human
auaggugcuacaaaaacacag

SEQ ID NO: 2309016 - RNA, 15 nt, Human
auaggugcuacaaaa

SEQ ID NO: 2309017 - RNA, 13 nt, Human
auauagagauguu

SEQ ID NO: 2309018 - RNA, 14 nt, Human
auauagagauguuu

SEQ ID NO: 2309019 - RNA, 22 nt, Human
auauacuuuuuucuuauuuaac

SEQ ID NO: 2309020 - RNA, 15 nt, Human
auauagaacagugcu

SEQ ID NO: 2309021 - RNA, 11 nt, Human
auauacuuuuu

SEQ ID NO: 2309022 - RNA, 20 nt, Human
auauacuuuuuuuucuuuaa

SEQ ID NO: 2309023 - RNA, 22 nt, Human
auauagagauguuuuuaaaagu

SEQ ID NO: 2309024 - RNA, 15 nt, Human
auauagagauguuuu

SEQ ID NO: 2309025 - RNA, 16 nt, Human
auauagagauguuuuu

SEQ ID NO: 2309026 - RNA, 23 nt, Human
auauagaucaguuauaaguagca

SEQ ID NO: 2309027 - RNA, 23 nt, Human
auaguauuugagaguucuaaauu

SEQ ID NO: 2309028 - RNA, 14 nt, Human
auagucaaauugug

SEQ ID NO: 2309029 - RNA, 22 nt, Human
auauacucuagaugaaguuuua

SEQ ID NO: 2309030 - RNA, 19 nt, Human
auagucaaaccauaaacuu

SEQ ID NO: 2309031 - RNA, 20 nt, Human
auagucaaaccauaaacuuc

SEQ ID NO: 2309032 - RNA, 22 nt, Human
auagucaaaccauaaacuucau

SEQ ID NO: 2309033 - RNA, 13 nt, Human
auauacuguaaag

SEQ ID NO: 2309034 - RNA, 12 nt, Human
auauacuguaaa

SEQ ID NO: 2309035 - RNA, 11 nt, Human
auauacuguaa

SEQ ID NO: 2309036 - RNA, 10 nt, Human
auauacugua

SEQ ID NO: 2309037 - RNA, 21 nt, Human
auauacuuguggacuaaaaga

SEQ ID NO: 2309038 - RNA, 14 nt, Human
auauacuuguggac

SEQ ID NO: 2309039 - RNA, 15 nt, Human
auauacuuguggacu

SEQ ID NO: 2309040 - RNA, 24 nt, Human
auauacuguaaagaaagagagaaa

SEQ ID NO: 2309041 - RNA, 15 nt, Human
auauacuuaaaugga

SEQ ID NO: 2309042 - RNA, 23 nt, Human
auauacuguaaagaaagagagaa

SEQ ID NO: 2309043 - RNA, 22 nt, Human
auauacuguaaagaaagagaga

SEQ ID NO: 2309044 - RNA, 21 nt, Human
auauacuguaaagaaagagag

SEQ ID NO: 2309045 - RNA, 20 nt, Human
auauacuguaaagaaagaga

SEQ ID NO: 2309046 - RNA, 19 nt, Human
auauacuguaaagaaagag

SEQ ID NO: 2309047 - RNA, 18 nt, Human
auauacuguaaagaaaga

SEQ ID NO: 2309048 - RNA, 15 nt, Human
auauacuguaaagaa

SEQ ID NO: 2309049 - RNA, 14 nt, Human
auauacuguaaaga

SEQ ID NO: 2309050 - RNA, 14 nt, Human
auaaagcccuggga

SEQ ID NO: 2309051 - RNA, 20 nt, Human
auaaagcccugggaucacug

SEQ ID NO: 2309052 - RNA, 18 nt, Human
auaaagcauuuauaaauu

SEQ ID NO: 2309053 - RNA, 12 nt, Human
auaaagccacug

SEQ ID NO: 2309054 - RNA, 14 nt, Human
auaaagcauuuaua

SEQ ID NO: 2309055 - RNA, 14 nt, Human
auaaagccugcuuu

SEQ ID NO: 2309056 - RNA, 20 nt, Human
auaaagccuguuuugucuuu

SEQ ID NO: 2309057 - RNA, 16 nt, Human
auaaagccacugaaaa

SEQ ID NO: 2309058 - RNA, 23 nt, Human
auaaagcaauuuuccuugaagcc

SEQ ID NO: 2309059 - RNA, 15 nt, Human
auaaagcaggcagaa

SEQ ID NO: 2309060 - RNA, 20 nt, Human
auaaagccuuggauguauau

SEQ ID NO: 2309061 - RNA, 18 nt, Human
auaaagccuguauucuca

SEQ ID NO: 2309062 - RNA, 20 nt, Human
auaaaggaaaaaagagaagu

SEQ ID NO: 2309063 - RNA, 18 nt, Human
auaaagcuguguggcagu

SEQ ID NO: 2309064 - RNA, 13 nt, Human
auaaaggauguga

SEQ ID NO: 2309065 - RNA, 22 nt, Human
auaaaggaugugauuguggaau

SEQ ID NO: 2309066 - RNA, 21 nt, Human
auaaaggaugugauuguggaa

SEQ ID NO: 2309067 - RNA, 17 nt, Human
auaaaggaugugauugu

SEQ ID NO: 2309068 - RNA, 14 nt, Human
auaaaggaugugau

SEQ ID NO: 2309069 - RNA, 12 nt, Human
auaaagacaccu

SEQ ID NO: 2309070 - RNA, 23 nt, Human
auaaagaagcaauaaagaagagu

SEQ ID NO: 2309071 - RNA, 15 nt, Human
auaaagaacaaggua

SEQ ID NO: 2309072 - RNA, 17 nt, Human
auaaagaaauugcaaua

SEQ ID NO: 2309073 - RNA, 21 nt, Human
auaaagaacaagguaguuuuu

SEQ ID NO: 2309074 - RNA, 14 nt, Human
auaaagaagauguu

SEQ ID NO: 2309075 - RNA, 20 nt, Human
auaaagcaauuuuccuugaa

SEQ ID NO: 2309076 - RNA, 21 nt, Human
auaaagcaauuuuccuugaag

SEQ ID NO: 2309077 - RNA, 13 nt, Human
auaaagcagcguu

SEQ ID NO: 2309078 - RNA, 20 nt, Human
auaaagcagcguuucuauga

SEQ ID NO: 2309079 - RNA, 19 nt, Human
auaaagcagcguuucuaug

SEQ ID NO: 2309080 - RNA, 18 nt, Human
auaaagcagcguuucuau

SEQ ID NO: 2309081 - RNA, 14 nt, Human
auaaagcagcguuu

SEQ ID NO: 2309082 - RNA, 17 nt, Human
auaaaaagugacacagc

SEQ ID NO: 2309083 - RNA, 19 nt, Human
auaaaaagugacacagcag

SEQ ID NO: 2309084 - RNA, 20 nt, Human
auaaaaagugacacagcagc

SEQ ID NO: 2309085 - RNA, 10 nt, Human
auaaaaaguu

SEQ ID NO: 2309086 - RNA, 12 nt, Human
auaaaaaguuaa

SEQ ID NO: 2309087 - RNA, 11 nt, Human
auaaaaaguua

SEQ ID NO: 2309088 - RNA, 22 nt, Human
auaaaaauaaauuugguucuaa

SEQ ID NO: 2309089 - RNA, 14 nt, Human
auaaaaauauugug

SEQ ID NO: 2309090 - RNA, 13 nt, Human
auaaaaauaaauu

SEQ ID NO: 2309091 - RNA, 18 nt, Human
auaaaaaguuaaaaaguu

SEQ ID NO: 2309092 - RNA, 13 nt, Human
auaaaaaguuaaa

SEQ ID NO: 2309093 - RNA, 11 nt, Human
auaaaacuuuu

SEQ ID NO: 2309094 - RNA, 15 nt, Human
auaaaacuuuuuaaa

SEQ ID NO: 2309095 - RNA, 23 nt, Human
auaaacuuuuuuuugagaauggu

SEQ ID NO: 2309096 - RNA, 20 nt, Human
auaaacuuuuuucuuacugu

SEQ ID NO: 2309097 - RNA, 24 nt, Human
auaaacuuuaccuuuuuuauacau

SEQ ID NO: 2309098 - RNA, 16 nt, Human
auaaacuuuaccuuuu

SEQ ID NO: 2309099 - RNA, 21 nt, Human
auaaacuuuaccuuuuuuaua

SEQ ID NO: 2309100 - RNA, 17 nt, Human
auaaaacuuuuuaaaau

SEQ ID NO: 2309101 - RNA, 22 nt, Human
auaaaaauauuguguugugaau

SEQ ID NO: 2309102 - RNA, 16 nt, Human
auaaaaauauguacaa

SEQ ID NO: 2309103 - RNA, 15 nt, Human
auaaaagaaaaaaua

SEQ ID NO: 2309104 - RNA, 19 nt, Human
auaaauuuuuuuuguuuca

SEQ ID NO: 2309105 - RNA, 22 nt, Human
auaaauuuuuuuuguuucauau

SEQ ID NO: 2309106 - RNA, 18 nt, Human
auaaaggauuaaugucaa

SEQ ID NO: 2309107 - RNA, 20 nt, Human
auaacagugcauauuccuuu

SEQ ID NO: 2309108 - RNA, 16 nt, Human
auaacaagaucuuuca

SEQ ID NO: 2309109 - RNA, 14 nt, Human
auaacaagaucuuu

SEQ ID NO: 2309110 - RNA, 15 nt, Human
auaacaaccuggaga

SEQ ID NO: 2309111 - RNA, 19 nt, Human
auaaaggccccaaauacca

SEQ ID NO: 2309112 - RNA, 14 nt, Human
auaacaacuucaua

SEQ ID NO: 2309113 - RNA, 18 nt, Human
auaaggaaagcaauaaau

SEQ ID NO: 2309114 - RNA, 22 nt, Human
auaaggaucagaacagcagagg

SEQ ID NO: 2309115 - RNA, 20 nt, Human
auaaggaucagaacagcaga

SEQ ID NO: 2309116 - RNA, 14 nt, Human
auaaggaucagaac

SEQ ID NO: 2309117 - RNA, 19 nt, Human
auaaggccauaaaacaggu

SEQ ID NO: 2309118 - RNA, 18 nt, Human
auaaugcuguugccucau

SEQ ID NO: 2309119 - RNA, 15 nt, Human
auaaugcuacugucu

SEQ ID NO: 2309120 - RNA, 14 nt, Human
auaauguaagcucu

SEQ ID NO: 2309121 - RNA, 21 nt, Human
auaaugggauuuucuuuucuu

SEQ ID NO: 2309122 - RNA, 16 nt, Human
auaaggccuuaauaug

SEQ ID NO: 2309123 - RNA, 20 nt, Human
auaaugcgugcauaccacuu

SEQ ID NO: 2309124 - RNA, 21 nt, Human
auaaugcgugcauaccacuuu

SEQ ID NO: 2309125 - RNA, 14 nt, Human
auaauguuugcuau

SEQ ID NO: 2309126 - RNA, 12 nt, Human
auaauuaaagug

SEQ ID NO: 2309127 - RNA, 13 nt, Human
auaauuaaagugu

SEQ ID NO: 2309128 - RNA, 15 nt, Human
auaauuaaagugucc

SEQ ID NO: 2309129 - RNA, 13 nt, Human
auaauguuugcua

SEQ ID NO: 2309130 - RNA, 19 nt, Human
auaaugucucugugagacu

SEQ ID NO: 2309131 - RNA, 15 nt, Human
auaaugucucuguga

SEQ ID NO: 2309132 - RNA, 16 nt, Human
auaauuaaagugucca

SEQ ID NO: 2309133 - RNA, 20 nt, Human
auaauuaaaguguccauuga

SEQ ID NO: 2309134 - RNA, 20 nt, Human
auaauuaaauuuugaguucu

SEQ ID NO: 2309135 - RNA, 14 nt, Human
auacacacauaugu

SEQ ID NO: 2309136 - RNA, 13 nt, Human
auacacacaguua

SEQ ID NO: 2309137 - RNA, 23 nt, Human
auacacacacacacacagccaca

SEQ ID NO: 2309138 - RNA, 22 nt, Human
auacacacacacacacagccac

SEQ ID NO: 2309139 - RNA, 14 nt, Human
auaauguauuguug

SEQ ID NO: 2309140 - RNA, 11 nt, Human
auaaugucucu

SEQ ID NO: 2309141 - RNA, 23 nt, Human
auaauguuucaaacauauauaac

SEQ ID NO: 2309142 - RNA, 15 nt, Human
auaauguaagcucua

SEQ ID NO: 2309143 - RNA, 22 nt, Human
auaauguauaaagaacaaggua

SEQ ID NO: 2309144 - RNA, 18 nt, Human
auaaugggcuuagagcag

SEQ ID NO: 2309145 - RNA, 20 nt, Human
auacaccacuacauucuguu

SEQ ID NO: 2309146 - RNA, 19 nt, Human
auacaccacuacauucugu

SEQ ID NO: 2309147 - RNA, 21 nt, Human
auacaccacuacauucuguua

SEQ ID NO: 2309148 - RNA, 19 nt, Human
auacacacauaugucauau

SEQ ID NO: 2309149 - RNA, 20 nt, Human
auacacacucaaaucaagaa

SEQ ID NO: 2309150 - RNA, 18 nt, Human
auacaccacuacauucug

SEQ ID NO: 2309151 - RNA, 18 nt, Human
auacacacucaaaucaag

SEQ ID NO: 2309152 - RNA, 17 nt, Human
auacacacucaaaucaa

SEQ ID NO: 2309153 - RNA, 18 nt, Human
auaccucaaccuauggua

SEQ ID NO: 2309154 - RNA, 15 nt, Human
auaccucaaccuaug

SEQ ID NO: 2309155 - RNA, 15 nt, Human
auaccucacccugcu

SEQ ID NO: 2309156 - RNA, 17 nt, Human
auaccugucccccugac

SEQ ID NO: 2309157 - RNA, 12 nt, Human
auaccucugugu

SEQ ID NO: 2309158 - RNA, 13 nt, Human
auaccucugugug

SEQ ID NO: 2309159 - RNA, 18 nt, Human
auaccugucccccugaca

SEQ ID NO: 2309160 - RNA, 11 nt, Human
auacccacccc

SEQ ID NO: 2309161 - RNA, 18 nt, Human
auacccaaauccucucca

SEQ ID NO: 2309162 - RNA, 23 nt, Human
auacccaaauccucuccagcuau

SEQ ID NO: 2309163 - RNA, 20 nt, Human
auaccauuuuuuaaggaaac

SEQ ID NO: 2309164 - RNA, 22 nt, Human
auaccauuuuuuaaggaaacaa

SEQ ID NO: 2309165 - RNA, 14 nt, Human
auacccaaauccuc

SEQ ID NO: 2309166 - RNA, 12 nt, Human
auacccaccccc

SEQ ID NO: 2309167 - RNA, 21 nt, Human
auaccuacauguauuuguuug

SEQ ID NO: 2309168 - RNA, 17 nt, Human
auaccuacauguauuug

SEQ ID NO: 2309169 - RNA, 20 nt, Human
auaccuuccuucccugggcu

SEQ ID NO: 2309170 - RNA, 14 nt, Human
auaccucugugugc

SEQ ID NO: 2309171 - RNA, 16 nt, Human
auaccugugccucggc

SEQ ID NO: 2309172 - RNA, 15 nt, Human
agggaccuugaaggg

SEQ ID NO: 2309173 - RNA, 15 nt, Human
agggacgccuggggg

SEQ ID NO: 2309174 - RNA, 13 nt, Human
agggacgccuggg

SEQ ID NO: 2309175 - RNA, 22 nt, Human
agggacgccugggggugccagg

SEQ ID NO: 2309176 - RNA, 18 nt, Human
agggacgccugggggugc

SEQ ID NO: 2309177 - RNA, 23 nt, Human
agggacgccugggggugccagga

SEQ ID NO: 2309178 - RNA, 15 nt, Human
agggaccucucccag

SEQ ID NO: 2309179 - RNA, 13 nt, Human
agggaccucuccc

SEQ ID NO: 2309180 - RNA, 16 nt, Human
agggaccucucccagg

SEQ ID NO: 2309181 - RNA, 14 nt, Human
agggaccuugaagg

SEQ ID NO: 2309182 - RNA, 17 nt, Human
aggcugucuggccaggc

SEQ ID NO: 2309183 - RNA, 22 nt, Human
agggacagaugaaugccgugga

SEQ ID NO: 2309184 - RNA, 23 nt, Human
agggacagaggggguggccuccc

SEQ ID NO: 2309185 - RNA, 21 nt, Human
aggcuguccuuacccaucugc

SEQ ID NO: 2309186 - RNA, 19 nt, Human
aggcuguccuuacccaucu

SEQ ID NO: 2309187 - RNA, 21 nt, Human
aggcuguccuguacauugugg

SEQ ID NO: 2309188 - RNA, 15 nt, Human
aggcugucuggccag

SEQ ID NO: 2309189 - RNA, 22 nt, Human
agggacagaggggguggccucc

SEQ ID NO: 2309190 - RNA, 18 nt, Human
aggcuggugggaggggcg

SEQ ID NO: 2309191 - RNA, 15 nt, Human
aggcuguccuguaca

SEQ ID NO: 2309192 - RNA, 16 nt, Human
aggcuguccuguacau

SEQ ID NO: 2309193 - RNA, 21 nt, Human
aggcugucaauuacaggaagu

SEQ ID NO: 2309194 - RNA, 15 nt, Human
aggcuagaucaugaa

SEQ ID NO: 2309195 - RNA, 20 nt, Human
aggcuagagugcaguggcau

SEQ ID NO: 2309196 - RNA, 16 nt, Human
aggcugguggcccagg

SEQ ID NO: 2309197 - RNA, 17 nt, Human
aggcugguggcccagga

SEQ ID NO: 2309198 - RNA, 12 nt, Human
aggcugguggga

SEQ ID NO: 2309199 - RNA, 14 nt, Human
aggcuggugggagg

SEQ ID NO: 2309200 - RNA, 17 nt, Human
aggcuggugggaggggc

SEQ ID NO: 2309201 - RNA, 17 nt, Human
aggcuagauguauguac

SEQ ID NO: 2309202 - RNA, 15 nt, Human
aggcuagauguaugu

SEQ ID NO: 2309203 - RNA, 16 nt, Human
aggcuagauguaugua

SEQ ID NO: 2309204 - RNA, 13 nt, Human
aggcuguauccca

SEQ ID NO: 2309205 - RNA, 18 nt, Human
aggcuguaucccaugagc

SEQ ID NO: 2309206 - RNA, 20 nt, Human
aggcugucaauuacaggaag

SEQ ID NO: 2309207 - RNA, 22 nt, Human
aggcugguucggauuuggggug

SEQ ID NO: 2309208 - RNA, 13 nt, Human
aggcccuuccucu

SEQ ID NO: 2309209 - RNA, 15 nt, Human
aggcccuuccucucc

SEQ ID NO: 2309210 - RNA, 17 nt, Human
aggcccuuccucuccac

SEQ ID NO: 2309211 - RNA, 18 nt, Human
aggcccuuccucuccacu

SEQ ID NO: 2309212 - RNA, 20 nt, Human
aggcccuucucuccagcccc

SEQ ID NO: 2309213 - RNA, 21 nt, Human
aggcccuucucuccagccccu

SEQ ID NO: 2309214 - RNA, 22 nt, Human
aggcccuuauuuucaagaaacu

SEQ ID NO: 2309215 - RNA, 20 nt, Human
aggcccuuauuuucaagaaa

SEQ ID NO: 2309216 - RNA, 16 nt, Human
aggcccuuauuuucaa

SEQ ID NO: 2309217 - RNA, 19 nt, Human
aggccgagaagcaagaaag

SEQ ID NO: 2309218 - RNA, 15 nt, Human
aggccgagaagcaag

SEQ ID NO: 2309219 - RNA, 17 nt, Human
aggccgagaagccagug

SEQ ID NO: 2309220 - RNA, 16 nt, Human
aggccgagaagccagu

SEQ ID NO: 2309221 - RNA, 12 nt, Human
aggccgcagcuc

SEQ ID NO: 2309222 - RNA, 13 nt, Human
aggccgcagcucu

SEQ ID NO: 2309223 - RNA, 16 nt, Human
aggccgcagcucuugc

SEQ ID NO: 2309224 - RNA, 14 nt, Human
aggccgaagcucug

SEQ ID NO: 2309225 - RNA, 15 nt, Human
aggccgaagcucugg

SEQ ID NO: 2309226 - RNA, 16 nt, Human
aggccgaagcucuggc

SEQ ID NO: 2309227 - RNA, 17 nt, Human
aggccgaagcucuggcu

SEQ ID NO: 2309228 - RNA, 19 nt, Human
aggccgaagcucuggcuga

SEQ ID NO: 2309229 - RNA, 23 nt, Human
aggccgaagcucuggcugaaccc

SEQ ID NO: 2309230 - RNA, 24 nt, Human
aggccgaagcucuggcugaacccu

SEQ ID NO: 2309231 - RNA, 17 nt, Human
aggccgcagcucuugcc

SEQ ID NO: 2309232 - RNA, 18 nt, Human
aggccgcagcucuugccc

SEQ ID NO: 2309233 - RNA, 22 nt, Human
aggccgaagaaggguccuuccc

SEQ ID NO: 2309234 - RNA, 18 nt, Human
aggccgaagaaggguccu

SEQ ID NO: 2309235 - RNA, 17 nt, Human
aggccgaagaagggucc

SEQ ID NO: 2309236 - RNA, 16 nt, Human
aggcccuuuccucagg

SEQ ID NO: 2309237 - RNA, 17 nt, Human
aggcccuuuccucaggc

SEQ ID NO: 2309238 - RNA, 22 nt, Human
aggcccuucucuccagccccug

SEQ ID NO: 2309239 - RNA, 23 nt, Human
aggcccuucucuccagccccugg

SEQ ID NO: 2309240 - RNA, 13 nt, Human
aggcgugaggaug

SEQ ID NO: 2309241 - RNA, 14 nt, Human
aggcgugaggaugg

SEQ ID NO: 2309242 - RNA, 21 nt, Human
aggcgugagccaccgugccug

SEQ ID NO: 2309243 - RNA, 21 nt, Human
aggcgucuguauauuuuggga

SEQ ID NO: 2309244 - RNA, 18 nt, Human
aggcgucuguauauuuug

SEQ ID NO: 2309245 - RNA, 19 nt, Human
aggcguucuucgaggugga

SEQ ID NO: 2309246 - RNA, 15 nt, Human
aggcguggagcugcc

SEQ ID NO: 2309247 - RNA, 16 nt, Human
aggcguggagcugccu

SEQ ID NO: 2309248 - RNA, 17 nt, Human
aggcguggagcugccug

SEQ ID NO: 2309249 - RNA, 18 nt, Human
aggcguggagcugccuga

SEQ ID NO: 2309250 - RNA, 18 nt, Human
aggcguucuucgaggugg

SEQ ID NO: 2309251 - RNA, 23 nt, Human
aggcuacuguaaggcaaucaugg

SEQ ID NO: 2309252 - RNA, 17 nt, Human
aggcuacugucagcucc

SEQ ID NO: 2309253 - RNA, 21 nt, Human
aggcuagaaccaccugccuau

SEQ ID NO: 2309254 - RNA, 21 nt, Human
aggcuaaacauccaauauuuu

SEQ ID NO: 2309255 - RNA, 13 nt, Human
aggcuaaacaucc

SEQ ID NO: 2309256 - RNA, 19 nt, Human
aggcuagaaccuggcaagc

SEQ ID NO: 2309257 - RNA, 13 nt, Human
agggucaggaagg

SEQ ID NO: 2309258 - RNA, 22 nt, Human
agggucaggaaggaugagcauu

SEQ ID NO: 2309259 - RNA, 21 nt, Human
agggucaggaaggaugagcau

SEQ ID NO: 2309260 - RNA, 21 nt, Human
agggucagagaggagucagag

SEQ ID NO: 2309261 - RNA, 13 nt, Human
agggucagagagg

SEQ ID NO: 2309262 - RNA, 21 nt, Human
agggucagacgccugaggaac

SEQ ID NO: 2309263 - RNA, 22 nt, Human
agggucauaucacucaggcccu

SEQ ID NO: 2309264 - RNA, 15 nt, Human
agggucaggagaggg

SEQ ID NO: 2309265 - RNA, 14 nt, Human
agggucaggagagg

SEQ ID NO: 2309266 - RNA, 18 nt, Human
agggucaggagaggggca

SEQ ID NO: 2309267 - RNA, 19 nt, Human
aggguaucaggugcugcca

SEQ ID NO: 2309268 - RNA, 23 nt, Human
aggggccuaggccucagccagag

SEQ ID NO: 2309269 - RNA, 19 nt, Human
aggggccuaggccucagcc

SEQ ID NO: 2309270 - RNA, 16 nt, Human
aggggccuaggccuca

SEQ ID NO: 2309271 - RNA, 18 nt, Human
aggguaucaggugcugcc

SEQ ID NO: 2309272 - RNA, 21 nt, Human
aggguaucaggugcugccauc

SEQ ID NO: 2309273 - RNA, 15 nt, Human
aggguaucuggugac

SEQ ID NO: 2309274 - RNA, 19 nt, Human
aggggccucuuaugggcug

SEQ ID NO: 2309275 - RNA, 20 nt, Human
aggggccucuuaugggcugg

SEQ ID NO: 2309276 - RNA, 21 nt, Human
aggggccucuuaugggcuggg

SEQ ID NO: 2309277 - RNA, 23 nt, Human
aggguccacaggaagugaagaau

SEQ ID NO: 2309278 - RNA, 12 nt, Human
agggucccaagc

SEQ ID NO: 2309279 - RNA, 13 nt, Human
agggucccaagcu

SEQ ID NO: 2309280 - RNA, 17 nt, Human
agggucccaagcugggc

SEQ ID NO: 2309281 - RNA, 18 nt, Human
aggguccccaccugggac

SEQ ID NO: 2309282 - RNA, 12 nt, Human
agggucccucug

SEQ ID NO: 2309283 - RNA, 18 nt, Human
agggucccaagcugggcc

SEQ ID NO: 2309284 - RNA, 19 nt, Human
agggucccaagcugggccc

SEQ ID NO: 2309285 - RNA, 20 nt, Human
agggucccauuucucacuga

SEQ ID NO: 2309286 - RNA, 15 nt, Human
aggguccccaccugg

SEQ ID NO: 2309287 - RNA, 11 nt, Human
agggucccugg

SEQ ID NO: 2309288 - RNA, 14 nt, Human
agggucccucugug

SEQ ID NO: 2309289 - RNA, 15 nt, Human
agggucccucugugu

SEQ ID NO: 2309290 - RNA, 18 nt, Human
agggucccucuguguauu

SEQ ID NO: 2309291 - RNA, 20 nt, Human
agggucccucuguguauuug

SEQ ID NO: 2309292 - RNA, 12 nt, Human
agggucccuggg

SEQ ID NO: 2309293 - RNA, 17 nt, Human
aggguccuggcuccuga

SEQ ID NO: 2309294 - RNA, 20 nt, Human
aggguccuggcuccugaggg

SEQ ID NO: 2309295 - RNA, 19 nt, Human
aggguccuggcuccugagg

SEQ ID NO: 2309296 - RNA, 15 nt, Human
aggguccuggggaac

SEQ ID NO: 2309297 - RNA, 12 nt, Human
aggguccugggg

SEQ ID NO: 2309298 - RNA, 17 nt, Human
aggguccuucccucucc

SEQ ID NO: 2309299 - RNA, 16 nt, Human
aggguccuucccucuc

SEQ ID NO: 2309300 - RNA, 21 nt, Human
aggguccuggcuccugagggg

SEQ ID NO: 2309301 - RNA, 14 nt, Human
aggguccuucccuc

SEQ ID NO: 2309302 - RNA, 23 nt, Human
aggguccuggggaaccugacccc

SEQ ID NO: 2309303 - RNA, 21 nt, Human
aggguccuggggaaccugacc

SEQ ID NO: 2309304 - RNA, 20 nt, Human
agguggagguugcagugagc

SEQ ID NO: 2309305 - RNA, 20 nt, Human
agguggaggcugcagugagc

SEQ ID NO: 2309306 - RNA, 17 nt, Human
agguggaucaccugagg

SEQ ID NO: 2309307 - RNA, 16 nt, Human
agguggaucacagagg

SEQ ID NO: 2309308 - RNA, 14 nt, Human
agguggacacacaa

SEQ ID NO: 2309309 - RNA, 16 nt, Human
agguggacuggaaggg

SEQ ID NO: 2309310 - RNA, 11 nt, Human
agguggagcaa

SEQ ID NO: 2309311 - RNA, 18 nt, Human
agguggagcaaagugagg

SEQ ID NO: 2309312 - RNA, 12 nt, Human
agguguuuauac

SEQ ID NO: 2309313 - RNA, 14 nt, Human
agguguuuauacag

SEQ ID NO: 2309314 - RNA, 24 nt, Human
agguuaaggcugaggaaaggccag

SEQ ID NO: 2309315 - RNA, 17 nt, Human
agguuaaggcugaggaa

SEQ ID NO: 2309316 - RNA, 16 nt, Human
agguuaaggcugagga

SEQ ID NO: 2309317 - RNA, 16 nt, Human
agguuacaacagauuu

SEQ ID NO: 2309318 - RNA, 19 nt, Human
agguuacaacagauuugug

SEQ ID NO: 2309319 - RNA, 21 nt, Human
agguuacaagccugcacaaua

SEQ ID NO: 2309320 - RNA, 15 nt, Human
agguuacaagccugc

SEQ ID NO: 2309321 - RNA, 21 nt, Human
agguuacaacagauuugugaa

SEQ ID NO: 2309322 - RNA, 22 nt, Human
agguuacaacagauuugugaac

SEQ ID NO: 2309323 - RNA, 23 nt, Human
agguuacaacagauuugugaacu

SEQ ID NO: 2309324 - RNA, 24 nt, Human
agguuacaacagauuugugaacuc

SEQ ID NO: 2309325 - RNA, 22 nt, Human
agguuaaaaaaaggcauuguuu

SEQ ID NO: 2309326 - RNA, 21 nt, Human
agguggaagcccuccuuccac

SEQ ID NO: 2309327 - RNA, 20 nt, Human
agguggaagcccuccuucca

SEQ ID NO: 2309328 - RNA, 19 nt, Human
agguggaagcccuccuucc

SEQ ID NO: 2309329 - RNA, 17 nt, Human
agguggaagcccuccuu

SEQ ID NO: 2309330 - RNA, 15 nt, Human
aggugcucauuggcu

SEQ ID NO: 2309331 - RNA, 18 nt, Human
aggugcucacaccccauu

SEQ ID NO: 2309332 - RNA, 21 nt, Human
agguggaauuauuuuaaaaga

SEQ ID NO: 2309333 - RNA, 17 nt, Human
agguggaauuauuuuaa

SEQ ID NO: 2309334 - RNA, 16 nt, Human
aggucuucagccauca

SEQ ID NO: 2309335 - RNA, 20 nt, Human
aggugcuacacccuuuucca

SEQ ID NO: 2309336 - RNA, 22 nt, Human
agguaacagaacagcuucaggu

SEQ ID NO: 2309337 - RNA, 21 nt, Human
aggugcuacacccuuuuccag

SEQ ID NO: 2309338 - RNA, 23 nt, Human
aggugcuaggaacacuccuucac

SEQ ID NO: 2309339 - RNA, 19 nt, Human
aggugcuaggaacacuccu

SEQ ID NO: 2309340 - RNA, 22 nt, Human
aggugcuaggaacacuccuuca

SEQ ID NO: 2309341 - RNA, 24 nt, Human
aggugcuacaaaaacacagcaagg

SEQ ID NO: 2309342 - RNA, 23 nt, Human
aggugcuacaaaaacacagcaag

SEQ ID NO: 2309343 - RNA, 12 nt, Human
agguuccucugc

SEQ ID NO: 2309344 - RNA, 23 nt, Human
agguucccuuugacgccauccca

SEQ ID NO: 2309345 - RNA, 23 nt, Human
agguuccgcuuggagcagagggg

SEQ ID NO: 2309346 - RNA, 21 nt, Human
agguuccgcuuggagcagagg

SEQ ID NO: 2309347 - RNA, 18 nt, Human
agguuccgcuuggagcag

SEQ ID NO: 2309348 - RNA, 19 nt, Human
agguuauuuuaguuucugu

SEQ ID NO: 2309349 - RNA, 20 nt, Human
agguuauuuuaguuucuguu

SEQ ID NO: 2309350 - RNA, 19 nt, Human
agguuauaggucacuccug

SEQ ID NO: 2309351 - RNA, 14 nt, Human
agguuaucgaaaua

SEQ ID NO: 2309352 - RNA, 17 nt, Human
agguuauaggucacucc

SEQ ID NO: 2309353 - RNA, 14 nt, Human
agguuauaggucac

SEQ ID NO: 2309354 - RNA, 16 nt, Human
agguuaucugucccag

SEQ ID NO: 2309355 - RNA, 17 nt, Human
agguuaucgaaauaaca

SEQ ID NO: 2309356 - RNA, 18 nt, Human
agguuaucgaaauaacaa

SEQ ID NO: 2309357 - RNA, 19 nt, Human
agguuaucgaaauaacaau

SEQ ID NO: 2309358 - RNA, 20 nt, Human
agguuaucgaaauaacaaug

SEQ ID NO: 2309359 - RNA, 17 nt, Human
agguuacccuguaacau

SEQ ID NO: 2309360 - RNA, 15 nt, Human
agguuaccaagaagc

SEQ ID NO: 2309361 - RNA, 16 nt, Human
agguuaccaagaagcc

SEQ ID NO: 2309362 - RNA, 21 nt, Human
agguuacccuguaacaugcaa

SEQ ID NO: 2309363 - RNA, 21 nt, Human
agguuaggaguucgagaccag

SEQ ID NO: 2309364 - RNA, 18 nt, Human
agguuagaaccuagaagg

SEQ ID NO: 2309365 - RNA, 20 nt, Human
agguuagaaccuagaagggc

SEQ ID NO: 2309366 - RNA, 22 nt, Human
agguuagauuuuguauucaggg

SEQ ID NO: 2309367 - RNA, 18 nt, Human
agguuaggauuuaacagu

SEQ ID NO: 2309368 - RNA, 15 nt, Human
agguucaaagauauu

SEQ ID NO: 2309369 - RNA, 17 nt, Human
agguuaucugucccagg

SEQ ID NO: 2309370 - RNA, 15 nt, Human
agguuauuuauuuaa

SEQ ID NO: 2309371 - RNA, 16 nt, Human
agguuauuuauuuaaa

SEQ ID NO: 2309372 - RNA, 17 nt, Human
agguuauuuuaguuucu

SEQ ID NO: 2309373 - RNA, 14 nt, Human
agguucaaagauau

SEQ ID NO: 2309374 - RNA, 22 nt, Human
agguucccuuugacgccauccc

SEQ ID NO: 2309375 - RNA, 13 nt, Human
agguucccuuuga

SEQ ID NO: 2309376 - RNA, 14 nt, Human
aggucugcucggcc

SEQ ID NO: 2309377 - RNA, 22 nt, Human
aggucuggagaagcucccagga

SEQ ID NO: 2309378 - RNA, 18 nt, Human
aggugcuacaaaaacaca

SEQ ID NO: 2309379 - RNA, 23 nt, Human
aggucuguucuuuccaaaguaca

SEQ ID NO: 2309380 - RNA, 22 nt, Human
aggucuguucuuuccaaaguac

SEQ ID NO: 2309381 - RNA, 22 nt, Human
aggugcuacaaaaacacagcaa

SEQ ID NO: 2309382 - RNA, 21 nt, Human
aggugcuacaaaaacacagca

SEQ ID NO: 2309383 - RNA, 20 nt, Human
aggugcuacaaaaacacagc

SEQ ID NO: 2309384 - RNA, 19 nt, Human
aggugcuacaaaaacacag

SEQ ID NO: 2309385 - RNA, 21 nt, Human
aggucugaaauggagguccuu

SEQ ID NO: 2309386 - RNA, 15 nt, Human
aggucugaaauggag

SEQ ID NO: 2309387 - RNA, 13 nt, Human
aggucugaaaugg

SEQ ID NO: 2309388 - RNA, 16 nt, Human
aggucucuugagggag

SEQ ID NO: 2309389 - RNA, 15 nt, Human
aggucucuugaggga

SEQ ID NO: 2309390 - RNA, 15 nt, Human
aggucucuuccccuc

SEQ ID NO: 2309391 - RNA, 12 nt, Human
aggucucuuccc

SEQ ID NO: 2309392 - RNA, 13 nt, Human
aggucucuucccc

SEQ ID NO: 2309393 - RNA, 15 nt, Human
aggucucugccggcu

SEQ ID NO: 2309394 - RNA, 16 nt, Human
aggucucugccggcuc

SEQ ID NO: 2309395 - RNA, 19 nt, Human
aggucucugccggcucuuu

SEQ ID NO: 2309396 - RNA, 16 nt, Human
aggucucuuccccucu

SEQ ID NO: 2309397 - RNA, 20 nt, Human
aggucugacacgucugccua

SEQ ID NO: 2309398 - RNA, 18 nt, Human
aggucuguucuuuccaaa

SEQ ID NO: 2309399 - RNA, 12 nt, Human
agguacacucuu

SEQ ID NO: 2309400 - RNA, 16 nt, Human
agguacacagcucuag

SEQ ID NO: 2309401 - RNA, 16 nt, Human
aggucccuaauaaagc

SEQ ID NO: 2309402 - RNA, 17 nt, Human
aggucucgcugaugcug

SEQ ID NO: 2309403 - RNA, 19 nt, Human
aggucucgcugaugcuggg

SEQ ID NO: 2309404 - RNA, 20 nt, Human
aggucucgcugaugcugggc

SEQ ID NO: 2309405 - RNA, 21 nt, Human
aggucucgcugaugcugggcu

SEQ ID NO: 2309406 - RNA, 22 nt, Human
aggucucgcugaugcugggcug

SEQ ID NO: 2309407 - RNA, 23 nt, Human
aggucucgcugaugcugggcugg

SEQ ID NO: 2309408 - RNA, 21 nt, Human
aggucucggacuaagccuacc

SEQ ID NO: 2309409 - RNA, 13 nt, Human
aggucccuaauaa

SEQ ID NO: 2309410 - RNA, 15 nt, Human
aggucccuaauaaag

SEQ ID NO: 2309411 - RNA, 16 nt, Human
agguaaugugaauaaa

SEQ ID NO: 2309412 - RNA, 16 nt, Human
agguaauuucuugugc

SEQ ID NO: 2309413 - RNA, 17 nt, Human
agguaaugagggacugg

SEQ ID NO: 2309414 - RNA, 13 nt, Human
agguaaugaggga

SEQ ID NO: 2309415 - RNA, 14 nt, Human
agguaaugagggac

SEQ ID NO: 2309416 - RNA, 17 nt, Human
agguacaaccuguucug

SEQ ID NO: 2309417 - RNA, 19 nt, Human
agguaauuucuugugccuc

SEQ ID NO: 2309418 - RNA, 12 nt, Human
aggucccuaaua

SEQ ID NO: 2309419 - RNA, 11 nt, Human
aggucccuaau

SEQ ID NO: 2309420 - RNA, 21 nt, Human
agguaaucgaccugccucggc

SEQ ID NO: 2309421 - RNA, 18 nt, Human
agguaacagaacagcuuc

SEQ ID NO: 2309422 - RNA, 19 nt, Human
agguaacagaacagcuuca

SEQ ID NO: 2309423 - RNA, 21 nt, Human
agguaacagaacagcuucagg

SEQ ID NO: 2309424 - RNA, 19 nt, Human
agguaaucgaccugccucg

SEQ ID NO: 2309425 - RNA, 13 nt, Human
agguaacagaaca

SEQ ID NO: 2309426 - RNA, 14 nt, Human
agguaacagaacag

SEQ ID NO: 2309427 - RNA, 15 nt, Human
agguaacagaacagc

SEQ ID NO: 2309428 - RNA, 17 nt, Human
agguaacagaacagcuu

SEQ ID NO: 2309429 - RNA, 14 nt, Human
agguaaacaguucu

SEQ ID NO: 2309430 - RNA, 14 nt, Human
agguaaacuccugu

SEQ ID NO: 2309431 - RNA, 15 nt, Human
agguaaacuccuguc

SEQ ID NO: 2309432 - RNA, 23 nt, Human
agguaaaucagacuaugaaguuu

SEQ ID NO: 2309433 - RNA, 19 nt, Human
agguaaaauugaaaggcau

SEQ ID NO: 2309434 - RNA, 13 nt, Human
agguaaacaguuc

SEQ ID NO: 2309435 - RNA, 18 nt, Human
agguaaaucagacuauga

SEQ ID NO: 2309436 - RNA, 17 nt, Human
agguaaaagugugagca

SEQ ID NO: 2309437 - RNA, 20 nt, Human
agguaaaagcaucacaugaa

SEQ ID NO: 2309438 - RNA, 23 nt, Human
agcuuccauuccaagccugacca

SEQ ID NO: 2309439 - RNA, 17 nt, Human
agcuuccccucucuccu

SEQ ID NO: 2309440 - RNA, 22 nt, Human
agcuucccccccaccacaggcc

SEQ ID NO: 2309441 - RNA, 20 nt, Human
agcuucccccccaccacagg

SEQ ID NO: 2309442 - RNA, 22 nt, Human
agcuuccuacccacaccucugc

SEQ ID NO: 2309443 - RNA, 23 nt, Human
agcuucccucccguguguucucc

SEQ ID NO: 2309444 - RNA, 17 nt, Human
agcuuccaguccaaucu

SEQ ID NO: 2309445 - RNA, 22 nt, Human
agcuuccaugauucuauuuaua

SEQ ID NO: 2309446 - RNA, 19 nt, Human
agcuucuguugcugccuca

SEQ ID NO: 2309447 - RNA, 20 nt, Human
agcuucugguacucuccuag

SEQ ID NO: 2309448 - RNA, 21 nt, Human
agcuucugguacucuccuaga

SEQ ID NO: 2309449 - RNA, 23 nt, Human
agcuucugguacucuccuagaga

SEQ ID NO: 2309450 - RNA, 12 nt, Human
agcuucuguccu

SEQ ID NO: 2309451 - RNA, 22 nt, Human
agcuucuggugaccuuccaaga

SEQ ID NO: 2309452 - RNA, 21 nt, Human
agcuucuggugaccuuccaag

SEQ ID NO: 2309453 - RNA, 20 nt, Human
agcuucugcuuuucugcccu

SEQ ID NO: 2309454 - RNA, 21 nt, Human
agcuucugcuuuucugcccug

SEQ ID NO: 2309455 - RNA, 23 nt, Human
agcuucugcuuuucugcccuggc

SEQ ID NO: 2309456 - RNA, 22 nt, Human
agcuucugcuuuucugcccugg

SEQ ID NO: 2309457 - RNA, 14 nt, Human
agcuucugguacuc

SEQ ID NO: 2309458 - RNA, 15 nt, Human
agcuucugguacucu

SEQ ID NO: 2309459 - RNA, 16 nt, Human
agcuucugguacucuc

SEQ ID NO: 2309460 - RNA, 17 nt, Human
agcuucugguacucucc

SEQ ID NO: 2309461 - RNA, 19 nt, Human
agcuucugguacucuccua

SEQ ID NO: 2309462 - RNA, 21 nt, Human
agcugcucagggaaaagcagc

SEQ ID NO: 2309463 - RNA, 23 nt, Human
agcugcucacuaccuccucaggg

SEQ ID NO: 2309464 - RNA, 16 nt, Human
agcugcucagggaaaa

SEQ ID NO: 2309465 - RNA, 23 nt, Human
agcugcgguccacccaggagccc

SEQ ID NO: 2309466 - RNA, 11 nt, Human
agcugcuacaa

SEQ ID NO: 2309467 - RNA, 13 nt, Human
agcugcuacaaag

SEQ ID NO: 2309468 - RNA, 14 nt, Human
agcugcuacaaaga

SEQ ID NO: 2309469 - RNA, 15 nt, Human
agcugcuacaaagaa

SEQ ID NO: 2309470 - RNA, 22 nt, Human
agcugcuacaaagaagacaugu

SEQ ID NO: 2309471 - RNA, 20 nt, Human
agcugcuacaaagaagacau

SEQ ID NO: 2309472 - RNA, 21 nt, Human
agcugcuacaaagaagacaug

SEQ ID NO: 2309473 - RNA, 16 nt, Human
agcugcuacaaagaag

SEQ ID NO: 2309474 - RNA, 17 nt, Human
agcugcuacaaagaaga

SEQ ID NO: 2309475 - RNA, 18 nt, Human
agcugcuacaaagaagac

SEQ ID NO: 2309476 - RNA, 19 nt, Human
agcugcuacaaagaagaca

SEQ ID NO: 2309477 - RNA, 16 nt, Human
agcugcuauagccugg

SEQ ID NO: 2309478 - RNA, 15 nt, Human
agcugcuauagccug

SEQ ID NO: 2309479 - RNA, 21 nt, Human
agcugcuauagccuggggugg

SEQ ID NO: 2309480 - RNA, 18 nt, Human
agcugaaauaugcuggcu

SEQ ID NO: 2309481 - RNA, 12 nt, Human
agcugaaaauau

SEQ ID NO: 2309482 - RNA, 23 nt, Human
agcugaaaaaucacauccuggcc

SEQ ID NO: 2309483 - RNA, 22 nt, Human
agcugaaaaccuaaguccuuua

SEQ ID NO: 2309484 - RNA, 19 nt, Human
agcugaaaaaucacauccu

SEQ ID NO: 2309485 - RNA, 21 nt, Human
agcugaaaaaucacauccugg

SEQ ID NO: 2309486 - RNA, 22 nt, Human
agcugaaaaaucacauccuggc

SEQ ID NO: 2309487 - RNA, 20 nt, Human
agcugaaauaugcuggcugg

SEQ ID NO: 2309488 - RNA, 12 nt, Human
agcugaaauacu

SEQ ID NO: 2309489 - RNA, 13 nt, Human
agcugaaaugcug

SEQ ID NO: 2309490 - RNA, 20 nt, Human
agcugaaaugcugcauuuua

SEQ ID NO: 2309491 - RNA, 16 nt, Human
agcugaaaugcugcau

SEQ ID NO: 2309492 - RNA, 18 nt, Human
agcugaaaugcugcauuu

SEQ ID NO: 2309493 - RNA, 22 nt, Human
agcugaacaauaggcuguuccc

SEQ ID NO: 2309494 - RNA, 21 nt, Human
agcugaacaauaggcuguucc

SEQ ID NO: 2309495 - RNA, 15 nt, Human
agcugagcagggaga

SEQ ID NO: 2309496 - RNA, 13 nt, Human
agcugagcaggga

SEQ ID NO: 2309497 - RNA, 15 nt, Human
agcugagcaccaggg

SEQ ID NO: 2309498 - RNA, 14 nt, Human
agcugagagacuuu

SEQ ID NO: 2309499 - RNA, 21 nt, Human
agcugcgguccacccaggagc

SEQ ID NO: 2309500 - RNA, 14 nt, Human
agcugagcaggugu

SEQ ID NO: 2309501 - RNA, 23 nt, Human
agcugagauuauaggcaccuacc

SEQ ID NO: 2309502 - RNA, 16 nt, Human
agcugagagaaaauaa

SEQ ID NO: 2309503 - RNA, 15 nt, Human
agcugagagacuuuu

SEQ ID NO: 2309504 - RNA, 12 nt, Human
agcuccuucugu

SEQ ID NO: 2309505 - RNA, 15 nt, Human
agcuccuagcagaga

SEQ ID NO: 2309506 - RNA, 14 nt, Human
agcuccguggagca

SEQ ID NO: 2309507 - RNA, 15 nt, Human
agcuccguggagcag

SEQ ID NO: 2309508 - RNA, 13 nt, Human
agcuccuucuguc

SEQ ID NO: 2309509 - RNA, 19 nt, Human
agcuccuuccuggagacug

SEQ ID NO: 2309510 - RNA, 15 nt, Human
agcuccuuccuggag

SEQ ID NO: 2309511 - RNA, 13 nt, Human
agcuccuuccugg

SEQ ID NO: 2309512 - RNA, 20 nt, Human
agcuccgcuuucuacccagc

SEQ ID NO: 2309513 - RNA, 21 nt, Human
agcuccgcuuucuacccagcg

SEQ ID NO: 2309514 - RNA, 23 nt, Human
agcuccgcuuucuacccagcgag

SEQ ID NO: 2309515 - RNA, 17 nt, Human
agcuccgccucccgggu

SEQ ID NO: 2309516 - RNA, 17 nt, Human
agcuccuagcagagaga

SEQ ID NO: 2309517 - RNA, 14 nt, Human
agcucccucugccu

SEQ ID NO: 2309518 - RNA, 13 nt, Human
agcucccucugcc

SEQ ID NO: 2309519 - RNA, 16 nt, Human
agcucccuucucugua

SEQ ID NO: 2309520 - RNA, 23 nt, Human
agcucccuucucuguagggaacu

SEQ ID NO: 2309521 - RNA, 13 nt, Human
agcucccuucucu

SEQ ID NO: 2309522 - RNA, 14 nt, Human
agcucccuucucug

SEQ ID NO: 2309523 - RNA, 15 nt, Human
agcucccuaggagac

SEQ ID NO: 2309524 - RNA, 17 nt, Human
agcucccuaggagacca

SEQ ID NO: 2309525 - RNA, 22 nt, Human
agcuccccucggagaagagcug

SEQ ID NO: 2309526 - RNA, 13 nt, Human
aggacccagaccc

SEQ ID NO: 2309527 - RNA, 14 nt, Human
aggacccagaccca

SEQ ID NO: 2309528 - RNA, 15 nt, Human
aggacccagacccag

SEQ ID NO: 2309529 - RNA, 15 nt, Human
aggacccagaggaag

SEQ ID NO: 2309530 - RNA, 13 nt, Human
aggacccagagga

SEQ ID NO: 2309531 - RNA, 12 nt, Human
aggacccagacc

SEQ ID NO: 2309532 - RNA, 12 nt, Human
aggacccuuccc

SEQ ID NO: 2309533 - RNA, 13 nt, Human
aggacccuucccu

SEQ ID NO: 2309534 - RNA, 20 nt, Human
aggacccuucccuugagccc

SEQ ID NO: 2309535 - RNA, 18 nt, Human
aggacccaucacgccugu

SEQ ID NO: 2309536 - RNA, 20 nt, Human
aggacccaucacgccugugc

SEQ ID NO: 2309537 - RNA, 18 nt, Human
aggacccagacccagugg

SEQ ID NO: 2309538 - RNA, 13 nt, Human
agcuuuugcuuuu

SEQ ID NO: 2309539 - RNA, 14 nt, Human
agcuuuuuaauugu

SEQ ID NO: 2309540 - RNA, 15 nt, Human
agcuuuuuaauuguu

SEQ ID NO: 2309541 - RNA, 19 nt, Human
agcuuuuuccagaggcuau

SEQ ID NO: 2309542 - RNA, 22 nt, Human
agcuuuuuauuccuccugcuca

SEQ ID NO: 2309543 - RNA, 17 nt, Human
agcuuuuuaauuguugu

SEQ ID NO: 2309544 - RNA, 21 nt, Human
agcuuuuuaauuguuguuucu

SEQ ID NO: 2309545 - RNA, 21 nt, Human
agcuuuucccuuuuuuuaagu

SEQ ID NO: 2309546 - RNA, 18 nt, Human
agcuuuugaauaaaaacu

SEQ ID NO: 2309547 - RNA, 14 nt, Human
agcuuuuccucccu

SEQ ID NO: 2309548 - RNA, 13 nt, Human
agcuuuuugucuu

SEQ ID NO: 2309549 - RNA, 22 nt, Human
agcuuuuuaauuguuguuucuu

SEQ ID NO: 2309550 - RNA, 21 nt, Human
aggaauccacucccaggcagc

SEQ ID NO: 2309551 - RNA, 16 nt, Human
aggaauccacucccag

SEQ ID NO: 2309552 - RNA, 17 nt, Human
aggaauccacucccagg

SEQ ID NO: 2309553 - RNA, 20 nt, Human
aggaauccagacccggcugc

SEQ ID NO: 2309554 - RNA, 17 nt, Human
aggaauccagacccggc

SEQ ID NO: 2309555 - RNA, 21 nt, Human
aggaaucaugugccaagcaga

SEQ ID NO: 2309556 - RNA, 13 nt, Human
aggauggagagag

SEQ ID NO: 2309557 - RNA, 19 nt, Human
aggauggaacacggccaca

SEQ ID NO: 2309558 - RNA, 17 nt, Human
aggauggagagagggga

SEQ ID NO: 2309559 - RNA, 16 nt, Human
aggauggagagagggg

SEQ ID NO: 2309560 - RNA, 15 nt, Human
aggauggagagaggg

SEQ ID NO: 2309561 - RNA, 14 nt, Human
aggauggagagagg

SEQ ID NO: 2309562 - RNA, 14 nt, Human
aggauggaacacgg

SEQ ID NO: 2309563 - RNA, 17 nt, Human
aggaguucaaugaucua

SEQ ID NO: 2309564 - RNA, 18 nt, Human
aggaguucaaugaucuag

SEQ ID NO: 2309565 - RNA, 13 nt, Human
aggaguucaauga

SEQ ID NO: 2309566 - RNA, 14 nt, Human
aggaguucaaugau

SEQ ID NO: 2309567 - RNA, 15 nt, Human
aggaguucaaugauc

SEQ ID NO: 2309568 - RNA, 16 nt, Human
aggaguucaaugaucu

SEQ ID NO: 2309569 - RNA, 21 nt, Human
aggauguaaacagugccugcu

SEQ ID NO: 2309570 - RNA, 20 nt, Human
aggauguaaacagugccugc

SEQ ID NO: 2309571 - RNA, 22 nt, Human
aggauguaaacagugccugcug

SEQ ID NO: 2309572 - RNA, 19 nt, Human
aggauguaaacagugccug

SEQ ID NO: 2309573 - RNA, 18 nt, Human
aggauguaaacagugccu

SEQ ID NO: 2309574 - RNA, 19 nt, Human
aggauggagagaggggaau

SEQ ID NO: 2309575 - RNA, 17 nt, Human
aggauggagccagcucu

SEQ ID NO: 2309576 - RNA, 23 nt, Human
aggaugguucccuugaugaagaa

SEQ ID NO: 2309577 - RNA, 15 nt, Human
aggauguucugggac

SEQ ID NO: 2309578 - RNA, 16 nt, Human
aggauguucugggaca

SEQ ID NO: 2309579 - RNA, 22 nt, Human
aggauguacaaggacagccccu

SEQ ID NO: 2309580 - RNA, 22 nt, Human
aggauguucuagcauggcugcc

SEQ ID NO: 2309581 - RNA, 14 nt, Human
aggauuauuggaaa

SEQ ID NO: 2309582 - RNA, 16 nt, Human
aggauuacaugcaugu

SEQ ID NO: 2309583 - RNA, 18 nt, Human
aggaugucacagggccaa

SEQ ID NO: 2309584 - RNA, 14 nt, Human
aggauguuuuucau

SEQ ID NO: 2309585 - RNA, 20 nt, Human
aggauuaaauaauguaaaua

SEQ ID NO: 2309586 - RNA, 18 nt, Human
aggauguucugggacaca

SEQ ID NO: 2309587 - RNA, 14 nt, Human
aggauuaaauaaug

SEQ ID NO: 2309588 - RNA, 15 nt, Human
aggaugucacagggc

SEQ ID NO: 2309589 - RNA, 16 nt, Human
aggaugucacagggcc

SEQ ID NO: 2309590 - RNA, 17 nt, Human
aggaugucacagggcca

SEQ ID NO: 2309591 - RNA, 20 nt, Human
aggaguuagaggccagccug

SEQ ID NO: 2309592 - RNA, 12 nt, Human
aggaguucaaug

SEQ ID NO: 2309593 - RNA, 17 nt, Human
aggaguuagaggccagc

SEQ ID NO: 2309594 - RNA, 17 nt, Human
aggaguuaagaguagca

SEQ ID NO: 2309595 - RNA, 22 nt, Human
aggaguuaguggauuacugcca

SEQ ID NO: 2309596 - RNA, 16 nt, Human
aggagugugagaauca

SEQ ID NO: 2309597 - RNA, 16 nt, Human
aggaguguggccacgu

SEQ ID NO: 2309598 - RNA, 18 nt, Human
aggagugugugauuuuuu

SEQ ID NO: 2309599 - RNA, 16 nt, Human
aggaguuaagaguagc

SEQ ID NO: 2309600 - RNA, 23 nt, Human
aggaugcuuguacauaaugcgug

SEQ ID NO: 2309601 - RNA, 21 nt, Human
aggaugcuuguacauaaugcg

SEQ ID NO: 2309602 - RNA, 18 nt, Human
aggaguggguugauuuca

SEQ ID NO: 2309603 - RNA, 21 nt, Human
aggagugggaaaacacugcca

SEQ ID NO: 2309604 - RNA, 17 nt, Human
aggagucccaaggaaag

SEQ ID NO: 2309605 - RNA, 16 nt, Human
aggagucccaaggaaa

SEQ ID NO: 2309606 - RNA, 21 nt, Human
aggagucccugccaucauguu

SEQ ID NO: 2309607 - RNA, 12 nt, Human
aggagucccugg

SEQ ID NO: 2309608 - RNA, 22 nt, Human
aggacccuucccuugagcccuc

SEQ ID NO: 2309609 - RNA, 16 nt, Human
aggaccggcggcucgg

SEQ ID NO: 2309610 - RNA, 13 nt, Human
aggaccucaggug

SEQ ID NO: 2309611 - RNA, 22 nt, Human
aggaccuagggauguucuggcc

SEQ ID NO: 2309612 - RNA, 18 nt, Human
aggaccucagcugcuucu

SEQ ID NO: 2309613 - RNA, 15 nt, Human
aggaccucagcugcu

SEQ ID NO: 2309614 - RNA, 19 nt, Human
aggaccuagggauguucug

SEQ ID NO: 2309615 - RNA, 16 nt, Human
aggagaaggaaggaga

SEQ ID NO: 2309616 - RNA, 12 nt, Human
aggagaaggaag

SEQ ID NO: 2309617 - RNA, 14 nt, Human
aggagucagagaga

SEQ ID NO: 2309618 - RNA, 20 nt, Human
aggaguccacuuuguuucgu

SEQ ID NO: 2309619 - RNA, 14 nt, Human
aggagucccaagga

SEQ ID NO: 2309620 - RNA, 22 nt, Human
aggaguccaggccauggaggca

SEQ ID NO: 2309621 - RNA, 11 nt, Human
aggagacacaa

SEQ ID NO: 2309622 - RNA, 19 nt, Human
aggagacacaacaacuccu

SEQ ID NO: 2309623 - RNA, 20 nt, Human
aggagaauggcgugaacccg

SEQ ID NO: 2309624 - RNA, 20 nt, Human
aggagaauugcuugaaccug

SEQ ID NO: 2309625 - RNA, 18 nt, Human
aggagaauccaagcgagg

SEQ ID NO: 2309626 - RNA, 16 nt, Human
aggagaauccaagcga

SEQ ID NO: 2309627 - RNA, 15 nt, Human
aggagaaugagccuc

SEQ ID NO: 2309628 - RNA, 20 nt, Human
aggagaaucacuugaaccug

SEQ ID NO: 2309629 - RNA, 18 nt, Human
agccucccauccagggcc

SEQ ID NO: 2309630 - RNA, 18 nt, Human
agccucccugucggccug

SEQ ID NO: 2309631 - RNA, 14 nt, Human
agccuccgagaggg

SEQ ID NO: 2309632 - RNA, 16 nt, Human
agccuccgagagggag

SEQ ID NO: 2309633 - RNA, 17 nt, Human
agccuccgagagggaga

SEQ ID NO: 2309634 - RNA, 18 nt, Human
agccuccgagagggagag

SEQ ID NO: 2309635 - RNA, 14 nt, Human
agccuccuccagcc

SEQ ID NO: 2309636 - RNA, 18 nt, Human
agccuccguauuucagac

SEQ ID NO: 2309637 - RNA, 17 nt, Human
agccuccguauuucaga

SEQ ID NO: 2309638 - RNA, 20 nt, Human
agccuccucaucccguguuc

SEQ ID NO: 2309639 - RNA, 23 nt, Human
agccuccggaguagcugggacca

SEQ ID NO: 2309640 - RNA, 13 nt, Human
agccucccacccc

SEQ ID NO: 2309641 - RNA, 17 nt, Human
agccucccauccagggc

SEQ ID NO: 2309642 - RNA, 16 nt, Human
agccucccugaagccu

SEQ ID NO: 2309643 - RNA, 20 nt, Human
agccucccgaguagcuggga

SEQ ID NO: 2309644 - RNA, 18 nt, Human
agccucccgaguagcugg

SEQ ID NO: 2309645 - RNA, 19 nt, Human
agccucccgaguagcuggg

SEQ ID NO: 2309646 - RNA, 16 nt, Human
agccgugcccugcccc

SEQ ID NO: 2309647 - RNA, 17 nt, Human
agccucccaaguagcug

SEQ ID NO: 2309648 - RNA, 18 nt, Human
agccgugcucgccccagc

SEQ ID NO: 2309649 - RNA, 22 nt, Human
agccucccacgacugcccggca

SEQ ID NO: 2309650 - RNA, 21 nt, Human
agccucccaaagugcugggau

SEQ ID NO: 2309651 - RNA, 17 nt, Human
agccgugccuucagcuc

SEQ ID NO: 2309652 - RNA, 15 nt, Human
agccgugccuucagc

SEQ ID NO: 2309653 - RNA, 16 nt, Human
agccgugccuucagcu

SEQ ID NO: 2309654 - RNA, 17 nt, Human
agccgugaugcucaggc

SEQ ID NO: 2309655 - RNA, 18 nt, Human
agccgugaugcucaggcu

SEQ ID NO: 2309656 - RNA, 19 nt, Human
agccgugaugcucaggcuu

SEQ ID NO: 2309657 - RNA, 20 nt, Human
agccgugaugcucaggcuug

SEQ ID NO: 2309658 - RNA, 22 nt, Human
agccgggcgugguggcgggcac

SEQ ID NO: 2309659 - RNA, 20 nt, Human
agccgucagccaaauguaau

SEQ ID NO: 2309660 - RNA, 13 nt, Human
agccgggccuggg

SEQ ID NO: 2309661 - RNA, 19 nt, Human
agccgggccuggggcuccu

SEQ ID NO: 2309662 - RNA, 21 nt, Human
agccgggcgugguggugagug

SEQ ID NO: 2309663 - RNA, 20 nt, Human
agcccucccuguccuccucg

SEQ ID NO: 2309664 - RNA, 19 nt, Human
agcccucccuguccuccuc

SEQ ID NO: 2309665 - RNA, 17 nt, Human
agcccucccuguccucc

SEQ ID NO: 2309666 - RNA, 16 nt, Human
agcccucccuguccuc

SEQ ID NO: 2309667 - RNA, 15 nt, Human
agcccucccuguccu

SEQ ID NO: 2309668 - RNA, 17 nt, Human
agcccuccaaaagcacu

SEQ ID NO: 2309669 - RNA, 14 nt, Human
agcccucccugucc

SEQ ID NO: 2309670 - RNA, 22 nt, Human
agcccucccuguccuccucgga

SEQ ID NO: 2309671 - RNA, 21 nt, Human
agcccucccuguccuccucgg

SEQ ID NO: 2309672 - RNA, 23 nt, Human
agcccuccgccauucucaagccc

SEQ ID NO: 2309673 - RNA, 13 nt, Human
agcccuccucacc

SEQ ID NO: 2309674 - RNA, 12 nt, Human
agcccuccucac

SEQ ID NO: 2309675 - RNA, 24 nt, Human
agcccuccgccauucucaagcccu

SEQ ID NO: 2309676 - RNA, 23 nt, Human
agcccucaccccugguucucauc

SEQ ID NO: 2309677 - RNA, 14 nt, Human
agcccucagaaccc

SEQ ID NO: 2309678 - RNA, 18 nt, Human
agcccucagaacccuugg

SEQ ID NO: 2309679 - RNA, 15 nt, Human
agcccucagaacccu

SEQ ID NO: 2309680 - RNA, 24 nt, Human
agcccucagaacccuuggcuugcc

SEQ ID NO: 2309681 - RNA, 19 nt, Human
agcccucagaacccuuggc

SEQ ID NO: 2309682 - RNA, 16 nt, Human
agcccucaucccgagc

SEQ ID NO: 2309683 - RNA, 15 nt, Human
agcccuccaaaagca

SEQ ID NO: 2309684 - RNA, 21 nt, Human
agccgcaucuucuccaucugg

SEQ ID NO: 2309685 - RNA, 17 nt, Human
agccgcaucuucuccau

SEQ ID NO: 2309686 - RNA, 13 nt, Human
agcccucuuccau

SEQ ID NO: 2309687 - RNA, 15 nt, Human
agcccucuuccauca

SEQ ID NO: 2309688 - RNA, 11 nt, Human
agcccucuucc

SEQ ID NO: 2309689 - RNA, 12 nt, Human
agcccucuucca

SEQ ID NO: 2309690 - RNA, 11 nt, Human
agcccuccuuc

SEQ ID NO: 2309691 - RNA, 14 nt, Human
agcccuccucaccc

SEQ ID NO: 2309692 - RNA, 13 nt, Human
agcccuccuucca

SEQ ID NO: 2309693 - RNA, 12 nt, Human
agcccuccuucc

SEQ ID NO: 2309694 - RNA, 17 nt, Human
agcccuccuuccacgga

SEQ ID NO: 2309695 - RNA, 14 nt, Human
agcccucgucuccc

SEQ ID NO: 2309696 - RNA, 19 nt, Human
agccgccauugccaccagg

SEQ ID NO: 2309697 - RNA, 18 nt, Human
agccgccauugccaccag

SEQ ID NO: 2309698 - RNA, 17 nt, Human
agccgccauugccacca

SEQ ID NO: 2309699 - RNA, 21 nt, Human
agccgccaugcuccuggccca

SEQ ID NO: 2309700 - RNA, 23 nt, Human
agccgggaacagacaacagaagu

SEQ ID NO: 2309701 - RNA, 20 nt, Human
agccgggaaagaagagccgg

SEQ ID NO: 2309702 - RNA, 14 nt, Human
agccgggccccugg

SEQ ID NO: 2309703 - RNA, 18 nt, Human
agccgggccccugggcuu

SEQ ID NO: 2309704 - RNA, 16 nt, Human
agccgggccccugggc

SEQ ID NO: 2309705 - RNA, 17 nt, Human
agccgggccccugggcu

SEQ ID NO: 2309706 - RNA, 23 nt, Human
agccggccucucuggccucccac

SEQ ID NO: 2309707 - RNA, 13 nt, Human
agccggcggccca

SEQ ID NO: 2309708 - RNA, 18 nt, Human
agccggcggcccaagccc

SEQ ID NO: 2309709 - RNA, 12 nt, Human
agccgcugcugg

SEQ ID NO: 2309710 - RNA, 18 nt, Human
agccggccucucuggccu

SEQ ID NO: 2309711 - RNA, 19 nt, Human
agccggccucucuggccuc

SEQ ID NO: 2309712 - RNA, 22 nt, Human
agccggccucucuggccuccca

SEQ ID NO: 2309713 - RNA, 12 nt, Human
agccgcugcccg

SEQ ID NO: 2309714 - RNA, 17 nt, Human
agccgcugcccggcgcc

SEQ ID NO: 2309715 - RNA, 18 nt, Human
agccgcugcccggcgccc

SEQ ID NO: 2309716 - RNA, 22 nt, Human
agccgcugcccggcgcccucug

SEQ ID NO: 2309717 - RNA, 13 nt, Human
agccgcuggggcc

SEQ ID NO: 2309718 - RNA, 21 nt, Human
agccgcuccugucugccagcc

SEQ ID NO: 2309719 - RNA, 19 nt, Human
agccgcuccugucugccag

SEQ ID NO: 2309720 - RNA, 17 nt, Human
agccgcuccugucugcc

SEQ ID NO: 2309721 - RNA, 16 nt, Human
agccgcuccugucugc

SEQ ID NO: 2309722 - RNA, 22 nt, Human
agccgcuccugucugccagcca

SEQ ID NO: 2309723 - RNA, 12 nt, Human
agccgcucggag

SEQ ID NO: 2309724 - RNA, 19 nt, Human
agccgcugagcgaggagau

SEQ ID NO: 2309725 - RNA, 15 nt, Human
agccgcugagcgagg

SEQ ID NO: 2309726 - RNA, 22 nt, Human
agccgccauugccaccaggaga

SEQ ID NO: 2309727 - RNA, 21 nt, Human
agccgccauugccaccaggag

SEQ ID NO: 2309728 - RNA, 20 nt, Human
agccgccauugccaccagga

SEQ ID NO: 2309729 - RNA, 14 nt, Human
agccgcuccugucu

SEQ ID NO: 2309730 - RNA, 16 nt, Human
agccuccuccugacca

SEQ ID NO: 2309731 - RNA, 12 nt, Human
agccuccuccug

SEQ ID NO: 2309732 - RNA, 13 nt, Human
agccuccuccuga

SEQ ID NO: 2309733 - RNA, 13 nt, Human
agccccagugcca

SEQ ID NO: 2309734 - RNA, 13 nt, Human
agccccagugccc

SEQ ID NO: 2309735 - RNA, 14 nt, Human
agccccagugccca

SEQ ID NO: 2309736 - RNA, 15 nt, Human
agccccagugcccac

SEQ ID NO: 2309737 - RNA, 23 nt, Human
agccccagugccaagcacagugc

SEQ ID NO: 2309738 - RNA, 20 nt, Human
agccccagugccaagcacag

SEQ ID NO: 2309739 - RNA, 16 nt, Human
agccccaugcuggagc

SEQ ID NO: 2309740 - RNA, 17 nt, Human
agccccaugcuggagcc

SEQ ID NO: 2309741 - RNA, 18 nt, Human
agccccaugcuggagccu

SEQ ID NO: 2309742 - RNA, 19 nt, Human
agccccaugcuggagccug

SEQ ID NO: 2309743 - RNA, 13 nt, Human
agccccauuccug

SEQ ID NO: 2309744 - RNA, 20 nt, Human
agccccaugcuggagccugu

SEQ ID NO: 2309745 - RNA, 21 nt, Human
agccccaugcuggagccugug

SEQ ID NO: 2309746 - RNA, 22 nt, Human
agccccaugcuggagccugugu

SEQ ID NO: 2309747 - RNA, 23 nt, Human
agccccaugcuggagccugugua

SEQ ID NO: 2309748 - RNA, 16 nt, Human
agcccguguggccccu

SEQ ID NO: 2309749 - RNA, 15 nt, Human
agcccguguggcccc

SEQ ID NO: 2309750 - RNA, 15 nt, Human
agcccgucucagugu

SEQ ID NO: 2309751 - RNA, 14 nt, Human
agcccgucucagug

SEQ ID NO: 2309752 - RNA, 19 nt, Human
agcccguguggccccuuca

SEQ ID NO: 2309753 - RNA, 18 nt, Human
agcccguguggccccuuc

SEQ ID NO: 2309754 - RNA, 17 nt, Human
agcccguguggccccuu

SEQ ID NO: 2309755 - RNA, 22 nt, Human
agcccuaaaauuccacugcguu

SEQ ID NO: 2309756 - RNA, 17 nt, Human
agcccucacccuggggc

SEQ ID NO: 2309757 - RNA, 22 nt, Human
agcccucaccccugguucucau

SEQ ID NO: 2309758 - RNA, 13 nt, Human
agcccucaaagug

SEQ ID NO: 2309759 - RNA, 19 nt, Human
agcccuaaaucuagacuca

SEQ ID NO: 2309760 - RNA, 14 nt, Human
agcccucaaaguga

SEQ ID NO: 2309761 - RNA, 13 nt, Human
agccccauucugc

SEQ ID NO: 2309762 - RNA, 16 nt, Human
agccccauucugccug

SEQ ID NO: 2309763 - RNA, 16 nt, Human
agccccauuccuggga

SEQ ID NO: 2309764 - RNA, 12 nt, Human
agcccgggcugc

SEQ ID NO: 2309765 - RNA, 13 nt, Human
agcccgggcugcc

SEQ ID NO: 2309766 - RNA, 14 nt, Human
agcccgggcugccu

SEQ ID NO: 2309767 - RNA, 15 nt, Human
agcccgggcugccug

SEQ ID NO: 2309768 - RNA, 20 nt, Human
agcccgggcugccugggcug

SEQ ID NO: 2309769 - RNA, 21 nt, Human
agcccgggcugccugggcugu

SEQ ID NO: 2309770 - RNA, 16 nt, Human
agcccgggcugccugg

SEQ ID NO: 2309771 - RNA, 17 nt, Human
agcccgggcugccuggg

SEQ ID NO: 2309772 - RNA, 18 nt, Human
agcccgggcugccugggc

SEQ ID NO: 2309773 - RNA, 19 nt, Human
agcccgggcugccugggcu

SEQ ID NO: 2309774 - RNA, 18 nt, Human
agccagcaggcucucagg

SEQ ID NO: 2309775 - RNA, 19 nt, Human
agccagcaggcucucaggc

SEQ ID NO: 2309776 - RNA, 17 nt, Human
agccagcaggcucucag

SEQ ID NO: 2309777 - RNA, 16 nt, Human
agccagcagacauugu

SEQ ID NO: 2309778 - RNA, 14 nt, Human
agccagcagacauu

SEQ ID NO: 2309779 - RNA, 15 nt, Human
agccagcagacauug

SEQ ID NO: 2309780 - RNA, 20 nt, Human
agccagcaggcucucaggcc

SEQ ID NO: 2309781 - RNA, 17 nt, Human
agccagcagacauuguc

SEQ ID NO: 2309782 - RNA, 21 nt, Human
agcaugcugugauugugccua

SEQ ID NO: 2309783 - RNA, 23 nt, Human
agcaugaccugugaccagcacug

SEQ ID NO: 2309784 - RNA, 22 nt, Human
agcaugaccugugaccagcacu

SEQ ID NO: 2309785 - RNA, 19 nt, Human
agcaugagagaauuguauc

SEQ ID NO: 2309786 - RNA, 20 nt, Human
agcaugccuggauggggcug

SEQ ID NO: 2309787 - RNA, 23 nt, Human
agcaugccuggauggggcugcac

SEQ ID NO: 2309788 - RNA, 17 nt, Human
agccaaaucaaaauaug

SEQ ID NO: 2309789 - RNA, 14 nt, Human
agcauggagcuggc

SEQ ID NO: 2309790 - RNA, 13 nt, Human
agcauggagcugg

SEQ ID NO: 2309791 - RNA, 16 nt, Human
agcauggagcuggccg

SEQ ID NO: 2309792 - RNA, 20 nt, Human
agccaaauguaauugaauaa

SEQ ID NO: 2309793 - RNA, 15 nt, Human
agccaaaugguuuaa

SEQ ID NO: 2309794 - RNA, 19 nt, Human
agccaacacccaucuguuu

SEQ ID NO: 2309795 - RNA, 18 nt, Human
agccaacagaagcuucca

SEQ ID NO: 2309796 - RNA, 19 nt, Human
agccaacacgcaccugccu

SEQ ID NO: 2309797 - RNA, 18 nt, Human
agccaacacgcaccugcc

SEQ ID NO: 2309798 - RNA, 21 nt, Human
agccaacagucaaaacagaga

SEQ ID NO: 2309799 - RNA, 23 nt, Human
agccaacagguggcaggaccagg

SEQ ID NO: 2309800 - RNA, 17 nt, Human
agccaacagguggcagg

SEQ ID NO: 2309801 - RNA, 21 nt, Human
agccaacagguggcaggacca

SEQ ID NO: 2309802 - RNA, 22 nt, Human
agccaacacgcaccugccucag

SEQ ID NO: 2309803 - RNA, 23 nt, Human
agccaacacccugucuaaaaaac

SEQ ID NO: 2309804 - RNA, 15 nt, Human
agccaacagguggca

SEQ ID NO: 2309805 - RNA, 16 nt, Human
agccaaccccugugga

SEQ ID NO: 2309806 - RNA, 14 nt, Human
agccaaccccugug

SEQ ID NO: 2309807 - RNA, 23 nt, Human
agccaagucagcuuugccuucca

SEQ ID NO: 2309808 - RNA, 21 nt, Human
agccaagucagcuuugccuuc

SEQ ID NO: 2309809 - RNA, 13 nt, Human
agccaaguccaga

SEQ ID NO: 2309810 - RNA, 15 nt, Human
agccaaguccagauu

SEQ ID NO: 2309811 - RNA, 18 nt, Human
agccaaguccagauuuac

SEQ ID NO: 2309812 - RNA, 13 nt, Human
agccaaguggggu

SEQ ID NO: 2309813 - RNA, 16 nt, Human
agccaaguggggugcu

SEQ ID NO: 2309814 - RNA, 20 nt, Human
agccaaguggggugcuggga

SEQ ID NO: 2309815 - RNA, 23 nt, Human
agccaagugugguagagugugcc

SEQ ID NO: 2309816 - RNA, 14 nt, Human
agccaauauuuuuc

SEQ ID NO: 2309817 - RNA, 18 nt, Human
agccaauaacacacagcu

SEQ ID NO: 2309818 - RNA, 13 nt, Human
agccaauccccuc

SEQ ID NO: 2309819 - RNA, 14 nt, Human
agccaauccccucc

SEQ ID NO: 2309820 - RNA, 15 nt, Human
agccaauccccuccu

SEQ ID NO: 2309821 - RNA, 22 nt, Human
agccagcacuuguccagcugag

SEQ ID NO: 2309822 - RNA, 21 nt, Human
agccagcacuuguccagcuga

SEQ ID NO: 2309823 - RNA, 20 nt, Human
agccagcacuuguccagcug

SEQ ID NO: 2309824 - RNA, 15 nt, Human
agccagcacuuguau

SEQ ID NO: 2309825 - RNA, 13 nt, Human
agccagcaccugg

SEQ ID NO: 2309826 - RNA, 14 nt, Human
agccagcaccuggc

SEQ ID NO: 2309827 - RNA, 15 nt, Human
agccagcaccuggca

SEQ ID NO: 2309828 - RNA, 23 nt, Human
agccagcaccuggcaucgcacca

SEQ ID NO: 2309829 - RNA, 19 nt, Human
agccagcacacagggcagu

SEQ ID NO: 2309830 - RNA, 20 nt, Human
agccaauccccuccuugggc

SEQ ID NO: 2309831 - RNA, 18 nt, Human
agccagcacacagggcag

SEQ ID NO: 2309832 - RNA, 17 nt, Human
agccagcacacagggca

SEQ ID NO: 2309833 - RNA, 15 nt, Human
agccagcacacaggg

SEQ ID NO: 2309834 - RNA, 16 nt, Human
agccaauccccuccuu

SEQ ID NO: 2309835 - RNA, 18 nt, Human
agccaauccccuccuugg

SEQ ID NO: 2309836 - RNA, 18 nt, Human
agcaugaccugugaccag

SEQ ID NO: 2309837 - RNA, 15 nt, Human
agcaugacauuucuu

SEQ ID NO: 2309838 - RNA, 14 nt, Human
agcaugacauuucu

SEQ ID NO: 2309839 - RNA, 19 nt, Human
agcaugacaagccccaggc

SEQ ID NO: 2309840 - RNA, 18 nt, Human
agcaugacaagccccagg

SEQ ID NO: 2309841 - RNA, 17 nt, Human
agcaugacaagccccag

SEQ ID NO: 2309842 - RNA, 21 nt, Human
agcaugacaagccccaggcag

SEQ ID NO: 2309843 - RNA, 20 nt, Human
agcaugacaagccccaggca

SEQ ID NO: 2309844 - RNA, 22 nt, Human
agcaugacaagccccaggcagg

SEQ ID NO: 2309845 - RNA, 22 nt, Human
agcaugaaugguauggaacucu

SEQ ID NO: 2309846 - RNA, 20 nt, Human
agcaugaauuuuuuucaucu

SEQ ID NO: 2309847 - RNA, 21 nt, Human
agcauccuuuucugcagaggg

SEQ ID NO: 2309848 - RNA, 19 nt, Human
agcauccuuuucugcagag

SEQ ID NO: 2309849 - RNA, 18 nt, Human
agcauccuggcacccggc

SEQ ID NO: 2309850 - RNA, 22 nt, Human
agcauccuggcacccggccccu

SEQ ID NO: 2309851 - RNA, 23 nt, Human
agcauccuggcacccggccccug

SEQ ID NO: 2309852 - RNA, 22 nt, Human
agcagugucuuccauaauguau

SEQ ID NO: 2309853 - RNA, 17 nt, Human
agcagugucuuccauaa

SEQ ID NO: 2309854 - RNA, 16 nt, Human
agcagugucuuccaua

SEQ ID NO: 2309855 - RNA, 15 nt, Human
agcagugucuuccau

SEQ ID NO: 2309856 - RNA, 20 nt, Human
agcagugucaucagaagaua

SEQ ID NO: 2309857 - RNA, 15 nt, Human
agcagugucaucaga

SEQ ID NO: 2309858 - RNA, 19 nt, Human
agcagugucaucagaagau

SEQ ID NO: 2309859 - RNA, 19 nt, Human
agcagugccuuccauaauu

SEQ ID NO: 2309860 - RNA, 13 nt, Human
agcagugucauca

SEQ ID NO: 2309861 - RNA, 18 nt, Human
agcagugggccuggccag

SEQ ID NO: 2309862 - RNA, 20 nt, Human
agcagugucuuccauaaugu

SEQ ID NO: 2309863 - RNA, 21 nt, Human
agcagugugaggccagggcag

SEQ ID NO: 2309864 - RNA, 15 nt, Human
agcagugugaggcca

SEQ ID NO: 2309865 - RNA, 21 nt, Human
agcaguuacaaaaaccuuccc

SEQ ID NO: 2309866 - RNA, 21 nt, Human
agcaguguuccccaucugggu

SEQ ID NO: 2309867 - RNA, 15 nt, Human
agcaguuaacuuuaa

SEQ ID NO: 2309868 - RNA, 22 nt, Human
agcaguuaacuuuaagacugag

SEQ ID NO: 2309869 - RNA, 14 nt, Human
agcaguuccggauu

SEQ ID NO: 2309870 - RNA, 16 nt, Human
agcaguugaaaagacu

SEQ ID NO: 2309871 - RNA, 13 nt, Human
agcaguugaaaag

SEQ ID NO: 2309872 - RNA, 14 nt, Human
agcagcucuccccu

SEQ ID NO: 2309873 - RNA, 12 nt, Human
agcagcucuccc

SEQ ID NO: 2309874 - RNA, 13 nt, Human
agcagcucuugcu

SEQ ID NO: 2309875 - RNA, 15 nt, Human
agcagcucuugcuaa

SEQ ID NO: 2309876 - RNA, 16 nt, Human
agcagcucuugcuaau

SEQ ID NO: 2309877 - RNA, 17 nt, Human
agcagcucuugcuaauc

SEQ ID NO: 2309878 - RNA, 22 nt, Human
agcagcugaaauaugcuggcug

SEQ ID NO: 2309879 - RNA, 23 nt, Human
agcagcugaaauaugcuggcugg

SEQ ID NO: 2309880 - RNA, 23 nt, Human
agcagcucuugcuaaucaguguc

SEQ ID NO: 2309881 - RNA, 18 nt, Human
agcagcugaacagccaaa

SEQ ID NO: 2309882 - RNA, 18 nt, Human
agcagcuuagacuaaggc

SEQ ID NO: 2309883 - RNA, 10 nt, Human
agcagcugga

SEQ ID NO: 2309884 - RNA, 13 nt, Human
agcagcuggacua

SEQ ID NO: 2309885 - RNA, 18 nt, Human
agcagcuggacuacccac

SEQ ID NO: 2309886 - RNA, 20 nt, Human
agcagugccuuccauaauua

SEQ ID NO: 2309887 - RNA, 17 nt, Human
agcagugccuuccauaa

SEQ ID NO: 2309888 - RNA, 16 nt, Human
agcagugccuuccaua

SEQ ID NO: 2309889 - RNA, 18 nt, Human
agcagugcaugcuguccc

SEQ ID NO: 2309890 - RNA, 22 nt, Human
agcagcugguaaucuugcucug

SEQ ID NO: 2309891 - RNA, 15 nt, Human
agcagcuucaccaga

SEQ ID NO: 2309892 - RNA, 19 nt, Human
agcagugcaugcugucccu

SEQ ID NO: 2309893 - RNA, 20 nt, Human
agcagugcaugcugucccuu

SEQ ID NO: 2309894 - RNA, 20 nt, Human
agcacugucucaguuucacu

SEQ ID NO: 2309895 - RNA, 14 nt, Human
agcacugugcuaau

SEQ ID NO: 2309896 - RNA, 14 nt, Human
agcacugucucagu

SEQ ID NO: 2309897 - RNA, 19 nt, Human
agcacuggguugcagggga

SEQ ID NO: 2309898 - RNA, 19 nt, Human
agcacugucccuugccuca

SEQ ID NO: 2309899 - RNA, 22 nt, Human
agcacugucccuugccucaaug

SEQ ID NO: 2309900 - RNA, 12 nt, Human
agcacugucccu

SEQ ID NO: 2309901 - RNA, 13 nt, Human
agcacugucccuu

SEQ ID NO: 2309902 - RNA, 15 nt, Human
agcacugucccuugc

SEQ ID NO: 2309903 - RNA, 16 nt, Human
agcacugucccuugcc

SEQ ID NO: 2309904 - RNA, 18 nt, Human
agcagcgaccaccccugc

SEQ ID NO: 2309905 - RNA, 20 nt, Human
agcacuguuccagccugccc

SEQ ID NO: 2309906 - RNA, 15 nt, Human
agcacugugcuaaua

SEQ ID NO: 2309907 - RNA, 23 nt, Human
agcacugugcuaauaacagugca

SEQ ID NO: 2309908 - RNA, 14 nt, Human
agcacugugcucag

SEQ ID NO: 2309909 - RNA, 15 nt, Human
agcacugugcucagg

SEQ ID NO: 2309910 - RNA, 18 nt, Human
agcacugugcucagggcu

SEQ ID NO: 2309911 - RNA, 19 nt, Human
agcacugugcucagggcua

SEQ ID NO: 2309912 - RNA, 16 nt, Human
agcacuguuccagccu

SEQ ID NO: 2309913 - RNA, 17 nt, Human
agcacuguuccagccug

SEQ ID NO: 2309914 - RNA, 17 nt, Human
agcagcgguuuggggag

SEQ ID NO: 2309915 - RNA, 16 nt, Human
agcagcgguggccucu

SEQ ID NO: 2309916 - RNA, 21 nt, Human
agcagcggggcgaagcccagg

SEQ ID NO: 2309917 - RNA, 15 nt, Human
agcagcgguggccuc

SEQ ID NO: 2309918 - RNA, 15 nt, Human
agcagcgccuuuccc

SEQ ID NO: 2309919 - RNA, 14 nt, Human
agcagcgccuuucc

SEQ ID NO: 2309920 - RNA, 18 nt, Human
agcagcgaccgcccccuc

SEQ ID NO: 2309921 - RNA, 20 nt, Human
agcagcgaccaccccugccu

SEQ ID NO: 2309922 - RNA, 21 nt, Human
agcagcgaccaccccugccuc

SEQ ID NO: 2309923 - RNA, 23 nt, Human
agcagcgaccgcccccuccucua

SEQ ID NO: 2309924 - RNA, 22 nt, Human
agcagcgaccaccccugccucc

SEQ ID NO: 2309925 - RNA, 23 nt, Human
agcagcgguuuggggagcagaga

SEQ ID NO: 2309926 - RNA, 22 nt, Human
agcagcgguuuggggagcagag

SEQ ID NO: 2309927 - RNA, 13 nt, Human
agcagcguuucua

SEQ ID NO: 2309928 - RNA, 14 nt, Human
agcacacucauccc

SEQ ID NO: 2309929 - RNA, 20 nt, Human
agcacacucauccccucacu

SEQ ID NO: 2309930 - RNA, 23 nt, Human
agcacacuugacaucaacugcau

SEQ ID NO: 2309931 - RNA, 13 nt, Human
agcacagaaggag

SEQ ID NO: 2309932 - RNA, 19 nt, Human
agcacagaaacagaggaga

SEQ ID NO: 2309933 - RNA, 19 nt, Human
agcacacuguagcauuaca

SEQ ID NO: 2309934 - RNA, 14 nt, Human
agcacacuguagca

SEQ ID NO: 2309935 - RNA, 17 nt, Human
agcacagacccugcccu

SEQ ID NO: 2309936 - RNA, 14 nt, Human
agcacacagggcag

SEQ ID NO: 2309937 - RNA, 16 nt, Human
agcacagaaggaggag

SEQ ID NO: 2309938 - RNA, 20 nt, Human
agcacagacccugcccugug

SEQ ID NO: 2309939 - RNA, 18 nt, Human
agcacagacccugcccug

SEQ ID NO: 2309940 - RNA, 19 nt, Human
agcacagacccugcccugu

SEQ ID NO: 2309941 - RNA, 17 nt, Human
agcacuggguugacuuu

SEQ ID NO: 2309942 - RNA, 13 nt, Human
agcacugaccugu

SEQ ID NO: 2309943 - RNA, 20 nt, Human
agcacugaccugucaugccc

SEQ ID NO: 2309944 - RNA, 22 nt, Human
agcacugaccugucaugccccc

SEQ ID NO: 2309945 - RNA, 23 nt, Human
agcacugacuagggaaaugauca

SEQ ID NO: 2309946 - RNA, 16 nt, Human
agcacugacuucuaag

SEQ ID NO: 2309947 - RNA, 12 nt, Human
agcacugaccug

SEQ ID NO: 2309948 - RNA, 19 nt, Human
agaugggcuuguuuucuug

SEQ ID NO: 2309949 - RNA, 18 nt, Human
agaugggcuuguuuucuu

SEQ ID NO: 2309950 - RNA, 15 nt, Human
agaugggggaaagca

SEQ ID NO: 2309951 - RNA, 14 nt, Human
agauggggccucug

SEQ ID NO: 2309952 - RNA, 15 nt, Human
agauggggccucugu

SEQ ID NO: 2309953 - RNA, 18 nt, Human
agaugggggaaagcacag

SEQ ID NO: 2309954 - RNA, 15 nt, Human
agaugggggcaagaa

SEQ ID NO: 2309955 - RNA, 16 nt, Human
agaugggggcaagaag

SEQ ID NO: 2309956 - RNA, 17 nt, Human
agaugggggcaagaaga

SEQ ID NO: 2309957 - RNA, 18 nt, Human
agaugggggcaagaagau

SEQ ID NO: 2309958 - RNA, 17 nt, Human
agaguguggccuucgga

SEQ ID NO: 2309959 - RNA, 20 nt, Human
agagugugggaagggagagc

SEQ ID NO: 2309960 - RNA, 19 nt, Human
agagugugggaagggagag

SEQ ID NO: 2309961 - RNA, 19 nt, Human
agagugugaaauagacauu

SEQ ID NO: 2309962 - RNA, 22 nt, Human
agagugucuucacggcaggaca

SEQ ID NO: 2309963 - RNA, 15 nt, Human
agagugucuuuccac

SEQ ID NO: 2309964 - RNA, 14 nt, Human
agagugucuuucca

SEQ ID NO: 2309965 - RNA, 14 nt, Human
agagugugccugaa

SEQ ID NO: 2309966 - RNA, 19 nt, Human
agaguggggauaugauuua

SEQ ID NO: 2309967 - RNA, 20 nt, Human
agagugucuucacggcagga

SEQ ID NO: 2309968 - RNA, 18 nt, Human
agagugggcugcaucugg

SEQ ID NO: 2309969 - RNA, 23 nt, Human
agaguggcuccucccggugccca

SEQ ID NO: 2309970 - RNA, 11 nt, Human
agagugggagc

SEQ ID NO: 2309971 - RNA, 19 nt, Human
agaguggcuccucccggug

SEQ ID NO: 2309972 - RNA, 23 nt, Human
agagggcccugguguuucuagca

SEQ ID NO: 2309973 - RNA, 21 nt, Human
agagggcccaggcaggccacc

SEQ ID NO: 2309974 - RNA, 13 nt, Human
agagggcccuggu

SEQ ID NO: 2309975 - RNA, 18 nt, Human
agagggcccugguguuuc

SEQ ID NO: 2309976 - RNA, 19 nt, Human
agaggguggugaccucugc

SEQ ID NO: 2309977 - RNA, 20 nt, Human
agaggguggugaccucugcc

SEQ ID NO: 2309978 - RNA, 22 nt, Human
agaggguggugaccucugccug

SEQ ID NO: 2309979 - RNA, 14 nt, Human
agagggcagaggcu

SEQ ID NO: 2309980 - RNA, 16 nt, Human
agagggcacacacugu

SEQ ID NO: 2309981 - RNA, 18 nt, Human
agagggccaagacuuggc

SEQ ID NO: 2309982 - RNA, 16 nt, Human
agagggcacucugcuu

SEQ ID NO: 2309983 - RNA, 17 nt, Human
agaggagagaggcagag

SEQ ID NO: 2309984 - RNA, 12 nt, Human
agaggagagcca

SEQ ID NO: 2309985 - RNA, 17 nt, Human
agagggcccaggcaggc

SEQ ID NO: 2309986 - RNA, 16 nt, Human
agagggcccaggcagg

SEQ ID NO: 2309987 - RNA, 14 nt, Human
agagggcccaggca

SEQ ID NO: 2309988 - RNA, 23 nt, Human
agagggcaugcgcacaaggcuga

SEQ ID NO: 2309989 - RNA, 12 nt, Human
agagggcacaga

SEQ ID NO: 2309990 - RNA, 17 nt, Human
agagggaugcauggaga

SEQ ID NO: 2309991 - RNA, 11 nt, Human
agaggagagag

SEQ ID NO: 2309992 - RNA, 12 nt, Human
agaggagagagg

SEQ ID NO: 2309993 - RNA, 13 nt, Human
agaggagagaggc

SEQ ID NO: 2309994 - RNA, 15 nt, Human
agaggagagaggcag

SEQ ID NO: 2309995 - RNA, 16 nt, Human
agaggacaagggaaau

SEQ ID NO: 2309996 - RNA, 15 nt, Human
agaggaaggggccag

SEQ ID NO: 2309997 - RNA, 20 nt, Human
agaggaacuguccagagagc

SEQ ID NO: 2309998 - RNA, 21 nt, Human
agaggaacuguccagagagca

SEQ ID NO: 2309999 - RNA, 22 nt, Human
agaggaagaauuuguuaucagu

SEQ ID NO: 2310000 - RNA, 13 nt, Human
agaggaagagcag

SEQ ID NO: 2310001 - RNA, 23 nt, Human
agaggacagaucaauggcgcagu

SEQ ID NO: 2310002 - RNA, 18 nt, Human
agaggacagaucaauggc

SEQ ID NO: 2310003 - RNA, 20 nt, Human
agaggacaguauuugugggg

SEQ ID NO: 2310004 - RNA, 14 nt, Human
agaggacgugggcg

SEQ ID NO: 2310005 - RNA, 16 nt, Human
agaggacgugggcggc

SEQ ID NO: 2310006 - RNA, 19 nt, Human
agaggacucacuugcccac

SEQ ID NO: 2310007 - RNA, 15 nt, Human
agaggaccggcggcu

SEQ ID NO: 2310008 - RNA, 14 nt, Human
agaggagaaacaca

SEQ ID NO: 2310009 - RNA, 22 nt, Human
agaggacgagcgauugaggugu

SEQ ID NO: 2310010 - RNA, 22 nt, Human
agaggacuguagggagggcggc

SEQ ID NO: 2310011 - RNA, 15 nt, Human
agaggagaaacacau

SEQ ID NO: 2310012 - RNA, 10 nt, Human
agaggagaga

SEQ ID NO: 2310013 - RNA, 15 nt, Human
agaggagagaggacc

SEQ ID NO: 2310014 - RNA, 16 nt, Human
agaggagagaggaccc

SEQ ID NO: 2310015 - RNA, 14 nt, Human
agaggaaccaaccc

SEQ ID NO: 2310016 - RNA, 16 nt, Human
agaggaaggagaggag

SEQ ID NO: 2310017 - RNA, 12 nt, Human
agaggaacuguc

SEQ ID NO: 2310018 - RNA, 15 nt, Human
agaggaacuguccag

SEQ ID NO: 2310019 - RNA, 17 nt, Human
agaggaacuguccagag

SEQ ID NO: 2310020 - RNA, 18 nt, Human
agaggaacuguccagaga

SEQ ID NO: 2310021 - RNA, 19 nt, Human
agaggaacuguccagagag

SEQ ID NO: 2310022 - RNA, 14 nt, Human
agagccccacacgg

SEQ ID NO: 2310023 - RNA, 15 nt, Human
agagcccaggccucc

SEQ ID NO: 2310024 - RNA, 13 nt, Human
agagcccaggccu

SEQ ID NO: 2310025 - RNA, 14 nt, Human
agagcccaggccuc

SEQ ID NO: 2310026 - RNA, 19 nt, Human
agauggccugagaagagag

SEQ ID NO: 2310027 - RNA, 19 nt, Human
agauggcauccugugaagu

SEQ ID NO: 2310028 - RNA, 17 nt, Human
agauggcauccugugaa

SEQ ID NO: 2310029 - RNA, 19 nt, Human
agauggcccagcuccccaa

SEQ ID NO: 2310030 - RNA, 14 nt, Human
agauggcagucacu

SEQ ID NO: 2310031 - RNA, 17 nt, Human
agaugaaagaggagguu

SEQ ID NO: 2310032 - RNA, 23 nt, Human
agaugaaagaggagguuuggggu

SEQ ID NO: 2310033 - RNA, 14 nt, Human
agauggcacuuuga

SEQ ID NO: 2310034 - RNA, 20 nt, Human
agaugaaaucuuacagcugg

SEQ ID NO: 2310035 - RNA, 23 nt, Human
agaugaaaucuuacagcugggug

SEQ ID NO: 2310036 - RNA, 17 nt, Human
agaugaaacacaaacaa

SEQ ID NO: 2310037 - RNA, 13 nt, Human
agaugaaagagga

SEQ ID NO: 2310038 - RNA, 20 nt, Human
agaugaaaaagcauguacag

SEQ ID NO: 2310039 - RNA, 21 nt, Human
agaugaaaaagcauguacagu

SEQ ID NO: 2310040 - RNA, 22 nt, Human
agaugaaaaagcauguacagug

SEQ ID NO: 2310041 - RNA, 14 nt, Human
agaugaaacacaaa

SEQ ID NO: 2310042 - RNA, 20 nt, Human
agauggcgagcauccuggcc

SEQ ID NO: 2310043 - RNA, 15 nt, Human
agauggcuccucuca

SEQ ID NO: 2310044 - RNA, 14 nt, Human
agauggcuccucuc

SEQ ID NO: 2310045 - RNA, 22 nt, Human
agauggcugacuuugcucuuuc

SEQ ID NO: 2310046 - RNA, 13 nt, Human
agaugggagcucc

SEQ ID NO: 2310047 - RNA, 14 nt, Human
agauggcugugccu

SEQ ID NO: 2310048 - RNA, 17 nt, Human
agaugggcuuguuuucu

SEQ ID NO: 2310049 - RNA, 16 nt, Human
agaugggcuuguuuuc

SEQ ID NO: 2310050 - RNA, 22 nt, Human
agaugggcauggggugggccuc

SEQ ID NO: 2310051 - RNA, 16 nt, Human
agaugggaugcuugcc

SEQ ID NO: 2310052 - RNA, 18 nt, Human
agaugggagcuccucucc

SEQ ID NO: 2310053 - RNA, 23 nt, Human
agaugggagcuccucuccuggag

SEQ ID NO: 2310054 - RNA, 21 nt, Human
agaucuuucaggaaagacgga

SEQ ID NO: 2310055 - RNA, 13 nt, Human
agaucuuucagga

SEQ ID NO: 2310056 - RNA, 12 nt, Human
agaucuuucagg

SEQ ID NO: 2310057 - RNA, 19 nt, Human
agaugaaaaagcauguaca

SEQ ID NO: 2310058 - RNA, 17 nt, Human
agaugaaaaagcaugua

SEQ ID NO: 2310059 - RNA, 14 nt, Human
agaucuucuguggg

SEQ ID NO: 2310060 - RNA, 19 nt, Human
agauauaugcucugcaugu

SEQ ID NO: 2310061 - RNA, 14 nt, Human
agaguucugcucua

SEQ ID NO: 2310062 - RNA, 22 nt, Human
agaguuccugcggagugaagag

SEQ ID NO: 2310063 - RNA, 13 nt, Human
agauauauuaaaa

SEQ ID NO: 2310064 - RNA, 17 nt, Human
agauauauuaaaaauau

SEQ ID NO: 2310065 - RNA, 15 nt, Human
agauauauuuuucac

SEQ ID NO: 2310066 - RNA, 14 nt, Human
agauauauuuuuca

SEQ ID NO: 2310067 - RNA, 21 nt, Human
agauauauuuuuaagauaaua

SEQ ID NO: 2310068 - RNA, 23 nt, Human
agauauauuuuuaagauaauaau

SEQ ID NO: 2310069 - RNA, 16 nt, Human
agauauauuuuucaca

SEQ ID NO: 2310070 - RNA, 17 nt, Human
agauauauuuuuaagau

SEQ ID NO: 2310071 - RNA, 20 nt, Human
agauauauuaagugacuguu

SEQ ID NO: 2310072 - RNA, 20 nt, Human
agauauauuuuuaagauaau

SEQ ID NO: 2310073 - RNA, 18 nt, Human
agauauauuaaaaauaua

SEQ ID NO: 2310074 - RNA, 19 nt, Human
agauauauuaaaaauauaa

SEQ ID NO: 2310075 - RNA, 20 nt, Human
agauauauuaaaaauauaaa

SEQ ID NO: 2310076 - RNA, 21 nt, Human
agauauauuaaaaauauaaaa

SEQ ID NO: 2310077 - RNA, 19 nt, Human
agaguuaguuucuuuggga

SEQ ID NO: 2310078 - RNA, 15 nt, Human
agaguuagacuguug

SEQ ID NO: 2310079 - RNA, 17 nt, Human
agaguuagacuguuggg

SEQ ID NO: 2310080 - RNA, 12 nt, Human
agaguuagacug

SEQ ID NO: 2310081 - RNA, 13 nt, Human
agaguuagacugu

SEQ ID NO: 2310082 - RNA, 14 nt, Human
agaguuagacuguu

SEQ ID NO: 2310083 - RNA, 19 nt, Human
agaguuccccaugcagaca

SEQ ID NO: 2310084 - RNA, 16 nt, Human
agaguuccugcggagu

SEQ ID NO: 2310085 - RNA, 16 nt, Human
agaguucacuauaaau

SEQ ID NO: 2310086 - RNA, 21 nt, Human
agaguucaauggcugcugaag

SEQ ID NO: 2310087 - RNA, 17 nt, Human
agaguucaauggcugcu

SEQ ID NO: 2310088 - RNA, 18 nt, Human
agaguucaauggcugcug

SEQ ID NO: 2310089 - RNA, 20 nt, Human
agaguucaauggcugcugaa

SEQ ID NO: 2310090 - RNA, 17 nt, Human
agaguuauuuaggcuuu

SEQ ID NO: 2310091 - RNA, 16 nt, Human
agauaucgacuuguuu

SEQ ID NO: 2310092 - RNA, 17 nt, Human
agauaucugagggagga

SEQ ID NO: 2310093 - RNA, 11 nt, Human
agagaaaagaa

SEQ ID NO: 2310094 - RNA, 10 nt, Human
agagaaaaga

SEQ ID NO: 2310095 - RNA, 18 nt, Human
agagaaaacuuauuugag

SEQ ID NO: 2310096 - RNA, 19 nt, Human
agagaaaacuuauuugagu

SEQ ID NO: 2310097 - RNA, 20 nt, Human
agagaaaacuuauuugagug

SEQ ID NO: 2310098 - RNA, 15 nt, Human
agagaaaagaaaaaa

SEQ ID NO: 2310099 - RNA, 14 nt, Human
agagaaaagaaaaa

SEQ ID NO: 2310100 - RNA, 13 nt, Human
agagaaaagaaaa

SEQ ID NO: 2310101 - RNA, 12 nt, Human
agagaaaagaaa

SEQ ID NO: 2310102 - RNA, 21 nt, Human
agagaaaagaaaaaaaaagaa

SEQ ID NO: 2310103 - RNA, 12 nt, Human
agagaaaauaaa

SEQ ID NO: 2310104 - RNA, 14 nt, Human
agagaaaauaaaaa

SEQ ID NO: 2310105 - RNA, 13 nt, Human
agagaaaauaaaa

SEQ ID NO: 2310106 - RNA, 15 nt, Human
agacugcugggacug

SEQ ID NO: 2310107 - RNA, 14 nt, Human
agacugcugggacu

SEQ ID NO: 2310108 - RNA, 19 nt, Human
agacuggaagcuaauuugc

SEQ ID NO: 2310109 - RNA, 14 nt, Human
agacuggaagcuaa

SEQ ID NO: 2310110 - RNA, 19 nt, Human
agacuggaagcacagcuuc

SEQ ID NO: 2310111 - RNA, 17 nt, Human
agacuggaagcacagcu

SEQ ID NO: 2310112 - RNA, 16 nt, Human
agacuggaagcacagc

SEQ ID NO: 2310113 - RNA, 22 nt, Human
agacugcgggaugguccugggg

SEQ ID NO: 2310114 - RNA, 20 nt, Human
agacugcgggaugguccugg

SEQ ID NO: 2310115 - RNA, 23 nt, Human
agacugcgauuugucccaggucc

SEQ ID NO: 2310116 - RNA, 23 nt, Human
agacugcgggaugguccuggggc

SEQ ID NO: 2310117 - RNA, 21 nt, Human
agacugcauuauauuuauuac

SEQ ID NO: 2310118 - RNA, 19 nt, Human
agagcccaccuuggcucaa

SEQ ID NO: 2310119 - RNA, 13 nt, Human
agagcccacgccc

SEQ ID NO: 2310120 - RNA, 15 nt, Human
agagcccagcuccaa

SEQ ID NO: 2310121 - RNA, 16 nt, Human
agagcccacgccccca

SEQ ID NO: 2310122 - RNA, 12 nt, Human
agagagcuggua

SEQ ID NO: 2310123 - RNA, 11 nt, Human
agagagcuggu

SEQ ID NO: 2310124 - RNA, 23 nt, Human
agagagcugguaguuaguagcau

SEQ ID NO: 2310125 - RNA, 22 nt, Human
agagaggguggugaccucugcc

SEQ ID NO: 2310126 - RNA, 20 nt, Human
agagaggguggugaccucug

SEQ ID NO: 2310127 - RNA, 21 nt, Human
agagaggguggugaccucugc

SEQ ID NO: 2310128 - RNA, 14 nt, Human
agagaacgcagccc

SEQ ID NO: 2310129 - RNA, 15 nt, Human
agagaacgcagcccu

SEQ ID NO: 2310130 - RNA, 16 nt, Human
agagaacuaacacuau

SEQ ID NO: 2310131 - RNA, 22 nt, Human
agagaacuaacacuauuuuaug

SEQ ID NO: 2310132 - RNA, 14 nt, Human
agagaacuguggcc

SEQ ID NO: 2310133 - RNA, 12 nt, Human
agagaagaauga

SEQ ID NO: 2310134 - RNA, 15 nt, Human
agagaagaaugagcc

SEQ ID NO: 2310135 - RNA, 11 nt, Human
agagaagacaa

SEQ ID NO: 2310136 - RNA, 17 nt, Human
agagaacuuccagaucc

SEQ ID NO: 2310137 - RNA, 20 nt, Human
agagaaccuggaguuccuga

SEQ ID NO: 2310138 - RNA, 17 nt, Human
agagaaaauaaaaaguu

SEQ ID NO: 2310139 - RNA, 16 nt, Human
agagaaaauaaaaagu

SEQ ID NO: 2310140 - RNA, 15 nt, Human
agagaaaauaaaaag

SEQ ID NO: 2310141 - RNA, 18 nt, Human
agagagcgagcgcuaccc

SEQ ID NO: 2310142 - RNA, 18 nt, Human
agagagccauuuugugaa

SEQ ID NO: 2310143 - RNA, 19 nt, Human
agagagccauuuugugaau

SEQ ID NO: 2310144 - RNA, 21 nt, Human
agagagcggucucaggcuggu

SEQ ID NO: 2310145 - RNA, 16 nt, Human
agagagcggucucagg

SEQ ID NO: 2310146 - RNA, 16 nt, Human
agagaagacccuucuc

SEQ ID NO: 2310147 - RNA, 18 nt, Human
agagagcaccccucucug

SEQ ID NO: 2310148 - RNA, 17 nt, Human
agagagcagcuucugcc

SEQ ID NO: 2310149 - RNA, 19 nt, Human
agagagcagcuucugccac

SEQ ID NO: 2310150 - RNA, 23 nt, Human
agagagcagcuucugccacuucc

SEQ ID NO: 2310151 - RNA, 13 nt, Human
agagagccauuuu

SEQ ID NO: 2310152 - RNA, 15 nt, Human
agagagccauuuugu

SEQ ID NO: 2310153 - RNA, 17 nt, Human
agagagccauuuuguga

SEQ ID NO: 2310154 - RNA, 17 nt, Human
agacgugauuuugcugu

SEQ ID NO: 2310155 - RNA, 14 nt, Human
agacgucccuccac

SEQ ID NO: 2310156 - RNA, 19 nt, Human
agacguaugcuuauuuuaa

SEQ ID NO: 2310157 - RNA, 18 nt, Human
agacguaugcuuauuuua

SEQ ID NO: 2310158 - RNA, 13 nt, Human
agacguguacaua

SEQ ID NO: 2310159 - RNA, 20 nt, Human
agacccccagcaacccuccu

SEQ ID NO: 2310160 - RNA, 13 nt, Human
agacccccacucu

SEQ ID NO: 2310161 - RNA, 21 nt, Human
agacggaggccuacucuucca

SEQ ID NO: 2310162 - RNA, 22 nt, Human
agacgcugugcugcccugccca

SEQ ID NO: 2310163 - RNA, 16 nt, Human
agacguaugcuuauuu

SEQ ID NO: 2310164 - RNA, 17 nt, Human
agacguaggggaggggu

SEQ ID NO: 2310165 - RNA, 20 nt, Human
agacguacguaucagcggcc

SEQ ID NO: 2310166 - RNA, 19 nt, Human
agacgguucaccagccucu

SEQ ID NO: 2310167 - RNA, 18 nt, Human
agacggagucccaccuug

SEQ ID NO: 2310168 - RNA, 15 nt, Human
agacccauuccuauu

SEQ ID NO: 2310169 - RNA, 20 nt, Human
agacagcucccucugccuga

SEQ ID NO: 2310170 - RNA, 16 nt, Human
agacccauuccuauuu

SEQ ID NO: 2310171 - RNA, 12 nt, Human
agacagcugccu

SEQ ID NO: 2310172 - RNA, 11 nt, Human
agacagcucuu

SEQ ID NO: 2310173 - RNA, 12 nt, Human
agacagcucuua

SEQ ID NO: 2310174 - RNA, 12 nt, Human
agacccccaccc

SEQ ID NO: 2310175 - RNA, 11 nt, Human
agacccccacc

SEQ ID NO: 2310176 - RNA, 15 nt, Human
agacccccacaccuc

SEQ ID NO: 2310177 - RNA, 14 nt, Human
agacccccacaccu

SEQ ID NO: 2310178 - RNA, 13 nt, Human
agacccccacacc

SEQ ID NO: 2310179 - RNA, 12 nt, Human
agaccccaccca

SEQ ID NO: 2310180 - RNA, 15 nt, Human
agaccccacccaagc

SEQ ID NO: 2310181 - RNA, 16 nt, Human
agaccccacccaagcu

SEQ ID NO: 2310182 - RNA, 20 nt, Human
agaccccacccaagcuuggc

SEQ ID NO: 2310183 - RNA, 23 nt, Human
agaccccacccaagcuuggcagc

SEQ ID NO: 2310184 - RNA, 12 nt, Human
agacccccacuc

SEQ ID NO: 2310185 - RNA, 21 nt, Human
agacccccaccccuuccccac

SEQ ID NO: 2310186 - RNA, 20 nt, Human
agacccccaccccuucccca

SEQ ID NO: 2310187 - RNA, 19 nt, Human
agacccccaccccuucccc

SEQ ID NO: 2310188 - RNA, 17 nt, Human
agacccccaccccuucc

SEQ ID NO: 2310189 - RNA, 16 nt, Human
agacccccaccccuuc

SEQ ID NO: 2310190 - RNA, 14 nt, Human
agacccccaccccu

SEQ ID NO: 2310191 - RNA, 13 nt, Human
agacccccacccc

SEQ ID NO: 2310192 - RNA, 21 nt, Human
agacgcugugcugcccugccc

SEQ ID NO: 2310193 - RNA, 21 nt, Human
agacaaauucuguuucuugag

SEQ ID NO: 2310194 - RNA, 19 nt, Human
agacaaauucuguuucuug

SEQ ID NO: 2310195 - RNA, 18 nt, Human
agacaaauucuguuucuu

SEQ ID NO: 2310196 - RNA, 17 nt, Human
agacaaauucuguuucu

SEQ ID NO: 2310197 - RNA, 15 nt, Human
agacaagacuucagu

SEQ ID NO: 2310198 - RNA, 18 nt, Human
agacaagaaaucccuguu

SEQ ID NO: 2310199 - RNA, 19 nt, Human
agacaagacuucaguaugu

SEQ ID NO: 2310200 - RNA, 21 nt, Human
agacaagacuucaguauguug

SEQ ID NO: 2310201 - RNA, 13 nt, Human
agacaagaaaucc

SEQ ID NO: 2310202 - RNA, 17 nt, Human
agacaagaaaucccugu

SEQ ID NO: 2310203 - RNA, 23 nt, Human
agacagagucucacuguugccca

SEQ ID NO: 2310204 - RNA, 15 nt, Human
agacaagagauggga

SEQ ID NO: 2310205 - RNA, 14 nt, Human
agacaacagaaguc

SEQ ID NO: 2310206 - RNA, 13 nt, Human
agacaacagaagu

SEQ ID NO: 2310207 - RNA, 15 nt, Human
agacaacagaaguca

SEQ ID NO: 2310208 - RNA, 21 nt, Human
agacaacccugcaaaggacug

SEQ ID NO: 2310209 - RNA, 20 nt, Human
agacaacccugcaaaggacu

SEQ ID NO: 2310210 - RNA, 14 nt, Human
agacaacccugcaa

SEQ ID NO: 2310211 - RNA, 19 nt, Human
agacagcucccucugccug

SEQ ID NO: 2310212 - RNA, 18 nt, Human
agacagcucccucugccu

SEQ ID NO: 2310213 - RNA, 15 nt, Human
agacagcucccucug

SEQ ID NO: 2310214 - RNA, 21 nt, Human
agacagcuccacccuggccga

SEQ ID NO: 2310215 - RNA, 19 nt, Human
agacagccccagagcaggg

SEQ ID NO: 2310216 - RNA, 20 nt, Human
agacagccccagagcagggu

SEQ ID NO: 2310217 - RNA, 17 nt, Human
agacagcuccacccugg

SEQ ID NO: 2310218 - RNA, 13 nt, Human
agacagccccaga

SEQ ID NO: 2310219 - RNA, 15 nt, Human
agacagccccagagc

SEQ ID NO: 2310220 - RNA, 17 nt, Human
agacagccccagagcag

SEQ ID NO: 2310221 - RNA, 18 nt, Human
agacagccccagagcagg

SEQ ID NO: 2310222 - RNA, 14 nt, Human
agacagcccgggcu

SEQ ID NO: 2310223 - RNA, 15 nt, Human
agacagcccgggcuc

SEQ ID NO: 2310224 - RNA, 15 nt, Human
agacagauacuccuc

SEQ ID NO: 2310225 - RNA, 21 nt, Human
agacagauacuccuccaaggu

SEQ ID NO: 2310226 - RNA, 12 nt, Human
agacagccccag

SEQ ID NO: 2310227 - RNA, 21 nt, Human
aauacuauauuuauacuguau

SEQ ID NO: 2310228 - RNA, 15 nt, Human
aauacuacuccugua

SEQ ID NO: 2310229 - RNA, 14 nt, Human
aauacuaguuguga

SEQ ID NO: 2310230 - RNA, 17 nt, Human
aauacuaguugugaccu

SEQ ID NO: 2310231 - RNA, 15 nt, Human
aauacuauuuuuacu

SEQ ID NO: 2310232 - RNA, 19 nt, Human
aauacuagggagaagguuu

SEQ ID NO: 2310233 - RNA, 21 nt, Human
aauacuaccuugaaaauaaga

SEQ ID NO: 2310234 - RNA, 18 nt, Human
aauacuaccuugaaaaua

SEQ ID NO: 2310235 - RNA, 17 nt, Human
aauacuaccuugaaaau

SEQ ID NO: 2310236 - RNA, 16 nt, Human
aauacucauaauguga

SEQ ID NO: 2310237 - RNA, 17 nt, Human
aauacucauaaugugaa

SEQ ID NO: 2310238 - RNA, 16 nt, Human
aauacuauuuuuacug

SEQ ID NO: 2310239 - RNA, 17 nt, Human
aauacuauuuuuacugc

SEQ ID NO: 2310240 - RNA, 19 nt, Human
aauacuauuuuuacugcca

SEQ ID NO: 2310241 - RNA, 21 nt, Human
aauacuauuuuuacugccacu

SEQ ID NO: 2310242 - RNA, 18 nt, Human
aauacucauaaugugaag

SEQ ID NO: 2310243 - RNA, 19 nt, Human
aauacucauaaugugaagu

SEQ ID NO: 2310244 - RNA, 23 nt, Human
aauacucauaaugugaaguguua

SEQ ID NO: 2310245 - RNA, 12 nt, Human
aauacucaugug

SEQ ID NO: 2310246 - RNA, 13 nt, Human
aauacucaugugu

SEQ ID NO: 2310247 - RNA, 14 nt, Human
aauacucaugugua

SEQ ID NO: 2310248 - RNA, 15 nt, Human
aauacucauguguau

SEQ ID NO: 2310249 - RNA, 16 nt, Human
aauacucauguguaug

SEQ ID NO: 2310250 - RNA, 23 nt, Human
aauacucuuaggaagagaaacca

SEQ ID NO: 2310251 - RNA, 22 nt, Human
aauacucuacccucuuagaaaa

SEQ ID NO: 2310252 - RNA, 20 nt, Human
aauacucuacccucuuagaa

SEQ ID NO: 2310253 - RNA, 13 nt, Human
aauagaaaacuga

SEQ ID NO: 2310254 - RNA, 10 nt, Human
aauacuuuuu

SEQ ID NO: 2310255 - RNA, 20 nt, Human
aauagaaaacugaaaaucua

SEQ ID NO: 2310256 - RNA, 19 nt, Human
aauagaaaacugaaaaucu

SEQ ID NO: 2310257 - RNA, 17 nt, Human
aauagaaaacugaaaau

SEQ ID NO: 2310258 - RNA, 18 nt, Human
aauagaaaacugaaaauc

SEQ ID NO: 2310259 - RNA, 15 nt, Human
aauacuuuuuacaau

SEQ ID NO: 2310260 - RNA, 11 nt, Human
aauacuuuugc

SEQ ID NO: 2310261 - RNA, 14 nt, Human
aauacuuuaaagga

SEQ ID NO: 2310262 - RNA, 15 nt, Human
aauacuuuaaaggaa

SEQ ID NO: 2310263 - RNA, 16 nt, Human
aauacuuuaaaggaaa

SEQ ID NO: 2310264 - RNA, 17 nt, Human
aauacuuuaaaggaaaa

SEQ ID NO: 2310265 - RNA, 16 nt, Human
aauacugccagaugcu

SEQ ID NO: 2310266 - RNA, 17 nt, Human
aauacugccagaugcug

SEQ ID NO: 2310267 - RNA, 23 nt, Human
aauacugccagaugcugauguuc

SEQ ID NO: 2310268 - RNA, 24 nt, Human
aauacugccagaugcugauguuca

SEQ ID NO: 2310269 - RNA, 18 nt, Human
aauacugccagaugcuga

SEQ ID NO: 2310270 - RNA, 19 nt, Human
aauacugccagaugcugau

SEQ ID NO: 2310271 - RNA, 20 nt, Human
aauacugccagaugcugaug

SEQ ID NO: 2310272 - RNA, 22 nt, Human
aauacugccagaugcugauguu

SEQ ID NO: 2310273 - RNA, 17 nt, Human
aauacuugucaauauuu

SEQ ID NO: 2310274 - RNA, 18 nt, Human
aauacuugucaauauuua

SEQ ID NO: 2310275 - RNA, 20 nt, Human
aauacuugucaauauuuaaa

SEQ ID NO: 2310276 - RNA, 22 nt, Human
aauacuguacaaugacuuuauu

SEQ ID NO: 2310277 - RNA, 16 nt, Human
aauacuguauuuugua

SEQ ID NO: 2310278 - RNA, 16 nt, Human
aauauaucccagaaau

SEQ ID NO: 2310279 - RNA, 22 nt, Human
aauauaucccagaaauuagaaa

SEQ ID NO: 2310280 - RNA, 17 nt, Human
aauauaucuaaauugaa

SEQ ID NO: 2310281 - RNA, 18 nt, Human
aauauaucuaaauugaau

SEQ ID NO: 2310282 - RNA, 17 nt, Human
aauauauaucugcuguc

SEQ ID NO: 2310283 - RNA, 19 nt, Human
aauauaccccuuaguguuu

SEQ ID NO: 2310284 - RNA, 16 nt, Human
aauauacuuguggacu

SEQ ID NO: 2310285 - RNA, 16 nt, Human
aauauauaucaaauau

SEQ ID NO: 2310286 - RNA, 13 nt, Human
aauauacuugugg

SEQ ID NO: 2310287 - RNA, 15 nt, Human
aauauacuuguggac

SEQ ID NO: 2310288 - RNA, 20 nt, Human
aauauaucuaaauugaauaa

SEQ ID NO: 2310289 - RNA, 21 nt, Human
aauauaucuaaauugaauaau

SEQ ID NO: 2310290 - RNA, 14 nt, Human
aauauauggcagag

SEQ ID NO: 2310291 - RNA, 19 nt, Human
aauauauggcagaguugua

SEQ ID NO: 2310292 - RNA, 20 nt, Human
aauauauggcagaguuguaa

SEQ ID NO: 2310293 - RNA, 21 nt, Human
aauauguuuuuuagaucaaau

SEQ ID NO: 2310294 - RNA, 22 nt, Human
aauauguuuuuuagaucaaaua

SEQ ID NO: 2310295 - RNA, 20 nt, Human
aauagaaggauguacauuuc

SEQ ID NO: 2310296 - RNA, 19 nt, Human
aauagaaggauguacauuu

SEQ ID NO: 2310297 - RNA, 22 nt, Human
aauagaaggauguacauuucca

SEQ ID NO: 2310298 - RNA, 17 nt, Human
aauagaauauaauuauc

SEQ ID NO: 2310299 - RNA, 20 nt, Human
aauagaauauaauuaucgga

SEQ ID NO: 2310300 - RNA, 13 nt, Human
aauagacaauuua

SEQ ID NO: 2310301 - RNA, 19 nt, Human
aauauacauucaaacuuaa

SEQ ID NO: 2310302 - RNA, 18 nt, Human
aauauacauucaaacuua

SEQ ID NO: 2310303 - RNA, 17 nt, Human
aauauacuauauuuaug

SEQ ID NO: 2310304 - RNA, 11 nt, Human
aauauacugua

SEQ ID NO: 2310305 - RNA, 13 nt, Human
aauauacuguaaa

SEQ ID NO: 2310306 - RNA, 12 nt, Human
aauauacuguaa

SEQ ID NO: 2310307 - RNA, 23 nt, Human
aauauacuguaaagaaagagaga

SEQ ID NO: 2310308 - RNA, 22 nt, Human
aauauacuguaaagaaagagag

SEQ ID NO: 2310309 - RNA, 21 nt, Human
aauauacuguaaagaaagaga

SEQ ID NO: 2310310 - RNA, 18 nt, Human
aauauacuguaaagaaag

SEQ ID NO: 2310311 - RNA, 17 nt, Human
aauauacuguaaagaaa

SEQ ID NO: 2310312 - RNA, 16 nt, Human
aauauacuguaaagaa

SEQ ID NO: 2310313 - RNA, 15 nt, Human
aauauacuguaaaga

SEQ ID NO: 2310314 - RNA, 14 nt, Human
aauauacuguaaag

SEQ ID NO: 2310315 - RNA, 19 nt, Human
aaucacauucgaguguuuc

SEQ ID NO: 2310316 - RNA, 14 nt, Human
aaucaccgaaaacg

SEQ ID NO: 2310317 - RNA, 15 nt, Human
aaucaccaaaggcuc

SEQ ID NO: 2310318 - RNA, 20 nt, Human
aaucaccacaccaaaccucu

SEQ ID NO: 2310319 - RNA, 15 nt, Human
aaucaccgaaaacgu

SEQ ID NO: 2310320 - RNA, 16 nt, Human
aaucaagagcugcccu

SEQ ID NO: 2310321 - RNA, 17 nt, Human
aaucaagagcugcccuc

SEQ ID NO: 2310322 - RNA, 13 nt, Human
aaucaagagcugc

SEQ ID NO: 2310323 - RNA, 14 nt, Human
aaucaagagcugcc

SEQ ID NO: 2310324 - RNA, 20 nt, Human
aaucaagauuuaauccuaga

SEQ ID NO: 2310325 - RNA, 13 nt, Human
aaucaagccucug

SEQ ID NO: 2310326 - RNA, 23 nt, Human
aaucaagccucuggucacauggc

SEQ ID NO: 2310327 - RNA, 15 nt, Human
aaucaagcuucaguu

SEQ ID NO: 2310328 - RNA, 23 nt, Human
aaucaagggcaaaaagucuacau

SEQ ID NO: 2310329 - RNA, 16 nt, Human
aauauuauacuaagaa

SEQ ID NO: 2310330 - RNA, 20 nt, Human
aauauuagaugugauuuaau

SEQ ID NO: 2310331 - RNA, 15 nt, Human
aauauuauacuaaga

SEQ ID NO: 2310332 - RNA, 22 nt, Human
aauauuauacuaagaaaagaua

SEQ ID NO: 2310333 - RNA, 18 nt, Human
aauauuagcuuuacuguu

SEQ ID NO: 2310334 - RNA, 15 nt, Human
aauauuagcuuuacu

SEQ ID NO: 2310335 - RNA, 16 nt, Human
aauauuagaugugauu

SEQ ID NO: 2310336 - RNA, 17 nt, Human
aauauuagaugugauuu

SEQ ID NO: 2310337 - RNA, 18 nt, Human
aauauuagaugugauuua

SEQ ID NO: 2310338 - RNA, 19 nt, Human
aauauuagaugugauuuaa

SEQ ID NO: 2310339 - RNA, 21 nt, Human
aauauuagcuuuacuguuugu

SEQ ID NO: 2310340 - RNA, 19 nt, Human
aauauuagcuuuacuguuu

SEQ ID NO: 2310341 - RNA, 21 nt, Human
aauauuagugaccucagcuuu

SEQ ID NO: 2310342 - RNA, 17 nt, Human
aauauuaaacccuggau

SEQ ID NO: 2310343 - RNA, 13 nt, Human
aauauuagaaaca

SEQ ID NO: 2310344 - RNA, 12 nt, Human
aauauuagaugu

SEQ ID NO: 2310345 - RNA, 13 nt, Human
aauauuagaugug

SEQ ID NO: 2310346 - RNA, 14 nt, Human
aauauuagauguga

SEQ ID NO: 2310347 - RNA, 15 nt, Human
aauauuagaugugau

SEQ ID NO: 2310348 - RNA, 17 nt, Human
aaugaaguuguagguaa

SEQ ID NO: 2310349 - RNA, 23 nt, Human
aaugaagucucugaagugaaacu

SEQ ID NO: 2310350 - RNA, 16 nt, Human
aaugaaguauuucuca

SEQ ID NO: 2310351 - RNA, 16 nt, Human
aaugaagucucugaag

SEQ ID NO: 2310352 - RNA, 14 nt, Human
aaugaagucucuga

SEQ ID NO: 2310353 - RNA, 16 nt, Human
aaugauccccagcugu

SEQ ID NO: 2310354 - RNA, 20 nt, Human
aaugauccccaagugugaac

SEQ ID NO: 2310355 - RNA, 16 nt, Human
aaugaaguuugaaugu

SEQ ID NO: 2310356 - RNA, 12 nt, Human
aaugaaguuuga

SEQ ID NO: 2310357 - RNA, 13 nt, Human
aaugaaguuugaa

SEQ ID NO: 2310358 - RNA, 14 nt, Human
aaugaaguuugaau

SEQ ID NO: 2310359 - RNA, 15 nt, Human
aaugaaguuugaaug

SEQ ID NO: 2310360 - RNA, 21 nt, Human
aaugaaauaauguacaucugg

SEQ ID NO: 2310361 - RNA, 15 nt, Human
aaugaaaguuugcac

SEQ ID NO: 2310362 - RNA, 13 nt, Human
aaugaaauacugu

SEQ ID NO: 2310363 - RNA, 14 nt, Human
aaugaaauacacaa

SEQ ID NO: 2310364 - RNA, 12 nt, Human
aaugaaauaucu

SEQ ID NO: 2310365 - RNA, 22 nt, Human
aaugaaauaucuguauuuaauu

SEQ ID NO: 2310366 - RNA, 18 nt, Human
aaugaaaugcucuccuuu

SEQ ID NO: 2310367 - RNA, 17 nt, Human
aaugaaaugcucuccuu

SEQ ID NO: 2310368 - RNA, 21 nt, Human
aaugaaauccugcuucagugu

SEQ ID NO: 2310369 - RNA, 14 nt, Human
aaugaaauaucugu

SEQ ID NO: 2310370 - RNA, 22 nt, Human
aaugaaggcgggccugcaagcc

SEQ ID NO: 2310371 - RNA, 19 nt, Human
aaugaaaugcucuccuuuc

SEQ ID NO: 2310372 - RNA, 22 nt, Human
aaugaaggugucagaauaauaa

SEQ ID NO: 2310373 - RNA, 21 nt, Human
aaugaagguuaggauuuaaca

SEQ ID NO: 2310374 - RNA, 22 nt, Human
aaugaagguuaggauuuaacag

SEQ ID NO: 2310375 - RNA, 22 nt, Human
aaugauccccagcuguuuaugc

SEQ ID NO: 2310376 - RNA, 19 nt, Human
aaugauccccagcuguuua

SEQ ID NO: 2310377 - RNA, 20 nt, Human
aaugauccccagcuguuuau

SEQ ID NO: 2310378 - RNA, 15 nt, Human
aaugauuaugaauua

SEQ ID NO: 2310379 - RNA, 13 nt, Human
aaugaucuagguu

SEQ ID NO: 2310380 - RNA, 14 nt, Human
aaugaucuagguuu

SEQ ID NO: 2310381 - RNA, 16 nt, Human
aaugaucuagguuuaa

SEQ ID NO: 2310382 - RNA, 17 nt, Human
aaugaucuagguuuaac

SEQ ID NO: 2310383 - RNA, 18 nt, Human
aaugaucuagguuuaacu

SEQ ID NO: 2310384 - RNA, 19 nt, Human
aaugaucuagguuuaacuc

SEQ ID NO: 2310385 - RNA, 22 nt, Human
aaugaucuagguuuaacucaga

SEQ ID NO: 2310386 - RNA, 23 nt, Human
aaugaucuagguuuaacucagau

SEQ ID NO: 2310387 - RNA, 22 nt, Human
aaugaucucucugaauccuaag

SEQ ID NO: 2310388 - RNA, 16 nt, Human
aaugauuaauuaaaac

SEQ ID NO: 2310389 - RNA, 23 nt, Human
aaugauuaugaauuacauuugua

SEQ ID NO: 2310390 - RNA, 21 nt, Human
aaugauuaugaauuacauuug

SEQ ID NO: 2310391 - RNA, 16 nt, Human
aaucucuccauucccg

SEQ ID NO: 2310392 - RNA, 17 nt, Human
aauccaggcagauccag

SEQ ID NO: 2310393 - RNA, 18 nt, Human
aauccaggcagauccagg

SEQ ID NO: 2310394 - RNA, 18 nt, Human
aaucucaaauuucuaaau

SEQ ID NO: 2310395 - RNA, 17 nt, Human
aaucucaaauuucuaaa

SEQ ID NO: 2310396 - RNA, 20 nt, Human
aaucucucgguuccacgucc

SEQ ID NO: 2310397 - RNA, 13 nt, Human
aaucucugugccu

SEQ ID NO: 2310398 - RNA, 17 nt, Human
aaugaaaguauaacuga

SEQ ID NO: 2310399 - RNA, 22 nt, Human
aaugaaagcauguggcauguuc

SEQ ID NO: 2310400 - RNA, 19 nt, Human
aaugaaaguauaacugagu

SEQ ID NO: 2310401 - RNA, 15 nt, Human
aaucucuuuuugacu

SEQ ID NO: 2310402 - RNA, 20 nt, Human
aaucucuuuuugcuuucgaa

SEQ ID NO: 2310403 - RNA, 23 nt, Human
aauccaagcgaggucaacagaga

SEQ ID NO: 2310404 - RNA, 13 nt, Human
aauccagccugcu

SEQ ID NO: 2310405 - RNA, 15 nt, Human
aaucucaaauuucua

SEQ ID NO: 2310406 - RNA, 16 nt, Human
aaucucaaauuucuaa

SEQ ID NO: 2310407 - RNA, 19 nt, Human
aauccagacccggcugcgu

SEQ ID NO: 2310408 - RNA, 17 nt, Human
aauccagacccggcugc

SEQ ID NO: 2310409 - RNA, 15 nt, Human
aauccaaugaaauga

SEQ ID NO: 2310410 - RNA, 17 nt, Human
aauccaagcaaauguga

SEQ ID NO: 2310411 - RNA, 18 nt, Human
aauccaagcaaaugugaa

SEQ ID NO: 2310412 - RNA, 18 nt, Human
aaugguugccuuaaagaa

SEQ ID NO: 2310413 - RNA, 15 nt, Human
aaugguuguauuaga

SEQ ID NO: 2310414 - RNA, 16 nt, Human
aaugguuguauuagau

SEQ ID NO: 2310415 - RNA, 17 nt, Human
aaugucacuuaaaggcu

SEQ ID NO: 2310416 - RNA, 15 nt, Human
aaugucagauacaau

SEQ ID NO: 2310417 - RNA, 19 nt, Human
aaugucagaaaccaguuau

SEQ ID NO: 2310418 - RNA, 17 nt, Human
aaugguugacuggguuu

SEQ ID NO: 2310419 - RNA, 21 nt, Human
aaugguuccaugccugagggu

SEQ ID NO: 2310420 - RNA, 15 nt, Human
aaugguugccuuaaa

SEQ ID NO: 2310421 - RNA, 12 nt, Human
aaugguuguauu

SEQ ID NO: 2310422 - RNA, 13 nt, Human
aaugguuguauua

SEQ ID NO: 2310423 - RNA, 14 nt, Human
aaugguuccaugcc

SEQ ID NO: 2310424 - RNA, 19 nt, Human
aaugguuccaugccugagg

SEQ ID NO: 2310425 - RNA, 15 nt, Human
aaugguuauaaaagu

SEQ ID NO: 2310426 - RNA, 16 nt, Human
aaugguuauaaaagug

SEQ ID NO: 2310427 - RNA, 17 nt, Human
aaugguuauaaaaguga

SEQ ID NO: 2310428 - RNA, 19 nt, Human
aaugguuauaaaagugauu

SEQ ID NO: 2310429 - RNA, 20 nt, Human
aaugucaggaacagaaggau

SEQ ID NO: 2310430 - RNA, 18 nt, Human
aaugucaggaacagaagg

SEQ ID NO: 2310431 - RNA, 16 nt, Human
aaugucagauacaaug

SEQ ID NO: 2310432 - RNA, 17 nt, Human
aaugucagauacaaugu

SEQ ID NO: 2310433 - RNA, 18 nt, Human
aaugucagauacaaugua

SEQ ID NO: 2310434 - RNA, 21 nt, Human
aaugucagauacaauguauuu

SEQ ID NO: 2310435 - RNA, 15 nt, Human
aaugucaguaugugg

SEQ ID NO: 2310436 - RNA, 13 nt, Human
aaugucaguaugu

SEQ ID NO: 2310437 - RNA, 19 nt, Human
aaugucauuaaaauaaaua

SEQ ID NO: 2310438 - RNA, 17 nt, Human
aaugucaucagaacuuu

SEQ ID NO: 2310439 - RNA, 23 nt, Human
aaugcuauaacuauguugauaaa

SEQ ID NO: 2310440 - RNA, 21 nt, Human
aaugcuagguuaauuccaauu

SEQ ID NO: 2310441 - RNA, 18 nt, Human
aaugcugaacauugcaua

SEQ ID NO: 2310442 - RNA, 18 nt, Human
aaugcugaaaaaacaccu

SEQ ID NO: 2310443 - RNA, 19 nt, Human
aaugcugcgcccuucccca

SEQ ID NO: 2310444 - RNA, 15 nt, Human
aaugcugccugccug

SEQ ID NO: 2310445 - RNA, 12 nt, Human
aaugcugccugc

SEQ ID NO: 2310446 - RNA, 14 nt, Human
aaugcugccugccu

SEQ ID NO: 2310447 - RNA, 18 nt, Human
aaugcugccugccugucu

SEQ ID NO: 2310448 - RNA, 12 nt, Human
aaugcugcagau

SEQ ID NO: 2310449 - RNA, 20 nt, Human
aaugcugcagauuugggcug

SEQ ID NO: 2310450 - RNA, 14 nt, Human
aaugcugcauuuua

SEQ ID NO: 2310451 - RNA, 16 nt, Human
aaugcugcauuuuaau

SEQ ID NO: 2310452 - RNA, 21 nt, Human
aaugcugcauuuuaauuuuaa

SEQ ID NO: 2310453 - RNA, 22 nt, Human
aaugcugcccaugccaccgcuu

SEQ ID NO: 2310454 - RNA, 23 nt, Human
aaugcugcccaugccaccgcuuc

SEQ ID NO: 2310455 - RNA, 17 nt, Human
aaugguguuuuuuuaau

SEQ ID NO: 2310456 - RNA, 14 nt, Human
aaugguuauaaaag

SEQ ID NO: 2310457 - RNA, 13 nt, Human
aaugguuaaaaga

SEQ ID NO: 2310458 - RNA, 19 nt, Human
aaugguguuguaugccuuu

SEQ ID NO: 2310459 - RNA, 13 nt, Human
aauguuuccuuua

SEQ ID NO: 2310460 - RNA, 20 nt, Human
aauguuuccaaccuggagua

SEQ ID NO: 2310461 - RNA, 15 nt, Human
aauguuuauuccuug

SEQ ID NO: 2310462 - RNA, 16 nt, Human
aauguuuauuccuuga

SEQ ID NO: 2310463 - RNA, 22 nt, Human
aauguuucuucuagguucuaaa

SEQ ID NO: 2310464 - RNA, 15 nt, Human
aauguuucugcagua

SEQ ID NO: 2310465 - RNA, 23 nt, Human
aauguuucuucuagguucuaaaa

SEQ ID NO: 2310466 - RNA, 15 nt, Human
aauguuugccucugc

SEQ ID NO: 2310467 - RNA, 16 nt, Human
aauguuugccucugcc

SEQ ID NO: 2310468 - RNA, 12 nt, Human
aauguuuccuuu

SEQ ID NO: 2310469 - RNA, 22 nt, Human
aauguuuaugagccagacaaau

SEQ ID NO: 2310470 - RNA, 20 nt, Human
aauguuuauuccugauaaua

SEQ ID NO: 2310471 - RNA, 23 nt, Human
aauguuuaugcaaggaaggaaag

SEQ ID NO: 2310472 - RNA, 23 nt, Human
aauguuucaaacauauauaacaa

SEQ ID NO: 2310473 - RNA, 22 nt, Human
aauguuuaugcaaggaaggaaa

SEQ ID NO: 2310474 - RNA, 21 nt, Human
aauguuuaugcaaggaaggaa

SEQ ID NO: 2310475 - RNA, 18 nt, Human
aauguuuaugagccagac

SEQ ID NO: 2310476 - RNA, 17 nt, Human
aauguuuaugagccaga

SEQ ID NO: 2310477 - RNA, 16 nt, Human
aauguuuaugagccag

SEQ ID NO: 2310478 - RNA, 15 nt, Human
aauguuuaugagcca

SEQ ID NO: 2310479 - RNA, 21 nt, Human
aauguuuacagggagccuccu

SEQ ID NO: 2310480 - RNA, 22 nt, Human
aauguuuacagggagccuccug

SEQ ID NO: 2310481 - RNA, 20 nt, Human
aauguuuagcaaauacauau

SEQ ID NO: 2310482 - RNA, 22 nt, Human
aauguuuacagauccccaagcc

SEQ ID NO: 2310483 - RNA, 15 nt, Human
aaugugaaaagaaaa

SEQ ID NO: 2310484 - RNA, 17 nt, Human
aaugugaaaagaaaaau

SEQ ID NO: 2310485 - RNA, 17 nt, Human
aaugucuuuugaauauu

SEQ ID NO: 2310486 - RNA, 14 nt, Human
aauguuuaaugcug

SEQ ID NO: 2310487 - RNA, 20 nt, Human
aauguuuacacucuuuguaa

SEQ ID NO: 2310488 - RNA, 23 nt, Human
aauguuuacacucuuuguaagag

SEQ ID NO: 2310489 - RNA, 22 nt, Human
aaugucuuuguuggaaaagaau

SEQ ID NO: 2310490 - RNA, 18 nt, Human
aaugucuuuguuggaaaa

SEQ ID NO: 2310491 - RNA, 13 nt, Human
aaugucuuuugaa

SEQ ID NO: 2310492 - RNA, 15 nt, Human
aaugucuuuugaaua

SEQ ID NO: 2310493 - RNA, 21 nt, Human
aaugucuuuuuuuuaaugugc

SEQ ID NO: 2310494 - RNA, 22 nt, Human
aaugucuuuuuuuuaaugugcu

SEQ ID NO: 2310495 - RNA, 23 nt, Human
aauguccuccagaagccucuggc

SEQ ID NO: 2310496 - RNA, 21 nt, Human
aauguccuccagaagccucug

SEQ ID NO: 2310497 - RNA, 12 nt, Human
aaugucuaaaug

SEQ ID NO: 2310498 - RNA, 15 nt, Human
aaugucuaaaugcug

SEQ ID NO: 2310499 - RNA, 17 nt, Human
aaugucuaaaugcugaa

SEQ ID NO: 2310500 - RNA, 18 nt, Human
aaugucuaaaugcugaaa

SEQ ID NO: 2310501 - RNA, 18 nt, Human
aauguccuccagaagccu

SEQ ID NO: 2310502 - RNA, 17 nt, Human
aauguccuccagaagcc

SEQ ID NO: 2310503 - RNA, 18 nt, Human
aauguccaugauggaaua

SEQ ID NO: 2310504 - RNA, 20 nt, Human
aaugcggccgcauucccuga

SEQ ID NO: 2310505 - RNA, 14 nt, Human
aaugcguaauuaaa

SEQ ID NO: 2310506 - RNA, 18 nt, Human
aaugcgugcauaccacuu

SEQ ID NO: 2310507 - RNA, 19 nt, Human
aaugcgugcauaccacuuu

SEQ ID NO: 2310508 - RNA, 18 nt, Human
aaugcuagguuaauucca

SEQ ID NO: 2310509 - RNA, 19 nt, Human
aaugcuagguuaauuccaa

SEQ ID NO: 2310510 - RNA, 12 nt, Human
aaugccuuuaaa

SEQ ID NO: 2310511 - RNA, 12 nt, Human
aaugccuuugag

SEQ ID NO: 2310512 - RNA, 13 nt, Human
aaugccuuugaga

SEQ ID NO: 2310513 - RNA, 14 nt, Human
aaugccuuugagac

SEQ ID NO: 2310514 - RNA, 16 nt, Human
aaugccuuugagacag

SEQ ID NO: 2310515 - RNA, 17 nt, Human
aaugccuuugagacagu

SEQ ID NO: 2310516 - RNA, 18 nt, Human
aaugccuuugagacaguu

SEQ ID NO: 2310517 - RNA, 19 nt, Human
aaugccuuugagacaguuu

SEQ ID NO: 2310518 - RNA, 20 nt, Human
aaugccuuugagacaguuuc

SEQ ID NO: 2310519 - RNA, 22 nt, Human
aaugccuuugagacaguuucuu

SEQ ID NO: 2310520 - RNA, 23 nt, Human
aaugccuuugagacaguuucuua

SEQ ID NO: 2310521 - RNA, 21 nt, Human
aaugcgcaggcuggcccugcc

SEQ ID NO: 2310522 - RNA, 22 nt, Human
aaugcgcaggcuggcccugccc

SEQ ID NO: 2310523 - RNA, 23 nt, Human
aaugccuuacccucauguucuua

SEQ ID NO: 2310524 - RNA, 15 nt, Human
aauguuuuuuuuuaa

SEQ ID NO: 2310525 - RNA, 20 nt, Human
aauguuuuuuuuuaaagacu

SEQ ID NO: 2310526 - RNA, 22 nt, Human
aauguuuuuuuuuaaagacuuu

SEQ ID NO: 2310527 - RNA, 21 nt, Human
aauuaaaaaaaaagaucuguu

SEQ ID NO: 2310528 - RNA, 20 nt, Human
aauuaaaaaaaaaaaacuuu

SEQ ID NO: 2310529 - RNA, 22 nt, Human
aagcagcggucagcagacaagg

SEQ ID NO: 2310530 - RNA, 17 nt, Human
aagcagcccuuggccag

SEQ ID NO: 2310531 - RNA, 19 nt, Human
aagcagcgaccgcccccuc

SEQ ID NO: 2310532 - RNA, 20 nt, Human
aagcagcgaccgcccccucc

SEQ ID NO: 2310533 - RNA, 19 nt, Human
aagcagcucaaaggcacag

SEQ ID NO: 2310534 - RNA, 18 nt, Human
aagcagcucaaaggcaca

SEQ ID NO: 2310535 - RNA, 16 nt, Human
aagcagcucaaaggca

SEQ ID NO: 2310536 - RNA, 13 nt, Human
aagcagcucaaag

SEQ ID NO: 2310537 - RNA, 17 nt, Human
aagccaauucagacagg

SEQ ID NO: 2310538 - RNA, 11 nt, Human
aagccaauuuu

SEQ ID NO: 2310539 - RNA, 22 nt, Human
aagcagcguuucuaugacacau

SEQ ID NO: 2310540 - RNA, 21 nt, Human
aagcagcguuucuaugacaca

SEQ ID NO: 2310541 - RNA, 14 nt, Human
aagccacagcuggu

SEQ ID NO: 2310542 - RNA, 16 nt, Human
aagccacaagaaauuu

SEQ ID NO: 2310543 - RNA, 11 nt, Human
aagccacagaa

SEQ ID NO: 2310544 - RNA, 22 nt, Human
aagccaauuuuucugcacugag

SEQ ID NO: 2310545 - RNA, 15 nt, Human
aagccacaagaaauu

SEQ ID NO: 2310546 - RNA, 18 nt, Human
aagccacaagaaauuuga

SEQ ID NO: 2310547 - RNA, 13 nt, Human
aagccaauuuuuc

SEQ ID NO: 2310548 - RNA, 14 nt, Human
aagccaauuuuucu

SEQ ID NO: 2310549 - RNA, 16 nt, Human
aagccaauuuuucugc

SEQ ID NO: 2310550 - RNA, 17 nt, Human
aagccaauuuuucugca

SEQ ID NO: 2310551 - RNA, 18 nt, Human
aagccaauuuuucugcac

SEQ ID NO: 2310552 - RNA, 20 nt, Human
aagccaauuuuucugcacug

SEQ ID NO: 2310553 - RNA, 21 nt, Human
aagccaauuuuucugcacuga

SEQ ID NO: 2310554 - RNA, 19 nt, Human
aagccagcaggcucucagg

SEQ ID NO: 2310555 - RNA, 22 nt, Human
aagccacaggccugagauuuca

SEQ ID NO: 2310556 - RNA, 23 nt, Human
aagccacaggccugagauuucau

SEQ ID NO: 2310557 - RNA, 14 nt, Human
aagccacaggccug

SEQ ID NO: 2310558 - RNA, 15 nt, Human
aagccacaggccuga

SEQ ID NO: 2310559 - RNA, 17 nt, Human
aagccacaggccugaga

SEQ ID NO: 2310560 - RNA, 19 nt, Human
aagccacaggccugagauu

SEQ ID NO: 2310561 - RNA, 21 nt, Human
aagcagccaagcuccuuggga

SEQ ID NO: 2310562 - RNA, 16 nt, Human
aagcagcccuuggcca

SEQ ID NO: 2310563 - RNA, 16 nt, Human
aagcagccucucccca

SEQ ID NO: 2310564 - RNA, 17 nt, Human
aagcagccucuccccag

SEQ ID NO: 2310565 - RNA, 22 nt, Human
aagcagccucuccccaggucca

SEQ ID NO: 2310566 - RNA, 14 nt, Human
aagcagcguuucua

SEQ ID NO: 2310567 - RNA, 20 nt, Human
aagcagcguuucuaugacac

SEQ ID NO: 2310568 - RNA, 17 nt, Human
aagcagcguuucuauga

SEQ ID NO: 2310569 - RNA, 20 nt, Human
aagcagauggaaugcugugu

SEQ ID NO: 2310570 - RNA, 16 nt, Human
aagcagccaagcuccu

SEQ ID NO: 2310571 - RNA, 14 nt, Human
aagcagccaagcuc

SEQ ID NO: 2310572 - RNA, 13 nt, Human
aagcagcccuugg

SEQ ID NO: 2310573 - RNA, 23 nt, Human
aagcagaugcaaagaggcaagag

SEQ ID NO: 2310574 - RNA, 21 nt, Human
aagcagaugcaaagaggcaag

SEQ ID NO: 2310575 - RNA, 19 nt, Human
aagcagaugcaaagaggca

SEQ ID NO: 2310576 - RNA, 17 nt, Human
aagcagauggaaugcug

SEQ ID NO: 2310577 - RNA, 19 nt, Human
aagcagauggaaugcugug

SEQ ID NO: 2310578 - RNA, 17 nt, Human
aagccagcguccuccuc

SEQ ID NO: 2310579 - RNA, 14 nt, Human
aagccagcguccuc

SEQ ID NO: 2310580 - RNA, 19 nt, Human
aagccagcguccuccucug

SEQ ID NO: 2310581 - RNA, 11 nt, Human
aagccagccuu

SEQ ID NO: 2310582 - RNA, 20 nt, Human
aagccagcaggcucucaggc

SEQ ID NO: 2310583 - RNA, 23 nt, Human
aagccagcaggcucucaggccag

SEQ ID NO: 2310584 - RNA, 14 nt, Human
aacuuuccucgccu

SEQ ID NO: 2310585 - RNA, 18 nt, Human
aacuuucucuucauacuu

SEQ ID NO: 2310586 - RNA, 21 nt, Human
aacuuuauuaaauacaaaacu

SEQ ID NO: 2310587 - RNA, 23 nt, Human
aacuuuauuaaauacaaaacuuc

SEQ ID NO: 2310588 - RNA, 19 nt, Human
aacuuuauuaaauacaaaa

SEQ ID NO: 2310589 - RNA, 17 nt, Human
aacuuuauuaaauacaa

SEQ ID NO: 2310590 - RNA, 11 nt, Human
aacuuucauuu

SEQ ID NO: 2310591 - RNA, 14 nt, Human
aacuuucauuuuuu

SEQ ID NO: 2310592 - RNA, 17 nt, Human
aacuuucauuuuuuucc

SEQ ID NO: 2310593 - RNA, 22 nt, Human
aagagugacaguggauugcauu

SEQ ID NO: 2310594 - RNA, 14 nt, Human
aagagugcauuuuc

SEQ ID NO: 2310595 - RNA, 15 nt, Human
aagagugaaaaauga

SEQ ID NO: 2310596 - RNA, 23 nt, Human
aagagugauagucuuuugcuuuu

SEQ ID NO: 2310597 - RNA, 16 nt, Human
aagagugggcugcauc

SEQ ID NO: 2310598 - RNA, 19 nt, Human
aagagugggggagagcagg

SEQ ID NO: 2310599 - RNA, 20 nt, Human
aagagugggggagagcaggc

SEQ ID NO: 2310600 - RNA, 20 nt, Human
aagagugcgccgagucuguc

SEQ ID NO: 2310601 - RNA, 17 nt, Human
aagauaaagaugaucua

SEQ ID NO: 2310602 - RNA, 22 nt, Human
aagauaccuaaaagagauuuca

SEQ ID NO: 2310603 - RNA, 13 nt, Human
aagauaccuaaaa

SEQ ID NO: 2310604 - RNA, 12 nt, Human
aagauaaagaug

SEQ ID NO: 2310605 - RNA, 14 nt, Human
aagauaaagaugau

SEQ ID NO: 2310606 - RNA, 21 nt, Human
aagauacgacuuuauuuucug

SEQ ID NO: 2310607 - RNA, 18 nt, Human
aagauacgacuuuauuuu

SEQ ID NO: 2310608 - RNA, 15 nt, Human
aagauacgacuuuau

SEQ ID NO: 2310609 - RNA, 14 nt, Human
aagauacgacuuua

SEQ ID NO: 2310610 - RNA, 13 nt, Human
aagauaaaugugc

SEQ ID NO: 2310611 - RNA, 23 nt, Human
aagauacaguuacucagaauucu

SEQ ID NO: 2310612 - RNA, 12 nt, Human
aagauaaaugug

SEQ ID NO: 2310613 - RNA, 12 nt, Human
aagaguguacug

SEQ ID NO: 2310614 - RNA, 20 nt, Human
aagauucccagagacaggaa

SEQ ID NO: 2310615 - RNA, 20 nt, Human
aagauuacuuagaggaaaua

SEQ ID NO: 2310616 - RNA, 19 nt, Human
aagauucccagagacagga

SEQ ID NO: 2310617 - RNA, 18 nt, Human
aagauuacuuagaggaaa

SEQ ID NO: 2310618 - RNA, 14 nt, Human
aagauguuuaacuu

SEQ ID NO: 2310619 - RNA, 18 nt, Human
aagauguuuaacuuaauc

SEQ ID NO: 2310620 - RNA, 16 nt, Human
aagauguuugucagau

SEQ ID NO: 2310621 - RNA, 19 nt, Human
aagcugggccccagcccac

SEQ ID NO: 2310622 - RNA, 17 nt, Human
aagcugggccccagccc

SEQ ID NO: 2310623 - RNA, 18 nt, Human
aagcugggccccagccca

SEQ ID NO: 2310624 - RNA, 15 nt, Human
aagcugggcagguug

SEQ ID NO: 2310625 - RNA, 19 nt, Human
aagcuaccucaaacuucca

SEQ ID NO: 2310626 - RNA, 20 nt, Human
aagcuacagguuacaacaga

SEQ ID NO: 2310627 - RNA, 21 nt, Human
aagcuacagguuacaacagau

SEQ ID NO: 2310628 - RNA, 22 nt, Human
aagcuacagguuacaacagauu

SEQ ID NO: 2310629 - RNA, 18 nt, Human
aagcuggucccacucagu

SEQ ID NO: 2310630 - RNA, 21 nt, Human
aagcuggucccacucagucca

SEQ ID NO: 2310631 - RNA, 17 nt, Human
aagcugguaaacuauuu

SEQ ID NO: 2310632 - RNA, 17 nt, Human
aagcuguaaaaagagag

SEQ ID NO: 2310633 - RNA, 18 nt, Human
aagcuguaaaaagagaga

SEQ ID NO: 2310634 - RNA, 22 nt, Human
aagcuguaguagcccuuucugu

SEQ ID NO: 2310635 - RNA, 19 nt, Human
aagcugugacuucuccagg

SEQ ID NO: 2310636 - RNA, 23 nt, Human
aagcuguaguagcccuuucugug

SEQ ID NO: 2310637 - RNA, 13 nt, Human
aagcugugagaca

SEQ ID NO: 2310638 - RNA, 22 nt, Human
aagcugugagacagugggaaau

SEQ ID NO: 2310639 - RNA, 14 nt, Human
aagcugugccaccc

SEQ ID NO: 2310640 - RNA, 22 nt, Human
aagcuguguccuugcaccugca

SEQ ID NO: 2310641 - RNA, 12 nt, Human
aagcuguguccu

SEQ ID NO: 2310642 - RNA, 21 nt, Human
aagcugugccacccugggcuc

SEQ ID NO: 2310643 - RNA, 13 nt, Human
aagcuguggccag

SEQ ID NO: 2310644 - RNA, 16 nt, Human
aagcugugccacccug

SEQ ID NO: 2310645 - RNA, 20 nt, Human
aagcugugccacccugggcu

SEQ ID NO: 2310646 - RNA, 18 nt, Human
aagcuguguggcagucug

SEQ ID NO: 2310647 - RNA, 23 nt, Human
aaggacuguuuuuuccugagcuu

SEQ ID NO: 2310648 - RNA, 22 nt, Human
aaggacuuccuguccagcucca

SEQ ID NO: 2310649 - RNA, 21 nt, Human
aaggacuuccuguccagcucc

SEQ ID NO: 2310650 - RNA, 20 nt, Human
aaggacuuccuguccagcuc

SEQ ID NO: 2310651 - RNA, 17 nt, Human
aaggacuuccuguccag

SEQ ID NO: 2310652 - RNA, 20 nt, Human
aagcuguguccuugcaccug

SEQ ID NO: 2310653 - RNA, 14 nt, Human
aaggacacuuccug

SEQ ID NO: 2310654 - RNA, 16 nt, Human
aaggacacuuccugcc

SEQ ID NO: 2310655 - RNA, 17 nt, Human
aaggacacuuccugccu

SEQ ID NO: 2310656 - RNA, 21 nt, Human
aagcugugugcucuccaagcc

SEQ ID NO: 2310657 - RNA, 13 nt, Human
aaggacacuagaa

SEQ ID NO: 2310658 - RNA, 18 nt, Human
aaggacacuuccugccua

SEQ ID NO: 2310659 - RNA, 17 nt, Human
aaggacagaguaugaac

SEQ ID NO: 2310660 - RNA, 19 nt, Human
aaggacagccccuccucca

SEQ ID NO: 2310661 - RNA, 13 nt, Human
aaggacagccccu

SEQ ID NO: 2310662 - RNA, 20 nt, Human
aaggcagggagcgagggaga

SEQ ID NO: 2310663 - RNA, 18 nt, Human
aaggcagggaaaggcucu

SEQ ID NO: 2310664 - RNA, 12 nt, Human
aaggcagggagg

SEQ ID NO: 2310665 - RNA, 19 nt, Human
aaggcaggaauguguggca

SEQ ID NO: 2310666 - RNA, 16 nt, Human
aaggcaggaaugugug

SEQ ID NO: 2310667 - RNA, 23 nt, Human
aaggauuguaaaaaaaaaugccu

SEQ ID NO: 2310668 - RNA, 12 nt, Human
aaggcaggaaga

SEQ ID NO: 2310669 - RNA, 13 nt, Human
aaggcaggaagag

SEQ ID NO: 2310670 - RNA, 14 nt, Human
aaggcaggaagaga

SEQ ID NO: 2310671 - RNA, 20 nt, Human
aaggcagcucuaaaugucaa

SEQ ID NO: 2310672 - RNA, 16 nt, Human
aaggauucauguggaa

SEQ ID NO: 2310673 - RNA, 15 nt, Human
aaggauguugguguu

SEQ ID NO: 2310674 - RNA, 23 nt, Human
aaggacuuccuguccagcuccaa

SEQ ID NO: 2310675 - RNA, 15 nt, Human
aaggauguucuagca

SEQ ID NO: 2310676 - RNA, 15 nt, Human
aaggauugcuacugu

SEQ ID NO: 2310677 - RNA, 12 nt, Human
aaggauuguaaa

SEQ ID NO: 2310678 - RNA, 13 nt, Human
aaggauuguaaaa

SEQ ID NO: 2310679 - RNA, 14 nt, Human
aaggauuguaaaaa

SEQ ID NO: 2310680 - RNA, 21 nt, Human
aaggauuguaaaaaaaaaugc

SEQ ID NO: 2310681 - RNA, 23 nt, Human
aagcggaaaagguuuuauuuugu

SEQ ID NO: 2310682 - RNA, 23 nt, Human
aagcuaauuugcauuaaauucac

SEQ ID NO: 2310683 - RNA, 22 nt, Human
aagcuaauuugcauuaaauuca

SEQ ID NO: 2310684 - RNA, 15 nt, Human
aagcuaauuugcauu

SEQ ID NO: 2310685 - RNA, 13 nt, Human
aagcuacagguua

SEQ ID NO: 2310686 - RNA, 14 nt, Human
aagcuacagguuac

SEQ ID NO: 2310687 - RNA, 15 nt, Human
aagcuacagguuaca

SEQ ID NO: 2310688 - RNA, 18 nt, Human
aagcuacagguuacaaca

SEQ ID NO: 2310689 - RNA, 19 nt, Human
aagcuacagguuacaacag

SEQ ID NO: 2310690 - RNA, 14 nt, Human
aagcuaauuugcau

SEQ ID NO: 2310691 - RNA, 21 nt, Human
aagcggagguugcagggagcc

SEQ ID NO: 2310692 - RNA, 21 nt, Human
aagcgauucuucugcuucagc

SEQ ID NO: 2310693 - RNA, 17 nt, Human
aagcgauucuucugcuu

SEQ ID NO: 2310694 - RNA, 18 nt, Human
aagggagcuaucaggaac

SEQ ID NO: 2310695 - RNA, 17 nt, Human
aagggagagcggggcag

SEQ ID NO: 2310696 - RNA, 17 nt, Human
aagggagcagaacugaa

SEQ ID NO: 2310697 - RNA, 24 nt, Human
aagggagcacuggguugacuuuca

SEQ ID NO: 2310698 - RNA, 16 nt, Human
aagggagagagagagg

SEQ ID NO: 2310699 - RNA, 17 nt, Human
aagggagagaccucauc

SEQ ID NO: 2310700 - RNA, 16 nt, Human
aagggagaagaaaggu

SEQ ID NO: 2310701 - RNA, 18 nt, Human
aagggacgcuacccggga

SEQ ID NO: 2310702 - RNA, 19 nt, Human
aagggacauguuuugauaa

SEQ ID NO: 2310703 - RNA, 20 nt, Human
aagggacauguuuugauaaa

SEQ ID NO: 2310704 - RNA, 13 nt, Human
aagggaccaaggc

SEQ ID NO: 2310705 - RNA, 13 nt, Human
aagggaaauauca

SEQ ID NO: 2310706 - RNA, 12 nt, Human
aagggaaauaga

SEQ ID NO: 2310707 - RNA, 14 nt, Human
aagggaaauaucau

SEQ ID NO: 2310708 - RNA, 15 nt, Human
aagggaaauaucauu

SEQ ID NO: 2310709 - RNA, 23 nt, Human
aagggaaacugccagcaacgcag

SEQ ID NO: 2310710 - RNA, 23 nt, Human
aagggaacagugaggugcccagc

SEQ ID NO: 2310711 - RNA, 16 nt, Human
aagggaaauaucauuu

SEQ ID NO: 2310712 - RNA, 15 nt, Human
aagggaaccuguguc

SEQ ID NO: 2310713 - RNA, 23 nt, Human
aagggaaggccccacagacaagg

SEQ ID NO: 2310714 - RNA, 18 nt, Human
aagggaaggaacucuggc

SEQ ID NO: 2310715 - RNA, 17 nt, Human
aagggaaguugugccuu

SEQ ID NO: 2310716 - RNA, 16 nt, Human
aagggacauguuuuga

SEQ ID NO: 2310717 - RNA, 22 nt, Human
aagggccaguccugccuggcca

SEQ ID NO: 2310718 - RNA, 9 nt, Human
aagggccag

SEQ ID NO: 2310719 - RNA, 14 nt, Human
aagggccagucugg

SEQ ID NO: 2310720 - RNA, 18 nt, Human
aagggccagucugggcug

SEQ ID NO: 2310721 - RNA, 16 nt, Human
aagggccaugcugaag

SEQ ID NO: 2310722 - RNA, 17 nt, Human
aagggccaugcugaagg

SEQ ID NO: 2310723 - RNA, 19 nt, Human
aagggccaugcugaaggga

SEQ ID NO: 2310724 - RNA, 16 nt, Human
aagggccaguccugcc

SEQ ID NO: 2310725 - RNA, 14 nt, Human
aagggccaguccug

SEQ ID NO: 2310726 - RNA, 17 nt, Human
aagggccagagccaggg

SEQ ID NO: 2310727 - RNA, 19 nt, Human
aaggucauuuuuuuuaaga

SEQ ID NO: 2310728 - RNA, 18 nt, Human
aaggucauuuuuuuuaag

SEQ ID NO: 2310729 - RNA, 16 nt, Human
aagggccagagccagg

SEQ ID NO: 2310730 - RNA, 15 nt, Human
aagggccagagccag

SEQ ID NO: 2310731 - RNA, 14 nt, Human
aagggccagagcca

SEQ ID NO: 2310732 - RNA, 13 nt, Human
aagggccagagcc

SEQ ID NO: 2310733 - RNA, 12 nt, Human
aagggccagagc

SEQ ID NO: 2310734 - RNA, 11 nt, Human
aagggccagag

SEQ ID NO: 2310735 - RNA, 23 nt, Human
aagggcauuggccauucuauugu

SEQ ID NO: 2310736 - RNA, 16 nt, Human
aagggaaaagucucuu

SEQ ID NO: 2310737 - RNA, 17 nt, Human
aagggaaacugccagca

SEQ ID NO: 2310738 - RNA, 16 nt, Human
aagggaaacugccagc

SEQ ID NO: 2310739 - RNA, 19 nt, Human
aaguccagauuuacacugg

SEQ ID NO: 2310740 - RNA, 22 nt, Human
aaguccagauuuacacugggag

SEQ ID NO: 2310741 - RNA, 22 nt, Human
aagucccuguaauuguuguuug

SEQ ID NO: 2310742 - RNA, 21 nt, Human
aagucccuguuuucugagccc

SEQ ID NO: 2310743 - RNA, 22 nt, Human
aagucccuguuuucugagcccg

SEQ ID NO: 2310744 - RNA, 18 nt, Human
aaguccucuuuucugaga

SEQ ID NO: 2310745 - RNA, 17 nt, Human
aaguccuacaagcuaaa

SEQ ID NO: 2310746 - RNA, 18 nt, Human
aaguauccugcuucugau

SEQ ID NO: 2310747 - RNA, 17 nt, Human
aaguaguguaucacagu

SEQ ID NO: 2310748 - RNA, 19 nt, Human
aaguaguaaaaauuaaaaa

SEQ ID NO: 2310749 - RNA, 17 nt, Human
aaguccaagcauaccaa

SEQ ID NO: 2310750 - RNA, 17 nt, Human
aaguaucuacaugcggu

SEQ ID NO: 2310751 - RNA, 12 nt, Human
aaguccaaugug

SEQ ID NO: 2310752 - RNA, 18 nt, Human
aaguccaagcauuuagau

SEQ ID NO: 2310753 - RNA, 16 nt, Human
aagucuaaauauuucc

SEQ ID NO: 2310754 - RNA, 21 nt, Human
aagucuaaaguuuacaguaaa

SEQ ID NO: 2310755 - RNA, 19 nt, Human
aagucuaaaguuuacagua

SEQ ID NO: 2310756 - RNA, 20 nt, Human
aagucuaaaguuuacaguaa

SEQ ID NO: 2310757 - RNA, 22 nt, Human
aagucuaggagcugggaggaaa

SEQ ID NO: 2310758 - RNA, 19 nt, Human
aagucuaggagcugggagg

SEQ ID NO: 2310759 - RNA, 15 nt, Human
aagucguugugaggg

SEQ ID NO: 2310760 - RNA, 11 nt, Human
aagucuaaagu

SEQ ID NO: 2310761 - RNA, 13 nt, Human
aagucuaaaguuu

SEQ ID NO: 2310762 - RNA, 14 nt, Human
aagucuaaaguuua

SEQ ID NO: 2310763 - RNA, 15 nt, Human
aagucuaaaguuuac

SEQ ID NO: 2310764 - RNA, 17 nt, Human
aagucuaaaguuuacag

SEQ ID NO: 2310765 - RNA, 21 nt, Human
aagucucacuggcugucagua

SEQ ID NO: 2310766 - RNA, 17 nt, Human
aagucuaaauauuuccu

SEQ ID NO: 2310767 - RNA, 17 nt, Human
aagucuaugaugcuguu

SEQ ID NO: 2310768 - RNA, 14 nt, Human
aagucuccaaaguc

SEQ ID NO: 2310769 - RNA, 15 nt, Human
aagucgaauuaauag

SEQ ID NO: 2310770 - RNA, 16 nt, Human
aaguccuuuaugugga

SEQ ID NO: 2310771 - RNA, 13 nt, Human
aaguccuuuaugu

SEQ ID NO: 2310772 - RNA, 21 nt, Human
aaguccuuuuuuuccaucuuu

SEQ ID NO: 2310773 - RNA, 18 nt, Human
aaguccuuaccucuuccg

SEQ ID NO: 2310774 - RNA, 22 nt, Human
aaguccugaagaggcgggccag

SEQ ID NO: 2310775 - RNA, 13 nt, Human
aaguccugaagag

SEQ ID NO: 2310776 - RNA, 17 nt, Human
aaguccugaagaggcgg

SEQ ID NO: 2310777 - RNA, 23 nt, Human
aaguccugaagaggcgggccagc

SEQ ID NO: 2310778 - RNA, 22 nt, Human
aaguccucuuuucugagaggac

SEQ ID NO: 2310779 - RNA, 14 nt, Human
aaguaguccuguga

SEQ ID NO: 2310780 - RNA, 17 nt, Human
aaguaucccuacuguaa

SEQ ID NO: 2310781 - RNA, 23 nt, Human
aaguaucccuacuguaauuugug

SEQ ID NO: 2310782 - RNA, 18 nt, Human
aaguaucccuacuguaau

SEQ ID NO: 2310783 - RNA, 21 nt, Human
aaguagaagucuuagauguau

SEQ ID NO: 2310784 - RNA, 15 nt, Human
aaguaggcaugaggg

SEQ ID NO: 2310785 - RNA, 15 nt, Human
aaguaggcaggacca

SEQ ID NO: 2310786 - RNA, 23 nt, Human
aaguaggacuuuccuaaauguuu

SEQ ID NO: 2310787 - RNA, 14 nt, Human
aaguaggcaggacc

SEQ ID NO: 2310788 - RNA, 22 nt, Human
aaguaggacuuuccuaaauguu

SEQ ID NO: 2310789 - RNA, 19 nt, Human
aaguagggguuguggguga

SEQ ID NO: 2310790 - RNA, 13 nt, Human
aaguaguaaaaau

SEQ ID NO: 2310791 - RNA, 15 nt, Human
aaguaguaaaaauua

SEQ ID NO: 2310792 - RNA, 18 nt, Human
aaguaguaaaaauuaaaa

SEQ ID NO: 2310793 - RNA, 15 nt, Human
aaguagggggucuaa

SEQ ID NO: 2310794 - RNA, 21 nt, Human
aaguagggacuucugucuuca

SEQ ID NO: 2310795 - RNA, 17 nt, Human
aaggugacccaaugauu

SEQ ID NO: 2310796 - RNA, 20 nt, Human
aaggucggaggcuugggacc

SEQ ID NO: 2310797 - RNA, 22 nt, Human
aaggucggaggcuugggaccgc

SEQ ID NO: 2310798 - RNA, 20 nt, Human
aagguccucugucagucaca

SEQ ID NO: 2310799 - RNA, 14 nt, Human
aaggucggaccagc

SEQ ID NO: 2310800 - RNA, 18 nt, Human
aaggucggaggcuuggga

SEQ ID NO: 2310801 - RNA, 20 nt, Human
aaggugaggagcuugaaacc

SEQ ID NO: 2310802 - RNA, 22 nt, Human
aaggugaguuugagcugccuuc

SEQ ID NO: 2310803 - RNA, 17 nt, Human
aaggugauauauuuaaa

SEQ ID NO: 2310804 - RNA, 20 nt, Human
aaggugaguuugagcugccu

SEQ ID NO: 2310805 - RNA, 21 nt, Human
aaggugaguuugagcugccuu

SEQ ID NO: 2310806 - RNA, 20 nt, Human
aaguagaagucuuagaugua

SEQ ID NO: 2310807 - RNA, 19 nt, Human
aaguagaagucuuagaugu

SEQ ID NO: 2310808 - RNA, 20 nt, Human
aaggugccugugaggcaggg

SEQ ID NO: 2310809 - RNA, 11 nt, Human
aaggugccugu

SEQ ID NO: 2310810 - RNA, 18 nt, Human
aaggugccugugaggcag

SEQ ID NO: 2310811 - RNA, 14 nt, Human
aaggugcaguuccc

SEQ ID NO: 2310812 - RNA, 23 nt, Human
aaggugcaguucccccaaccuca

SEQ ID NO: 2310813 - RNA, 22 nt, Human
aaguugcagugagcugauauca

SEQ ID NO: 2310814 - RNA, 20 nt, Human
aaguugauauagaacagugc

SEQ ID NO: 2310815 - RNA, 21 nt, Human
aaguugauauagaacagugcu

SEQ ID NO: 2310816 - RNA, 17 nt, Human
aaguugauauagaacag

SEQ ID NO: 2310817 - RNA, 19 nt, Human
aaguguaagaaacacacug

SEQ ID NO: 2310818 - RNA, 12 nt, Human
aaguguaacugg

SEQ ID NO: 2310819 - RNA, 11 nt, Human
aaguguaacug

SEQ ID NO: 2310820 - RNA, 21 nt, Human
aaguguaacagcugaggucuc

SEQ ID NO: 2310821 - RNA, 16 nt, Human
aaguguaauagauuau

SEQ ID NO: 2310822 - RNA, 14 nt, Human
aaguguacauaugu

SEQ ID NO: 2310823 - RNA, 20 nt, Human
aaguguaggcagacacaggg

SEQ ID NO: 2310824 - RNA, 23 nt, Human
aaguguauaucagaaaagggaag

SEQ ID NO: 2310825 - RNA, 13 nt, Human
aaguguaggcaga

SEQ ID NO: 2310826 - RNA, 14 nt, Human
aaguguaggcagac

SEQ ID NO: 2310827 - RNA, 15 nt, Human
aaguguaggcagaca

SEQ ID NO: 2310828 - RNA, 16 nt, Human
aaguguaggcagacac

SEQ ID NO: 2310829 - RNA, 17 nt, Human
aaguguaggcagacaca

SEQ ID NO: 2310830 - RNA, 19 nt, Human
aaguguaggcagacacagg

SEQ ID NO: 2310831 - RNA, 21 nt, Human
aaguguaggcagacacaggga

SEQ ID NO: 2310832 - RNA, 19 nt, Human
aaguggaaaaauagccugc

SEQ ID NO: 2310833 - RNA, 17 nt, Human
aaguguaacagcugagg

SEQ ID NO: 2310834 - RNA, 16 nt, Human
aaguguaacagcugag

SEQ ID NO: 2310835 - RNA, 15 nt, Human
aaguguaacagcuga

SEQ ID NO: 2310836 - RNA, 14 nt, Human
aaguguaacagcug

SEQ ID NO: 2310837 - RNA, 19 nt, Human
aaguggaccaggacaggac

SEQ ID NO: 2310838 - RNA, 21 nt, Human
aaguguaaagcauuccaacaa

SEQ ID NO: 2310839 - RNA, 22 nt, Human
aaguguaaagcauuccaacaaa

SEQ ID NO: 2310840 - RNA, 16 nt, Human
aaguggaccaggacag

SEQ ID NO: 2310841 - RNA, 13 nt, Human
aaguggaaauguu

SEQ ID NO: 2310842 - RNA, 21 nt, Human
aaguggaaaaauagccugccu

SEQ ID NO: 2310843 - RNA, 15 nt, Human
aagucuccaaagucu

SEQ ID NO: 2310844 - RNA, 22 nt, Human
aagucugugugaugaacuuucu

SEQ ID NO: 2310845 - RNA, 23 nt, Human
aagucugugugaugaacuuucuc

SEQ ID NO: 2310846 - RNA, 22 nt, Human
aagucugugagauucauucaug

SEQ ID NO: 2310847 - RNA, 18 nt, Human
aagucuggaucugggacc

SEQ ID NO: 2310848 - RNA, 23 nt, Human
aaguccagauuuacacugggaga

SEQ ID NO: 2310849 - RNA, 21 nt, Human
aagucugcaacuuuaagcagc

SEQ ID NO: 2310850 - RNA, 12 nt, Human
aagucuguuuua

SEQ ID NO: 2310851 - RNA, 14 nt, Human
aagucuguuuuaug

SEQ ID NO: 2310852 - RNA, 13 nt, Human
aagucuguuuuau

SEQ ID NO: 2310853 - RNA, 20 nt, Human
aaaccauuaugaagaagaga

SEQ ID NO: 2310854 - RNA, 16 nt, Human
aaacccgacagaggga

SEQ ID NO: 2310855 - RNA, 13 nt, Human
aaaccauguagaa

SEQ ID NO: 2310856 - RNA, 15 nt, Human
aaaccaugcaaaugc

SEQ ID NO: 2310857 - RNA, 18 nt, Human
aaacccgacagagggaag

SEQ ID NO: 2310858 - RNA, 19 nt, Human
aaacccgacagagggaaga

SEQ ID NO: 2310859 - RNA, 16 nt, Human
aaacccuauugguaaa

SEQ ID NO: 2310860 - RNA, 13 nt, Human
aaacucucugaac

SEQ ID NO: 2310861 - RNA, 12 nt, Human
aaacucucugaa

SEQ ID NO: 2310862 - RNA, 17 nt, Human
aaacucucuuugggaau

SEQ ID NO: 2310863 - RNA, 22 nt, Human
aaacucucuuugggaauguuug

SEQ ID NO: 2310864 - RNA, 23 nt, Human
aaacucucuuugggaauguuugu

SEQ ID NO: 2310865 - RNA, 18 nt, Human
aaacucuccucugcugcu

SEQ ID NO: 2310866 - RNA, 24 nt, Human
aaacccucgaggcggaucuuugga

SEQ ID NO: 2310867 - RNA, 13 nt, Human
aaacccucgaggc

SEQ ID NO: 2310868 - RNA, 18 nt, Human
aaaccaucauugaaaucu

SEQ ID NO: 2310869 - RNA, 23 nt, Human
aaaccaugaagagauuuuucaug

SEQ ID NO: 2310870 - RNA, 17 nt, Human
aaagaaauauaccuaaa

SEQ ID NO: 2310871 - RNA, 23 nt, Human
aaacugagacucagacaggaaag

SEQ ID NO: 2310872 - RNA, 14 nt, Human
aaacugaggaauuu

SEQ ID NO: 2310873 - RNA, 18 nt, Human
aaacugaggaauuuucuu

SEQ ID NO: 2310874 - RNA, 19 nt, Human
aaacugaggaauuucaccu

SEQ ID NO: 2310875 - RNA, 15 nt, Human
aaagaaauauaccua

SEQ ID NO: 2310876 - RNA, 22 nt, Human
aaacugagauccuuccuuuuga

SEQ ID NO: 2310877 - RNA, 21 nt, Human
aaacugagacucagacaggaa

SEQ ID NO: 2310878 - RNA, 22 nt, Human
aaacucugggaaauaagagaga

SEQ ID NO: 2310879 - RNA, 14 nt, Human
aaacucugggaaau

SEQ ID NO: 2310880 - RNA, 12 nt, Human
aaacucugcugu

SEQ ID NO: 2310881 - RNA, 11 nt, Human
aaacucugcug

SEQ ID NO: 2310882 - RNA, 14 nt, Human
aaacucugccagcc

SEQ ID NO: 2310883 - RNA, 23 nt, Human
aaacugagaugugaacacaucag

SEQ ID NO: 2310884 - RNA, 21 nt, Human
aaacugagaugugaacacauc

SEQ ID NO: 2310885 - RNA, 18 nt, Human
aaagaagacauguuuuag

SEQ ID NO: 2310886 - RNA, 15 nt, Human
aaagaaauguaaggg

SEQ ID NO: 2310887 - RNA, 20 nt, Human
aaagaagcccaauauuauaa

SEQ ID NO: 2310888 - RNA, 13 nt, Human
aaagaagauguuu

SEQ ID NO: 2310889 - RNA, 15 nt, Human
aaagaagauguuuaa

SEQ ID NO: 2310890 - RNA, 21 nt, Human
aaagaagacauguuuuagaca

SEQ ID NO: 2310891 - RNA, 12 nt, Human
aaagaagagaca

SEQ ID NO: 2310892 - RNA, 21 nt, Human
aaagaagagccggagccucca

SEQ ID NO: 2310893 - RNA, 12 nt, Human
aaagaaggaagu

SEQ ID NO: 2310894 - RNA, 16 nt, Human
aaagaagcccccagcu

SEQ ID NO: 2310895 - RNA, 20 nt, Human
aaagaagguuucagaaagaa

SEQ ID NO: 2310896 - RNA, 14 nt, Human
aaagaguaggaaga

SEQ ID NO: 2310897 - RNA, 18 nt, Human
aaagaaggaaaaugaucu

SEQ ID NO: 2310898 - RNA, 22 nt, Human
aaagaagguuuguguuuuucug

SEQ ID NO: 2310899 - RNA, 12 nt, Human
aaagaguuagaa

SEQ ID NO: 2310900 - RNA, 17 nt, Human
aaagauauuuugcuuug

SEQ ID NO: 2310901 - RNA, 13 nt, Human
aaagauaaagaug

SEQ ID NO: 2310902 - RNA, 15 nt, Human
aaagauaaagaugau

SEQ ID NO: 2310903 - RNA, 16 nt, Human
aaagaguucuuaagga

SEQ ID NO: 2310904 - RNA, 22 nt, Human
aaagagugggcugcaucuggga

SEQ ID NO: 2310905 - RNA, 16 nt, Human
aaagauauuuugcuuu

SEQ ID NO: 2310906 - RNA, 12 nt, Human
aaagauauuuug

SEQ ID NO: 2310907 - RNA, 21 nt, Human
aaacacgcacuuagucucuaa

SEQ ID NO: 2310908 - RNA, 13 nt, Human
aaacaccuucucu

SEQ ID NO: 2310909 - RNA, 14 nt, Human
aaacaccuucucug

SEQ ID NO: 2310910 - RNA, 21 nt, Human
aaacacugggagaaaugaaaa

SEQ ID NO: 2310911 - RNA, 24 nt, Human
aaacacucaguuguucaauaauaa

SEQ ID NO: 2310912 - RNA, 17 nt, Human
aaacacucggcauuuca

SEQ ID NO: 2310913 - RNA, 19 nt, Human
aaacacuggggcuggcaca

SEQ ID NO: 2310914 - RNA, 22 nt, Human
aaacacugggagaaaugaaaaa

SEQ ID NO: 2310915 - RNA, 15 nt, Human
aaacacuguguaagc

SEQ ID NO: 2310916 - RNA, 13 nt, Human
aaacacugugcac

SEQ ID NO: 2310917 - RNA, 16 nt, Human
aaacacuguucucugc

SEQ ID NO: 2310918 - RNA, 16 nt, Human
aaaaucucaauauuuc

SEQ ID NO: 2310919 - RNA, 22 nt, Human
aaaaucucaaauuucuaaaucu

SEQ ID NO: 2310920 - RNA, 19 nt, Human
aaaaucucaaauuucuaaa

SEQ ID NO: 2310921 - RNA, 23 nt, Human
aaaauugauauacuuuuuucuua

SEQ ID NO: 2310922 - RNA, 23 nt, Human
aaaaucuaauauuaaaaauaugg

SEQ ID NO: 2310923 - RNA, 15 nt, Human
aaaauugcaaaucuu

SEQ ID NO: 2310924 - RNA, 21 nt, Human
aaaauugauguguuuauuuau

SEQ ID NO: 2310925 - RNA, 12 nt, Human
aaaauugccaua

SEQ ID NO: 2310926 - RNA, 22 nt, Human
aaacaccuuccagcuccuguaa

SEQ ID NO: 2310927 - RNA, 15 nt, Human
aaacaccuucucugg

SEQ ID NO: 2310928 - RNA, 21 nt, Human
aaaauugaugggauuugguca

SEQ ID NO: 2310929 - RNA, 12 nt, Human
aaaauugaugug

SEQ ID NO: 2310930 - RNA, 14 nt, Human
aaaauugauguguu

SEQ ID NO: 2310931 - RNA, 22 nt, Human
aaacagacaaaaacagccucac

SEQ ID NO: 2310932 - RNA, 13 nt, Human
aaacagaacauca

SEQ ID NO: 2310933 - RNA, 22 nt, Human
aaacagaccuaaugcuccuugu

SEQ ID NO: 2310934 - RNA, 21 nt, Human
aaacagaacaucauuagaaca

SEQ ID NO: 2310935 - RNA, 13 nt, Human
aaacagacuauuu

SEQ ID NO: 2310936 - RNA, 12 nt, Human
aaacagaagccu

SEQ ID NO: 2310937 - RNA, 12 nt, Human
aaacagacacug

SEQ ID NO: 2310938 - RNA, 13 nt, Human
aaacagaaacaaa

SEQ ID NO: 2310939 - RNA, 21 nt, Human
aaacagaaacaaaaacacuaa

SEQ ID NO: 2310940 - RNA, 19 nt, Human
aaacagaaacaaaaacacu

SEQ ID NO: 2310941 - RNA, 15 nt, Human
aaaaagaaaggaggg

SEQ ID NO: 2310942 - RNA, 16 nt, Human
aaaaagaaacauuugg

SEQ ID NO: 2310943 - RNA, 20 nt, Human
aaaaacucugggaaauaaga

SEQ ID NO: 2310944 - RNA, 21 nt, Human
aaaaacucgaggacuguauuu

SEQ ID NO: 2310945 - RNA, 17 nt, Human
aaaaacucgaggacugu

SEQ ID NO: 2310946 - RNA, 11 nt, Human
aaaaagaaaaa

SEQ ID NO: 2310947 - RNA, 13 nt, Human
aaaaagaaaaaag

SEQ ID NO: 2310948 - RNA, 14 nt, Human
aaaaagaaaagaua

SEQ ID NO: 2310949 - RNA, 14 nt, Human
aaaaagaaacaaga

SEQ ID NO: 2310950 - RNA, 23 nt, Human
aaaagugaucaauaaaaugugau

SEQ ID NO: 2310951 - RNA, 16 nt, Human
aaaaguggccucuuug

SEQ ID NO: 2310952 - RNA, 21 nt, Human
aaaagugggccagugugggaa

SEQ ID NO: 2310953 - RNA, 17 nt, Human
aaaaguggccucuuugu

SEQ ID NO: 2310954 - RNA, 17 nt, Human
aaaagugauuguuggca

SEQ ID NO: 2310955 - RNA, 18 nt, Human
aaaagugggcuugauucu

SEQ ID NO: 2310956 - RNA, 17 nt, Human
aaaagugggcuugauuc

SEQ ID NO: 2310957 - RNA, 17 nt, Human
aaaaguuauuaauauuu

SEQ ID NO: 2310958 - RNA, 12 nt, Human
aaaaguugaaau

SEQ ID NO: 2310959 - RNA, 18 nt, Human
aaaaguucugcagauaaa

SEQ ID NO: 2310960 - RNA, 14 nt, Human
aaaaguuagcugag

SEQ ID NO: 2310961 - RNA, 12 nt, Human
aaaaguuauuaa

SEQ ID NO: 2310962 - RNA, 14 nt, Human
aaaaguuaaaaagu

SEQ ID NO: 2310963 - RNA, 13 nt, Human
aaaaguguuuauu

SEQ ID NO: 2310964 - RNA, 21 nt, Human
aaaaguguuuauuuuucauau

SEQ ID NO: 2310965 - RNA, 19 nt, Human
aaaauaaaauuaaagcuga

SEQ ID NO: 2310966 - RNA, 14 nt, Human
aaaauaaacaaaua

SEQ ID NO: 2310967 - RNA, 12 nt, Human
aaaauaaacaaa

SEQ ID NO: 2310968 - RNA, 14 nt, Human
aaaaguugaaauua

SEQ ID NO: 2310969 - RNA, 17 nt, Human
aaaaguucugacuugac

SEQ ID NO: 2310970 - RNA, 17 nt, Human
aaaauaaaacuuuuuaa

SEQ ID NO: 2310971 - RNA, 16 nt, Human
aaaauccucuuccucu

SEQ ID NO: 2310972 - RNA, 22 nt, Human
aaaaucauugauugucagcuac

SEQ ID NO: 2310973 - RNA, 12 nt, Human
aaaaucauugau

SEQ ID NO: 2310974 - RNA, 18 nt, Human
aaaaucauguacauuucu

SEQ ID NO: 2310975 - RNA, 15 nt, Human
aaaaucauguuugcu

SEQ ID NO: 2310976 - RNA, 17 nt, Human
aaaaucauguacauuuc

SEQ ID NO: 2310977 - RNA, 16 nt, Human
aaaaucauguacauuu

SEQ ID NO: 2310978 - RNA, 22 nt, Human
aaaaucccuuaccucggugccu

SEQ ID NO: 2310979 - RNA, 13 nt, Human
aaaauccuugcuu

SEQ ID NO: 2310980 - RNA, 20 nt, Human
aaaauccuugcuuaugacau

SEQ ID NO: 2310981 - RNA, 15 nt, Human
aaaaucuaauauuaa

SEQ ID NO: 2310982 - RNA, 21 nt, Human
aaaaucuacacuccagugaga

SEQ ID NO: 2310983 - RNA, 15 nt, Human
aaaaucauguacauu

SEQ ID NO: 2310984 - RNA, 22 nt, Human
aaaaucauggaaugguuauaaa

SEQ ID NO: 2310985 - RNA, 17 nt, Human
aaaaucauggaaugguu

SEQ ID NO: 2310986 - RNA, 19 nt, Human
aaaaucauggaaugguuau

SEQ ID NO: 2310987 - RNA, 12 nt, Human
aaaaucaugaga

SEQ ID NO: 2310988 - RNA, 13 nt, Human
aaaaucauggaau

SEQ ID NO: 2310989 - RNA, 22 nt, Human
aaaaucauaaacugugugcaga

SEQ ID NO: 2310990 - RNA, 13 nt, Human
aaaaucauaaacu

SEQ ID NO: 2310991 - RNA, 13 nt, Human
aaaaucauauugc

SEQ ID NO: 2310992 - RNA, 14 nt, Human
aaaaucauauugcu

SEQ ID NO: 2310993 - RNA, 18 nt, Human
aaaaucauauugcuucuu

SEQ ID NO: 2310994 - RNA, 15 nt, Human
aaauagcuuguauag

SEQ ID NO: 2310995 - RNA, 19 nt, Human
aaauagcuauauccaugua

SEQ ID NO: 2310996 - RNA, 16 nt, Human
aaauagcuauauccau

SEQ ID NO: 2310997 - RNA, 19 nt, Human
aaauagcuccguggagcag

SEQ ID NO: 2310998 - RNA, 13 nt, Human
aaauagcucuuuc

SEQ ID NO: 2310999 - RNA, 12 nt, Human
aaauagcuauau

SEQ ID NO: 2311000 - RNA, 16 nt, Human
aaauagcuuguauagu

SEQ ID NO: 2311001 - RNA, 14 nt, Human
aaauaggagaggau

SEQ ID NO: 2311002 - RNA, 16 nt, Human
aaauaggagaggauga

SEQ ID NO: 2311003 - RNA, 24 nt, Human
aaauaggagaggaugagagcccag

SEQ ID NO: 2311004 - RNA, 23 nt, Human
aaauaggagaggaugagagccca

SEQ ID NO: 2311005 - RNA, 20 nt, Human
aaauaguguggaaauuaaga

SEQ ID NO: 2311006 - RNA, 19 nt, Human
aaauaguggugugauuugg

SEQ ID NO: 2311007 - RNA, 19 nt, Human
aaauaguugagccagcaga

SEQ ID NO: 2311008 - RNA, 20 nt, Human
aaauaguugagccagcagac

SEQ ID NO: 2311009 - RNA, 23 nt, Human
aaauaguugagccagcagacauu

SEQ ID NO: 2311010 - RNA, 21 nt, Human
aaauaguguggaaauuaagaa

SEQ ID NO: 2311011 - RNA, 22 nt, Human
aaauaguuaagacaugauuucc

SEQ ID NO: 2311012 - RNA, 17 nt, Human
aaauaguuaagacauga

SEQ ID NO: 2311013 - RNA, 21 nt, Human
aaauagccgggcaugguggcg

SEQ ID NO: 2311014 - RNA, 23 nt, Human
aaauagccacuuaccuucaauaa

SEQ ID NO: 2311015 - RNA, 21 nt, Human
aaauagccacuuaccuucaau

SEQ ID NO: 2311016 - RNA, 13 nt, Human
aaauagcauuugu

SEQ ID NO: 2311017 - RNA, 23 nt, Human
aaauagccaacacccaucuguuu

SEQ ID NO: 2311018 - RNA, 24 nt, Human
aaauagcucaggugucccugcacu

SEQ ID NO: 2311019 - RNA, 18 nt, Human
aaaucaaguauuugggaa

SEQ ID NO: 2311020 - RNA, 23 nt, Human
aaaucaaguauuugggaagugaa

SEQ ID NO: 2311021 - RNA, 15 nt, Human
aaaucaauacacuag

SEQ ID NO: 2311022 - RNA, 22 nt, Human
aaaucaauacacuaguuguuuc

SEQ ID NO: 2311023 - RNA, 17 nt, Human
aaaucaauacacuaguu

SEQ ID NO: 2311024 - RNA, 19 nt, Human
aaaucaaugcuauaacuau

SEQ ID NO: 2311025 - RNA, 13 nt, Human
aaaucaaugucac

SEQ ID NO: 2311026 - RNA, 19 nt, Human
aaaucaauuacugguccaa

SEQ ID NO: 2311027 - RNA, 23 nt, Human
aaaucaauuacugguccaaaaga

SEQ ID NO: 2311028 - RNA, 12 nt, Human
aaaucacauccu

SEQ ID NO: 2311029 - RNA, 21 nt, Human
aaaucuguccaaaggaggcug

SEQ ID NO: 2311030 - RNA, 22 nt, Human
aaaucuguccaaaggaggcugg

SEQ ID NO: 2311031 - RNA, 12 nt, Human
aaaucuggaagc

SEQ ID NO: 2311032 - RNA, 16 nt, Human
aaaucaaauaugcaaa

SEQ ID NO: 2311033 - RNA, 15 nt, Human
aaaucaaauaugcaa

SEQ ID NO: 2311034 - RNA, 14 nt, Human
aaaucaaauaugca

SEQ ID NO: 2311035 - RNA, 12 nt, Human
aaaucaaauaug

SEQ ID NO: 2311036 - RNA, 20 nt, Human
aaauauuuauuuuaauaaug

SEQ ID NO: 2311037 - RNA, 15 nt, Human
aaauauuuauuuuaa

SEQ ID NO: 2311038 - RNA, 13 nt, Human
aaauauuuauuuu

SEQ ID NO: 2311039 - RNA, 19 nt, Human
aaauaaaguaucaugcauu

SEQ ID NO: 2311040 - RNA, 15 nt, Human
aaauaaaguaucaug

SEQ ID NO: 2311041 - RNA, 18 nt, Human
aaauaaaguaucaugcau

SEQ ID NO: 2311042 - RNA, 20 nt, Human
aaauaaaguauauauagaau

SEQ ID NO: 2311043 - RNA, 16 nt, Human
aaauaaaguauauaua

SEQ ID NO: 2311044 - RNA, 18 nt, Human
aaauaaaguuggugacag

SEQ ID NO: 2311045 - RNA, 20 nt, Human
aaauaaaguuugcuuagaaa

SEQ ID NO: 2311046 - RNA, 11 nt, Human
aaauaaaagca

SEQ ID NO: 2311047 - RNA, 17 nt, Human
aaauaaaaccuuucaaa

SEQ ID NO: 2311048 - RNA, 19 nt, Human
aaauaaaagcagcaucugc

SEQ ID NO: 2311049 - RNA, 13 nt, Human
aaauaaaagcagc

SEQ ID NO: 2311050 - RNA, 19 nt, Human
aaauaaaacuuuuuaaaau

SEQ ID NO: 2311051 - RNA, 19 nt, Human
aaagucuaaaguuuacagu

SEQ ID NO: 2311052 - RNA, 17 nt, Human
aaaguggccaugccacc

SEQ ID NO: 2311053 - RNA, 14 nt, Human
aaaguggccucuuu

SEQ ID NO: 2311054 - RNA, 18 nt, Human
aaaguggccucuuugucu

SEQ ID NO: 2311055 - RNA, 16 nt, Human
aaaguggccucuuugu

SEQ ID NO: 2311056 - RNA, 16 nt, Human
aaauaaaacuuuuuaa

SEQ ID NO: 2311057 - RNA, 13 nt, Human
aaauaaaacuuuu

SEQ ID NO: 2311058 - RNA, 23 nt, Human
aaagucauuggcuuuauccucuu

SEQ ID NO: 2311059 - RNA, 18 nt, Human
aaaguccuuuuuuuccau

SEQ ID NO: 2311060 - RNA, 16 nt, Human
aaaguccuuuuuuucc

SEQ ID NO: 2311061 - RNA, 22 nt, Human
aaaguccuuuuuuuccaucuuu

SEQ ID NO: 2311062 - RNA, 15 nt, Human
aaagucgaauuaaua

SEQ ID NO: 2311063 - RNA, 12 nt, Human
aaagucuaaagu

SEQ ID NO: 2311064 - RNA, 16 nt, Human
aaagucuaaaguuuac

SEQ ID NO: 2311065 - RNA, 22 nt, Human
aaagucuaaaguuuacaguaaa

SEQ ID NO: 2311066 - RNA, 20 nt, Human
aaaguggaaaacaaggaagu

SEQ ID NO: 2311067 - RNA, 19 nt, Human
aaaguggaaaacaaggaag

SEQ ID NO: 2311068 - RNA, 13 nt, Human
aaaguggaaaaau

SEQ ID NO: 2311069 - RNA, 20 nt, Human
aaagucaugcaaaggcuggg

SEQ ID NO: 2311070 - RNA, 21 nt, Human
aaaggcgcagugcuucucuac

SEQ ID NO: 2311071 - RNA, 13 nt, Human
aaagucauuggcu

SEQ ID NO: 2311072 - RNA, 21 nt, Human
aaagucaugcaaaggcuggga

SEQ ID NO: 2311073 - RNA, 14 nt, Human
aaagucauuggcuu

SEQ ID NO: 2311074 - RNA, 15 nt, Human
aaagucauuggcuuu

SEQ ID NO: 2311075 - RNA, 17 nt, Human
aaagucauuggcuuuau

SEQ ID NO: 2311076 - RNA, 21 nt, Human
aaagucauuggcuuuauccuc

SEQ ID NO: 2311077 - RNA, 19 nt, Human
aaaggcuccaggagcagcc

SEQ ID NO: 2311078 - RNA, 20 nt, Human
aaaggcuccaggagcagcca

SEQ ID NO: 2311079 - RNA, 16 nt, Human
aaauaaauagcuauau

SEQ ID NO: 2311080 - RNA, 11 nt, Human
aaauaaauaua

SEQ ID NO: 2311081 - RNA, 12 nt, Human
aaauaaauauau

SEQ ID NO: 2311082 - RNA, 13 nt, Human
aaauaaauauaua

SEQ ID NO: 2311083 - RNA, 20 nt, Human
aaauaaauagcuauauccau

SEQ ID NO: 2311084 - RNA, 22 nt, Human
aaauaaaugagcuauguauuaa

SEQ ID NO: 2311085 - RNA, 13 nt, Human
aaauaaaugcaau

SEQ ID NO: 2311086 - RNA, 20 nt, Human
aaauaaaugagcuauguauu

SEQ ID NO: 2311087 - RNA, 14 nt, Human
aaauaaauauauau

SEQ ID NO: 2311088 - RNA, 15 nt, Human
aaauaaauauauaua

SEQ ID NO: 2311089 - RNA, 12 nt, Human
aaaggccagcug

SEQ ID NO: 2311090 - RNA, 18 nt, Human
aaaggccagcuggcagca

SEQ ID NO: 2311091 - RNA, 14 nt, Human
aaaggccagcuggc

SEQ ID NO: 2311092 - RNA, 20 nt, Human
aaaggccagcuggcagcaga

SEQ ID NO: 2311093 - RNA, 14 nt, Human
aaaggccauggaga

SEQ ID NO: 2311094 - RNA, 19 nt, Human
aaaggccauggagagcugg

SEQ ID NO: 2311095 - RNA, 21 nt, Human
aaaggcaccuauaaaacaggu

SEQ ID NO: 2311096 - RNA, 20 nt, Human
aaaggccaaaccucuguuca

SEQ ID NO: 2311097 - RNA, 18 nt, Human
aaaggccaaaccucuguu

SEQ ID NO: 2311098 - RNA, 20 nt, Human
aaaggcaccuauaaaacagg

SEQ ID NO: 2311099 - RNA, 17 nt, Human
aaaggcaccaucuaaua

SEQ ID NO: 2311100 - RNA, 17 nt, Human
aaaggcaccuauaaaac

SEQ ID NO: 2311101 - RNA, 12 nt, Human
aaaggcacagug

SEQ ID NO: 2311102 - RNA, 17 nt, Human
aaaggcaaauguguaca

SEQ ID NO: 2311103 - RNA, 14 nt, Human
aaaggcagaagcaa

SEQ ID NO: 2311104 - RNA, 11 nt, Human
aaaggccucuu

SEQ ID NO: 2311105 - RNA, 12 nt, Human
aaaggccuuuaa

SEQ ID NO: 2311106 - RNA, 17 nt, Human
aaaggccuuuaaaauuu

SEQ ID NO: 2311107 - RNA, 14 nt, Human
aaaggccucuuccu

SEQ ID NO: 2311108 - RNA, 12 nt, Human
aaaggcccccua

SEQ ID NO: 2311109 - RNA, 15 nt, Human
aaaggcuccaggagc

SEQ ID NO: 2311110 - RNA, 16 nt, Human
aaaggcuccaggagca

SEQ ID NO: 2311111 - RNA, 19 nt, Human
aaagccaauaacacacagc

SEQ ID NO: 2311112 - RNA, 12 nt, Human
aaagccaccucu

SEQ ID NO: 2311113 - RNA, 18 nt, Human
aaagccacguuccuuacu

SEQ ID NO: 2311114 - RNA, 17 nt, Human
aaagccaccucucccuc

SEQ ID NO: 2311115 - RNA, 17 nt, Human
aaagccaaugugaacag

SEQ ID NO: 2311116 - RNA, 15 nt, Human
aaagccaaugugaac

SEQ ID NO: 2311117 - RNA, 19 nt, Human
aaagcccuuaggaagaauu

SEQ ID NO: 2311118 - RNA, 16 nt, Human
aaagccagugacucca

SEQ ID NO: 2311119 - RNA, 19 nt, Human
aaagccagcugccgaccag

SEQ ID NO: 2311120 - RNA, 14 nt, Human
aaagccagaagcug

SEQ ID NO: 2311121 - RNA, 20 nt, Human
aaagccagaaccagaugagu

SEQ ID NO: 2311122 - RNA, 21 nt, Human
aaagccagcguccuccucugu

SEQ ID NO: 2311123 - RNA, 16 nt, Human
aaagccuccuccagcc

SEQ ID NO: 2311124 - RNA, 22 nt, Human
aaagcccuuccaugucgccucu

SEQ ID NO: 2311125 - RNA, 23 nt, Human
aaagcccuuccaugucgccucug

SEQ ID NO: 2311126 - RNA, 23 nt, Human
aaagccguuguuuacuuaaagau

SEQ ID NO: 2311127 - RNA, 21 nt, Human
aaagccguuguuuacuuaaag

SEQ ID NO: 2311128 - RNA, 13 nt, Human
aaaggcaaggucc

SEQ ID NO: 2311129 - RNA, 14 nt, Human
aaaggcaagcacuu

SEQ ID NO: 2311130 - RNA, 16 nt, Human
aaaggcaaauguguac

SEQ ID NO: 2311131 - RNA, 23 nt, Human
aaagccaaguuuauauacaauua

SEQ ID NO: 2311132 - RNA, 21 nt, Human
aacucagaaacaucaguuacu

SEQ ID NO: 2311133 - RNA, 22 nt, Human
aacucacugcucaagaagacau

SEQ ID NO: 2311134 - RNA, 14 nt, Human
aacucagagccucc

SEQ ID NO: 2311135 - RNA, 14 nt, Human
aacucagaucacua

SEQ ID NO: 2311136 - RNA, 14 nt, Human
aacucacuuuccuc

SEQ ID NO: 2311137 - RNA, 14 nt, Human
aacucacugcucaa

SEQ ID NO: 2311138 - RNA, 21 nt, Human
aacucacugcucaagaagaca

SEQ ID NO: 2311139 - RNA, 23 nt, Human
aacuauuuaucuguguuuuugaa

SEQ ID NO: 2311140 - RNA, 17 nt, Human
aacuauuucuuauauau

SEQ ID NO: 2311141 - RNA, 18 nt, Human
aacuauuucuuauauaug

SEQ ID NO: 2311142 - RNA, 19 nt, Human
aacuauuugucuuucagga

SEQ ID NO: 2311143 - RNA, 20 nt, Human
aacuauuucuuauauaugug

SEQ ID NO: 2311144 - RNA, 18 nt, Human
aacuauuugucuuucagg

SEQ ID NO: 2311145 - RNA, 19 nt, Human
aacucaaaacuuaacauau

SEQ ID NO: 2311146 - RNA, 15 nt, Human
aacgggcugcccugc

SEQ ID NO: 2311147 - RNA, 14 nt, Human
aacuauugcccagg

SEQ ID NO: 2311148 - RNA, 20 nt, Human
aacuauuuaucuguguuuuu

SEQ ID NO: 2311149 - RNA, 13 nt, Human
aacuauuuaucug

SEQ ID NO: 2311150 - RNA, 16 nt, Human
aacuauuuaacuugag

SEQ ID NO: 2311151 - RNA, 23 nt, Human
aacuauuuaacuugagcuuuaaa

SEQ ID NO: 2311152 - RNA, 14 nt, Human
aacggcuccaggau

SEQ ID NO: 2311153 - RNA, 22 nt, Human
aacggauuauuuuuucagaccg

SEQ ID NO: 2311154 - RNA, 15 nt, Human
aacggauuccaaaga

SEQ ID NO: 2311155 - RNA, 18 nt, Human
aacggaucagaaauacag

SEQ ID NO: 2311156 - RNA, 16 nt, Human
aacggauuauuuuuuc

SEQ ID NO: 2311157 - RNA, 17 nt, Human
aacggauuauuuuuuca

SEQ ID NO: 2311158 - RNA, 18 nt, Human
aacggauuauuuuuucag

SEQ ID NO: 2311159 - RNA, 19 nt, Human
aacggauuauuuuuucaga

SEQ ID NO: 2311160 - RNA, 20 nt, Human
aacggauuauuuuuucagac

SEQ ID NO: 2311161 - RNA, 21 nt, Human
aacggauuauuuuuucagacc

SEQ ID NO: 2311162 - RNA, 13 nt, Human
aacgcagcccuag

SEQ ID NO: 2311163 - RNA, 21 nt, Human
aacgcagcccuagagccugcc

SEQ ID NO: 2311164 - RNA, 22 nt, Human
aacgcagcccuagagccugccu

SEQ ID NO: 2311165 - RNA, 23 nt, Human
aacgcagcccuagagccugccug

SEQ ID NO: 2311166 - RNA, 18 nt, Human
aacgcagaugauccauga

SEQ ID NO: 2311167 - RNA, 11 nt, Human
aacgcagcccu

SEQ ID NO: 2311168 - RNA, 11 nt, Human
aacgcugccug

SEQ ID NO: 2311169 - RNA, 13 nt, Human
aacgcugccugcc

SEQ ID NO: 2311170 - RNA, 12 nt, Human
aacgcugccugc

SEQ ID NO: 2311171 - RNA, 15 nt, Human
aacgcugccugcccg

SEQ ID NO: 2311172 - RNA, 21 nt, Human
aacgcuuaaaggugucuuccu

SEQ ID NO: 2311173 - RNA, 15 nt, Human
aacgcugccugccca

SEQ ID NO: 2311174 - RNA, 14 nt, Human
aacgcugccugccc

SEQ ID NO: 2311175 - RNA, 19 nt, Human
aacggagagcgccugcccc

SEQ ID NO: 2311176 - RNA, 14 nt, Human
aacggagaaaggug

SEQ ID NO: 2311177 - RNA, 13 nt, Human
aacggaucagaaa

SEQ ID NO: 2311178 - RNA, 17 nt, Human
aacggaucagaaauaca

SEQ ID NO: 2311179 - RNA, 20 nt, Human
aacggagccccaggccucug

SEQ ID NO: 2311180 - RNA, 13 nt, Human
aacgauuuagaaa

SEQ ID NO: 2311181 - RNA, 18 nt, Human
aacgcaaagggcugaaag

SEQ ID NO: 2311182 - RNA, 20 nt, Human
aacgcaaagggcugaaagcc

SEQ ID NO: 2311183 - RNA, 17 nt, Human
aacgauuuaauucucuu

SEQ ID NO: 2311184 - RNA, 18 nt, Human
aacgauuuaauucucuug

SEQ ID NO: 2311185 - RNA, 12 nt, Human
aacgauuuagaa

SEQ ID NO: 2311186 - RNA, 20 nt, Human
aacgauuuaauucucuugaa

SEQ ID NO: 2311187 - RNA, 18 nt, Human
aacugagauccuuccuuu

SEQ ID NO: 2311188 - RNA, 18 nt, Human
aacugacuuuauccucag

SEQ ID NO: 2311189 - RNA, 20 nt, Human
aacugaggaauuuucuuugu

SEQ ID NO: 2311190 - RNA, 18 nt, Human
aacugaggaauuuucuuu

SEQ ID NO: 2311191 - RNA, 20 nt, Human
aacugaggcagacagcagcu

SEQ ID NO: 2311192 - RNA, 12 nt, Human
aacugaggcaga

SEQ ID NO: 2311193 - RNA, 16 nt, Human
aacugagugccuuuug

SEQ ID NO: 2311194 - RNA, 14 nt, Human
aacugauaaagaug

SEQ ID NO: 2311195 - RNA, 17 nt, Human
aacugaguccuuaaaca

SEQ ID NO: 2311196 - RNA, 15 nt, Human
aacugauaguuacug

SEQ ID NO: 2311197 - RNA, 16 nt, Human
aacugauaguuacugu

SEQ ID NO: 2311198 - RNA, 17 nt, Human
aacugauaguuacuguu

SEQ ID NO: 2311199 - RNA, 19 nt, Human
aacugauaguuacuguugu

SEQ ID NO: 2311200 - RNA, 23 nt, Human
aacugauaguuacuguugugacc

SEQ ID NO: 2311201 - RNA, 17 nt, Human
aacuuaacauucuguaa

SEQ ID NO: 2311202 - RNA, 16 nt, Human
aacuuaacauucugua

SEQ ID NO: 2311203 - RNA, 21 nt, Human
aacuuaacauucuguaaaaug

SEQ ID NO: 2311204 - RNA, 21 nt, Human
aacuuaaguugguccuuuaca

SEQ ID NO: 2311205 - RNA, 17 nt, Human
aacuuaaguuaaacaua

SEQ ID NO: 2311206 - RNA, 19 nt, Human
aacuuaaauuuuaauuuau

SEQ ID NO: 2311207 - RNA, 16 nt, Human
aacuuaaauuuuaauu

SEQ ID NO: 2311208 - RNA, 14 nt, Human
aacuuaacauauuu

SEQ ID NO: 2311209 - RNA, 16 nt, Human
aacuuaacauauuuac

SEQ ID NO: 2311210 - RNA, 22 nt, Human
aacugauaguuacuguugugac

SEQ ID NO: 2311211 - RNA, 13 nt, Human
aacugacuuuauc

SEQ ID NO: 2311212 - RNA, 20 nt, Human
aacugagaugugaacacauc

SEQ ID NO: 2311213 - RNA, 19 nt, Human
aacugacucuuaagaagac

SEQ ID NO: 2311214 - RNA, 20 nt, Human
aacugacucuuaagaagacu

SEQ ID NO: 2311215 - RNA, 22 nt, Human
aacucagauccagggacagagg

SEQ ID NO: 2311216 - RNA, 21 nt, Human
aacucagaucacuacugcagu

SEQ ID NO: 2311217 - RNA, 13 nt, Human
aacucagaucugu

SEQ ID NO: 2311218 - RNA, 15 nt, Human
aacucagauccaggg

SEQ ID NO: 2311219 - RNA, 14 nt, Human
aacucagauccagg

SEQ ID NO: 2311220 - RNA, 13 nt, Human
aacucagauccag

SEQ ID NO: 2311221 - RNA, 12 nt, Human
aacucagaucca

SEQ ID NO: 2311222 - RNA, 15 nt, Human
aacucagaucacuac

SEQ ID NO: 2311223 - RNA, 18 nt, Human
aacucagaucacuacugc

SEQ ID NO: 2311224 - RNA, 19 nt, Human
aacucagaucacuacugca

SEQ ID NO: 2311225 - RNA, 20 nt, Human
aacucagaucacuacugcag

SEQ ID NO: 2311226 - RNA, 15 nt, Human
aacugacucuuaaga

SEQ ID NO: 2311227 - RNA, 18 nt, Human
aacugacucuuaagaaga

SEQ ID NO: 2311228 - RNA, 12 nt, Human
aacuuacacaca

SEQ ID NO: 2311229 - RNA, 18 nt, Human
aacuuaauaguauuuaug

SEQ ID NO: 2311230 - RNA, 20 nt, Human
aacuuaauguucugaauaau

SEQ ID NO: 2311231 - RNA, 18 nt, Human
aacuuaaucuaaauggaa

SEQ ID NO: 2311232 - RNA, 16 nt, Human
aacuuaaucuaaaugg

SEQ ID NO: 2311233 - RNA, 15 nt, Human
aacuuaaucuaaaug

SEQ ID NO: 2311234 - RNA, 21 nt, Human
aacuuuaucacauuauuugca

SEQ ID NO: 2311235 - RNA, 14 nt, Human
aacuuuauuaaaua

SEQ ID NO: 2311236 - RNA, 17 nt, Human
aacuuuauguguaaaua

SEQ ID NO: 2311237 - RNA, 13 nt, Human
aacuuuaugugua

SEQ ID NO: 2311238 - RNA, 14 nt, Human
aacuuuauguguaa

SEQ ID NO: 2311239 - RNA, 21 nt, Human
aacuuuaugcuaagugaaaua

SEQ ID NO: 2311240 - RNA, 20 nt, Human
aacuuuaugcuaagugaaau

SEQ ID NO: 2311241 - RNA, 23 nt, Human
aacccuucuccucuuguaaauaa

SEQ ID NO: 2311242 - RNA, 14 nt, Human
aacccuugaaaaga

SEQ ID NO: 2311243 - RNA, 21 nt, Human
aacccuuggagccaauggaga

SEQ ID NO: 2311244 - RNA, 15 nt, Human
aacccuauugguaaa

SEQ ID NO: 2311245 - RNA, 15 nt, Human
aacccuugaaaagac

SEQ ID NO: 2311246 - RNA, 13 nt, Human
aacccuugucagu

SEQ ID NO: 2311247 - RNA, 21 nt, Human
aacccuugucagugacaguau

SEQ ID NO: 2311248 - RNA, 21 nt, Human
aacccuaaaaagcagagcuuu

SEQ ID NO: 2311249 - RNA, 19 nt, Human
aaccuaggagugccccauu

SEQ ID NO: 2311250 - RNA, 12 nt, Human
aaccuagccccu

SEQ ID NO: 2311251 - RNA, 22 nt, Human
aaccuacuuucauacugaagau

SEQ ID NO: 2311252 - RNA, 15 nt, Human
aaccuaaccccuuuc

SEQ ID NO: 2311253 - RNA, 22 nt, Human
aacccuuuuggcccccgagcug

SEQ ID NO: 2311254 - RNA, 16 nt, Human
aacccuuuuggccccc

SEQ ID NO: 2311255 - RNA, 19 nt, Human
aacccuuuugucugccucu

SEQ ID NO: 2311256 - RNA, 15 nt, Human
aaccgagcaaagauc

SEQ ID NO: 2311257 - RNA, 17 nt, Human
aaccgagcaaagaucaa

SEQ ID NO: 2311258 - RNA, 22 nt, Human
aaccuaaauuugguucuaggcc

SEQ ID NO: 2311259 - RNA, 18 nt, Human
aaccuaccaccccuuccu

SEQ ID NO: 2311260 - RNA, 21 nt, Human
aaccuaccuucauuucaggag

SEQ ID NO: 2311261 - RNA, 19 nt, Human
aaccuaccaccccuuccug

SEQ ID NO: 2311262 - RNA, 20 nt, Human
aaccuaccaccccuuccugu

SEQ ID NO: 2311263 - RNA, 23 nt, Human
aaccuaccuucauuucaggaggg

SEQ ID NO: 2311264 - RNA, 20 nt, Human
aaccuacuuucauacugaag

SEQ ID NO: 2311265 - RNA, 14 nt, Human
aaccuagaagggcu

SEQ ID NO: 2311266 - RNA, 17 nt, Human
aaccuagggugauauua

SEQ ID NO: 2311267 - RNA, 19 nt, Human
aacauccaaggagaaacag

SEQ ID NO: 2311268 - RNA, 17 nt, Human
aacauccaaccuuccca

SEQ ID NO: 2311269 - RNA, 16 nt, Human
aacauccaaccuuccc

SEQ ID NO: 2311270 - RNA, 11 nt, Human
aacauccaaaa

SEQ ID NO: 2311271 - RNA, 15 nt, Human
aacauccaauauuuu

SEQ ID NO: 2311272 - RNA, 22 nt, Human
aacauccaaggagaaacagaga

SEQ ID NO: 2311273 - RNA, 16 nt, Human
aacagcuucucaauuu

SEQ ID NO: 2311274 - RNA, 13 nt, Human
aacagcuguggcu

SEQ ID NO: 2311275 - RNA, 14 nt, Human
aacagcuucagguu

SEQ ID NO: 2311276 - RNA, 15 nt, Human
aacagcuucagguua

SEQ ID NO: 2311277 - RNA, 16 nt, Human
aacagcuucagguuau

SEQ ID NO: 2311278 - RNA, 16 nt, Human
aacaucccauugcccu

SEQ ID NO: 2311279 - RNA, 19 nt, Human
aaccaccagaagcccagaa

SEQ ID NO: 2311280 - RNA, 18 nt, Human
aaccaccagaagcccaga

SEQ ID NO: 2311281 - RNA, 18 nt, Human
aaccaccgcuccccagcc

SEQ ID NO: 2311282 - RNA, 17 nt, Human
aaccaccgcuccccagc

SEQ ID NO: 2311283 - RNA, 16 nt, Human
aaccaccgcuccccag

SEQ ID NO: 2311284 - RNA, 15 nt, Human
aaccaccgcucccca

SEQ ID NO: 2311285 - RNA, 19 nt, Human
aacaucccauugcccuggu

SEQ ID NO: 2311286 - RNA, 18 nt, Human
aacaucccauugcccugg

SEQ ID NO: 2311287 - RNA, 13 nt, Human
aaccacgcuggac

SEQ ID NO: 2311288 - RNA, 19 nt, Human
aaccacuuaaaaaaugucc

SEQ ID NO: 2311289 - RNA, 13 nt, Human
aaccacuuaaaaa

SEQ ID NO: 2311290 - RNA, 16 nt, Human
aaccacuguaaaauga

SEQ ID NO: 2311291 - RNA, 20 nt, Human
aaccacuguaaaaugaaauu

SEQ ID NO: 2311292 - RNA, 15 nt, Human
aaccacuguaaaaug

SEQ ID NO: 2311293 - RNA, 18 nt, Human
aaccacgucugucuucac

SEQ ID NO: 2311294 - RNA, 15 nt, Human
aaccacuucagcuga

SEQ ID NO: 2311295 - RNA, 20 nt, Human
aaccaccgcuccccagccca

SEQ ID NO: 2311296 - RNA, 19 nt, Human
aaccaccgcuccccagccc

SEQ ID NO: 2311297 - RNA, 19 nt, Human
aaccaccuaaucaggcuga

SEQ ID NO: 2311298 - RNA, 14 nt, Human
aaccacggaaaaga

SEQ ID NO: 2311299 - RNA, 22 nt, Human
aaccacuggaaaguuuaugguu

SEQ ID NO: 2311300 - RNA, 18 nt, Human
aaccagaauaaaguucug

SEQ ID NO: 2311301 - RNA, 22 nt, Human
aaccagaagcaacagaaaaaau

SEQ ID NO: 2311302 - RNA, 21 nt, Human
aaccagaagcaacagaaaaaa

SEQ ID NO: 2311303 - RNA, 17 nt, Human
aaccagaagcaacagaa

SEQ ID NO: 2311304 - RNA, 18 nt, Human
aaccagagccauggacuc

SEQ ID NO: 2311305 - RNA, 21 nt, Human
aaccacuucccucaucucucc

SEQ ID NO: 2311306 - RNA, 12 nt, Human
aaccacuucccu

SEQ ID NO: 2311307 - RNA, 13 nt, Human
aaccacuucccuc

SEQ ID NO: 2311308 - RNA, 15 nt, Human
aacagcauugcuuuc

SEQ ID NO: 2311309 - RNA, 14 nt, Human
aacagcauugcuuu

SEQ ID NO: 2311310 - RNA, 12 nt, Human
aacagcauugcu

SEQ ID NO: 2311311 - RNA, 15 nt, Human
aacagcaguguuccc

SEQ ID NO: 2311312 - RNA, 21 nt, Human
aacagcaggguagucugguuu

SEQ ID NO: 2311313 - RNA, 11 nt, Human
aacagcagugu

SEQ ID NO: 2311314 - RNA, 13 nt, Human
aacagcaguguuc

SEQ ID NO: 2311315 - RNA, 21 nt, Human
aacagcagagguucuuuuaaa

SEQ ID NO: 2311316 - RNA, 17 nt, Human
aacagcagagguucuuu

SEQ ID NO: 2311317 - RNA, 16 nt, Human
aacagcagagguucuu

SEQ ID NO: 2311318 - RNA, 18 nt, Human
aacagcacuggcucucuc

SEQ ID NO: 2311319 - RNA, 14 nt, Human
aacagcacuggcuc

SEQ ID NO: 2311320 - RNA, 23 nt, Human
aacagcacuggcucucuccagga

SEQ ID NO: 2311321 - RNA, 20 nt, Human
aacagcacuggcucucucca

SEQ ID NO: 2311322 - RNA, 21 nt, Human
aacagcacuggcucucuccag

SEQ ID NO: 2311323 - RNA, 12 nt, Human
aaauuaacacug

SEQ ID NO: 2311324 - RNA, 13 nt, Human
aaauuaacacugc

SEQ ID NO: 2311325 - RNA, 17 nt, Human
aaauuaacaguccuaac

SEQ ID NO: 2311326 - RNA, 21 nt, Human
aaauuaacacugcuuguguuu

SEQ ID NO: 2311327 - RNA, 23 nt, Human
aaauguuucugcaguagucucug

SEQ ID NO: 2311328 - RNA, 13 nt, Human
aaauuaaagcuga

SEQ ID NO: 2311329 - RNA, 17 nt, Human
aaauuaaagcugaaaac

SEQ ID NO: 2311330 - RNA, 18 nt, Human
aaauuaacaguccuaacu

SEQ ID NO: 2311331 - RNA, 21 nt, Human
aaauucuugcaaaguaucccu

SEQ ID NO: 2311332 - RNA, 23 nt, Human
aaauugaaaggcauucucugaag

SEQ ID NO: 2311333 - RNA, 22 nt, Human
aaauugaaaggcauucucugaa

SEQ ID NO: 2311334 - RNA, 20 nt, Human
aaauugaaaggcauucucug

SEQ ID NO: 2311335 - RNA, 20 nt, Human
aaauugacacaaguggaccu

SEQ ID NO: 2311336 - RNA, 23 nt, Human
aaauugaaucaguauaaacaaag

SEQ ID NO: 2311337 - RNA, 13 nt, Human
aaauugaauaaug

SEQ ID NO: 2311338 - RNA, 23 nt, Human
aaauugaauaaugguaccagaua

SEQ ID NO: 2311339 - RNA, 19 nt, Human
aaauugacacuuaaaaaug

SEQ ID NO: 2311340 - RNA, 15 nt, Human
aaauugccauauugc

SEQ ID NO: 2311341 - RNA, 16 nt, Human
aaauugccauauugca

SEQ ID NO: 2311342 - RNA, 13 nt, Human
aaauugcuccuug

SEQ ID NO: 2311343 - RNA, 22 nt, Human
aaauugcuccuaagcuucaaau

SEQ ID NO: 2311344 - RNA, 14 nt, Human
aaauugcuccuuga

SEQ ID NO: 2311345 - RNA, 18 nt, Human
aaauugccauauugcaca

SEQ ID NO: 2311346 - RNA, 19 nt, Human
aaauugccauauugcacau

SEQ ID NO: 2311347 - RNA, 21 nt, Human
aaauugccauauugcacaugu

SEQ ID NO: 2311348 - RNA, 23 nt, Human
aaauugccauauugcacaugucu

SEQ ID NO: 2311349 - RNA, 13 nt, Human
aaaugccuuugag

SEQ ID NO: 2311350 - RNA, 14 nt, Human
aaaugccuuugaga

SEQ ID NO: 2311351 - RNA, 15 nt, Human
aaaugccuuuguacu

SEQ ID NO: 2311352 - RNA, 20 nt, Human
aaaugccuuugagacaguuu

SEQ ID NO: 2311353 - RNA, 16 nt, Human
aaaugccuuugagaca

SEQ ID NO: 2311354 - RNA, 17 nt, Human
aaaugccuuugagacag

SEQ ID NO: 2311355 - RNA, 18 nt, Human
aaaugccuuugagacagu

SEQ ID NO: 2311356 - RNA, 19 nt, Human
aaaugccuuugagacaguu

SEQ ID NO: 2311357 - RNA, 19 nt, Human
aaaucuuauauuccauaua

SEQ ID NO: 2311358 - RNA, 21 nt, Human
aaaucuuauauuccauauauu

SEQ ID NO: 2311359 - RNA, 23 nt, Human
aaaugccuuacccucauguucuu

SEQ ID NO: 2311360 - RNA, 17 nt, Human
aaaucuuauaauuuaaa

SEQ ID NO: 2311361 - RNA, 13 nt, Human
aaauguuucugca

SEQ ID NO: 2311362 - RNA, 15 nt, Human
aaauguuucugcagu

SEQ ID NO: 2311363 - RNA, 20 nt, Human
aaauguuuacagggagccuc

SEQ ID NO: 2311364 - RNA, 21 nt, Human
aaauguuuacagggagccucc

SEQ ID NO: 2311365 - RNA, 23 nt, Human
aaauguuggauuuauaaaugcua

SEQ ID NO: 2311366 - RNA, 23 nt, Human
aaauguuguucauuauuggaggg

SEQ ID NO: 2311367 - RNA, 19 nt, Human
aaauguuggucauuuuaug

SEQ ID NO: 2311368 - RNA, 17 nt, Human
aaauguuggucauuuua

SEQ ID NO: 2311369 - RNA, 22 nt, Human
aaauguuguucucuucuuuaaa

SEQ ID NO: 2311370 - RNA, 20 nt, Human
aacacgccugcaaacgcugc

SEQ ID NO: 2311371 - RNA, 15 nt, Human
aacacgccugcaaac

SEQ ID NO: 2311372 - RNA, 20 nt, Human
aacacccagucuguucccca

SEQ ID NO: 2311373 - RNA, 22 nt, Human
aacaccagccccugccccagcc

SEQ ID NO: 2311374 - RNA, 23 nt, Human
aacaccagccccugccccagccc

SEQ ID NO: 2311375 - RNA, 21 nt, Human
aacaccagguuuauggaaaau

SEQ ID NO: 2311376 - RNA, 19 nt, Human
aacaccacagacacacaca

SEQ ID NO: 2311377 - RNA, 23 nt, Human
aacaccacagacacacacacgca

SEQ ID NO: 2311378 - RNA, 13 nt, Human
aacaccagccccu

SEQ ID NO: 2311379 - RNA, 15 nt, Human
aacaccagccccugc

SEQ ID NO: 2311380 - RNA, 16 nt, Human
aacaccagccccugcc

SEQ ID NO: 2311381 - RNA, 17 nt, Human
aacaccagccccugccc

SEQ ID NO: 2311382 - RNA, 18 nt, Human
aacaccagccccugcccc

SEQ ID NO: 2311383 - RNA, 19 nt, Human
aacaccagccccugcccca

SEQ ID NO: 2311384 - RNA, 21 nt, Human
aacacauuaagccuuccacac

SEQ ID NO: 2311385 - RNA, 21 nt, Human
aacacauuaucgggagcagug

SEQ ID NO: 2311386 - RNA, 17 nt, Human
aacacaucuuuccuguc

SEQ ID NO: 2311387 - RNA, 20 nt, Human
aacacauuugauucugugug

SEQ ID NO: 2311388 - RNA, 13 nt, Human
aacaccacagaca

SEQ ID NO: 2311389 - RNA, 14 nt, Human
aacaccacagacac

SEQ ID NO: 2311390 - RNA, 15 nt, Human
aacaccacagacaca

SEQ ID NO: 2311391 - RNA, 16 nt, Human
aacaccacagacacac

SEQ ID NO: 2311392 - RNA, 17 nt, Human
aacaccacagacacaca

SEQ ID NO: 2311393 - RNA, 18 nt, Human
aacaccacagacacacac

SEQ ID NO: 2311394 - RNA, 18 nt, Human
aacacauuugauucugug

SEQ ID NO: 2311395 - RNA, 13 nt, Human
aacaacauguaua

SEQ ID NO: 2311396 - RNA, 16 nt, Human
aacaaauugaacucuu

SEQ ID NO: 2311397 - RNA, 18 nt, Human
aacaaauuuacagagaca

SEQ ID NO: 2311398 - RNA, 13 nt, Human
aacaaccuggaga

SEQ ID NO: 2311399 - RNA, 18 nt, Human
aacaaccucaacugccua

SEQ ID NO: 2311400 - RNA, 14 nt, Human
aacaaccucaacug

SEQ ID NO: 2311401 - RNA, 16 nt, Human
aacacaucagcuugcc

SEQ ID NO: 2311402 - RNA, 17 nt, Human
aaauuuuuuuuguuuca

SEQ ID NO: 2311403 - RNA, 18 nt, Human
aaauuuuuuuuguuucau

SEQ ID NO: 2311404 - RNA, 15 nt, Human
aaauuuuuuuucaug

SEQ ID NO: 2311405 - RNA, 20 nt, Human
aacaaauuauguuacaucug

SEQ ID NO: 2311406 - RNA, 11 nt, Human
aacaaaaagaa

SEQ ID NO: 2311407 - RNA, 12 nt, Human
aacaaaaagaac

SEQ ID NO: 2311408 - RNA, 18 nt, Human
aacaaauucauauucugu

SEQ ID NO: 2311409 - RNA, 22 nt, Human
aacaaauucaucaaauggaaga

SEQ ID NO: 2311410 - RNA, 13 nt, Human
aacaaaaaaaucu

SEQ ID NO: 2311411 - RNA, 19 nt, Human
aacaaaaacacuaaaaaua

SEQ ID NO: 2311412 - RNA, 23 nt, Human
aaauuuuuuuucauguuuuaaca

SEQ ID NO: 2311413 - RNA, 17 nt, Human
aaauuuuuuuuuuaaua

SEQ ID NO: 2311414 - RNA, 22 nt, Human
aaauuuuuuuucauguuuuaac

SEQ ID NO: 2311415 - RNA, 17 nt, Human
aaauuuuuuuucauguu

SEQ ID NO: 2311416 - RNA, 18 nt, Human
aacacuaacauauaaugu

SEQ ID NO: 2311417 - RNA, 19 nt, Human
aacacuaaacagacuauuu

SEQ ID NO: 2311418 - RNA, 15 nt, Human
aacacuaaaaauaaa

SEQ ID NO: 2311419 - RNA, 14 nt, Human
aacacuaaaaauaa

SEQ ID NO: 2311420 - RNA, 21 nt, Human
aacacccaugaaucaaagaca

SEQ ID NO: 2311421 - RNA, 21 nt, Human
aacacguccagaauuuuucau

SEQ ID NO: 2311422 - RNA, 21 nt, Human
aacacggccacaucaaagagg

SEQ ID NO: 2311423 - RNA, 13 nt, Human
aacacggccacau

SEQ ID NO: 2311424 - RNA, 18 nt, Human
accccuccccuaaugccu

SEQ ID NO: 2311425 - RNA, 12 nt, Human
accccuccccau

SEQ ID NO: 2311426 - RNA, 19 nt, Human
accccucccauuaggacaa

SEQ ID NO: 2311427 - RNA, 22 nt, Human
accccucccagcugacaguccu

SEQ ID NO: 2311428 - RNA, 11 nt, Human
accccucccau

SEQ ID NO: 2311429 - RNA, 17 nt, Human
accccucacucuggccu

SEQ ID NO: 2311430 - RNA, 12 nt, Human
accccucccagc

SEQ ID NO: 2311431 - RNA, 13 nt, Human
accccucccagcu

SEQ ID NO: 2311432 - RNA, 14 nt, Human
accccucccagcug

SEQ ID NO: 2311433 - RNA, 15 nt, Human
accccucccagcuga

SEQ ID NO: 2311434 - RNA, 16 nt, Human
accccucccagcugac

SEQ ID NO: 2311435 - RNA, 20 nt, Human
acccccuucagugcccacca

SEQ ID NO: 2311436 - RNA, 18 nt, Human
acccccuucagugcccac

SEQ ID NO: 2311437 - RNA, 11 nt, Human
acccccuuccc

SEQ ID NO: 2311438 - RNA, 19 nt, Human
acccccuuccuacucccag

SEQ ID NO: 2311439 - RNA, 16 nt, Human
acccccuucagugccc

SEQ ID NO: 2311440 - RNA, 22 nt, Human
acccaccuuguuggagccugca

SEQ ID NO: 2311441 - RNA, 15 nt, Human
acccccugcccugca

SEQ ID NO: 2311442 - RNA, 12 nt, Human
acccccuggaga

SEQ ID NO: 2311443 - RNA, 13 nt, Human
acccccugcccug

SEQ ID NO: 2311444 - RNA, 14 nt, Human
acccccugcccugc

SEQ ID NO: 2311445 - RNA, 20 nt, Human
accccucacaggagcuuacu

SEQ ID NO: 2311446 - RNA, 13 nt, Human
acccccuucucug

SEQ ID NO: 2311447 - RNA, 14 nt, Human
acccccuucucugc

SEQ ID NO: 2311448 - RNA, 19 nt, Human
acccccuucuacugagccu

SEQ ID NO: 2311449 - RNA, 18 nt, Human
acccccuucuacugagcc

SEQ ID NO: 2311450 - RNA, 19 nt, Human
acccccuucuccauccaca

SEQ ID NO: 2311451 - RNA, 18 nt, Human
acccccuucuccauccac

SEQ ID NO: 2311452 - RNA, 16 nt, Human
accccuccaugugggc

SEQ ID NO: 2311453 - RNA, 19 nt, Human
accccuccaugugggcuag

SEQ ID NO: 2311454 - RNA, 23 nt, Human
accccucaccuugcaacacacag

SEQ ID NO: 2311455 - RNA, 15 nt, Human
accccucacucuggc

SEQ ID NO: 2311456 - RNA, 18 nt, Human
accccucacucuggccuc

SEQ ID NO: 2311457 - RNA, 22 nt, Human
accccucaccuugcaacacaca

SEQ ID NO: 2311458 - RNA, 19 nt, Human
accccucaccuugcaacac

SEQ ID NO: 2311459 - RNA, 16 nt, Human
accccucaccuugcaa

SEQ ID NO: 2311460 - RNA, 15 nt, Human
accccucaccuugca

SEQ ID NO: 2311461 - RNA, 17 nt, Human
accccucauagcccuca

SEQ ID NO: 2311462 - RNA, 12 nt, Human
accccuccagga

SEQ ID NO: 2311463 - RNA, 21 nt, Human
accaucucaggccaccugccc

SEQ ID NO: 2311464 - RNA, 17 nt, Human
accaucucaggccaccu

SEQ ID NO: 2311465 - RNA, 16 nt, Human
accaucucaggccacc

SEQ ID NO: 2311466 - RNA, 15 nt, Human
accaucucaggccac

SEQ ID NO: 2311467 - RNA, 14 nt, Human
accaucucaggcca

SEQ ID NO: 2311468 - RNA, 13 nt, Human
accaucucaggcc

SEQ ID NO: 2311469 - RNA, 13 nt, Human
accaucuaauagc

SEQ ID NO: 2311470 - RNA, 18 nt, Human
acccaagggccuggccug

SEQ ID NO: 2311471 - RNA, 19 nt, Human
acccaagggccuggccuga

SEQ ID NO: 2311472 - RNA, 22 nt, Human
acccaagggccuggccugagcu

SEQ ID NO: 2311473 - RNA, 16 nt, Human
accauccuauuuaacu

SEQ ID NO: 2311474 - RNA, 17 nt, Human
accauccgccagggccc

SEQ ID NO: 2311475 - RNA, 16 nt, Human
accauccugcagccuc

SEQ ID NO: 2311476 - RNA, 13 nt, Human
accauccuauuua

SEQ ID NO: 2311477 - RNA, 20 nt, Human
accaucccuuuuugaagugu

SEQ ID NO: 2311478 - RNA, 21 nt, Human
accaucccuuuuugaagugua

SEQ ID NO: 2311479 - RNA, 17 nt, Human
accauccugcagccucc

SEQ ID NO: 2311480 - RNA, 15 nt, Human
accaucgcuuuauug

SEQ ID NO: 2311481 - RNA, 19 nt, Human
accaucccuuuuugaagug

SEQ ID NO: 2311482 - RNA, 19 nt, Human
accauauucagugcugugg

SEQ ID NO: 2311483 - RNA, 20 nt, Human
accauauuaccacagacaua

SEQ ID NO: 2311484 - RNA, 13 nt, Human
acccacaagugcc

SEQ ID NO: 2311485 - RNA, 21 nt, Human
acccacaagaaaugaaagcag

SEQ ID NO: 2311486 - RNA, 23 nt, Human
acccaagggccuggccugagcug

SEQ ID NO: 2311487 - RNA, 17 nt, Human
acccacaagaaaugaaa

SEQ ID NO: 2311488 - RNA, 17 nt, Human
acccacaagugccacug

SEQ ID NO: 2311489 - RNA, 16 nt, Human
acccacaccucugcca

SEQ ID NO: 2311490 - RNA, 15 nt, Human
acccacaccucugcc

SEQ ID NO: 2311491 - RNA, 17 nt, Human
acccaccguccgcccug

SEQ ID NO: 2311492 - RNA, 17 nt, Human
acccacaccucugccag

SEQ ID NO: 2311493 - RNA, 19 nt, Human
acccaccguccgcccugcu

SEQ ID NO: 2311494 - RNA, 13 nt, Human
acccaccucagcc

SEQ ID NO: 2311495 - RNA, 14 nt, Human
acccaccucagccu

SEQ ID NO: 2311496 - RNA, 15 nt, Human
acccaccucagccuc

SEQ ID NO: 2311497 - RNA, 19 nt, Human
acccaccugguggccucug

SEQ ID NO: 2311498 - RNA, 19 nt, Human
acccaccuuguuggagccu

SEQ ID NO: 2311499 - RNA, 22 nt, Human
acccaccugcugagagacccaa

SEQ ID NO: 2311500 - RNA, 17 nt, Human
acccaccugcugagaga

SEQ ID NO: 2311501 - RNA, 22 nt, Human
acccagugcccccacugaccag

SEQ ID NO: 2311502 - RNA, 20 nt, Human
acccaccuuguuggagccug

SEQ ID NO: 2311503 - RNA, 21 nt, Human
acccaccuuguuggagccugc

SEQ ID NO: 2311504 - RNA, 11 nt, Human
acccaccugcu

SEQ ID NO: 2311505 - RNA, 13 nt, Human
acccaccugcuga

SEQ ID NO: 2311506 - RNA, 18 nt, Human
acccaccucccugccucc

SEQ ID NO: 2311507 - RNA, 16 nt, Human
acccaccucccugccu

SEQ ID NO: 2311508 - RNA, 16 nt, Human
acccaccucagccucc

SEQ ID NO: 2311509 - RNA, 15 nt, Human
acccaccucccugcc

SEQ ID NO: 2311510 - RNA, 14 nt, Human
acccaccucccugc

SEQ ID NO: 2311511 - RNA, 13 nt, Human
acccaccucccug

SEQ ID NO: 2311512 - RNA, 15 nt, Human
acccaccguggagga

SEQ ID NO: 2311513 - RNA, 20 nt, Human
acccaccguccgcccugcuc

SEQ ID NO: 2311514 - RNA, 22 nt, Human
acccaccguccgcccugcuccu

SEQ ID NO: 2311515 - RNA, 22 nt, Human
acccaccguggaggaggaaggc

SEQ ID NO: 2311516 - RNA, 17 nt, Human
acccaguugccaucugc

SEQ ID NO: 2311517 - RNA, 18 nt, Human
acccaguugccaucugcg

SEQ ID NO: 2311518 - RNA, 22 nt, Human
acccauucguggugaucaauua

SEQ ID NO: 2311519 - RNA, 19 nt, Human
acccauucuacacagagca

SEQ ID NO: 2311520 - RNA, 17 nt, Human
acccauuccuauuucuu

SEQ ID NO: 2311521 - RNA, 20 nt, Human
acccauuuaaauuuuuuucc

SEQ ID NO: 2311522 - RNA, 23 nt, Human
acccauuuaaauuuuuuuccuua

SEQ ID NO: 2311523 - RNA, 13 nt, Human
acccauuccuauu

SEQ ID NO: 2311524 - RNA, 17 nt, Human
acccauuccauuuaucu

SEQ ID NO: 2311525 - RNA, 19 nt, Human
acccauuccauuuaucuuu

SEQ ID NO: 2311526 - RNA, 17 nt, Human
acccaugugccaaggug

SEQ ID NO: 2311527 - RNA, 14 nt, Human
acccaugggcucug

SEQ ID NO: 2311528 - RNA, 17 nt, Human
acccaugggcucugaca

SEQ ID NO: 2311529 - RNA, 16 nt, Human
acccaugggcucugac

SEQ ID NO: 2311530 - RNA, 14 nt, Human
acccaugugccaag

SEQ ID NO: 2311531 - RNA, 16 nt, Human
acccauguuucucugg

SEQ ID NO: 2311532 - RNA, 20 nt, Human
acccccugcaaagcccagcu

SEQ ID NO: 2311533 - RNA, 18 nt, Human
acccccugcaaagcccag

SEQ ID NO: 2311534 - RNA, 22 nt, Human
acccccugcaaagcccagcuug

SEQ ID NO: 2311535 - RNA, 17 nt, Human
acccccugcaaagccca

SEQ ID NO: 2311536 - RNA, 14 nt, Human
acccccugcaaagc

SEQ ID NO: 2311537 - RNA, 11 nt, Human
acccccugaau

SEQ ID NO: 2311538 - RNA, 16 nt, Human
accauauuaccacaga

SEQ ID NO: 2311539 - RNA, 14 nt, Human
accauauuaccaca

SEQ ID NO: 2311540 - RNA, 14 nt, Human
accagaggcugcag

SEQ ID NO: 2311541 - RNA, 15 nt, Human
accagaggcugcaga

SEQ ID NO: 2311542 - RNA, 19 nt, Human
accagaggcugcagaaggc

SEQ ID NO: 2311543 - RNA, 21 nt, Human
accagaggcugcagaaggcca

SEQ ID NO: 2311544 - RNA, 22 nt, Human
accagaggcugcagaaggccaa

SEQ ID NO: 2311545 - RNA, 14 nt, Human
accaccucccucac

SEQ ID NO: 2311546 - RNA, 17 nt, Human
accagagcuguggagag

SEQ ID NO: 2311547 - RNA, 18 nt, Human
accagaggaaucacucuu

SEQ ID NO: 2311548 - RNA, 15 nt, Human
accagaggaaucacu

SEQ ID NO: 2311549 - RNA, 21 nt, Human
accagauaagaaugcugguuu

SEQ ID NO: 2311550 - RNA, 20 nt, Human
accagauaagaaugcugguu

SEQ ID NO: 2311551 - RNA, 20 nt, Human
accagauaaaauuauagaug

SEQ ID NO: 2311552 - RNA, 13 nt, Human
accagaucauugu

SEQ ID NO: 2311553 - RNA, 18 nt, Human
accaccuaggccacuccu

SEQ ID NO: 2311554 - RNA, 17 nt, Human
accaccuaggccacucc

SEQ ID NO: 2311555 - RNA, 16 nt, Human
accaccuaggccacuc

SEQ ID NO: 2311556 - RNA, 19 nt, Human
accaccuaccuuacaguga

SEQ ID NO: 2311557 - RNA, 23 nt, Human
accaccgcuccccagcccagggu

SEQ ID NO: 2311558 - RNA, 18 nt, Human
accaccuaaucaggcuga

SEQ ID NO: 2311559 - RNA, 21 nt, Human
accaccgcuccccagcccagg

SEQ ID NO: 2311560 - RNA, 19 nt, Human
accaccgcuccccagccca

SEQ ID NO: 2311561 - RNA, 18 nt, Human
accaccgcuccccagccc

SEQ ID NO: 2311562 - RNA, 17 nt, Human
accaccgcuccccagcc

SEQ ID NO: 2311563 - RNA, 15 nt, Human
accaccgcuccccag

SEQ ID NO: 2311564 - RNA, 14 nt, Human
accaccgcucccca

SEQ ID NO: 2311565 - RNA, 13 nt, Human
accaccgcucccc

SEQ ID NO: 2311566 - RNA, 15 nt, Human
accaccucacuccug

SEQ ID NO: 2311567 - RNA, 16 nt, Human
accaccucacuccugu

SEQ ID NO: 2311568 - RNA, 21 nt, Human
accaccuaggccacuccucca

SEQ ID NO: 2311569 - RNA, 20 nt, Human
accaccuaggccacuccucc

SEQ ID NO: 2311570 - RNA, 19 nt, Human
accagagcugccaccugcc

SEQ ID NO: 2311571 - RNA, 14 nt, Human
accagcccagaugu

SEQ ID NO: 2311572 - RNA, 15 nt, Human
accagcccagauguu

SEQ ID NO: 2311573 - RNA, 22 nt, Human
accagccauacuuaucucucug

SEQ ID NO: 2311574 - RNA, 23 nt, Human
accagccaggcucugugcugacc

SEQ ID NO: 2311575 - RNA, 21 nt, Human
accagccauuggcuauuuaaa

SEQ ID NO: 2311576 - RNA, 16 nt, Human
accagcacugucucag

SEQ ID NO: 2311577 - RNA, 17 nt, Human
accagcauuccuuuuga

SEQ ID NO: 2311578 - RNA, 15 nt, Human
accagccagauccuc

SEQ ID NO: 2311579 - RNA, 14 nt, Human
accagccagauccu

SEQ ID NO: 2311580 - RNA, 17 nt, Human
accagccaggcucugug

SEQ ID NO: 2311581 - RNA, 19 nt, Human
accagccaggcucugugcu

SEQ ID NO: 2311582 - RNA, 20 nt, Human
accagccaggcucugugcug

SEQ ID NO: 2311583 - RNA, 17 nt, Human
accagccaguaaauggg

SEQ ID NO: 2311584 - RNA, 15 nt, Human
accagcacugucuca

SEQ ID NO: 2311585 - RNA, 15 nt, Human
accagcauuccuuuu

SEQ ID NO: 2311586 - RNA, 13 nt, Human
accagcagaaaug

SEQ ID NO: 2311587 - RNA, 23 nt, Human
accagcaacuugucuuuuucugg

SEQ ID NO: 2311588 - RNA, 17 nt, Human
accagcaauauaucuga

SEQ ID NO: 2311589 - RNA, 17 nt, Human
accagcaauauguaaau

SEQ ID NO: 2311590 - RNA, 17 nt, Human
accagaugaugggggag

SEQ ID NO: 2311591 - RNA, 18 nt, Human
accagaugaugggggagg

SEQ ID NO: 2311592 - RNA, 16 nt, Human
accaagcaggaagcuc

SEQ ID NO: 2311593 - RNA, 15 nt, Human
accaagcaggaagcu

SEQ ID NO: 2311594 - RNA, 14 nt, Human
accaagcaggaagc

SEQ ID NO: 2311595 - RNA, 13 nt, Human
accaagcaggaag

SEQ ID NO: 2311596 - RNA, 24 nt, Human
accaagcaggaagcucagacuggu

SEQ ID NO: 2311597 - RNA, 14 nt, Human
accaagcaucuugg

SEQ ID NO: 2311598 - RNA, 16 nt, Human
accaagcacagcagcc

SEQ ID NO: 2311599 - RNA, 14 nt, Human
accaagcacagcag

SEQ ID NO: 2311600 - RNA, 17 nt, Human
accaagcacagcagccu

SEQ ID NO: 2311601 - RNA, 13 nt, Human
accaagcaggaaa

SEQ ID NO: 2311602 - RNA, 12 nt, Human
accaagcccagu

SEQ ID NO: 2311603 - RNA, 17 nt, Human
accaagcaggaagcuca

SEQ ID NO: 2311604 - RNA, 20 nt, Human
accaagccaagggaaccugu

SEQ ID NO: 2311605 - RNA, 23 nt, Human
accaagccaagggaaccuguguc

SEQ ID NO: 2311606 - RNA, 20 nt, Human
accaauauuauacuaagaaa

SEQ ID NO: 2311607 - RNA, 23 nt, Human
accaauagggcugagcucucugu

SEQ ID NO: 2311608 - RNA, 13 nt, Human
accacccugaggc

SEQ ID NO: 2311609 - RNA, 13 nt, Human
accaauagauucc

SEQ ID NO: 2311610 - RNA, 14 nt, Human
accaauagauuccc

SEQ ID NO: 2311611 - RNA, 23 nt, Human
accaaguuucagguauuaagaaa

SEQ ID NO: 2311612 - RNA, 23 nt, Human
accaaguuauaaaucaaugucac

SEQ ID NO: 2311613 - RNA, 16 nt, Human
accaaguggaccuuga

SEQ ID NO: 2311614 - RNA, 15 nt, Human
accaaggucuucagc

SEQ ID NO: 2311615 - RNA, 19 nt, Human
accaaggucuucagccauc

SEQ ID NO: 2311616 - RNA, 15 nt, Human
accaaguauuuauua

SEQ ID NO: 2311617 - RNA, 15 nt, Human
acauuuuaaauggac

SEQ ID NO: 2311618 - RNA, 15 nt, Human
acauuuuaaauaaaa

SEQ ID NO: 2311619 - RNA, 17 nt, Human
acauuuuaaauaaaaga

SEQ ID NO: 2311620 - RNA, 20 nt, Human
acauuuuaaauaaaagaaaa

SEQ ID NO: 2311621 - RNA, 14 nt, Human
acauuuuaaauaaa

SEQ ID NO: 2311622 - RNA, 21 nt, Human
acauuuguguaaacaguguuu

SEQ ID NO: 2311623 - RNA, 19 nt, Human
acauuuguucuauagcuuu

SEQ ID NO: 2311624 - RNA, 15 nt, Human
acauuuauucugcuc

SEQ ID NO: 2311625 - RNA, 15 nt, Human
acauuuauuuuuaua

SEQ ID NO: 2311626 - RNA, 13 nt, Human
acauuucccaggg

SEQ ID NO: 2311627 - RNA, 21 nt, Human
acauuuccccagaccugagcu

SEQ ID NO: 2311628 - RNA, 12 nt, Human
acauuucccugu

SEQ ID NO: 2311629 - RNA, 14 nt, Human
acauuuauucugcu

SEQ ID NO: 2311630 - RNA, 22 nt, Human
acaggcaacugaggcagacagc

SEQ ID NO: 2311631 - RNA, 12 nt, Human
acaggcacaaaa

SEQ ID NO: 2311632 - RNA, 23 nt, Human
acagggucucuagugcugugaaa

SEQ ID NO: 2311633 - RNA, 14 nt, Human
acagggucugcucu

SEQ ID NO: 2311634 - RNA, 15 nt, Human
acagggucugcucuu

SEQ ID NO: 2311635 - RNA, 22 nt, Human
acagggucugcucuuucucugc

SEQ ID NO: 2311636 - RNA, 23 nt, Human
acagggucugcucuuucucugcc

SEQ ID NO: 2311637 - RNA, 19 nt, Human
acaggcaaugcuggcuguu

SEQ ID NO: 2311638 - RNA, 23 nt, Human
acaggcaaugcuggcuguuggcu

SEQ ID NO: 2311639 - RNA, 16 nt, Human
acaggguucaaaaugu

SEQ ID NO: 2311640 - RNA, 24 nt, Human
acagggucugcucuuucucugcca

SEQ ID NO: 2311641 - RNA, 14 nt, Human
acaggguugggccc

SEQ ID NO: 2311642 - RNA, 15 nt, Human
acaggguuucaccau

SEQ ID NO: 2311643 - RNA, 19 nt, Human
acaggguuuugccauguug

SEQ ID NO: 2311644 - RNA, 22 nt, Human
acaggguuuggcugugucuaaa

SEQ ID NO: 2311645 - RNA, 23 nt, Human
acaggguuuggcugugucuaaac

SEQ ID NO: 2311646 - RNA, 21 nt, Human
acauaaugcgugcauaccacu

SEQ ID NO: 2311647 - RNA, 22 nt, Human
acauaaugcgugcauaccacuu

SEQ ID NO: 2311648 - RNA, 23 nt, Human
acauaaugcgugcauaccacuuu

SEQ ID NO: 2311649 - RNA, 17 nt, Human
acauaaugggguccugg

SEQ ID NO: 2311650 - RNA, 20 nt, Human
acauaauguauuguugguaa

SEQ ID NO: 2311651 - RNA, 17 nt, Human
acaugcauuugagguca

SEQ ID NO: 2311652 - RNA, 21 nt, Human
acaugugacauuuauauauug

SEQ ID NO: 2311653 - RNA, 21 nt, Human
acauguuuauuuauucugcau

SEQ ID NO: 2311654 - RNA, 23 nt, Human
acauguuuauuuauucugcauuu

SEQ ID NO: 2311655 - RNA, 11 nt, Human
acauguuuccu

SEQ ID NO: 2311656 - RNA, 19 nt, Human
acauguuucuuuguaauga

SEQ ID NO: 2311657 - RNA, 22 nt, Human
acauguuucuuuguaaugaaaa

SEQ ID NO: 2311658 - RNA, 23 nt, Human
acauguuucuuuguaaugaaaac

SEQ ID NO: 2311659 - RNA, 16 nt, Human
acauguuuccucuagu

SEQ ID NO: 2311660 - RNA, 19 nt, Human
acaugaucuucuuuauaau

SEQ ID NO: 2311661 - RNA, 13 nt, Human
acaugauuccuuc

SEQ ID NO: 2311662 - RNA, 13 nt, Human
acaugauucauuu

SEQ ID NO: 2311663 - RNA, 13 nt, Human
acaugauuuccuu

SEQ ID NO: 2311664 - RNA, 14 nt, Human
acaugauuccuucc

SEQ ID NO: 2311665 - RNA, 22 nt, Human
acaugauuccuuccuguucuga

SEQ ID NO: 2311666 - RNA, 15 nt, Human
acaugauuccuuccu

SEQ ID NO: 2311667 - RNA, 18 nt, Human
acaucagcacgauuucug

SEQ ID NO: 2311668 - RNA, 16 nt, Human
acauaauuaaaguguc

SEQ ID NO: 2311669 - RNA, 13 nt, Human
acauaauuaaagu

SEQ ID NO: 2311670 - RNA, 15 nt, Human
acauaauuaaagugu

SEQ ID NO: 2311671 - RNA, 17 nt, Human
acaucagcacgauuucu

SEQ ID NO: 2311672 - RNA, 15 nt, Human
acaucagcacgauuu

SEQ ID NO: 2311673 - RNA, 16 nt, Human
acaugcauacuucaaa

SEQ ID NO: 2311674 - RNA, 17 nt, Human
acaugcauacuucaaaa

SEQ ID NO: 2311675 - RNA, 24 nt, Human
acaugcauacacacacacacacag

SEQ ID NO: 2311676 - RNA, 16 nt, Human
acaugcauuacugcau

SEQ ID NO: 2311677 - RNA, 21 nt, Human
acaugcauacuucaaaaguau

SEQ ID NO: 2311678 - RNA, 17 nt, Human
acaugcauacacacaca

SEQ ID NO: 2311679 - RNA, 16 nt, Human
acaugcauacacacac

SEQ ID NO: 2311680 - RNA, 15 nt, Human
acaugcauacacaca

SEQ ID NO: 2311681 - RNA, 14 nt, Human
acaugcauacacac

SEQ ID NO: 2311682 - RNA, 22 nt, Human
acaugcagcccaugcccaccug

SEQ ID NO: 2311683 - RNA, 20 nt, Human
acaugcagcccaugcccacc

SEQ ID NO: 2311684 - RNA, 23 nt, Human
acaugcagcugcacccucccucc

SEQ ID NO: 2311685 - RNA, 17 nt, Human
acaugauuuccuugaau

SEQ ID NO: 2311686 - RNA, 16 nt, Human
acaugauuuccuugaa

SEQ ID NO: 2311687 - RNA, 13 nt, Human
acaugcauacaca

SEQ ID NO: 2311688 - RNA, 12 nt, Human
acaugcauacac

SEQ ID NO: 2311689 - RNA, 12 nt, Human
acaugcauuuga

SEQ ID NO: 2311690 - RNA, 19 nt, Human
acaugcauacuucaaaagu

SEQ ID NO: 2311691 - RNA, 20 nt, Human
acaugcauuacugcaugcac

SEQ ID NO: 2311692 - RNA, 21 nt, Human
acaugcauuugaggucaagua

SEQ ID NO: 2311693 - RNA, 15 nt, Human
acaugugacacauau

SEQ ID NO: 2311694 - RNA, 21 nt, Human
acaugugacacauaugcaccu

SEQ ID NO: 2311695 - RNA, 13 nt, Human
acaugugacauuu

SEQ ID NO: 2311696 - RNA, 14 nt, Human
acaugugacauuua

SEQ ID NO: 2311697 - RNA, 15 nt, Human
acaugugacauuuau

SEQ ID NO: 2311698 - RNA, 16 nt, Human
acaugugacauuuaua

SEQ ID NO: 2311699 - RNA, 16 nt, Human
acaugugcacaugcac

SEQ ID NO: 2311700 - RNA, 18 nt, Human
acaugugcacaugcacgu

SEQ ID NO: 2311701 - RNA, 17 nt, Human
acagaggcuauuguccc

SEQ ID NO: 2311702 - RNA, 13 nt, Human
acagaggccugcc

SEQ ID NO: 2311703 - RNA, 20 nt, Human
acagagggaagaaaagagcu

SEQ ID NO: 2311704 - RNA, 15 nt, Human
acagagggaagaaaa

SEQ ID NO: 2311705 - RNA, 14 nt, Human
acagaggccugccc

SEQ ID NO: 2311706 - RNA, 23 nt, Human
acagagucucacuguugcccagg

SEQ ID NO: 2311707 - RNA, 13 nt, Human
acagagucugggu

SEQ ID NO: 2311708 - RNA, 16 nt, Human
acagagggaagaaaag

SEQ ID NO: 2311709 - RNA, 14 nt, Human
acagaggggguggc

SEQ ID NO: 2311710 - RNA, 15 nt, Human
acagagugagacucu

SEQ ID NO: 2311711 - RNA, 19 nt, Human
acagagugagacucugucu

SEQ ID NO: 2311712 - RNA, 21 nt, Human
acagcaguugaaaagacucca

SEQ ID NO: 2311713 - RNA, 23 nt, Human
acagcaguugaaaagacuccaaa

SEQ ID NO: 2311714 - RNA, 22 nt, Human
acagcaguugaaaagacuccaa

SEQ ID NO: 2311715 - RNA, 19 nt, Human
acagccaacuauggccugu

SEQ ID NO: 2311716 - RNA, 11 nt, Human
acagccacaca

SEQ ID NO: 2311717 - RNA, 10 nt, Human
acagccacac

SEQ ID NO: 2311718 - RNA, 19 nt, Human
acagccacacacacagaaa

SEQ ID NO: 2311719 - RNA, 18 nt, Human
acagccacacacacagaa

SEQ ID NO: 2311720 - RNA, 17 nt, Human
acagccacacacacaga

SEQ ID NO: 2311721 - RNA, 16 nt, Human
acagccacacacacag

SEQ ID NO: 2311722 - RNA, 15 nt, Human
acagccacacacaca

SEQ ID NO: 2311723 - RNA, 14 nt, Human
acagccacacacac

SEQ ID NO: 2311724 - RNA, 13 nt, Human
acagccacacaca

SEQ ID NO: 2311725 - RNA, 12 nt, Human
acagccacacac

SEQ ID NO: 2311726 - RNA, 17 nt, Human
acagccaacuauggccu

SEQ ID NO: 2311727 - RNA, 24 nt, Human
acagccaacacgcaccugccucag

SEQ ID NO: 2311728 - RNA, 13 nt, Human
acagccaacaggu

SEQ ID NO: 2311729 - RNA, 23 nt, Human
acagccaacagguggcaggacca

SEQ ID NO: 2311730 - RNA, 15 nt, Human
acagcauaacaaggu

SEQ ID NO: 2311731 - RNA, 13 nt, Human
acagcaucagggu

SEQ ID NO: 2311732 - RNA, 22 nt, Human
acagccaacacgcaccugccuc

SEQ ID NO: 2311733 - RNA, 21 nt, Human
acagccaacacgcaccugccu

SEQ ID NO: 2311734 - RNA, 20 nt, Human
acagccaacacgcaccugcc

SEQ ID NO: 2311735 - RNA, 22 nt, Human
acagcauaacaagguccaagau

SEQ ID NO: 2311736 - RNA, 23 nt, Human
acagaaucauaugauucugcuuu

SEQ ID NO: 2311737 - RNA, 15 nt, Human
acacuguacugcaau

SEQ ID NO: 2311738 - RNA, 21 nt, Human
acacugguauuccugccucca

SEQ ID NO: 2311739 - RNA, 14 nt, Human
acacuggugacugc

SEQ ID NO: 2311740 - RNA, 16 nt, Human
acacuggugugaccug

SEQ ID NO: 2311741 - RNA, 20 nt, Human
acacuggugugaccugaggg

SEQ ID NO: 2311742 - RNA, 21 nt, Human
acacuggugugaccugagggc

SEQ ID NO: 2311743 - RNA, 15 nt, Human
acagaauucugcuac

SEQ ID NO: 2311744 - RNA, 17 nt, Human
acagaauucugcuaccu

SEQ ID NO: 2311745 - RNA, 20 nt, Human
acagaauguuuuacugugaa

SEQ ID NO: 2311746 - RNA, 18 nt, Human
acagaauugugucugcag

SEQ ID NO: 2311747 - RNA, 20 nt, Human
acagacaaaaacagccucac

SEQ ID NO: 2311748 - RNA, 19 nt, Human
acagacaaaaacagccuca

SEQ ID NO: 2311749 - RNA, 18 nt, Human
acagacaaaaacagccuc

SEQ ID NO: 2311750 - RNA, 21 nt, Human
acagaauguuuuacugugaaa

SEQ ID NO: 2311751 - RNA, 13 nt, Human
acagacaaagcgu

SEQ ID NO: 2311752 - RNA, 11 nt, Human
acagacacagg

SEQ ID NO: 2311753 - RNA, 15 nt, Human
acagacacaggcccg

SEQ ID NO: 2311754 - RNA, 16 nt, Human
acagaggccccagccu

SEQ ID NO: 2311755 - RNA, 15 nt, Human
acagaggccccagcc

SEQ ID NO: 2311756 - RNA, 22 nt, Human
acagaggccccagccucccuga

SEQ ID NO: 2311757 - RNA, 12 nt, Human
acagaggccugc

SEQ ID NO: 2311758 - RNA, 18 nt, Human
acagaggccccagccucc

SEQ ID NO: 2311759 - RNA, 17 nt, Human
acagaggccccagccuc

SEQ ID NO: 2311760 - RNA, 19 nt, Human
acagaggcagccccauucu

SEQ ID NO: 2311761 - RNA, 23 nt, Human
acagaggcagccccauucugccu

SEQ ID NO: 2311762 - RNA, 13 nt, Human
acagacacaggcc

SEQ ID NO: 2311763 - RNA, 14 nt, Human
acagacacaggccc

SEQ ID NO: 2311764 - RNA, 14 nt, Human
acagaggcagcccc

SEQ ID NO: 2311765 - RNA, 15 nt, Human
acagaggcagcccca

SEQ ID NO: 2311766 - RNA, 19 nt, Human
acacugcuuguguuuuuaa

SEQ ID NO: 2311767 - RNA, 21 nt, Human
acacugcaggcaucacagcua

SEQ ID NO: 2311768 - RNA, 16 nt, Human
acacuggacuccggcc

SEQ ID NO: 2311769 - RNA, 23 nt, Human
acacugcuuguguuuuuaacuca

SEQ ID NO: 2311770 - RNA, 16 nt, Human
acacugcaggcaucac

SEQ ID NO: 2311771 - RNA, 20 nt, Human
acacugcaggcaucacagcu

SEQ ID NO: 2311772 - RNA, 15 nt, Human
acacugcauguuugu

SEQ ID NO: 2311773 - RNA, 14 nt, Human
acacugcauguuug

SEQ ID NO: 2311774 - RNA, 21 nt, Human
acacuggcucauauuccugca

SEQ ID NO: 2311775 - RNA, 14 nt, Human
acacuggcugccag

SEQ ID NO: 2311776 - RNA, 16 nt, Human
acacuggccccuagaa

SEQ ID NO: 2311777 - RNA, 21 nt, Human
acacuggggugccgccugccc

SEQ ID NO: 2311778 - RNA, 22 nt, Human
acacuggcugccagcuauuuuu

SEQ ID NO: 2311779 - RNA, 16 nt, Human
acacuggcugccagcu

SEQ ID NO: 2311780 - RNA, 21 nt, Human
acacuggcugccagcuauuuu

SEQ ID NO: 2311781 - RNA, 17 nt, Human
acacugggugcccaagc

SEQ ID NO: 2311782 - RNA, 18 nt, Human
acacugguauuccugccu

SEQ ID NO: 2311783 - RNA, 19 nt, Human
acacugguauuccugccuc

SEQ ID NO: 2311784 - RNA, 13 nt, Human
acacuggccccua

SEQ ID NO: 2311785 - RNA, 12 nt, Human
acacuggccccu

SEQ ID NO: 2311786 - RNA, 13 nt, Human
acacuggccccuc

SEQ ID NO: 2311787 - RNA, 14 nt, Human
acacuggccccuca

SEQ ID NO: 2311788 - RNA, 22 nt, Human
acacuggcguagaaguuuuugu

SEQ ID NO: 2311789 - RNA, 22 nt, Human
acacuggaggagagaagaauga

SEQ ID NO: 2311790 - RNA, 18 nt, Human
acacuggaggagagaaga

SEQ ID NO: 2311791 - RNA, 19 nt, Human
acacuggaggagagaagaa

SEQ ID NO: 2311792 - RNA, 20 nt, Human
acacuggaggagagaagaau

SEQ ID NO: 2311793 - RNA, 21 nt, Human
acacuggaggagagaagaaug

SEQ ID NO: 2311794 - RNA, 18 nt, Human
acacugcaagagccuugg

SEQ ID NO: 2311795 - RNA, 22 nt, Human
acacugcacucuuaagcuuccg

SEQ ID NO: 2311796 - RNA, 19 nt, Human
acaggaugggggcuggccu

SEQ ID NO: 2311797 - RNA, 18 nt, Human
acaggaugaccuggauaa

SEQ ID NO: 2311798 - RNA, 21 nt, Human
acaggauccuauucucaccag

SEQ ID NO: 2311799 - RNA, 22 nt, Human
acaggauccuauucucaccagg

SEQ ID NO: 2311800 - RNA, 14 nt, Human
acaggaugaaggca

SEQ ID NO: 2311801 - RNA, 14 nt, Human
acaggauuauugga

SEQ ID NO: 2311802 - RNA, 20 nt, Human
acagcucuguguugccaugu

SEQ ID NO: 2311803 - RNA, 21 nt, Human
acaggaugaugacuauggaaa

SEQ ID NO: 2311804 - RNA, 18 nt, Human
acaggcaaugcuggcugu

SEQ ID NO: 2311805 - RNA, 12 nt, Human
acaggcaagcac

SEQ ID NO: 2311806 - RNA, 20 nt, Human
acaggauuugaacucagauc

SEQ ID NO: 2311807 - RNA, 19 nt, Human
acaggcaaaauccuugcuu

SEQ ID NO: 2311808 - RNA, 19 nt, Human
acaggcaacugaggcagac

SEQ ID NO: 2311809 - RNA, 18 nt, Human
acaggcaacugaggcaga

SEQ ID NO: 2311810 - RNA, 16 nt, Human
acaggcaacugaggca

SEQ ID NO: 2311811 - RNA, 14 nt, Human
acaggcaaaugcau

SEQ ID NO: 2311812 - RNA, 16 nt, Human
acagcucuucuccagg

SEQ ID NO: 2311813 - RNA, 17 nt, Human
acagcucuucuccaggc

SEQ ID NO: 2311814 - RNA, 15 nt, Human
acaggaucagucuga

SEQ ID NO: 2311815 - RNA, 19 nt, Human
acagcucuguguugccaug

SEQ ID NO: 2311816 - RNA, 17 nt, Human
acagcucuguguugcca

SEQ ID NO: 2311817 - RNA, 18 nt, Human
acagcucuucuccaggcu

SEQ ID NO: 2311818 - RNA, 18 nt, Human
acagccacggccaggcca

SEQ ID NO: 2311819 - RNA, 15 nt, Human
acagccacggccagg

SEQ ID NO: 2311820 - RNA, 23 nt, Human
acagccacacacacagaaaauau

SEQ ID NO: 2311821 - RNA, 22 nt, Human
acagccacacacacagaaaaua

SEQ ID NO: 2311822 - RNA, 21 nt, Human
acagccacacacacagaaaau

SEQ ID NO: 2311823 - RNA, 20 nt, Human
acagccacacacacagaaaa

SEQ ID NO: 2311824 - RNA, 16 nt, Human
acagccacggccaggc

SEQ ID NO: 2311825 - RNA, 17 nt, Human
acagccacggccaggcc

SEQ ID NO: 2311826 - RNA, 16 nt, Human
acaacuaggcuucagc

SEQ ID NO: 2311827 - RNA, 16 nt, Human
acaagaaaaaaugaau

SEQ ID NO: 2311828 - RNA, 14 nt, Human
acaacgaggaagcc

SEQ ID NO: 2311829 - RNA, 17 nt, Human
acaaggauugcuacugu

SEQ ID NO: 2311830 - RNA, 15 nt, Human
acaagaaaucccugu

SEQ ID NO: 2311831 - RNA, 16 nt, Human
acaagaaaucccuguu

SEQ ID NO: 2311832 - RNA, 13 nt, Human
acaagaaaugaaa

SEQ ID NO: 2311833 - RNA, 12 nt, Human
acaaggcaaggc

SEQ ID NO: 2311834 - RNA, 14 nt, Human
acaaggcaaggcug

SEQ ID NO: 2311835 - RNA, 15 nt, Human
acaacgaggaagccc

SEQ ID NO: 2311836 - RNA, 18 nt, Human
acaaccuucuguggcuca

SEQ ID NO: 2311837 - RNA, 16 nt, Human
acaaacaaaauuucua

SEQ ID NO: 2311838 - RNA, 18 nt, Human
acaaacaaaauuucuauu

SEQ ID NO: 2311839 - RNA, 19 nt, Human
acaaacaaaauuucuauua

SEQ ID NO: 2311840 - RNA, 15 nt, Human
acaacgugcauugug

SEQ ID NO: 2311841 - RNA, 16 nt, Human
acaacgugcauugugc

SEQ ID NO: 2311842 - RNA, 17 nt, Human
acaacgugcauugugcu

SEQ ID NO: 2311843 - RNA, 18 nt, Human
acaacgugcauugugcuu

SEQ ID NO: 2311844 - RNA, 13 nt, Human
acaacgugcauug

SEQ ID NO: 2311845 - RNA, 14 nt, Human
acaacgugcauugu

SEQ ID NO: 2311846 - RNA, 22 nt, Human
acaaaauguaggguuauaauaa

SEQ ID NO: 2311847 - RNA, 20 nt, Human
acaaaauuuaguuuuuguuc

SEQ ID NO: 2311848 - RNA, 15 nt, Human
acaaaauuuaguuuu

SEQ ID NO: 2311849 - RNA, 14 nt, Human
acaaaauuucuauu

SEQ ID NO: 2311850 - RNA, 20 nt, Human
acaaaauucgaccugauuua

SEQ ID NO: 2311851 - RNA, 20 nt, Human
acaaggcugaccaagagaga

SEQ ID NO: 2311852 - RNA, 18 nt, Human
acaaggcugaccaagaga

SEQ ID NO: 2311853 - RNA, 13 nt, Human
acaaggcugacca

SEQ ID NO: 2311854 - RNA, 17 nt, Human
acaaggcuagaucauga

SEQ ID NO: 2311855 - RNA, 18 nt, Human
acaaggccccagagacuc

SEQ ID NO: 2311856 - RNA, 17 nt, Human
acaaggccccagagacu

SEQ ID NO: 2311857 - RNA, 16 nt, Human
acaaggccccagagac

SEQ ID NO: 2311858 - RNA, 15 nt, Human
acaaggccccagaga

SEQ ID NO: 2311859 - RNA, 23 nt, Human
acaaggcauucaaguguacagug

SEQ ID NO: 2311860 - RNA, 17 nt, Human
acaaggcauucaagugu

SEQ ID NO: 2311861 - RNA, 13 nt, Human
acaaggccccaga

SEQ ID NO: 2311862 - RNA, 11 nt, Human
acaaggcccca

SEQ ID NO: 2311863 - RNA, 18 nt, Human
acaaggccaucugggcuc

SEQ ID NO: 2311864 - RNA, 20 nt, Human
acaaggcaaggcugucaauu

SEQ ID NO: 2311865 - RNA, 21 nt, Human
acaagaaaucccuguuuaaua

SEQ ID NO: 2311866 - RNA, 23 nt, Human
acaagaaaucccuguuuaauauu

SEQ ID NO: 2311867 - RNA, 15 nt, Human
acaaggcaaggcugu

SEQ ID NO: 2311868 - RNA, 22 nt, Human
acaaggcugaccaagagagaaa

SEQ ID NO: 2311869 - RNA, 15 nt, Human
acaaggcuguugcau

SEQ ID NO: 2311870 - RNA, 22 nt, Human
aauuuucuucaugcaaugacau

SEQ ID NO: 2311871 - RNA, 19 nt, Human
aauuuucuucaugcaauga

SEQ ID NO: 2311872 - RNA, 20 nt, Human
aauuuugguuguauucuuug

SEQ ID NO: 2311873 - RNA, 22 nt, Human
aauuuugguuguauucuuugau

SEQ ID NO: 2311874 - RNA, 23 nt, Human
aauuuugguuguauucuuugaug

SEQ ID NO: 2311875 - RNA, 13 nt, Human
aauuuuguacaaa

SEQ ID NO: 2311876 - RNA, 15 nt, Human
aauuuuguaacgaag

SEQ ID NO: 2311877 - RNA, 14 nt, Human
aauuuuguacaaau

SEQ ID NO: 2311878 - RNA, 16 nt, Human
aauuuuguaugaaaaa

SEQ ID NO: 2311879 - RNA, 12 nt, Human
aauuuuguauuu

SEQ ID NO: 2311880 - RNA, 13 nt, Human
aauuuuguauuuu

SEQ ID NO: 2311881 - RNA, 21 nt, Human
aauuuuguauuuuccaagugu

SEQ ID NO: 2311882 - RNA, 23 nt, Human
aauuuuguauuuuccaagugugc

SEQ ID NO: 2311883 - RNA, 14 nt, Human
aauuuuguauuuuc

SEQ ID NO: 2311884 - RNA, 15 nt, Human
aauuuuguauuuucc

SEQ ID NO: 2311885 - RNA, 16 nt, Human
aauuuuguauuuucca

SEQ ID NO: 2311886 - RNA, 17 nt, Human
aauuuuguauuuuccaa

SEQ ID NO: 2311887 - RNA, 13 nt, Human
aauuuuguugcug

SEQ ID NO: 2311888 - RNA, 19 nt, Human
aauuuuguucuaguuuuca

SEQ ID NO: 2311889 - RNA, 20 nt, Human
aauuuuguucuaguuuucag

SEQ ID NO: 2311890 - RNA, 13 nt, Human
aauuuugugaagc

SEQ ID NO: 2311891 - RNA, 14 nt, Human
aauuuucuucaugc

SEQ ID NO: 2311892 - RNA, 21 nt, Human
aauuuucuguguucugaaguc

SEQ ID NO: 2311893 - RNA, 13 nt, Human
aauuuucuucaug

SEQ ID NO: 2311894 - RNA, 22 nt, Human
aauuuucuggaauacaugaaau

SEQ ID NO: 2311895 - RNA, 18 nt, Human
aauuuucuagacuuucug

SEQ ID NO: 2311896 - RNA, 18 nt, Human
aauuuucucccaggaagc

SEQ ID NO: 2311897 - RNA, 12 nt, Human
aauuuucuagac

SEQ ID NO: 2311898 - RNA, 15 nt, Human
aauuuucuagacuuu

SEQ ID NO: 2311899 - RNA, 17 nt, Human
aauuuucuagacuuucu

SEQ ID NO: 2311900 - RNA, 20 nt, Human
aauuuucuagacuuucuguu

SEQ ID NO: 2311901 - RNA, 16 nt, Human
aauuuuccuugaagcc

SEQ ID NO: 2311902 - RNA, 17 nt, Human
aauuuuccuugaagccg

SEQ ID NO: 2311903 - RNA, 14 nt, Human
aauuuuccuugaag

SEQ ID NO: 2311904 - RNA, 15 nt, Human
aauuuuccuugaagc

SEQ ID NO: 2311905 - RNA, 19 nt, Human
aauuuuccuaauaaaguuc

SEQ ID NO: 2311906 - RNA, 12 nt, Human
acacagaggaag

SEQ ID NO: 2311907 - RNA, 21 nt, Human
acacagaggaagagcaggcac

SEQ ID NO: 2311908 - RNA, 17 nt, Human
acacagaggaagagcag

SEQ ID NO: 2311909 - RNA, 13 nt, Human
acacagaggaaga

SEQ ID NO: 2311910 - RNA, 20 nt, Human
acaauuguaaaacugaggca

SEQ ID NO: 2311911 - RNA, 12 nt, Human
acaauuguaaua

SEQ ID NO: 2311912 - RNA, 12 nt, Human
acaauugaaaug

SEQ ID NO: 2311913 - RNA, 18 nt, Human
acaauucuuuauacaaca

SEQ ID NO: 2311914 - RNA, 19 nt, Human
acaauucuuuauacaacag

SEQ ID NO: 2311915 - RNA, 17 nt, Human
acaauugaacuuaaaua

SEQ ID NO: 2311916 - RNA, 21 nt, Human
acaauucuuuauacaacagug

SEQ ID NO: 2311917 - RNA, 19 nt, Human
acaauugaacuuaaauaaa

SEQ ID NO: 2311918 - RNA, 20 nt, Human
acacagcucuguccugggag

SEQ ID NO: 2311919 - RNA, 14 nt, Human
acacagcucugucc

SEQ ID NO: 2311920 - RNA, 17 nt, Human
acacagauuugagcuca

SEQ ID NO: 2311921 - RNA, 23 nt, Human
acacagaguggucuuucuggaga

SEQ ID NO: 2311922 - RNA, 21 nt, Human
acacagaguggucuuucugga

SEQ ID NO: 2311923 - RNA, 19 nt, Human
acacagaguggucuuucug

SEQ ID NO: 2311924 - RNA, 14 nt, Human
acacagaugaaaca

SEQ ID NO: 2311925 - RNA, 21 nt, Human
acacagaugaaacacaaacaa

SEQ ID NO: 2311926 - RNA, 19 nt, Human
acacagaggcugccucucc

SEQ ID NO: 2311927 - RNA, 14 nt, Human
acacauuuuucaga

SEQ ID NO: 2311928 - RNA, 13 nt, Human
acacauuuuguau

SEQ ID NO: 2311929 - RNA, 14 nt, Human
acacauuuuguaua

SEQ ID NO: 2311930 - RNA, 15 nt, Human
acacauuuuguauaa

SEQ ID NO: 2311931 - RNA, 16 nt, Human
acacauuuuguauaau

SEQ ID NO: 2311932 - RNA, 12 nt, Human
acacauuuuucu

SEQ ID NO: 2311933 - RNA, 22 nt, Human
acacauuuuuuaaaugcaccug

SEQ ID NO: 2311934 - RNA, 20 nt, Human
acacauuuuuuaaaugcacc

SEQ ID NO: 2311935 - RNA, 14 nt, Human
acacagcagcaguu

SEQ ID NO: 2311936 - RNA, 16 nt, Human
acacagaugaaacaca

SEQ ID NO: 2311937 - RNA, 12 nt, Human
acacauuuugua

SEQ ID NO: 2311938 - RNA, 21 nt, Human
acacauuuuauuuuauuaugc

SEQ ID NO: 2311939 - RNA, 22 nt, Human
acacauuuuauuuuauuaugca

SEQ ID NO: 2311940 - RNA, 11 nt, Human
acacagcucuu

SEQ ID NO: 2311941 - RNA, 13 nt, Human
acacagcucuucu

SEQ ID NO: 2311942 - RNA, 23 nt, Human
acacgcacacacacacacaggag

SEQ ID NO: 2311943 - RNA, 20 nt, Human
acacgcacacacacacacag

SEQ ID NO: 2311944 - RNA, 14 nt, Human
acacgcacacacac

SEQ ID NO: 2311945 - RNA, 13 nt, Human
acacgcacacaca

SEQ ID NO: 2311946 - RNA, 22 nt, Human
acacgagguaugaggucuagga

SEQ ID NO: 2311947 - RNA, 21 nt, Human
acacgagcaggcuacugucag

SEQ ID NO: 2311948 - RNA, 15 nt, Human
acacgcgugcacaca

SEQ ID NO: 2311949 - RNA, 17 nt, Human
acacgcgugcacacacc

SEQ ID NO: 2311950 - RNA, 14 nt, Human
acaccaaauaaaua

SEQ ID NO: 2311951 - RNA, 21 nt, Human
acacauuuuguauaauuguau

SEQ ID NO: 2311952 - RNA, 19 nt, Human
acacgagcaggcuacuguc

SEQ ID NO: 2311953 - RNA, 14 nt, Human
acacgagcaggcua

SEQ ID NO: 2311954 - RNA, 14 nt, Human
acacgcuccucccu

SEQ ID NO: 2311955 - RNA, 14 nt, Human
acacgcuccuuccu

SEQ ID NO: 2311956 - RNA, 16 nt, Human
acacgcuccuuccucu

SEQ ID NO: 2311957 - RNA, 22 nt, Human
acaauucuguuuuagguuaaaa

SEQ ID NO: 2311958 - RNA, 13 nt, Human
acaauucuuuaua

SEQ ID NO: 2311959 - RNA, 14 nt, Human
acaauucuuuauac

SEQ ID NO: 2311960 - RNA, 15 nt, Human
acaauucuuuauaca

SEQ ID NO: 2311961 - RNA, 16 nt, Human
acaauucuuuauacaa

SEQ ID NO: 2311962 - RNA, 17 nt, Human
acaauucuuuauacaac

SEQ ID NO: 2311963 - RNA, 20 nt, Human
acuuuauuuauacacugucu

SEQ ID NO: 2311964 - RNA, 15 nt, Human
acuuuaugccggaug

SEQ ID NO: 2311965 - RNA, 20 nt, Human
acuuuaugccggaugugcuu

SEQ ID NO: 2311966 - RNA, 21 nt, Human
acuuuaugccggaugugcuuu

SEQ ID NO: 2311967 - RNA, 20 nt, Human
acuuuauuaaauacaaaacu

SEQ ID NO: 2311968 - RNA, 13 nt, Human
acuuuauugcauc

SEQ ID NO: 2311969 - RNA, 22 nt, Human
acuuuaucuugaauaauguaag

SEQ ID NO: 2311970 - RNA, 23 nt, Human
acuuuaucuaauaccucugugug

SEQ ID NO: 2311971 - RNA, 22 nt, Human
acuuuauuuucuauaauuuaaa

SEQ ID NO: 2311972 - RNA, 16 nt, Human
acuuuguucuggcucu

SEQ ID NO: 2311973 - RNA, 17 nt, Human
acuuuguucuggcucuu

SEQ ID NO: 2311974 - RNA, 13 nt, Human
acuuuuauaaacu

SEQ ID NO: 2311975 - RNA, 12 nt, Human
acuuuuaugaua

SEQ ID NO: 2311976 - RNA, 16 nt, Human
acuuuuaugauacuug

SEQ ID NO: 2311977 - RNA, 13 nt, Human
acuuuauuuucug

SEQ ID NO: 2311978 - RNA, 20 nt, Human
acuuuguucuggcucuucca

SEQ ID NO: 2311979 - RNA, 19 nt, Human
acuuuguucuggcucuucc

SEQ ID NO: 2311980 - RNA, 24 nt, Human
acuuuauuuucugguagauagaaa

SEQ ID NO: 2311981 - RNA, 17 nt, Human
acuuuuaauaaacuuuu

SEQ ID NO: 2311982 - RNA, 14 nt, Human
acuuuuaaggcagu

SEQ ID NO: 2311983 - RNA, 20 nt, Human
acuuuuaaacuguguacaua

SEQ ID NO: 2311984 - RNA, 12 nt, Human
acuuuucaguga

SEQ ID NO: 2311985 - RNA, 17 nt, Human
acuuuuccauguaucua

SEQ ID NO: 2311986 - RNA, 16 nt, Human
acuuuucuuucagcca

SEQ ID NO: 2311987 - RNA, 20 nt, Human
acuuuuccguuucagcggaa

SEQ ID NO: 2311988 - RNA, 17 nt, Human
acuuuuccccuguccug

SEQ ID NO: 2311989 - RNA, 17 nt, Human
acuuuuccauucccaau

SEQ ID NO: 2311990 - RNA, 21 nt, Human
acuuuuccauguaucuaccuc

SEQ ID NO: 2311991 - RNA, 22 nt, Human
acuuuuccauguaucuaccuca

SEQ ID NO: 2311992 - RNA, 20 nt, Human
acuuuucauaaccuagccuu

SEQ ID NO: 2311993 - RNA, 19 nt, Human
acuuuuaugauguauauuu

SEQ ID NO: 2311994 - RNA, 20 nt, Human
acuuuuaugauguauauuua

SEQ ID NO: 2311995 - RNA, 23 nt, Human
acuuuuauuuccagugaaaucag

SEQ ID NO: 2311996 - RNA, 23 nt, Human
acuuuuaugauacuugaaaauua

SEQ ID NO: 2311997 - RNA, 17 nt, Human
agaaaauaaucauucuu

SEQ ID NO: 2311998 - RNA, 14 nt, Human
agaaaauaacaaua

SEQ ID NO: 2311999 - RNA, 12 nt, Human
acuuuugacaaa

SEQ ID NO: 2312000 - RNA, 15 nt, Human
acuuuugcccuuuga

SEQ ID NO: 2312001 - RNA, 14 nt, Human
acuuuucuuugugg

SEQ ID NO: 2312002 - RNA, 10 nt, Human
agaaaauaua

SEQ ID NO: 2312003 - RNA, 16 nt, Human
agaaaauauuuugucu

SEQ ID NO: 2312004 - RNA, 18 nt, Human
agaaaauauuuugucuaa

SEQ ID NO: 2312005 - RNA, 16 nt, Human
agaaaaucaggcuggc

SEQ ID NO: 2312006 - RNA, 19 nt, Human
agaaaauaguggugugauu

SEQ ID NO: 2312007 - RNA, 15 nt, Human
agaaaauaccaagga

SEQ ID NO: 2312008 - RNA, 21 nt, Human
acuuuaucacauuauuugcau

SEQ ID NO: 2312009 - RNA, 14 nt, Human
acuuuaucacauua

SEQ ID NO: 2312010 - RNA, 13 nt, Human
acuuuaucacauu

SEQ ID NO: 2312011 - RNA, 19 nt, Human
agaaaaucauauugcuucu

SEQ ID NO: 2312012 - RNA, 13 nt, Human
agaaaaucacuua

SEQ ID NO: 2312013 - RNA, 19 nt, Human
agaaaauauuuugucuaaa

SEQ ID NO: 2312014 - RNA, 20 nt, Human
agaaaauauuuugucuaaaa

SEQ ID NO: 2312015 - RNA, 21 nt, Human
agaaaauauuuugucuaaaau

SEQ ID NO: 2312016 - RNA, 22 nt, Human
agaaaauauuuugucuaaaaug

SEQ ID NO: 2312017 - RNA, 16 nt, Human
agaaaggauaaaguug

SEQ ID NO: 2312018 - RNA, 14 nt, Human
agaaaggccuuuaa

SEQ ID NO: 2312019 - RNA, 15 nt, Human
agaaaggccuuuaaa

SEQ ID NO: 2312020 - RNA, 16 nt, Human
agaaaggccuuuaaaa

SEQ ID NO: 2312021 - RNA, 17 nt, Human
agaaaggccuuuaaaau

SEQ ID NO: 2312022 - RNA, 19 nt, Human
agaaaggccuuuaaaauuu

SEQ ID NO: 2312023 - RNA, 17 nt, Human
agaaaggggagcccacu

SEQ ID NO: 2312024 - RNA, 16 nt, Human
agaaaggggagcccac

SEQ ID NO: 2312025 - RNA, 15 nt, Human
agaaaggggagccca

SEQ ID NO: 2312026 - RNA, 14 nt, Human
agaaaggggagccc

SEQ ID NO: 2312027 - RNA, 20 nt, Human
agaaagggcaacaauaaaau

SEQ ID NO: 2312028 - RNA, 14 nt, Human
agaaaggguguuuu

SEQ ID NO: 2312029 - RNA, 17 nt, Human
agaaaggguguuuuucu

SEQ ID NO: 2312030 - RNA, 22 nt, Human
agaaaggugaguuugagcugcc

SEQ ID NO: 2312031 - RNA, 23 nt, Human
agaaaggugaguuugagcugccu

SEQ ID NO: 2312032 - RNA, 22 nt, Human
agaaaguacuucuccacccugc

SEQ ID NO: 2312033 - RNA, 20 nt, Human
agaaagucgaauuaauagcu

SEQ ID NO: 2312034 - RNA, 20 nt, Human
agaaagguggacuggaaggg

SEQ ID NO: 2312035 - RNA, 16 nt, Human
agaaagguucugcccg

SEQ ID NO: 2312036 - RNA, 23 nt, Human
agaaaguacuucuccacccugcu

SEQ ID NO: 2312037 - RNA, 15 nt, Human
agaaagugaagcaaa

SEQ ID NO: 2312038 - RNA, 22 nt, Human
agaaagucuuauuuauucauau

SEQ ID NO: 2312039 - RNA, 19 nt, Human
agaaagucuuauuuauuca

SEQ ID NO: 2312040 - RNA, 21 nt, Human
agaaagucgaauuaauagcuu

SEQ ID NO: 2312041 - RNA, 23 nt, Human
agaaagugaagcaaaucagaaac

SEQ ID NO: 2312042 - RNA, 15 nt, Human
agaaagugauuucua

SEQ ID NO: 2312043 - RNA, 21 nt, Human
agaaaguggccaugccacccu

SEQ ID NO: 2312044 - RNA, 23 nt, Human
agaaaguggaaaacaaggaaguc

SEQ ID NO: 2312045 - RNA, 20 nt, Human
agaaaguggaaaacaaggaa

SEQ ID NO: 2312046 - RNA, 19 nt, Human
agaaaguggaaaacaagga

SEQ ID NO: 2312047 - RNA, 16 nt, Human
agaaagugugagcaaa

SEQ ID NO: 2312048 - RNA, 20 nt, Human
agaaagugggugagaugcug

SEQ ID NO: 2312049 - RNA, 21 nt, Human
agaaagugggugagaugcugg

SEQ ID NO: 2312050 - RNA, 14 nt, Human
agaaaguggugcuc

SEQ ID NO: 2312051 - RNA, 17 nt, Human
agaaaguggugcucagu

SEQ ID NO: 2312052 - RNA, 23 nt, Human
agaaagugugagcaaacuaacuu

SEQ ID NO: 2312053 - RNA, 17 nt, Human
agaaagugugagcaaac

SEQ ID NO: 2312054 - RNA, 22 nt, Human
agaaagugugcuuuaugcugaa

SEQ ID NO: 2312055 - RNA, 16 nt, Human
agaaagugugcuuuau

SEQ ID NO: 2312056 - RNA, 15 nt, Human
agaaagugugcuuua

SEQ ID NO: 2312057 - RNA, 21 nt, Human
agaaaguggugcucaguugua

SEQ ID NO: 2312058 - RNA, 23 nt, Human
agaaagugugcuuuaugcugaaa

SEQ ID NO: 2312059 - RNA, 17 nt, Human
agaaaguugcacggcug

SEQ ID NO: 2312060 - RNA, 19 nt, Human
agaaaguugcacggcugcu

SEQ ID NO: 2312061 - RNA, 20 nt, Human
agaaaguugcacggcugcug

SEQ ID NO: 2312062 - RNA, 21 nt, Human
agaaaguugcacggcugcuga

SEQ ID NO: 2312063 - RNA, 15 nt, Human
agaaauaaaacuguu

SEQ ID NO: 2312064 - RNA, 14 nt, Human
agaaauaaaacugu

SEQ ID NO: 2312065 - RNA, 17 nt, Human
agaaauaaaaggaagcc

SEQ ID NO: 2312066 - RNA, 18 nt, Human
agaaauaaauagcuauau

SEQ ID NO: 2312067 - RNA, 15 nt, Human
agaaauaaauagcua

SEQ ID NO: 2312068 - RNA, 21 nt, Human
agaaauaaaguuugcuuagaa

SEQ ID NO: 2312069 - RNA, 22 nt, Human
agaaauaaauagcuauauccau

SEQ ID NO: 2312070 - RNA, 19 nt, Human
agaaauaaauagcuauauc

SEQ ID NO: 2312071 - RNA, 15 nt, Human
agaaauaauaugcau

SEQ ID NO: 2312072 - RNA, 16 nt, Human
agaaauaauaugcauu

SEQ ID NO: 2312073 - RNA, 14 nt, Human
agaaauaauaugca

SEQ ID NO: 2312074 - RNA, 22 nt, Human
agaaauaagugguuauuucuca

SEQ ID NO: 2312075 - RNA, 17 nt, Human
agaaauaagugguuauu

SEQ ID NO: 2312076 - RNA, 21 nt, Human
agaaauaagugguuauuucuc

SEQ ID NO: 2312077 - RNA, 18 nt, Human
acucugucucaguccaug

SEQ ID NO: 2312078 - RNA, 20 nt, Human
acucugucucaguccaugaa

SEQ ID NO: 2312079 - RNA, 22 nt, Human
acucugucuucaccugauucaa

SEQ ID NO: 2312080 - RNA, 15 nt, Human
acucugucuuguguu

SEQ ID NO: 2312081 - RNA, 18 nt, Human
acucugucuucaccugau

SEQ ID NO: 2312082 - RNA, 17 nt, Human
acucugucuucaccuga

SEQ ID NO: 2312083 - RNA, 16 nt, Human
acucugucuucaccug

SEQ ID NO: 2312084 - RNA, 13 nt, Human
acugccagcaacg

SEQ ID NO: 2312085 - RNA, 15 nt, Human
acugccagaugcuga

SEQ ID NO: 2312086 - RNA, 17 nt, Human
acugccagaugcugaug

SEQ ID NO: 2312087 - RNA, 19 nt, Human
acugccagaugcugauguu

SEQ ID NO: 2312088 - RNA, 22 nt, Human
acugccagaugcugauguucag

SEQ ID NO: 2312089 - RNA, 23 nt, Human
acugccagaugcugauguucagu

SEQ ID NO: 2312090 - RNA, 15 nt, Human
acugguaggaccaag

SEQ ID NO: 2312091 - RNA, 14 nt, Human
acuggagcccagga

SEQ ID NO: 2312092 - RNA, 13 nt, Human
acuggagcccagg

SEQ ID NO: 2312093 - RNA, 18 nt, Human
acugguaggaaacuaggu

SEQ ID NO: 2312094 - RNA, 14 nt, Human
acugguccugugug

SEQ ID NO: 2312095 - RNA, 15 nt, Human
acugguccugugugc

SEQ ID NO: 2312096 - RNA, 20 nt, Human
acugguccugugugcaguga

SEQ ID NO: 2312097 - RNA, 15 nt, Human
acuggucuguaggga

SEQ ID NO: 2312098 - RNA, 14 nt, Human
acugguauuuuauc

SEQ ID NO: 2312099 - RNA, 18 nt, Human
acugguauuccugccucc

SEQ ID NO: 2312100 - RNA, 22 nt, Human
acugguccaaaagauugcugaa

SEQ ID NO: 2312101 - RNA, 21 nt, Human
acugguccaaaagauugcuga

SEQ ID NO: 2312102 - RNA, 18 nt, Human
acuggagcaucugacuca

SEQ ID NO: 2312103 - RNA, 12 nt, Human
acuggagcccag

SEQ ID NO: 2312104 - RNA, 19 nt, Human
acuggagcaccaggcacga

SEQ ID NO: 2312105 - RNA, 14 nt, Human
acuggagcaucuga

SEQ ID NO: 2312106 - RNA, 16 nt, Human
acuggagcaucugacu

SEQ ID NO: 2312107 - RNA, 17 nt, Human
acuggagcaucugacuc

SEQ ID NO: 2312108 - RNA, 16 nt, Human
acuggagcaccaggca

SEQ ID NO: 2312109 - RNA, 15 nt, Human
acuggagcaccaggc

SEQ ID NO: 2312110 - RNA, 13 nt, Human
acuggagcaucug

SEQ ID NO: 2312111 - RNA, 13 nt, Human
acuggagcaccag

SEQ ID NO: 2312112 - RNA, 17 nt, Human
acuggagaggcuagaac

SEQ ID NO: 2312113 - RNA, 17 nt, Human
acuggagaagucuuaga

SEQ ID NO: 2312114 - RNA, 21 nt, Human
acuggaagcauguaggagaau

SEQ ID NO: 2312115 - RNA, 19 nt, Human
acuggaagcuaauuugcau

SEQ ID NO: 2312116 - RNA, 15 nt, Human
acuggagaaaaugga

SEQ ID NO: 2312117 - RNA, 17 nt, Human
acugccccaacuccugg

SEQ ID NO: 2312118 - RNA, 15 nt, Human
acugccccaacuccu

SEQ ID NO: 2312119 - RNA, 21 nt, Human
acugcccauggacaggcuggc

SEQ ID NO: 2312120 - RNA, 21 nt, Human
acugccccaacuccuggaagc

SEQ ID NO: 2312121 - RNA, 18 nt, Human
acugccccaacuccugga

SEQ ID NO: 2312122 - RNA, 15 nt, Human
acugcccccucugcc

SEQ ID NO: 2312123 - RNA, 14 nt, Human
acugcccccucugc

SEQ ID NO: 2312124 - RNA, 19 nt, Human
acugcccauggacaggcug

SEQ ID NO: 2312125 - RNA, 17 nt, Human
acugccaggccagccuc

SEQ ID NO: 2312126 - RNA, 15 nt, Human
acugccaggccagcc

SEQ ID NO: 2312127 - RNA, 16 nt, Human
acugccaggccagccu

SEQ ID NO: 2312128 - RNA, 20 nt, Human
acuggaagcauguaggagaa

SEQ ID NO: 2312129 - RNA, 19 nt, Human
acuggaagcauguaggaga

SEQ ID NO: 2312130 - RNA, 16 nt, Human
acuggaagcuaauuug

SEQ ID NO: 2312131 - RNA, 19 nt, Human
acuggaagcacagcuucau

SEQ ID NO: 2312132 - RNA, 17 nt, Human
acuggaagcacagcuuc

SEQ ID NO: 2312133 - RNA, 17 nt, Human
acugcccccucugcccu

SEQ ID NO: 2312134 - RNA, 16 nt, Human
acugcccccucugccc

SEQ ID NO: 2312135 - RNA, 20 nt, Human
acugguuguugccaaacagc

SEQ ID NO: 2312136 - RNA, 20 nt, Human
acugguuuauccacccacaa

SEQ ID NO: 2312137 - RNA, 18 nt, Human
acugguuccauggccucu

SEQ ID NO: 2312138 - RNA, 22 nt, Human
acugguuuguugcagccaaaga

SEQ ID NO: 2312139 - RNA, 19 nt, Human
acugucucaagagggcacu

SEQ ID NO: 2312140 - RNA, 22 nt, Human
acuguaagaaaauaucacuugu

SEQ ID NO: 2312141 - RNA, 19 nt, Human
acuguaagaaaauaucacu

SEQ ID NO: 2312142 - RNA, 13 nt, Human
acuguaagaaaau

SEQ ID NO: 2312143 - RNA, 20 nt, Human
acugucucaagagggcacug

SEQ ID NO: 2312144 - RNA, 21 nt, Human
acugucucaagagggcacugg

SEQ ID NO: 2312145 - RNA, 18 nt, Human
acugucucaguuucacuu

SEQ ID NO: 2312146 - RNA, 12 nt, Human
acugucucacug

SEQ ID NO: 2312147 - RNA, 22 nt, Human
acugguuuauccacccacaaca

SEQ ID NO: 2312148 - RNA, 23 nt, Human
acugucucaagagggcacuggug

SEQ ID NO: 2312149 - RNA, 15 nt, Human
acugugaaggacccu

SEQ ID NO: 2312150 - RNA, 18 nt, Human
acugucucucaugaaccu

SEQ ID NO: 2312151 - RNA, 22 nt, Human
acugucuccauggcccugcaaa

SEQ ID NO: 2312152 - RNA, 21 nt, Human
acugucucgaugcaaugaaca

SEQ ID NO: 2312153 - RNA, 17 nt, Human
acugucucucaugaacc

SEQ ID NO: 2312154 - RNA, 15 nt, Human
acugucucucaugaa

SEQ ID NO: 2312155 - RNA, 12 nt, Human
acugugaccugu

SEQ ID NO: 2312156 - RNA, 23 nt, Human
acugugacucuuuuuagggccag

SEQ ID NO: 2312157 - RNA, 11 nt, Human
acugugacuga

SEQ ID NO: 2312158 - RNA, 21 nt, Human
acugugacccccagcuccggc

SEQ ID NO: 2312159 - RNA, 19 nt, Human
acugugacccccagcuccg

SEQ ID NO: 2312160 - RNA, 11 nt, Human
acugugccuuu

SEQ ID NO: 2312161 - RNA, 23 nt, Human
acugugccuuugaguuuccucag

SEQ ID NO: 2312162 - RNA, 18 nt, Human
acugugacaggcagcaga

SEQ ID NO: 2312163 - RNA, 19 nt, Human
acugugacaggcagcagag

SEQ ID NO: 2312164 - RNA, 14 nt, Human
acugugacaggcag

SEQ ID NO: 2312165 - RNA, 15 nt, Human
acugugacaggcagc

SEQ ID NO: 2312166 - RNA, 16 nt, Human
acugugacaggcagca

SEQ ID NO: 2312167 - RNA, 17 nt, Human
acugugacaggcagcag

SEQ ID NO: 2312168 - RNA, 16 nt, Human
acugugaaggacccuu

SEQ ID NO: 2312169 - RNA, 13 nt, Human
acugugacaggca

SEQ ID NO: 2312170 - RNA, 22 nt, Human
acugugaaguuuacauuguaaa

SEQ ID NO: 2312171 - RNA, 19 nt, Human
acuucacugucaggaagaa

SEQ ID NO: 2312172 - RNA, 21 nt, Human
acuucacugucaggaagaaau

SEQ ID NO: 2312173 - RNA, 23 nt, Human
acuucacugucaggaagaaauca

SEQ ID NO: 2312174 - RNA, 17 nt, Human
acuucacuuuaauucuc

SEQ ID NO: 2312175 - RNA, 19 nt, Human
acuuauuuuuuucugauug

SEQ ID NO: 2312176 - RNA, 21 nt, Human
acuuauuuuuuucugauugua

SEQ ID NO: 2312177 - RNA, 15 nt, Human
acuucaaaaguauuu

SEQ ID NO: 2312178 - RNA, 16 nt, Human
acuucaaaaguauuuu

SEQ ID NO: 2312179 - RNA, 17 nt, Human
acuucaaaaguauuuuc

SEQ ID NO: 2312180 - RNA, 18 nt, Human
acuucaaaaguauuuucc

SEQ ID NO: 2312181 - RNA, 19 nt, Human
acuucaaaaguauuuuccu

SEQ ID NO: 2312182 - RNA, 21 nt, Human
acuucaaaaguauuuuccugu

SEQ ID NO: 2312183 - RNA, 12 nt, Human
acuucagacaua

SEQ ID NO: 2312184 - RNA, 22 nt, Human
acuucugggcuucaucuggcaa

SEQ ID NO: 2312185 - RNA, 19 nt, Human
acuucugggcuucaucugg

SEQ ID NO: 2312186 - RNA, 17 nt, Human
acuucugggcuucaucu

SEQ ID NO: 2312187 - RNA, 15 nt, Human
acuucuggcuccuca

SEQ ID NO: 2312188 - RNA, 16 nt, Human
acuucuggguggggca

SEQ ID NO: 2312189 - RNA, 17 nt, Human
acuucuggguggggcag

SEQ ID NO: 2312190 - RNA, 16 nt, Human
acuucuggcuccucaa

SEQ ID NO: 2312191 - RNA, 21 nt, Human
acuucugucuucacaacagau

SEQ ID NO: 2312192 - RNA, 15 nt, Human
acuuauuuauauaaa

SEQ ID NO: 2312193 - RNA, 11 nt, Human
acuuauuugag

SEQ ID NO: 2312194 - RNA, 21 nt, Human
acuguuugccuucuacuuuua

SEQ ID NO: 2312195 - RNA, 22 nt, Human
acuguuugccuucuacuuuuaa

SEQ ID NO: 2312196 - RNA, 23 nt, Human
acuguuugagguuuuuaagccuu

SEQ ID NO: 2312197 - RNA, 15 nt, Human
acuuauuuucucugu

SEQ ID NO: 2312198 - RNA, 12 nt, Human
acuuauuugagu

SEQ ID NO: 2312199 - RNA, 22 nt, Human
acuuauuugagugauuauuugu

SEQ ID NO: 2312200 - RNA, 16 nt, Human
acuuauuuuugacagu

SEQ ID NO: 2312201 - RNA, 14 nt, Human
acuuauuuuugaca

SEQ ID NO: 2312202 - RNA, 22 nt, Human
acuuauuuuugacaguguugaa

SEQ ID NO: 2312203 - RNA, 19 nt, Human
acuuauuuuugacaguguu

SEQ ID NO: 2312204 - RNA, 15 nt, Human
acuuauuuuuuucug

SEQ ID NO: 2312205 - RNA, 16 nt, Human
acuuauuuuuuucuga

SEQ ID NO: 2312206 - RNA, 17 nt, Human
acuuauuuuuuucugau

SEQ ID NO: 2312207 - RNA, 18 nt, Human
acuuauuuuuuucugauu

SEQ ID NO: 2312208 - RNA, 14 nt, Human
acuguuucucugcu

SEQ ID NO: 2312209 - RNA, 13 nt, Human
acuguuucucugc

SEQ ID NO: 2312210 - RNA, 15 nt, Human
acuguuucucugcug

SEQ ID NO: 2312211 - RNA, 18 nt, Human
acuguuugagguuuuuaa

SEQ ID NO: 2312212 - RNA, 15 nt, Human
acuguuucugucagg

SEQ ID NO: 2312213 - RNA, 16 nt, Human
acuguuucugucagga

SEQ ID NO: 2312214 - RNA, 14 nt, Human
acuguuucugucag

SEQ ID NO: 2312215 - RNA, 18 nt, Human
acuugguuggguccucac

SEQ ID NO: 2312216 - RNA, 22 nt, Human
acuugguguccuuucccuccac

SEQ ID NO: 2312217 - RNA, 21 nt, Human
acuugguguccuuucccucca

SEQ ID NO: 2312218 - RNA, 23 nt, Human
acuuggggaguuaagaccuggca

SEQ ID NO: 2312219 - RNA, 18 nt, Human
acuugggccauagcuccu

SEQ ID NO: 2312220 - RNA, 16 nt, Human
acuugguuuuuaaaaa

SEQ ID NO: 2312221 - RNA, 14 nt, Human
acuugggccacugu

SEQ ID NO: 2312222 - RNA, 16 nt, Human
acuucuugaaggugcu

SEQ ID NO: 2312223 - RNA, 13 nt, Human
acuucuugaaggu

SEQ ID NO: 2312224 - RNA, 15 nt, Human
acuugggccacugug

SEQ ID NO: 2312225 - RNA, 21 nt, Human
acuuggggaguuaagaccugg

SEQ ID NO: 2312226 - RNA, 20 nt, Human
acuuggggagauggaguucu

SEQ ID NO: 2312227 - RNA, 17 nt, Human
acuugggccauagcucc

SEQ ID NO: 2312228 - RNA, 12 nt, Human
acuucuugaagg

SEQ ID NO: 2312229 - RNA, 20 nt, Human
acuucuucagagcugacaca

SEQ ID NO: 2312230 - RNA, 23 nt, Human
acuucuuauggaauugauuugca

SEQ ID NO: 2312231 - RNA, 21 nt, Human
acuucuuauggaauugauuug

SEQ ID NO: 2312232 - RNA, 13 nt, Human
acuucuucagagc

SEQ ID NO: 2312233 - RNA, 16 nt, Human
acuucuucagagcuga

SEQ ID NO: 2312234 - RNA, 21 nt, Human
acuucuucagagcugacacag

SEQ ID NO: 2312235 - RNA, 20 nt, Human
acuucuuauggaauugauuu

SEQ ID NO: 2312236 - RNA, 17 nt, Human
acuucuuauggaauuga

SEQ ID NO: 2312237 - RNA, 16 nt, Human
acuucuuauggaauug

SEQ ID NO: 2312238 - RNA, 22 nt, Human
acuucugucuucacaacagauu

SEQ ID NO: 2312239 - RNA, 22 nt, Human
acugugcugagucugaaggcug

SEQ ID NO: 2312240 - RNA, 12 nt, Human
acugugcuaaua

SEQ ID NO: 2312241 - RNA, 18 nt, Human
acugugcuaauaacagug

SEQ ID NO: 2312242 - RNA, 21 nt, Human
acugugcuaauaacagugcau

SEQ ID NO: 2312243 - RNA, 14 nt, Human
acugugcucagggc

SEQ ID NO: 2312244 - RNA, 20 nt, Human
acugugcugagucugaaggc

SEQ ID NO: 2312245 - RNA, 23 nt, Human
acgcugucuccagacccccaccc

SEQ ID NO: 2312246 - RNA, 18 nt, Human
acgcuuuccugaauccaa

SEQ ID NO: 2312247 - RNA, 17 nt, Human
acgcuuucuagcuguug

SEQ ID NO: 2312248 - RNA, 11 nt, Human
acgcuuugauu

SEQ ID NO: 2312249 - RNA, 22 nt, Human
acgcugucuccagacccccacc

SEQ ID NO: 2312250 - RNA, 21 nt, Human
acgcugucuccagacccccac

SEQ ID NO: 2312251 - RNA, 20 nt, Human
acgcugucuccagaccccca

SEQ ID NO: 2312252 - RNA, 13 nt, Human
acgccaccucgcc

SEQ ID NO: 2312253 - RNA, 19 nt, Human
acgcugucuccagaccccc

SEQ ID NO: 2312254 - RNA, 16 nt, Human
acgcuuugauucauag

SEQ ID NO: 2312255 - RNA, 14 nt, Human
acgcuuugauucau

SEQ ID NO: 2312256 - RNA, 13 nt, Human
acgcuuugauuca

SEQ ID NO: 2312257 - RNA, 12 nt, Human
acgcuuugauuc

SEQ ID NO: 2312258 - RNA, 20 nt, Human
acguccugccaccuggggca

SEQ ID NO: 2312259 - RNA, 15 nt, Human
acguccugucagugc

SEQ ID NO: 2312260 - RNA, 18 nt, Human
acguccugucagugccgc

SEQ ID NO: 2312261 - RNA, 13 nt, Human
acgucugacaggc

SEQ ID NO: 2312262 - RNA, 14 nt, Human
acgucugacaggca

SEQ ID NO: 2312263 - RNA, 19 nt, Human
acgucgucuucuguauacu

SEQ ID NO: 2312264 - RNA, 21 nt, Human
acguccugucagugccgccgc

SEQ ID NO: 2312265 - RNA, 22 nt, Human
acgcauggaguguguauuguuc

SEQ ID NO: 2312266 - RNA, 14 nt, Human
acgcaguggccuuc

SEQ ID NO: 2312267 - RNA, 17 nt, Human
acgcagggguugcagug

SEQ ID NO: 2312268 - RNA, 22 nt, Human
acgcaggcccccaggugccagu

SEQ ID NO: 2312269 - RNA, 19 nt, Human
acgcaggcccccaggugcc

SEQ ID NO: 2312270 - RNA, 13 nt, Human
acgccaccauucc

SEQ ID NO: 2312271 - RNA, 18 nt, Human
acgccaccauuccuggaa

SEQ ID NO: 2312272 - RNA, 12 nt, Human
acgccacccagc

SEQ ID NO: 2312273 - RNA, 11 nt, Human
acgcugugcug

SEQ ID NO: 2312274 - RNA, 12 nt, Human
acgcugugcugc

SEQ ID NO: 2312275 - RNA, 14 nt, Human
acgcugugcugccc

SEQ ID NO: 2312276 - RNA, 23 nt, Human
acuaauuccacaccuuuuauuga

SEQ ID NO: 2312277 - RNA, 20 nt, Human
acuaauuggccucuuuaaga

SEQ ID NO: 2312278 - RNA, 14 nt, Human
acuaauuguauaac

SEQ ID NO: 2312279 - RNA, 15 nt, Human
acuaauuguauaaca

SEQ ID NO: 2312280 - RNA, 14 nt, Human
acuaauuucaaaau

SEQ ID NO: 2312281 - RNA, 20 nt, Human
acuaauuguauaacagguua

SEQ ID NO: 2312282 - RNA, 22 nt, Human
acuaauuguauaacagguuauu

SEQ ID NO: 2312283 - RNA, 16 nt, Human
acuaauuguauaacag

SEQ ID NO: 2312284 - RNA, 17 nt, Human
acuaauuguauaacagg

SEQ ID NO: 2312285 - RNA, 18 nt, Human
acuaauuguauaacaggu

SEQ ID NO: 2312286 - RNA, 19 nt, Human
acuaauuguauaacagguu

SEQ ID NO: 2312287 - RNA, 19 nt, Human
acuaauuucaaaaugcuuu

SEQ ID NO: 2312288 - RNA, 16 nt, Human
acuaauuucaaaaugc

SEQ ID NO: 2312289 - RNA, 20 nt, Human
acuaauuucaaaaugcuuuu

SEQ ID NO: 2312290 - RNA, 15 nt, Human
acuaauuuaaaaaau

SEQ ID NO: 2312291 - RNA, 21 nt, Human
acuaaggggcccggccagcca

SEQ ID NO: 2312292 - RNA, 22 nt, Human
acuaaggggcccggccagccau

SEQ ID NO: 2312293 - RNA, 17 nt, Human
acuaaguuauaguauau

SEQ ID NO: 2312294 - RNA, 18 nt, Human
acuaaguuauaguauauc

SEQ ID NO: 2312295 - RNA, 15 nt, Human
acuaauuccacaccu

SEQ ID NO: 2312296 - RNA, 13 nt, Human
acuaauuccacac

SEQ ID NO: 2312297 - RNA, 12 nt, Human
acuaaggggccc

SEQ ID NO: 2312298 - RNA, 20 nt, Human
acuaaggaguaaucugugua

SEQ ID NO: 2312299 - RNA, 20 nt, Human
acuaagcuuugccagcugcu

SEQ ID NO: 2312300 - RNA, 21 nt, Human
acuaagcuuugccagcugcug

SEQ ID NO: 2312301 - RNA, 22 nt, Human
acuaagcccugucgagacacuu

SEQ ID NO: 2312302 - RNA, 14 nt, Human
acuaagccuaccug

SEQ ID NO: 2312303 - RNA, 18 nt, Human
acuaagccuaccugcucu

SEQ ID NO: 2312304 - RNA, 19 nt, Human
acuaagccuaccugcucuc

SEQ ID NO: 2312305 - RNA, 19 nt, Human
acuaagcagaggaggggcc

SEQ ID NO: 2312306 - RNA, 15 nt, Human
acuaagccacaagaa

SEQ ID NO: 2312307 - RNA, 16 nt, Human
acuaagccacaagaaa

SEQ ID NO: 2312308 - RNA, 18 nt, Human
acuaagccacaagaaauu

SEQ ID NO: 2312309 - RNA, 13 nt, Human
acuaagcccuguc

SEQ ID NO: 2312310 - RNA, 16 nt, Human
acuaagcccugucgag

SEQ ID NO: 2312311 - RNA, 18 nt, Human
acuaagcccugucgagac

SEQ ID NO: 2312312 - RNA, 17 nt, Human
acuaacuugacuuuuaa

SEQ ID NO: 2312313 - RNA, 13 nt, Human
acuaagaagaaaa

SEQ ID NO: 2312314 - RNA, 14 nt, Human
acuaagaagaaaau

SEQ ID NO: 2312315 - RNA, 18 nt, Human
acuaagaauucaaacugg

SEQ ID NO: 2312316 - RNA, 16 nt, Human
acuaagaauucaaacu

SEQ ID NO: 2312317 - RNA, 14 nt, Human
acuaagaaaagaua

SEQ ID NO: 2312318 - RNA, 22 nt, Human
acuaagcagaggaggggccgcu

SEQ ID NO: 2312319 - RNA, 13 nt, Human
acuaagagagaau

SEQ ID NO: 2312320 - RNA, 23 nt, Human
acgugagagugucuucacggcag

SEQ ID NO: 2312321 - RNA, 15 nt, Human
acgugagagugucuu

SEQ ID NO: 2312322 - RNA, 16 nt, Human
acgugagaucauucac

SEQ ID NO: 2312323 - RNA, 14 nt, Human
acgugagccaggua

SEQ ID NO: 2312324 - RNA, 15 nt, Human
acgugagccagguaa

SEQ ID NO: 2312325 - RNA, 22 nt, Human
acgugagccagguaaugaggga

SEQ ID NO: 2312326 - RNA, 23 nt, Human
acgugagccagguaaugagggac

SEQ ID NO: 2312327 - RNA, 18 nt, Human
acgugauggucugagacu

SEQ ID NO: 2312328 - RNA, 11 nt, Human
acgugaguccu

SEQ ID NO: 2312329 - RNA, 14 nt, Human
acgugagagugucu

SEQ ID NO: 2312330 - RNA, 21 nt, Human
acgugacuguggcacacgccu

SEQ ID NO: 2312331 - RNA, 20 nt, Human
acgugacugccccaacuccu

SEQ ID NO: 2312332 - RNA, 18 nt, Human
acgugacugccccaacuc

SEQ ID NO: 2312333 - RNA, 14 nt, Human
acgugacugcccca

SEQ ID NO: 2312334 - RNA, 17 nt, Human
acgugacagugccuggg

SEQ ID NO: 2312335 - RNA, 21 nt, Human
acgugaccggacuuuucugca

SEQ ID NO: 2312336 - RNA, 19 nt, Human
acgugacagugccugggaa

SEQ ID NO: 2312337 - RNA, 16 nt, Human
acgugacagugccugg

SEQ ID NO: 2312338 - RNA, 20 nt, Human
accuuucauaaucuuugcuu

SEQ ID NO: 2312339 - RNA, 21 nt, Human
accuuucauaaucuuugcuuu

SEQ ID NO: 2312340 - RNA, 19 nt, Human
accuuucauaaucuuugcu

SEQ ID NO: 2312341 - RNA, 20 nt, Human
accuuuauuaaaaucuuaaa

SEQ ID NO: 2312342 - RNA, 18 nt, Human
accuuuauuaaaaucuua

SEQ ID NO: 2312343 - RNA, 17 nt, Human
accuuuauuaaaaucuu

SEQ ID NO: 2312344 - RNA, 16 nt, Human
accuuuauuaaaaucu

SEQ ID NO: 2312345 - RNA, 15 nt, Human
accuuuauuaaaauc

SEQ ID NO: 2312346 - RNA, 14 nt, Human
accuuuauuaaaau

SEQ ID NO: 2312347 - RNA, 15 nt, Human
accuuuaugguuucu

SEQ ID NO: 2312348 - RNA, 20 nt, Human
accuuuagugguggccauuu

SEQ ID NO: 2312349 - RNA, 21 nt, Human
accuuuagggcagcuugcccc

SEQ ID NO: 2312350 - RNA, 18 nt, Human
accuuguuguuguuaaau

SEQ ID NO: 2312351 - RNA, 14 nt, Human
accuuuagggcagc

SEQ ID NO: 2312352 - RNA, 15 nt, Human
accuuuagggcagcu

SEQ ID NO: 2312353 - RNA, 15 nt, Human
accuuuaagagaaau

SEQ ID NO: 2312354 - RNA, 23 nt, Human
accuuuccaaaguuaacagauuu

SEQ ID NO: 2312355 - RNA, 18 nt, Human
accuuuccaccacagcca

SEQ ID NO: 2312356 - RNA, 18 nt, Human
accuuucccaucuuccaa

SEQ ID NO: 2312357 - RNA, 13 nt, Human
accuuucccaucu

SEQ ID NO: 2312358 - RNA, 17 nt, Human
accuuggcugcagggag

SEQ ID NO: 2312359 - RNA, 15 nt, Human
accuguugcuuacaa

SEQ ID NO: 2312360 - RNA, 16 nt, Human
accuguugcuuacaau

SEQ ID NO: 2312361 - RNA, 18 nt, Human
accuguugcuuacaauuu

SEQ ID NO: 2312362 - RNA, 19 nt, Human
accuguugcuuacaauuuu

SEQ ID NO: 2312363 - RNA, 20 nt, Human
accuguugcuuacaauuuuu

SEQ ID NO: 2312364 - RNA, 21 nt, Human
accuguugcuuacaauuuuuu

SEQ ID NO: 2312365 - RNA, 14 nt, Human
accuguugguucca

SEQ ID NO: 2312366 - RNA, 17 nt, Human
accuguuagcagacagg

SEQ ID NO: 2312367 - RNA, 17 nt, Human
accuguucagugucccg

SEQ ID NO: 2312368 - RNA, 18 nt, Human
accuguucagugucccgg

SEQ ID NO: 2312369 - RNA, 18 nt, Human
accuguuaccuacuuuga

SEQ ID NO: 2312370 - RNA, 17 nt, Human
accuguuaccuacuuug

SEQ ID NO: 2312371 - RNA, 22 nt, Human
accuguucagugucccgggccc

SEQ ID NO: 2312372 - RNA, 19 nt, Human
accuguucagugucccggg

SEQ ID NO: 2312373 - RNA, 20 nt, Human
accuguucagugucccgggc

SEQ ID NO: 2312374 - RNA, 18 nt, Human
accuuggcugcagggagu

SEQ ID NO: 2312375 - RNA, 16 nt, Human
accuguugguuccaag

SEQ ID NO: 2312376 - RNA, 14 nt, Human
accuguuuaaauau

SEQ ID NO: 2312377 - RNA, 16 nt, Human
accuguuuaaauauuu

SEQ ID NO: 2312378 - RNA, 17 nt, Human
accuuggggcuugacuu

SEQ ID NO: 2312379 - RNA, 23 nt, Human
accuugguguaguugaacugaua

SEQ ID NO: 2312380 - RNA, 15 nt, Human
accuuguuggagccu

SEQ ID NO: 2312381 - RNA, 16 nt, Human
accuuguuggagccug

SEQ ID NO: 2312382 - RNA, 17 nt, Human
accuuguuggagccugc

SEQ ID NO: 2312383 - RNA, 18 nt, Human
accuuguuggagccugca

SEQ ID NO: 2312384 - RNA, 19 nt, Human
accuuguuggagccugcag

SEQ ID NO: 2312385 - RNA, 12 nt, Human
accugucuccuu

SEQ ID NO: 2312386 - RNA, 22 nt, Human
accugucuccuuucaccccagg

SEQ ID NO: 2312387 - RNA, 17 nt, Human
accugucuccuuucuca

SEQ ID NO: 2312388 - RNA, 14 nt, Human
accugucucagccu

SEQ ID NO: 2312389 - RNA, 14 nt, Human
accuguccuugcac

SEQ ID NO: 2312390 - RNA, 18 nt, Human
accuguccuccugguggg

SEQ ID NO: 2312391 - RNA, 13 nt, Human
accugucucacca

SEQ ID NO: 2312392 - RNA, 20 nt, Human
accugucaugccccccucaa

SEQ ID NO: 2312393 - RNA, 14 nt, Human
accuguccuccugg

SEQ ID NO: 2312394 - RNA, 15 nt, Human
accuguccuccuggu

SEQ ID NO: 2312395 - RNA, 16 nt, Human
accugucccccugaca

SEQ ID NO: 2312396 - RNA, 12 nt, Human
accugucccccu

SEQ ID NO: 2312397 - RNA, 15 nt, Human
accugucccccugac

SEQ ID NO: 2312398 - RNA, 20 nt, Human
accugccgaccucguccucc

SEQ ID NO: 2312399 - RNA, 18 nt, Human
accugccgaccucguccu

SEQ ID NO: 2312400 - RNA, 17 nt, Human
accugccgaccucgucc

SEQ ID NO: 2312401 - RNA, 13 nt, Human
accugccgaccuc

SEQ ID NO: 2312402 - RNA, 12 nt, Human
accugccgaccu

SEQ ID NO: 2312403 - RNA, 19 nt, Human
accugcccugccugagggc

SEQ ID NO: 2312404 - RNA, 20 nt, Human
accugcccugccugagggcc

SEQ ID NO: 2312405 - RNA, 19 nt, Human
accugucaccgugagcagc

SEQ ID NO: 2312406 - RNA, 23 nt, Human
accugucacgauugucaucagga

SEQ ID NO: 2312407 - RNA, 18 nt, Human
accugucaccgugagcag

SEQ ID NO: 2312408 - RNA, 17 nt, Human
accugccucacagcugg

SEQ ID NO: 2312409 - RNA, 15 nt, Human
accugucaugccccc

SEQ ID NO: 2312410 - RNA, 17 nt, Human
accugucaugccccccu

SEQ ID NO: 2312411 - RNA, 18 nt, Human
accugucaugccccccuc

SEQ ID NO: 2312412 - RNA, 19 nt, Human
accugucaugccccccuca

SEQ ID NO: 2312413 - RNA, 19 nt, Human
accucuggacuggcuagag

SEQ ID NO: 2312414 - RNA, 16 nt, Human
accucuggacuggcua

SEQ ID NO: 2312415 - RNA, 15 nt, Human
accucuggacuggcu

SEQ ID NO: 2312416 - RNA, 14 nt, Human
accucuggacuggc

SEQ ID NO: 2312417 - RNA, 20 nt, Human
accucugcggaccccagcug

SEQ ID NO: 2312418 - RNA, 12 nt, Human
accucugcucug

SEQ ID NO: 2312419 - RNA, 14 nt, Human
accucugcucugag

SEQ ID NO: 2312420 - RNA, 22 nt, Human
accucugcucugaggcuuccag

SEQ ID NO: 2312421 - RNA, 23 nt, Human
accucuggacuggcuagaguccu

SEQ ID NO: 2312422 - RNA, 23 nt, Human
accucugcucugaggcuuccaga

SEQ ID NO: 2312423 - RNA, 18 nt, Human
accugcccugccugaggg

SEQ ID NO: 2312424 - RNA, 17 nt, Human
accugcccugccugagg

SEQ ID NO: 2312425 - RNA, 20 nt, Human
accugcccugcugaguccca

SEQ ID NO: 2312426 - RNA, 15 nt, Human
accucugcagcaaua

SEQ ID NO: 2312427 - RNA, 20 nt, Human
accucugcagcaauaaagca

SEQ ID NO: 2312428 - RNA, 18 nt, Human
accucugcagcaauaaag

SEQ ID NO: 2312429 - RNA, 12 nt, Human
accucugccaga

SEQ ID NO: 2312430 - RNA, 14 nt, Human
accucugcggaccc

SEQ ID NO: 2312431 - RNA, 17 nt, Human
accucugcggaccccag

SEQ ID NO: 2312432 - RNA, 18 nt, Human
accucugcggaccccagc

SEQ ID NO: 2312433 - RNA, 19 nt, Human
accucugcggaccccagcu

SEQ ID NO: 2312434 - RNA, 21 nt, Human
accucugcagcaauaaagcag

SEQ ID NO: 2312435 - RNA, 22 nt, Human
acucauauccccuauuuaacag

SEQ ID NO: 2312436 - RNA, 21 nt, Human
acucauacugugcuggagcca

SEQ ID NO: 2312437 - RNA, 23 nt, Human
acucauacugugcuggagccacu

SEQ ID NO: 2312438 - RNA, 14 nt, Human
acucauacaucugg

SEQ ID NO: 2312439 - RNA, 15 nt, Human
acucauacaucuggc

SEQ ID NO: 2312440 - RNA, 17 nt, Human
acucauaccuuuaaagg

SEQ ID NO: 2312441 - RNA, 15 nt, Human
acucauacugugcug

SEQ ID NO: 2312442 - RNA, 17 nt, Human
acucauacugugcugga

SEQ ID NO: 2312443 - RNA, 19 nt, Human
acucauacugugcuggagc

SEQ ID NO: 2312444 - RNA, 20 nt, Human
acucauacugugcuggagcc

SEQ ID NO: 2312445 - RNA, 17 nt, Human
acucuagggaaaaacca

SEQ ID NO: 2312446 - RNA, 15 nt, Human
acucuagggaaaaac

SEQ ID NO: 2312447 - RNA, 14 nt, Human
acucuagauuuugu

SEQ ID NO: 2312448 - RNA, 19 nt, Human
acucuagauuuuguuuugc

SEQ ID NO: 2312449 - RNA, 20 nt, Human
acucuagauuuuguuuugcu

SEQ ID NO: 2312450 - RNA, 21 nt, Human
acucuagauuuuguuuugcuu

SEQ ID NO: 2312451 - RNA, 17 nt, Human
acucuaggugcccuugg

SEQ ID NO: 2312452 - RNA, 21 nt, Human
acucuaggggucaggcuccau

SEQ ID NO: 2312453 - RNA, 20 nt, Human
acucuagcugggggugggcc

SEQ ID NO: 2312454 - RNA, 23 nt, Human
acucuagauuuuguuuugcuuuu

SEQ ID NO: 2312455 - RNA, 13 nt, Human
acucuagggcagu

SEQ ID NO: 2312456 - RNA, 23 nt, Human
acucuaucaaguauuauaccuuu

SEQ ID NO: 2312457 - RNA, 17 nt, Human
acucuauguucuaagaa

SEQ ID NO: 2312458 - RNA, 21 nt, Human
acucuaucaaguauuauaccu

SEQ ID NO: 2312459 - RNA, 16 nt, Human
acucugucagauggga

SEQ ID NO: 2312460 - RNA, 14 nt, Human
acucugucagaugg

SEQ ID NO: 2312461 - RNA, 23 nt, Human
acucugucaauuucccugacucc

SEQ ID NO: 2312462 - RNA, 19 nt, Human
acucugucgcccagucugg

SEQ ID NO: 2312463 - RNA, 15 nt, Human
acucugguucuuugu

SEQ ID NO: 2312464 - RNA, 23 nt, Human
acucaaaugcucagaccagcucu

SEQ ID NO: 2312465 - RNA, 12 nt, Human
acucaaaugcuu

SEQ ID NO: 2312466 - RNA, 17 nt, Human
acucaaauggggccaga

SEQ ID NO: 2312467 - RNA, 19 nt, Human
acucaaaugcuuggcuucu

SEQ ID NO: 2312468 - RNA, 22 nt, Human
acucaaaugcuuggcuucucau

SEQ ID NO: 2312469 - RNA, 23 nt, Human
acucaaauggggccagauccagc

SEQ ID NO: 2312470 - RNA, 22 nt, Human
acucaaauggggccagauccag

SEQ ID NO: 2312471 - RNA, 21 nt, Human
acucaaauggggccagaucca

SEQ ID NO: 2312472 - RNA, 20 nt, Human
acucaaauggggccagaucc

SEQ ID NO: 2312473 - RNA, 21 nt, Human
acucaaaugcucagaccagcu

SEQ ID NO: 2312474 - RNA, 18 nt, Human
acucaaaugcucagacca

SEQ ID NO: 2312475 - RNA, 15 nt, Human
acucaaaacuuaaca

SEQ ID NO: 2312476 - RNA, 20 nt, Human
acucaaaacccaucugggcu

SEQ ID NO: 2312477 - RNA, 21 nt, Human
acucagcagcccuccucaccc

SEQ ID NO: 2312478 - RNA, 20 nt, Human
acucagcagcccuccucacc

SEQ ID NO: 2312479 - RNA, 19 nt, Human
acucagcagcccuccucac

SEQ ID NO: 2312480 - RNA, 18 nt, Human
acucagcagcccuccuca

SEQ ID NO: 2312481 - RNA, 23 nt, Human
acucagcagcccuccucaccccg

SEQ ID NO: 2312482 - RNA, 22 nt, Human
acucagcagcccuccucacccc

SEQ ID NO: 2312483 - RNA, 14 nt, Human
acucagccaagcac

SEQ ID NO: 2312484 - RNA, 15 nt, Human
acucagccaagcaca

SEQ ID NO: 2312485 - RNA, 16 nt, Human
acucagccaagcacag

SEQ ID NO: 2312486 - RNA, 17 nt, Human
acucagccaagcacagu

SEQ ID NO: 2312487 - RNA, 18 nt, Human
acucagccaagcacagug

SEQ ID NO: 2312488 - RNA, 14 nt, Human
acucagcccugagg

SEQ ID NO: 2312489 - RNA, 11 nt, Human
acucagcccug

SEQ ID NO: 2312490 - RNA, 21 nt, Human
acucagcccucauuggcucuu

SEQ ID NO: 2312491 - RNA, 17 nt, Human
acucagcccucauuggc

SEQ ID NO: 2312492 - RNA, 22 nt, Human
acucagccaagcacaguggugg

SEQ ID NO: 2312493 - RNA, 23 nt, Human
acucagccaagcacagugguggc

SEQ ID NO: 2312494 - RNA, 19 nt, Human
acucaggaggcugaggcag

SEQ ID NO: 2312495 - RNA, 18 nt, Human
acucaggaggcugaggca

SEQ ID NO: 2312496 - RNA, 17 nt, Human
acucaggaggcugaggc

SEQ ID NO: 2312497 - RNA, 16 nt, Human
acucaggaggcugagg

SEQ ID NO: 2312498 - RNA, 14 nt, Human
acucaggaggcuga

SEQ ID NO: 2312499 - RNA, 13 nt, Human
acucaggaggcug

SEQ ID NO: 2312500 - RNA, 13 nt, Human
acucaggaagaac

SEQ ID NO: 2312501 - RNA, 14 nt, Human
acucaggaugccca

SEQ ID NO: 2312502 - RNA, 18 nt, Human
acucaggauccagucccu

SEQ ID NO: 2312503 - RNA, 18 nt, Human
acucaggaggcugagggg

SEQ ID NO: 2312504 - RNA, 17 nt, Human
acucaggaggcugaggg

SEQ ID NO: 2312505 - RNA, 20 nt, Human
acucaggaggcugaggcaga

SEQ ID NO: 2312506 - RNA, 17 nt, Human
acucagcuuccuaccca

SEQ ID NO: 2312507 - RNA, 18 nt, Human
acucaggaugcccagggc

SEQ ID NO: 2312508 - RNA, 16 nt, Human
acucaggaugcccagg

SEQ ID NO: 2312509 - RNA, 15 nt, Human
acucaggaugcccag

SEQ ID NO: 2312510 - RNA, 15 nt, Human
acucagggccccagc

SEQ ID NO: 2312511 - RNA, 16 nt, Human
acucaggcccaaagcc

SEQ ID NO: 2312512 - RNA, 23 nt, Human
acucagguuguaguaaagaaauu

SEQ ID NO: 2312513 - RNA, 22 nt, Human
acucagguuguaguaaagaaau

SEQ ID NO: 2312514 - RNA, 21 nt, Human
acucagguuguaguaaagaaa

SEQ ID NO: 2312515 - RNA, 20 nt, Human
acucagguuguaguaaagaa

SEQ ID NO: 2312516 - RNA, 17 nt, Human
acucaggaugcccaggg

SEQ ID NO: 2312517 - RNA, 22 nt, Human
acucagggccccagcacuaaag

SEQ ID NO: 2312518 - RNA, 18 nt, Human
acucagggccccagcacu

SEQ ID NO: 2312519 - RNA, 16 nt, Human
acucagggcuccuggg

SEQ ID NO: 2312520 - RNA, 19 nt, Human
acucaguccauagcagaga

SEQ ID NO: 2312521 - RNA, 14 nt, Human
acucauaaugugaa

SEQ ID NO: 2312522 - RNA, 15 nt, Human
acucauaaugugaag

SEQ ID NO: 2312523 - RNA, 16 nt, Human
acucauaaugugaagu

SEQ ID NO: 2312524 - RNA, 19 nt, Human
acucauaaugugaaguguu

SEQ ID NO: 2312525 - RNA, 14 nt, Human
acuauuuuucagaa

SEQ ID NO: 2312526 - RNA, 15 nt, Human
acuauuuaucugugu

SEQ ID NO: 2312527 - RNA, 18 nt, Human
acuauuuuucagaaucuc

SEQ ID NO: 2312528 - RNA, 13 nt, Human
acucaaaagcugg

SEQ ID NO: 2312529 - RNA, 12 nt, Human
acuauuuaucug

SEQ ID NO: 2312530 - RNA, 23 nt, Human
acuauuuaguuuuuguaauuuau

SEQ ID NO: 2312531 - RNA, 21 nt, Human
acuauuuaguuuuuguaauuu

SEQ ID NO: 2312532 - RNA, 20 nt, Human
acuauuuaguuuuuguaauu

SEQ ID NO: 2312533 - RNA, 14 nt, Human
acuauuuaacuuga

SEQ ID NO: 2312534 - RNA, 15 nt, Human
acuauuuaacuugag

SEQ ID NO: 2312535 - RNA, 22 nt, Human
acuauuuaacuugagcuuuaaa

SEQ ID NO: 2312536 - RNA, 18 nt, Human
acuauuuaacuugagggu

SEQ ID NO: 2312537 - RNA, 23 nt, Human
acuauucugauuacacaaaacaa

SEQ ID NO: 2312538 - RNA, 20 nt, Human
acuauuuaaagccuccucau

SEQ ID NO: 2312539 - RNA, 11 nt, Human
acuauuuaaag

SEQ ID NO: 2312540 - RNA, 20 nt, Human
acuauuccccagcagggucu

SEQ ID NO: 2312541 - RNA, 15 nt, Human
acuauucugauuaca

SEQ ID NO: 2312542 - RNA, 21 nt, Human
acuauucugauuacacaaaac

SEQ ID NO: 2312543 - RNA, 22 nt, Human
acuauucugauuacacaaaaca

SEQ ID NO: 2312544 - RNA, 15 nt, Human
acuaguguugcuugg

SEQ ID NO: 2312545 - RNA, 13 nt, Human
acuauucaaguau

SEQ ID NO: 2312546 - RNA, 22 nt, Human
acuauucaggagaguagaacag

SEQ ID NO: 2312547 - RNA, 21 nt, Human
acuauuccccagcagggucuu

SEQ ID NO: 2312548 - RNA, 13 nt, Human
acuaguuacacau

SEQ ID NO: 2312549 - RNA, 21 nt, Human
acuauucaaacagucucagga

SEQ ID NO: 2312550 - RNA, 23 nt, Human
acuagugacaagcuccuggucuu

SEQ ID NO: 2312551 - RNA, 16 nt, Human
acuagugcaaaucaua

SEQ ID NO: 2312552 - RNA, 16 nt, Human
acuagugaggaaagau

SEQ ID NO: 2312553 - RNA, 13 nt, Human
acuagugcaaauc

SEQ ID NO: 2312554 - RNA, 15 nt, Human
acuagcauaucugcc

SEQ ID NO: 2312555 - RNA, 17 nt, Human
acuagcauaucugccuu

SEQ ID NO: 2312556 - RNA, 19 nt, Human
acuagcauaucugccuuua

SEQ ID NO: 2312557 - RNA, 20 nt, Human
acuaguauuucuaugaaaua

SEQ ID NO: 2312558 - RNA, 18 nt, Human
acuagauuacauucaguu

SEQ ID NO: 2312559 - RNA, 13 nt, Human
acuagauuacauu

SEQ ID NO: 2312560 - RNA, 13 nt, Human
acuagcauaucug

SEQ ID NO: 2312561 - RNA, 18 nt, Human
acuagauggugcugagaa

SEQ ID NO: 2312562 - RNA, 16 nt, Human
acuagauggugcugag

SEQ ID NO: 2312563 - RNA, 15 nt, Human
acuagauggugcuga

SEQ ID NO: 2312564 - RNA, 15 nt, Human
acuagauggcgagca

SEQ ID NO: 2312565 - RNA, 13 nt, Human
acuagaugaugga

SEQ ID NO: 2312566 - RNA, 13 nt, Human
cacccacccuggg

SEQ ID NO: 2312567 - RNA, 14 nt, Human
cacccacccuggga

SEQ ID NO: 2312568 - RNA, 14 nt, Human
cacccacccagcac

SEQ ID NO: 2312569 - RNA, 20 nt, Human
cacccaccguccgcccugcu

SEQ ID NO: 2312570 - RNA, 22 nt, Human
cacccaccguccgcccugcucc

SEQ ID NO: 2312571 - RNA, 23 nt, Human
cacccaccguccgcccugcuccu

SEQ ID NO: 2312572 - RNA, 13 nt, Human
cacccaccgugga

SEQ ID NO: 2312573 - RNA, 20 nt, Human
cacccaccaucaugucuggc

SEQ ID NO: 2312574 - RNA, 22 nt, Human
cacccaccaucaugucuggcua

SEQ ID NO: 2312575 - RNA, 12 nt, Human
cacccaccucag

SEQ ID NO: 2312576 - RNA, 13 nt, Human
cacccaccucagc

SEQ ID NO: 2312577 - RNA, 14 nt, Human
cacccaccucagcc

SEQ ID NO: 2312578 - RNA, 16 nt, Human
cacccaccucagccuc

SEQ ID NO: 2312579 - RNA, 20 nt, Human
caccccagcugcuccccucc

SEQ ID NO: 2312580 - RNA, 19 nt, Human
caccccagcugcuccccuc

SEQ ID NO: 2312581 - RNA, 18 nt, Human
caccccagcugcuccccu

SEQ ID NO: 2312582 - RNA, 16 nt, Human
caccccagcugcuccc

SEQ ID NO: 2312583 - RNA, 13 nt, Human
caccccagcugcu

SEQ ID NO: 2312584 - RNA, 19 nt, Human
caccccagccuaagaugaa

SEQ ID NO: 2312585 - RNA, 11 nt, Human
caccccagccu

SEQ ID NO: 2312586 - RNA, 16 nt, Human
cacccaccguggagga

SEQ ID NO: 2312587 - RNA, 22 nt, Human
caccccagcugcuccccucccu

SEQ ID NO: 2312588 - RNA, 13 nt, Human
caccccaggacuc

SEQ ID NO: 2312589 - RNA, 15 nt, Human
caccccagggccuga

SEQ ID NO: 2312590 - RNA, 12 nt, Human
caccccagcccc

SEQ ID NO: 2312591 - RNA, 13 nt, Human
caccccagcccca

SEQ ID NO: 2312592 - RNA, 21 nt, Human
caccccaucccacacccugga

SEQ ID NO: 2312593 - RNA, 15 nt, Human
caccccaucccacac

SEQ ID NO: 2312594 - RNA, 12 nt, Human
caccccauccca

SEQ ID NO: 2312595 - RNA, 20 nt, Human
caccccagugcacccacucu

SEQ ID NO: 2312596 - RNA, 18 nt, Human
caccccagugcacccacu

SEQ ID NO: 2312597 - RNA, 17 nt, Human
caccccagugcacccac

SEQ ID NO: 2312598 - RNA, 22 nt, Human
caccccagggccugagccuggc

SEQ ID NO: 2312599 - RNA, 17 nt, Human
caccccagggccugagc

SEQ ID NO: 2312600 - RNA, 16 nt, Human
caccccagggccugag

SEQ ID NO: 2312601 - RNA, 17 nt, Human
caccccaugccaaagcu

SEQ ID NO: 2312602 - RNA, 15 nt, Human
caccccaugccaaag

SEQ ID NO: 2312603 - RNA, 12 nt, Human
caccccaugcca

SEQ ID NO: 2312604 - RNA, 22 nt, Human
caccccauagugaccggcugcu

SEQ ID NO: 2312605 - RNA, 16 nt, Human
caccccaugcuguuga

SEQ ID NO: 2312606 - RNA, 12 nt, Human
caccccaugcug

SEQ ID NO: 2312607 - RNA, 22 nt, Human
caccccaugcuguugauugcua

SEQ ID NO: 2312608 - RNA, 18 nt, Human
caccacugcacuccagcc

SEQ ID NO: 2312609 - RNA, 13 nt, Human
caccacugcacuc

SEQ ID NO: 2312610 - RNA, 13 nt, Human
caccacuggccac

SEQ ID NO: 2312611 - RNA, 14 nt, Human
caccacuggccacc

SEQ ID NO: 2312612 - RNA, 15 nt, Human
caccacuggccacca

SEQ ID NO: 2312613 - RNA, 15 nt, Human
caccagaagcccaga

SEQ ID NO: 2312614 - RNA, 14 nt, Human
caccagaagcccag

SEQ ID NO: 2312615 - RNA, 13 nt, Human
caccagaagccca

SEQ ID NO: 2312616 - RNA, 16 nt, Human
caccacuggccaccag

SEQ ID NO: 2312617 - RNA, 18 nt, Human
caccacuggccaccaggc

SEQ ID NO: 2312618 - RNA, 19 nt, Human
caccacuggccaccaggcu

SEQ ID NO: 2312619 - RNA, 20 nt, Human
caccacuggccaccaggcug

SEQ ID NO: 2312620 - RNA, 16 nt, Human
cacccaagggccuggc

SEQ ID NO: 2312621 - RNA, 17 nt, Human
caccagaagcccagaau

SEQ ID NO: 2312622 - RNA, 16 nt, Human
caccagaagcccagaa

SEQ ID NO: 2312623 - RNA, 17 nt, Human
cacccaagggccuggcc

SEQ ID NO: 2312624 - RNA, 18 nt, Human
cacccaagggccuggccu

SEQ ID NO: 2312625 - RNA, 20 nt, Human
cacccacaagugccacugcc

SEQ ID NO: 2312626 - RNA, 15 nt, Human
cacccacacacucgc

SEQ ID NO: 2312627 - RNA, 17 nt, Human
cacccacacacucgccc

SEQ ID NO: 2312628 - RNA, 21 nt, Human
cacccacacacucgcccgccc

SEQ ID NO: 2312629 - RNA, 23 nt, Human
cacccacacacucgcccgcccac

SEQ ID NO: 2312630 - RNA, 16 nt, Human
caccacuucuuuuaua

SEQ ID NO: 2312631 - RNA, 21 nt, Human
caccacuggccaccaggcugg

SEQ ID NO: 2312632 - RNA, 12 nt, Human
caccagaauaaa

SEQ ID NO: 2312633 - RNA, 23 nt, Human
cacccaauaaacauuaagauuga

SEQ ID NO: 2312634 - RNA, 15 nt, Human
cacccaccagggcga

SEQ ID NO: 2312635 - RNA, 13 nt, Human
cacccacagggcu

SEQ ID NO: 2312636 - RNA, 21 nt, Human
cacccacaugugacacauaug

SEQ ID NO: 2312637 - RNA, 12 nt, Human
cacccacaugug

SEQ ID NO: 2312638 - RNA, 13 nt, Human
cacccacauguga

SEQ ID NO: 2312639 - RNA, 19 nt, Human
cacccacaugugacacaua

SEQ ID NO: 2312640 - RNA, 19 nt, Human
cacccaagggccuggccug

SEQ ID NO: 2312641 - RNA, 20 nt, Human
cacccaagggccuggccuga

SEQ ID NO: 2312642 - RNA, 21 nt, Human
cacccaagggccuggccugag

SEQ ID NO: 2312643 - RNA, 23 nt, Human
cacccaagggccuggccugagcu

SEQ ID NO: 2312644 - RNA, 22 nt, Human
caccccgucugggguucagccc

SEQ ID NO: 2312645 - RNA, 15 nt, Human
caccccguagauucc

SEQ ID NO: 2312646 - RNA, 19 nt, Human
caccccggggacccuguga

SEQ ID NO: 2312647 - RNA, 20 nt, Human
caccccggggacccugugac

SEQ ID NO: 2312648 - RNA, 18 nt, Human
caccccgggcucucugcu

SEQ ID NO: 2312649 - RNA, 17 nt, Human
caccccggggacccugu

SEQ ID NO: 2312650 - RNA, 18 nt, Human
caccccggggacccugug

SEQ ID NO: 2312651 - RNA, 15 nt, Human
caccccgggcucucu

SEQ ID NO: 2312652 - RNA, 15 nt, Human
caccccgcucugcau

SEQ ID NO: 2312653 - RNA, 23 nt, Human
caccccgucugggguucagcccc

SEQ ID NO: 2312654 - RNA, 14 nt, Human
caccccuaaagaga

SEQ ID NO: 2312655 - RNA, 14 nt, Human
caccccggccaccu

SEQ ID NO: 2312656 - RNA, 15 nt, Human
caccccggccaccug

SEQ ID NO: 2312657 - RNA, 16 nt, Human
caccccggccaccugc

SEQ ID NO: 2312658 - RNA, 17 nt, Human
caccccggccaccugcg

SEQ ID NO: 2312659 - RNA, 22 nt, Human
cacccccuucucugcuccacca

SEQ ID NO: 2312660 - RNA, 18 nt, Human
cacccccuucucugcucc

SEQ ID NO: 2312661 - RNA, 17 nt, Human
cacccccuucucugcuc

SEQ ID NO: 2312662 - RNA, 16 nt, Human
cacccccuucucugcu

SEQ ID NO: 2312663 - RNA, 21 nt, Human
cacccccuucagugcccacca

SEQ ID NO: 2312664 - RNA, 20 nt, Human
cacccccuucagugcccacc

SEQ ID NO: 2312665 - RNA, 17 nt, Human
cacccccuucagugccc

SEQ ID NO: 2312666 - RNA, 13 nt, Human
cacccccuucucu

SEQ ID NO: 2312667 - RNA, 18 nt, Human
cacccccuucuccaucca

SEQ ID NO: 2312668 - RNA, 16 nt, Human
caccccgccugcccuc

SEQ ID NO: 2312669 - RNA, 13 nt, Human
caccccgcucugc

SEQ ID NO: 2312670 - RNA, 14 nt, Human
caccccgcucugca

SEQ ID NO: 2312671 - RNA, 12 nt, Human
cacccccuuucc

SEQ ID NO: 2312672 - RNA, 14 nt, Human
cacccccuuuccug

SEQ ID NO: 2312673 - RNA, 16 nt, Human
cacccccuucagugcc

SEQ ID NO: 2312674 - RNA, 17 nt, Human
cacccccugcccugcac

SEQ ID NO: 2312675 - RNA, 14 nt, Human
cacccccugcccug

SEQ ID NO: 2312676 - RNA, 16 nt, Human
cacccccugcccugca

SEQ ID NO: 2312677 - RNA, 13 nt, Human
cacccccugcccu

SEQ ID NO: 2312678 - RNA, 23 nt, Human
cacccccucccuggccuguucug

SEQ ID NO: 2312679 - RNA, 14 nt, Human
cacccccuccugcu

SEQ ID NO: 2312680 - RNA, 16 nt, Human
cacccccucccuggcc

SEQ ID NO: 2312681 - RNA, 14 nt, Human
cacccccucccugg

SEQ ID NO: 2312682 - RNA, 17 nt, Human
cacccccuccugcugca

SEQ ID NO: 2312683 - RNA, 15 nt, Human
cacccccuccugcug

SEQ ID NO: 2312684 - RNA, 16 nt, Human
cacccccuccugcugc

SEQ ID NO: 2312685 - RNA, 11 nt, Human
cacccccuccc

SEQ ID NO: 2312686 - RNA, 20 nt, Human
cacccccucaagccaauccc

SEQ ID NO: 2312687 - RNA, 17 nt, Human
cacccccuccccagggg

SEQ ID NO: 2312688 - RNA, 16 nt, Human
cacccccuccccaggg

SEQ ID NO: 2312689 - RNA, 15 nt, Human
cacccccuccccagg

SEQ ID NO: 2312690 - RNA, 14 nt, Human
cacccccuccccag

SEQ ID NO: 2312691 - RNA, 13 nt, Human
cacccccucccug

SEQ ID NO: 2312692 - RNA, 18 nt, Human
cacccccuccccagggga

SEQ ID NO: 2312693 - RNA, 16 nt, Human
cacccccuccccgccc

SEQ ID NO: 2312694 - RNA, 13 nt, Human
cacccccaucucu

SEQ ID NO: 2312695 - RNA, 12 nt, Human
cacccccagcuu

SEQ ID NO: 2312696 - RNA, 17 nt, Human
cacccccaucucucccu

SEQ ID NO: 2312697 - RNA, 14 nt, Human
caccccccaagcug

SEQ ID NO: 2312698 - RNA, 12 nt, Human
cacccccagcuc

SEQ ID NO: 2312699 - RNA, 13 nt, Human
cacccccagcuca

SEQ ID NO: 2312700 - RNA, 14 nt, Human
cacccccagcucaa

SEQ ID NO: 2312701 - RNA, 13 nt, Human
cacccccagcugc

SEQ ID NO: 2312702 - RNA, 17 nt, Human
cacccccagcugcuugu

SEQ ID NO: 2312703 - RNA, 12 nt, Human
caccccccucau

SEQ ID NO: 2312704 - RNA, 13 nt, Human
caccccccugggc

SEQ ID NO: 2312705 - RNA, 21 nt, Human
caccccccagaaccuguccuu

SEQ ID NO: 2312706 - RNA, 20 nt, Human
caccccccagaaccuguccu

SEQ ID NO: 2312707 - RNA, 19 nt, Human
caccccccagaaccugucc

SEQ ID NO: 2312708 - RNA, 18 nt, Human
caccccccagaaccuguc

SEQ ID NO: 2312709 - RNA, 13 nt, Human
caccccccagaac

SEQ ID NO: 2312710 - RNA, 23 nt, Human
caccccccacacucacuccugag

SEQ ID NO: 2312711 - RNA, 16 nt, Human
caccccccacucugug

SEQ ID NO: 2312712 - RNA, 15 nt, Human
caccccccaagcugu

SEQ ID NO: 2312713 - RNA, 13 nt, Human
caccccccacacu

SEQ ID NO: 2312714 - RNA, 18 nt, Human
caccccccacacucacuc

SEQ ID NO: 2312715 - RNA, 11 nt, Human
cacccccaccc

SEQ ID NO: 2312716 - RNA, 14 nt, Human
cacccccaccccca

SEQ ID NO: 2312717 - RNA, 17 nt, Human
cacccccacccccagcu

SEQ ID NO: 2312718 - RNA, 14 nt, Human
cacccccaccccuu

SEQ ID NO: 2312719 - RNA, 19 nt, Human
cacccccaaggggcagucu

SEQ ID NO: 2312720 - RNA, 12 nt, Human
cacccccaaggg

SEQ ID NO: 2312721 - RNA, 17 nt, Human
caccccauuuucugugg

SEQ ID NO: 2312722 - RNA, 12 nt, Human
cacccccacacc

SEQ ID NO: 2312723 - RNA, 11 nt, Human
cacccccacca

SEQ ID NO: 2312724 - RNA, 15 nt, Human
cacccccaccaaggg

SEQ ID NO: 2312725 - RNA, 22 nt, Human
cacccccacccaagggccuggc

SEQ ID NO: 2312726 - RNA, 15 nt, Human
caccccuaaagagau

SEQ ID NO: 2312727 - RNA, 15 nt, Human
caaauagcauaaguu

SEQ ID NO: 2312728 - RNA, 19 nt, Human
caaauacuuuaaaggaaaa

SEQ ID NO: 2312729 - RNA, 20 nt, Human
caaauaguuuauaaauguga

SEQ ID NO: 2312730 - RNA, 15 nt, Human
caaauagugcucgcu

SEQ ID NO: 2312731 - RNA, 14 nt, Human
caaauauaagaaua

SEQ ID NO: 2312732 - RNA, 18 nt, Human
caaauauaagaauaaaau

SEQ ID NO: 2312733 - RNA, 12 nt, Human
caaauauauuca

SEQ ID NO: 2312734 - RNA, 14 nt, Human
caaauaauaagcaa

SEQ ID NO: 2312735 - RNA, 13 nt, Human
caaauaaugucuc

SEQ ID NO: 2312736 - RNA, 16 nt, Human
caaauaaugucucugu

SEQ ID NO: 2312737 - RNA, 20 nt, Human
caaauaaugucucugugaga

SEQ ID NO: 2312738 - RNA, 23 nt, Human
caaauaaugucucugugagacuc

SEQ ID NO: 2312739 - RNA, 16 nt, Human
caaauacuuuaaagga

SEQ ID NO: 2312740 - RNA, 12 nt, Human
caaauacuuuaa

SEQ ID NO: 2312741 - RNA, 17 nt, Human
caaaguuggggcaggcu

SEQ ID NO: 2312742 - RNA, 15 nt, Human
caaaggcaagcacuu

SEQ ID NO: 2312743 - RNA, 21 nt, Human
caaaggaugugauauauaagu

SEQ ID NO: 2312744 - RNA, 14 nt, Human
caaaggaugugaua

SEQ ID NO: 2312745 - RNA, 17 nt, Human
caaaggaugugauauau

SEQ ID NO: 2312746 - RNA, 21 nt, Human
caaaggaugcccaaagaugca

SEQ ID NO: 2312747 - RNA, 13 nt, Human
caaaggaugugau

SEQ ID NO: 2312748 - RNA, 13 nt, Human
caaaggauacugu

SEQ ID NO: 2312749 - RNA, 13 nt, Human
caaaguuuugaaa

SEQ ID NO: 2312750 - RNA, 14 nt, Human
caaaguuuugaaaa

SEQ ID NO: 2312751 - RNA, 17 nt, Human
caaaguuuugaaaagcu

SEQ ID NO: 2312752 - RNA, 18 nt, Human
caaaguuuugaaaagcua

SEQ ID NO: 2312753 - RNA, 19 nt, Human
caaaguuuugaaaagcuau

SEQ ID NO: 2312754 - RNA, 20 nt, Human
caaaguuuugaaaagcuauu

SEQ ID NO: 2312755 - RNA, 21 nt, Human
caaaguuuugaaaagcuauua

SEQ ID NO: 2312756 - RNA, 17 nt, Human
caaauaaaaacuaaauu

SEQ ID NO: 2312757 - RNA, 22 nt, Human
caaauaaaaacuaaauuguaaa

SEQ ID NO: 2312758 - RNA, 19 nt, Human
caaauaaaaacuaaauugu

SEQ ID NO: 2312759 - RNA, 21 nt, Human
caaauaaaaacuaaauuguaa

SEQ ID NO: 2312760 - RNA, 16 nt, Human
caaaucagcugcuacu

SEQ ID NO: 2312761 - RNA, 18 nt, Human
caaaugucuuccuggauu

SEQ ID NO: 2312762 - RNA, 15 nt, Human
caaaugucuuccugg

SEQ ID NO: 2312763 - RNA, 13 nt, Human
caaaucagcugcu

SEQ ID NO: 2312764 - RNA, 15 nt, Human
caaaucacugaacuu

SEQ ID NO: 2312765 - RNA, 17 nt, Human
caaauaugcaaagcacu

SEQ ID NO: 2312766 - RNA, 16 nt, Human
caaauaugcaaagcac

SEQ ID NO: 2312767 - RNA, 18 nt, Human
caaauaugcaaagcacug

SEQ ID NO: 2312768 - RNA, 22 nt, Human
caaauauaagaauaaaauguug

SEQ ID NO: 2312769 - RNA, 14 nt, Human
caaaucacugaacu

SEQ ID NO: 2312770 - RNA, 14 nt, Human
caaaugugaccugu

SEQ ID NO: 2312771 - RNA, 13 nt, Human
caaaucagccaug

SEQ ID NO: 2312772 - RNA, 17 nt, Human
caaaugugaccuguguc

SEQ ID NO: 2312773 - RNA, 20 nt, Human
caaauguguaucggaugcuu

SEQ ID NO: 2312774 - RNA, 20 nt, Human
caaauguguacauggcagag

SEQ ID NO: 2312775 - RNA, 23 nt, Human
caaauguguacauggcagaguuu

SEQ ID NO: 2312776 - RNA, 14 nt, Human
caaauguggcuccu

SEQ ID NO: 2312777 - RNA, 20 nt, Human
caaauguucaucaaugaaug

SEQ ID NO: 2312778 - RNA, 21 nt, Human
caaauguucaucaaugaauga

SEQ ID NO: 2312779 - RNA, 14 nt, Human
caaauucauuuuuu

SEQ ID NO: 2312780 - RNA, 16 nt, Human
caaauucauauucugu

SEQ ID NO: 2312781 - RNA, 22 nt, Human
caaauucugcuugcuugcuuuu

SEQ ID NO: 2312782 - RNA, 23 nt, Human
caaacuuccagugcaacacugaa

SEQ ID NO: 2312783 - RNA, 13 nt, Human
caaacuugcuuua

SEQ ID NO: 2312784 - RNA, 12 nt, Human
caaaaaaugagc

SEQ ID NO: 2312785 - RNA, 15 nt, Human
caaaaaacugcagug

SEQ ID NO: 2312786 - RNA, 14 nt, Human
caaaaaaauuaaau

SEQ ID NO: 2312787 - RNA, 15 nt, Human
caaaaaacucgagga

SEQ ID NO: 2312788 - RNA, 21 nt, Human
caaaaaacucgaggacuguau

SEQ ID NO: 2312789 - RNA, 14 nt, Human
caaaaaacugcagu

SEQ ID NO: 2312790 - RNA, 16 nt, Human
caaaaaaaucugcaga

SEQ ID NO: 2312791 - RNA, 17 nt, Human
caaaaaaaucugcagaa

SEQ ID NO: 2312792 - RNA, 21 nt, Human
caaaaaaaucugcagaaggaa

SEQ ID NO: 2312793 - RNA, 15 nt, Human
auuuuuuucaauauu

SEQ ID NO: 2312794 - RNA, 14 nt, Human
auuuuuuucaccuc

SEQ ID NO: 2312795 - RNA, 21 nt, Human
auuuuuuucacuggaguuaca

SEQ ID NO: 2312796 - RNA, 23 nt, Human
caaaaaaauauauuuaaugauaa

SEQ ID NO: 2312797 - RNA, 17 nt, Human
auuuuuuuagaaagcau

SEQ ID NO: 2312798 - RNA, 23 nt, Human
auuuuuuuagaaagcauuugaau

SEQ ID NO: 2312799 - RNA, 21 nt, Human
auuuuuuuaucuugggacugg

SEQ ID NO: 2312800 - RNA, 16 nt, Human
auuuuuuuauuacuga

SEQ ID NO: 2312801 - RNA, 18 nt, Human
auuuuuuuauuguuuaaa

SEQ ID NO: 2312802 - RNA, 22 nt, Human
auuuuuuuauuguuuaaagcaa

SEQ ID NO: 2312803 - RNA, 18 nt, Human
auuuuuuuaagcuguaaa

SEQ ID NO: 2312804 - RNA, 12 nt, Human
auuuuuuuaagc

SEQ ID NO: 2312805 - RNA, 13 nt, Human
auuuuuuuaagcu

SEQ ID NO: 2312806 - RNA, 18 nt, Human
auuuuuuuaauuuacaaa

SEQ ID NO: 2312807 - RNA, 16 nt, Human
auuuuuuuaauuuugu

SEQ ID NO: 2312808 - RNA, 17 nt, Human
auuuuuuuaauuuugua

SEQ ID NO: 2312809 - RNA, 18 nt, Human
auuuuuuuacuaauagac

SEQ ID NO: 2312810 - RNA, 14 nt, Human
caaagagggcuucc

SEQ ID NO: 2312811 - RNA, 13 nt, Human
caaagagguauuu

SEQ ID NO: 2312812 - RNA, 15 nt, Human
caaagagggcuuccu

SEQ ID NO: 2312813 - RNA, 16 nt, Human
caaagagggcuuccuc

SEQ ID NO: 2312814 - RNA, 18 nt, Human
caaagagggcuuccucua

SEQ ID NO: 2312815 - RNA, 22 nt, Human
caaagagggcuuccucuagaag

SEQ ID NO: 2312816 - RNA, 20 nt, Human
caaagaggcaagaggcugga

SEQ ID NO: 2312817 - RNA, 15 nt, Human
caaagaggcaagagg

SEQ ID NO: 2312818 - RNA, 22 nt, Human
caaagaggcugaggcuggcaca

SEQ ID NO: 2312819 - RNA, 20 nt, Human
caaagaggcugaggcuggca

SEQ ID NO: 2312820 - RNA, 14 nt, Human
caaagaggcaagag

SEQ ID NO: 2312821 - RNA, 13 nt, Human
caaagaggcaaga

SEQ ID NO: 2312822 - RNA, 13 nt, Human
caaagaaacccaa

SEQ ID NO: 2312823 - RNA, 19 nt, Human
caaacuuuuccccuguccu

SEQ ID NO: 2312824 - RNA, 15 nt, Human
caaacuucagacuga

SEQ ID NO: 2312825 - RNA, 22 nt, Human
caaacuuggaauuuguaaccuc

SEQ ID NO: 2312826 - RNA, 12 nt, Human
caaacuuuauuu

SEQ ID NO: 2312827 - RNA, 17 nt, Human
caaacuuggauuuuuga

SEQ ID NO: 2312828 - RNA, 18 nt, Human
caaacuuuuauacucuuu

SEQ ID NO: 2312829 - RNA, 16 nt, Human
caaaggaguagaaaga

SEQ ID NO: 2312830 - RNA, 20 nt, Human
caaaggagggucaggaagga

SEQ ID NO: 2312831 - RNA, 17 nt, Human
caaaggaggcuggcagg

SEQ ID NO: 2312832 - RNA, 22 nt, Human
caaaggaaaaagcacaagaagc

SEQ ID NO: 2312833 - RNA, 22 nt, Human
caaaggaaaauaguaauguuuu

SEQ ID NO: 2312834 - RNA, 16 nt, Human
caaagcuuuuagaaau

SEQ ID NO: 2312835 - RNA, 18 nt, Human
caaaggaaaaagcacaag

SEQ ID NO: 2312836 - RNA, 21 nt, Human
caaaggaaaaagcacaagaag

SEQ ID NO: 2312837 - RNA, 21 nt, Human
caaagcuuggaagagccugca

SEQ ID NO: 2312838 - RNA, 23 nt, Human
caaagcuuuccugccccaggccu

SEQ ID NO: 2312839 - RNA, 18 nt, Human
caaagcuuuccugcccca

SEQ ID NO: 2312840 - RNA, 22 nt, Human
caaagcuuuccugccccaggcc

SEQ ID NO: 2312841 - RNA, 20 nt, Human
caaagcuuuuagaaauacug

SEQ ID NO: 2312842 - RNA, 16 nt, Human
caaagcuuuuuccaga

SEQ ID NO: 2312843 - RNA, 16 nt, Human
caaagcuuguuaagau

SEQ ID NO: 2312844 - RNA, 13 nt, Human
caaagcuuuccug

SEQ ID NO: 2312845 - RNA, 22 nt, Human
caaagcuuggaagagccugcag

SEQ ID NO: 2312846 - RNA, 14 nt, Human
caaagcuuuccugc

SEQ ID NO: 2312847 - RNA, 16 nt, Human
caaagcuuuccugccc

SEQ ID NO: 2312848 - RNA, 22 nt, Human
caaagcuuagcaggagaggaga

SEQ ID NO: 2312849 - RNA, 17 nt, Human
caaagcuuagcaggaga

SEQ ID NO: 2312850 - RNA, 18 nt, Human
caaagcuuagcaggagag

SEQ ID NO: 2312851 - RNA, 14 nt, Human
caaagcuuagcagg

SEQ ID NO: 2312852 - RNA, 15 nt, Human
caaagcuuagcagga

SEQ ID NO: 2312853 - RNA, 16 nt, Human
caaagcuuagcaggag

SEQ ID NO: 2312854 - RNA, 19 nt, Human
caaagcuugaagaucguua

SEQ ID NO: 2312855 - RNA, 19 nt, Human
caaagcuuggaagagccug

SEQ ID NO: 2312856 - RNA, 14 nt, Human
caaagcuugaagau

SEQ ID NO: 2312857 - RNA, 21 nt, Human
caaagcuucuaucccaggagg

SEQ ID NO: 2312858 - RNA, 18 nt, Human
caaagcuucuaucccagg

SEQ ID NO: 2312859 - RNA, 19 nt, Human
caaagcuucuaucccagga

SEQ ID NO: 2312860 - RNA, 20 nt, Human
caaagcuucuaucccaggag

SEQ ID NO: 2312861 - RNA, 20 nt, Human
caaagccaaagcuaggccug

SEQ ID NO: 2312862 - RNA, 22 nt, Human
caaagccaaacucugccagcca

SEQ ID NO: 2312863 - RNA, 18 nt, Human
caaagccaaacucugcca

SEQ ID NO: 2312864 - RNA, 17 nt, Human
caaagccaaacucugcc

SEQ ID NO: 2312865 - RNA, 17 nt, Human
caaagcauugagcaaag

SEQ ID NO: 2312866 - RNA, 21 nt, Human
caaagccaaagcuaggccugg

SEQ ID NO: 2312867 - RNA, 15 nt, Human
caaagcuaggccugg

SEQ ID NO: 2312868 - RNA, 16 nt, Human
caaagcuaggccuggc

SEQ ID NO: 2312869 - RNA, 17 nt, Human
caaagcuaggccuggcc

SEQ ID NO: 2312870 - RNA, 18 nt, Human
caaagcuaggccuggcca

SEQ ID NO: 2312871 - RNA, 17 nt, Human
caacuucuacuucugcc

SEQ ID NO: 2312872 - RNA, 15 nt, Human
caaauucucaccaaa

SEQ ID NO: 2312873 - RNA, 21 nt, Human
caaauucucaaccuaccaccc

SEQ ID NO: 2312874 - RNA, 22 nt, Human
caaauucucaaccuaccacccc

SEQ ID NO: 2312875 - RNA, 16 nt, Human
caaauucgcaaacuuu

SEQ ID NO: 2312876 - RNA, 14 nt, Human
caaauuuacagaga

SEQ ID NO: 2312877 - RNA, 15 nt, Human
caaauucugucucug

SEQ ID NO: 2312878 - RNA, 23 nt, Human
caacaggcugggcuucaguggca

SEQ ID NO: 2312879 - RNA, 15 nt, Human
caaauuuacagagac

SEQ ID NO: 2312880 - RNA, 24 nt, Human
caacaggcugggcuucaguggcag

SEQ ID NO: 2312881 - RNA, 17 nt, Human
caacaucaauguucauu

SEQ ID NO: 2312882 - RNA, 16 nt, Human
caacaucaauguucau

SEQ ID NO: 2312883 - RNA, 15 nt, Human
caacaucaauguuca

SEQ ID NO: 2312884 - RNA, 13 nt, Human
caacaucaauguu

SEQ ID NO: 2312885 - RNA, 22 nt, Human
caacaucaauguucauuguaau

SEQ ID NO: 2312886 - RNA, 18 nt, Human
caacaucaauguucauug

SEQ ID NO: 2312887 - RNA, 14 nt, Human
caacagucaaaaca

SEQ ID NO: 2312888 - RNA, 20 nt, Human
caacaguagcauaggacccu

SEQ ID NO: 2312889 - RNA, 18 nt, Human
caacagucaaaacagaga

SEQ ID NO: 2312890 - RNA, 22 nt, Human
caacaucuuggucagauuugaa

SEQ ID NO: 2312891 - RNA, 17 nt, Human
caacaucccauugcccu

SEQ ID NO: 2312892 - RNA, 15 nt, Human
caacaucccauugcc

SEQ ID NO: 2312893 - RNA, 18 nt, Human
caacagguggcaggacca

SEQ ID NO: 2312894 - RNA, 21 nt, Human
caacagguggcaggaccagga

SEQ ID NO: 2312895 - RNA, 13 nt, Human
caacagguuuuau

SEQ ID NO: 2312896 - RNA, 22 nt, Human
caacagguggcaggaccaggac

SEQ ID NO: 2312897 - RNA, 23 nt, Human
caacagguggcaggaccaggacu

SEQ ID NO: 2312898 - RNA, 19 nt, Human
caacagguuuuccugaaga

SEQ ID NO: 2312899 - RNA, 18 nt, Human
caacaggguuuuuuucca

SEQ ID NO: 2312900 - RNA, 15 nt, Human
caacagguuuuccug

SEQ ID NO: 2312901 - RNA, 16 nt, Human
caaccaauguagaaag

SEQ ID NO: 2312902 - RNA, 18 nt, Human
caaccaagucaugugcau

SEQ ID NO: 2312903 - RNA, 20 nt, Human
caaccaagucaugugcauuu

SEQ ID NO: 2312904 - RNA, 16 nt, Human
caacauuucucaauaa

SEQ ID NO: 2312905 - RNA, 17 nt, Human
caacauuucucaauaau

SEQ ID NO: 2312906 - RNA, 14 nt, Human
caacauuucucaau

SEQ ID NO: 2312907 - RNA, 21 nt, Human
caaccccuucgcuccuguguc

SEQ ID NO: 2312908 - RNA, 21 nt, Human
caacccucagagccaccccua

SEQ ID NO: 2312909 - RNA, 18 nt, Human
caacccucagagccaccc

SEQ ID NO: 2312910 - RNA, 18 nt, Human
caaccccuucgcuccugu

SEQ ID NO: 2312911 - RNA, 19 nt, Human
caaccccuucgcuccugug

SEQ ID NO: 2312912 - RNA, 13 nt, Human
caacauguauaau

SEQ ID NO: 2312913 - RNA, 15 nt, Human
caacauggugucugg

SEQ ID NO: 2312914 - RNA, 16 nt, Human
caacauggugucugga

SEQ ID NO: 2312915 - RNA, 18 nt, Human
caacauggugaaaccccg

SEQ ID NO: 2312916 - RNA, 13 nt, Human
caacauggagaaa

SEQ ID NO: 2312917 - RNA, 23 nt, Human
caacaugccugccccaaacaaau

SEQ ID NO: 2312918 - RNA, 22 nt, Human
caacauggagaaacccugucuc

SEQ ID NO: 2312919 - RNA, 23 nt, Human
caacauggagaaacccugucucu

SEQ ID NO: 2312920 - RNA, 20 nt, Human
caacaucccauugcccuggu

SEQ ID NO: 2312921 - RNA, 19 nt, Human
caacaucccauugcccugg

SEQ ID NO: 2312922 - RNA, 18 nt, Human
caacaucccauugcccug

SEQ ID NO: 2312923 - RNA, 13 nt, Human
caacaucuagcaa

SEQ ID NO: 2312924 - RNA, 13 nt, Human
caacaucuuuucu

SEQ ID NO: 2312925 - RNA, 14 nt, Human
caacaucugagugc

SEQ ID NO: 2312926 - RNA, 15 nt, Human
caacaugagucaaga

SEQ ID NO: 2312927 - RNA, 15 nt, Human
caacauugccuauuu

SEQ ID NO: 2312928 - RNA, 22 nt, Human
caacauugcuggcuggaaggga

SEQ ID NO: 2312929 - RNA, 17 nt, Human
caacauugcuugugcca

SEQ ID NO: 2312930 - RNA, 21 nt, Human
caacauuacagggaaugccug

SEQ ID NO: 2312931 - RNA, 20 nt, Human
caacauuaaaacaauauugu

SEQ ID NO: 2312932 - RNA, 23 nt, Human
caacauguugggaaacuuggcuc

SEQ ID NO: 2312933 - RNA, 19 nt, Human
caacauguugggaaacuug

SEQ ID NO: 2312934 - RNA, 22 nt, Human
caacauguugggaaacuuggcu

SEQ ID NO: 2312935 - RNA, 17 nt, Human
caacauguauaauauuu

SEQ ID NO: 2312936 - RNA, 18 nt, Human
caacauguauaauauuuu

SEQ ID NO: 2312937 - RNA, 19 nt, Human
caacauguauaauauuuuu

SEQ ID NO: 2312938 - RNA, 23 nt, Human
caacauguauaauauuuuuaauu

SEQ ID NO: 2312939 - RNA, 20 nt, Human
caacauguuacugaccagca

SEQ ID NO: 2312940 - RNA, 18 nt, Human
caacauguuacugaccag

SEQ ID NO: 2312941 - RNA, 17 nt, Human
caacauguuacugacca

SEQ ID NO: 2312942 - RNA, 20 nt, Human
caacauguagcugaguuuaa

SEQ ID NO: 2312943 - RNA, 21 nt, Human
caacauguguacuuaauuucu

SEQ ID NO: 2312944 - RNA, 15 nt, Human
caacuuaauguucug

SEQ ID NO: 2312945 - RNA, 19 nt, Human
caacuguuguaacuaggcu

SEQ ID NO: 2312946 - RNA, 19 nt, Human
caacuguugauugcaggaa

SEQ ID NO: 2312947 - RNA, 19 nt, Human
caacuguuaugaaauaaag

SEQ ID NO: 2312948 - RNA, 12 nt, Human
caacugcugcuu

SEQ ID NO: 2312949 - RNA, 14 nt, Human
caacugcugcuuuu

SEQ ID NO: 2312950 - RNA, 23 nt, Human
caacugccucgaaacacagaaac

SEQ ID NO: 2312951 - RNA, 21 nt, Human
caacugccucgaaacacagaa

SEQ ID NO: 2312952 - RNA, 22 nt, Human
caacugccuacuccaaaauguu

SEQ ID NO: 2312953 - RNA, 18 nt, Human
caacugccuacuccaaaa

SEQ ID NO: 2312954 - RNA, 16 nt, Human
caacugcauuggcuuu

SEQ ID NO: 2312955 - RNA, 15 nt, Human
caacugccuacucca

SEQ ID NO: 2312956 - RNA, 14 nt, Human
caacugccuacucc

SEQ ID NO: 2312957 - RNA, 20 nt, Human
caacucuccuccagagucag

SEQ ID NO: 2312958 - RNA, 23 nt, Human
caacuucccaguucaggaguccc

SEQ ID NO: 2312959 - RNA, 19 nt, Human
caacuucaugucaacuucu

SEQ ID NO: 2312960 - RNA, 16 nt, Human
caacuuuaagaggaca

SEQ ID NO: 2312961 - RNA, 18 nt, Human
caacuuuaagcagcucuu

SEQ ID NO: 2312962 - RNA, 21 nt, Human
caacuuuaagcagcucuugcu

SEQ ID NO: 2312963 - RNA, 22 nt, Human
caacuuuaagcagcucuugcua

SEQ ID NO: 2312964 - RNA, 22 nt, Human
caacuucaagugcaugcucucu

SEQ ID NO: 2312965 - RNA, 18 nt, Human
caacuucagcaguaccua

SEQ ID NO: 2312966 - RNA, 18 nt, Human
caacuucaagugcaugcu

SEQ ID NO: 2312967 - RNA, 17 nt, Human
caacuucaagugcaugc

SEQ ID NO: 2312968 - RNA, 16 nt, Human
caacuucaagugcaug

SEQ ID NO: 2312969 - RNA, 21 nt, Human
caacuuaauguucugaauaau

SEQ ID NO: 2312970 - RNA, 18 nt, Human
caacuuagaucuccagga

SEQ ID NO: 2312971 - RNA, 14 nt, Human
caacuuacuacuga

SEQ ID NO: 2312972 - RNA, 11 nt, Human
caacuuucugu

SEQ ID NO: 2312973 - RNA, 12 nt, Human
caacuuucugua

SEQ ID NO: 2312974 - RNA, 16 nt, Human
caacuuucuguaaacu

SEQ ID NO: 2312975 - RNA, 11 nt, Human
caacuuuguau

SEQ ID NO: 2312976 - RNA, 12 nt, Human
caacuuuguaua

SEQ ID NO: 2312977 - RNA, 23 nt, Human
caacuuucuguaaacucaaaacu

SEQ ID NO: 2312978 - RNA, 10 nt, Human
caacccuucu

SEQ ID NO: 2312979 - RNA, 18 nt, Human
caacccuucccucaccuu

SEQ ID NO: 2312980 - RNA, 20 nt, Human
caacccuucuccucuuguaa

SEQ ID NO: 2312981 - RNA, 21 nt, Human
caacccuucuccucuuguaaa

SEQ ID NO: 2312982 - RNA, 23 nt, Human
caacccuucuccucuuguaaaua

SEQ ID NO: 2312983 - RNA, 19 nt, Human
caacccuuuugucugccuc

SEQ ID NO: 2312984 - RNA, 16 nt, Human
caaccucuucuggcuc

SEQ ID NO: 2312985 - RNA, 20 nt, Human
caacccuuaccccuuagccu

SEQ ID NO: 2312986 - RNA, 19 nt, Human
caacccuuaccccuuagcc

SEQ ID NO: 2312987 - RNA, 15 nt, Human
caacccuuaccccuu

SEQ ID NO: 2312988 - RNA, 17 nt, Human
caacccuguuuuauacu

SEQ ID NO: 2312989 - RNA, 17 nt, Human
caacccuguuuccugag

SEQ ID NO: 2312990 - RNA, 19 nt, Human
caacccuguuuuauacugu

SEQ ID NO: 2312991 - RNA, 11 nt, Human
caacccuuccc

SEQ ID NO: 2312992 - RNA, 22 nt, Human
caacccuuaccccuuagccucc

SEQ ID NO: 2312993 - RNA, 17 nt, Human
caacccuucccucaccu

SEQ ID NO: 2312994 - RNA, 12 nt, Human
caacccuucccc

SEQ ID NO: 2312995 - RNA, 13 nt, Human
caacccuucccca

SEQ ID NO: 2312996 - RNA, 14 nt, Human
caacccucccucag

SEQ ID NO: 2312997 - RNA, 14 nt, Human
caaccaccgcuccc

SEQ ID NO: 2312998 - RNA, 18 nt, Human
caacccucccucagcccc

SEQ ID NO: 2312999 - RNA, 17 nt, Human
caacccucccucagccc

SEQ ID NO: 2313000 - RNA, 11 nt, Human
caacccugucu

SEQ ID NO: 2313001 - RNA, 12 nt, Human
caacccugucug

SEQ ID NO: 2313002 - RNA, 13 nt, Human
caacccuguuucc

SEQ ID NO: 2313003 - RNA, 15 nt, Human
caacccuguuuccug

SEQ ID NO: 2313004 - RNA, 16 nt, Human
caacccuguuuccuga

SEQ ID NO: 2313005 - RNA, 12 nt, Human
caacccucauca

SEQ ID NO: 2313006 - RNA, 15 nt, Human
caacccucaucacca

SEQ ID NO: 2313007 - RNA, 12 nt, Human
caaccugaaccu

SEQ ID NO: 2313008 - RNA, 13 nt, Human
caaccugaaccua

SEQ ID NO: 2313009 - RNA, 16 nt, Human
caaccugaaccuagga

SEQ ID NO: 2313010 - RNA, 15 nt, Human
caaccugaccaacau

SEQ ID NO: 2313011 - RNA, 18 nt, Human
caaccucuucuggcucaa

SEQ ID NO: 2313012 - RNA, 17 nt, Human
caaccucuucuggcuca

SEQ ID NO: 2313013 - RNA, 15 nt, Human
caaccucuuggccug

SEQ ID NO: 2313014 - RNA, 13 nt, Human
caaccucuuggcc

SEQ ID NO: 2313015 - RNA, 23 nt, Human
caaccugaccaacauggagaaac

SEQ ID NO: 2313016 - RNA, 20 nt, Human
caaccugaccaacauggaga

SEQ ID NO: 2313017 - RNA, 13 nt, Human
caacgaggaagcc

SEQ ID NO: 2313018 - RNA, 12 nt, Human
caacgaggaagc

SEQ ID NO: 2313019 - RNA, 21 nt, Human
caaccugaccaacauggagaa

SEQ ID NO: 2313020 - RNA, 16 nt, Human
caaccugauugugucu

SEQ ID NO: 2313021 - RNA, 18 nt, Human
caacgcagcccugcuuug

SEQ ID NO: 2313022 - RNA, 19 nt, Human
caacucuccuccagaguca

SEQ ID NO: 2313023 - RNA, 12 nt, Human
caacgcagcccu

SEQ ID NO: 2313024 - RNA, 15 nt, Human
caacgaggaagcccu

SEQ ID NO: 2313025 - RNA, 13 nt, Human
caacgcagcccug

SEQ ID NO: 2313026 - RNA, 15 nt, Human
caacgcagcccugcu

SEQ ID NO: 2313027 - RNA, 18 nt, Human
caagcccccccuuccacu

SEQ ID NO: 2313028 - RNA, 13 nt, Human
caagccccugccc

SEQ ID NO: 2313029 - RNA, 21 nt, Human
caagccccugcuccagaagau

SEQ ID NO: 2313030 - RNA, 17 nt, Human
caagccccugcccaucu

SEQ ID NO: 2313031 - RNA, 18 nt, Human
caagccccugcccaucug

SEQ ID NO: 2313032 - RNA, 21 nt, Human
caagccaccaacauacuccca

SEQ ID NO: 2313033 - RNA, 21 nt, Human
caagccaagggaaccuguguc

SEQ ID NO: 2313034 - RNA, 22 nt, Human
caagccaagggaaccugugucc

SEQ ID NO: 2313035 - RNA, 23 nt, Human
caagccaagggaaccuguguccg

SEQ ID NO: 2313036 - RNA, 14 nt, Human
caagccaauccccu

SEQ ID NO: 2313037 - RNA, 15 nt, Human
caagccaauccccuc

SEQ ID NO: 2313038 - RNA, 22 nt, Human
caagccaauccccuccuugggc

SEQ ID NO: 2313039 - RNA, 17 nt, Human
caagccaauccccuccu

SEQ ID NO: 2313040 - RNA, 11 nt, Human
caagccacaga

SEQ ID NO: 2313041 - RNA, 13 nt, Human
caagccacagaag

SEQ ID NO: 2313042 - RNA, 14 nt, Human
caagccacagaagc

SEQ ID NO: 2313043 - RNA, 19 nt, Human
caagccacagaagccagga

SEQ ID NO: 2313044 - RNA, 22 nt, Human
caagccacagaagccaggagca

SEQ ID NO: 2313045 - RNA, 16 nt, Human
caagcgugagccacug

SEQ ID NO: 2313046 - RNA, 21 nt, Human
caagcccuggagccaacugcu

SEQ ID NO: 2313047 - RNA, 21 nt, Human
caagcccuccccaucccaugu

SEQ ID NO: 2313048 - RNA, 21 nt, Human
caagcccgacuugcuguuuug

SEQ ID NO: 2313049 - RNA, 14 nt, Human
caagccguggcuuc

SEQ ID NO: 2313050 - RNA, 15 nt, Human
caagccguggcuucc

SEQ ID NO: 2313051 - RNA, 16 nt, Human
caagccguggcuuccc

SEQ ID NO: 2313052 - RNA, 16 nt, Human
caagaaagcugguaaa

SEQ ID NO: 2313053 - RNA, 22 nt, Human
caagaaagaaacccgacagagg

SEQ ID NO: 2313054 - RNA, 19 nt, Human
caagaaacugaggaauuuu

SEQ ID NO: 2313055 - RNA, 18 nt, Human
caagcaccuccugccucg

SEQ ID NO: 2313056 - RNA, 17 nt, Human
caagaaacucaccccca

SEQ ID NO: 2313057 - RNA, 15 nt, Human
caagaaacucacccc

SEQ ID NO: 2313058 - RNA, 18 nt, Human
caagaaacugaggaauuu

SEQ ID NO: 2313059 - RNA, 15 nt, Human
caagaaagaaacccg

SEQ ID NO: 2313060 - RNA, 18 nt, Human
caagcacugcuaggcgag

SEQ ID NO: 2313061 - RNA, 23 nt, Human
caagcacugcuaggcgagugcca

SEQ ID NO: 2313062 - RNA, 12 nt, Human
caagcacugugc

SEQ ID NO: 2313063 - RNA, 13 nt, Human
caagcacugugcu

SEQ ID NO: 2313064 - RNA, 21 nt, Human
caagccaagcagccaagcucc

SEQ ID NO: 2313065 - RNA, 19 nt, Human
caagccaagcagccaagcu

SEQ ID NO: 2313066 - RNA, 18 nt, Human
caagccaagggaaccugu

SEQ ID NO: 2313067 - RNA, 17 nt, Human
caagcacugugcucagg

SEQ ID NO: 2313068 - RNA, 17 nt, Human
caagcacuaaacaaaga

SEQ ID NO: 2313069 - RNA, 18 nt, Human
caaggacagccccuccuc

SEQ ID NO: 2313070 - RNA, 22 nt, Human
caaggaaagggggucccagugg

SEQ ID NO: 2313071 - RNA, 20 nt, Human
caaggaaagccccagcacua

SEQ ID NO: 2313072 - RNA, 14 nt, Human
caaggaaaggccug

SEQ ID NO: 2313073 - RNA, 15 nt, Human
caaggaaaggcaaau

SEQ ID NO: 2313074 - RNA, 20 nt, Human
caaggaaagggggucccagu

SEQ ID NO: 2313075 - RNA, 23 nt, Human
caaggaaagggggucccaguggg

SEQ ID NO: 2313076 - RNA, 21 nt, Human
caaggaccaggacucccuccu

SEQ ID NO: 2313077 - RNA, 20 nt, Human
caaggaccaggacucccucc

SEQ ID NO: 2313078 - RNA, 18 nt, Human
caaggaccaggacucccu

SEQ ID NO: 2313079 - RNA, 16 nt, Human
caaggaccaggacucc

SEQ ID NO: 2313080 - RNA, 15 nt, Human
caaggaccaggacuc

SEQ ID NO: 2313081 - RNA, 14 nt, Human
caaggaccaggacu

SEQ ID NO: 2313082 - RNA, 13 nt, Human
caaggaccaggac

SEQ ID NO: 2313083 - RNA, 17 nt, Human
caaggaaagccccagca

SEQ ID NO: 2313084 - RNA, 22 nt, Human
caaggaaaccacagcugcugga

SEQ ID NO: 2313085 - RNA, 17 nt, Human
caaggaaaccacagcug

SEQ ID NO: 2313086 - RNA, 18 nt, Human
caaggaaaccacagcugc

SEQ ID NO: 2313087 - RNA, 20 nt, Human
caaggaaaccacagcugcug

SEQ ID NO: 2313088 - RNA, 21 nt, Human
caaggaaaccacagcugcugg

SEQ ID NO: 2313089 - RNA, 15 nt, Human
caaggaaaaacaggu

SEQ ID NO: 2313090 - RNA, 14 nt, Human
caaggaaaccacag

SEQ ID NO: 2313091 - RNA, 17 nt, Human
caagcgugagccacugc

SEQ ID NO: 2313092 - RNA, 18 nt, Human
caagcgugagccacugca

SEQ ID NO: 2313093 - RNA, 20 nt, Human
caaggaccccucaccuugca

SEQ ID NO: 2313094 - RNA, 17 nt, Human
caaggaccccucaccuu

SEQ ID NO: 2313095 - RNA, 15 nt, Human
caaggaccccucacc

SEQ ID NO: 2313096 - RNA, 14 nt, Human
caaggaccccucac

SEQ ID NO: 2313097 - RNA, 13 nt, Human
caaggaccccuca

SEQ ID NO: 2313098 - RNA, 22 nt, Human
caaggacccagccugagauggu

SEQ ID NO: 2313099 - RNA, 20 nt, Human
caaggacuacguuaagggaa

SEQ ID NO: 2313100 - RNA, 17 nt, Human
caaggauagaugcuggc

SEQ ID NO: 2313101 - RNA, 16 nt, Human
caaggauagaugcugg

SEQ ID NO: 2313102 - RNA, 15 nt, Human
caaggauagaugcug

SEQ ID NO: 2313103 - RNA, 17 nt, Human
caaggauagaaguauac

SEQ ID NO: 2313104 - RNA, 21 nt, Human
caaggacuacguuaagggaag

SEQ ID NO: 2313105 - RNA, 16 nt, Human
caaggagucagacauu

SEQ ID NO: 2313106 - RNA, 19 nt, Human
caaggaguuccaugaagac

SEQ ID NO: 2313107 - RNA, 21 nt, Human
caaggaguuccaugaagacca

SEQ ID NO: 2313108 - RNA, 13 nt, Human
caaggauccugag

SEQ ID NO: 2313109 - RNA, 23 nt, Human
caaggauagaugcuggcccaggg

SEQ ID NO: 2313110 - RNA, 22 nt, Human
caaggauagaugcuggcccagg

SEQ ID NO: 2313111 - RNA, 21 nt, Human
caaggauagaugcuggcccag

SEQ ID NO: 2313112 - RNA, 20 nt, Human
caaggauagaugcuggccca

SEQ ID NO: 2313113 - RNA, 19 nt, Human
caaggaugccccguccccc

SEQ ID NO: 2313114 - RNA, 21 nt, Human
caaggaugaucuaggaagacu

SEQ ID NO: 2313115 - RNA, 16 nt, Human
caagugauucuccugc

SEQ ID NO: 2313116 - RNA, 17 nt, Human
caagugauucuccugcc

SEQ ID NO: 2313117 - RNA, 19 nt, Human
caagugaaaaaggaggaag

SEQ ID NO: 2313118 - RNA, 22 nt, Human
caagugauucucaugccucagc

SEQ ID NO: 2313119 - RNA, 22 nt, Human
caagucucugcuggcccagcca

SEQ ID NO: 2313120 - RNA, 19 nt, Human
caagucucugcuggcccag

SEQ ID NO: 2313121 - RNA, 18 nt, Human
caagucucugcuggccca

SEQ ID NO: 2313122 - RNA, 17 nt, Human
caagucuccuuccccuu

SEQ ID NO: 2313123 - RNA, 14 nt, Human
caagucuccuuccc

SEQ ID NO: 2313124 - RNA, 18 nt, Human
caagucuaugaugcuguu

SEQ ID NO: 2313125 - RNA, 16 nt, Human
caagucuacagaguga

SEQ ID NO: 2313126 - RNA, 19 nt, Human
caagucuacagagugauag

SEQ ID NO: 2313127 - RNA, 20 nt, Human
caagucuaugaugcuguugc

SEQ ID NO: 2313128 - RNA, 21 nt, Human
caagucuaugaugcuguugcc

SEQ ID NO: 2313129 - RNA, 16 nt, Human
caagucucaguggcuu

SEQ ID NO: 2313130 - RNA, 23 nt, Human
caagucucaguggcuucaucugu

SEQ ID NO: 2313131 - RNA, 19 nt, Human
caagucuggaucugggacc

SEQ ID NO: 2313132 - RNA, 18 nt, Human
caagucuggaucugggac

SEQ ID NO: 2313133 - RNA, 13 nt, Human
caagucuggaucu

SEQ ID NO: 2313134 - RNA, 17 nt, Human
caagucugcaggugcac

SEQ ID NO: 2313135 - RNA, 23 nt, Human
caagucucugcuggcccagccaa

SEQ ID NO: 2313136 - RNA, 13 nt, Human
caagucugcagcc

SEQ ID NO: 2313137 - RNA, 12 nt, Human
caagucugcagg

SEQ ID NO: 2313138 - RNA, 15 nt, Human
caagucuucccugau

SEQ ID NO: 2313139 - RNA, 14 nt, Human
caagucuucccuga

SEQ ID NO: 2313140 - RNA, 22 nt, Human
caagugauucuccugccucagc

SEQ ID NO: 2313141 - RNA, 21 nt, Human
caagugauucuccugccucag

SEQ ID NO: 2313142 - RNA, 14 nt, Human
caagugauucuccu

SEQ ID NO: 2313143 - RNA, 15 nt, Human
caagugauugaaaau

SEQ ID NO: 2313144 - RNA, 19 nt, Human
caagugauugaaaauagua

SEQ ID NO: 2313145 - RNA, 13 nt, Human
caagugcaggcug

SEQ ID NO: 2313146 - RNA, 18 nt, Human
caagugauugggacagag

SEQ ID NO: 2313147 - RNA, 19 nt, Human
caagugauugggacagagg

SEQ ID NO: 2313148 - RNA, 17 nt, Human
caagugcaugcucucug

SEQ ID NO: 2313149 - RNA, 17 nt, Human
caagugggaucugucac

SEQ ID NO: 2313150 - RNA, 13 nt, Human
caagugggggcag

SEQ ID NO: 2313151 - RNA, 21 nt, Human
caaguggggcucgccaugccg

SEQ ID NO: 2313152 - RNA, 16 nt, Human
caaguggggcucgcca

SEQ ID NO: 2313153 - RNA, 17 nt, Human
caaguggggcucgccau

SEQ ID NO: 2313154 - RNA, 20 nt, Human
caagugcaggcuggcaccgc

SEQ ID NO: 2313155 - RNA, 14 nt, Human
caagugcaggcugg

SEQ ID NO: 2313156 - RNA, 20 nt, Human
caagugggaucugucacacc

SEQ ID NO: 2313157 - RNA, 22 nt, Human
caagugggaucugucacaccag

SEQ ID NO: 2313158 - RNA, 20 nt, Human
caagugggggcagagggcag

SEQ ID NO: 2313159 - RNA, 14 nt, Human
caagugggggcaga

SEQ ID NO: 2313160 - RNA, 15 nt, Human
caaguggggugcugg

SEQ ID NO: 2313161 - RNA, 17 nt, Human
caaguggggugcuggga

SEQ ID NO: 2313162 - RNA, 21 nt, Human
caaguggggugcugggaggag

SEQ ID NO: 2313163 - RNA, 18 nt, Human
caaguggggugcugggag

SEQ ID NO: 2313164 - RNA, 19 nt, Human
caaguggggugcugggagg

SEQ ID NO: 2313165 - RNA, 22 nt, Human
caagugugguagagugugccug

SEQ ID NO: 2313166 - RNA, 22 nt, Human
caaguggugguaacccuggugg

SEQ ID NO: 2313167 - RNA, 20 nt, Human
caaguggugguaacccuggu

SEQ ID NO: 2313168 - RNA, 19 nt, Human
caaguggugguaacccugg

SEQ ID NO: 2313169 - RNA, 18 nt, Human
caaguggugguaacccug

SEQ ID NO: 2313170 - RNA, 13 nt, Human
caaguggugccua

SEQ ID NO: 2313171 - RNA, 20 nt, Human
caagugguagcaagaaguga

SEQ ID NO: 2313172 - RNA, 24 nt, Human
caaggugggcugagcccuggcagg

SEQ ID NO: 2313173 - RNA, 23 nt, Human
caaggugggcugagcccuggcag

SEQ ID NO: 2313174 - RNA, 22 nt, Human
caagguggggggaucacaaggu

SEQ ID NO: 2313175 - RNA, 20 nt, Human
caagguggucugcucgggcc

SEQ ID NO: 2313176 - RNA, 23 nt, Human
caagguggucugcucgggcccag

SEQ ID NO: 2313177 - RNA, 21 nt, Human
caaggugggcugagcccuggc

SEQ ID NO: 2313178 - RNA, 20 nt, Human
caaggugggcugagcccugg

SEQ ID NO: 2313179 - RNA, 19 nt, Human
caaggugggcugagcccug

SEQ ID NO: 2313180 - RNA, 18 nt, Human
caaggugggcugagcccu

SEQ ID NO: 2313181 - RNA, 22 nt, Human
caaguccuuaccucuuccggag

SEQ ID NO: 2313182 - RNA, 15 nt, Human
caagucuacagagug

SEQ ID NO: 2313183 - RNA, 17 nt, Human
caagucgaugaacuauu

SEQ ID NO: 2313184 - RNA, 23 nt, Human
caaguccuuaccucuuccggaga

SEQ ID NO: 2313185 - RNA, 18 nt, Human
caaguccuuaccucuucc

SEQ ID NO: 2313186 - RNA, 15 nt, Human
caaguccuuaccucu

SEQ ID NO: 2313187 - RNA, 20 nt, Human
caaguccugaagaggcgggc

SEQ ID NO: 2313188 - RNA, 23 nt, Human
caaguccugaagaggcgggccag

SEQ ID NO: 2313189 - RNA, 15 nt, Human
caaguccugugaauu

SEQ ID NO: 2313190 - RNA, 17 nt, Human
caaguccugugaauuuc

SEQ ID NO: 2313191 - RNA, 18 nt, Human
caaguccugugaauuucu

SEQ ID NO: 2313192 - RNA, 17 nt, Human
caaggugggcugagccc

SEQ ID NO: 2313193 - RNA, 16 nt, Human
caaggugggcugagcc

SEQ ID NO: 2313194 - RNA, 12 nt, Human
caaggugggcug

SEQ ID NO: 2313195 - RNA, 22 nt, Human
caaggugggccuugcuaccuca

SEQ ID NO: 2313196 - RNA, 23 nt, Human
caaggugggaggauugcuugagc

SEQ ID NO: 2313197 - RNA, 12 nt, Human
caaggugggagg

SEQ ID NO: 2313198 - RNA, 17 nt, Human
caagguggccaaauuau

SEQ ID NO: 2313199 - RNA, 13 nt, Human
caaggugcucaca

SEQ ID NO: 2313200 - RNA, 19 nt, Human
caagguggccaaauuauuu

SEQ ID NO: 2313201 - RNA, 19 nt, Human
caagguggcuccagcacca

SEQ ID NO: 2313202 - RNA, 15 nt, Human
caaggauugcuacug

SEQ ID NO: 2313203 - RNA, 16 nt, Human
caagggccuggccuga

SEQ ID NO: 2313204 - RNA, 14 nt, Human
caagggcuccccac

SEQ ID NO: 2313205 - RNA, 17 nt, Human
caagggcuccccacugc

SEQ ID NO: 2313206 - RNA, 16 nt, Human
caagggcgcaagagua

SEQ ID NO: 2313207 - RNA, 23 nt, Human
caaggaguuccaugaagaccaca

SEQ ID NO: 2313208 - RNA, 19 nt, Human
caagggccuggccugagcu

SEQ ID NO: 2313209 - RNA, 22 nt, Human
caagggcuuacacguggaggaa

SEQ ID NO: 2313210 - RNA, 21 nt, Human
caagggcuuacacguggagga

SEQ ID NO: 2313211 - RNA, 19 nt, Human
caagggcuccccacugccu

SEQ ID NO: 2313212 - RNA, 18 nt, Human
caagggcuucugcacccu

SEQ ID NO: 2313213 - RNA, 19 nt, Human
caagggcuucugcacccuc

SEQ ID NO: 2313214 - RNA, 20 nt, Human
caagggcuucugcacccucc

SEQ ID NO: 2313215 - RNA, 21 nt, Human
caagggcuucugcacccucca

SEQ ID NO: 2313216 - RNA, 23 nt, Human
caagggcuucugcacccuccacc

SEQ ID NO: 2313217 - RNA, 20 nt, Human
caagggcuuuguuuugcaca

SEQ ID NO: 2313218 - RNA, 13 nt, Human
caaggucuggccu

SEQ ID NO: 2313219 - RNA, 15 nt, Human
caaggugcaaaucaa

SEQ ID NO: 2313220 - RNA, 14 nt, Human
caaggucuuugguu

SEQ ID NO: 2313221 - RNA, 23 nt, Human
caaggugaagaugggaacgcaga

SEQ ID NO: 2313222 - RNA, 18 nt, Human
caaggucuggccucaggu

SEQ ID NO: 2313223 - RNA, 16 nt, Human
caaggucuucagccau

SEQ ID NO: 2313224 - RNA, 23 nt, Human
cacauuaagccuuccacacucac

SEQ ID NO: 2313225 - RNA, 18 nt, Human
cacauuaauauuugcuga

SEQ ID NO: 2313226 - RNA, 19 nt, Human
cacauuaauauuugcugac

SEQ ID NO: 2313227 - RNA, 20 nt, Human
cacauuaucgggagcagugu

SEQ ID NO: 2313228 - RNA, 17 nt, Human
cacauuaucgggagcag

SEQ ID NO: 2313229 - RNA, 16 nt, Human
cacauuaucgggagca

SEQ ID NO: 2313230 - RNA, 15 nt, Human
cacauguuuucucug

SEQ ID NO: 2313231 - RNA, 22 nt, Human
cacauuaucgggagcagugucu

SEQ ID NO: 2313232 - RNA, 23 nt, Human
cacauuaucgggagcagugucuu

SEQ ID NO: 2313233 - RNA, 14 nt, Human
cacauuauuugcau

SEQ ID NO: 2313234 - RNA, 13 nt, Human
cacauuauuugca

SEQ ID NO: 2313235 - RNA, 17 nt, Human
cacauucaacccuggag

SEQ ID NO: 2313236 - RNA, 16 nt, Human
cacauucaauaagcau

SEQ ID NO: 2313237 - RNA, 20 nt, Human
cacauucaacccuggagagu

SEQ ID NO: 2313238 - RNA, 15 nt, Human
cacauuauuugcaug

SEQ ID NO: 2313239 - RNA, 19 nt, Human
cacauucaacccuggagag

SEQ ID NO: 2313240 - RNA, 12 nt, Human
cacauucaggaa

SEQ ID NO: 2313241 - RNA, 14 nt, Human
cacauucaggaaga

SEQ ID NO: 2313242 - RNA, 16 nt, Human
cacauuccugaugcuu

SEQ ID NO: 2313243 - RNA, 17 nt, Human
cacauucaggaagauga

SEQ ID NO: 2313244 - RNA, 18 nt, Human
cacauuccuugccugcac

SEQ ID NO: 2313245 - RNA, 19 nt, Human
cacauuccuugccugcaca

SEQ ID NO: 2313246 - RNA, 16 nt, Human
cacauucggcucccug

SEQ ID NO: 2313247 - RNA, 14 nt, Human
cacaugugcacaug

SEQ ID NO: 2313248 - RNA, 15 nt, Human
cacaugugcacaugc

SEQ ID NO: 2313249 - RNA, 15 nt, Human
cacaugucuuguaca

SEQ ID NO: 2313250 - RNA, 23 nt, Human
cacaugucuuaaugaaguuugaa

SEQ ID NO: 2313251 - RNA, 20 nt, Human
cacaugucuuguacaugugu

SEQ ID NO: 2313252 - RNA, 13 nt, Human
cacaugugacaca

SEQ ID NO: 2313253 - RNA, 16 nt, Human
cacaugucuuaaugaa

SEQ ID NO: 2313254 - RNA, 17 nt, Human
cacaugucuuaaugaag

SEQ ID NO: 2313255 - RNA, 18 nt, Human
cacaugucuuaaugaagu

SEQ ID NO: 2313256 - RNA, 22 nt, Human
cacaugucuuaaugaaguuuga

SEQ ID NO: 2313257 - RNA, 17 nt, Human
cacaugugcacaugcac

SEQ ID NO: 2313258 - RNA, 13 nt, Human
cacauguggacuu

SEQ ID NO: 2313259 - RNA, 15 nt, Human
cacaugugacacaua

SEQ ID NO: 2313260 - RNA, 11 nt, Human
cacaugugugc

SEQ ID NO: 2313261 - RNA, 12 nt, Human
cacauguuuccu

SEQ ID NO: 2313262 - RNA, 18 nt, Human
cacauguuuagaguugca

SEQ ID NO: 2313263 - RNA, 21 nt, Human
cacauguuuagaguugcaauc

SEQ ID NO: 2313264 - RNA, 14 nt, Human
cacauguuuccucu

SEQ ID NO: 2313265 - RNA, 15 nt, Human
cacauguuuccucua

SEQ ID NO: 2313266 - RNA, 18 nt, Human
cacauggcuauguuuuag

SEQ ID NO: 2313267 - RNA, 15 nt, Human
cacauggccuaugca

SEQ ID NO: 2313268 - RNA, 23 nt, Human
cacauggccccucccccugccag

SEQ ID NO: 2313269 - RNA, 19 nt, Human
cacaucacccuuaccaugu

SEQ ID NO: 2313270 - RNA, 15 nt, Human
cacaucagaaaggaa

SEQ ID NO: 2313271 - RNA, 12 nt, Human
cacauggcuucc

SEQ ID NO: 2313272 - RNA, 14 nt, Human
cacauggcuuccuc

SEQ ID NO: 2313273 - RNA, 18 nt, Human
cacauggcuuccuccugc

SEQ ID NO: 2313274 - RNA, 20 nt, Human
cacauggcuuccuccugcgc

SEQ ID NO: 2313275 - RNA, 19 nt, Human
cacauggcuuccuccugcg

SEQ ID NO: 2313276 - RNA, 19 nt, Human
cacauggggcugggcagcu

SEQ ID NO: 2313277 - RNA, 13 nt, Human
cacaucaaagagg

SEQ ID NO: 2313278 - RNA, 19 nt, Human
cacaugccucucucaggcc

SEQ ID NO: 2313279 - RNA, 20 nt, Human
cacauggggcugggcagcua

SEQ ID NO: 2313280 - RNA, 22 nt, Human
cacauggugacuuuugaaaaga

SEQ ID NO: 2313281 - RNA, 20 nt, Human
cacauggugcuacgccugca

SEQ ID NO: 2313282 - RNA, 22 nt, Human
cacauggugcuacgccugcaug

SEQ ID NO: 2313283 - RNA, 17 nt, Human
cacauguaucuaugcau

SEQ ID NO: 2313284 - RNA, 23 nt, Human
cacauguccaagaagcccaggaa

SEQ ID NO: 2313285 - RNA, 14 nt, Human
cacauguauguuuu

SEQ ID NO: 2313286 - RNA, 17 nt, Human
cacauguccuugugugu

SEQ ID NO: 2313287 - RNA, 12 nt, Human
cacaugucuuaa

SEQ ID NO: 2313288 - RNA, 13 nt, Human
cacaugucuuaau

SEQ ID NO: 2313289 - RNA, 14 nt, Human
cacaugucuuaaug

SEQ ID NO: 2313290 - RNA, 15 nt, Human
cacaugucuuaauga

SEQ ID NO: 2313291 - RNA, 12 nt, Human
cacauaucuguc

SEQ ID NO: 2313292 - RNA, 15 nt, Human
cacauauuugauagu

SEQ ID NO: 2313293 - RNA, 18 nt, Human
cacaucagcacgauuucu

SEQ ID NO: 2313294 - RNA, 19 nt, Human
cacaucagcacgauuucug

SEQ ID NO: 2313295 - RNA, 13 nt, Human
cacaugccucucu

SEQ ID NO: 2313296 - RNA, 17 nt, Human
cacaugccucucucagg

SEQ ID NO: 2313297 - RNA, 18 nt, Human
cacaugccucucucaggc

SEQ ID NO: 2313298 - RNA, 20 nt, Human
caccacuaggacucugaggc

SEQ ID NO: 2313299 - RNA, 17 nt, Human
caccacgguagugccug

SEQ ID NO: 2313300 - RNA, 15 nt, Human
caccacguccagcug

SEQ ID NO: 2313301 - RNA, 15 nt, Human
caccacgguggucac

SEQ ID NO: 2313302 - RNA, 20 nt, Human
caccacuacauucuguuaau

SEQ ID NO: 2313303 - RNA, 19 nt, Human
caccacuacauucuguuaa

SEQ ID NO: 2313304 - RNA, 18 nt, Human
caccacuacauucuguua

SEQ ID NO: 2313305 - RNA, 17 nt, Human
caccacuacauucuguu

SEQ ID NO: 2313306 - RNA, 16 nt, Human
caccacuacauucugu

SEQ ID NO: 2313307 - RNA, 14 nt, Human
caccaccucuuugg

SEQ ID NO: 2313308 - RNA, 19 nt, Human
caccacaugugcacaugca

SEQ ID NO: 2313309 - RNA, 14 nt, Human
caccacaucuaagc

SEQ ID NO: 2313310 - RNA, 13 nt, Human
caccaccaagcca

SEQ ID NO: 2313311 - RNA, 18 nt, Human
caccaccacgguggucac

SEQ ID NO: 2313312 - RNA, 13 nt, Human
caccaccacuggc

SEQ ID NO: 2313313 - RNA, 15 nt, Human
caccaccacuggcca

SEQ ID NO: 2313314 - RNA, 15 nt, Human
caccacaugugcaca

SEQ ID NO: 2313315 - RNA, 18 nt, Human
caccacaugugcacaugc

SEQ ID NO: 2313316 - RNA, 21 nt, Human
caccaccccagcugcuccccu

SEQ ID NO: 2313317 - RNA, 14 nt, Human
caccaccccccacu

SEQ ID NO: 2313318 - RNA, 15 nt, Human
caccaccccccacuc

SEQ ID NO: 2313319 - RNA, 16 nt, Human
caccaccccccacucu

SEQ ID NO: 2313320 - RNA, 18 nt, Human
caccaccccccacucugu

SEQ ID NO: 2313321 - RNA, 20 nt, Human
caccaccccccacucugugc

SEQ ID NO: 2313322 - RNA, 22 nt, Human
caccaccccccacucugugccu

SEQ ID NO: 2313323 - RNA, 14 nt, Human
caccaccccagcug

SEQ ID NO: 2313324 - RNA, 23 nt, Human
caccaccacuggccaccaggcug

SEQ ID NO: 2313325 - RNA, 16 nt, Human
caccaccacuggccac

SEQ ID NO: 2313326 - RNA, 18 nt, Human
caccaccacuggccacca

SEQ ID NO: 2313327 - RNA, 11 nt, Human
caccacccaaa

SEQ ID NO: 2313328 - RNA, 12 nt, Human
caccaccucucc

SEQ ID NO: 2313329 - RNA, 13 nt, Human
caccaccucccuc

SEQ ID NO: 2313330 - RNA, 14 nt, Human
caccaccucccuca

SEQ ID NO: 2313331 - RNA, 17 nt, Human
caccaccucacuccugu

SEQ ID NO: 2313332 - RNA, 18 nt, Human
caccaccucacuccuguu

SEQ ID NO: 2313333 - RNA, 13 nt, Human
caccaccucagag

SEQ ID NO: 2313334 - RNA, 14 nt, Human
caccaccucagagu

SEQ ID NO: 2313335 - RNA, 23 nt, Human
caccaccuaggccacuccuccaa

SEQ ID NO: 2313336 - RNA, 16 nt, Human
caccaccucacuccug

SEQ ID NO: 2313337 - RNA, 22 nt, Human
caccaccuaggccacuccucca

SEQ ID NO: 2313338 - RNA, 22 nt, Human
caccacccuagucccuuccccu

SEQ ID NO: 2313339 - RNA, 23 nt, Human
caccacccgcuuucuugcugguu

SEQ ID NO: 2313340 - RNA, 19 nt, Human
caccaagcucacaguuccu

SEQ ID NO: 2313341 - RNA, 15 nt, Human
caccaagcucacagu

SEQ ID NO: 2313342 - RNA, 14 nt, Human
caccaagcucacag

SEQ ID NO: 2313343 - RNA, 16 nt, Human
caccaagcucaaagcg

SEQ ID NO: 2313344 - RNA, 13 nt, Human
caccaagcucaaa

SEQ ID NO: 2313345 - RNA, 23 nt, Human
cacauugggcagcgcccuuccuc

SEQ ID NO: 2313346 - RNA, 22 nt, Human
caccaagccuggucagcccaaa

SEQ ID NO: 2313347 - RNA, 13 nt, Human
caccacacccagc

SEQ ID NO: 2313348 - RNA, 15 nt, Human
caccacacccagccc

SEQ ID NO: 2313349 - RNA, 21 nt, Human
caccacauccuccguccagcc

SEQ ID NO: 2313350 - RNA, 18 nt, Human
caccacauccuccgucca

SEQ ID NO: 2313351 - RNA, 13 nt, Human
caccacagcaggu

SEQ ID NO: 2313352 - RNA, 21 nt, Human
caccacaggcccuuuccucag

SEQ ID NO: 2313353 - RNA, 23 nt, Human
caccacaggcccuuuccucaggc

SEQ ID NO: 2313354 - RNA, 17 nt, Human
caccacaguaaguuccu

SEQ ID NO: 2313355 - RNA, 13 nt, Human
caccacagccagc

SEQ ID NO: 2313356 - RNA, 20 nt, Human
caccacagacacacacacgc

SEQ ID NO: 2313357 - RNA, 21 nt, Human
caccacagacacacacacgca

SEQ ID NO: 2313358 - RNA, 17 nt, Human
caccacagccagcaccu

SEQ ID NO: 2313359 - RNA, 19 nt, Human
caccacagccagcaccugg

SEQ ID NO: 2313360 - RNA, 20 nt, Human
caccaagcucacaguuccuc

SEQ ID NO: 2313361 - RNA, 14 nt, Human
caccacacccagcc

SEQ ID NO: 2313362 - RNA, 16 nt, Human
caccacagacacacac

SEQ ID NO: 2313363 - RNA, 19 nt, Human
caccacagacacacacacg

SEQ ID NO: 2313364 - RNA, 17 nt, Human
caccacacccagcccac

SEQ ID NO: 2313365 - RNA, 19 nt, Human
caccaagccuggucagccc

SEQ ID NO: 2313366 - RNA, 21 nt, Human
caccaagccuggucagcccaa

SEQ ID NO: 2313367 - RNA, 20 nt, Human
caccaagccuggucagccca

SEQ ID NO: 2313368 - RNA, 18 nt, Human
cacauugggcagcgcccu

SEQ ID NO: 2313369 - RNA, 22 nt, Human
cacauugggcagcgcccuuccu

SEQ ID NO: 2313370 - RNA, 15 nt, Human
caccaagcccaguua

SEQ ID NO: 2313371 - RNA, 18 nt, Human
cacauuggagauguuuag

SEQ ID NO: 2313372 - RNA, 19 nt, Human
cacauucuuauaaauauga

SEQ ID NO: 2313373 - RNA, 17 nt, Human
cacauucuuauaaauau

SEQ ID NO: 2313374 - RNA, 18 nt, Human
cacauucuuauaaauaug

SEQ ID NO: 2313375 - RNA, 17 nt, Human
cacauucggcucccugg

SEQ ID NO: 2313376 - RNA, 21 nt, Human
cacauucggcucccuggagcc

SEQ ID NO: 2313377 - RNA, 16 nt, Human
cacauucuggcucagg

SEQ ID NO: 2313378 - RNA, 20 nt, Human
cacauucuggcucagggagg

SEQ ID NO: 2313379 - RNA, 21 nt, Human
cacauucuggcucagggaggu

SEQ ID NO: 2313380 - RNA, 22 nt, Human
cacauucuuaacacauguccuu

SEQ ID NO: 2313381 - RNA, 15 nt, Human
cacauucuuauaaau

SEQ ID NO: 2313382 - RNA, 16 nt, Human
cacauucuuauaaaua

SEQ ID NO: 2313383 - RNA, 23 nt, Human
cacauucuuauaaauaugaagcu

SEQ ID NO: 2313384 - RNA, 16 nt, Human
caccaccccagcugcu

SEQ ID NO: 2313385 - RNA, 14 nt, Human
cacauaauuuuucu

SEQ ID NO: 2313386 - RNA, 15 nt, Human
cacauacacacauau

SEQ ID NO: 2313387 - RNA, 17 nt, Human
cacauacacacacacgc

SEQ ID NO: 2313388 - RNA, 21 nt, Human
cacauagugaugguuccccug

SEQ ID NO: 2313389 - RNA, 21 nt, Human
cacauauaaacaucacacaca

SEQ ID NO: 2313390 - RNA, 22 nt, Human
cacauaguuuuuaagguuauuu

SEQ ID NO: 2313391 - RNA, 12 nt, Human
cacaguuugaac

SEQ ID NO: 2313392 - RNA, 22 nt, Human
cacauaauucaggaagcagcuu

SEQ ID NO: 2313393 - RNA, 19 nt, Human
cacauaagcucagaaucca

SEQ ID NO: 2313394 - RNA, 18 nt, Human
cacauaauuaaagugucc

SEQ ID NO: 2313395 - RNA, 22 nt, Human
cacauaauuaaaguguccauug

SEQ ID NO: 2313396 - RNA, 14 nt, Human
cacaguuuucugag

SEQ ID NO: 2313397 - RNA, 15 nt, Human
cacaguuuucugaga

SEQ ID NO: 2313398 - RNA, 21 nt, Human
cacaguuuccucaucugucca

SEQ ID NO: 2313399 - RNA, 22 nt, Human
cacaguuggcuggaugaaauuu

SEQ ID NO: 2313400 - RNA, 19 nt, Human
cacagugagucgaggacag

SEQ ID NO: 2313401 - RNA, 20 nt, Human
cacagugagucgaggacagg

SEQ ID NO: 2313402 - RNA, 13 nt, Human
cacaggcccuccc

SEQ ID NO: 2313403 - RNA, 23 nt, Human
cacaguucuuugggccagacaug

SEQ ID NO: 2313404 - RNA, 12 nt, Human
cacaguuggccu

SEQ ID NO: 2313405 - RNA, 15 nt, Human
cacaguuggccuuca

SEQ ID NO: 2313406 - RNA, 23 nt, Human
cacaguuggccuucagaaccauc

SEQ ID NO: 2313407 - RNA, 17 nt, Human
cacaguuggcuggauga

SEQ ID NO: 2313408 - RNA, 18 nt, Human
cacagugagucgaggaca

SEQ ID NO: 2313409 - RNA, 20 nt, Human
cacaggcccggcuccaggcu

SEQ ID NO: 2313410 - RNA, 23 nt, Human
cacaggcccggcuccaggcuccu

SEQ ID NO: 2313411 - RNA, 15 nt, Human
cacaggcagcauuua

SEQ ID NO: 2313412 - RNA, 14 nt, Human
cacaggcagcauuu

SEQ ID NO: 2313413 - RNA, 23 nt, Human
cacaggcaacugaggcagacagc

SEQ ID NO: 2313414 - RNA, 22 nt, Human
cacaggcaacugaggcagacag

SEQ ID NO: 2313415 - RNA, 10 nt, Human
cacaggcagg

SEQ ID NO: 2313416 - RNA, 11 nt, Human
cacaggcagcu

SEQ ID NO: 2313417 - RNA, 16 nt, Human
cacaggcagcuggaug

SEQ ID NO: 2313418 - RNA, 21 nt, Human
cacaggcagcuggaugagacu

SEQ ID NO: 2313419 - RNA, 12 nt, Human
cacaggcagcuu

SEQ ID NO: 2313420 - RNA, 16 nt, Human
cacaggcccggcucca

SEQ ID NO: 2313421 - RNA, 17 nt, Human
cacaggcccggcuccag

SEQ ID NO: 2313422 - RNA, 18 nt, Human
cacaggcccggcuccagg

SEQ ID NO: 2313423 - RNA, 19 nt, Human
cacaggcccggcuccaggc

SEQ ID NO: 2313424 - RNA, 12 nt, Human
cacaggaucagu

SEQ ID NO: 2313425 - RNA, 22 nt, Human
cacaggaagccugcaguccugg

SEQ ID NO: 2313426 - RNA, 10 nt, Human
cacagccucu

SEQ ID NO: 2313427 - RNA, 19 nt, Human
cacagccuccucugucugc

SEQ ID NO: 2313428 - RNA, 20 nt, Human
cacagccuccucugucugcc

SEQ ID NO: 2313429 - RNA, 21 nt, Human
cacagccuccucugucugccc

SEQ ID NO: 2313430 - RNA, 23 nt, Human
cacagccuccucugucugcccuu

SEQ ID NO: 2313431 - RNA, 15 nt, Human
cacaggaucagucug

SEQ ID NO: 2313432 - RNA, 16 nt, Human
cacaggaucagucuga

SEQ ID NO: 2313433 - RNA, 15 nt, Human
cacaggaaguagagg

SEQ ID NO: 2313434 - RNA, 20 nt, Human
cacaggaaccacaagacugc

SEQ ID NO: 2313435 - RNA, 23 nt, Human
cacagccuccccugccagggcag

SEQ ID NO: 2313436 - RNA, 14 nt, Human
cacagccuccucug

SEQ ID NO: 2313437 - RNA, 15 nt, Human
cacagccuccucugu

SEQ ID NO: 2313438 - RNA, 21 nt, Human
cacagccuccccugccagggc

SEQ ID NO: 2313439 - RNA, 20 nt, Human
cacagccuccccugccaggg

SEQ ID NO: 2313440 - RNA, 19 nt, Human
cacaggaaccacaagacug

SEQ ID NO: 2313441 - RNA, 22 nt, Human
cacagccgcagccucccucuga

SEQ ID NO: 2313442 - RNA, 21 nt, Human
cacagccgcagccucccucug

SEQ ID NO: 2313443 - RNA, 23 nt, Human
cacagccgcagccucccucugac

SEQ ID NO: 2313444 - RNA, 14 nt, Human
cacagccuccccug

SEQ ID NO: 2313445 - RNA, 19 nt, Human
cacagccuccccugccagg

SEQ ID NO: 2313446 - RNA, 17 nt, Human
cacagccuccccugcca

SEQ ID NO: 2313447 - RNA, 14 nt, Human
cacagccgcagccu

SEQ ID NO: 2313448 - RNA, 15 nt, Human
cacagccacacacac

SEQ ID NO: 2313449 - RNA, 14 nt, Human
cacagccaaggacu

SEQ ID NO: 2313450 - RNA, 14 nt, Human
cacagccacacaca

SEQ ID NO: 2313451 - RNA, 13 nt, Human
cacagccacacac

SEQ ID NO: 2313452 - RNA, 22 nt, Human
cacagccaacacgcaccugccu

SEQ ID NO: 2313453 - RNA, 10 nt, Human
cacagccaca

SEQ ID NO: 2313454 - RNA, 12 nt, Human
cacagccacaca

SEQ ID NO: 2313455 - RNA, 11 nt, Human
cacagccacac

SEQ ID NO: 2313456 - RNA, 16 nt, Human
cacagcagcugaacag

SEQ ID NO: 2313457 - RNA, 19 nt, Human
cacagcagcugaacagcca

SEQ ID NO: 2313458 - RNA, 13 nt, Human
cacagcagcuuca

SEQ ID NO: 2313459 - RNA, 14 nt, Human
cacagcagccuggg

SEQ ID NO: 2313460 - RNA, 18 nt, Human
cacagcagcaucuucaaa

SEQ ID NO: 2313461 - RNA, 22 nt, Human
cacagcaguugaaaagacucca

SEQ ID NO: 2313462 - RNA, 13 nt, Human
cacagcaugugua

SEQ ID NO: 2313463 - RNA, 23 nt, Human
cacagcaucauuuugcauucaaa

SEQ ID NO: 2313464 - RNA, 15 nt, Human
cacagcagcuucacc

SEQ ID NO: 2313465 - RNA, 18 nt, Human
cacagcagcuucaccaga

SEQ ID NO: 2313466 - RNA, 19 nt, Human
cacagcagcuucaccagag

SEQ ID NO: 2313467 - RNA, 20 nt, Human
cacagcaucauuuugcauuc

SEQ ID NO: 2313468 - RNA, 22 nt, Human
cacagaguggucuuucuggaga

SEQ ID NO: 2313469 - RNA, 21 nt, Human
cacagagcaggacugcacagc

SEQ ID NO: 2313470 - RNA, 13 nt, Human
cacagagcgggga

SEQ ID NO: 2313471 - RNA, 19 nt, Human
cacagauggauuugccugu

SEQ ID NO: 2313472 - RNA, 20 nt, Human
cacagaguuguuacauuuuu

SEQ ID NO: 2313473 - RNA, 14 nt, Human
cacagaugggugcu

SEQ ID NO: 2313474 - RNA, 18 nt, Human
cacagaugggugcuugga

SEQ ID NO: 2313475 - RNA, 23 nt, Human
cacagauggauuugccugugcca

SEQ ID NO: 2313476 - RNA, 20 nt, Human
cacagauggauuugccugug

SEQ ID NO: 2313477 - RNA, 14 nt, Human
cacagagcggggac

SEQ ID NO: 2313478 - RNA, 19 nt, Human
cacagagugugcuggagga

SEQ ID NO: 2313479 - RNA, 20 nt, Human
cacagaugggugcuuggagg

SEQ ID NO: 2313480 - RNA, 16 nt, Human
cacagcagccccugca

SEQ ID NO: 2313481 - RNA, 12 nt, Human
cacagcagccug

SEQ ID NO: 2313482 - RNA, 20 nt, Human
cacagcacgggggccaagga

SEQ ID NO: 2313483 - RNA, 22 nt, Human
cacaccuguaaucccagcacuu

SEQ ID NO: 2313484 - RNA, 16 nt, Human
cacaccugacucugaa

SEQ ID NO: 2313485 - RNA, 11 nt, Human
cacaccugagc

SEQ ID NO: 2313486 - RNA, 20 nt, Human
cacaccgagggcgaccccgu

SEQ ID NO: 2313487 - RNA, 12 nt, Human
cacaccucugcc

SEQ ID NO: 2313488 - RNA, 13 nt, Human
cacaccucugcca

SEQ ID NO: 2313489 - RNA, 14 nt, Human
cacaccucugccag

SEQ ID NO: 2313490 - RNA, 15 nt, Human
cacacgcacacacac

SEQ ID NO: 2313491 - RNA, 20 nt, Human
cacaccuguagucccagcua

SEQ ID NO: 2313492 - RNA, 14 nt, Human
cacacgcacacaca

SEQ ID NO: 2313493 - RNA, 23 nt, Human
cacaccuuuuauugacacagaaa

SEQ ID NO: 2313494 - RNA, 19 nt, Human
cacaccuguagucccagcu

SEQ ID NO: 2313495 - RNA, 16 nt, Human
cacaccuguaguccca

SEQ ID NO: 2313496 - RNA, 22 nt, Human
cacaccuuuuauugacacagaa

SEQ ID NO: 2313497 - RNA, 17 nt, Human
cacaccugagccagccu

SEQ ID NO: 2313498 - RNA, 16 nt, Human
cacaccuguagcacuu

SEQ ID NO: 2313499 - RNA, 17 nt, Human
cacaccgggcacucaga

SEQ ID NO: 2313500 - RNA, 17 nt, Human
cacacccucucccagga

SEQ ID NO: 2313501 - RNA, 21 nt, Human
cacacccucccccgccacucc

SEQ ID NO: 2313502 - RNA, 21 nt, Human
cacacccuguacuguucugug

SEQ ID NO: 2313503 - RNA, 14 nt, Human
cacacccuguuuua

SEQ ID NO: 2313504 - RNA, 18 nt, Human
cacacccucucccaggac

SEQ ID NO: 2313505 - RNA, 13 nt, Human
cacacccccaccc

SEQ ID NO: 2313506 - RNA, 23 nt, Human
cacacccccaccccuugcucuca

SEQ ID NO: 2313507 - RNA, 21 nt, Human
cacaccaggcuugccugcagg

SEQ ID NO: 2313508 - RNA, 22 nt, Human
cacaccaggcuugccugcaggc

SEQ ID NO: 2313509 - RNA, 22 nt, Human
cacaccaggcugugggccucaa

SEQ ID NO: 2313510 - RNA, 13 nt, Human
cacacccagccca

SEQ ID NO: 2313511 - RNA, 16 nt, Human
cacacccacucagcuc

SEQ ID NO: 2313512 - RNA, 22 nt, Human
cacacccaccguccgcccugcu

SEQ ID NO: 2313513 - RNA, 15 nt, Human
cacacccacucagcu

SEQ ID NO: 2313514 - RNA, 14 nt, Human
cacacccacucagc

SEQ ID NO: 2313515 - RNA, 14 nt, Human
cacacccaccgucc

SEQ ID NO: 2313516 - RNA, 21 nt, Human
cacacccaccguccgcccugc

SEQ ID NO: 2313517 - RNA, 21 nt, Human
cacaccaggcugugggccuca

SEQ ID NO: 2313518 - RNA, 16 nt, Human
cacaccacaucuaagc

SEQ ID NO: 2313519 - RNA, 13 nt, Human
cacacagcuccca

SEQ ID NO: 2313520 - RNA, 15 nt, Human
cacaccagagcccac

SEQ ID NO: 2313521 - RNA, 12 nt, Human
cacaccagagcc

SEQ ID NO: 2313522 - RNA, 13 nt, Human
cacaccagagccc

SEQ ID NO: 2313523 - RNA, 14 nt, Human
cacaaccugaaccu

SEQ ID NO: 2313524 - RNA, 14 nt, Human
cacaacgugcauug

SEQ ID NO: 2313525 - RNA, 17 nt, Human
cacaacgugcauugugc

SEQ ID NO: 2313526 - RNA, 19 nt, Human
cacaacgugcauugugcuu

SEQ ID NO: 2313527 - RNA, 13 nt, Human
cacaacuauauug

SEQ ID NO: 2313528 - RNA, 12 nt, Human
cacacacaggag

SEQ ID NO: 2313529 - RNA, 15 nt, Human
cacacacagcugggc

SEQ ID NO: 2313530 - RNA, 13 nt, Human
cacacacaggagc

SEQ ID NO: 2313531 - RNA, 17 nt, Human
cacaacccuguuuuaua

SEQ ID NO: 2313532 - RNA, 14 nt, Human
cacaacuauuuuuc

SEQ ID NO: 2313533 - RNA, 19 nt, Human
cacaacuauuuuuccaaaa

SEQ ID NO: 2313534 - RNA, 21 nt, Human
cacacacaggcaacugaggca

SEQ ID NO: 2313535 - RNA, 13 nt, Human
cacacacaggcaa

SEQ ID NO: 2313536 - RNA, 15 nt, Human
cacacacaggagcau

SEQ ID NO: 2313537 - RNA, 19 nt, Human
cacacacauacacacauau

SEQ ID NO: 2313538 - RNA, 18 nt, Human
cacacacaugcauacaca

SEQ ID NO: 2313539 - RNA, 17 nt, Human
cacacacaugcauacac

SEQ ID NO: 2313540 - RNA, 16 nt, Human
cacacacaugcauaca

SEQ ID NO: 2313541 - RNA, 12 nt, Human
cacacacaugca

SEQ ID NO: 2313542 - RNA, 14 nt, Human
cacacaccagagcc

SEQ ID NO: 2313543 - RNA, 20 nt, Human
cacacagaaaauauacugua

SEQ ID NO: 2313544 - RNA, 23 nt, Human
cacacagaaaauauacuguaaag

SEQ ID NO: 2313545 - RNA, 22 nt, Human
cacacagaaaauauacuguaaa

SEQ ID NO: 2313546 - RNA, 21 nt, Human
cacacagaaaauauacuguaa

SEQ ID NO: 2313547 - RNA, 15 nt, Human
cacacagaaacucuu

SEQ ID NO: 2313548 - RNA, 12 nt, Human
cacacagaggaa

SEQ ID NO: 2313549 - RNA, 22 nt, Human
cacacagaggaagagcaggcac

SEQ ID NO: 2313550 - RNA, 18 nt, Human
cacacagaggaagagcag

SEQ ID NO: 2313551 - RNA, 11 nt, Human
cacacagccac

SEQ ID NO: 2313552 - RNA, 19 nt, Human
cacacagaggcugccucuc

SEQ ID NO: 2313553 - RNA, 12 nt, Human
cacacagcucug

SEQ ID NO: 2313554 - RNA, 22 nt, Human
cacacagccacacacacagaaa

SEQ ID NO: 2313555 - RNA, 21 nt, Human
cacacagccacacacacagaa

SEQ ID NO: 2313556 - RNA, 14 nt, Human
cacacagccaggug

SEQ ID NO: 2313557 - RNA, 15 nt, Human
cacacagccaggugc

SEQ ID NO: 2313558 - RNA, 19 nt, Human
cacacagccaggugccuug

SEQ ID NO: 2313559 - RNA, 21 nt, Human
cacacagccaggugccuugga

SEQ ID NO: 2313560 - RNA, 20 nt, Human
cacacagccacacacacaga

SEQ ID NO: 2313561 - RNA, 19 nt, Human
cacacagccacacacacag

SEQ ID NO: 2313562 - RNA, 17 nt, Human
cacacagccacacacac

SEQ ID NO: 2313563 - RNA, 16 nt, Human
cacacagccacacaca

SEQ ID NO: 2313564 - RNA, 15 nt, Human
cacacagccacacac

SEQ ID NO: 2313565 - RNA, 14 nt, Human
cacacagccacaca

SEQ ID NO: 2313566 - RNA, 13 nt, Human
cacacagccacac

SEQ ID NO: 2313567 - RNA, 12 nt, Human
cacacagccaca

SEQ ID NO: 2313568 - RNA, 14 nt, Human
cacacucauccccu

SEQ ID NO: 2313569 - RNA, 14 nt, Human
cacacugaggcagg

SEQ ID NO: 2313570 - RNA, 13 nt, Human
cacacugaggcag

SEQ ID NO: 2313571 - RNA, 12 nt, Human
cacacucacugc

SEQ ID NO: 2313572 - RNA, 18 nt, Human
cacacugaggcagggaag

SEQ ID NO: 2313573 - RNA, 17 nt, Human
cacacugaggcagggaa

SEQ ID NO: 2313574 - RNA, 16 nt, Human
cacacugaggcaggga

SEQ ID NO: 2313575 - RNA, 15 nt, Human
cacacugaggcaggg

SEQ ID NO: 2313576 - RNA, 18 nt, Human
cacacugaugcuuagaug

SEQ ID NO: 2313577 - RNA, 14 nt, Human
cacacugaugcuua

SEQ ID NO: 2313578 - RNA, 13 nt, Human
cacacuggacucc

SEQ ID NO: 2313579 - RNA, 19 nt, Human
cacacuggacuccggcccu

SEQ ID NO: 2313580 - RNA, 20 nt, Human
cacacuggacuccggcccuc

SEQ ID NO: 2313581 - RNA, 18 nt, Human
cacacugcaagagccuug

SEQ ID NO: 2313582 - RNA, 17 nt, Human
cacacugcaagagccuu

SEQ ID NO: 2313583 - RNA, 16 nt, Human
cacacugcaagagccu

SEQ ID NO: 2313584 - RNA, 20 nt, Human
cacacugcaagagccuuggu

SEQ ID NO: 2313585 - RNA, 19 nt, Human
cacacugcaagagccuugg

SEQ ID NO: 2313586 - RNA, 21 nt, Human
cacacugcaagagccuuggug

SEQ ID NO: 2313587 - RNA, 19 nt, Human
cacacuagccucuccagga

SEQ ID NO: 2313588 - RNA, 18 nt, Human
cacacuagccucuccagg

SEQ ID NO: 2313589 - RNA, 17 nt, Human
cacacuagccucuccag

SEQ ID NO: 2313590 - RNA, 19 nt, Human
cacacucaaaucaagaaac

SEQ ID NO: 2313591 - RNA, 14 nt, Human
cacacugaagaagc

SEQ ID NO: 2313592 - RNA, 17 nt, Human
cacacuauuaccaugag

SEQ ID NO: 2313593 - RNA, 18 nt, Human
cacacuauuaccaugaga

SEQ ID NO: 2313594 - RNA, 20 nt, Human
cacacuauuaccaugagaag

SEQ ID NO: 2313595 - RNA, 19 nt, Human
cacacuauuaccaugagaa

SEQ ID NO: 2313596 - RNA, 17 nt, Human
cacacucacuccugaga

SEQ ID NO: 2313597 - RNA, 18 nt, Human
cacacucacuccugagac

SEQ ID NO: 2313598 - RNA, 19 nt, Human
cacacucacuccugagacc

SEQ ID NO: 2313599 - RNA, 23 nt, Human
cacacuguagcauuacagugggu

SEQ ID NO: 2313600 - RNA, 14 nt, Human
cacacugugcuuuc

SEQ ID NO: 2313601 - RNA, 15 nt, Human
cacacugugcuuucu

SEQ ID NO: 2313602 - RNA, 16 nt, Human
cacacugugcuuucua

SEQ ID NO: 2313603 - RNA, 20 nt, Human
cacacugugcuuucuauugu

SEQ ID NO: 2313604 - RNA, 22 nt, Human
cacacugugcuuucuauuguac

SEQ ID NO: 2313605 - RNA, 23 nt, Human
cacacugugcuuucuauuguaca

SEQ ID NO: 2313606 - RNA, 16 nt, Human
cacacuguguccuggu

SEQ ID NO: 2313607 - RNA, 23 nt, Human
cacacugcuaggugggccagccc

SEQ ID NO: 2313608 - RNA, 19 nt, Human
cacacugggacuugcaaaa

SEQ ID NO: 2313609 - RNA, 19 nt, Human
cacacuggggugccgccug

SEQ ID NO: 2313610 - RNA, 22 nt, Human
cacacuggggugccgccugccc

SEQ ID NO: 2313611 - RNA, 21 nt, Human
cacacugggugcccaagcuca

SEQ ID NO: 2313612 - RNA, 15 nt, Human
cacacuggugacugc

SEQ ID NO: 2313613 - RNA, 23 nt, Human
cacacugguguggauuaaccugc

SEQ ID NO: 2313614 - RNA, 18 nt, Human
cacacuucaggcucuucu

SEQ ID NO: 2313615 - RNA, 20 nt, Human
cacacuucaggcucuucucc

SEQ ID NO: 2313616 - RNA, 21 nt, Human
cacacuucaggcucuucuccu

SEQ ID NO: 2313617 - RNA, 22 nt, Human
cacacuucaggcucuucuccuu

SEQ ID NO: 2313618 - RNA, 14 nt, Human
cacacuucaggcuc

SEQ ID NO: 2313619 - RNA, 17 nt, Human
cacacuucaggcucuuc

SEQ ID NO: 2313620 - RNA, 19 nt, Human
cacacuguguccuggugcu

SEQ ID NO: 2313621 - RNA, 20 nt, Human
cacacuguguccuggugcuc

SEQ ID NO: 2313622 - RNA, 23 nt, Human
cacacuguguccuggugcucucu

SEQ ID NO: 2313623 - RNA, 24 nt, Human
cacacuguguccuggugcucucug

SEQ ID NO: 2313624 - RNA, 14 nt, Human
cacagagaagacaa

SEQ ID NO: 2313625 - RNA, 14 nt, Human
cacagagacccccg

SEQ ID NO: 2313626 - RNA, 21 nt, Human
cacagagacauuccuccgagc

SEQ ID NO: 2313627 - RNA, 16 nt, Human
cacagagacauuccuc

SEQ ID NO: 2313628 - RNA, 15 nt, Human
cacagagaagacaaa

SEQ ID NO: 2313629 - RNA, 17 nt, Human
cacagagaagacaaaau

SEQ ID NO: 2313630 - RNA, 22 nt, Human
cacagagaagacaaaauuagca

SEQ ID NO: 2313631 - RNA, 18 nt, Human
cacagacucaaaugcuca

SEQ ID NO: 2313632 - RNA, 16 nt, Human
cacagacgucccucca

SEQ ID NO: 2313633 - RNA, 23 nt, Human
cacagaccuggagccccugggug

SEQ ID NO: 2313634 - RNA, 24 nt, Human
cacagaccuggagccccugggugg

SEQ ID NO: 2313635 - RNA, 22 nt, Human
cacagagagggggccaccuccc

SEQ ID NO: 2313636 - RNA, 23 nt, Human
cacagagacccccggaacaagcc

SEQ ID NO: 2313637 - RNA, 22 nt, Human
cacagagacccccggaacaagc

SEQ ID NO: 2313638 - RNA, 14 nt, Human
cacagagagaguca

SEQ ID NO: 2313639 - RNA, 12 nt, Human
cacagagagucc

SEQ ID NO: 2313640 - RNA, 16 nt, Human
cacagagagucccacu

SEQ ID NO: 2313641 - RNA, 18 nt, Human
cacagagagucccacugc

SEQ ID NO: 2313642 - RNA, 19 nt, Human
cacagagagucccacugcc

SEQ ID NO: 2313643 - RNA, 14 nt, Human
cacagagcaggacu

SEQ ID NO: 2313644 - RNA, 17 nt, Human
cacagaguuguuacauu

SEQ ID NO: 2313645 - RNA, 16 nt, Human
cacagaguuguuacau

SEQ ID NO: 2313646 - RNA, 16 nt, Human
cacacuuccuguccag

SEQ ID NO: 2313647 - RNA, 15 nt, Human
cacacuuccugucca

SEQ ID NO: 2313648 - RNA, 14 nt, Human
cacacuuccugucc

SEQ ID NO: 2313649 - RNA, 13 nt, Human
cacacuuccuguc

SEQ ID NO: 2313650 - RNA, 20 nt, Human
cacacuuccuguccagagag

SEQ ID NO: 2313651 - RNA, 19 nt, Human
cacacuuccuguccagaga

SEQ ID NO: 2313652 - RNA, 23 nt, Human
cacacuuccuguccagagagaga

SEQ ID NO: 2313653 - RNA, 19 nt, Human
cacacuuccaccagccugc

SEQ ID NO: 2313654 - RNA, 18 nt, Human
cacacuuccaccagccug

SEQ ID NO: 2313655 - RNA, 16 nt, Human
cacacuuccaccagcc

SEQ ID NO: 2313656 - RNA, 22 nt, Human
cacacuucugugagacccccac

SEQ ID NO: 2313657 - RNA, 15 nt, Human
cacacuucugugaga

SEQ ID NO: 2313658 - RNA, 17 nt, Human
cacacuugagaggauga

SEQ ID NO: 2313659 - RNA, 18 nt, Human
cacacuugagaggaugaa

SEQ ID NO: 2313660 - RNA, 21 nt, Human
cacacuugacaucaacugcau

SEQ ID NO: 2313661 - RNA, 22 nt, Human
cacagacccugcccugugggcc

SEQ ID NO: 2313662 - RNA, 17 nt, Human
cacacuuguuccagcuc

SEQ ID NO: 2313663 - RNA, 16 nt, Human
cacacuuguuccagcu

SEQ ID NO: 2313664 - RNA, 14 nt, Human
cacagaccuggagc

SEQ ID NO: 2313665 - RNA, 15 nt, Human
cacagaccuggagcc

SEQ ID NO: 2313666 - RNA, 16 nt, Human
cacagaccuggagccc

SEQ ID NO: 2313667 - RNA, 18 nt, Human
cacagaccuggagccccu

SEQ ID NO: 2313668 - RNA, 19 nt, Human
cacagaccuggagccccug

SEQ ID NO: 2313669 - RNA, 20 nt, Human
cacagaccuggagccccugg

SEQ ID NO: 2313670 - RNA, 21 nt, Human
cacagaccuggagccccuggg

SEQ ID NO: 2313671 - RNA, 22 nt, Human
cacagaccuggagccccugggu

SEQ ID NO: 2313672 - RNA, 22 nt, Human
cacacuugguuggguccucaca

SEQ ID NO: 2313673 - RNA, 19 nt, Human
cacacuugagaggaugaau

SEQ ID NO: 2313674 - RNA, 21 nt, Human
cacacuugagaggaugaaugu

SEQ ID NO: 2313675 - RNA, 21 nt, Human
cacacuuggcccaaguggcag

SEQ ID NO: 2313676 - RNA, 15 nt, Human
cacacuuguuccagc

SEQ ID NO: 2313677 - RNA, 23 nt, Human
cacacuugugugugggcugugag

SEQ ID NO: 2313678 - RNA, 21 nt, Human
cacacuugugugugggcugug

SEQ ID NO: 2313679 - RNA, 19 nt, Human
cacacuugugugugggcug

SEQ ID NO: 2313680 - RNA, 13 nt, Human
cacacuugugugu

SEQ ID NO: 2313681 - RNA, 17 nt, Human
caauuuucucccaggaa

SEQ ID NO: 2313682 - RNA, 12 nt, Human
cacaaaaaugaa

SEQ ID NO: 2313683 - RNA, 22 nt, Human
cacaaaacaaaugccacacauc

SEQ ID NO: 2313684 - RNA, 19 nt, Human
caauuuucuggaauacaug

SEQ ID NO: 2313685 - RNA, 18 nt, Human
caauuuuccuugaagccg

SEQ ID NO: 2313686 - RNA, 13 nt, Human
caauuuucuccca

SEQ ID NO: 2313687 - RNA, 16 nt, Human
caauuuuccuugaagc

SEQ ID NO: 2313688 - RNA, 17 nt, Human
caauuuuccuugaagcc

SEQ ID NO: 2313689 - RNA, 19 nt, Human
caauuuuccuugaagccga

SEQ ID NO: 2313690 - RNA, 16 nt, Human
cacaaaaguuucucuu

SEQ ID NO: 2313691 - RNA, 18 nt, Human
cacaaaaguuucucuuuu

SEQ ID NO: 2313692 - RNA, 19 nt, Human
cacaaacuuuuauacucuu

SEQ ID NO: 2313693 - RNA, 18 nt, Human
cacaaagcacaguuugaa

SEQ ID NO: 2313694 - RNA, 22 nt, Human
cacaaagcacaguuugaacaaa

SEQ ID NO: 2313695 - RNA, 18 nt, Human
cacaaaaguuagcugagc

SEQ ID NO: 2313696 - RNA, 15 nt, Human
cacaaaacaacccua

SEQ ID NO: 2313697 - RNA, 14 nt, Human
cacaaacuguaaau

SEQ ID NO: 2313698 - RNA, 16 nt, Human
cacaaaacccagaccu

SEQ ID NO: 2313699 - RNA, 23 nt, Human
cacaaacuguaaauaaaaagaaa

SEQ ID NO: 2313700 - RNA, 15 nt, Human
cacaaacuguaaaua

SEQ ID NO: 2313701 - RNA, 11 nt, Human
cacaaagccca

SEQ ID NO: 2313702 - RNA, 14 nt, Human
cacaaagcccaagg

SEQ ID NO: 2313703 - RNA, 12 nt, Human
cacaaagcccaa

SEQ ID NO: 2313704 - RNA, 17 nt, Human
cacaaauuauuaaugaa

SEQ ID NO: 2313705 - RNA, 21 nt, Human
cacaaauucugucucuggauu

SEQ ID NO: 2313706 - RNA, 16 nt, Human
cacaacacacacacuc

SEQ ID NO: 2313707 - RNA, 20 nt, Human
cacaaauuauuaaugaaaau

SEQ ID NO: 2313708 - RNA, 11 nt, Human
cacaacagauu

SEQ ID NO: 2313709 - RNA, 17 nt, Human
cacaaccuucuguggcu

SEQ ID NO: 2313710 - RNA, 18 nt, Human
cacaaccuucuguggcuc

SEQ ID NO: 2313711 - RNA, 19 nt, Human
cacaaccuucuguggcuca

SEQ ID NO: 2313712 - RNA, 23 nt, Human
cacaaccuucuguggcucacaga

SEQ ID NO: 2313713 - RNA, 23 nt, Human
cacaaccaucugucccugccuca

SEQ ID NO: 2313714 - RNA, 22 nt, Human
cacaacacacagauuugagcuc

SEQ ID NO: 2313715 - RNA, 22 nt, Human
caaugccaaaaaaagacagggc

SEQ ID NO: 2313716 - RNA, 21 nt, Human
caaugcauuuuggaaagcucc

SEQ ID NO: 2313717 - RNA, 16 nt, Human
caaugcaugcagccac

SEQ ID NO: 2313718 - RNA, 20 nt, Human
caaugcaugcagccacugug

SEQ ID NO: 2313719 - RNA, 12 nt, Human
caaugcauuuug

SEQ ID NO: 2313720 - RNA, 13 nt, Human
caaugcauuuugg

SEQ ID NO: 2313721 - RNA, 21 nt, Human
caaugucaggaacagaaggau

SEQ ID NO: 2313722 - RNA, 16 nt, Human
caaugucugagugaac

SEQ ID NO: 2313723 - RNA, 15 nt, Human
caaugucugagugaa

SEQ ID NO: 2313724 - RNA, 20 nt, Human
caaugucugagugaaccugu

SEQ ID NO: 2313725 - RNA, 12 nt, Human
caaugucugugc

SEQ ID NO: 2313726 - RNA, 13 nt, Human
caaugucugugcu

SEQ ID NO: 2313727 - RNA, 14 nt, Human
caauuaaacggauu

SEQ ID NO: 2313728 - RNA, 15 nt, Human
caauuaaacggauua

SEQ ID NO: 2313729 - RNA, 16 nt, Human
caauuaaacggauuau

SEQ ID NO: 2313730 - RNA, 17 nt, Human
caauuaaacggauuauu

SEQ ID NO: 2313731 - RNA, 18 nt, Human
caauuaaacggauuauuu

SEQ ID NO: 2313732 - RNA, 19 nt, Human
caauuaaacggauuauuuu

SEQ ID NO: 2313733 - RNA, 23 nt, Human
caaugucuugaugcaugcacugu

SEQ ID NO: 2313734 - RNA, 21 nt, Human
caaugucuugaugcaugcacu

SEQ ID NO: 2313735 - RNA, 11 nt, Human
caaugucuuga

SEQ ID NO: 2313736 - RNA, 14 nt, Human
caaugucugugcua

SEQ ID NO: 2313737 - RNA, 20 nt, Human
caaugucugugcuagggaaa

SEQ ID NO: 2313738 - RNA, 14 nt, Human
caauuaaauguagg

SEQ ID NO: 2313739 - RNA, 13 nt, Human
caauuaaauguag

SEQ ID NO: 2313740 - RNA, 13 nt, Human
caauuaaggauuu

SEQ ID NO: 2313741 - RNA, 20 nt, Human
caauuaaggauuuuaugcuu

SEQ ID NO: 2313742 - RNA, 15 nt, Human
caauuaaggauuuua

SEQ ID NO: 2313743 - RNA, 12 nt, Human
caauuaaaugua

SEQ ID NO: 2313744 - RNA, 20 nt, Human
caauuaaacggauuauuuuu

SEQ ID NO: 2313745 - RNA, 23 nt, Human
caauuaaacggauuauuuuuuca

SEQ ID NO: 2313746 - RNA, 22 nt, Human
caauuaaauguagguaugaaua

SEQ ID NO: 2313747 - RNA, 22 nt, Human
caauuaaggauuuuaugcuuua

SEQ ID NO: 2313748 - RNA, 21 nt, Human
caauuaaggauuuuaugcuuu

SEQ ID NO: 2313749 - RNA, 17 nt, Human
caauucaacccuuugcc

SEQ ID NO: 2313750 - RNA, 14 nt, Human
caauucaacacucc

SEQ ID NO: 2313751 - RNA, 13 nt, Human
caauucagacagg

SEQ ID NO: 2313752 - RNA, 20 nt, Human
caauucacaucuaaccucau

SEQ ID NO: 2313753 - RNA, 15 nt, Human
caauuccaaaggaau

SEQ ID NO: 2313754 - RNA, 21 nt, Human
caauucaugaacuucgcauca

SEQ ID NO: 2313755 - RNA, 14 nt, Human
caauucaugaacuu

SEQ ID NO: 2313756 - RNA, 15 nt, Human
caauucaugaacuuc

SEQ ID NO: 2313757 - RNA, 14 nt, Human
caauucaacccuuu

SEQ ID NO: 2313758 - RNA, 13 nt, Human
caauucaugaacu

SEQ ID NO: 2313759 - RNA, 21 nt, Human
caauucagugcuguacuugau

SEQ ID NO: 2313760 - RNA, 23 nt, Human
caauucagacaggcaaauaaaag

SEQ ID NO: 2313761 - RNA, 15 nt, Human
caauucagacaggca

SEQ ID NO: 2313762 - RNA, 14 nt, Human
caauucagacaggc

SEQ ID NO: 2313763 - RNA, 21 nt, Human
caauuuuaucccucaccugua

SEQ ID NO: 2313764 - RNA, 17 nt, Human
caauuuuaaugcuauuu

SEQ ID NO: 2313765 - RNA, 13 nt, Human
caauuuuccuuga

SEQ ID NO: 2313766 - RNA, 14 nt, Human
caauuuuccuugaa

SEQ ID NO: 2313767 - RNA, 15 nt, Human
caauuuuccuugaag

SEQ ID NO: 2313768 - RNA, 11 nt, Human
caauuuuccuu

SEQ ID NO: 2313769 - RNA, 10 nt, Human
caauuuuccu

SEQ ID NO: 2313770 - RNA, 24 nt, Human
caaugaucuagguuuaacucagau

SEQ ID NO: 2313771 - RNA, 21 nt, Human
caaugaugaaugagaaucuac

SEQ ID NO: 2313772 - RNA, 16 nt, Human
caaugauggcaauuuu

SEQ ID NO: 2313773 - RNA, 13 nt, Human
caaugauggcaau

SEQ ID NO: 2313774 - RNA, 17 nt, Human
caaugcaaaccaucauu

SEQ ID NO: 2313775 - RNA, 18 nt, Human
caaugcaaaccaucauug

SEQ ID NO: 2313776 - RNA, 23 nt, Human
caaugcacuuuguucuggcucuu

SEQ ID NO: 2313777 - RNA, 19 nt, Human
caaugcaaaccaucauuga

SEQ ID NO: 2313778 - RNA, 20 nt, Human
caaugcaaaccaucauugaa

SEQ ID NO: 2313779 - RNA, 14 nt, Human
caaugacacagucu

SEQ ID NO: 2313780 - RNA, 19 nt, Human
caaugacacagucuuggcu

SEQ ID NO: 2313781 - RNA, 21 nt, Human
caaugacacagucuuggcuca

SEQ ID NO: 2313782 - RNA, 13 nt, Human
caaugaaccccca

SEQ ID NO: 2313783 - RNA, 20 nt, Human
caaugaacccccaugaugua

SEQ ID NO: 2313784 - RNA, 22 nt, Human
caaugaaugaaugaauggcuaa

SEQ ID NO: 2313785 - RNA, 19 nt, Human
caaugacaucuucaaagcu

SEQ ID NO: 2313786 - RNA, 15 nt, Human
caaugacaucuucaa

SEQ ID NO: 2313787 - RNA, 16 nt, Human
caaugacaucucaggg

SEQ ID NO: 2313788 - RNA, 17 nt, Human
caaugacaucucagggg

SEQ ID NO: 2313789 - RNA, 19 nt, Human
caaugacaucucaggggcc

SEQ ID NO: 2313790 - RNA, 22 nt, Human
caaugacaucucaggggccaga

SEQ ID NO: 2313791 - RNA, 19 nt, Human
caaugaggucugaaaugga

SEQ ID NO: 2313792 - RNA, 18 nt, Human
caaugauaguaagaaaag

SEQ ID NO: 2313793 - RNA, 14 nt, Human
caaugaugaaugag

SEQ ID NO: 2313794 - RNA, 22 nt, Human
caaugaucuagguuuaacucag

SEQ ID NO: 2313795 - RNA, 23 nt, Human
caaugaucuagguuuaacucaga

SEQ ID NO: 2313796 - RNA, 17 nt, Human
caaugaucuagguuuaa

SEQ ID NO: 2313797 - RNA, 18 nt, Human
caaugaucuagguuuaac

SEQ ID NO: 2313798 - RNA, 20 nt, Human
caaugaucuagguuuaacuc

SEQ ID NO: 2313799 - RNA, 21 nt, Human
caaugaucuagguuuaacuca

SEQ ID NO: 2313800 - RNA, 20 nt, Human
caaugauaguaagaaaagug

SEQ ID NO: 2313801 - RNA, 14 nt, Human
caaugaucuagguu

SEQ ID NO: 2313802 - RNA, 20 nt, Human
caaugauauauggauaaugc

SEQ ID NO: 2313803 - RNA, 16 nt, Human
caaugaucuagguuua

SEQ ID NO: 2313804 - RNA, 18 nt, Human
caauccucacuggguggg

SEQ ID NO: 2313805 - RNA, 11 nt, Human
caauccugccc

SEQ ID NO: 2313806 - RNA, 12 nt, Human
caauccugcccc

SEQ ID NO: 2313807 - RNA, 13 nt, Human
caauccucuaagc

SEQ ID NO: 2313808 - RNA, 17 nt, Human
caauccucacugggugg

SEQ ID NO: 2313809 - RNA, 16 nt, Human
caauccucacugggug

SEQ ID NO: 2313810 - RNA, 14 nt, Human
caauccucacuggg

SEQ ID NO: 2313811 - RNA, 21 nt, Human
caaugaaaugcucuccuuucc

SEQ ID NO: 2313812 - RNA, 19 nt, Human
caaugaaaugcucuccuuu

SEQ ID NO: 2313813 - RNA, 19 nt, Human
caaugaaaugaauuaaagu

SEQ ID NO: 2313814 - RNA, 13 nt, Human
caauccugccccc

SEQ ID NO: 2313815 - RNA, 11 nt, Human
caauccuggac

SEQ ID NO: 2313816 - RNA, 23 nt, Human
caaugaaaugaauuaaaguggac

SEQ ID NO: 2313817 - RNA, 21 nt, Human
caaugaaaugaauuaaagugg

SEQ ID NO: 2313818 - RNA, 22 nt, Human
caauauguauuaauauucauug

SEQ ID NO: 2313819 - RNA, 16 nt, Human
caauauguauuaauau

SEQ ID NO: 2313820 - RNA, 13 nt, Human
caauauguauugu

SEQ ID NO: 2313821 - RNA, 14 nt, Human
caauauguauugua

SEQ ID NO: 2313822 - RNA, 15 nt, Human
caauauguauuguaa

SEQ ID NO: 2313823 - RNA, 16 nt, Human
caauauguauuguaaa

SEQ ID NO: 2313824 - RNA, 21 nt, Human
caauauguauuguaaacaugu

SEQ ID NO: 2313825 - RNA, 22 nt, Human
caauauguauuguaaacaugug

SEQ ID NO: 2313826 - RNA, 23 nt, Human
caauauguauuguaaacaugugu

SEQ ID NO: 2313827 - RNA, 12 nt, Human
caauauuaaaua

SEQ ID NO: 2313828 - RNA, 14 nt, Human
caauauuaaauaca

SEQ ID NO: 2313829 - RNA, 15 nt, Human
caauauuaaauacag

SEQ ID NO: 2313830 - RNA, 20 nt, Human
caauauuaaauacagacacu

SEQ ID NO: 2313831 - RNA, 20 nt, Human
caauccuauguuuuuguuca

SEQ ID NO: 2313832 - RNA, 14 nt, Human
caauccuauguuuu

SEQ ID NO: 2313833 - RNA, 15 nt, Human
caauccuagugcuuu

SEQ ID NO: 2313834 - RNA, 21 nt, Human
caauccuaauuucuccucccu

SEQ ID NO: 2313835 - RNA, 17 nt, Human
caauccuagguaggguu

SEQ ID NO: 2313836 - RNA, 21 nt, Human
caauauuaaauacagacacua

SEQ ID NO: 2313837 - RNA, 22 nt, Human
caauauuaaauacagacacuaa

SEQ ID NO: 2313838 - RNA, 17 nt, Human
caagugugugcaugugu

SEQ ID NO: 2313839 - RNA, 16 nt, Human
caagugugugcaugug

SEQ ID NO: 2313840 - RNA, 22 nt, Human
caagugugugcacaugugugcg

SEQ ID NO: 2313841 - RNA, 21 nt, Human
caagugugugcacaugugugc

SEQ ID NO: 2313842 - RNA, 20 nt, Human
caagugugugcacaugugug

SEQ ID NO: 2313843 - RNA, 19 nt, Human
caagugugugcacaugugu

SEQ ID NO: 2313844 - RNA, 14 nt, Human
caagugugugcaca

SEQ ID NO: 2313845 - RNA, 11 nt, Human
caagugugugc

SEQ ID NO: 2313846 - RNA, 23 nt, Human
caaguguguaugugcgugugugc

SEQ ID NO: 2313847 - RNA, 23 nt, Human
caagugugguagggacuuaaaaa

SEQ ID NO: 2313848 - RNA, 22 nt, Human
caagugugguagggacuuaaaa

SEQ ID NO: 2313849 - RNA, 15 nt, Human
caaguguaaaauauu

SEQ ID NO: 2313850 - RNA, 16 nt, Human
caaguguaaaauauuu

SEQ ID NO: 2313851 - RNA, 17 nt, Human
caagugugugugcgugu

SEQ ID NO: 2313852 - RNA, 20 nt, Human
caagugugugcaugugugcg

SEQ ID NO: 2313853 - RNA, 20 nt, Human
caauaggaaaaacugauuuu

SEQ ID NO: 2313854 - RNA, 18 nt, Human
caaguuaaagugaauaac

SEQ ID NO: 2313855 - RNA, 11 nt, Human
caagugugugu

SEQ ID NO: 2313856 - RNA, 19 nt, Human
caaguguuguuuuuuaagu

SEQ ID NO: 2313857 - RNA, 23 nt, Human
caauaggcaaaggggggaaggga

SEQ ID NO: 2313858 - RNA, 22 nt, Human
caauaggcagacuggguuucua

SEQ ID NO: 2313859 - RNA, 21 nt, Human
caauaggaaaaacugauuuuu

SEQ ID NO: 2313860 - RNA, 15 nt, Human
caauaggcuguuccc

SEQ ID NO: 2313861 - RNA, 15 nt, Human
caauauguaaauagu

SEQ ID NO: 2313862 - RNA, 12 nt, Human
caauaugcuuac

SEQ ID NO: 2313863 - RNA, 21 nt, Human
caauauguaaauagugcagaa

SEQ ID NO: 2313864 - RNA, 18 nt, Human
caauaguaauucucaggc

SEQ ID NO: 2313865 - RNA, 15 nt, Human
caauaugcaguucug

SEQ ID NO: 2313866 - RNA, 11 nt, Human
caauaugcuua

SEQ ID NO: 2313867 - RNA, 19 nt, Human
caaugugaaaagaaaaaug

SEQ ID NO: 2313868 - RNA, 13 nt, Human
uugggauuaauau

SEQ ID NO: 2313869 - RNA, 16 nt, Human
uugggauuccugaccc

SEQ ID NO: 2313870 - RNA, 18 nt, Human
uugggauuccugacccag

SEQ ID NO: 2313871 - RNA, 21 nt, Human
uugggauuccugacccaggcc

SEQ ID NO: 2313872 - RNA, 14 nt, Human
uugggauugggggc

SEQ ID NO: 2313873 - RNA, 16 nt, Human
uugggauugggggcug

SEQ ID NO: 2313874 - RNA, 21 nt, Human
uugggauugggggcuggugcc

SEQ ID NO: 2313875 - RNA, 18 nt, Human
uugggaugaugccucaug

SEQ ID NO: 2313876 - RNA, 16 nt, Human
uugggauacugcaggg

SEQ ID NO: 2313877 - RNA, 15 nt, Human
uugggaggcugaggc

SEQ ID NO: 2313878 - RNA, 19 nt, Human
uugggagcuugggaaugga

SEQ ID NO: 2313879 - RNA, 15 nt, Human
uugggagugagaugc

SEQ ID NO: 2313880 - RNA, 19 nt, Human
uugggagugagaugccugc

SEQ ID NO: 2313881 - RNA, 17 nt, Human
uugggagcuugggaaug

SEQ ID NO: 2313882 - RNA, 22 nt, Human
uugggagcacuggagugcaggg

SEQ ID NO: 2313883 - RNA, 11 nt, Human
uugggagcacu

SEQ ID NO: 2313884 - RNA, 15 nt, Human
uugggagcacuggag

SEQ ID NO: 2313885 - RNA, 16 nt, Human
uugggagcacuggagu

SEQ ID NO: 2313886 - RNA, 22 nt, Human
uugggauugggggcuggugcca

SEQ ID NO: 2313887 - RNA, 23 nt, Human
uugguaaauuuccccaacagugu

SEQ ID NO: 2313888 - RNA, 19 nt, Human
uugguaacacaaauuuuca

SEQ ID NO: 2313889 - RNA, 21 nt, Human
uugguaacauccuuucuauug

SEQ ID NO: 2313890 - RNA, 20 nt, Human
uugguaaggggaauugagga

SEQ ID NO: 2313891 - RNA, 16 nt, Human
uugguaacauccuuuc

SEQ ID NO: 2313892 - RNA, 19 nt, Human
uugguaacauccuuucuau

SEQ ID NO: 2313893 - RNA, 20 nt, Human
uuggucugacccacugcuuu

SEQ ID NO: 2313894 - RNA, 17 nt, Human
uuggucugggacuuccu

SEQ ID NO: 2313895 - RNA, 20 nt, Human
uugguacauggccaguguga

SEQ ID NO: 2313896 - RNA, 15 nt, Human
uugguaauuauuuug

SEQ ID NO: 2313897 - RNA, 14 nt, Human
uugguccuuuacac

SEQ ID NO: 2313898 - RNA, 13 nt, Human
uuguaaaauggug

SEQ ID NO: 2313899 - RNA, 12 nt, Human
uuguaaaauggu

SEQ ID NO: 2313900 - RNA, 15 nt, Human
uuggucugugagaug

SEQ ID NO: 2313901 - RNA, 13 nt, Human
uuguaaaauauag

SEQ ID NO: 2313902 - RNA, 14 nt, Human
uuguaaaauauagc

SEQ ID NO: 2313903 - RNA, 18 nt, Human
uuguaaaauauagcugua

SEQ ID NO: 2313904 - RNA, 20 nt, Human
uuguaaaauauagcuguaca

SEQ ID NO: 2313905 - RNA, 21 nt, Human
uugggaaggggacccccgccc

SEQ ID NO: 2313906 - RNA, 21 nt, Human
uuggcuuuauccucuuuagag

SEQ ID NO: 2313907 - RNA, 22 nt, Human
uuggcuuuauccucuuuagagu

SEQ ID NO: 2313908 - RNA, 14 nt, Human
uugggaauaaauau

SEQ ID NO: 2313909 - RNA, 15 nt, Human
uugggaauaaauaug

SEQ ID NO: 2313910 - RNA, 17 nt, Human
uugggaauaaauaugcc

SEQ ID NO: 2313911 - RNA, 15 nt, Human
uugggaauauuugaa

SEQ ID NO: 2313912 - RNA, 16 nt, Human
uugggaauauuugaau

SEQ ID NO: 2313913 - RNA, 11 nt, Human
uugggaauguu

SEQ ID NO: 2313914 - RNA, 14 nt, Human
uugggaauguuugu

SEQ ID NO: 2313915 - RNA, 17 nt, Human
uugggaauauuugaauc

SEQ ID NO: 2313916 - RNA, 19 nt, Human
uugggaauauuugaaucuu

SEQ ID NO: 2313917 - RNA, 18 nt, Human
uugggaauggauccugga

SEQ ID NO: 2313918 - RNA, 16 nt, Human
uugggaaugaggcuug

SEQ ID NO: 2313919 - RNA, 19 nt, Human
uugggaaugaggcuugcug

SEQ ID NO: 2313920 - RNA, 20 nt, Human
uugggaccccuggugguuca

SEQ ID NO: 2313921 - RNA, 16 nt, Human
uugggaccccuggugg

SEQ ID NO: 2313922 - RNA, 15 nt, Human
uugggaccccuggug

SEQ ID NO: 2313923 - RNA, 14 nt, Human
uugggaccccuggu

SEQ ID NO: 2313924 - RNA, 16 nt, Human
uugggagauauauuuu

SEQ ID NO: 2313925 - RNA, 23 nt, Human
uugggacuggguuuggaccccag

SEQ ID NO: 2313926 - RNA, 17 nt, Human
uugggagacaugugaca

SEQ ID NO: 2313927 - RNA, 22 nt, Human
uugggacugcuaaauaaaauuu

SEQ ID NO: 2313928 - RNA, 16 nt, Human
uugggaccgccagaug

SEQ ID NO: 2313929 - RNA, 14 nt, Human
uugggagacaugug

SEQ ID NO: 2313930 - RNA, 22 nt, Human
uugggaccgccagauggggccu

SEQ ID NO: 2313931 - RNA, 18 nt, Human
uugggacuggggcugaag

SEQ ID NO: 2313932 - RNA, 23 nt, Human
uuggcuucacggaagagccuugc

SEQ ID NO: 2313933 - RNA, 23 nt, Human
uuggcagugagugagccuggcuc

SEQ ID NO: 2313934 - RNA, 17 nt, Human
uuggcuuuaaacacccu

SEQ ID NO: 2313935 - RNA, 22 nt, Human
uuggcuuuaaacacccuucaca

SEQ ID NO: 2313936 - RNA, 14 nt, Human
uuggcuuuauccuc

SEQ ID NO: 2313937 - RNA, 20 nt, Human
uuggcuuuauccucuuuaga

SEQ ID NO: 2313938 - RNA, 19 nt, Human
uuggcuucuucuuuaggau

SEQ ID NO: 2313939 - RNA, 21 nt, Human
uuggcuuccaugaugguuauu

SEQ ID NO: 2313940 - RNA, 17 nt, Human
uuggcuuccuuucuugg

SEQ ID NO: 2313941 - RNA, 22 nt, Human
uuggcuuccuuucuugguucau

SEQ ID NO: 2313942 - RNA, 14 nt, Human
uuggcagucugaau

SEQ ID NO: 2313943 - RNA, 13 nt, Human
uuggcaggcuggc

SEQ ID NO: 2313944 - RNA, 14 nt, Human
uuggcaggcuggcc

SEQ ID NO: 2313945 - RNA, 20 nt, Human
uuggcagugagugagccugg

SEQ ID NO: 2313946 - RNA, 17 nt, Human
uuguagcauccucuuua

SEQ ID NO: 2313947 - RNA, 20 nt, Human
uuguaucucuuuugaaucca

SEQ ID NO: 2313948 - RNA, 21 nt, Human
uuguaucugcaggcagacacg

SEQ ID NO: 2313949 - RNA, 22 nt, Human
uuguagaaguaggaagugaaaa

SEQ ID NO: 2313950 - RNA, 22 nt, Human
uuguagaaggguuauauuuuac

SEQ ID NO: 2313951 - RNA, 16 nt, Human
uuguagaauguauugu

SEQ ID NO: 2313952 - RNA, 17 nt, Human
uuguagaauguauugua

SEQ ID NO: 2313953 - RNA, 21 nt, Human
uuguaccccccaaccccugag

SEQ ID NO: 2313954 - RNA, 18 nt, Human
uuguacuuuagggaagua

SEQ ID NO: 2313955 - RNA, 20 nt, Human
uuguaaaauggugugaccac

SEQ ID NO: 2313956 - RNA, 14 nt, Human
uuguaaacaugugu

SEQ ID NO: 2313957 - RNA, 15 nt, Human
uuguaaacauguguu

SEQ ID NO: 2313958 - RNA, 16 nt, Human
uuguaaacucaaaaua

SEQ ID NO: 2313959 - RNA, 22 nt, Human
uuguaaacucaaaauauuugua

SEQ ID NO: 2313960 - RNA, 11 nt, Human
uuguaccucuc

SEQ ID NO: 2313961 - RNA, 13 nt, Human
uuguaccugguga

SEQ ID NO: 2313962 - RNA, 15 nt, Human
uuguaccccccaacc

SEQ ID NO: 2313963 - RNA, 23 nt, Human
uuguacauuuaugauuuaauaaa

SEQ ID NO: 2313964 - RNA, 20 nt, Human
uuguaccccccaaccccuga

SEQ ID NO: 2313965 - RNA, 16 nt, Human
uuguaccgcaauguga

SEQ ID NO: 2313966 - RNA, 12 nt, Human
uugucucugggc

SEQ ID NO: 2313967 - RNA, 17 nt, Human
uugucugaagucacugc

SEQ ID NO: 2313968 - RNA, 18 nt, Human
uugucugaagucacugca

SEQ ID NO: 2313969 - RNA, 22 nt, Human
uugucuuaaaaaguggaaaaau

SEQ ID NO: 2313970 - RNA, 20 nt, Human
uugucuaugggacucaaugc

SEQ ID NO: 2313971 - RNA, 18 nt, Human
uugucuauuaccuguuag

SEQ ID NO: 2313972 - RNA, 19 nt, Human
uugucucuaugccagcuca

SEQ ID NO: 2313973 - RNA, 19 nt, Human
uugucucccuggcccucaa

SEQ ID NO: 2313974 - RNA, 15 nt, Human
uugucuauucuccag

SEQ ID NO: 2313975 - RNA, 16 nt, Human
uugucuauuuuugucu

SEQ ID NO: 2313976 - RNA, 17 nt, Human
uugucuauuuuugucuu

SEQ ID NO: 2313977 - RNA, 18 nt, Human
uugucuauuuuugucuua

SEQ ID NO: 2313978 - RNA, 14 nt, Human
uugucuaugggacu

SEQ ID NO: 2313979 - RNA, 22 nt, Human
uugucaaaguggugagaggcau

SEQ ID NO: 2313980 - RNA, 22 nt, Human
uugucaaacuguagaaaugaug

SEQ ID NO: 2313981 - RNA, 22 nt, Human
uuguauuuuuuugcaagugaag

SEQ ID NO: 2313982 - RNA, 13 nt, Human
uugucaaagagag

SEQ ID NO: 2313983 - RNA, 20 nt, Human
uuguauuuuuuugcaaguga

SEQ ID NO: 2313984 - RNA, 21 nt, Human
uuguauuuuuuugcaagugaa

SEQ ID NO: 2313985 - RNA, 15 nt, Human
uuguauuuuuaaugg

SEQ ID NO: 2313986 - RNA, 21 nt, Human
uuguauuuuccaagugugcau

SEQ ID NO: 2313987 - RNA, 14 nt, Human
uuguauuuuuaaug

SEQ ID NO: 2313988 - RNA, 12 nt, Human
uuguaugccuuu

SEQ ID NO: 2313989 - RNA, 12 nt, Human
uuguauuuucca

SEQ ID NO: 2313990 - RNA, 23 nt, Human
uuguauuuuccaagugugcauau

SEQ ID NO: 2313991 - RNA, 22 nt, Human
uuguaugaaagauggcugugcc

SEQ ID NO: 2313992 - RNA, 20 nt, Human
uuguaugauccuaaugaaug

SEQ ID NO: 2313993 - RNA, 20 nt, Human
uuguaugccuuuaaaucugu

SEQ ID NO: 2313994 - RNA, 20 nt, Human
uuguaugauguguugugaua

SEQ ID NO: 2313995 - RNA, 21 nt, Human
uuguaugauguguugugauag

SEQ ID NO: 2313996 - RNA, 13 nt, Human
uuguaugaugugu

SEQ ID NO: 2313997 - RNA, 14 nt, Human
uuguaugauguguu

SEQ ID NO: 2313998 - RNA, 16 nt, Human
uuguaugauguguugu

SEQ ID NO: 2313999 - RNA, 18 nt, Human
uuguaugauguguuguga

SEQ ID NO: 2314000 - RNA, 22 nt, Human
uuggcagcaggugcugcuaccc

SEQ ID NO: 2314001 - RNA, 14 nt, Human
uuggcagcagauuu

SEQ ID NO: 2314002 - RNA, 12 nt, Human
uuggcagcaggu

SEQ ID NO: 2314003 - RNA, 18 nt, Human
uuggcagcaggugcugcu

SEQ ID NO: 2314004 - RNA, 21 nt, Human
uuggcagcaggugcugcuacc

SEQ ID NO: 2314005 - RNA, 16 nt, Human
uuggcagcucuacucu

SEQ ID NO: 2314006 - RNA, 12 nt, Human
uuggcaggcugg

SEQ ID NO: 2314007 - RNA, 22 nt, Human
uuggcacugagauauuuauugu

SEQ ID NO: 2314008 - RNA, 14 nt, Human
uuggcacucacaga

SEQ ID NO: 2314009 - RNA, 22 nt, Human
uuggcacucacagaccuggagc

SEQ ID NO: 2314010 - RNA, 21 nt, Human
uuggcaccuaauccaggcaga

SEQ ID NO: 2314011 - RNA, 23 nt, Human
uuggcacucacagaccuggagcc

SEQ ID NO: 2314012 - RNA, 12 nt, Human
uuggcagcagau

SEQ ID NO: 2314013 - RNA, 15 nt, Human
uuggcagcaccuguc

SEQ ID NO: 2314014 - RNA, 23 nt, Human
uuggcacagaaacacaauauuuu

SEQ ID NO: 2314015 - RNA, 13 nt, Human
uuggcaccagaca

SEQ ID NO: 2314016 - RNA, 20 nt, Human
uuggcaccagacacccagga

SEQ ID NO: 2314017 - RNA, 17 nt, Human
uuggcaccagacaccca

SEQ ID NO: 2314018 - RNA, 19 nt, Human
uuggcaccuaauccaggca

SEQ ID NO: 2314019 - RNA, 23 nt, Human
uuggcaccagacacccaggacuu

SEQ ID NO: 2314020 - RNA, 21 nt, Human
uuggcaccagacacccaggac

SEQ ID NO: 2314021 - RNA, 16 nt, Human
uuggcacagaaacaca

SEQ ID NO: 2314022 - RNA, 15 nt, Human
uuggcacagaaacac

SEQ ID NO: 2314023 - RNA, 17 nt, Human
uuggcaaugccaucauc

SEQ ID NO: 2314024 - RNA, 16 nt, Human
uuggcaauaguuugca

SEQ ID NO: 2314025 - RNA, 20 nt, Human
uuggcaauaguuugcauaga

SEQ ID NO: 2314026 - RNA, 15 nt, Human
uuggauuguccccga

SEQ ID NO: 2314027 - RNA, 14 nt, Human
uuggauuuguuuaa

SEQ ID NO: 2314028 - RNA, 18 nt, Human
uuggauuuguuuaaaagg

SEQ ID NO: 2314029 - RNA, 22 nt, Human
uuggauuugacauugcguuuga

SEQ ID NO: 2314030 - RNA, 14 nt, Human
uuggauuugacauu

SEQ ID NO: 2314031 - RNA, 15 nt, Human
uuggacccugaggcc

SEQ ID NO: 2314032 - RNA, 18 nt, Human
uuggacccugaggcccag

SEQ ID NO: 2314033 - RNA, 19 nt, Human
uuggacccugaggcccaga

SEQ ID NO: 2314034 - RNA, 21 nt, Human
uuggacccugaggcccagagg

SEQ ID NO: 2314035 - RNA, 19 nt, Human
uuggaagcuccgcuuucua

SEQ ID NO: 2314036 - RNA, 17 nt, Human
uuggaagcucugaaguc

SEQ ID NO: 2314037 - RNA, 22 nt, Human
uuggaagcuagcuccccuccuc

SEQ ID NO: 2314038 - RNA, 23 nt, Human
uuggaagcuagcuccccuccucu

SEQ ID NO: 2314039 - RNA, 21 nt, Human
uuggaagcuagcuccccuccu

SEQ ID NO: 2314040 - RNA, 13 nt, Human
uuggaagagaaag

SEQ ID NO: 2314041 - RNA, 15 nt, Human
uugcuguuuccuuuu

SEQ ID NO: 2314042 - RNA, 20 nt, Human
uuggaagaccccacccaagc

SEQ ID NO: 2314043 - RNA, 19 nt, Human
uugcuguuguuucuaaaca

SEQ ID NO: 2314044 - RNA, 13 nt, Human
uugcuguuuccuu

SEQ ID NO: 2314045 - RNA, 19 nt, Human
uugcuguugucccucugcu

SEQ ID NO: 2314046 - RNA, 20 nt, Human
uugcugugucauaccaggcc

SEQ ID NO: 2314047 - RNA, 15 nt, Human
uugcugugggaacga

SEQ ID NO: 2314048 - RNA, 23 nt, Human
uugcugugggaacgagaggggaa

SEQ ID NO: 2314049 - RNA, 21 nt, Human
uugcuguugaugaggccucuu

SEQ ID NO: 2314050 - RNA, 20 nt, Human
uugcuguugauuucuuucca

SEQ ID NO: 2314051 - RNA, 14 nt, Human
uugcugugccuccc

SEQ ID NO: 2314052 - RNA, 20 nt, Human
uugcugugaggcuguccugu

SEQ ID NO: 2314053 - RNA, 16 nt, Human
uugcugugccucccaa

SEQ ID NO: 2314054 - RNA, 19 nt, Human
uugcugugccucccaaaau

SEQ ID NO: 2314055 - RNA, 12 nt, Human
uugcugugggaa

SEQ ID NO: 2314056 - RNA, 13 nt, Human
uugcugugggaac

SEQ ID NO: 2314057 - RNA, 23 nt, Human
uuggacaaucaugaaauaugcau

SEQ ID NO: 2314058 - RNA, 15 nt, Human
uuggacacuguacaa

SEQ ID NO: 2314059 - RNA, 16 nt, Human
uuggacaacugcaugg

SEQ ID NO: 2314060 - RNA, 14 nt, Human
uuggacauccuccu

SEQ ID NO: 2314061 - RNA, 19 nt, Human
uuggacagaagcagcucuu

SEQ ID NO: 2314062 - RNA, 16 nt, Human
uuggacagaagcagcu

SEQ ID NO: 2314063 - RNA, 18 nt, Human
uuggaauuaaccuggugc

SEQ ID NO: 2314064 - RNA, 18 nt, Human
uuggaaugggcagcucau

SEQ ID NO: 2314065 - RNA, 16 nt, Human
uuggaaugcuucuucu

SEQ ID NO: 2314066 - RNA, 17 nt, Human
uuggaaugggcagcuca

SEQ ID NO: 2314067 - RNA, 20 nt, Human
uuggaauuaaccuggugcug

SEQ ID NO: 2314068 - RNA, 19 nt, Human
uuggaauuaaccuggugcu

SEQ ID NO: 2314069 - RNA, 19 nt, Human
uuggaauuuguaaccucag

SEQ ID NO: 2314070 - RNA, 21 nt, Human
uuggaauuuguaaccucagcu

SEQ ID NO: 2314071 - RNA, 22 nt, Human
uuggaauuuguaaccucagcuc

SEQ ID NO: 2314072 - RNA, 17 nt, Human
uuggaauuaaccuggug

SEQ ID NO: 2314073 - RNA, 13 nt, Human
uuggaauacuuuu

SEQ ID NO: 2314074 - RNA, 23 nt, Human
uuggaauauuguccauuguccaa

SEQ ID NO: 2314075 - RNA, 11 nt, Human
uugcuguccua

SEQ ID NO: 2314076 - RNA, 23 nt, Human
uugcuggggacggggggccccag

SEQ ID NO: 2314077 - RNA, 20 nt, Human
uugcugugaauuagcucacu

SEQ ID NO: 2314078 - RNA, 20 nt, Human
uugcugugagcaagaaguca

SEQ ID NO: 2314079 - RNA, 14 nt, Human
uugcugugaggcug

SEQ ID NO: 2314080 - RNA, 15 nt, Human
uugcugugaggcugu

SEQ ID NO: 2314081 - RNA, 17 nt, Human
uugcugugaggcugucc

SEQ ID NO: 2314082 - RNA, 18 nt, Human
uugcugugaggcuguccu

SEQ ID NO: 2314083 - RNA, 19 nt, Human
uugcugugaggcuguccug

SEQ ID NO: 2314084 - RNA, 15 nt, Human
uugcuguccuaggcc

SEQ ID NO: 2314085 - RNA, 21 nt, Human
uugcugucauaagaaugaaua

SEQ ID NO: 2314086 - RNA, 20 nt, Human
uugcugggcaguuuuucugu

SEQ ID NO: 2314087 - RNA, 12 nt, Human
uugcugggcuuu

SEQ ID NO: 2314088 - RNA, 18 nt, Human
uugcugucccuuuuccuu

SEQ ID NO: 2314089 - RNA, 16 nt, Human
uugcuggcaaagacag

SEQ ID NO: 2314090 - RNA, 12 nt, Human
uugcuggcugga

SEQ ID NO: 2314091 - RNA, 15 nt, Human
uugcugggagcugaa

SEQ ID NO: 2314092 - RNA, 21 nt, Human
uugcugggagcugaaaaauca

SEQ ID NO: 2314093 - RNA, 22 nt, Human
uugcugggagcugaaaaaucac

SEQ ID NO: 2314094 - RNA, 16 nt, Human
uugcugucccuuuucc

SEQ ID NO: 2314095 - RNA, 23 nt, Human
uugcugcuuuuccuuggggcagg

SEQ ID NO: 2314096 - RNA, 18 nt, Human
uugcugcuuuuccuuggg

SEQ ID NO: 2314097 - RNA, 21 nt, Human
uugcuggaauaaguucaaauu

SEQ ID NO: 2314098 - RNA, 23 nt, Human
uugcuggacugucauagaaauua

SEQ ID NO: 2314099 - RNA, 21 nt, Human
uugcuggacggggacugggga

SEQ ID NO: 2314100 - RNA, 23 nt, Human
uugcuggacggggacuggggaug

SEQ ID NO: 2314101 - RNA, 13 nt, Human
uugcugcugaagg

SEQ ID NO: 2314102 - RNA, 16 nt, Human
uugcugcuugaggcaa

SEQ ID NO: 2314103 - RNA, 14 nt, Human
uugcugcuugaggc

SEQ ID NO: 2314104 - RNA, 21 nt, Human
uugcuaagccccagcaagcaa

SEQ ID NO: 2314105 - RNA, 20 nt, Human
uugcuaagaugcucuaucuu

SEQ ID NO: 2314106 - RNA, 13 nt, Human
uugcuaagaugcu

SEQ ID NO: 2314107 - RNA, 14 nt, Human
uugcuaagaugcuc

SEQ ID NO: 2314108 - RNA, 16 nt, Human
uugcuaagaugcucua

SEQ ID NO: 2314109 - RNA, 18 nt, Human
uugcuaagcauuccaacu

SEQ ID NO: 2314110 - RNA, 16 nt, Human
uugcuaagcauuccaa

SEQ ID NO: 2314111 - RNA, 13 nt, Human
uugcgcuguugcg

SEQ ID NO: 2314112 - RNA, 20 nt, Human
uugccauguuggccaggcug

SEQ ID NO: 2314113 - RNA, 21 nt, Human
uugccauguuggccaggcugg

SEQ ID NO: 2314114 - RNA, 18 nt, Human
uugcccacaccgagggcg

SEQ ID NO: 2314115 - RNA, 20 nt, Human
uugcccaacaccagccccug

SEQ ID NO: 2314116 - RNA, 21 nt, Human
uugcccaacaccagccccugc

SEQ ID NO: 2314117 - RNA, 13 nt, Human
uugcccaacacca

SEQ ID NO: 2314118 - RNA, 18 nt, Human
uugcccaacaccagcccc

SEQ ID NO: 2314119 - RNA, 19 nt, Human
uugcccaacaccagccccu

SEQ ID NO: 2314120 - RNA, 20 nt, Human
uugccaugggcuucacugua

SEQ ID NO: 2314121 - RNA, 21 nt, Human
uugccaugggcuucacuguau

SEQ ID NO: 2314122 - RNA, 22 nt, Human
uugccaugggcuucacuguaua

SEQ ID NO: 2314123 - RNA, 12 nt, Human
uugccugugcca

SEQ ID NO: 2314124 - RNA, 13 nt, Human
uugccuguucagu

SEQ ID NO: 2314125 - RNA, 16 nt, Human
uugccuguucaguuac

SEQ ID NO: 2314126 - RNA, 20 nt, Human
uugccuguucaguuacagaa

SEQ ID NO: 2314127 - RNA, 22 nt, Human
uugccuguucaguuacagaaag

SEQ ID NO: 2314128 - RNA, 16 nt, Human
uugccuuaacuggagc

SEQ ID NO: 2314129 - RNA, 17 nt, Human
uugccuuauuaaaguuc

SEQ ID NO: 2314130 - RNA, 14 nt, Human
uugccuucaacuaa

SEQ ID NO: 2314131 - RNA, 23 nt, Human
uugccuguucaguuacagaaagu

SEQ ID NO: 2314132 - RNA, 16 nt, Human
uugccuuaaagaaagu

SEQ ID NO: 2314133 - RNA, 21 nt, Human
uugccuuccacgcugucucca

SEQ ID NO: 2314134 - RNA, 18 nt, Human
uugccuugaaccacuucc

SEQ ID NO: 2314135 - RNA, 17 nt, Human
uugccuucuacuuuuaa

SEQ ID NO: 2314136 - RNA, 19 nt, Human
uugccuucuucacccagcu

SEQ ID NO: 2314137 - RNA, 20 nt, Human
uugccuugggcugcuccuca

SEQ ID NO: 2314138 - RNA, 21 nt, Human
uugccuugaaccacuucccuc

SEQ ID NO: 2314139 - RNA, 22 nt, Human
uugccuuuagugaucacagcag

SEQ ID NO: 2314140 - RNA, 11 nt, Human
uugccuuucuc

SEQ ID NO: 2314141 - RNA, 23 nt, Human
uugccuuuagugaucacagcagc

SEQ ID NO: 2314142 - RNA, 13 nt, Human
uugccuuucucga

SEQ ID NO: 2314143 - RNA, 17 nt, Human
uugccuuuguuuugaug

SEQ ID NO: 2314144 - RNA, 18 nt, Human
uugccuuuucuagcccga

SEQ ID NO: 2314145 - RNA, 13 nt, Human
uugccuuuugcaa

SEQ ID NO: 2314146 - RNA, 17 nt, Human
uugcgaaugguuccauu

SEQ ID NO: 2314147 - RNA, 18 nt, Human
uugccuuuugcaaacuuu

SEQ ID NO: 2314148 - RNA, 21 nt, Human
uucuuucccugcuuaaugaaa

SEQ ID NO: 2314149 - RNA, 22 nt, Human
uucuuuccucuuccccuugccc

SEQ ID NO: 2314150 - RNA, 18 nt, Human
uucuuucuaguggucuuu

SEQ ID NO: 2314151 - RNA, 13 nt, Human
uucuuuccugccu

SEQ ID NO: 2314152 - RNA, 21 nt, Human
uugaaaauaagaauagaaaua

SEQ ID NO: 2314153 - RNA, 18 nt, Human
uugaaaauuaacaugaau

SEQ ID NO: 2314154 - RNA, 15 nt, Human
uugaaaauuauuuua

SEQ ID NO: 2314155 - RNA, 19 nt, Human
uugaaaauuauuuuaaaca

SEQ ID NO: 2314156 - RNA, 20 nt, Human
uugaaaauuauuuuaaacaa

SEQ ID NO: 2314157 - RNA, 22 nt, Human
uugaaaauuauuuuaaacaaaa

SEQ ID NO: 2314158 - RNA, 18 nt, Human
uugaaaauucaaaaagug

SEQ ID NO: 2314159 - RNA, 20 nt, Human
uugaaaauucaaaaaguguu

SEQ ID NO: 2314160 - RNA, 21 nt, Human
uugaaaauucaaaaaguguuu

SEQ ID NO: 2314161 - RNA, 19 nt, Human
uugaaaccaccuuuuauua

SEQ ID NO: 2314162 - RNA, 13 nt, Human
uugaaacagaacc

SEQ ID NO: 2314163 - RNA, 16 nt, Human
uugaaacaaagaaggu

SEQ ID NO: 2314164 - RNA, 15 nt, Human
uugaaacaauacuca

SEQ ID NO: 2314165 - RNA, 23 nt, Human
uugaaacaauacucauaauguga

SEQ ID NO: 2314166 - RNA, 15 nt, Human
uugaacuuugaccuc

SEQ ID NO: 2314167 - RNA, 17 nt, Human
uucuuuccauuaugauu

SEQ ID NO: 2314168 - RNA, 14 nt, Human
uucuuuccauuaug

SEQ ID NO: 2314169 - RNA, 20 nt, Human
uucuuuaccugagaccaguu

SEQ ID NO: 2314170 - RNA, 12 nt, Human
uucuuuccagag

SEQ ID NO: 2314171 - RNA, 20 nt, Human
uucuuuccauuaugauucuu

SEQ ID NO: 2314172 - RNA, 21 nt, Human
uucuuuccugaggcugggcuc

SEQ ID NO: 2314173 - RNA, 21 nt, Human
uugaaaaucuuauaauuuaaa

SEQ ID NO: 2314174 - RNA, 14 nt, Human
uucuuuaccugaga

SEQ ID NO: 2314175 - RNA, 18 nt, Human
uucuuuccacagaagcuc

SEQ ID NO: 2314176 - RNA, 18 nt, Human
uucuuuaaugcuuuuaua

SEQ ID NO: 2314177 - RNA, 12 nt, Human
uucuuuaaugcu

SEQ ID NO: 2314178 - RNA, 21 nt, Human
uucuuuaagaauuacagguug

SEQ ID NO: 2314179 - RNA, 22 nt, Human
uugaagauaucuugaaaugaaa

SEQ ID NO: 2314180 - RNA, 15 nt, Human
uugaagaggugagca

SEQ ID NO: 2314181 - RNA, 18 nt, Human
uugaagaugcugaaacag

SEQ ID NO: 2314182 - RNA, 20 nt, Human
uugaagaucguuaguaucua

SEQ ID NO: 2314183 - RNA, 14 nt, Human
uugaagcacguaca

SEQ ID NO: 2314184 - RNA, 18 nt, Human
uugaagcacguacauuuu

SEQ ID NO: 2314185 - RNA, 15 nt, Human
uugaagcaguugugu

SEQ ID NO: 2314186 - RNA, 18 nt, Human
uugaacuuugaccucugc

SEQ ID NO: 2314187 - RNA, 17 nt, Human
uugaacuuugaccucug

SEQ ID NO: 2314188 - RNA, 20 nt, Human
uugaacuuugaccucugcag

SEQ ID NO: 2314189 - RNA, 13 nt, Human
uugaagaggaaaa

SEQ ID NO: 2314190 - RNA, 21 nt, Human
uugaagaggaaaaugaauaau

SEQ ID NO: 2314191 - RNA, 22 nt, Human
uugaagaggaaaaugaauaaua

SEQ ID NO: 2314192 - RNA, 23 nt, Human
uugaaugaaaaauuuaagcauug

SEQ ID NO: 2314193 - RNA, 22 nt, Human
uugaaugaaaaauuuaagcauu

SEQ ID NO: 2314194 - RNA, 17 nt, Human
uugaaugacaacagaag

SEQ ID NO: 2314195 - RNA, 18 nt, Human
uugaaugacaacagaagc

SEQ ID NO: 2314196 - RNA, 21 nt, Human
uugaaugaaaaauuuaagcau

SEQ ID NO: 2314197 - RNA, 20 nt, Human
uugaaugaaaaauuuaagca

SEQ ID NO: 2314198 - RNA, 22 nt, Human
uugaagcauuuuauaaaucgcu

SEQ ID NO: 2314199 - RNA, 17 nt, Human
uugaagcauuuuauaaa

SEQ ID NO: 2314200 - RNA, 15 nt, Human
uugaagcauuuuaua

SEQ ID NO: 2314201 - RNA, 14 nt, Human
uugaagcauuuuau

SEQ ID NO: 2314202 - RNA, 13 nt, Human
uugaagcauuuua

SEQ ID NO: 2314203 - RNA, 12 nt, Human
uugaaugaugcc

SEQ ID NO: 2314204 - RNA, 16 nt, Human
uugaaugaugccauga

SEQ ID NO: 2314205 - RNA, 20 nt, Human
uugaaugagaugauucagaa

SEQ ID NO: 2314206 - RNA, 20 nt, Human
uugaaugacaacagaagcuu

SEQ ID NO: 2314207 - RNA, 21 nt, Human
uugaaugacaacagaagcuuc

SEQ ID NO: 2314208 - RNA, 22 nt, Human
uugaaugagaugauucagaagg

SEQ ID NO: 2314209 - RNA, 23 nt, Human
uugaaugagaugauucagaaggg

SEQ ID NO: 2314210 - RNA, 22 nt, Human
uugaauguggcuugagaaauau

SEQ ID NO: 2314211 - RNA, 21 nt, Human
uugaauguggcuugagaaaua

SEQ ID NO: 2314212 - RNA, 19 nt, Human
uugaauguggcuugagaaa

SEQ ID NO: 2314213 - RNA, 13 nt, Human
uugaauguuaaau

SEQ ID NO: 2314214 - RNA, 15 nt, Human
uugaauguuaaauaa

SEQ ID NO: 2314215 - RNA, 18 nt, Human
uugaauguuaaauaaauu

SEQ ID NO: 2314216 - RNA, 14 nt, Human
uugaauguuaagca

SEQ ID NO: 2314217 - RNA, 17 nt, Human
uugaauguuaagcagau

SEQ ID NO: 2314218 - RNA, 16 nt, Human
uucuuauauaugugaa

SEQ ID NO: 2314219 - RNA, 16 nt, Human
uucuuaucuucugcaa

SEQ ID NO: 2314220 - RNA, 15 nt, Human
uucuuaguagauuuu

SEQ ID NO: 2314221 - RNA, 13 nt, Human
uucuuaguucuca

SEQ ID NO: 2314222 - RNA, 13 nt, Human
uucuuagugucac

SEQ ID NO: 2314223 - RNA, 23 nt, Human
uucuuagcucuuaauuguucauu

SEQ ID NO: 2314224 - RNA, 15 nt, Human
uucuuagcuuuuuaa

SEQ ID NO: 2314225 - RNA, 13 nt, Human
uucuuagugacuu

SEQ ID NO: 2314226 - RNA, 19 nt, Human
uucuuagcuuuuuaauugu

SEQ ID NO: 2314227 - RNA, 20 nt, Human
uucuuagcuuuuuaauuguu

SEQ ID NO: 2314228 - RNA, 17 nt, Human
uucuuagggaaggauac

SEQ ID NO: 2314229 - RNA, 19 nt, Human
uucuuaggguuaugauuaa

SEQ ID NO: 2314230 - RNA, 21 nt, Human
uucuuauguaugugaaaguua

SEQ ID NO: 2314231 - RNA, 22 nt, Human
uucuuauggaauugauuugcau

SEQ ID NO: 2314232 - RNA, 18 nt, Human
uucuuauggaauugauuu

SEQ ID NO: 2314233 - RNA, 17 nt, Human
uucuuauggaauugauu

SEQ ID NO: 2314234 - RNA, 15 nt, Human
uucuuauggaauuga

SEQ ID NO: 2314235 - RNA, 23 nt, Human
uucuuaugccauguuaauuucau

SEQ ID NO: 2314236 - RNA, 17 nt, Human
uucuuauguugcccagu

SEQ ID NO: 2314237 - RNA, 19 nt, Human
uucuuauucucacuccacc

SEQ ID NO: 2314238 - RNA, 15 nt, Human
uucuuaucuucugca

SEQ ID NO: 2314239 - RNA, 13 nt, Human
uucuucagagacu

SEQ ID NO: 2314240 - RNA, 13 nt, Human
uucuugucaaaaa

SEQ ID NO: 2314241 - RNA, 14 nt, Human
uucuugucaaaaaa

SEQ ID NO: 2314242 - RNA, 19 nt, Human
uucuugucugauuggcuca

SEQ ID NO: 2314243 - RNA, 14 nt, Human
uucuuuaacuuaau

SEQ ID NO: 2314244 - RNA, 22 nt, Human
uucuugugacagauuauacaga

SEQ ID NO: 2314245 - RNA, 22 nt, Human
uucuugugccauagucacaugg

SEQ ID NO: 2314246 - RNA, 14 nt, Human
uucuuguguguuua

SEQ ID NO: 2314247 - RNA, 18 nt, Human
uucuucaugcaaugacau

SEQ ID NO: 2314248 - RNA, 17 nt, Human
uucuucaugcaaugaca

SEQ ID NO: 2314249 - RNA, 15 nt, Human
uucuucaugcaauga

SEQ ID NO: 2314250 - RNA, 14 nt, Human
uucuucaugcaaug

SEQ ID NO: 2314251 - RNA, 21 nt, Human
uucuucauccggcagccugga

SEQ ID NO: 2314252 - RNA, 20 nt, Human
uucuucauucaauacaagug

SEQ ID NO: 2314253 - RNA, 18 nt, Human
uucuuguauuaagaauga

SEQ ID NO: 2314254 - RNA, 19 nt, Human
uucuuguauuaagaaugaa

SEQ ID NO: 2314255 - RNA, 14 nt, Human
uucuucagccaccu

SEQ ID NO: 2314256 - RNA, 18 nt, Human
uucuucauaacaauuuua

SEQ ID NO: 2314257 - RNA, 21 nt, Human
uucuucauaacaauuuuagga

SEQ ID NO: 2314258 - RNA, 23 nt, Human
uucuucagccaccucucuuuuuc

SEQ ID NO: 2314259 - RNA, 17 nt, Human
uucuucagaucagugcu

SEQ ID NO: 2314260 - RNA, 15 nt, Human
uucuuauugcuuuua

SEQ ID NO: 2314261 - RNA, 14 nt, Human
uucuggccucccac

SEQ ID NO: 2314262 - RNA, 15 nt, Human
uucuggccucccaca

SEQ ID NO: 2314263 - RNA, 16 nt, Human
uucuggcuaugcauuu

SEQ ID NO: 2314264 - RNA, 15 nt, Human
uucuggcagaggagg

SEQ ID NO: 2314265 - RNA, 20 nt, Human
uucuggcagaguugaagaca

SEQ ID NO: 2314266 - RNA, 15 nt, Human
uucuaagucuuucca

SEQ ID NO: 2314267 - RNA, 12 nt, Human
uucuaagucuuu

SEQ ID NO: 2314268 - RNA, 17 nt, Human
uucuaagucuuuccauu

SEQ ID NO: 2314269 - RNA, 24 nt, Human
uucuaaguaaaaccacagcaguug

SEQ ID NO: 2314270 - RNA, 17 nt, Human
uucuguauauacuuuuu

SEQ ID NO: 2314271 - RNA, 16 nt, Human
uucuguauauacuuuu

SEQ ID NO: 2314272 - RNA, 15 nt, Human
uucuguauauacuuu

SEQ ID NO: 2314273 - RNA, 23 nt, Human
uucuguauacaacccuggcauua

SEQ ID NO: 2314274 - RNA, 24 nt, Human
uucuguauacaacccuggcauuau

SEQ ID NO: 2314275 - RNA, 13 nt, Human
uucuguauacaac

SEQ ID NO: 2314276 - RNA, 21 nt, Human
uucuguauacaacccuggcau

SEQ ID NO: 2314277 - RNA, 19 nt, Human
uucugugagacccccacac

SEQ ID NO: 2314278 - RNA, 13 nt, Human
uucugugccugaa

SEQ ID NO: 2314279 - RNA, 17 nt, Human
uucugugccugaauauu

SEQ ID NO: 2314280 - RNA, 16 nt, Human
uucugugccugaauau

SEQ ID NO: 2314281 - RNA, 15 nt, Human
uucugugccugaaua

SEQ ID NO: 2314282 - RNA, 20 nt, Human
uucuguggaaaguguaaagc

SEQ ID NO: 2314283 - RNA, 18 nt, Human
uucuguggaaaguguaaa

SEQ ID NO: 2314284 - RNA, 19 nt, Human
uucuguggaaaguguaaag

SEQ ID NO: 2314285 - RNA, 13 nt, Human
uucuguggaaagu

SEQ ID NO: 2314286 - RNA, 15 nt, Human
uucuguggaaagugu

SEQ ID NO: 2314287 - RNA, 16 nt, Human
uucuguggaaagugua

SEQ ID NO: 2314288 - RNA, 17 nt, Human
uucuguggaaaguguaa

SEQ ID NO: 2314289 - RNA, 14 nt, Human
uugaauuagaaaca

SEQ ID NO: 2314290 - RNA, 23 nt, Human
uugaauuagaaacauaaauaaaa

SEQ ID NO: 2314291 - RNA, 23 nt, Human
uugaauuaaauuaggaauaaaua

SEQ ID NO: 2314292 - RNA, 23 nt, Human
uugaauuaauaucccuacaugua

SEQ ID NO: 2314293 - RNA, 22 nt, Human
uugaauuaaauuaggaauaaau

SEQ ID NO: 2314294 - RNA, 17 nt, Human
uugaauuaaauuaggaa

SEQ ID NO: 2314295 - RNA, 20 nt, Human
uugaauguuaaauaaauugu

SEQ ID NO: 2314296 - RNA, 23 nt, Human
uugaauguuauuuguuauuuuca

SEQ ID NO: 2314297 - RNA, 20 nt, Human
uugaauugaggggauuaaua

SEQ ID NO: 2314298 - RNA, 15 nt, Human
uugaauuguaacugu

SEQ ID NO: 2314299 - RNA, 21 nt, Human
uugaauucuugguugaggaaa

SEQ ID NO: 2314300 - RNA, 22 nt, Human
uugaauuaucuugguugaaaau

SEQ ID NO: 2314301 - RNA, 20 nt, Human
uugaauuaucuugguugaaa

SEQ ID NO: 2314302 - RNA, 18 nt, Human
uugaauuaucuugguuga

SEQ ID NO: 2314303 - RNA, 13 nt, Human
uugaauuaucuug

SEQ ID NO: 2314304 - RNA, 14 nt, Human
uugagccugggagg

SEQ ID NO: 2314305 - RNA, 14 nt, Human
uugagccuugaacu

SEQ ID NO: 2314306 - RNA, 16 nt, Human
uugagccuugaacuuu

SEQ ID NO: 2314307 - RNA, 15 nt, Human
uugagccuugaacuu

SEQ ID NO: 2314308 - RNA, 23 nt, Human
uugagcucagacccccacucuca

SEQ ID NO: 2314309 - RNA, 18 nt, Human
uugagcucucucauuguc

SEQ ID NO: 2314310 - RNA, 19 nt, Human
uugagcucugcagcccagg

SEQ ID NO: 2314311 - RNA, 13 nt, Human
uugagcucagccc

SEQ ID NO: 2314312 - RNA, 15 nt, Human
uugagcuauugcugu

SEQ ID NO: 2314313 - RNA, 18 nt, Human
uugaauuguaacuguucu

SEQ ID NO: 2314314 - RNA, 19 nt, Human
uugagccuugaacuuugac

SEQ ID NO: 2314315 - RNA, 14 nt, Human
uugagcugagaugg

SEQ ID NO: 2314316 - RNA, 14 nt, Human
uugagcugaaaugc

SEQ ID NO: 2314317 - RNA, 22 nt, Human
uugagcugaaaugcugcauuuu

SEQ ID NO: 2314318 - RNA, 11 nt, Human
uugagcugccu

SEQ ID NO: 2314319 - RNA, 17 nt, Human
uugaggacuauggaaau

SEQ ID NO: 2314320 - RNA, 12 nt, Human
uugaggagcccc

SEQ ID NO: 2314321 - RNA, 19 nt, Human
uugaggagcagcuucaguu

SEQ ID NO: 2314322 - RNA, 16 nt, Human
uugaggagccccagcu

SEQ ID NO: 2314323 - RNA, 19 nt, Human
uugaggaggggcagguaaa

SEQ ID NO: 2314324 - RNA, 13 nt, Human
uugaggccaggag

SEQ ID NO: 2314325 - RNA, 17 nt, Human
uugaggauuuugaguau

SEQ ID NO: 2314326 - RNA, 15 nt, Human
uugaggauuuugagu

SEQ ID NO: 2314327 - RNA, 16 nt, Human
uugaggauuuugagua

SEQ ID NO: 2314328 - RNA, 18 nt, Human
uugaggauauauuuucac

SEQ ID NO: 2314329 - RNA, 13 nt, Human
uugaggaguguga

SEQ ID NO: 2314330 - RNA, 21 nt, Human
uugaggauauauuuucacuuu

SEQ ID NO: 2314331 - RNA, 22 nt, Human
uugaggauauauuuucacuuug

SEQ ID NO: 2314332 - RNA, 22 nt, Human
uugauauuuucaacgcagcccu

SEQ ID NO: 2314333 - RNA, 22 nt, Human
uugauaugaaaaauaugauauu

SEQ ID NO: 2314334 - RNA, 14 nt, Human
uugaucaguauaau

SEQ ID NO: 2314335 - RNA, 18 nt, Human
uugaucagaucugacaug

SEQ ID NO: 2314336 - RNA, 18 nt, Human
uugaucaacaucuuuucu

SEQ ID NO: 2314337 - RNA, 22 nt, Human
uugaucaacaucuuuucuugcc

SEQ ID NO: 2314338 - RNA, 17 nt, Human
uugaucaacaucuuuuc

SEQ ID NO: 2314339 - RNA, 17 nt, Human
uugaucaaauucauuuu

SEQ ID NO: 2314340 - RNA, 21 nt, Human
uugauaugaaaaauaugauau

SEQ ID NO: 2314341 - RNA, 16 nt, Human
uugauaugaaaaauau

SEQ ID NO: 2314342 - RNA, 16 nt, Human
uugauaugcuuauaca

SEQ ID NO: 2314343 - RNA, 13 nt, Human
uugauaugaaaaa

SEQ ID NO: 2314344 - RNA, 15 nt, Human
uugaggcuuucaggu

SEQ ID NO: 2314345 - RNA, 14 nt, Human
uugaggcugcagcg

SEQ ID NO: 2314346 - RNA, 19 nt, Human
uugaggccugcccucaggg

SEQ ID NO: 2314347 - RNA, 20 nt, Human
uugauaugccuuuucccaac

SEQ ID NO: 2314348 - RNA, 16 nt, Human
uugauucagcucugca

SEQ ID NO: 2314349 - RNA, 23 nt, Human
uugauucagacagcugccuggga

SEQ ID NO: 2314350 - RNA, 17 nt, Human
uugauucagacagcugc

SEQ ID NO: 2314351 - RNA, 21 nt, Human
uugauucagacagcugccugg

SEQ ID NO: 2314352 - RNA, 22 nt, Human
uugaucauuuuccccccacucu

SEQ ID NO: 2314353 - RNA, 19 nt, Human
uugaucauuuuccccccac

SEQ ID NO: 2314354 - RNA, 18 nt, Human
uugaucauuuucccccca

SEQ ID NO: 2314355 - RNA, 17 nt, Human
uugauccagaaagaaaa

SEQ ID NO: 2314356 - RNA, 17 nt, Human
uugaucugcucagcccu

SEQ ID NO: 2314357 - RNA, 18 nt, Human
uugaucugcucagcccug

SEQ ID NO: 2314358 - RNA, 19 nt, Human
uugaucugcucagcccugg

SEQ ID NO: 2314359 - RNA, 19 nt, Human
uugaucgccuuucccaggu

SEQ ID NO: 2314360 - RNA, 21 nt, Human
uugaucccuguuacccagaga

SEQ ID NO: 2314361 - RNA, 15 nt, Human
uugccagaaagcaua

SEQ ID NO: 2314362 - RNA, 20 nt, Human
uugcauaauaagcuaaagag

SEQ ID NO: 2314363 - RNA, 15 nt, Human
uugcauaauaagcua

SEQ ID NO: 2314364 - RNA, 22 nt, Human
uugccagacauguggugggaca

SEQ ID NO: 2314365 - RNA, 20 nt, Human
uugccagaaagcauaaaauu

SEQ ID NO: 2314366 - RNA, 14 nt, Human
uugccagagaugga

SEQ ID NO: 2314367 - RNA, 19 nt, Human
uugccagagauccaaaaga

SEQ ID NO: 2314368 - RNA, 16 nt, Human
uugcauaacguauaaa

SEQ ID NO: 2314369 - RNA, 19 nt, Human
uugcauaacaauuccucua

SEQ ID NO: 2314370 - RNA, 23 nt, Human
uugcaguuuaucauucaagugua

SEQ ID NO: 2314371 - RNA, 19 nt, Human
uugcaguuuaucauucaag

SEQ ID NO: 2314372 - RNA, 20 nt, Human
uugcaguuuaucauucaagu

SEQ ID NO: 2314373 - RNA, 17 nt, Human
uugccagaaagcauaaa

SEQ ID NO: 2314374 - RNA, 15 nt, Human
uugccagcugcugcu

SEQ ID NO: 2314375 - RNA, 19 nt, Human
uugccagcugcugcuggau

SEQ ID NO: 2314376 - RNA, 12 nt, Human
uugccagcuuuu

SEQ ID NO: 2314377 - RNA, 18 nt, Human
uugccagcuuuuccuccc

SEQ ID NO: 2314378 - RNA, 19 nt, Human
uugccagcuuuuccucccu

SEQ ID NO: 2314379 - RNA, 20 nt, Human
uugccagcuuuuccucccuu

SEQ ID NO: 2314380 - RNA, 22 nt, Human
uugccagcuuuuccucccuugg

SEQ ID NO: 2314381 - RNA, 19 nt, Human
uugccauauuuucaccauu

SEQ ID NO: 2314382 - RNA, 16 nt, Human
uugccauguuggccag

SEQ ID NO: 2314383 - RNA, 17 nt, Human
uugccauguuggccagg

SEQ ID NO: 2314384 - RNA, 18 nt, Human
uugccauguuggccaggc

SEQ ID NO: 2314385 - RNA, 19 nt, Human
uugccauguuggccaggcu

SEQ ID NO: 2314386 - RNA, 23 nt, Human
uugccaucugcgugacaauaaaa

SEQ ID NO: 2314387 - RNA, 12 nt, Human
uugccaggcuag

SEQ ID NO: 2314388 - RNA, 19 nt, Human
uugcagcgauuaauaacag

SEQ ID NO: 2314389 - RNA, 18 nt, Human
uugcagcgauuaauaaca

SEQ ID NO: 2314390 - RNA, 18 nt, Human
uugcagccggcacagggu

SEQ ID NO: 2314391 - RNA, 20 nt, Human
uugcagccggcacagggucu

SEQ ID NO: 2314392 - RNA, 16 nt, Human
uugcaguucagcacca

SEQ ID NO: 2314393 - RNA, 13 nt, Human
uugcaguucaccu

SEQ ID NO: 2314394 - RNA, 13 nt, Human
uugcaguuuauca

SEQ ID NO: 2314395 - RNA, 18 nt, Human
uugcaguuuaucauucaa

SEQ ID NO: 2314396 - RNA, 20 nt, Human
uugcaguguggugagaucau

SEQ ID NO: 2314397 - RNA, 14 nt, Human
uugcagagacagga

SEQ ID NO: 2314398 - RNA, 19 nt, Human
uugcagacucaguuuguca

SEQ ID NO: 2314399 - RNA, 20 nt, Human
uugcagacuagaauucuagu

SEQ ID NO: 2314400 - RNA, 21 nt, Human
uugcagaaaagcaccugccga

SEQ ID NO: 2314401 - RNA, 13 nt, Human
uugcagacuagaa

SEQ ID NO: 2314402 - RNA, 23 nt, Human
uugcagacaggcaagcaccuccu

SEQ ID NO: 2314403 - RNA, 14 nt, Human
uugcagcagugagu

SEQ ID NO: 2314404 - RNA, 12 nt, Human
uugcagcaguga

SEQ ID NO: 2314405 - RNA, 18 nt, Human
uugcagcacucacacagg

SEQ ID NO: 2314406 - RNA, 23 nt, Human
uugcagcagugagucucuucaga

SEQ ID NO: 2314407 - RNA, 19 nt, Human
uugcagagacaggaccuga

SEQ ID NO: 2314408 - RNA, 14 nt, Human
uugcagaugacaaa

SEQ ID NO: 2314409 - RNA, 19 nt, Human
uugcagaugacaaaaauuc

SEQ ID NO: 2314410 - RNA, 18 nt, Human
uugcagauucauuuuucu

SEQ ID NO: 2314411 - RNA, 19 nt, Human
uugcacucuaaaagguuca

SEQ ID NO: 2314412 - RNA, 16 nt, Human
uugcacuccagccugg

SEQ ID NO: 2314413 - RNA, 22 nt, Human
uugcacucuaaaagguucaggg

SEQ ID NO: 2314414 - RNA, 17 nt, Human
uugcacucuagccuggg

SEQ ID NO: 2314415 - RNA, 12 nt, Human
uugcacugaggg

SEQ ID NO: 2314416 - RNA, 13 nt, Human
uugcacugagggc

SEQ ID NO: 2314417 - RNA, 17 nt, Human
uugcacuugugauuauu

SEQ ID NO: 2314418 - RNA, 16 nt, Human
uugcacugagggccac

SEQ ID NO: 2314419 - RNA, 21 nt, Human
uugcacugagggccacacuau

SEQ ID NO: 2314420 - RNA, 20 nt, Human
uugcagaaaagcaccugccg

SEQ ID NO: 2314421 - RNA, 19 nt, Human
uugcagaaaagcaccugcc

SEQ ID NO: 2314422 - RNA, 18 nt, Human
uugcagaaaagcaccugc

SEQ ID NO: 2314423 - RNA, 17 nt, Human
uugcagaaaagcaccug

SEQ ID NO: 2314424 - RNA, 15 nt, Human
uugcagaaacauuuu

SEQ ID NO: 2314425 - RNA, 17 nt, Human
uugcacuggaguucuau

SEQ ID NO: 2314426 - RNA, 20 nt, Human
uugcacuugugauuauuuau

SEQ ID NO: 2314427 - RNA, 13 nt, Human
uugauucauaaug

SEQ ID NO: 2314428 - RNA, 17 nt, Human
uugauucauaaugacuu

SEQ ID NO: 2314429 - RNA, 19 nt, Human
uugauucauaguaacuucu

SEQ ID NO: 2314430 - RNA, 23 nt, Human
uugauucgguauccccccaucuu

SEQ ID NO: 2314431 - RNA, 22 nt, Human
uugaucugcucagcccuggagg

SEQ ID NO: 2314432 - RNA, 20 nt, Human
uugaucugcucagcccugga

SEQ ID NO: 2314433 - RNA, 21 nt, Human
uugaucugcucagcccuggag

SEQ ID NO: 2314434 - RNA, 12 nt, Human
uugauucuccuu

SEQ ID NO: 2314435 - RNA, 13 nt, Human
uugauucuccuuc

SEQ ID NO: 2314436 - RNA, 17 nt, Human
uugauucuccuucagcc

SEQ ID NO: 2314437 - RNA, 20 nt, Human
uugauucuccuucagcccuc

SEQ ID NO: 2314438 - RNA, 19 nt, Human
uuuacccacacacagauaa

SEQ ID NO: 2314439 - RNA, 18 nt, Human
uuuacccaaaaacuaaau

SEQ ID NO: 2314440 - RNA, 20 nt, Human
uuuaccaugccccugagcaa

SEQ ID NO: 2314441 - RNA, 23 nt, Human
uuuaccagccuccguauuucaga

SEQ ID NO: 2314442 - RNA, 20 nt, Human
uuuacaugcaauuuauuaaa

SEQ ID NO: 2314443 - RNA, 20 nt, Human
uuuacagccucacuugaaug

SEQ ID NO: 2314444 - RNA, 21 nt, Human
uuuacagcacuacucugugcc

SEQ ID NO: 2314445 - RNA, 17 nt, Human
uuuacagaugaauguau

SEQ ID NO: 2314446 - RNA, 15 nt, Human
uuuacagcacuacuc

SEQ ID NO: 2314447 - RNA, 16 nt, Human
uuuacagcacuacucu

SEQ ID NO: 2314448 - RNA, 13 nt, Human
uuuacagcugccu

SEQ ID NO: 2314449 - RNA, 15 nt, Human
uuuacauacugcugu

SEQ ID NO: 2314450 - RNA, 18 nt, Human
uuuacagcacuacucugu

SEQ ID NO: 2314451 - RNA, 21 nt, Human
uuuacaguuucaaaaacugua

SEQ ID NO: 2314452 - RNA, 18 nt, Human
uuuacaugaauugcauuu

SEQ ID NO: 2314453 - RNA, 12 nt, Human
uuuaauauuuaa

SEQ ID NO: 2314454 - RNA, 22 nt, Human
uuuaauauugagaaagaaacua

SEQ ID NO: 2314455 - RNA, 15 nt, Human
uuuaauauugagaaa

SEQ ID NO: 2314456 - RNA, 18 nt, Human
uuuaauauuuaaacagca

SEQ ID NO: 2314457 - RNA, 14 nt, Human
uuuaauauuuugca

SEQ ID NO: 2314458 - RNA, 13 nt, Human
uuuaauauuuaaa

SEQ ID NO: 2314459 - RNA, 15 nt, Human
uuuaauauuuaaaca

SEQ ID NO: 2314460 - RNA, 13 nt, Human
uuuacagagacag

SEQ ID NO: 2314461 - RNA, 20 nt, Human
uuuacagaggacaguauuug

SEQ ID NO: 2314462 - RNA, 14 nt, Human
uuuaauauagcuau

SEQ ID NO: 2314463 - RNA, 16 nt, Human
uuuaauauagcuauuu

SEQ ID NO: 2314464 - RNA, 15 nt, Human
uuuaauauagcuauu

SEQ ID NO: 2314465 - RNA, 18 nt, Human
uuuaauauggguucuuuu

SEQ ID NO: 2314466 - RNA, 17 nt, Human
uuuaaccauuaaaacug

SEQ ID NO: 2314467 - RNA, 23 nt, Human
uuuaaccaaaggugaaggaauau

SEQ ID NO: 2314468 - RNA, 20 nt, Human
uuuaaccauuaaaacugaag

SEQ ID NO: 2314469 - RNA, 22 nt, Human
uuuaaccauugucuuguucugu

SEQ ID NO: 2314470 - RNA, 14 nt, Human
uuuaauaaacacuc

SEQ ID NO: 2314471 - RNA, 15 nt, Human
uuuaauaaacacucu

SEQ ID NO: 2314472 - RNA, 15 nt, Human
uuuaacagaaaugua

SEQ ID NO: 2314473 - RNA, 14 nt, Human
uuuaacagaaaugu

SEQ ID NO: 2314474 - RNA, 14 nt, Human
uuuaaccaaaacau

SEQ ID NO: 2314475 - RNA, 19 nt, Human
uuuaaccaaaacaugucuc

SEQ ID NO: 2314476 - RNA, 12 nt, Human
uuuaaccaaagg

SEQ ID NO: 2314477 - RNA, 13 nt, Human
uuuaaccaaaggu

SEQ ID NO: 2314478 - RNA, 15 nt, Human
uuuaaccaaagguga

SEQ ID NO: 2314479 - RNA, 21 nt, Human
uuuaaccaaaggugaaggaau

SEQ ID NO: 2314480 - RNA, 21 nt, Human
uuuaacaccugauguguacau

SEQ ID NO: 2314481 - RNA, 16 nt, Human
uuuaaccuaugauauu

SEQ ID NO: 2314482 - RNA, 19 nt, Human
uuuaauaauguuucaaaca

SEQ ID NO: 2314483 - RNA, 15 nt, Human
uuuaauauaaagccu

SEQ ID NO: 2314484 - RNA, 18 nt, Human
uuuaauaguguuaaucaa

SEQ ID NO: 2314485 - RNA, 22 nt, Human
uuuaauaguguuaaucaauuua

SEQ ID NO: 2314486 - RNA, 12 nt, Human
uuuaauaguguu

SEQ ID NO: 2314487 - RNA, 14 nt, Human
uuuaauaguguuaa

SEQ ID NO: 2314488 - RNA, 17 nt, Human
uuuaauaguguuaauca

SEQ ID NO: 2314489 - RNA, 23 nt, Human
uuuaauauaaaguaguccuguga

SEQ ID NO: 2314490 - RNA, 22 nt, Human
uuuaauaaacacucuugaaaaa

SEQ ID NO: 2314491 - RNA, 13 nt, Human
uuuaauaaaccau

SEQ ID NO: 2314492 - RNA, 14 nt, Human
uuuaauaauguuuc

SEQ ID NO: 2314493 - RNA, 15 nt, Human
uuuaauaauguuuca

SEQ ID NO: 2314494 - RNA, 17 nt, Human
uuuauacguguagcuau

SEQ ID NO: 2314495 - RNA, 16 nt, Human
uuuauacugaaggaaa

SEQ ID NO: 2314496 - RNA, 20 nt, Human
uuuauacucuuucuguauau

SEQ ID NO: 2314497 - RNA, 18 nt, Human
uuuauacucuuucuguau

SEQ ID NO: 2314498 - RNA, 13 nt, Human
uuuauacuguaua

SEQ ID NO: 2314499 - RNA, 16 nt, Human
uuuauacuguuuacug

SEQ ID NO: 2314500 - RNA, 12 nt, Human
uuuaucauuuuc

SEQ ID NO: 2314501 - RNA, 21 nt, Human
uuuauccauucaacugaaaau

SEQ ID NO: 2314502 - RNA, 16 nt, Human
uuuaucccucaccugu

SEQ ID NO: 2314503 - RNA, 16 nt, Human
uuuauacucuuucugu

SEQ ID NO: 2314504 - RNA, 15 nt, Human
uuuauacguguagcu

SEQ ID NO: 2314505 - RNA, 16 nt, Human
uuuauacguguagcua

SEQ ID NO: 2314506 - RNA, 20 nt, Human
uuuauacauaaacaagacca

SEQ ID NO: 2314507 - RNA, 12 nt, Human
uuuauacauaaa

SEQ ID NO: 2314508 - RNA, 17 nt, Human
uuuaucugggauuaugg

SEQ ID NO: 2314509 - RNA, 14 nt, Human
uuuaucucuauuua

SEQ ID NO: 2314510 - RNA, 17 nt, Human
uuuaucucuauuuaaua

SEQ ID NO: 2314511 - RNA, 13 nt, Human
uuuaucugauuaa

SEQ ID NO: 2314512 - RNA, 13 nt, Human
uuuaucucuauuu

SEQ ID NO: 2314513 - RNA, 18 nt, Human
uuuauccucuuuagaguu

SEQ ID NO: 2314514 - RNA, 18 nt, Human
uuuauccugaaauuucag

SEQ ID NO: 2314515 - RNA, 19 nt, Human
uuuauccugaaauuucaga

SEQ ID NO: 2314516 - RNA, 20 nt, Human
uuuaugaaugaaaaaacagu

SEQ ID NO: 2314517 - RNA, 12 nt, Human
uuuaucuuuaua

SEQ ID NO: 2314518 - RNA, 18 nt, Human
uuuaugaauuaaaguaau

SEQ ID NO: 2314519 - RNA, 16 nt, Human
uuuaugaauuaaagua

SEQ ID NO: 2314520 - RNA, 20 nt, Human
uuuaugacuucauuaauaau

SEQ ID NO: 2314521 - RNA, 19 nt, Human
uuuaucuguaguaaacuau

SEQ ID NO: 2314522 - RNA, 16 nt, Human
uuuaucuguaguaaac

SEQ ID NO: 2314523 - RNA, 21 nt, Human
uuuaucuuggacugacauuua

SEQ ID NO: 2314524 - RNA, 15 nt, Human
uuuaucuugggacug

SEQ ID NO: 2314525 - RNA, 14 nt, Human
uuuaucuugucucu

SEQ ID NO: 2314526 - RNA, 13 nt, Human
uuuaucuguucuu

SEQ ID NO: 2314527 - RNA, 17 nt, Human
uuuaguuguaucucuuu

SEQ ID NO: 2314528 - RNA, 19 nt, Human
uuuaguugcagacucaguu

SEQ ID NO: 2314529 - RNA, 20 nt, Human
uuuaguuguaucucuuuuga

SEQ ID NO: 2314530 - RNA, 22 nt, Human
uuuauaaaucgcuuuugauaau

SEQ ID NO: 2314531 - RNA, 18 nt, Human
uuuauaaaucgcuuuuga

SEQ ID NO: 2314532 - RNA, 15 nt, Human
uuuauaaaucgcuuu

SEQ ID NO: 2314533 - RNA, 19 nt, Human
uuuaguugcagaaacauuu

SEQ ID NO: 2314534 - RNA, 11 nt, Human
uuuaguucuuu

SEQ ID NO: 2314535 - RNA, 17 nt, Human
uuuaguucuuuggaaau

SEQ ID NO: 2314536 - RNA, 18 nt, Human
uuuauaaacuuuaccuuu

SEQ ID NO: 2314537 - RNA, 14 nt, Human
uuuauaaaugcuau

SEQ ID NO: 2314538 - RNA, 15 nt, Human
uuuauaaaugcuauu

SEQ ID NO: 2314539 - RNA, 19 nt, Human
uuuauaaaucgcuuuugau

SEQ ID NO: 2314540 - RNA, 12 nt, Human
uuuauaaaugcu

SEQ ID NO: 2314541 - RNA, 13 nt, Human
uuuauaaaugcua

SEQ ID NO: 2314542 - RNA, 16 nt, Human
uuuauaaaugcuauuu

SEQ ID NO: 2314543 - RNA, 14 nt, Human
uuuaguuuacucaa

SEQ ID NO: 2314544 - RNA, 15 nt, Human
uuuauacaacagugc

SEQ ID NO: 2314545 - RNA, 16 nt, Human
uuuauacaacagugcu

SEQ ID NO: 2314546 - RNA, 17 nt, Human
uuuauacaacagugcua

SEQ ID NO: 2314547 - RNA, 18 nt, Human
uuuauacaacagugcuaa

SEQ ID NO: 2314548 - RNA, 16 nt, Human
uuuauacaauaucauc

SEQ ID NO: 2314549 - RNA, 19 nt, Human
uuuauacaacagugcuaaa

SEQ ID NO: 2314550 - RNA, 23 nt, Human
uuuauacaacagugcuaaaaaug

SEQ ID NO: 2314551 - RNA, 11 nt, Human
uuuauacacau

SEQ ID NO: 2314552 - RNA, 12 nt, Human
uuuauacacaua

SEQ ID NO: 2314553 - RNA, 15 nt, Human
uuuauacacauaauu

SEQ ID NO: 2314554 - RNA, 19 nt, Human
uuuauacaccaauugauuu

SEQ ID NO: 2314555 - RNA, 22 nt, Human
uuuagacccuauugcugcuuga

SEQ ID NO: 2314556 - RNA, 14 nt, Human
uuuaguuauaguuu

SEQ ID NO: 2314557 - RNA, 15 nt, Human
uuuaguuauaguuuc

SEQ ID NO: 2314558 - RNA, 15 nt, Human
uuuagacuguagccu

SEQ ID NO: 2314559 - RNA, 17 nt, Human
uuuaguugcaacuuugu

SEQ ID NO: 2314560 - RNA, 18 nt, Human
uuuaguugcaacuuugua

SEQ ID NO: 2314561 - RNA, 15 nt, Human
uuuagaccauuuauc

SEQ ID NO: 2314562 - RNA, 20 nt, Human
uuuagacagucucacuuugu

SEQ ID NO: 2314563 - RNA, 16 nt, Human
uuuagacagucucacu

SEQ ID NO: 2314564 - RNA, 19 nt, Human
uuuagacccuauugcugcu

SEQ ID NO: 2314565 - RNA, 14 nt, Human
uuuacccauauccc

SEQ ID NO: 2314566 - RNA, 17 nt, Human
uuuacccauauccccuc

SEQ ID NO: 2314567 - RNA, 18 nt, Human
uuuacccauauccccucu

SEQ ID NO: 2314568 - RNA, 21 nt, Human
uuuacccauauccccucuccc

SEQ ID NO: 2314569 - RNA, 11 nt, Human
uuuagacagua

SEQ ID NO: 2314570 - RNA, 19 nt, Human
uuuaaaaguuauuaauauu

SEQ ID NO: 2314571 - RNA, 17 nt, Human
uuuaaaaguuucaaugu

SEQ ID NO: 2314572 - RNA, 15 nt, Human
uuuaaaaguuauuaa

SEQ ID NO: 2314573 - RNA, 20 nt, Human
uuuaaaaggauuuuuaucuu

SEQ ID NO: 2314574 - RNA, 20 nt, Human
uuuaaaaguuucaaugugau

SEQ ID NO: 2314575 - RNA, 19 nt, Human
uuuaaaauacacacucaaa

SEQ ID NO: 2314576 - RNA, 16 nt, Human
uuuaaaauauuuaucu

SEQ ID NO: 2314577 - RNA, 16 nt, Human
uuuaaaaucuuuucua

SEQ ID NO: 2314578 - RNA, 15 nt, Human
uuuaaaaucugucac

SEQ ID NO: 2314579 - RNA, 16 nt, Human
uuuaaaaucauuucug

SEQ ID NO: 2314580 - RNA, 14 nt, Human
uuuaaaagauucau

SEQ ID NO: 2314581 - RNA, 18 nt, Human
uuuaaaagaugcaaugua

SEQ ID NO: 2314582 - RNA, 16 nt, Human
uuuaaaagauucauuu

SEQ ID NO: 2314583 - RNA, 14 nt, Human
uuuaaaagacacug

SEQ ID NO: 2314584 - RNA, 20 nt, Human
uuuaaaagauaaauauuaua

SEQ ID NO: 2314585 - RNA, 13 nt, Human
uuuaaaagauaca

SEQ ID NO: 2314586 - RNA, 21 nt, Human
uuuaaaacccauuuaaauuuu

SEQ ID NO: 2314587 - RNA, 14 nt, Human
uuuaaaacccauuu

SEQ ID NO: 2314588 - RNA, 14 nt, Human
uuuaaaagaaugau

SEQ ID NO: 2314589 - RNA, 17 nt, Human
uuuaaaagaaugauuau

SEQ ID NO: 2314590 - RNA, 11 nt, Human
uuuaaaacuug

SEQ ID NO: 2314591 - RNA, 17 nt, Human
uuuaaaagaaugggcag

SEQ ID NO: 2314592 - RNA, 18 nt, Human
uuuaaaagaaugggcagu

SEQ ID NO: 2314593 - RNA, 23 nt, Human
uuuaaaagaaugggcaguuacau

SEQ ID NO: 2314594 - RNA, 16 nt, Human
uuuaaaagacaagacu

SEQ ID NO: 2314595 - RNA, 19 nt, Human
uuuaaaagacaagacuuca

SEQ ID NO: 2314596 - RNA, 17 nt, Human
uuuaacaccugaugugu

SEQ ID NO: 2314597 - RNA, 18 nt, Human
uuuaacaccugaugugua

SEQ ID NO: 2314598 - RNA, 19 nt, Human
uuuaacacaaguccuguga

SEQ ID NO: 2314599 - RNA, 14 nt, Human
uuuaaacuguguac

SEQ ID NO: 2314600 - RNA, 23 nt, Human
uuuaacaauuuccuuuauauuua

SEQ ID NO: 2314601 - RNA, 13 nt, Human
uuuaacagaaaug

SEQ ID NO: 2314602 - RNA, 22 nt, Human
uuuaaaccucaccuuugugggg

SEQ ID NO: 2314603 - RNA, 15 nt, Human
uuuaaacugauucau

SEQ ID NO: 2314604 - RNA, 16 nt, Human
uuuaaacaggcccagc

SEQ ID NO: 2314605 - RNA, 16 nt, Human
uuuaaacauagaaagu

SEQ ID NO: 2314606 - RNA, 13 nt, Human
uuuaaacagcagu

SEQ ID NO: 2314607 - RNA, 14 nt, Human
uuuaaacaccuccu

SEQ ID NO: 2314608 - RNA, 14 nt, Human
uuuaaacaaauuca

SEQ ID NO: 2314609 - RNA, 23 nt, Human
uuuaaacaaauucauauucuguc

SEQ ID NO: 2314610 - RNA, 21 nt, Human
uuuaaacccauuuuagucacu

SEQ ID NO: 2314611 - RNA, 17 nt, Human
uuuaaacccauuuuagu

SEQ ID NO: 2314612 - RNA, 15 nt, Human
uuuaaacccauuuua

SEQ ID NO: 2314613 - RNA, 21 nt, Human
uuuaaacaggcccagcauugc

SEQ ID NO: 2314614 - RNA, 20 nt, Human
uuuaaacaugguuacaauca

SEQ ID NO: 2314615 - RNA, 16 nt, Human
uuuaaaauugugaugu

SEQ ID NO: 2314616 - RNA, 19 nt, Human
uuuaaaauuuaaguaucuu

SEQ ID NO: 2314617 - RNA, 17 nt, Human
uuuaaaauuuuaucucu

SEQ ID NO: 2314618 - RNA, 18 nt, Human
uuuaaaauuuuuuuagaa

SEQ ID NO: 2314619 - RNA, 19 nt, Human
uuuaaaauuuuuuuagaaa

SEQ ID NO: 2314620 - RNA, 20 nt, Human
uuuaaacaaaauagaagcug

SEQ ID NO: 2314621 - RNA, 12 nt, Human
uuuaaacaaauu

SEQ ID NO: 2314622 - RNA, 12 nt, Human
uuuaaaaugauu

SEQ ID NO: 2314623 - RNA, 14 nt, Human
uuuaaaaugauuag

SEQ ID NO: 2314624 - RNA, 16 nt, Human
uuuaaaaugagaaauc

SEQ ID NO: 2314625 - RNA, 12 nt, Human
uuuaaaaugucu

SEQ ID NO: 2314626 - RNA, 18 nt, Human
uuguuuuaaaauuaaagc

SEQ ID NO: 2314627 - RNA, 20 nt, Human
uuguuuuaaaauuaaagcua

SEQ ID NO: 2314628 - RNA, 21 nt, Human
uuguuuguuucucccccuggg

SEQ ID NO: 2314629 - RNA, 13 nt, Human
uuguuuguuucaa

SEQ ID NO: 2314630 - RNA, 12 nt, Human
uuguuuguuuca

SEQ ID NO: 2314631 - RNA, 14 nt, Human
uuuaaaacauguaa

SEQ ID NO: 2314632 - RNA, 15 nt, Human
uuuaaaacauguaau

SEQ ID NO: 2314633 - RNA, 16 nt, Human
uuuaaaacauguaaua

SEQ ID NO: 2314634 - RNA, 15 nt, Human
uuuaaaacagacacu

SEQ ID NO: 2314635 - RNA, 13 nt, Human
uuguuugucuuua

SEQ ID NO: 2314636 - RNA, 11 nt, Human
uuguuugugcu

SEQ ID NO: 2314637 - RNA, 12 nt, Human
uuguuugugcuu

SEQ ID NO: 2314638 - RNA, 22 nt, Human
uuguuuguauguauaauucaaa

SEQ ID NO: 2314639 - RNA, 16 nt, Human
uuguuugguauuguau

SEQ ID NO: 2314640 - RNA, 19 nt, Human
uuguuugguauuguauuua

SEQ ID NO: 2314641 - RNA, 19 nt, Human
uuguuuguauguauaauuc

SEQ ID NO: 2314642 - RNA, 13 nt, Human
uuguuuguaugua

SEQ ID NO: 2314643 - RNA, 15 nt, Human
uuguuucuuucuagu

SEQ ID NO: 2314644 - RNA, 21 nt, Human
uuguuugguauuguauuuauu

SEQ ID NO: 2314645 - RNA, 13 nt, Human
uuguuucuuccaa

SEQ ID NO: 2314646 - RNA, 19 nt, Human
uuguuucuuccaaagcaca

SEQ ID NO: 2314647 - RNA, 15 nt, Human
uuguuucuuccaaag

SEQ ID NO: 2314648 - RNA, 15 nt, Human
uuguuugguauugua

SEQ ID NO: 2314649 - RNA, 20 nt, Human
uuguuuggggaugagaaagg

SEQ ID NO: 2314650 - RNA, 20 nt, Human
uuguuuauucuuuuuaaagu

SEQ ID NO: 2314651 - RNA, 18 nt, Human
uuguuuauaccuuugccu

SEQ ID NO: 2314652 - RNA, 23 nt, Human
uuguuuacuuaaagauuuaucaa

SEQ ID NO: 2314653 - RNA, 21 nt, Human
uuguuuagaaagaauauucau

SEQ ID NO: 2314654 - RNA, 17 nt, Human
uuguuucucccccuggg

SEQ ID NO: 2314655 - RNA, 20 nt, Human
uuguucaaaauauguucuuu

SEQ ID NO: 2314656 - RNA, 22 nt, Human
uuguuauuuugcaaccucgcug

SEQ ID NO: 2314657 - RNA, 15 nt, Human
uuguuauuuugcaac

SEQ ID NO: 2314658 - RNA, 14 nt, Human
uuguuauuuauaac

SEQ ID NO: 2314659 - RNA, 15 nt, Human
uuguuauuuguacag

SEQ ID NO: 2314660 - RNA, 17 nt, Human
uuguuuaaaaucauuuc

SEQ ID NO: 2314661 - RNA, 18 nt, Human
uuguuuaaaaucauuucu

SEQ ID NO: 2314662 - RNA, 21 nt, Human
uuguuuacagcacuacucugu

SEQ ID NO: 2314663 - RNA, 19 nt, Human
uuguucaauaauaaauauu

SEQ ID NO: 2314664 - RNA, 13 nt, Human
uuguuauuuucag

SEQ ID NO: 2314665 - RNA, 13 nt, Human
uuguuuaaagcaa

SEQ ID NO: 2314666 - RNA, 17 nt, Human
uuguuuaaagcaacugu

SEQ ID NO: 2314667 - RNA, 18 nt, Human
uuguuuagaagaagugug

SEQ ID NO: 2314668 - RNA, 15 nt, Human
uuguuuagaagaagu

SEQ ID NO: 2314669 - RNA, 22 nt, Human
uuguuuacagcacuacucugug

SEQ ID NO: 2314670 - RNA, 16 nt, Human
uuguuuacuuaaagau

SEQ ID NO: 2314671 - RNA, 18 nt, Human
uuguuuacuuaaagauuu

SEQ ID NO: 2314672 - RNA, 23 nt, Human
uuguuauuauauaauuacauauu

SEQ ID NO: 2314673 - RNA, 23 nt, Human
uuguuauugggcaagugauugaa

SEQ ID NO: 2314674 - RNA, 14 nt, Human
uuguuauuauauaa

SEQ ID NO: 2314675 - RNA, 23 nt, Human
uugucuuuguaaugucaccaccu

SEQ ID NO: 2314676 - RNA, 20 nt, Human
uugucuuuggacccugaggc

SEQ ID NO: 2314677 - RNA, 24 nt, Human
uugucuuuggacccugaggcccag

SEQ ID NO: 2314678 - RNA, 14 nt, Human
uugucuuguucugu

SEQ ID NO: 2314679 - RNA, 14 nt, Human
uugucuuuaacugu

SEQ ID NO: 2314680 - RNA, 13 nt, Human
uugucuuucagga

SEQ ID NO: 2314681 - RNA, 15 nt, Human
uugucuuuggacccu

SEQ ID NO: 2314682 - RNA, 15 nt, Human
uugucuucuccccag

SEQ ID NO: 2314683 - RNA, 16 nt, Human
uugucuucuccccagg

SEQ ID NO: 2314684 - RNA, 13 nt, Human
uugucuugaaaga

SEQ ID NO: 2314685 - RNA, 14 nt, Human
uugucuugaaagau

SEQ ID NO: 2314686 - RNA, 15 nt, Human
uugucuugaaugucu

SEQ ID NO: 2314687 - RNA, 22 nt, Human
uugucuugaaugucuuuugaau

SEQ ID NO: 2314688 - RNA, 18 nt, Human
uugucuugccuuauuaaa

SEQ ID NO: 2314689 - RNA, 15 nt, Human
uugucuuauauauau

SEQ ID NO: 2314690 - RNA, 13 nt, Human
uugucuuauauau

SEQ ID NO: 2314691 - RNA, 16 nt, Human
uuucuccuuuguacuu

SEQ ID NO: 2314692 - RNA, 22 nt, Human
uuucucuaacuucaaggcccau

SEQ ID NO: 2314693 - RNA, 17 nt, Human
uuucucgauuuuaucuu

SEQ ID NO: 2314694 - RNA, 16 nt, Human
uuucuaccuugagguc

SEQ ID NO: 2314695 - RNA, 13 nt, Human
uuucuaccuccca

SEQ ID NO: 2314696 - RNA, 14 nt, Human
uuucuaccucccag

SEQ ID NO: 2314697 - RNA, 15 nt, Human
uuucuaccucccaga

SEQ ID NO: 2314698 - RNA, 20 nt, Human
uuucucuccagccugacuug

SEQ ID NO: 2314699 - RNA, 12 nt, Human
uuucucuaggaa

SEQ ID NO: 2314700 - RNA, 22 nt, Human
uuucuacccagcgagcccuggu

SEQ ID NO: 2314701 - RNA, 21 nt, Human
uuucuacaaugugaacuuuau

SEQ ID NO: 2314702 - RNA, 15 nt, Human
uuucuacccuagcca

SEQ ID NO: 2314703 - RNA, 17 nt, Human
uuucuacccuagccauu

SEQ ID NO: 2314704 - RNA, 20 nt, Human
uuucuacccuagccauuccu

SEQ ID NO: 2314705 - RNA, 16 nt, Human
uuucuaccauuucaga

SEQ ID NO: 2314706 - RNA, 19 nt, Human
uuucuacagugguuuuaua

SEQ ID NO: 2314707 - RNA, 15 nt, Human
uuucuacccagcgag

SEQ ID NO: 2314708 - RNA, 18 nt, Human
uuucuacccagcgagccc

SEQ ID NO: 2314709 - RNA, 19 nt, Human
uuucugaaaauuaacacug

SEQ ID NO: 2314710 - RNA, 16 nt, Human
uuucugaaaauauaac

SEQ ID NO: 2314711 - RNA, 20 nt, Human
uuucugaaaauuaacacugc

SEQ ID NO: 2314712 - RNA, 14 nt, Human
uuucugaaauaaca

SEQ ID NO: 2314713 - RNA, 23 nt, Human
uuucugauaacuagauggugcug

SEQ ID NO: 2314714 - RNA, 22 nt, Human
uuuccucucuuuguucucagcu

SEQ ID NO: 2314715 - RNA, 23 nt, Human
uuuccucucuuuguucucagcuc

SEQ ID NO: 2314716 - RNA, 19 nt, Human
uuuccucucuuuguucuca

SEQ ID NO: 2314717 - RNA, 19 nt, Human
uuuccuggcacugcuucca

SEQ ID NO: 2314718 - RNA, 22 nt, Human
uuuccucuuagucgagccaagu

SEQ ID NO: 2314719 - RNA, 23 nt, Human
uuuccuggcacugcuuccaguga

SEQ ID NO: 2314720 - RNA, 19 nt, Human
uuuccucccuucugcuacu

SEQ ID NO: 2314721 - RNA, 24 nt, Human
uuuccuaauaaaguucuguacuca

SEQ ID NO: 2314722 - RNA, 17 nt, Human
uuuccuaaggcugcaag

SEQ ID NO: 2314723 - RNA, 15 nt, Human
uuuccuaaggcugca

SEQ ID NO: 2314724 - RNA, 19 nt, Human
uuuccuaagugauuguaug

SEQ ID NO: 2314725 - RNA, 23 nt, Human
uuuccuaauaaaguucuguacuc

SEQ ID NO: 2314726 - RNA, 21 nt, Human
uuuccuaauaaaguucuguac

SEQ ID NO: 2314727 - RNA, 20 nt, Human
uuuccucccuucugcuacug

SEQ ID NO: 2314728 - RNA, 15 nt, Human
uuuccucccuugggu

SEQ ID NO: 2314729 - RNA, 22 nt, Human
uuuccuccgucaccucagagac

SEQ ID NO: 2314730 - RNA, 21 nt, Human
uuuccuccugaggcuuuggau

SEQ ID NO: 2314731 - RNA, 22 nt, Human
uuuccucccuuggguucugaua

SEQ ID NO: 2314732 - RNA, 14 nt, Human
uuuccuccuuccau

SEQ ID NO: 2314733 - RNA, 22 nt, Human
uuuccuccugaggcuuuggauu

SEQ ID NO: 2314734 - RNA, 19 nt, Human
uuuccucuauugauguaca

SEQ ID NO: 2314735 - RNA, 20 nt, Human
uuuccucuauugauguacag

SEQ ID NO: 2314736 - RNA, 18 nt, Human
uuucuacaguauuaugua

SEQ ID NO: 2314737 - RNA, 22 nt, Human
uuucuacaaugugaacuuuauu

SEQ ID NO: 2314738 - RNA, 18 nt, Human
uuucuacaaugugaacuu

SEQ ID NO: 2314739 - RNA, 17 nt, Human
uuucuacaaugugaacu

SEQ ID NO: 2314740 - RNA, 13 nt, Human
uuucuaaauguuu

SEQ ID NO: 2314741 - RNA, 23 nt, Human
uuuccuguaaaaaaaaaaaaguu

SEQ ID NO: 2314742 - RNA, 19 nt, Human
uuuccuguagccuucugua

SEQ ID NO: 2314743 - RNA, 15 nt, Human
uuucuaaugugugaa

SEQ ID NO: 2314744 - RNA, 21 nt, Human
uuucuaacaaaaaaauauauu

SEQ ID NO: 2314745 - RNA, 17 nt, Human
uuucuaaaguaaaaaca

SEQ ID NO: 2314746 - RNA, 22 nt, Human
uuuccuggugccaauuucaagu

SEQ ID NO: 2314747 - RNA, 19 nt, Human
uuuccuggugccaauuuca

SEQ ID NO: 2314748 - RNA, 16 nt, Human
uuuccuggugccaauu

SEQ ID NO: 2314749 - RNA, 14 nt, Human
uuuccuggugccaa

SEQ ID NO: 2314750 - RNA, 22 nt, Human
uuucuaaaguaaaaacaaagaa

SEQ ID NO: 2314751 - RNA, 19 nt, Human
uuucuaaaucuccaaaaua

SEQ ID NO: 2314752 - RNA, 14 nt, Human
uuucaauuuccaag

SEQ ID NO: 2314753 - RNA, 20 nt, Human
uuucaauugcaucucccaga

SEQ ID NO: 2314754 - RNA, 22 nt, Human
uuucaauuccaccugcaaucaa

SEQ ID NO: 2314755 - RNA, 21 nt, Human
uuucaauuaaacggauuauuu

SEQ ID NO: 2314756 - RNA, 14 nt, Human
uuucaauucucaaa

SEQ ID NO: 2314757 - RNA, 18 nt, Human
uuucaauugcaucuccca

SEQ ID NO: 2314758 - RNA, 15 nt, Human
uuucaauucucaaaa

SEQ ID NO: 2314759 - RNA, 19 nt, Human
uuucacaguguguuuguga

SEQ ID NO: 2314760 - RNA, 13 nt, Human
uuucacagcuccu

SEQ ID NO: 2314761 - RNA, 15 nt, Human
uuucacaguuuuucc

SEQ ID NO: 2314762 - RNA, 14 nt, Human
uuucacauagaugu

SEQ ID NO: 2314763 - RNA, 13 nt, Human
uuucacaguuuuu

SEQ ID NO: 2314764 - RNA, 17 nt, Human
uuucagcgauguaugca

SEQ ID NO: 2314765 - RNA, 22 nt, Human
uuucagcgauguaugcagcuau

SEQ ID NO: 2314766 - RNA, 18 nt, Human
uuucagcgacuccguugg

SEQ ID NO: 2314767 - RNA, 23 nt, Human
uuucagcgacuccguuggccacu

SEQ ID NO: 2314768 - RNA, 17 nt, Human
uuucagccaagaauucu

SEQ ID NO: 2314769 - RNA, 16 nt, Human
uuucacauagcugucu

SEQ ID NO: 2314770 - RNA, 18 nt, Human
uuucacauagcugucuag

SEQ ID NO: 2314771 - RNA, 20 nt, Human
uuuaugccuuuuauuucuua

SEQ ID NO: 2314772 - RNA, 16 nt, Human
uuuaugcucaauccau

SEQ ID NO: 2314773 - RNA, 12 nt, Human
uuuaugcuuuaa

SEQ ID NO: 2314774 - RNA, 20 nt, Human
uuuaugcauuugcauuugcu

SEQ ID NO: 2314775 - RNA, 18 nt, Human
uuuaugccggaugugcuu

SEQ ID NO: 2314776 - RNA, 21 nt, Human
uuuaugccggaugugcuuuuc

SEQ ID NO: 2314777 - RNA, 19 nt, Human
uuuaugccuucuuauugcu

SEQ ID NO: 2314778 - RNA, 17 nt, Human
uuuaugagccagacaaa

SEQ ID NO: 2314779 - RNA, 12 nt, Human
uuuaugagccag

SEQ ID NO: 2314780 - RNA, 19 nt, Human
uuuaugagccagacaaaug

SEQ ID NO: 2314781 - RNA, 21 nt, Human
uuucaaugguuugcaaggaag

SEQ ID NO: 2314782 - RNA, 23 nt, Human
uuuauggaggauggagagagggg

SEQ ID NO: 2314783 - RNA, 21 nt, Human
uuuaugcugaaacagaauacu

SEQ ID NO: 2314784 - RNA, 17 nt, Human
uuuauggaaucuaccaa

SEQ ID NO: 2314785 - RNA, 16 nt, Human
uuuaugcuuuaaacau

SEQ ID NO: 2314786 - RNA, 15 nt, Human
uuuaugcuuuaaaca

SEQ ID NO: 2314787 - RNA, 18 nt, Human
uuucaauuaaacggauua

SEQ ID NO: 2314788 - RNA, 19 nt, Human
uuucaauuaaacggauuau

SEQ ID NO: 2314789 - RNA, 14 nt, Human
uuucaauuaaacgg

SEQ ID NO: 2314790 - RNA, 15 nt, Human
uuucaauuaaacgga

SEQ ID NO: 2314791 - RNA, 16 nt, Human
uuucaauuaaacggau

SEQ ID NO: 2314792 - RNA, 17 nt, Human
uuucaauuaaacggauu

SEQ ID NO: 2314793 - RNA, 13 nt, Human
uuucaaugugauu

SEQ ID NO: 2314794 - RNA, 14 nt, Human
uuucaaugugauuc

SEQ ID NO: 2314795 - RNA, 20 nt, Human
uuucaaugugauucuaaugu

SEQ ID NO: 2314796 - RNA, 12 nt, Human
uuucaauuaaac

SEQ ID NO: 2314797 - RNA, 13 nt, Human
uuucaauuaaacg

SEQ ID NO: 2314798 - RNA, 22 nt, Human
uuucaaugugauucuaaugucu

SEQ ID NO: 2314799 - RNA, 19 nt, Human
uuucauuugguucauuaau

SEQ ID NO: 2314800 - RNA, 22 nt, Human
uuucauuugccuauucccacac

SEQ ID NO: 2314801 - RNA, 14 nt, Human
uuucauuucaacug

SEQ ID NO: 2314802 - RNA, 12 nt, Human
uuucauuucuug

SEQ ID NO: 2314803 - RNA, 13 nt, Human
uuucauuugccua

SEQ ID NO: 2314804 - RNA, 14 nt, Human
uuucauuugccuau

SEQ ID NO: 2314805 - RNA, 17 nt, Human
uuucagugaaagcauca

SEQ ID NO: 2314806 - RNA, 21 nt, Human
uuucagucauauaaaagcuau

SEQ ID NO: 2314807 - RNA, 21 nt, Human
uuucaguauuuuggagaaauu

SEQ ID NO: 2314808 - RNA, 20 nt, Human
uuucaguauuagugauguca

SEQ ID NO: 2314809 - RNA, 19 nt, Human
uuucagguuuuguaaagau

SEQ ID NO: 2314810 - RNA, 18 nt, Human
uuucagguuuuguaaaga

SEQ ID NO: 2314811 - RNA, 18 nt, Human
uuucagguguuuaguugc

SEQ ID NO: 2314812 - RNA, 14 nt, Human
uuucagguuuuagu

SEQ ID NO: 2314813 - RNA, 19 nt, Human
uuucagguuuuaguuuuua

SEQ ID NO: 2314814 - RNA, 16 nt, Human
uuucaggugacaugug

SEQ ID NO: 2314815 - RNA, 19 nt, Human
uuucaggugacaugugaaa

SEQ ID NO: 2314816 - RNA, 20 nt, Human
uuucaggugacaugugaaac

SEQ ID NO: 2314817 - RNA, 22 nt, Human
uuucaggugacaugugaaaccu

SEQ ID NO: 2314818 - RNA, 21 nt, Human
uuucagcgauguaugcagcua

SEQ ID NO: 2314819 - RNA, 14 nt, Human
uuucagcugugaac

SEQ ID NO: 2314820 - RNA, 21 nt, Human
uuucagcugugaacauggacu

SEQ ID NO: 2314821 - RNA, 15 nt, Human
uuucaggugacaugu

SEQ ID NO: 2314822 - RNA, 15 nt, Human
uuucauuuuuuucca

SEQ ID NO: 2314823 - RNA, 20 nt, Human
uuucauuuuuuuccaggcug

SEQ ID NO: 2314824 - RNA, 17 nt, Human
uuuccaaaaaaauacug

SEQ ID NO: 2314825 - RNA, 18 nt, Human
uuucauuuucugcaagcc

SEQ ID NO: 2314826 - RNA, 14 nt, Human
uuucauuuucugca

SEQ ID NO: 2314827 - RNA, 15 nt, Human
uuucauuuucugcaa

SEQ ID NO: 2314828 - RNA, 22 nt, Human
uuuccacccccucccuggccug

SEQ ID NO: 2314829 - RNA, 15 nt, Human
uuuccacccccuccc

SEQ ID NO: 2314830 - RNA, 18 nt, Human
uuuccaaaaguggccucu

SEQ ID NO: 2314831 - RNA, 23 nt, Human
uuuccaccacagccagcaccugg

SEQ ID NO: 2314832 - RNA, 15 nt, Human
uuuccacuacugcua

SEQ ID NO: 2314833 - RNA, 14 nt, Human
uuuccacuacugcu

SEQ ID NO: 2314834 - RNA, 13 nt, Human
uuuccacuacugc

SEQ ID NO: 2314835 - RNA, 23 nt, Human
uuuccacggagccacuccucuga

SEQ ID NO: 2314836 - RNA, 18 nt, Human
uuuccacuccuccuagcc

SEQ ID NO: 2314837 - RNA, 19 nt, Human
uuuccacgaugaaaaacuu

SEQ ID NO: 2314838 - RNA, 12 nt, Human
uuuccacugaag

SEQ ID NO: 2314839 - RNA, 19 nt, Human
uuuccacuccuccuagcca

SEQ ID NO: 2314840 - RNA, 18 nt, Human
uuuccuaacaggauuaga

SEQ ID NO: 2314841 - RNA, 22 nt, Human
uuuccuaacaggauuagacagu

SEQ ID NO: 2314842 - RNA, 13 nt, Human
uuuccuaaauguu

SEQ ID NO: 2314843 - RNA, 17 nt, Human
uuuccuaaaugcaguga

SEQ ID NO: 2314844 - RNA, 14 nt, Human
uuuccuaaauguuu

SEQ ID NO: 2314845 - RNA, 15 nt, Human
uuuccuaaaugcagu

SEQ ID NO: 2314846 - RNA, 12 nt, Human
uuuccacuuugu

SEQ ID NO: 2314847 - RNA, 20 nt, Human
uuuccuaaauauauuuuaag

SEQ ID NO: 2314848 - RNA, 18 nt, Human
uuuguauguuuuuuuucu

SEQ ID NO: 2314849 - RNA, 10 nt, Human
uuuguauguu

SEQ ID NO: 2314850 - RNA, 12 nt, Human
uuuguauguuuu

SEQ ID NO: 2314851 - RNA, 15 nt, Human
uuuguauucucuccu

SEQ ID NO: 2314852 - RNA, 22 nt, Human
uuuguaugccaagugagaagau

SEQ ID NO: 2314853 - RNA, 12 nt, Human
uuuguauguaaa

SEQ ID NO: 2314854 - RNA, 14 nt, Human
uuuguauguaaaug

SEQ ID NO: 2314855 - RNA, 16 nt, Human
uuuguaugcacuuugu

SEQ ID NO: 2314856 - RNA, 13 nt, Human
uuuguaugugugu

SEQ ID NO: 2314857 - RNA, 15 nt, Human
uuuguauguauaauu

SEQ ID NO: 2314858 - RNA, 14 nt, Human
uuuguauguauaau

SEQ ID NO: 2314859 - RNA, 16 nt, Human
uuuguauguaaaugug

SEQ ID NO: 2314860 - RNA, 17 nt, Human
uuuguauguaaaugugc

SEQ ID NO: 2314861 - RNA, 12 nt, Human
uuuguaaagugu

SEQ ID NO: 2314862 - RNA, 17 nt, Human
uuuguaaaguguggucc

SEQ ID NO: 2314863 - RNA, 22 nt, Human
uuuguaaaguguggucccaaca

SEQ ID NO: 2314864 - RNA, 22 nt, Human
uuuguaaacucaaaauauuugu

SEQ ID NO: 2314865 - RNA, 17 nt, Human
uuuguaaacucaaaaua

SEQ ID NO: 2314866 - RNA, 16 nt, Human
uuuguaaacucaaaau

SEQ ID NO: 2314867 - RNA, 13 nt, Human
uuugguucuaaua

SEQ ID NO: 2314868 - RNA, 13 nt, Human
uuugguucugggg

SEQ ID NO: 2314869 - RNA, 14 nt, Human
uuugguucuggggc

SEQ ID NO: 2314870 - RNA, 12 nt, Human
uuugguucugug

SEQ ID NO: 2314871 - RNA, 20 nt, Human
uuugguucauuaauucuaua

SEQ ID NO: 2314872 - RNA, 17 nt, Human
uuugguugaauaaacua

SEQ ID NO: 2314873 - RNA, 18 nt, Human
uuugguuguauucuuuga

SEQ ID NO: 2314874 - RNA, 21 nt, Human
uuugguucuuaguucucacug

SEQ ID NO: 2314875 - RNA, 15 nt, Human
uuugguugaauaaac

SEQ ID NO: 2314876 - RNA, 14 nt, Human
uuugguugaauaaa

SEQ ID NO: 2314877 - RNA, 17 nt, Human
uuugguugcuuuaauau

SEQ ID NO: 2314878 - RNA, 16 nt, Human
uuuggguucugccugc

SEQ ID NO: 2314879 - RNA, 22 nt, Human
uuuggguuaauauggcucuuca

SEQ ID NO: 2314880 - RNA, 22 nt, Human
uuuggagaaauuauuuaauaaa

SEQ ID NO: 2314881 - RNA, 15 nt, Human
uuuggguucugccug

SEQ ID NO: 2314882 - RNA, 14 nt, Human
uuuggguucugccu

SEQ ID NO: 2314883 - RNA, 20 nt, Human
uuugguaaaauacuucuuga

SEQ ID NO: 2314884 - RNA, 18 nt, Human
uuugguacuuauuacugc

SEQ ID NO: 2314885 - RNA, 18 nt, Human
uuugguaaggggaauuga

SEQ ID NO: 2314886 - RNA, 16 nt, Human
uuugcuucucucucua

SEQ ID NO: 2314887 - RNA, 20 nt, Human
uuugccagcugcugcuggau

SEQ ID NO: 2314888 - RNA, 17 nt, Human
uuugcuugcaguagauu

SEQ ID NO: 2314889 - RNA, 20 nt, Human
uuugcuugcaguagauuuuc

SEQ ID NO: 2314890 - RNA, 21 nt, Human
uuugcuugcaguagauuuucu

SEQ ID NO: 2314891 - RNA, 16 nt, Human
uuugcuugaaagaaaa

SEQ ID NO: 2314892 - RNA, 14 nt, Human
uuugcuugaaagaa

SEQ ID NO: 2314893 - RNA, 16 nt, Human
uuuggaccuaauccaa

SEQ ID NO: 2314894 - RNA, 19 nt, Human
uuuggagacucuguggggc

SEQ ID NO: 2314895 - RNA, 19 nt, Human
uuuggaccuaaauggccuc

SEQ ID NO: 2314896 - RNA, 15 nt, Human
uuuggacccugaggc

SEQ ID NO: 2314897 - RNA, 19 nt, Human
uuuggacccugaggcccag

SEQ ID NO: 2314898 - RNA, 14 nt, Human
uuugccaacauugc

SEQ ID NO: 2314899 - RNA, 21 nt, Human
uuugccagaacaguuuguaca

SEQ ID NO: 2314900 - RNA, 18 nt, Human
uuugccacccucaugcug

SEQ ID NO: 2314901 - RNA, 13 nt, Human
uuugccagcugcu

SEQ ID NO: 2314902 - RNA, 14 nt, Human
uuugccagcugcug

SEQ ID NO: 2314903 - RNA, 16 nt, Human
uuugccagcugcugcu

SEQ ID NO: 2314904 - RNA, 19 nt, Human
uuugccacccucaugcugu

SEQ ID NO: 2314905 - RNA, 23 nt, Human
uuugauauccaaagcugaauaca

SEQ ID NO: 2314906 - RNA, 17 nt, Human
uuugauauccaaagcug

SEQ ID NO: 2314907 - RNA, 18 nt, Human
uuugauaaucaacugggc

SEQ ID NO: 2314908 - RNA, 12 nt, Human
uuugauaauguu

SEQ ID NO: 2314909 - RNA, 14 nt, Human
uuugauaauguuaa

SEQ ID NO: 2314910 - RNA, 15 nt, Human
uuugauaauguuaaa

SEQ ID NO: 2314911 - RNA, 18 nt, Human
uuugaucagguggggagu

SEQ ID NO: 2314912 - RNA, 19 nt, Human
uuugauauuaaaggaguua

SEQ ID NO: 2314913 - RNA, 17 nt, Human
uuugaauauaaacacua

SEQ ID NO: 2314914 - RNA, 18 nt, Human
uuugaauauaaacacuau

SEQ ID NO: 2314915 - RNA, 16 nt, Human
uuugagaguucuaaau

SEQ ID NO: 2314916 - RNA, 17 nt, Human
uuugagaucagccuggg

SEQ ID NO: 2314917 - RNA, 16 nt, Human
uuugagaucagccugg

SEQ ID NO: 2314918 - RNA, 19 nt, Human
uuugaaggaggugagggau

SEQ ID NO: 2314919 - RNA, 23 nt, Human
uuugaaguaguuuguauaacuuc

SEQ ID NO: 2314920 - RNA, 22 nt, Human
uuugaaguaaucccgccaccua

SEQ ID NO: 2314921 - RNA, 16 nt, Human
uuugaaguacaauugu

SEQ ID NO: 2314922 - RNA, 22 nt, Human
uuugaagucauaccaaugaaaa

SEQ ID NO: 2314923 - RNA, 22 nt, Human
uuugaaguguaggcagacacag

SEQ ID NO: 2314924 - RNA, 11 nt, Human
uuugaagugua

SEQ ID NO: 2314925 - RNA, 18 nt, Human
uuugaaguguaggcagac

SEQ ID NO: 2314926 - RNA, 20 nt, Human
uuugaaguguaggcagacac

SEQ ID NO: 2314927 - RNA, 21 nt, Human
uuugaaguguaggcagacaca

SEQ ID NO: 2314928 - RNA, 23 nt, Human
uuugaggucaaguaagaagacau

SEQ ID NO: 2314929 - RNA, 20 nt, Human
uuugaggucaaguaagaaga

SEQ ID NO: 2314930 - RNA, 13 nt, Human
uuugaguucuaca

SEQ ID NO: 2314931 - RNA, 16 nt, Human
uuugauaaaauaaaug

SEQ ID NO: 2314932 - RNA, 14 nt, Human
uuugauaaaguagu

SEQ ID NO: 2314933 - RNA, 19 nt, Human
uuugauaaaguaguaaaaa

SEQ ID NO: 2314934 - RNA, 18 nt, Human
uuugauaaaguuucucag

SEQ ID NO: 2314935 - RNA, 19 nt, Human
uuugauaaaguuucucaga

SEQ ID NO: 2314936 - RNA, 20 nt, Human
uuugauaaaguaguaaaaau

SEQ ID NO: 2314937 - RNA, 21 nt, Human
uuugauaaaguaguaaaaauu

SEQ ID NO: 2314938 - RNA, 13 nt, Human
uuugauaaaguuu

SEQ ID NO: 2314939 - RNA, 15 nt, Human
uuugauaaaguuucu

SEQ ID NO: 2314940 - RNA, 20 nt, Human
uuugauaaucaacugggcug

SEQ ID NO: 2314941 - RNA, 15 nt, Human
uuugaggcugcagcg

SEQ ID NO: 2314942 - RNA, 16 nt, Human
uuugaggggaaaacac

SEQ ID NO: 2314943 - RNA, 20 nt, Human
uuugaggcuuucagguuuua

SEQ ID NO: 2314944 - RNA, 11 nt, Human
uuugaggggcu

SEQ ID NO: 2314945 - RNA, 22 nt, Human
uuugaggauauauuuucacuuu

SEQ ID NO: 2314946 - RNA, 20 nt, Human
uuugaggauauauuuucacu

SEQ ID NO: 2314947 - RNA, 21 nt, Human
uuugaggauauauuuucacuu

SEQ ID NO: 2314948 - RNA, 22 nt, Human
uuugaggagcagcuucaguugu

SEQ ID NO: 2314949 - RNA, 21 nt, Human
uuugaggagcagcuucaguug

SEQ ID NO: 2314950 - RNA, 15 nt, Human
uuugaggauauauuu

SEQ ID NO: 2314951 - RNA, 20 nt, Human
uuugaggagcagcuucaguu

SEQ ID NO: 2314952 - RNA, 15 nt, Human
uuucuuaaaugggcu

SEQ ID NO: 2314953 - RNA, 13 nt, Human
uuucuuaaauaau

SEQ ID NO: 2314954 - RNA, 18 nt, Human
uuucuuaaccagaucauu

SEQ ID NO: 2314955 - RNA, 18 nt, Human
uuucuuaaaccuucaguu

SEQ ID NO: 2314956 - RNA, 23 nt, Human
uuucugaucugaugcaagcaaga

SEQ ID NO: 2314957 - RNA, 12 nt, Human
uuucuuaaauaa

SEQ ID NO: 2314958 - RNA, 11 nt, Human
uuucuugcugg

SEQ ID NO: 2314959 - RNA, 18 nt, Human
uuucuugccucugucccc

SEQ ID NO: 2314960 - RNA, 21 nt, Human
uuucuugccucuguccccuuc

SEQ ID NO: 2314961 - RNA, 15 nt, Human
uuucuuaaccaucuu

SEQ ID NO: 2314962 - RNA, 14 nt, Human
uuucuuaaccaucu

SEQ ID NO: 2314963 - RNA, 21 nt, Human
uuucuugcugguugucauuuu

SEQ ID NO: 2314964 - RNA, 17 nt, Human
uuucuugguucauaaau

SEQ ID NO: 2314965 - RNA, 18 nt, Human
uuucuugguucauaaaug

SEQ ID NO: 2314966 - RNA, 19 nt, Human
uuucuugguucauaaauga

SEQ ID NO: 2314967 - RNA, 19 nt, Human
uuucuuguguguuuauugu

SEQ ID NO: 2314968 - RNA, 16 nt, Human
uuugaagcuacugugu

SEQ ID NO: 2314969 - RNA, 18 nt, Human
uuugaagcuacugugugu

SEQ ID NO: 2314970 - RNA, 13 nt, Human
uuugaaggcaaaa

SEQ ID NO: 2314971 - RNA, 12 nt, Human
uuugaaggcaaa

SEQ ID NO: 2314972 - RNA, 22 nt, Human
uuugaagccugcccuugucuga

SEQ ID NO: 2314973 - RNA, 13 nt, Human
uuugaaggaaaca

SEQ ID NO: 2314974 - RNA, 20 nt, Human
uuugaaggaaacaguuaaua

SEQ ID NO: 2314975 - RNA, 15 nt, Human
uuugaacuaauaaaa

SEQ ID NO: 2314976 - RNA, 15 nt, Human
uuugaacucagaucu

SEQ ID NO: 2314977 - RNA, 16 nt, Human
uuugaagcaguugugu

SEQ ID NO: 2314978 - RNA, 18 nt, Human
uuugaagcaguuguguca

SEQ ID NO: 2314979 - RNA, 15 nt, Human
uuugaagccugcccu

SEQ ID NO: 2314980 - RNA, 22 nt, Human
uuugaacaacuaggcuucagca

SEQ ID NO: 2314981 - RNA, 23 nt, Human
uuucuugguucauaaaugaauuu

SEQ ID NO: 2314982 - RNA, 19 nt, Human
uuucuuguaauuuaaacag

SEQ ID NO: 2314983 - RNA, 21 nt, Human
uuugaaauuguauuacaaauc

SEQ ID NO: 2314984 - RNA, 13 nt, Human
uucacggaaguuu

SEQ ID NO: 2314985 - RNA, 22 nt, Human
uucacggaaguuuucaaugaug

SEQ ID NO: 2314986 - RNA, 22 nt, Human
uucaccuugggaugaugccuca

SEQ ID NO: 2314987 - RNA, 16 nt, Human
uucaccuugggaugau

SEQ ID NO: 2314988 - RNA, 21 nt, Human
uucaccugauucaacuaaaaa

SEQ ID NO: 2314989 - RNA, 18 nt, Human
uucacggaagagccuugc

SEQ ID NO: 2314990 - RNA, 14 nt, Human
uucacuaaagcagu

SEQ ID NO: 2314991 - RNA, 13 nt, Human
uucacuaaagcag

SEQ ID NO: 2314992 - RNA, 14 nt, Human
uucacgugcagcuc

SEQ ID NO: 2314993 - RNA, 15 nt, Human
uucacgugguccuaa

SEQ ID NO: 2314994 - RNA, 16 nt, Human
uucaccugauucaacu

SEQ ID NO: 2314995 - RNA, 18 nt, Human
uucaccugccccaacucu

SEQ ID NO: 2314996 - RNA, 15 nt, Human
uucacaaacuuuuau

SEQ ID NO: 2314997 - RNA, 12 nt, Human
uucaccugagca

SEQ ID NO: 2314998 - RNA, 16 nt, Human
uucaccuguaaaccug

SEQ ID NO: 2314999 - RNA, 13 nt, Human
uucaccuguaaac

SEQ ID NO: 2315000 - RNA, 14 nt, Human
uucaccuugaagaa

SEQ ID NO: 2315001 - RNA, 23 nt, Human
uucaccuucguuuacuaugccug

SEQ ID NO: 2315002 - RNA, 22 nt, Human
uucaccuguuuuuaagcuguuu

SEQ ID NO: 2315003 - RNA, 23 nt, Human
uucaccuguuuuuaagcuguuuc

SEQ ID NO: 2315004 - RNA, 19 nt, Human
uucaccuguuuuuaagcug

SEQ ID NO: 2315005 - RNA, 21 nt, Human
uucaccuguuuuuaagcuguu

SEQ ID NO: 2315006 - RNA, 18 nt, Human
uucaccuguaaaccugag

SEQ ID NO: 2315007 - RNA, 17 nt, Human
uucaccuguaaaccuga

SEQ ID NO: 2315008 - RNA, 17 nt, Human
uucaauuuccaagagcu

SEQ ID NO: 2315009 - RNA, 19 nt, Human
uucaauuuccaagagcuga

SEQ ID NO: 2315010 - RNA, 17 nt, Human
uucaauuuauucaagaa

SEQ ID NO: 2315011 - RNA, 19 nt, Human
uucaauuuauucaagaaaa

SEQ ID NO: 2315012 - RNA, 15 nt, Human
uucacaaaauuucca

SEQ ID NO: 2315013 - RNA, 14 nt, Human
uucaacugaaaaga

SEQ ID NO: 2315014 - RNA, 21 nt, Human
uucaacugccaaaaugcucua

SEQ ID NO: 2315015 - RNA, 13 nt, Human
uucaacucagacu

SEQ ID NO: 2315016 - RNA, 16 nt, Human
uucaacucagacuagu

SEQ ID NO: 2315017 - RNA, 17 nt, Human
uucaauugcaucuccca

SEQ ID NO: 2315018 - RNA, 15 nt, Human
uucaauugcaucucc

SEQ ID NO: 2315019 - RNA, 16 nt, Human
uucaauuuauucaaga

SEQ ID NO: 2315020 - RNA, 14 nt, Human
uucaauuguaaauu

SEQ ID NO: 2315021 - RNA, 12 nt, Human
uucaauuguaaa

SEQ ID NO: 2315022 - RNA, 19 nt, Human
uucaauugcaucucccaga

SEQ ID NO: 2315023 - RNA, 13 nt, Human
uucaauaggaaaa

SEQ ID NO: 2315024 - RNA, 15 nt, Human
uucaauaggaaaaac

SEQ ID NO: 2315025 - RNA, 18 nt, Human
uucaauaggaaaaacuga

SEQ ID NO: 2315026 - RNA, 20 nt, Human
uucaauaggaaaaacugauu

SEQ ID NO: 2315027 - RNA, 24 nt, Human
uucacuccggugugccugcagccc

SEQ ID NO: 2315028 - RNA, 23 nt, Human
uucacuccggugugccugcagcc

SEQ ID NO: 2315029 - RNA, 13 nt, Human
uucacucuccuug

SEQ ID NO: 2315030 - RNA, 22 nt, Human
uucacuccggugugccugcagc

SEQ ID NO: 2315031 - RNA, 21 nt, Human
uucacuccggugugccugcag

SEQ ID NO: 2315032 - RNA, 13 nt, Human
uucacuccagccu

SEQ ID NO: 2315033 - RNA, 19 nt, Human
uucacuauuuccuuuauaa

SEQ ID NO: 2315034 - RNA, 20 nt, Human
uucacuauuuuuauuuauau

SEQ ID NO: 2315035 - RNA, 13 nt, Human
uucacuauuuccu

SEQ ID NO: 2315036 - RNA, 14 nt, Human
uucacuauuuccuu

SEQ ID NO: 2315037 - RNA, 18 nt, Human
uucacuauaaaugguguu

SEQ ID NO: 2315038 - RNA, 19 nt, Human
uucagagacuccugcaggc

SEQ ID NO: 2315039 - RNA, 20 nt, Human
uucagacauagaauuaacac

SEQ ID NO: 2315040 - RNA, 21 nt, Human
uucagacagcugccugggauc

SEQ ID NO: 2315041 - RNA, 16 nt, Human
uucagacauagaauua

SEQ ID NO: 2315042 - RNA, 23 nt, Human
uucagagcugacacaggaugaag

SEQ ID NO: 2315043 - RNA, 15 nt, Human
uucagagaggccuuu

SEQ ID NO: 2315044 - RNA, 20 nt, Human
uucagagagggcagaggggu

SEQ ID NO: 2315045 - RNA, 15 nt, Human
uucagagagcuggua

SEQ ID NO: 2315046 - RNA, 14 nt, Human
uucagagagcuggu

SEQ ID NO: 2315047 - RNA, 13 nt, Human
uucagagagcugg

SEQ ID NO: 2315048 - RNA, 19 nt, Human
uucagagagcuaaauuaca

SEQ ID NO: 2315049 - RNA, 21 nt, Human
uucagaguugaugguuguaca

SEQ ID NO: 2315050 - RNA, 22 nt, Human
uucagaguugaugguuguacau

SEQ ID NO: 2315051 - RNA, 23 nt, Human
uucagauaacuguuauuuauaau

SEQ ID NO: 2315052 - RNA, 18 nt, Human
uucaggaaaagccucugu

SEQ ID NO: 2315053 - RNA, 18 nt, Human
uucagauaacuguuauuu

SEQ ID NO: 2315054 - RNA, 17 nt, Human
uucagauaacuguuauu

SEQ ID NO: 2315055 - RNA, 20 nt, Human
uucagauaaucacaauacau

SEQ ID NO: 2315056 - RNA, 12 nt, Human
uuauuuuaagac

SEQ ID NO: 2315057 - RNA, 17 nt, Human
uuauuuuaauucaguug

SEQ ID NO: 2315058 - RNA, 17 nt, Human
uuauuuuaauaauguuu

SEQ ID NO: 2315059 - RNA, 16 nt, Human
uuauuuuaguuucugu

SEQ ID NO: 2315060 - RNA, 20 nt, Human
uuauuuuauguugcauagaa

SEQ ID NO: 2315061 - RNA, 23 nt, Human
uucaaagccagcguccuccucug

SEQ ID NO: 2315062 - RNA, 16 nt, Human
uuauuuuauccucugg

SEQ ID NO: 2315063 - RNA, 16 nt, Human
uucaaagcuugaagau

SEQ ID NO: 2315064 - RNA, 22 nt, Human
uucaaagcuuuuuccagaggcu

SEQ ID NO: 2315065 - RNA, 17 nt, Human
uucaacugaccagccuc

SEQ ID NO: 2315066 - RNA, 12 nt, Human
uucaacucagac

SEQ ID NO: 2315067 - RNA, 20 nt, Human
uucaacgcagcccugcuuug

SEQ ID NO: 2315068 - RNA, 16 nt, Human
uucaacgcagcccugc

SEQ ID NO: 2315069 - RNA, 19 nt, Human
uucaacgcagcccugcuuu

SEQ ID NO: 2315070 - RNA, 17 nt, Human
uucaaauccuugaagau

SEQ ID NO: 2315071 - RNA, 19 nt, Human
uucaaauagggucuaacuc

SEQ ID NO: 2315072 - RNA, 18 nt, Human
uucaaauagggucuaacu

SEQ ID NO: 2315073 - RNA, 16 nt, Human
uuauuggaauuaaccu

SEQ ID NO: 2315074 - RNA, 19 nt, Human
uuauugggcaagugauuga

SEQ ID NO: 2315075 - RNA, 22 nt, Human
uuauuggcugagauaugaacau

SEQ ID NO: 2315076 - RNA, 12 nt, Human
uuauuguaccuc

SEQ ID NO: 2315077 - RNA, 14 nt, Human
uuauuguaccucuc

SEQ ID NO: 2315078 - RNA, 18 nt, Human
uuauuguaacagacauug

SEQ ID NO: 2315079 - RNA, 19 nt, Human
uuauuguaacagacauugu

SEQ ID NO: 2315080 - RNA, 20 nt, Human
uuauuguaacagacauuguu

SEQ ID NO: 2315081 - RNA, 19 nt, Human
uuauuguacagcuguuuaa

SEQ ID NO: 2315082 - RNA, 20 nt, Human
uuauugggcaagugauugaa

SEQ ID NO: 2315083 - RNA, 16 nt, Human
uuauuguaacagacau

SEQ ID NO: 2315084 - RNA, 17 nt, Human
uuauuguaacagacauu

SEQ ID NO: 2315085 - RNA, 13 nt, Human
uuauuggaauuaa

SEQ ID NO: 2315086 - RNA, 13 nt, Human
uuauugcuuuuau

SEQ ID NO: 2315087 - RNA, 23 nt, Human
uuauugcuugauacuuuugacaa

SEQ ID NO: 2315088 - RNA, 22 nt, Human
uuauuggaauuaaccuggugcu

SEQ ID NO: 2315089 - RNA, 14 nt, Human
uuauuggcugagau

SEQ ID NO: 2315090 - RNA, 16 nt, Human
uuauuggcugagauau

SEQ ID NO: 2315091 - RNA, 15 nt, Human
uuauuggcugagaua

SEQ ID NO: 2315092 - RNA, 12 nt, Human
uuauugcuguug

SEQ ID NO: 2315093 - RNA, 12 nt, Human
uuauugcauuug

SEQ ID NO: 2315094 - RNA, 22 nt, Human
uuauuguauaaacuaucaguuu

SEQ ID NO: 2315095 - RNA, 16 nt, Human
uuauugugauuucccg

SEQ ID NO: 2315096 - RNA, 15 nt, Human
uuauuguguuuguca

SEQ ID NO: 2315097 - RNA, 16 nt, Human
uuauuguguuugucau

SEQ ID NO: 2315098 - RNA, 17 nt, Human
uuauuguguuugucauu

SEQ ID NO: 2315099 - RNA, 18 nt, Human
uuauuguguuugucauua

SEQ ID NO: 2315100 - RNA, 15 nt, Human
uuauuuuaauaaugu

SEQ ID NO: 2315101 - RNA, 16 nt, Human
uuauuuuaauaauguu

SEQ ID NO: 2315102 - RNA, 15 nt, Human
uuauuguaccucucu

SEQ ID NO: 2315103 - RNA, 17 nt, Human
uuauuguaccucucuua

SEQ ID NO: 2315104 - RNA, 12 nt, Human
uuauuguacuug

SEQ ID NO: 2315105 - RNA, 14 nt, Human
uuauuguauaaacu

SEQ ID NO: 2315106 - RNA, 21 nt, Human
uuauuguauaaacuaucaguu

SEQ ID NO: 2315107 - RNA, 17 nt, Human
uuauugucaaaguggug

SEQ ID NO: 2315108 - RNA, 18 nt, Human
uuauugucaaagugguga

SEQ ID NO: 2315109 - RNA, 15 nt, Human
uuauugucuagugaa

SEQ ID NO: 2315110 - RNA, 15 nt, Human
uuaugccuuuuauuu

SEQ ID NO: 2315111 - RNA, 17 nt, Human
uuaugccggaugugcuu

SEQ ID NO: 2315112 - RNA, 20 nt, Human
uuaugccggaugugcuuuuc

SEQ ID NO: 2315113 - RNA, 17 nt, Human
uuaugccuuuuuugauc

SEQ ID NO: 2315114 - RNA, 17 nt, Human
uuaugcccagcguuuga

SEQ ID NO: 2315115 - RNA, 21 nt, Human
uuaugcccaguuucugccucu

SEQ ID NO: 2315116 - RNA, 14 nt, Human
uuaugcucaggguc

SEQ ID NO: 2315117 - RNA, 13 nt, Human
uuaugcugaaaca

SEQ ID NO: 2315118 - RNA, 16 nt, Human
uuaugcggucuaggga

SEQ ID NO: 2315119 - RNA, 14 nt, Human
uuaugcugaguaug

SEQ ID NO: 2315120 - RNA, 17 nt, Human
uuaugcugugacacaug

SEQ ID NO: 2315121 - RNA, 11 nt, Human
uuaugcuucuu

SEQ ID NO: 2315122 - RNA, 14 nt, Human
uuaugcuuuaaaca

SEQ ID NO: 2315123 - RNA, 13 nt, Human
uuaugcuuuaaac

SEQ ID NO: 2315124 - RNA, 16 nt, Human
uuauggaacacucuga

SEQ ID NO: 2315125 - RNA, 21 nt, Human
uuauggcacuaguauuucuau

SEQ ID NO: 2315126 - RNA, 22 nt, Human
uuaugcaugaaguaauaugcac

SEQ ID NO: 2315127 - RNA, 14 nt, Human
uuaugcauagauaa

SEQ ID NO: 2315128 - RNA, 20 nt, Human
uuaugcaagggacugugugu

SEQ ID NO: 2315129 - RNA, 16 nt, Human
uuaugcaugaaguaau

SEQ ID NO: 2315130 - RNA, 16 nt, Human
uuaucuugucucuggg

SEQ ID NO: 2315131 - RNA, 17 nt, Human
uuaucuugucucugggc

SEQ ID NO: 2315132 - RNA, 12 nt, Human
uuaucuuuauau

SEQ ID NO: 2315133 - RNA, 16 nt, Human
uuaucuuuacuuuuaa

SEQ ID NO: 2315134 - RNA, 17 nt, Human
uuaucuuggacugacau

SEQ ID NO: 2315135 - RNA, 16 nt, Human
uuaucuuggacugaca

SEQ ID NO: 2315136 - RNA, 14 nt, Human
uuaucuugggacug

SEQ ID NO: 2315137 - RNA, 17 nt, Human
uuaucuugguugaaaau

SEQ ID NO: 2315138 - RNA, 22 nt, Human
uuaugcaaggaaggaaagaaag

SEQ ID NO: 2315139 - RNA, 18 nt, Human
uuaugcaaggaaggaaag

SEQ ID NO: 2315140 - RNA, 17 nt, Human
uuaugcaaggaaggaaa

SEQ ID NO: 2315141 - RNA, 19 nt, Human
uuaucuugggacuggguuu

SEQ ID NO: 2315142 - RNA, 15 nt, Human
uuaucuuucgcacag

SEQ ID NO: 2315143 - RNA, 17 nt, Human
uuaucuuucgugauaaa

SEQ ID NO: 2315144 - RNA, 24 nt, Human
uuaucuuucgugauaaacuuugcu

SEQ ID NO: 2315145 - RNA, 13 nt, Human
uuaguugcuguau

SEQ ID NO: 2315146 - RNA, 15 nt, Human
uuaguugcuguaugu

SEQ ID NO: 2315147 - RNA, 20 nt, Human
uuaguugcaacuuuguauaa

SEQ ID NO: 2315148 - RNA, 17 nt, Human
uuaguuuacaaucagcc

SEQ ID NO: 2315149 - RNA, 20 nt, Human
uuaguuguaucucuuuugaa

SEQ ID NO: 2315150 - RNA, 16 nt, Human
uuaucuagauacugua

SEQ ID NO: 2315151 - RNA, 15 nt, Human
uuaguucuuuguuau

SEQ ID NO: 2315152 - RNA, 16 nt, Human
uuaguucuuuggaaau

SEQ ID NO: 2315153 - RNA, 21 nt, Human
uuaguucucacuguucccucu

SEQ ID NO: 2315154 - RNA, 12 nt, Human
uuaguucccaac

SEQ ID NO: 2315155 - RNA, 13 nt, Human
uuaguugcaacuu

SEQ ID NO: 2315156 - RNA, 14 nt, Human
uuaguuccuugagu

SEQ ID NO: 2315157 - RNA, 16 nt, Human
uuaguuccucauuagc

SEQ ID NO: 2315158 - RNA, 23 nt, Human
uuaucugggauuaugguuuugug

SEQ ID NO: 2315159 - RNA, 20 nt, Human
uuaucugggcauagaugcag

SEQ ID NO: 2315160 - RNA, 18 nt, Human
uuaucuguguuuuugaaa

SEQ ID NO: 2315161 - RNA, 19 nt, Human
uuaucugugcgugaaacac

SEQ ID NO: 2315162 - RNA, 18 nt, Human
uuaucugugcgugaaaca

SEQ ID NO: 2315163 - RNA, 17 nt, Human
uuaucugugaauucaga

SEQ ID NO: 2315164 - RNA, 12 nt, Human
uuaucuguccca

SEQ ID NO: 2315165 - RNA, 12 nt, Human
uuaucugugaau

SEQ ID NO: 2315166 - RNA, 20 nt, Human
uuaucuugaauaauguaaga

SEQ ID NO: 2315167 - RNA, 17 nt, Human
uuaucuagauacuguau

SEQ ID NO: 2315168 - RNA, 14 nt, Human
uuaucucucugugc

SEQ ID NO: 2315169 - RNA, 12 nt, Human
uuaucucugugu

SEQ ID NO: 2315170 - RNA, 17 nt, Human
uuaucuauacauaucuu

SEQ ID NO: 2315171 - RNA, 19 nt, Human
uuaucucuauuuaauauuu

SEQ ID NO: 2315172 - RNA, 14 nt, Human
uuaugcuucuugga

SEQ ID NO: 2315173 - RNA, 11 nt, Human
uuauggccuca

SEQ ID NO: 2315174 - RNA, 18 nt, Human
uuauggccucagcugccu

SEQ ID NO: 2315175 - RNA, 15 nt, Human
uuauggccucagcug

SEQ ID NO: 2315176 - RNA, 13 nt, Human
uuauggccucagc

SEQ ID NO: 2315177 - RNA, 12 nt, Human
uuauggccucag

SEQ ID NO: 2315178 - RNA, 16 nt, Human
uuauuaaaaucuuaaa

SEQ ID NO: 2315179 - RNA, 12 nt, Human
uuauuaaaaucu

SEQ ID NO: 2315180 - RNA, 14 nt, Human
uuauuaaaaugauu

SEQ ID NO: 2315181 - RNA, 19 nt, Human
uuauuaaaaugauuguaaa

SEQ ID NO: 2315182 - RNA, 20 nt, Human
uuauuaaaaugauuguaaaa

SEQ ID NO: 2315183 - RNA, 21 nt, Human
uuauuaaaaugauuguaaaau

SEQ ID NO: 2315184 - RNA, 17 nt, Human
uuauggcuauaggugcu

SEQ ID NO: 2315185 - RNA, 21 nt, Human
uuauuaaacagauuuuuacaa

SEQ ID NO: 2315186 - RNA, 18 nt, Human
uuauuaaacguaugcaug

SEQ ID NO: 2315187 - RNA, 20 nt, Human
uuauuaaacguaugcaugug

SEQ ID NO: 2315188 - RNA, 22 nt, Human
uuauuaaacguaugcaugugaa

SEQ ID NO: 2315189 - RNA, 17 nt, Human
uuauuaaaguucuguaa

SEQ ID NO: 2315190 - RNA, 11 nt, Human
uuauuaaugca

SEQ ID NO: 2315191 - RNA, 18 nt, Human
uuauuaaugcacuuucua

SEQ ID NO: 2315192 - RNA, 13 nt, Human
uuauuaaugcacu

SEQ ID NO: 2315193 - RNA, 17 nt, Human
uuauuaaugcacuuucu

SEQ ID NO: 2315194 - RNA, 15 nt, Human
uuauuaauugcuuug

SEQ ID NO: 2315195 - RNA, 14 nt, Human
uuauuaauugcuuu

SEQ ID NO: 2315196 - RNA, 16 nt, Human
uuauuacuguaagaaa

SEQ ID NO: 2315197 - RNA, 17 nt, Human
uuauucucacuccacca

SEQ ID NO: 2315198 - RNA, 13 nt, Human
uuauucuagauua

SEQ ID NO: 2315199 - RNA, 17 nt, Human
uuauuccuguauguugu

SEQ ID NO: 2315200 - RNA, 22 nt, Human
uuauuaauuguuuugcacuuuu

SEQ ID NO: 2315201 - RNA, 18 nt, Human
uuauuacuguuugucuuc

SEQ ID NO: 2315202 - RNA, 13 nt, Human
uuauuccuguaug

SEQ ID NO: 2315203 - RNA, 15 nt, Human
uuauuccuguauguu

SEQ ID NO: 2315204 - RNA, 19 nt, Human
uuauuccuguauguugucc

SEQ ID NO: 2315205 - RNA, 17 nt, Human
uuauuacuguaagaaaa

SEQ ID NO: 2315206 - RNA, 18 nt, Human
uuauuacuguaagaaaau

SEQ ID NO: 2315207 - RNA, 18 nt, Human
uuauugaaucuauuuaag

SEQ ID NO: 2315208 - RNA, 20 nt, Human
uuauugaaucuauuuaagua

SEQ ID NO: 2315209 - RNA, 18 nt, Human
uuauugacaauaauuuca

SEQ ID NO: 2315210 - RNA, 14 nt, Human
uuauugacaauaau

SEQ ID NO: 2315211 - RNA, 22 nt, Human
uuauugacaauaauuucagguu

SEQ ID NO: 2315212 - RNA, 14 nt, Human
uuauugacacagaa

SEQ ID NO: 2315213 - RNA, 23 nt, Human
uuauugacacagaaaauguugag

SEQ ID NO: 2315214 - RNA, 19 nt, Human
uuauugacacagaaaaugu

SEQ ID NO: 2315215 - RNA, 11 nt, Human
uuauucugcuc

SEQ ID NO: 2315216 - RNA, 13 nt, Human
uuauucuggaguu

SEQ ID NO: 2315217 - RNA, 20 nt, Human
uuauucuguagauucugugg

SEQ ID NO: 2315218 - RNA, 16 nt, Human
uuauucuuuuuaaagu

SEQ ID NO: 2315219 - RNA, 13 nt, Human
uuauucuuuuuaa

SEQ ID NO: 2315220 - RNA, 19 nt, Human
uuauugcagcgauuaauaa

SEQ ID NO: 2315221 - RNA, 14 nt, Human
uuauugcaguuuau

SEQ ID NO: 2315222 - RNA, 16 nt, Human
uuauugcaguuuauca

SEQ ID NO: 2315223 - RNA, 20 nt, Human
uuauugcaauaaaagugcuu

SEQ ID NO: 2315224 - RNA, 21 nt, Human
uuauugcaaaauagcauuugu

SEQ ID NO: 2315225 - RNA, 13 nt, Human
uuauugcauuaua

SEQ ID NO: 2315226 - RNA, 22 nt, Human
uuauugcaguuuaucauucaag

SEQ ID NO: 2315227 - RNA, 18 nt, Human
uuauugcaguuuaucauu

SEQ ID NO: 2315228 - RNA, 21 nt, Human
uuauugcaguuuaucauucaa

SEQ ID NO: 2315229 - RNA, 15 nt, Human
uuauugcccacgcug

SEQ ID NO: 2315230 - RNA, 19 nt, Human
uuauugagaauuuuaaauu

SEQ ID NO: 2315231 - RNA, 13 nt, Human
uuauugagaauuu

SEQ ID NO: 2315232 - RNA, 14 nt, Human
uuauugagaaagag

SEQ ID NO: 2315233 - RNA, 16 nt, Human
uuauugagaaagagca

SEQ ID NO: 2315234 - RNA, 18 nt, Human
uuauugagaaagagcacu

SEQ ID NO: 2315235 - RNA, 23 nt, Human
uuauugagaaagagcacuuaaga

SEQ ID NO: 2315236 - RNA, 13 nt, Human
uuccauguugcug

SEQ ID NO: 2315237 - RNA, 14 nt, Human
uuccauguggagaa

SEQ ID NO: 2315238 - RNA, 15 nt, Human
uuccauuaugauucu

SEQ ID NO: 2315239 - RNA, 14 nt, Human
uuccauuaugauuc

SEQ ID NO: 2315240 - RNA, 15 nt, Human
uuccauguugcugcc

SEQ ID NO: 2315241 - RNA, 16 nt, Human
uuccauguugcugcca

SEQ ID NO: 2315242 - RNA, 23 nt, Human
uuccagcaauucuccugccucag

SEQ ID NO: 2315243 - RNA, 22 nt, Human
uuccagcaauucuccugccuca

SEQ ID NO: 2315244 - RNA, 21 nt, Human
uuccagcaauucuccugccuc

SEQ ID NO: 2315245 - RNA, 20 nt, Human
uuccagcaauucuccugccu

SEQ ID NO: 2315246 - RNA, 20 nt, Human
uuccauucuggauuuuguca

SEQ ID NO: 2315247 - RNA, 16 nt, Human
uuccauuggaucucau

SEQ ID NO: 2315248 - RNA, 17 nt, Human
uuccauuggaucucauu

SEQ ID NO: 2315249 - RNA, 16 nt, Human
uuccauuaugauucuu

SEQ ID NO: 2315250 - RNA, 13 nt, Human
uuccauuccagaa

SEQ ID NO: 2315251 - RNA, 16 nt, Human
uuccauuccagaauau

SEQ ID NO: 2315252 - RNA, 15 nt, Human
uuccauucuggaagu

SEQ ID NO: 2315253 - RNA, 13 nt, Human
uuccauucuggaa

SEQ ID NO: 2315254 - RNA, 23 nt, Human
uucccaucacuggagcaccaggc

SEQ ID NO: 2315255 - RNA, 21 nt, Human
uucccauaccacccaaugcug

SEQ ID NO: 2315256 - RNA, 18 nt, Human
uucccauaauuuucuuca

SEQ ID NO: 2315257 - RNA, 16 nt, Human
uucccauaauuuucuu

SEQ ID NO: 2315258 - RNA, 15 nt, Human
uucccauaauuuucu

SEQ ID NO: 2315259 - RNA, 11 nt, Human
uucccauaauu

SEQ ID NO: 2315260 - RNA, 13 nt, Human
uucccauccuacc

SEQ ID NO: 2315261 - RNA, 14 nt, Human
uucccauccuaccc

SEQ ID NO: 2315262 - RNA, 14 nt, Human
uucccaucgcuguc

SEQ ID NO: 2315263 - RNA, 15 nt, Human
uucccaucgcuguca

SEQ ID NO: 2315264 - RNA, 12 nt, Human
uucccaucugca

SEQ ID NO: 2315265 - RNA, 14 nt, Human
uucccaucugcacc

SEQ ID NO: 2315266 - RNA, 20 nt, Human
uucccaugacccaggcuggg

SEQ ID NO: 2315267 - RNA, 18 nt, Human
uucccaugacccaggcug

SEQ ID NO: 2315268 - RNA, 19 nt, Human
uucccaugacccaggcugg

SEQ ID NO: 2315269 - RNA, 14 nt, Human
uucccauucuugca

SEQ ID NO: 2315270 - RNA, 17 nt, Human
uucccauuguggcuccu

SEQ ID NO: 2315271 - RNA, 13 nt, Human
uucccauguuaaa

SEQ ID NO: 2315272 - RNA, 17 nt, Human
uucccauguagcccccu

SEQ ID NO: 2315273 - RNA, 23 nt, Human
uucccauggggagggauucuggu

SEQ ID NO: 2315274 - RNA, 14 nt, Human
uucccauggggagg

SEQ ID NO: 2315275 - RNA, 15 nt, Human
uucccauggggaggg

SEQ ID NO: 2315276 - RNA, 15 nt, Human
uucccauuucagcug

SEQ ID NO: 2315277 - RNA, 14 nt, Human
uucccauuucagcu

SEQ ID NO: 2315278 - RNA, 16 nt, Human
uucccauuugcuccuu

SEQ ID NO: 2315279 - RNA, 15 nt, Human
uuccccaggaggcca

SEQ ID NO: 2315280 - RNA, 16 nt, Human
uuccccaggaggccag

SEQ ID NO: 2315281 - RNA, 17 nt, Human
uucccccaaccucagac

SEQ ID NO: 2315282 - RNA, 18 nt, Human
uucccccaaccucagacu

SEQ ID NO: 2315283 - RNA, 16 nt, Human
uuccccauugccuccu

SEQ ID NO: 2315284 - RNA, 23 nt, Human
uuccccaugguuuuaaucuguau

SEQ ID NO: 2315285 - RNA, 18 nt, Human
uucccccaccagcuaagg

SEQ ID NO: 2315286 - RNA, 17 nt, Human
uucccccauagccaccc

SEQ ID NO: 2315287 - RNA, 15 nt, Human
uucccccauagccac

SEQ ID NO: 2315288 - RNA, 18 nt, Human
uucccccauagccacccc

SEQ ID NO: 2315289 - RNA, 12 nt, Human
uuccccccacuc

SEQ ID NO: 2315290 - RNA, 14 nt, Human
uucccccauagcca

SEQ ID NO: 2315291 - RNA, 20 nt, Human
uucccccagcccuguggaag

SEQ ID NO: 2315292 - RNA, 15 nt, Human
uucccccagcccugu

SEQ ID NO: 2315293 - RNA, 14 nt, Human
uucccccagcccug

SEQ ID NO: 2315294 - RNA, 13 nt, Human
uucccccagcccu

SEQ ID NO: 2315295 - RNA, 15 nt, Human
uucccccacugauca

SEQ ID NO: 2315296 - RNA, 20 nt, Human
uucccucccuuccucuuucc

SEQ ID NO: 2315297 - RNA, 17 nt, Human
uucccucccuuccucuu

SEQ ID NO: 2315298 - RNA, 21 nt, Human
uuccccccacucuccccacac

SEQ ID NO: 2315299 - RNA, 13 nt, Human
uucccccgccgcu

SEQ ID NO: 2315300 - RNA, 23 nt, Human
uucccccgccgcuuuucuccucu

SEQ ID NO: 2315301 - RNA, 19 nt, Human
uuccccccacucuccccac

SEQ ID NO: 2315302 - RNA, 18 nt, Human
uuccccccacucucccca

SEQ ID NO: 2315303 - RNA, 11 nt, Human
uucccucccuu

SEQ ID NO: 2315304 - RNA, 15 nt, Human
uuccccaucuggguc

SEQ ID NO: 2315305 - RNA, 18 nt, Human
uuccccaggggaaaauga

SEQ ID NO: 2315306 - RNA, 21 nt, Human
uuccccaggaggccagccuug

SEQ ID NO: 2315307 - RNA, 11 nt, Human
uuccccauggg

SEQ ID NO: 2315308 - RNA, 18 nt, Human
uuccccaucuucuaaacc

SEQ ID NO: 2315309 - RNA, 17 nt, Human
uuccccaucuucuaaac

SEQ ID NO: 2315310 - RNA, 19 nt, Human
uuccccaugucucgacuca

SEQ ID NO: 2315311 - RNA, 12 nt, Human
uuccccauggga

SEQ ID NO: 2315312 - RNA, 23 nt, Human
uuccccaugggaagacgaggccc

SEQ ID NO: 2315313 - RNA, 17 nt, Human
uuccccaggaggccagc

SEQ ID NO: 2315314 - RNA, 18 nt, Human
uuccccaggaggccagcc

SEQ ID NO: 2315315 - RNA, 19 nt, Human
uuccccaggaggccagccu

SEQ ID NO: 2315316 - RNA, 20 nt, Human
uuccccaggaggccagccuu

SEQ ID NO: 2315317 - RNA, 17 nt, Human
uuccacuacaccuggcu

SEQ ID NO: 2315318 - RNA, 18 nt, Human
uuccacuacaccuggcug

SEQ ID NO: 2315319 - RNA, 19 nt, Human
uuccacuacaccuggcuga

SEQ ID NO: 2315320 - RNA, 22 nt, Human
uuccacuacaccuggcugaggu

SEQ ID NO: 2315321 - RNA, 18 nt, Human
uuccacuccuccuagcca

SEQ ID NO: 2315322 - RNA, 16 nt, Human
uuccacuccuccuagc

SEQ ID NO: 2315323 - RNA, 15 nt, Human
uuccacuacugcuac

SEQ ID NO: 2315324 - RNA, 16 nt, Human
uuccacugaaguagug

SEQ ID NO: 2315325 - RNA, 17 nt, Human
uuccagagaguccucug

SEQ ID NO: 2315326 - RNA, 21 nt, Human
uuccacuccuccuagccaccc

SEQ ID NO: 2315327 - RNA, 17 nt, Human
uuccagagaguggcucc

SEQ ID NO: 2315328 - RNA, 18 nt, Human
uuccagagaguggcuccu

SEQ ID NO: 2315329 - RNA, 19 nt, Human
uuccagagaguggcuccuc

SEQ ID NO: 2315330 - RNA, 20 nt, Human
uuccagagaguggcuccucc

SEQ ID NO: 2315331 - RNA, 21 nt, Human
uuccagagaguggcuccuccc

SEQ ID NO: 2315332 - RNA, 20 nt, Human
uuccagaugccuucuccaga

SEQ ID NO: 2315333 - RNA, 20 nt, Human
uuccagagaguccucuggau

SEQ ID NO: 2315334 - RNA, 19 nt, Human
uuccagauccuggaaauca

SEQ ID NO: 2315335 - RNA, 15 nt, Human
uuccaaauucugcuu

SEQ ID NO: 2315336 - RNA, 15 nt, Human
uuccaaauucacaag

SEQ ID NO: 2315337 - RNA, 21 nt, Human
uuccaaaugaauguugucugu

SEQ ID NO: 2315338 - RNA, 21 nt, Human
uuccaaauguaauaaacuuua

SEQ ID NO: 2315339 - RNA, 23 nt, Human
uuccaaauucacaaguuguguuu

SEQ ID NO: 2315340 - RNA, 14 nt, Human
uuccaacaaagggu

SEQ ID NO: 2315341 - RNA, 15 nt, Human
uuccacuacaccugg

SEQ ID NO: 2315342 - RNA, 12 nt, Human
uuccacuaaccc

SEQ ID NO: 2315343 - RNA, 16 nt, Human
uuccacuacaccuggc

SEQ ID NO: 2315344 - RNA, 15 nt, Human
uuccaacaaaggguu

SEQ ID NO: 2315345 - RNA, 16 nt, Human
uuccaacaaaggguuu

SEQ ID NO: 2315346 - RNA, 21 nt, Human
uuccaacaaaggguuuuaaug

SEQ ID NO: 2315347 - RNA, 22 nt, Human
uuccaacaaaggguuuuaaugu

SEQ ID NO: 2315348 - RNA, 13 nt, Human
uuccaaaauaauu

SEQ ID NO: 2315349 - RNA, 21 nt, Human
uuccaaaauaauuuuaagaaa

SEQ ID NO: 2315350 - RNA, 16 nt, Human
uuccaaaccugacaga

SEQ ID NO: 2315351 - RNA, 17 nt, Human
uuccaaaugaauguugu

SEQ ID NO: 2315352 - RNA, 21 nt, Human
uuccaaagaguagaauugcau

SEQ ID NO: 2315353 - RNA, 22 nt, Human
uucaugaaaauagcucuuucag

SEQ ID NO: 2315354 - RNA, 16 nt, Human
uucaucuuuuguauag

SEQ ID NO: 2315355 - RNA, 15 nt, Human
uucaugauuuugaaa

SEQ ID NO: 2315356 - RNA, 22 nt, Human
uucaucuuggucacauacaauu

SEQ ID NO: 2315357 - RNA, 14 nt, Human
uucaggaagaugaa

SEQ ID NO: 2315358 - RNA, 21 nt, Human
uucaucuugaauuguaaggaa

SEQ ID NO: 2315359 - RNA, 19 nt, Human
uucaggaaaagccucugug

SEQ ID NO: 2315360 - RNA, 20 nt, Human
uucaggaaaagccucugugu

SEQ ID NO: 2315361 - RNA, 11 nt, Human
uucaggaagcu

SEQ ID NO: 2315362 - RNA, 13 nt, Human
uucaggaagcuca

SEQ ID NO: 2315363 - RNA, 17 nt, Human
uucaucuugaauuguaa

SEQ ID NO: 2315364 - RNA, 21 nt, Human
uucaugcaaugacaucuucaa

SEQ ID NO: 2315365 - RNA, 15 nt, Human
uucaugcaaugacau

SEQ ID NO: 2315366 - RNA, 12 nt, Human
uucauuuccugc

SEQ ID NO: 2315367 - RNA, 13 nt, Human
uucaugcauggaa

SEQ ID NO: 2315368 - RNA, 20 nt, Human
uucaugcaaggggaaaaucu

SEQ ID NO: 2315369 - RNA, 14 nt, Human
uucaugcaaugaca

SEQ ID NO: 2315370 - RNA, 17 nt, Human
uucaugauuuugaaauc

SEQ ID NO: 2315371 - RNA, 17 nt, Human
uucaugcaaacuuuauu

SEQ ID NO: 2315372 - RNA, 15 nt, Human
uucauuuccuguguc

SEQ ID NO: 2315373 - RNA, 16 nt, Human
uucauuuccugugucu

SEQ ID NO: 2315374 - RNA, 13 nt, Human
uucauuuccugcc

SEQ ID NO: 2315375 - RNA, 14 nt, Human
uucauuuccugccc

SEQ ID NO: 2315376 - RNA, 16 nt, Human
uucauuugaugcuaaa

SEQ ID NO: 2315377 - RNA, 18 nt, Human
uucauuugagaaguaaac

SEQ ID NO: 2315378 - RNA, 20 nt, Human
uucauuugaguuauuuuaau

SEQ ID NO: 2315379 - RNA, 12 nt, Human
uuccaaaauaau

SEQ ID NO: 2315380 - RNA, 21 nt, Human
uuccucacaccaggcuugccu

SEQ ID NO: 2315381 - RNA, 17 nt, Human
uuccuauuuucagccca

SEQ ID NO: 2315382 - RNA, 13 nt, Human
uuccucacuucca

SEQ ID NO: 2315383 - RNA, 13 nt, Human
uuccucauuagca

SEQ ID NO: 2315384 - RNA, 16 nt, Human
uuccucauuccugaaa

SEQ ID NO: 2315385 - RNA, 14 nt, Human
uuccuccacauccu

SEQ ID NO: 2315386 - RNA, 15 nt, Human
uuccuccacauccuu

SEQ ID NO: 2315387 - RNA, 17 nt, Human
uuccuccacauccuuuc

SEQ ID NO: 2315388 - RNA, 14 nt, Human
uuccucaugaauua

SEQ ID NO: 2315389 - RNA, 23 nt, Human
uuccuccaucuccaagaaugcug

SEQ ID NO: 2315390 - RNA, 20 nt, Human
uuccucccaaguggugccua

SEQ ID NO: 2315391 - RNA, 23 nt, Human
uuccuccacauccuuucuaaaca

SEQ ID NO: 2315392 - RNA, 15 nt, Human
uuccuauuucuuaua

SEQ ID NO: 2315393 - RNA, 18 nt, Human
uuccuauuugccaugggc

SEQ ID NO: 2315394 - RNA, 20 nt, Human
uuccuauuugccaugggcuu

SEQ ID NO: 2315395 - RNA, 22 nt, Human
uuccuauuugccaugggcuuca

SEQ ID NO: 2315396 - RNA, 23 nt, Human
uuccuauuugccaugggcuucac

SEQ ID NO: 2315397 - RNA, 19 nt, Human
uuccuauuuguuuucaugg

SEQ ID NO: 2315398 - RNA, 21 nt, Human
uuccuauuuguuuucauggug

SEQ ID NO: 2315399 - RNA, 14 nt, Human
uuccuauguaacug

SEQ ID NO: 2315400 - RNA, 20 nt, Human
uuccuauggcuggccacugc

SEQ ID NO: 2315401 - RNA, 13 nt, Human
uuccuauugucau

SEQ ID NO: 2315402 - RNA, 17 nt, Human
uuccuauugucauuaaa

SEQ ID NO: 2315403 - RNA, 18 nt, Human
uuccuauugucauuaaag

SEQ ID NO: 2315404 - RNA, 21 nt, Human
uuccuauugugauuugacugu

SEQ ID NO: 2315405 - RNA, 22 nt, Human
uuccuauugugauuugacuguu

SEQ ID NO: 2315406 - RNA, 20 nt, Human
uuccuauugucauuaaaggu

SEQ ID NO: 2315407 - RNA, 12 nt, Human
uuccuauuguga

SEQ ID NO: 2315408 - RNA, 14 nt, Human
uuccuauugugauu

SEQ ID NO: 2315409 - RNA, 20 nt, Human
uuccuauugugauuugacug

SEQ ID NO: 2315410 - RNA, 14 nt, Human
uucccuugagcccu

SEQ ID NO: 2315411 - RNA, 15 nt, Human
uucccuugagcccuc

SEQ ID NO: 2315412 - RNA, 20 nt, Human
uucccuuugacgccauccca

SEQ ID NO: 2315413 - RNA, 21 nt, Human
uucccuuugacgccaucccag

SEQ ID NO: 2315414 - RNA, 22 nt, Human
uucccuuugacgccaucccagc

SEQ ID NO: 2315415 - RNA, 20 nt, Human
uuccuauaauauaauaaaua

SEQ ID NO: 2315416 - RNA, 15 nt, Human
uucccuuugugcaca

SEQ ID NO: 2315417 - RNA, 23 nt, Human
uucccuugaaauuuuaaacuaua

SEQ ID NO: 2315418 - RNA, 19 nt, Human
uuccuauauaguuuauuga

SEQ ID NO: 2315419 - RNA, 19 nt, Human
uuccuauacgcagcgugcu

SEQ ID NO: 2315420 - RNA, 13 nt, Human
uuccuauacgcag

SEQ ID NO: 2315421 - RNA, 22 nt, Human
uuccuauauaguuuauugacaa

SEQ ID NO: 2315422 - RNA, 21 nt, Human
uuccuauauaguuuauugaca

SEQ ID NO: 2315423 - RNA, 12 nt, Human
uuccuauaugca

SEQ ID NO: 2315424 - RNA, 12 nt, Human
uucccuucucca

SEQ ID NO: 2315425 - RNA, 20 nt, Human
uucccuucuccaucucucug

SEQ ID NO: 2315426 - RNA, 22 nt, Human
uucccuucuccaucucucuggc

SEQ ID NO: 2315427 - RNA, 22 nt, Human
uucccuucuugguuuccaaagg

SEQ ID NO: 2315428 - RNA, 17 nt, Human
uucccuugaugaagaag

SEQ ID NO: 2315429 - RNA, 23 nt, Human
uucccuggcuuguaacuccacca

SEQ ID NO: 2315430 - RNA, 16 nt, Human
uucccuggccuuucau

SEQ ID NO: 2315431 - RNA, 17 nt, Human
uucccuggccuuucaua

SEQ ID NO: 2315432 - RNA, 16 nt, Human
uucccugcuuccagga

SEQ ID NO: 2315433 - RNA, 17 nt, Human
uucccugggcugugcua

SEQ ID NO: 2315434 - RNA, 20 nt, Human
uucccugggcugugcuaccu

SEQ ID NO: 2315435 - RNA, 17 nt, Human
uucccugcuuaaugaaa

SEQ ID NO: 2315436 - RNA, 23 nt, Human
uucccugccucucaucaacugaa

SEQ ID NO: 2315437 - RNA, 14 nt, Human
uucccugccucuca

SEQ ID NO: 2315438 - RNA, 10 nt, Human
uucccugcaa

SEQ ID NO: 2315439 - RNA, 19 nt, Human
uucccugagucaccaggaa

SEQ ID NO: 2315440 - RNA, 18 nt, Human
uucccugagucaccagga

SEQ ID NO: 2315441 - RNA, 16 nt, Human
uucccugagucaccag

SEQ ID NO: 2315442 - RNA, 17 nt, Human
uucccugacacugcggg

SEQ ID NO: 2315443 - RNA, 18 nt, Human
uucccugacuccucuaag

SEQ ID NO: 2315444 - RNA, 12 nt, Human
uucccuggccuu

SEQ ID NO: 2315445 - RNA, 14 nt, Human
uucccugcuuccag

SEQ ID NO: 2315446 - RNA, 15 nt, Human
uucccugcuuccagg

SEQ ID NO: 2315447 - RNA, 19 nt, Human
uucccugcauuucugaguu

SEQ ID NO: 2315448 - RNA, 12 nt, Human
uucccugccugg

SEQ ID NO: 2315449 - RNA, 22 nt, Human
uucccugcugucgucuuagcaa

SEQ ID NO: 2315450 - RNA, 13 nt, Human
uucccugcuucca

SEQ ID NO: 2315451 - RNA, 19 nt, Human
uucccugaaaacccagaga

SEQ ID NO: 2315452 - RNA, 17 nt, Human
uucccugaaaacccaga

SEQ ID NO: 2315453 - RNA, 20 nt, Human
uucccucuuuggcuccccug

SEQ ID NO: 2315454 - RNA, 21 nt, Human
uucccucugccugucccucuc

SEQ ID NO: 2315455 - RNA, 15 nt, Human
uucccucugcuccug

SEQ ID NO: 2315456 - RNA, 19 nt, Human
uucccucugcuccuggagc

SEQ ID NO: 2315457 - RNA, 14 nt, Human
uucccucuuuggcu

SEQ ID NO: 2315458 - RNA, 16 nt, Human
uucccucuuuggcucc

SEQ ID NO: 2315459 - RNA, 15 nt, Human
uucccugaauguauu

SEQ ID NO: 2315460 - RNA, 20 nt, Human
uucccugaaaacccagagag

SEQ ID NO: 2315461 - RNA, 16 nt, Human
uucccugaaggaacca

SEQ ID NO: 2315462 - RNA, 12 nt, Human
uucccugaggug

SEQ ID NO: 2315463 - RNA, 16 nt, Human
uucccugacucauucu

SEQ ID NO: 2315464 - RNA, 13 nt, Human
uucccugacucau

SEQ ID NO: 2315465 - RNA, 18 nt, Human
uucccucugccugucccu

SEQ ID NO: 2315466 - RNA, 17 nt, Human
uucccucugccuguccc

SEQ ID NO: 2315467 - RNA, 14 nt, Human
uucccucugccugu

SEQ ID NO: 2315468 - RNA, 13 nt, Human
uucccucugccug

SEQ ID NO: 2315469 - RNA, 11 nt, Human
uucccucugag

SEQ ID NO: 2315470 - RNA, 22 nt, Human
uucccucugagaauuccaagga

SEQ ID NO: 2315471 - RNA, 23 nt, Human
uucccucugagaauuccaaggag

SEQ ID NO: 2315472 - RNA, 14 nt, Human
uucccucucccugu

SEQ ID NO: 2315473 - RNA, 14 nt, Human
uucccucucucuga

SEQ ID NO: 2315474 - RNA, 15 nt, Human
uucccucucucugac

SEQ ID NO: 2315475 - RNA, 15 nt, Human
uucccuccugcuacu

SEQ ID NO: 2315476 - RNA, 14 nt, Human
uucgggcccugccu

SEQ ID NO: 2315477 - RNA, 23 nt, Human
uucgggaagagaggaguucaaug

SEQ ID NO: 2315478 - RNA, 14 nt, Human
uucgggaagagagg

SEQ ID NO: 2315479 - RNA, 22 nt, Human
uucgggaagagaggaguucaau

SEQ ID NO: 2315480 - RNA, 13 nt, Human
uucgggcugugcc

SEQ ID NO: 2315481 - RNA, 12 nt, Human
uucgggcugugc

SEQ ID NO: 2315482 - RNA, 13 nt, Human
uucggcugucuca

SEQ ID NO: 2315483 - RNA, 20 nt, Human
uucgggaggucgaggcagga

SEQ ID NO: 2315484 - RNA, 17 nt, Human
uuccuuggggcaggcag

SEQ ID NO: 2315485 - RNA, 18 nt, Human
uuccuuggggcaggcagu

SEQ ID NO: 2315486 - RNA, 15 nt, Human
uuccuuggggcaggc

SEQ ID NO: 2315487 - RNA, 15 nt, Human
uuccuuggcuggugc

SEQ ID NO: 2315488 - RNA, 14 nt, Human
uuccuuggggcagg

SEQ ID NO: 2315489 - RNA, 21 nt, Human
uuccuuggcaugccuuccagc

SEQ ID NO: 2315490 - RNA, 18 nt, Human
uuccuuggcaugccuucc

SEQ ID NO: 2315491 - RNA, 23 nt, Human
uuccuuggauaggcuuuuuagua

SEQ ID NO: 2315492 - RNA, 15 nt, Human
uuccuuggcucccau

SEQ ID NO: 2315493 - RNA, 21 nt, Human
uuccuuggcucccauucacuc

SEQ ID NO: 2315494 - RNA, 23 nt, Human
uuccuuggcucccauucacucuu

SEQ ID NO: 2315495 - RNA, 13 nt, Human
uuccuuggcuggu

SEQ ID NO: 2315496 - RNA, 24 nt, Human
uuccuugagacacggagcccagcc

SEQ ID NO: 2315497 - RNA, 20 nt, Human
uuccuuggacucauuuuaaa

SEQ ID NO: 2315498 - RNA, 15 nt, Human
uucuaaagauggaaa

SEQ ID NO: 2315499 - RNA, 18 nt, Human
uucuaaagccuuaagucu

SEQ ID NO: 2315500 - RNA, 13 nt, Human
uucuaaagcugcc

SEQ ID NO: 2315501 - RNA, 17 nt, Human
uucuaaagcugccagcc

SEQ ID NO: 2315502 - RNA, 12 nt, Human
uucguucugugg

SEQ ID NO: 2315503 - RNA, 14 nt, Human
uucgggcugugccc

SEQ ID NO: 2315504 - RNA, 17 nt, Human
uucguuuguuuguuuca

SEQ ID NO: 2315505 - RNA, 14 nt, Human
uucguuucuguaua

SEQ ID NO: 2315506 - RNA, 16 nt, Human
uucguuucuguauaca

SEQ ID NO: 2315507 - RNA, 13 nt, Human
uucguucuguuua

SEQ ID NO: 2315508 - RNA, 15 nt, Human
uucguuuauuuucaa

SEQ ID NO: 2315509 - RNA, 13 nt, Human
uucuaaaaaacag

SEQ ID NO: 2315510 - RNA, 14 nt, Human
uucuaaaaaaagaa

SEQ ID NO: 2315511 - RNA, 18 nt, Human
uucuaaaaauugugauca

SEQ ID NO: 2315512 - RNA, 18 nt, Human
uucuaaaacuaaauagca

SEQ ID NO: 2315513 - RNA, 19 nt, Human
uucuaaaacuaaauagcau

SEQ ID NO: 2315514 - RNA, 22 nt, Human
uucuaaaacuaaauagcaugua

SEQ ID NO: 2315515 - RNA, 23 nt, Human
uuccuccccauuagagucagccu

SEQ ID NO: 2315516 - RNA, 21 nt, Human
uuccuccccauuagagucagc

SEQ ID NO: 2315517 - RNA, 13 nt, Human
uuccuccccagca

SEQ ID NO: 2315518 - RNA, 12 nt, Human
uuccuccccagc

SEQ ID NO: 2315519 - RNA, 11 nt, Human
uuccuccccag

SEQ ID NO: 2315520 - RNA, 15 nt, Human
uuccugaugcuucuu

SEQ ID NO: 2315521 - RNA, 18 nt, Human
uuccugaugcuucuucag

SEQ ID NO: 2315522 - RNA, 19 nt, Human
uuccugaugcuucuucaga

SEQ ID NO: 2315523 - RNA, 15 nt, Human
uuccugcauuuguga

SEQ ID NO: 2315524 - RNA, 16 nt, Human
uuccugcauuugugaa

SEQ ID NO: 2315525 - RNA, 18 nt, Human
uuccugcauuugugaaau

SEQ ID NO: 2315526 - RNA, 14 nt, Human
uuccuccccagcag

SEQ ID NO: 2315527 - RNA, 12 nt, Human
uuccugccacca

SEQ ID NO: 2315528 - RNA, 18 nt, Human
uuccugccaccagucacu

SEQ ID NO: 2315529 - RNA, 15 nt, Human
uuccugccaccaguc

SEQ ID NO: 2315530 - RNA, 17 nt, Human
uuccugccaccagucac

SEQ ID NO: 2315531 - RNA, 17 nt, Human
uuccugccaggcauggu

SEQ ID NO: 2315532 - RNA, 24 nt, Human
uuccuggacauccucuucugcuua

SEQ ID NO: 2315533 - RNA, 15 nt, Human
uuccuggcaauagug

SEQ ID NO: 2315534 - RNA, 15 nt, Human
uuccuggagcccaga

SEQ ID NO: 2315535 - RNA, 16 nt, Human
uuccuggagcccagag

SEQ ID NO: 2315536 - RNA, 14 nt, Human
uuccuggcacugcu

SEQ ID NO: 2315537 - RNA, 12 nt, Human
uuccuggacauc

SEQ ID NO: 2315538 - RNA, 20 nt, Human
uuccuggacauccucuucug

SEQ ID NO: 2315539 - RNA, 13 nt, Human
uuccugccccagg

SEQ ID NO: 2315540 - RNA, 16 nt, Human
uuccugccccaggccu

SEQ ID NO: 2315541 - RNA, 19 nt, Human
uuccuggacacucagaccu

SEQ ID NO: 2315542 - RNA, 15 nt, Human
uuccuugaccagcag

SEQ ID NO: 2315543 - RNA, 13 nt, Human
uuccuugaccagc

SEQ ID NO: 2315544 - RNA, 17 nt, Human
uuccuugagaaaaacaa

SEQ ID NO: 2315545 - RNA, 22 nt, Human
uuccuugagacacggagcccag

SEQ ID NO: 2315546 - RNA, 20 nt, Human
uuccuugaguugauucagcu

SEQ ID NO: 2315547 - RNA, 23 nt, Human
uuccuggcaauaguguguucuga

SEQ ID NO: 2315548 - RNA, 22 nt, Human
uuccuggcaauaguguguucug

SEQ ID NO: 2315549 - RNA, 20 nt, Human
uuccuggcaauaguguguuc

SEQ ID NO: 2315550 - RNA, 18 nt, Human
uuccuggcaauagugugu

SEQ ID NO: 2315551 - RNA, 17 nt, Human
uuccuucuugccuucag

SEQ ID NO: 2315552 - RNA, 12 nt, Human
uuccuucuuuga

SEQ ID NO: 2315553 - RNA, 13 nt, Human
uuccuugaagccg

SEQ ID NO: 2315554 - RNA, 14 nt, Human
uuccuugaagccga

SEQ ID NO: 2315555 - RNA, 13 nt, Human
uuccuucuuugau

SEQ ID NO: 2315556 - RNA, 14 nt, Human
uuccuucuuugaua

SEQ ID NO: 2315557 - RNA, 19 nt, Human
uuccuucuuugauaauguu

SEQ ID NO: 2315558 - RNA, 22 nt, Human
uuccuucuuugauaauguuaaa

SEQ ID NO: 2315559 - RNA, 22 nt, Human
uuacuuuuauaauaaaaggaaa

SEQ ID NO: 2315560 - RNA, 14 nt, Human
uuacuuuuuaaaau

SEQ ID NO: 2315561 - RNA, 15 nt, Human
uuacuuuuaaauguc

SEQ ID NO: 2315562 - RNA, 23 nt, Human
uuacuuuuauaauaaaaggaaaa

SEQ ID NO: 2315563 - RNA, 19 nt, Human
uuacuuuuaaacuguguac

SEQ ID NO: 2315564 - RNA, 16 nt, Human
uuacuuuuaaacugug

SEQ ID NO: 2315565 - RNA, 14 nt, Human
uuacuuuguguuca

SEQ ID NO: 2315566 - RNA, 15 nt, Human
uuacuuuuaaacugu

SEQ ID NO: 2315567 - RNA, 14 nt, Human
uuacuuuuaaacug

SEQ ID NO: 2315568 - RNA, 17 nt, Human
uuacuuuuaaacaguga

SEQ ID NO: 2315569 - RNA, 13 nt, Human
uuacuuugugaau

SEQ ID NO: 2315570 - RNA, 20 nt, Human
uuagaaaagcaaagggugcu

SEQ ID NO: 2315571 - RNA, 21 nt, Human
uuagaaaacauaaucuucugc

SEQ ID NO: 2315572 - RNA, 15 nt, Human
uuagacagucccugc

SEQ ID NO: 2315573 - RNA, 19 nt, Human
uuagaaacacaacuauauu

SEQ ID NO: 2315574 - RNA, 17 nt, Human
uuacuuuaaaaggagcc

SEQ ID NO: 2315575 - RNA, 18 nt, Human
uuacuuuaaaaggagcca

SEQ ID NO: 2315576 - RNA, 19 nt, Human
uuacuugcauugaauauau

SEQ ID NO: 2315577 - RNA, 14 nt, Human
uuacuugaccuccu

SEQ ID NO: 2315578 - RNA, 11 nt, Human
uuacuuucugu

SEQ ID NO: 2315579 - RNA, 18 nt, Human
uuacuuucuguugccaca

SEQ ID NO: 2315580 - RNA, 21 nt, Human
uuacuuuccuuuccccagccc

SEQ ID NO: 2315581 - RNA, 15 nt, Human
uuacuuuaccacccc

SEQ ID NO: 2315582 - RNA, 20 nt, Human
uuacuuuaccacccccacac

SEQ ID NO: 2315583 - RNA, 16 nt, Human
uuacuuuauguuacua

SEQ ID NO: 2315584 - RNA, 23 nt, Human
uuagagacaguugggugagaaca

SEQ ID NO: 2315585 - RNA, 21 nt, Human
uuagagaaguauacauaaguu

SEQ ID NO: 2315586 - RNA, 17 nt, Human
uuagacuugaaauacua

SEQ ID NO: 2315587 - RNA, 19 nt, Human
uuagacucaucuuacugua

SEQ ID NO: 2315588 - RNA, 14 nt, Human
uuagacuacauuua

SEQ ID NO: 2315589 - RNA, 18 nt, Human
uuagacuacauuuagaga

SEQ ID NO: 2315590 - RNA, 13 nt, Human
uuagacuccuccu

SEQ ID NO: 2315591 - RNA, 21 nt, Human
uuagacuucgacucaggaucc

SEQ ID NO: 2315592 - RNA, 20 nt, Human
uuagacuguuggggugggua

SEQ ID NO: 2315593 - RNA, 14 nt, Human
uuagacuguagccu

SEQ ID NO: 2315594 - RNA, 20 nt, Human
uuagacuguagccuggauau

SEQ ID NO: 2315595 - RNA, 23 nt, Human
uuagacuguaggaagaguagcau

SEQ ID NO: 2315596 - RNA, 13 nt, Human
uuagaccucagcc

SEQ ID NO: 2315597 - RNA, 12 nt, Human
uuagaccucagc

SEQ ID NO: 2315598 - RNA, 11 nt, Human
uuagaccucag

SEQ ID NO: 2315599 - RNA, 15 nt, Human
uuagaccucagccug

SEQ ID NO: 2315600 - RNA, 14 nt, Human
uuagaccucagccu

SEQ ID NO: 2315601 - RNA, 16 nt, Human
uuagaccucagccugu

SEQ ID NO: 2315602 - RNA, 18 nt, Human
uuagacuaaggccauuau

SEQ ID NO: 2315603 - RNA, 15 nt, Human
uuagaccacaaauag

SEQ ID NO: 2315604 - RNA, 13 nt, Human
uuagacccugggu

SEQ ID NO: 2315605 - RNA, 16 nt, Human
uuagacagucccugcc

SEQ ID NO: 2315606 - RNA, 17 nt, Human
uuagacagucccugcca

SEQ ID NO: 2315607 - RNA, 18 nt, Human
uuagacagucccugccaa

SEQ ID NO: 2315608 - RNA, 14 nt, Human
uuagacagucccug

SEQ ID NO: 2315609 - RNA, 19 nt, Human
uuagaaaauguuauuuaac

SEQ ID NO: 2315610 - RNA, 13 nt, Human
uuagacauaacaa

SEQ ID NO: 2315611 - RNA, 23 nt, Human
uuacuguggaggaaggauuguaa

SEQ ID NO: 2315612 - RNA, 18 nt, Human
uuacuguuagucauuugc

SEQ ID NO: 2315613 - RNA, 23 nt, Human
uuacuguuaccugaucaaugaca

SEQ ID NO: 2315614 - RNA, 21 nt, Human
uuacuuaaaccgccaaggcug

SEQ ID NO: 2315615 - RNA, 14 nt, Human
uuacuguugugacc

SEQ ID NO: 2315616 - RNA, 15 nt, Human
uuacuguugugaccu

SEQ ID NO: 2315617 - RNA, 14 nt, Human
uuacuguuucuguc

SEQ ID NO: 2315618 - RNA, 15 nt, Human
uuacuguuucuguca

SEQ ID NO: 2315619 - RNA, 16 nt, Human
uuacuguuucugucag

SEQ ID NO: 2315620 - RNA, 17 nt, Human
uuacugucuuuuuucua

SEQ ID NO: 2315621 - RNA, 14 nt, Human
uuacugugaaacug

SEQ ID NO: 2315622 - RNA, 14 nt, Human
uuacuguggaggaa

SEQ ID NO: 2315623 - RNA, 16 nt, Human
uuacuguggcuucuua

SEQ ID NO: 2315624 - RNA, 16 nt, Human
uuacuguggaggaagg

SEQ ID NO: 2315625 - RNA, 17 nt, Human
uuacuguggaggaagga

SEQ ID NO: 2315626 - RNA, 18 nt, Human
uuacuguggaggaaggau

SEQ ID NO: 2315627 - RNA, 20 nt, Human
uuacuguggaggaaggauug

SEQ ID NO: 2315628 - RNA, 19 nt, Human
uuacuauggcccuggccua

SEQ ID NO: 2315629 - RNA, 18 nt, Human
uuacuaugccugugucuu

SEQ ID NO: 2315630 - RNA, 14 nt, Human
uuacuaugccugug

SEQ ID NO: 2315631 - RNA, 19 nt, Human
uuacugucuuuuuucuaaa

SEQ ID NO: 2315632 - RNA, 15 nt, Human
uuacuuccuaucaag

SEQ ID NO: 2315633 - RNA, 22 nt, Human
uuacuucguguccgacucuucu

SEQ ID NO: 2315634 - RNA, 16 nt, Human
uuacuuaucuuaugcc

SEQ ID NO: 2315635 - RNA, 19 nt, Human
uuacuucacuuuaauucuc

SEQ ID NO: 2315636 - RNA, 11 nt, Human
uuacuucugcu

SEQ ID NO: 2315637 - RNA, 23 nt, Human
uuacuucuuauacauuugauaaa

SEQ ID NO: 2315638 - RNA, 12 nt, Human
uuacuucugcua

SEQ ID NO: 2315639 - RNA, 15 nt, Human
uuacuguuuguuaug

SEQ ID NO: 2315640 - RNA, 21 nt, Human
uuacuguuugucuucucccca

SEQ ID NO: 2315641 - RNA, 22 nt, Human
uuacuguuugucuucuccccag

SEQ ID NO: 2315642 - RNA, 13 nt, Human
uuacuuaaagauu

SEQ ID NO: 2315643 - RNA, 14 nt, Human
uuacuuaaagauuu

SEQ ID NO: 2315644 - RNA, 19 nt, Human
uuacuuaaagauuuaucaa

SEQ ID NO: 2315645 - RNA, 20 nt, Human
uuacuuaaagauuuaucaaa

SEQ ID NO: 2315646 - RNA, 15 nt, Human
uuacuuagaggaaau

SEQ ID NO: 2315647 - RNA, 20 nt, Human
uuacuuagaggaaauaagaa

SEQ ID NO: 2315648 - RNA, 13 nt, Human
uuacuuaccuaaa

SEQ ID NO: 2315649 - RNA, 22 nt, Human
uuacuuaaagauuuaucaaauc

SEQ ID NO: 2315650 - RNA, 23 nt, Human
uuacuuaucauccacauuguuuu

SEQ ID NO: 2315651 - RNA, 17 nt, Human
uuacuuaucauccacau

SEQ ID NO: 2315652 - RNA, 18 nt, Human
uuacuuagguguggggga

SEQ ID NO: 2315653 - RNA, 18 nt, Human
uuacuacaugugggagcu

SEQ ID NO: 2315654 - RNA, 13 nt, Human
uuacuacaguugu

SEQ ID NO: 2315655 - RNA, 13 nt, Human
uuacuacugugga

SEQ ID NO: 2315656 - RNA, 13 nt, Human
uuacuagaacaca

SEQ ID NO: 2315657 - RNA, 23 nt, Human
uuacuagggaucccucaucuguc

SEQ ID NO: 2315658 - RNA, 20 nt, Human
uuacuagggaucccucaucu

SEQ ID NO: 2315659 - RNA, 16 nt, Human
uuacuagggaucccuc

SEQ ID NO: 2315660 - RNA, 20 nt, Human
uuacuagaacacagaaagcc

SEQ ID NO: 2315661 - RNA, 15 nt, Human
uuacuacaguuguuu

SEQ ID NO: 2315662 - RNA, 14 nt, Human
uuacuacaugcacu

SEQ ID NO: 2315663 - RNA, 13 nt, Human
uuacuacaugcac

SEQ ID NO: 2315664 - RNA, 20 nt, Human
uuacuacaaaauuugaaauu

SEQ ID NO: 2315665 - RNA, 14 nt, Human
uuacuacaaaauuu

SEQ ID NO: 2315666 - RNA, 21 nt, Human
uuacuaagccacaagaaauuu

SEQ ID NO: 2315667 - RNA, 22 nt, Human
uuacuaagccacaagaaauuug

SEQ ID NO: 2315668 - RNA, 14 nt, Human
uuacuaagcuuugc

SEQ ID NO: 2315669 - RNA, 22 nt, Human
uuacuaagcuuugccagcugcu

SEQ ID NO: 2315670 - RNA, 16 nt, Human
uuacuaugcacaauuu

SEQ ID NO: 2315671 - RNA, 13 nt, Human
uuacuaugccugu

SEQ ID NO: 2315672 - RNA, 21 nt, Human
uuacuaucaugucaaacguga

SEQ ID NO: 2315673 - RNA, 19 nt, Human
uuacuaucaugucaaacgu

SEQ ID NO: 2315674 - RNA, 17 nt, Human
uuacuaguuucccuugc

SEQ ID NO: 2315675 - RNA, 21 nt, Human
uuacuaggugcccagaaugag

SEQ ID NO: 2315676 - RNA, 19 nt, Human
uuacuagguaacuucauau

SEQ ID NO: 2315677 - RNA, 17 nt, Human
uuacuagguaacuucau

SEQ ID NO: 2315678 - RNA, 16 nt, Human
uuacuagguaacuuca

SEQ ID NO: 2315679 - RNA, 14 nt, Human
uuacuagguaacuu

SEQ ID NO: 2315680 - RNA, 16 nt, Human
uuacacaaaacaaaug

SEQ ID NO: 2315681 - RNA, 18 nt, Human
uuacacaaaacaaaugcc

SEQ ID NO: 2315682 - RNA, 21 nt, Human
uuacaauuuuuuuaauuuugu

SEQ ID NO: 2315683 - RNA, 22 nt, Human
uuacaauuuuuuuaauuuugua

SEQ ID NO: 2315684 - RNA, 23 nt, Human
uuacaauuuuuuuaauuuuguau

SEQ ID NO: 2315685 - RNA, 20 nt, Human
uuacaauuuuuuaucaugca

SEQ ID NO: 2315686 - RNA, 18 nt, Human
uuacaauuuuuuaucaug

SEQ ID NO: 2315687 - RNA, 17 nt, Human
uuacaauuuuuuaucau

SEQ ID NO: 2315688 - RNA, 15 nt, Human
uuacaauuuuuuauc

SEQ ID NO: 2315689 - RNA, 13 nt, Human
uuacuaagaagaa

SEQ ID NO: 2315690 - RNA, 15 nt, Human
uuacuaagaagaaaa

SEQ ID NO: 2315691 - RNA, 21 nt, Human
uuacacaaaacaaaugccaca

SEQ ID NO: 2315692 - RNA, 23 nt, Human
uuacuaaagaaaauaucugaaau

SEQ ID NO: 2315693 - RNA, 15 nt, Human
uuacuaaagaaagau

SEQ ID NO: 2315694 - RNA, 18 nt, Human
uuacuaaagaaagauuac

SEQ ID NO: 2315695 - RNA, 22 nt, Human
uuacuaaagaaagauuacuuag

SEQ ID NO: 2315696 - RNA, 15 nt, Human
uuacuaacuaaacuc

SEQ ID NO: 2315697 - RNA, 20 nt, Human
uuacuaacuaaacucucuuu

SEQ ID NO: 2315698 - RNA, 16 nt, Human
uuacuaauagacaauu

SEQ ID NO: 2315699 - RNA, 14 nt, Human
uuacuaaguuuuua

SEQ ID NO: 2315700 - RNA, 13 nt, Human
uuacuaaguuuuu

SEQ ID NO: 2315701 - RNA, 22 nt, Human
uuacuaagaagaaaauugcugu

SEQ ID NO: 2315702 - RNA, 21 nt, Human
uuacuaagaugacauugcuaa

SEQ ID NO: 2315703 - RNA, 22 nt, Human
uuacuaagaugacauugcuaag

SEQ ID NO: 2315704 - RNA, 23 nt, Human
uuacuaagaugacauugcuaaga

SEQ ID NO: 2315705 - RNA, 21 nt, Human
uuacuaagcauagcaaacaga

SEQ ID NO: 2315706 - RNA, 17 nt, Human
uuacuaagccacaagaa

SEQ ID NO: 2315707 - RNA, 18 nt, Human
uuacuaagccacaagaaa

SEQ ID NO: 2315708 - RNA, 20 nt, Human
uuacuaagccacaagaaauu

SEQ ID NO: 2315709 - RNA, 16 nt, Human
uuagcuggcauuacag

SEQ ID NO: 2315710 - RNA, 12 nt, Human
uuagcugggaga

SEQ ID NO: 2315711 - RNA, 15 nt, Human
uuagcugucugcuca

SEQ ID NO: 2315712 - RNA, 15 nt, Human
uuagcugugugaaau

SEQ ID NO: 2315713 - RNA, 17 nt, Human
uuagcugucugcucaga

SEQ ID NO: 2315714 - RNA, 12 nt, Human
uuagcuggaaaa

SEQ ID NO: 2315715 - RNA, 13 nt, Human
uuagcuggaaaag

SEQ ID NO: 2315716 - RNA, 13 nt, Human
uuagcugcagaac

SEQ ID NO: 2315717 - RNA, 23 nt, Human
uuagcugaugaacuuauucugua

SEQ ID NO: 2315718 - RNA, 10 nt, Human
uuagcugagc

SEQ ID NO: 2315719 - RNA, 23 nt, Human
uuagcucuuaauuguucauuuug

SEQ ID NO: 2315720 - RNA, 14 nt, Human
uuagcuccuguggc

SEQ ID NO: 2315721 - RNA, 19 nt, Human
uuagcucuggaccagccug

SEQ ID NO: 2315722 - RNA, 12 nt, Human
uuagcucuuaau

SEQ ID NO: 2315723 - RNA, 22 nt, Human
uuagcucuuaauuguucauuuu

SEQ ID NO: 2315724 - RNA, 13 nt, Human
uuagcuccccucc

SEQ ID NO: 2315725 - RNA, 14 nt, Human
uuagcuccccucca

SEQ ID NO: 2315726 - RNA, 18 nt, Human
uuagcuccccuccaaccu

SEQ ID NO: 2315727 - RNA, 20 nt, Human
uuagcucccuguucuugggu

SEQ ID NO: 2315728 - RNA, 13 nt, Human
uuagcuccugugg

SEQ ID NO: 2315729 - RNA, 19 nt, Human
uuaggaaauaaaaccuuuc

SEQ ID NO: 2315730 - RNA, 18 nt, Human
uuaggaaauaaaaccuuu

SEQ ID NO: 2315731 - RNA, 17 nt, Human
uuaggaaauaaaaccuu

SEQ ID NO: 2315732 - RNA, 15 nt, Human
uuaggaaauaaaacc

SEQ ID NO: 2315733 - RNA, 21 nt, Human
uuaggaaauaaaaccuuucaa

SEQ ID NO: 2315734 - RNA, 20 nt, Human
uuaggaaauaaaaccuuuca

SEQ ID NO: 2315735 - RNA, 19 nt, Human
uuaggaaaugaaugugugu

SEQ ID NO: 2315736 - RNA, 15 nt, Human
uuaggaaaugaaugu

SEQ ID NO: 2315737 - RNA, 17 nt, Human
uuaggaaaugaaugugu

SEQ ID NO: 2315738 - RNA, 12 nt, Human
uuaggaaauaaa

SEQ ID NO: 2315739 - RNA, 11 nt, Human
uuaggaaauaa

SEQ ID NO: 2315740 - RNA, 18 nt, Human
uuagcuuuuuaauuguug

SEQ ID NO: 2315741 - RNA, 19 nt, Human
uuagcuuugcucugccaac

SEQ ID NO: 2315742 - RNA, 16 nt, Human
uuagcuuuuuaauugu

SEQ ID NO: 2315743 - RNA, 17 nt, Human
uuagcuuuuuaauuguu

SEQ ID NO: 2315744 - RNA, 21 nt, Human
uuagcuugaaggaucuguuuu

SEQ ID NO: 2315745 - RNA, 16 nt, Human
uuagcuuuacuguuug

SEQ ID NO: 2315746 - RNA, 15 nt, Human
uuagcuuuacuguuu

SEQ ID NO: 2315747 - RNA, 17 nt, Human
uuagcuuuacuguuugu

SEQ ID NO: 2315748 - RNA, 15 nt, Human
uuagcuuugcucugc

SEQ ID NO: 2315749 - RNA, 21 nt, Human
uuagcuuagaccucagccugu

SEQ ID NO: 2315750 - RNA, 18 nt, Human
uuagcuuagaccucagcc

SEQ ID NO: 2315751 - RNA, 17 nt, Human
uuagcuuagaccucagc

SEQ ID NO: 2315752 - RNA, 16 nt, Human
uuagcuuagaccucag

SEQ ID NO: 2315753 - RNA, 21 nt, Human
uuagcuguuauuucuauuuuu

SEQ ID NO: 2315754 - RNA, 19 nt, Human
uuagcuguuauuucuauuu

SEQ ID NO: 2315755 - RNA, 17 nt, Human
uuagcuguuauuucuau

SEQ ID NO: 2315756 - RNA, 16 nt, Human
uuagcuguuauuucua

SEQ ID NO: 2315757 - RNA, 16 nt, Human
uuagcugugugaaaua

SEQ ID NO: 2315758 - RNA, 21 nt, Human
uuagagcagaugaccccuccc

SEQ ID NO: 2315759 - RNA, 13 nt, Human
uuagagaugaauu

SEQ ID NO: 2315760 - RNA, 20 nt, Human
uuagagcaguuucuguccug

SEQ ID NO: 2315761 - RNA, 15 nt, Human
uuagagcauugccau

SEQ ID NO: 2315762 - RNA, 16 nt, Human
uuagagccaggcacac

SEQ ID NO: 2315763 - RNA, 21 nt, Human
uuagagccaggcacacacugu

SEQ ID NO: 2315764 - RNA, 12 nt, Human
uuagaggccagc

SEQ ID NO: 2315765 - RNA, 18 nt, Human
uuagagggagguguuuaa

SEQ ID NO: 2315766 - RNA, 18 nt, Human
uuagagggaggagaauga

SEQ ID NO: 2315767 - RNA, 19 nt, Human
uuagaggaaaaaaaugacu

SEQ ID NO: 2315768 - RNA, 20 nt, Human
uuagaggaaauaagaaaaau

SEQ ID NO: 2315769 - RNA, 22 nt, Human
uuagaggaaauaagaaaaauca

SEQ ID NO: 2315770 - RNA, 23 nt, Human
uuagaggaaauaagaaaaaucau

SEQ ID NO: 2315771 - RNA, 18 nt, Human
uuagaggaaaaaaaugac

SEQ ID NO: 2315772 - RNA, 17 nt, Human
uuagaggaaaaaaauga

SEQ ID NO: 2315773 - RNA, 14 nt, Human
uuagagccucccuc

SEQ ID NO: 2315774 - RNA, 22 nt, Human
uuagagccaggcacacacugug

SEQ ID NO: 2315775 - RNA, 13 nt, Human
uuagagccucccu

SEQ ID NO: 2315776 - RNA, 21 nt, Human
uuagagcugacacaaaccugc

SEQ ID NO: 2315777 - RNA, 14 nt, Human
uuagagucagccuu

SEQ ID NO: 2315778 - RNA, 20 nt, Human
uuagagguuuuaaagugauu

SEQ ID NO: 2315779 - RNA, 13 nt, Human
uuagagguuuuaa

SEQ ID NO: 2315780 - RNA, 19 nt, Human
uuagagguuuuaaagugau

SEQ ID NO: 2315781 - RNA, 21 nt, Human
uuagagguuuuaaagugauua

SEQ ID NO: 2315782 - RNA, 17 nt, Human
uuagagugucuuuccac

SEQ ID NO: 2315783 - RNA, 16 nt, Human
uuagagugucuuucca

SEQ ID NO: 2315784 - RNA, 12 nt, Human
uuagaguuagac

SEQ ID NO: 2315785 - RNA, 13 nt, Human
uuagaguuagacu

SEQ ID NO: 2315786 - RNA, 14 nt, Human
uuagaguugauacu

SEQ ID NO: 2315787 - RNA, 14 nt, Human
uuagaguuagacug

SEQ ID NO: 2315788 - RNA, 17 nt, Human
uuagaguuagacuguug

SEQ ID NO: 2315789 - RNA, 18 nt, Human
uuagaguuagacuguugg

SEQ ID NO: 2315790 - RNA, 21 nt, Human
uuagcguagcuaagugaaaag

SEQ ID NO: 2315791 - RNA, 12 nt, Human
uuagcuaaagga

SEQ ID NO: 2315792 - RNA, 16 nt, Human
uuagcuacuauauaug

SEQ ID NO: 2315793 - RNA, 21 nt, Human
uuagcuaaacggauuccaaag

SEQ ID NO: 2315794 - RNA, 20 nt, Human
uuagaugcaguucugaagaa

SEQ ID NO: 2315795 - RNA, 21 nt, Human
uuagaugcaguucugaagaag

SEQ ID NO: 2315796 - RNA, 13 nt, Human
uuagaucaaauac

SEQ ID NO: 2315797 - RNA, 14 nt, Human
uuagauauaacacu

SEQ ID NO: 2315798 - RNA, 17 nt, Human
uuagauauaacacuaug

SEQ ID NO: 2315799 - RNA, 23 nt, Human
uuagaucaaauacuuuaaaggaa

SEQ ID NO: 2315800 - RNA, 16 nt, Human
uuagaguuaacaauga

SEQ ID NO: 2315801 - RNA, 22 nt, Human
uuagauaauacaccacuacauu

SEQ ID NO: 2315802 - RNA, 18 nt, Human
uuagucucuaaagaguuu

SEQ ID NO: 2315803 - RNA, 22 nt, Human
uuagucucuuguauuaaacucu

SEQ ID NO: 2315804 - RNA, 22 nt, Human
uuagucucaguuugugugucuu

SEQ ID NO: 2315805 - RNA, 23 nt, Human
uuagucucaguuugugugucuua

SEQ ID NO: 2315806 - RNA, 12 nt, Human
uuagucucaguu

SEQ ID NO: 2315807 - RNA, 21 nt, Human
uuagucucaguuugugugucu

SEQ ID NO: 2315808 - RNA, 19 nt, Human
uuagucuacucuuaagcca

SEQ ID NO: 2315809 - RNA, 20 nt, Human
uuagucuacucuuaagccau

SEQ ID NO: 2315810 - RNA, 21 nt, Human
uuagucuacucuuaagccauc

SEQ ID NO: 2315811 - RNA, 22 nt, Human
uuagucuacucuuaagccaucu

SEQ ID NO: 2315812 - RNA, 12 nt, Human
uuaguguuucug

SEQ ID NO: 2315813 - RNA, 16 nt, Human
uuaguguuucugugca

SEQ ID NO: 2315814 - RNA, 14 nt, Human
uuaguguucauaaa

SEQ ID NO: 2315815 - RNA, 21 nt, Human
uuaguguuuggguauauucau

SEQ ID NO: 2315816 - RNA, 17 nt, Human
uuaguguuucugugcau

SEQ ID NO: 2315817 - RNA, 18 nt, Human
uuaguguuucugugcaug

SEQ ID NO: 2315818 - RNA, 13 nt, Human
uuaguuaauauau

SEQ ID NO: 2315819 - RNA, 16 nt, Human
uuaguuauagaugucu

SEQ ID NO: 2315820 - RNA, 13 nt, Human
uuaguuauaguuu

SEQ ID NO: 2315821 - RNA, 15 nt, Human
uuaguuauaguuuca

SEQ ID NO: 2315822 - RNA, 18 nt, Human
uuaguuauaguuucagau

SEQ ID NO: 2315823 - RNA, 22 nt, Human
uuaguuauaguuucagauauau

SEQ ID NO: 2315824 - RNA, 22 nt, Human
uuagucacuuuuuuuuuccaaa

SEQ ID NO: 2315825 - RNA, 23 nt, Human
uuagucacugccugcagaggucu

SEQ ID NO: 2315826 - RNA, 13 nt, Human
uuagucacuuuuu

SEQ ID NO: 2315827 - RNA, 13 nt, Human
uuagucaugugac

SEQ ID NO: 2315828 - RNA, 14 nt, Human
uuagucaugugacc

SEQ ID NO: 2315829 - RNA, 16 nt, Human
uuaguauuugcauauu

SEQ ID NO: 2315830 - RNA, 13 nt, Human
uuaguauuugcau

SEQ ID NO: 2315831 - RNA, 22 nt, Human
uuaguauuuauuuaauguuaug

SEQ ID NO: 2315832 - RNA, 17 nt, Human
uuagucccucaugcaaa

SEQ ID NO: 2315833 - RNA, 13 nt, Human
uuagucgugagcu

SEQ ID NO: 2315834 - RNA, 13 nt, Human
uuaguccuugcuu

SEQ ID NO: 2315835 - RNA, 16 nt, Human
uuagucgugagcucuu

SEQ ID NO: 2315836 - RNA, 19 nt, Human
uuagucgugagcucuugug

SEQ ID NO: 2315837 - RNA, 21 nt, Human
uuagucgugagcucuugugag

SEQ ID NO: 2315838 - RNA, 24 nt, Human
uuagucgugagcucuugugaggaa

SEQ ID NO: 2315839 - RNA, 23 nt, Human
uuaguaucuaacauguaucccaa

SEQ ID NO: 2315840 - RNA, 18 nt, Human
uuaguaugaggcauuugu

SEQ ID NO: 2315841 - RNA, 18 nt, Human
uuaguaucuaacauguau

SEQ ID NO: 2315842 - RNA, 17 nt, Human
uuaguaucuaacaugua

SEQ ID NO: 2315843 - RNA, 15 nt, Human
uuaguaucuaacaug

SEQ ID NO: 2315844 - RNA, 16 nt, Human
uuaguaugaggcauuu

SEQ ID NO: 2315845 - RNA, 16 nt, Human
uuaggaugugugcaug

SEQ ID NO: 2315846 - RNA, 14 nt, Human
uuaggauuuaacag

SEQ ID NO: 2315847 - RNA, 21 nt, Human
uuaggauuuaacagucauuua

SEQ ID NO: 2315848 - RNA, 15 nt, Human
uuaggcagauugaaa

SEQ ID NO: 2315849 - RNA, 22 nt, Human
uuaggauuuaacagucauuuaa

SEQ ID NO: 2315850 - RNA, 14 nt, Human
uuaggcagggaagu

SEQ ID NO: 2315851 - RNA, 23 nt, Human
uuaggcagcagcuuuuaauacag

SEQ ID NO: 2315852 - RNA, 13 nt, Human
uuaggcagcagcu

SEQ ID NO: 2315853 - RNA, 21 nt, Human
uuaggaguucgagaccagccu

SEQ ID NO: 2315854 - RNA, 19 nt, Human
uuaggagggaguuaucuaa

SEQ ID NO: 2315855 - RNA, 18 nt, Human
uuaggauguugaaaaagu

SEQ ID NO: 2315856 - RNA, 21 nt, Human
uuaggaaguguaacagcugag

SEQ ID NO: 2315857 - RNA, 20 nt, Human
uuaggaaguguaacagcuga

SEQ ID NO: 2315858 - RNA, 19 nt, Human
uuaggaaguguaacagcug

SEQ ID NO: 2315859 - RNA, 13 nt, Human
uuaggaaguguaa

SEQ ID NO: 2315860 - RNA, 15 nt, Human
uuaggaagagaaacc

SEQ ID NO: 2315861 - RNA, 23 nt, Human
uuaggagauuuuagguguugauu

SEQ ID NO: 2315862 - RNA, 17 nt, Human
uuaggagaagccaggaa

SEQ ID NO: 2315863 - RNA, 16 nt, Human
uuaggagaagccagga

SEQ ID NO: 2315864 - RNA, 21 nt, Human
uuaggacaaucaguccccucc

SEQ ID NO: 2315865 - RNA, 19 nt, Human
uuaggaauuaaguuaucuu

SEQ ID NO: 2315866 - RNA, 23 nt, Human
uuaggaauuaaguuaucuuuaaa

SEQ ID NO: 2315867 - RNA, 13 nt, Human
uuaggagaagcca

SEQ ID NO: 2315868 - RNA, 12 nt, Human
uuaggagaagcc

SEQ ID NO: 2315869 - RNA, 22 nt, Human
uuaggccaaaaaaauguaagau

SEQ ID NO: 2315870 - RNA, 19 nt, Human
uuaggcagggauuugagga

SEQ ID NO: 2315871 - RNA, 12 nt, Human
uuaggcagggau

SEQ ID NO: 2315872 - RNA, 18 nt, Human
uuaggcagggauuugagg

SEQ ID NO: 2315873 - RNA, 16 nt, Human
uuaggcuauucacaac

SEQ ID NO: 2315874 - RNA, 15 nt, Human
uuaggcuauucacaa

SEQ ID NO: 2315875 - RNA, 16 nt, Human
uuaggccuuccucucu

SEQ ID NO: 2315876 - RNA, 17 nt, Human
uuaggccuggcacagug

SEQ ID NO: 2315877 - RNA, 18 nt, Human
uuaggccuggcacagugu

SEQ ID NO: 2315878 - RNA, 12 nt, Human
uuaggccuggca

SEQ ID NO: 2315879 - RNA, 14 nt, Human
uuaggccuggcaca

SEQ ID NO: 2315880 - RNA, 15 nt, Human
uuaggccuggcacag

SEQ ID NO: 2315881 - RNA, 16 nt, Human
uuaggcugguggccca

SEQ ID NO: 2315882 - RNA, 18 nt, Human
uuaggcugguggcccagg

SEQ ID NO: 2315883 - RNA, 17 nt, Human
uuaggcugguggcccag

SEQ ID NO: 2315884 - RNA, 19 nt, Human
uuaggcugguggcccagga

SEQ ID NO: 2315885 - RNA, 14 nt, Human
uuagggaaaacauu

SEQ ID NO: 2315886 - RNA, 17 nt, Human
uuaguagagacaggguu

SEQ ID NO: 2315887 - RNA, 13 nt, Human
uuaguagcauguu

SEQ ID NO: 2315888 - RNA, 12 nt, Human
uuaguagcaugu

SEQ ID NO: 2315889 - RNA, 16 nt, Human
uguuuuguucuguggu

SEQ ID NO: 2315890 - RNA, 22 nt, Human
uguuuuaagaggcagggucuca

SEQ ID NO: 2315891 - RNA, 18 nt, Human
uguuuuaaggaugcuugu

SEQ ID NO: 2315892 - RNA, 16 nt, Human
uguuuuuaaaaaucau

SEQ ID NO: 2315893 - RNA, 14 nt, Human
uguuuuuuggucuu

SEQ ID NO: 2315894 - RNA, 17 nt, Human
uguuuuguucuuuaaag

SEQ ID NO: 2315895 - RNA, 17 nt, Human
uguuuuguuuggagaca

SEQ ID NO: 2315896 - RNA, 18 nt, Human
uguuuuuuuuuuccacuu

SEQ ID NO: 2315897 - RNA, 19 nt, Human
uguuuuuuuuuuccacuua

SEQ ID NO: 2315898 - RNA, 20 nt, Human
uuaaaagaaagccucagaga

SEQ ID NO: 2315899 - RNA, 23 nt, Human
uuaaaagaaaauaaaaaaaagaa

SEQ ID NO: 2315900 - RNA, 22 nt, Human
uuaaaagaaaauaaaaaaaaga

SEQ ID NO: 2315901 - RNA, 18 nt, Human
uguuuuuuuuuaaagacu

SEQ ID NO: 2315902 - RNA, 16 nt, Human
uguuuuuuggucuuuu

SEQ ID NO: 2315903 - RNA, 17 nt, Human
uuaaaagauacaguuac

SEQ ID NO: 2315904 - RNA, 14 nt, Human
uuaaaagauacagu

SEQ ID NO: 2315905 - RNA, 22 nt, Human
uuaaaagaauauuuuaacuucc

SEQ ID NO: 2315906 - RNA, 21 nt, Human
uuaaaagaauauuuuaacuuc

SEQ ID NO: 2315907 - RNA, 20 nt, Human
uuaaacuguguggacuguga

SEQ ID NO: 2315908 - RNA, 11 nt, Human
uuaaagaaagu

SEQ ID NO: 2315909 - RNA, 21 nt, Human
uuaaacuguguggacugugau

SEQ ID NO: 2315910 - RNA, 19 nt, Human
uuaaacuguguacauaacu

SEQ ID NO: 2315911 - RNA, 12 nt, Human
uuaaacugugua

SEQ ID NO: 2315912 - RNA, 22 nt, Human
uuaaacugguauuuuaucuuug

SEQ ID NO: 2315913 - RNA, 13 nt, Human
uuaaacugguauu

SEQ ID NO: 2315914 - RNA, 19 nt, Human
uuaaacugguauuuuaucu

SEQ ID NO: 2315915 - RNA, 17 nt, Human
uuaaaaguugaauuuuu

SEQ ID NO: 2315916 - RNA, 22 nt, Human
uuaaaauagcaacacucuauau

SEQ ID NO: 2315917 - RNA, 15 nt, Human
uuaaaauagaaauaa

SEQ ID NO: 2315918 - RNA, 19 nt, Human
uuaaacucuucacaaaauc

SEQ ID NO: 2315919 - RNA, 22 nt, Human
uuaaacucuguugcaagugcaa

SEQ ID NO: 2315920 - RNA, 20 nt, Human
uuaaacucagggacagagcc

SEQ ID NO: 2315921 - RNA, 22 nt, Human
uuaaacucagggacagagccau

SEQ ID NO: 2315922 - RNA, 17 nt, Human
uuaaaaggauuuuuauc

SEQ ID NO: 2315923 - RNA, 20 nt, Human
uuaaaaggauuuuuaucuuu

SEQ ID NO: 2315924 - RNA, 22 nt, Human
uuaaaaggauuuuuaucuuucg

SEQ ID NO: 2315925 - RNA, 21 nt, Human
uuaaaagggauuacccaagca

SEQ ID NO: 2315926 - RNA, 23 nt, Human
uuaaaagggauuacccaagcaaa

SEQ ID NO: 2315927 - RNA, 21 nt, Human
uuaaaauaccagccaguaaau

SEQ ID NO: 2315928 - RNA, 19 nt, Human
uuaaaauacacacucaaau

SEQ ID NO: 2315929 - RNA, 21 nt, Human
uuaaaagaugcaauguagagg

SEQ ID NO: 2315930 - RNA, 16 nt, Human
uuaaaagauucauuuu

SEQ ID NO: 2315931 - RNA, 17 nt, Human
uuaaaagauucauuuuu

SEQ ID NO: 2315932 - RNA, 21 nt, Human
uuaaaagauucauuuuuaauc

SEQ ID NO: 2315933 - RNA, 18 nt, Human
uuaaaagaugaaaauauu

SEQ ID NO: 2315934 - RNA, 15 nt, Human
uuaaaagaugaaaau

SEQ ID NO: 2315935 - RNA, 15 nt, Human
uguuuguauguauaa

SEQ ID NO: 2315936 - RNA, 19 nt, Human
uguuuguauaaugaaugag

SEQ ID NO: 2315937 - RNA, 15 nt, Human
uguuugucauuagcc

SEQ ID NO: 2315938 - RNA, 17 nt, Human
uguuugucauuagccug

SEQ ID NO: 2315939 - RNA, 22 nt, Human
uguuugguauuguauuuauuca

SEQ ID NO: 2315940 - RNA, 16 nt, Human
uguuugguauuguauu

SEQ ID NO: 2315941 - RNA, 17 nt, Human
uguuugguauuguauuu

SEQ ID NO: 2315942 - RNA, 20 nt, Human
uguuugguucuggggccccu

SEQ ID NO: 2315943 - RNA, 16 nt, Human
uguuugguucuggggc

SEQ ID NO: 2315944 - RNA, 17 nt, Human
uguuugucugucuucau

SEQ ID NO: 2315945 - RNA, 19 nt, Human
uguuugucugucuucauag

SEQ ID NO: 2315946 - RNA, 16 nt, Human
uguuugucagauauga

SEQ ID NO: 2315947 - RNA, 16 nt, Human
uguuugucucauccca

SEQ ID NO: 2315948 - RNA, 13 nt, Human
uguuugugauuga

SEQ ID NO: 2315949 - RNA, 20 nt, Human
uguuuuaagaggcagggucu

SEQ ID NO: 2315950 - RNA, 17 nt, Human
uguuugucuucucccca

SEQ ID NO: 2315951 - RNA, 16 nt, Human
uguuugucuucucccc

SEQ ID NO: 2315952 - RNA, 14 nt, Human
uguuugugcugugg

SEQ ID NO: 2315953 - RNA, 13 nt, Human
uguuugugcugug

SEQ ID NO: 2315954 - RNA, 15 nt, Human
uguuuccuucagugc

SEQ ID NO: 2315955 - RNA, 12 nt, Human
uguuuccuucag

SEQ ID NO: 2315956 - RNA, 23 nt, Human
uguuuccuggcacugcuuccagu

SEQ ID NO: 2315957 - RNA, 20 nt, Human
uguuuccagacuuccuugag

SEQ ID NO: 2315958 - RNA, 23 nt, Human
uguuuccaauguuuagcaaauac

SEQ ID NO: 2315959 - RNA, 22 nt, Human
uguuucauguuuugugacuaua

SEQ ID NO: 2315960 - RNA, 19 nt, Human
uguuucauguuuugugacu

SEQ ID NO: 2315961 - RNA, 21 nt, Human
uguuucauguuuugugacuau

SEQ ID NO: 2315962 - RNA, 13 nt, Human
uguuucauguuuu

SEQ ID NO: 2315963 - RNA, 14 nt, Human
uguuucauguuuug

SEQ ID NO: 2315964 - RNA, 23 nt, Human
uguuuccagacuuccuugagaca

SEQ ID NO: 2315965 - RNA, 18 nt, Human
uguuuccaaccuggagua

SEQ ID NO: 2315966 - RNA, 15 nt, Human
uguuuccaauguuua

SEQ ID NO: 2315967 - RNA, 21 nt, Human
uguuuccaauguuuagcaaau

SEQ ID NO: 2315968 - RNA, 22 nt, Human
uguuuccaauguuuagcaaaua

SEQ ID NO: 2315969 - RNA, 19 nt, Human
uguuucgugaaguauacug

SEQ ID NO: 2315970 - RNA, 15 nt, Human
uguuucgugaaguau

SEQ ID NO: 2315971 - RNA, 20 nt, Human
uguuucgugaaguauacugu

SEQ ID NO: 2315972 - RNA, 15 nt, Human
uguuucguggggagg

SEQ ID NO: 2315973 - RNA, 21 nt, Human
uguuucgcugauauauguguu

SEQ ID NO: 2315974 - RNA, 22 nt, Human
uguuucggagacgggaccgggc

SEQ ID NO: 2315975 - RNA, 11 nt, Human
uguuuccuuuu

SEQ ID NO: 2315976 - RNA, 21 nt, Human
uguuucuaauaaagaaagcag

SEQ ID NO: 2315977 - RNA, 21 nt, Human
uguuucuagcacuggccugca

SEQ ID NO: 2315978 - RNA, 20 nt, Human
uguuucauauugaugugugu

SEQ ID NO: 2315979 - RNA, 18 nt, Human
uguuucacgaaguuuguu

SEQ ID NO: 2315980 - RNA, 16 nt, Human
uguuucaauugcaucu

SEQ ID NO: 2315981 - RNA, 17 nt, Human
uguuucaaguggggcuc

SEQ ID NO: 2315982 - RNA, 21 nt, Human
uguuucaaguggggcucgcca

SEQ ID NO: 2315983 - RNA, 15 nt, Human
uguuucaaacuuuac

SEQ ID NO: 2315984 - RNA, 17 nt, Human
uguuuagaguugcaauc

SEQ ID NO: 2315985 - RNA, 21 nt, Human
uguuucaaacauauauaacaa

SEQ ID NO: 2315986 - RNA, 22 nt, Human
uguuucaaacauauauaacaau

SEQ ID NO: 2315987 - RNA, 16 nt, Human
uguuuagauaauacac

SEQ ID NO: 2315988 - RNA, 19 nt, Human
uguuucaaacauauauaac

SEQ ID NO: 2315989 - RNA, 16 nt, Human
uguuuagaguugcaau

SEQ ID NO: 2315990 - RNA, 23 nt, Human
uggugccccaggaccagcucagg

SEQ ID NO: 2315991 - RNA, 19 nt, Human
uguuuagaagaaguguguc

SEQ ID NO: 2315992 - RNA, 16 nt, Human
uguuuagaagaagugu

SEQ ID NO: 2315993 - RNA, 21 nt, Human
uggugccccaggaccagcuca

SEQ ID NO: 2315994 - RNA, 20 nt, Human
uggugccccaggaccagcuc

SEQ ID NO: 2315995 - RNA, 19 nt, Human
uggugccccaggaccagcu

SEQ ID NO: 2315996 - RNA, 18 nt, Human
uggugccccaggaccagc

SEQ ID NO: 2315997 - RNA, 17 nt, Human
uggugccccaggaccag

SEQ ID NO: 2315998 - RNA, 16 nt, Human
uggugccccaggacca

SEQ ID NO: 2315999 - RNA, 14 nt, Human
uggugccccaggac

SEQ ID NO: 2316000 - RNA, 13 nt, Human
uggugccccagga

SEQ ID NO: 2316001 - RNA, 14 nt, Human
uggugccagccuuc

SEQ ID NO: 2316002 - RNA, 13 nt, Human
uggugccagccuu

SEQ ID NO: 2316003 - RNA, 21 nt, Human
uggugccagccuuccucugca

SEQ ID NO: 2316004 - RNA, 22 nt, Human
uggugccaauggaaccuccuuu

SEQ ID NO: 2316005 - RNA, 17 nt, Human
uggugccacaaauaaaa

SEQ ID NO: 2316006 - RNA, 18 nt, Human
uggugccacaaauaaaau

SEQ ID NO: 2316007 - RNA, 20 nt, Human
uggugccacaaauaaaaugg

SEQ ID NO: 2316008 - RNA, 17 nt, Human
uuacaagcccccccuuc

SEQ ID NO: 2316009 - RNA, 19 nt, Human
uuacaagcccccccuucca

SEQ ID NO: 2316010 - RNA, 20 nt, Human
uuacaagcccccccuuccac

SEQ ID NO: 2316011 - RNA, 20 nt, Human
uuacaagcgugagccacugc

SEQ ID NO: 2316012 - RNA, 17 nt, Human
uuaauguuuauuccuga

SEQ ID NO: 2316013 - RNA, 15 nt, Human
uuaauguuuauuccu

SEQ ID NO: 2316014 - RNA, 22 nt, Human
uuaauguucugaauaauuucuu

SEQ ID NO: 2316015 - RNA, 23 nt, Human
uuaauguucugaauaauuucuua

SEQ ID NO: 2316016 - RNA, 17 nt, Human
uuacaauugaaaugacu

SEQ ID NO: 2316017 - RNA, 13 nt, Human
uuacaauugucau

SEQ ID NO: 2316018 - RNA, 12 nt, Human
uuacaauuuaca

SEQ ID NO: 2316019 - RNA, 13 nt, Human
uuacaauuuacaa

SEQ ID NO: 2316020 - RNA, 16 nt, Human
uuacaauuuacaaagu

SEQ ID NO: 2316021 - RNA, 18 nt, Human
uuacaauuuacaaagugu

SEQ ID NO: 2316022 - RNA, 19 nt, Human
uuacaauuuacaaagugug

SEQ ID NO: 2316023 - RNA, 15 nt, Human
uuacaauugaaauga

SEQ ID NO: 2316024 - RNA, 14 nt, Human
uuacaauugaaaug

SEQ ID NO: 2316025 - RNA, 13 nt, Human
uuacaauugaaau

SEQ ID NO: 2316026 - RNA, 18 nt, Human
uuacaauucccugcuguc

SEQ ID NO: 2316027 - RNA, 19 nt, Human
uuacaauucccugcugucg

SEQ ID NO: 2316028 - RNA, 21 nt, Human
uuacaagcgugagccacugca

SEQ ID NO: 2316029 - RNA, 16 nt, Human
uuacaauguucauccc

SEQ ID NO: 2316030 - RNA, 20 nt, Human
uuaaugcauguuaggaaaau

SEQ ID NO: 2316031 - RNA, 18 nt, Human
uuaaugcaucuagauuau

SEQ ID NO: 2316032 - RNA, 19 nt, Human
uuaaugccauuaucccuga

SEQ ID NO: 2316033 - RNA, 15 nt, Human
uuaaugcacuuucua

SEQ ID NO: 2316034 - RNA, 11 nt, Human
uuaaugcacuu

SEQ ID NO: 2316035 - RNA, 12 nt, Human
uuaaugcacuuu

SEQ ID NO: 2316036 - RNA, 13 nt, Human
uuaaugcacuuuc

SEQ ID NO: 2316037 - RNA, 14 nt, Human
uuaaugcacuuucu

SEQ ID NO: 2316038 - RNA, 21 nt, Human
uuaauggggguagcagcugga

SEQ ID NO: 2316039 - RNA, 23 nt, Human
uuaaugccgauauacucuagaug

SEQ ID NO: 2316040 - RNA, 19 nt, Human
uuaauggggguagcagcug

SEQ ID NO: 2316041 - RNA, 18 nt, Human
uuaauguaaucugauggc

SEQ ID NO: 2316042 - RNA, 20 nt, Human
uuaauggugccuucauuugg

SEQ ID NO: 2316043 - RNA, 19 nt, Human
uuaauggugccuucauuug

SEQ ID NO: 2316044 - RNA, 17 nt, Human
uuaauggugccuucauu

SEQ ID NO: 2316045 - RNA, 15 nt, Human
uuaauguagauuuuu

SEQ ID NO: 2316046 - RNA, 13 nt, Human
uuaauguguauua

SEQ ID NO: 2316047 - RNA, 21 nt, Human
uuaaugugcuguguaaaguua

SEQ ID NO: 2316048 - RNA, 22 nt, Human
uuaaugugcuguguaaaguuag

SEQ ID NO: 2316049 - RNA, 16 nt, Human
uuaaugugcuguguaa

SEQ ID NO: 2316050 - RNA, 17 nt, Human
uuaaugugcuguguaaa

SEQ ID NO: 2316051 - RNA, 18 nt, Human
uuaaugugcuguguaaag

SEQ ID NO: 2316052 - RNA, 19 nt, Human
uuaaugugcuguguaaagu

SEQ ID NO: 2316053 - RNA, 15 nt, Human
uuaauguagccaugg

SEQ ID NO: 2316054 - RNA, 14 nt, Human
uuaaugugcugugu

SEQ ID NO: 2316055 - RNA, 15 nt, Human
uuaaugugcugugua

SEQ ID NO: 2316056 - RNA, 15 nt, Human
uuaauauaacugccu

SEQ ID NO: 2316057 - RNA, 17 nt, Human
uuaagcuguuacugucu

SEQ ID NO: 2316058 - RNA, 20 nt, Human
uuaagcagcucuugcuaauc

SEQ ID NO: 2316059 - RNA, 22 nt, Human
uuaagccucauauuuaaagaca

SEQ ID NO: 2316060 - RNA, 16 nt, Human
uuaagccuuuggaaac

SEQ ID NO: 2316061 - RNA, 15 nt, Human
uuaagccuuuggaaa

SEQ ID NO: 2316062 - RNA, 12 nt, Human
uuaagcagcucu

SEQ ID NO: 2316063 - RNA, 13 nt, Human
uuaagcagcucuu

SEQ ID NO: 2316064 - RNA, 17 nt, Human
uuaagcagcucuugcua

SEQ ID NO: 2316065 - RNA, 18 nt, Human
uuaagcagcucuugcuaa

SEQ ID NO: 2316066 - RNA, 23 nt, Human
uuaauauaacugccuuaaaacuu

SEQ ID NO: 2316067 - RNA, 15 nt, Human
uuaauauagcuauuu

SEQ ID NO: 2316068 - RNA, 17 nt, Human
uuaauauagcuauuuuu

SEQ ID NO: 2316069 - RNA, 20 nt, Human
uuaauauaucccagaaauua

SEQ ID NO: 2316070 - RNA, 19 nt, Human
uuaauauaucccagaaauu

SEQ ID NO: 2316071 - RNA, 22 nt, Human
uuaauauugauaugcuuauaca

SEQ ID NO: 2316072 - RNA, 18 nt, Human
uuaauauugauaugcuua

SEQ ID NO: 2316073 - RNA, 22 nt, Human
uuaauauucauuguauaaaaau

SEQ ID NO: 2316074 - RNA, 15 nt, Human
uuaauauucuauuaa

SEQ ID NO: 2316075 - RNA, 21 nt, Human
uuaaugauaaguaaaugcuag

SEQ ID NO: 2316076 - RNA, 12 nt, Human
uuaacucaauau

SEQ ID NO: 2316077 - RNA, 23 nt, Human
uuaacuaauaugggcauuguagu

SEQ ID NO: 2316078 - RNA, 14 nt, Human
uuaacucagaucac

SEQ ID NO: 2316079 - RNA, 15 nt, Human
uuaacucagaucacu

SEQ ID NO: 2316080 - RNA, 22 nt, Human
uuaacucagaucacuacugcag

SEQ ID NO: 2316081 - RNA, 12 nt, Human
uuaacucagucu

SEQ ID NO: 2316082 - RNA, 19 nt, Human
uuaacuauuuuauuuucua

SEQ ID NO: 2316083 - RNA, 15 nt, Human
uuaacuagaauuuau

SEQ ID NO: 2316084 - RNA, 16 nt, Human
uuaacuagaauuuauu

SEQ ID NO: 2316085 - RNA, 21 nt, Human
uuaacuagaauuuauucaauu

SEQ ID NO: 2316086 - RNA, 12 nt, Human
uuaacucugucu

SEQ ID NO: 2316087 - RNA, 13 nt, Human
uuaacucugucuu

SEQ ID NO: 2316088 - RNA, 22 nt, Human
uuaacuuaaauuuuaauuuauu

SEQ ID NO: 2316089 - RNA, 22 nt, Human
uuaacuucagagggaaaguaaa

SEQ ID NO: 2316090 - RNA, 14 nt, Human
uuaacuucucugga

SEQ ID NO: 2316091 - RNA, 15 nt, Human
uuaacuuuuauaaac

SEQ ID NO: 2316092 - RNA, 18 nt, Human
uuaacuuaacauucugua

SEQ ID NO: 2316093 - RNA, 18 nt, Human
uuaacuuagcuugaagga

SEQ ID NO: 2316094 - RNA, 16 nt, Human
uuaacuucacauauug

SEQ ID NO: 2316095 - RNA, 17 nt, Human
uuaacuuuuauaaacuu

SEQ ID NO: 2316096 - RNA, 16 nt, Human
uuaacuuuuauaaacu

SEQ ID NO: 2316097 - RNA, 22 nt, Human
uuaacuugaggguaauaaacuu

SEQ ID NO: 2316098 - RNA, 21 nt, Human
uuaagcagauggaaugcugug

SEQ ID NO: 2316099 - RNA, 18 nt, Human
uuaacuuuuauaaacuuu

SEQ ID NO: 2316100 - RNA, 12 nt, Human
uuaacuucugcc

SEQ ID NO: 2316101 - RNA, 17 nt, Human
uuaacuugagcuuuaaa

SEQ ID NO: 2316102 - RNA, 19 nt, Human
uuaaccauugucuuguucu

SEQ ID NO: 2316103 - RNA, 13 nt, Human
uuaaccagaauaa

SEQ ID NO: 2316104 - RNA, 16 nt, Human
uuaaccauuaaaacug

SEQ ID NO: 2316105 - RNA, 17 nt, Human
uuaaccauuaaaacuga

SEQ ID NO: 2316106 - RNA, 18 nt, Human
uuaaccauuaaaacugaa

SEQ ID NO: 2316107 - RNA, 13 nt, Human
uuaaccauugucu

SEQ ID NO: 2316108 - RNA, 14 nt, Human
uuaacauuucaagg

SEQ ID NO: 2316109 - RNA, 19 nt, Human
uuaaccaaaaagaccagac

SEQ ID NO: 2316110 - RNA, 12 nt, Human
uuaaccaaaggu

SEQ ID NO: 2316111 - RNA, 13 nt, Human
uuaaccaaaggug

SEQ ID NO: 2316112 - RNA, 14 nt, Human
uuaaccaaagguga

SEQ ID NO: 2316113 - RNA, 18 nt, Human
uuaaccaaaggugaagga

SEQ ID NO: 2316114 - RNA, 17 nt, Human
uuaaccacuucagcuga

SEQ ID NO: 2316115 - RNA, 20 nt, Human
uuaaccuaugauauuuucug

SEQ ID NO: 2316116 - RNA, 15 nt, Human
uuaaccucaguguca

SEQ ID NO: 2316117 - RNA, 21 nt, Human
uuaaccuaugauauuuucugu

SEQ ID NO: 2316118 - RNA, 13 nt, Human
uuaaccuggugcu

SEQ ID NO: 2316119 - RNA, 19 nt, Human
uuaaccucagugucauuua

SEQ ID NO: 2316120 - RNA, 13 nt, Human
uuaaccugaugca

SEQ ID NO: 2316121 - RNA, 12 nt, Human
uuaaccucugca

SEQ ID NO: 2316122 - RNA, 15 nt, Human
uuaaccucugcacua

SEQ ID NO: 2316123 - RNA, 17 nt, Human
uuaaccuggugcuggau

SEQ ID NO: 2316124 - RNA, 17 nt, Human
uuaacggcuccaggauu

SEQ ID NO: 2316125 - RNA, 19 nt, Human
uuaacggcuccaggauuuu

SEQ ID NO: 2316126 - RNA, 23 nt, Human
uuaacuaaucuauuggguucauu

SEQ ID NO: 2316127 - RNA, 12 nt, Human
uuaacuagaauu

SEQ ID NO: 2316128 - RNA, 14 nt, Human
uuaacuagaauuua

SEQ ID NO: 2316129 - RNA, 11 nt, Human
uuaaagacaga

SEQ ID NO: 2316130 - RNA, 12 nt, Human
uuaaagacagag

SEQ ID NO: 2316131 - RNA, 21 nt, Human
uuaaagacaaagacaaauucu

SEQ ID NO: 2316132 - RNA, 21 nt, Human
uuaaauguuuuuuuuuaaaga

SEQ ID NO: 2316133 - RNA, 23 nt, Human
uuaaauguuuuuuuuuaaagacu

SEQ ID NO: 2316134 - RNA, 14 nt, Human
uuuguguacagugu

SEQ ID NO: 2316135 - RNA, 19 nt, Human
uuuguguaauagaaaacug

SEQ ID NO: 2316136 - RNA, 12 nt, Human
uuuguggcuggg

SEQ ID NO: 2316137 - RNA, 11 nt, Human
uuuguggggag

SEQ ID NO: 2316138 - RNA, 22 nt, Human
uuugugguacgaccuuuagauu

SEQ ID NO: 2316139 - RNA, 14 nt, Human
ugggauguuucugu

SEQ ID NO: 2316140 - RNA, 13 nt, Human
ugggcagagccca

SEQ ID NO: 2316141 - RNA, 14 nt, Human
ugggcagagcccaa

SEQ ID NO: 2316142 - RNA, 12 nt, Human
ugggcagagcug

SEQ ID NO: 2316143 - RNA, 23 nt, Human
ugggcagagcagagaccaucccu

SEQ ID NO: 2316144 - RNA, 16 nt, Human
ugggcagagcuggcuc

SEQ ID NO: 2316145 - RNA, 13 nt, Human
ugggcagggagcg

SEQ ID NO: 2316146 - RNA, 14 nt, Human
ugggcagagcuggc

SEQ ID NO: 2316147 - RNA, 23 nt, Human
ugggcaggacucagcuccccaga

SEQ ID NO: 2316148 - RNA, 13 nt, Human
ugggcccugccuc

SEQ ID NO: 2316149 - RNA, 18 nt, Human
ugggcccugccucuguuu

SEQ ID NO: 2316150 - RNA, 14 nt, Human
ugggccuggcuccc

SEQ ID NO: 2316151 - RNA, 11 nt, Human
ugggccuucag

SEQ ID NO: 2316152 - RNA, 11 nt, Human
ugggcccuccu

SEQ ID NO: 2316153 - RNA, 18 nt, Human
ugggcccucucugcucug

SEQ ID NO: 2316154 - RNA, 16 nt, Human
ugggcccucucugcuc

SEQ ID NO: 2316155 - RNA, 13 nt, Human
ugggcccucucug

SEQ ID NO: 2316156 - RNA, 15 nt, Human
ugggcaggugggagc

SEQ ID NO: 2316157 - RNA, 14 nt, Human
ugggcagguggugg

SEQ ID NO: 2316158 - RNA, 15 nt, Human
ugggcaggugguggc

SEQ ID NO: 2316159 - RNA, 16 nt, Human
ugggcaggugguggca

SEQ ID NO: 2316160 - RNA, 21 nt, Human
ugggcaggugguggcacugag

SEQ ID NO: 2316161 - RNA, 20 nt, Human
ugggccccugccucucugca

SEQ ID NO: 2316162 - RNA, 17 nt, Human
ugggcaggugguggcac

SEQ ID NO: 2316163 - RNA, 21 nt, Human
ugggccccugccucucugcag

SEQ ID NO: 2316164 - RNA, 23 nt, Human
ugggccccugccucucugcaggu

SEQ ID NO: 2316165 - RNA, 23 nt, Human
ugggauguggcugcagcagcggu

SEQ ID NO: 2316166 - RNA, 19 nt, Human
ugggauguccacagaugcc

SEQ ID NO: 2316167 - RNA, 20 nt, Human
ugggaucccucugggcacug

SEQ ID NO: 2316168 - RNA, 18 nt, Human
ugggaugguggagggcca

SEQ ID NO: 2316169 - RNA, 14 nt, Human
ugggauccuccagg

SEQ ID NO: 2316170 - RNA, 12 nt, Human
ugggauccucca

SEQ ID NO: 2316171 - RNA, 13 nt, Human
ugggauccuccag

SEQ ID NO: 2316172 - RNA, 22 nt, Human
ugggauuacaagcgugagccac

SEQ ID NO: 2316173 - RNA, 16 nt, Human
ugggauguucagcacu

SEQ ID NO: 2316174 - RNA, 20 nt, Human
ugggauguucagcacugucc

SEQ ID NO: 2316175 - RNA, 21 nt, Human
ugggauguucagcacuguccc

SEQ ID NO: 2316176 - RNA, 22 nt, Human
ugggauguucagcacugucccu

SEQ ID NO: 2316177 - RNA, 18 nt, Human
ugggcagagcagagacca

SEQ ID NO: 2316178 - RNA, 17 nt, Human
ugggauuacaggcguga

SEQ ID NO: 2316179 - RNA, 22 nt, Human
ugggcagagcagagaccauccc

SEQ ID NO: 2316180 - RNA, 16 nt, Human
uggcugggggccucag

SEQ ID NO: 2316181 - RNA, 17 nt, Human
uggcugggggccucagu

SEQ ID NO: 2316182 - RNA, 20 nt, Human
uggcugggggccucagugcc

SEQ ID NO: 2316183 - RNA, 22 nt, Human
ugggagugaggaugucugggcc

SEQ ID NO: 2316184 - RNA, 14 nt, Human
uggcugcugcccag

SEQ ID NO: 2316185 - RNA, 15 nt, Human
uggcugcugccccca

SEQ ID NO: 2316186 - RNA, 16 nt, Human
uggcugcugcccccac

SEQ ID NO: 2316187 - RNA, 20 nt, Human
uggcugcugcccccaccccg

SEQ ID NO: 2316188 - RNA, 19 nt, Human
ugggaucacauguggacuu

SEQ ID NO: 2316189 - RNA, 13 nt, Human
ugggaguguguaa

SEQ ID NO: 2316190 - RNA, 11 nt, Human
ugggagugugu

SEQ ID NO: 2316191 - RNA, 14 nt, Human
ugggagugggccca

SEQ ID NO: 2316192 - RNA, 16 nt, Human
ugggagugggcccaau

SEQ ID NO: 2316193 - RNA, 15 nt, Human
uggggauauaauacu

SEQ ID NO: 2316194 - RNA, 17 nt, Human
uggggauaaaggagaag

SEQ ID NO: 2316195 - RNA, 13 nt, Human
uggggauaugcuu

SEQ ID NO: 2316196 - RNA, 21 nt, Human
uggggaucacagagacauucc

SEQ ID NO: 2316197 - RNA, 15 nt, Human
uggggaugagaaagg

SEQ ID NO: 2316198 - RNA, 23 nt, Human
uggggaugagaaagguugaagca

SEQ ID NO: 2316199 - RNA, 20 nt, Human
uggggccaggcugggucgcc

SEQ ID NO: 2316200 - RNA, 20 nt, Human
uggggaucccucccccccau

SEQ ID NO: 2316201 - RNA, 15 nt, Human
uggggaucacagaga

SEQ ID NO: 2316202 - RNA, 14 nt, Human
uggggaucucaggg

SEQ ID NO: 2316203 - RNA, 15 nt, Human
ugggggaagcccugg

SEQ ID NO: 2316204 - RNA, 14 nt, Human
uggggaugugggag

SEQ ID NO: 2316205 - RNA, 18 nt, Human
uggggaucucaggggcug

SEQ ID NO: 2316206 - RNA, 15 nt, Human
uggggccaggucacc

SEQ ID NO: 2316207 - RNA, 20 nt, Human
uggggccaguuggucccccu

SEQ ID NO: 2316208 - RNA, 21 nt, Human
uggggccaggcugggucgccc

SEQ ID NO: 2316209 - RNA, 22 nt, Human
uggggccaggcugggucgcccu

SEQ ID NO: 2316210 - RNA, 23 nt, Human
ugggcuuccauuugugugugugc

SEQ ID NO: 2316211 - RNA, 19 nt, Human
ugggcuuccauuugugugu

SEQ ID NO: 2316212 - RNA, 12 nt, Human
ugggcuucccag

SEQ ID NO: 2316213 - RNA, 19 nt, Human
ugggcuucccaguggcugc

SEQ ID NO: 2316214 - RNA, 21 nt, Human
ugggcuucccaguggcugcug

SEQ ID NO: 2316215 - RNA, 22 nt, Human
ugggcuucccaguggcugcugc

SEQ ID NO: 2316216 - RNA, 23 nt, Human
ugggcuucccaguggcugcugcc

SEQ ID NO: 2316217 - RNA, 12 nt, Human
ugggccuucagg

SEQ ID NO: 2316218 - RNA, 13 nt, Human
ugggcuucaucug

SEQ ID NO: 2316219 - RNA, 14 nt, Human
ugggcuuggccugc

SEQ ID NO: 2316220 - RNA, 13 nt, Human
ugggcuugauucu

SEQ ID NO: 2316221 - RNA, 14 nt, Human
ugggcuugauucug

SEQ ID NO: 2316222 - RNA, 20 nt, Human
uggggauagauguguggaca

SEQ ID NO: 2316223 - RNA, 18 nt, Human
uggggauagaugugugga

SEQ ID NO: 2316224 - RNA, 17 nt, Human
uggggauagaugugugg

SEQ ID NO: 2316225 - RNA, 16 nt, Human
uggggauagaugugug

SEQ ID NO: 2316226 - RNA, 19 nt, Human
ugggggagucugaagcaga

SEQ ID NO: 2316227 - RNA, 12 nt, Human
ugggggagugga

SEQ ID NO: 2316228 - RNA, 13 nt, Human
uggggggguggcc

SEQ ID NO: 2316229 - RNA, 14 nt, Human
uggggggguggccg

SEQ ID NO: 2316230 - RNA, 23 nt, Human
uggggggguggccgcugaguggc

SEQ ID NO: 2316231 - RNA, 15 nt, Human
uggggguagagcuga

SEQ ID NO: 2316232 - RNA, 15 nt, Human
ugggggaguggaaua

SEQ ID NO: 2316233 - RNA, 14 nt, Human
ugggggucugugug

SEQ ID NO: 2316234 - RNA, 17 nt, Human
uggggguagcagcugga

SEQ ID NO: 2316235 - RNA, 18 nt, Human
uggggguagcagcuggac

SEQ ID NO: 2316236 - RNA, 18 nt, Human
uggggguagagcugaucc

SEQ ID NO: 2316237 - RNA, 21 nt, Human
uggggguagagcugauccaga

SEQ ID NO: 2316238 - RNA, 15 nt, Human
uggggguagcagcug

SEQ ID NO: 2316239 - RNA, 16 nt, Human
uggggguagcagcugg

SEQ ID NO: 2316240 - RNA, 16 nt, Human
ugggggaagcccugga

SEQ ID NO: 2316241 - RNA, 15 nt, Human
ugggggacagggcug

SEQ ID NO: 2316242 - RNA, 22 nt, Human
ugggggacagggcuggcccagc

SEQ ID NO: 2316243 - RNA, 16 nt, Human
ugggggacagggcugg

SEQ ID NO: 2316244 - RNA, 18 nt, Human
ugggggacagggcuggcc

SEQ ID NO: 2316245 - RNA, 21 nt, Human
ugggggacuuacaugauucau

SEQ ID NO: 2316246 - RNA, 14 nt, Human
ugggggacuuacau

SEQ ID NO: 2316247 - RNA, 13 nt, Human
ugggggagagcag

SEQ ID NO: 2316248 - RNA, 14 nt, Human
ugggggagagcagg

SEQ ID NO: 2316249 - RNA, 17 nt, Human
ugggggagagcaggcug

SEQ ID NO: 2316250 - RNA, 19 nt, Human
ugggggagagcaggcuggc

SEQ ID NO: 2316251 - RNA, 21 nt, Human
ugggggaguagaucuuucuag

SEQ ID NO: 2316252 - RNA, 13 nt, Human
uggggggggugcu

SEQ ID NO: 2316253 - RNA, 16 nt, Human
ugggggaguggccaca

SEQ ID NO: 2316254 - RNA, 15 nt, Human
uggggguucuuucuu

SEQ ID NO: 2316255 - RNA, 19 nt, Human
uggggguucuuucuuccuc

SEQ ID NO: 2316256 - RNA, 16 nt, Human
ugggggugggccaggc

SEQ ID NO: 2316257 - RNA, 19 nt, Human
uggggguggaggcuuccug

SEQ ID NO: 2316258 - RNA, 13 nt, Human
ugggggugggcca

SEQ ID NO: 2316259 - RNA, 15 nt, Human
uggguacagagaggu

SEQ ID NO: 2316260 - RNA, 18 nt, Human
uggguaaucgauggggga

SEQ ID NO: 2316261 - RNA, 15 nt, Human
uggguaccuauuuuc

SEQ ID NO: 2316262 - RNA, 20 nt, Human
uggggguucuuucuuccucu

SEQ ID NO: 2316263 - RNA, 22 nt, Human
uggggguucuuucuuccucugc

SEQ ID NO: 2316264 - RNA, 15 nt, Human
uggguauauucauuu

SEQ ID NO: 2316265 - RNA, 17 nt, Human
uggguauaaaagauggg

SEQ ID NO: 2316266 - RNA, 19 nt, Human
uggguacuucuugaaggug

SEQ ID NO: 2316267 - RNA, 16 nt, Human
uggguacuucuugaag

SEQ ID NO: 2316268 - RNA, 14 nt, Human
uggguauaaaagau

SEQ ID NO: 2316269 - RNA, 15 nt, Human
uggguauaaaagaug

SEQ ID NO: 2316270 - RNA, 17 nt, Human
uggguacuuguggacac

SEQ ID NO: 2316271 - RNA, 18 nt, Human
uggguacuuguggacaca

SEQ ID NO: 2316272 - RNA, 15 nt, Human
uggugcagugugaaa

SEQ ID NO: 2316273 - RNA, 19 nt, Human
uggugcauuacagagagga

SEQ ID NO: 2316274 - RNA, 16 nt, Human
uggugcauuacagaga

SEQ ID NO: 2316275 - RNA, 13 nt, Human
uggugcauuacag

SEQ ID NO: 2316276 - RNA, 10 nt, Human
uggugcauua

SEQ ID NO: 2316277 - RNA, 15 nt, Human
uggugccaauuucaa

SEQ ID NO: 2316278 - RNA, 17 nt, Human
uggugccaauggaaccu

SEQ ID NO: 2316279 - RNA, 20 nt, Human
uggugccaauggaaccuccu

SEQ ID NO: 2316280 - RNA, 21 nt, Human
uggugcaaugaccuuucaaua

SEQ ID NO: 2316281 - RNA, 20 nt, Human
uggugauggagguuucauac

SEQ ID NO: 2316282 - RNA, 15 nt, Human
uggugcacagugauu

SEQ ID NO: 2316283 - RNA, 18 nt, Human
uggugaucaauuaaaugu

SEQ ID NO: 2316284 - RNA, 17 nt, Human
uggugaucaauuaaaug

SEQ ID NO: 2316285 - RNA, 20 nt, Human
uggugagucuuggcggcagc

SEQ ID NO: 2316286 - RNA, 22 nt, Human
uggugagucuuggcggcagcag

SEQ ID NO: 2316287 - RNA, 18 nt, Human
uggugagucuuggcggca

SEQ ID NO: 2316288 - RNA, 18 nt, Human
uggugaggcaggcuuugu

SEQ ID NO: 2316289 - RNA, 17 nt, Human
uggugaggccuugcucc

SEQ ID NO: 2316290 - RNA, 20 nt, Human
uggugagaugcagcuggaaa

SEQ ID NO: 2316291 - RNA, 16 nt, Human
uggugagaugcagcug

SEQ ID NO: 2316292 - RNA, 17 nt, Human
uggugagaugcagcugg

SEQ ID NO: 2316293 - RNA, 22 nt, Human
uggugaccccuuuucagcuucu

SEQ ID NO: 2316294 - RNA, 17 nt, Human
uggugacccagucagag

SEQ ID NO: 2316295 - RNA, 18 nt, Human
uggugacugcgaucuuca

SEQ ID NO: 2316296 - RNA, 19 nt, Human
uggugacuuuccucuuugg

SEQ ID NO: 2316297 - RNA, 22 nt, Human
uggugaccuuccaagagccuga

SEQ ID NO: 2316298 - RNA, 21 nt, Human
uggugaccuuccaagagccug

SEQ ID NO: 2316299 - RNA, 15 nt, Human
uggugaccucugccu

SEQ ID NO: 2316300 - RNA, 16 nt, Human
uggugaccucugccug

SEQ ID NO: 2316301 - RNA, 17 nt, Human
uggugaccucugccuga

SEQ ID NO: 2316302 - RNA, 22 nt, Human
uggugaccucugccugaaguca

SEQ ID NO: 2316303 - RNA, 15 nt, Human
uggucgcccaggaga

SEQ ID NO: 2316304 - RNA, 13 nt, Human
uggucgcuccugc

SEQ ID NO: 2316305 - RNA, 15 nt, Human
uggucgcuccugccc

SEQ ID NO: 2316306 - RNA, 14 nt, Human
uggucggaaaacau

SEQ ID NO: 2316307 - RNA, 17 nt, Human
uggucggaaaacaugcu

SEQ ID NO: 2316308 - RNA, 23 nt, Human
ugguccuuccaggcccccaccac

SEQ ID NO: 2316309 - RNA, 20 nt, Human
ugguccugugugcagugaag

SEQ ID NO: 2316310 - RNA, 14 nt, Human
ugguccuuuacacu

SEQ ID NO: 2316311 - RNA, 12 nt, Human
ugguccuuuggg

SEQ ID NO: 2316312 - RNA, 20 nt, Human
ugguccuuuacacucaggcu

SEQ ID NO: 2316313 - RNA, 21 nt, Human
ugguccuuuacacucaggcuu

SEQ ID NO: 2316314 - RNA, 14 nt, Human
uggucgcccaggag

SEQ ID NO: 2316315 - RNA, 13 nt, Human
uggucgcccagga

SEQ ID NO: 2316316 - RNA, 14 nt, Human
ugguccuggggcuc

SEQ ID NO: 2316317 - RNA, 11 nt, Human
ugguccugggg

SEQ ID NO: 2316318 - RNA, 22 nt, Human
ugguccugacucaacauguuac

SEQ ID NO: 2316319 - RNA, 14 nt, Human
ugguccugagaccu

SEQ ID NO: 2316320 - RNA, 20 nt, Human
ugguccugaggguccccacc

SEQ ID NO: 2316321 - RNA, 19 nt, Human
ugguccuggggcucugugc

SEQ ID NO: 2316322 - RNA, 16 nt, Human
ugguccuggggcucug

SEQ ID NO: 2316323 - RNA, 18 nt, Human
uggugacaccagccuuuc

SEQ ID NO: 2316324 - RNA, 16 nt, Human
uggugacaccagccuu

SEQ ID NO: 2316325 - RNA, 19 nt, Human
uggucuacacugugcugag

SEQ ID NO: 2316326 - RNA, 13 nt, Human
uggugaccucugc

SEQ ID NO: 2316327 - RNA, 14 nt, Human
uggugaccucugcc

SEQ ID NO: 2316328 - RNA, 15 nt, Human
uggucuacacugugc

SEQ ID NO: 2316329 - RNA, 16 nt, Human
uggucuacacugugcu

SEQ ID NO: 2316330 - RNA, 17 nt, Human
uggucuacacugugcug

SEQ ID NO: 2316331 - RNA, 18 nt, Human
uggucuacacugugcuga

SEQ ID NO: 2316332 - RNA, 22 nt, Human
uggucaaacaaacucucugaac

SEQ ID NO: 2316333 - RNA, 17 nt, Human
uggucaaaagcuggauu

SEQ ID NO: 2316334 - RNA, 14 nt, Human
uggucaaaccgcac

SEQ ID NO: 2316335 - RNA, 14 nt, Human
uggucaacacuuaa

SEQ ID NO: 2316336 - RNA, 21 nt, Human
uggucaaaccgcacucaccca

SEQ ID NO: 2316337 - RNA, 17 nt, Human
uggucaaaccgcacuca

SEQ ID NO: 2316338 - RNA, 20 nt, Human
uggucaaaccgcacucaccc

SEQ ID NO: 2316339 - RNA, 17 nt, Human
uggucacaggaaguaga

SEQ ID NO: 2316340 - RNA, 18 nt, Human
uggucacaggacucugcc

SEQ ID NO: 2316341 - RNA, 14 nt, Human
uggucaaccuccug

SEQ ID NO: 2316342 - RNA, 16 nt, Human
uggucaaccuccugga

SEQ ID NO: 2316343 - RNA, 22 nt, Human
uggucacaggaaguagaggagg

SEQ ID NO: 2316344 - RNA, 15 nt, Human
uggucaagauuuuga

SEQ ID NO: 2316345 - RNA, 18 nt, Human
uggucaaccuccuggaca

SEQ ID NO: 2316346 - RNA, 13 nt, Human
uggucccauccag

SEQ ID NO: 2316347 - RNA, 15 nt, Human
uggucccauccaggc

SEQ ID NO: 2316348 - RNA, 16 nt, Human
uggucccauccaggca

SEQ ID NO: 2316349 - RNA, 17 nt, Human
uggucccauccaggcag

SEQ ID NO: 2316350 - RNA, 18 nt, Human
uggucccauccaggcagu

SEQ ID NO: 2316351 - RNA, 14 nt, Human
uggucccccuucca

SEQ ID NO: 2316352 - RNA, 19 nt, Human
uggucacaggacucugccu

SEQ ID NO: 2316353 - RNA, 13 nt, Human
uggucccacucag

SEQ ID NO: 2316354 - RNA, 21 nt, Human
uggucaaacaaacucucugaa

SEQ ID NO: 2316355 - RNA, 16 nt, Human
uggucaaacaaacucu

SEQ ID NO: 2316356 - RNA, 21 nt, Human
ugguauguguguguaugcuac

SEQ ID NO: 2316357 - RNA, 23 nt, Human
ugguauuguauuuauucaauaaa

SEQ ID NO: 2316358 - RNA, 19 nt, Human
ugguauguguguguaugcu

SEQ ID NO: 2316359 - RNA, 17 nt, Human
ugguauguguguguaug

SEQ ID NO: 2316360 - RNA, 15 nt, Human
ugguaugugugugua

SEQ ID NO: 2316361 - RNA, 12 nt, Human
ugguaugugugu

SEQ ID NO: 2316362 - RNA, 21 nt, Human
ugguauguuuucaggcuagau

SEQ ID NO: 2316363 - RNA, 13 nt, Human
ugguauguuuuca

SEQ ID NO: 2316364 - RNA, 13 nt, Human
ugggucaaggaau

SEQ ID NO: 2316365 - RNA, 19 nt, Human
uggguauauucauuucaaa

SEQ ID NO: 2316366 - RNA, 21 nt, Human
uggguaccuauuuucauugua

SEQ ID NO: 2316367 - RNA, 21 nt, Human
ugguaugugacaugcgggcug

SEQ ID NO: 2316368 - RNA, 19 nt, Human
ugguauggaacucucucca

SEQ ID NO: 2316369 - RNA, 19 nt, Human
ugguccugacucaacaugu

SEQ ID NO: 2316370 - RNA, 12 nt, Human
ugguccugacuc

SEQ ID NO: 2316371 - RNA, 20 nt, Human
ugguccucuugccuccugga

SEQ ID NO: 2316372 - RNA, 15 nt, Human
ugguccucuugccuc

SEQ ID NO: 2316373 - RNA, 13 nt, Human
ugguccugcugca

SEQ ID NO: 2316374 - RNA, 15 nt, Human
ugguccugcugcagu

SEQ ID NO: 2316375 - RNA, 23 nt, Human
ugguccugcugcaguugccaguc

SEQ ID NO: 2316376 - RNA, 15 nt, Human
ugguccgguguccuu

SEQ ID NO: 2316377 - RNA, 12 nt, Human
ugguccuaccca

SEQ ID NO: 2316378 - RNA, 20 nt, Human
ugguccgugggacggugccc

SEQ ID NO: 2316379 - RNA, 14 nt, Human
ugguccucacacuc

SEQ ID NO: 2316380 - RNA, 17 nt, Human
ugguccuaaucuucuga

SEQ ID NO: 2316381 - RNA, 19 nt, Human
ugguccuaaucuucugaac

SEQ ID NO: 2316382 - RNA, 19 nt, Human
uggucccugggaggaaauu

SEQ ID NO: 2316383 - RNA, 12 nt, Human
uggucccugggg

SEQ ID NO: 2316384 - RNA, 16 nt, Human
ugguccggacacuccu

SEQ ID NO: 2316385 - RNA, 19 nt, Human
ugguccggacacuccuaga

SEQ ID NO: 2316386 - RNA, 14 nt, Human
uggucccugggagg

SEQ ID NO: 2316387 - RNA, 13 nt, Human
uggucccugggag

SEQ ID NO: 2316388 - RNA, 17 nt, Human
uggucccugcccucauc

SEQ ID NO: 2316389 - RNA, 15 nt, Human
uggucccccuuccau

SEQ ID NO: 2316390 - RNA, 16 nt, Human
uggucccccuuccaug

SEQ ID NO: 2316391 - RNA, 18 nt, Human
uggucccccuuccaugga

SEQ ID NO: 2316392 - RNA, 23 nt, Human
uggucccccuuccauggacuuug

SEQ ID NO: 2316393 - RNA, 14 nt, Human
uggacuccggcccu

SEQ ID NO: 2316394 - RNA, 22 nt, Human
uggacuccagccugccuggcag

SEQ ID NO: 2316395 - RNA, 23 nt, Human
uggacuccagccugccuggcagg

SEQ ID NO: 2316396 - RNA, 13 nt, Human
uggacuccucugu

SEQ ID NO: 2316397 - RNA, 19 nt, Human
uggacugaagccugcagga

SEQ ID NO: 2316398 - RNA, 17 nt, Human
uggacugaagccugcag

SEQ ID NO: 2316399 - RNA, 17 nt, Human
uggacuccggcccuccu

SEQ ID NO: 2316400 - RNA, 13 nt, Human
uggacugacauuu

SEQ ID NO: 2316401 - RNA, 18 nt, Human
uggacugaagccugcagg

SEQ ID NO: 2316402 - RNA, 11 nt, Human
uggacugaggc

SEQ ID NO: 2316403 - RNA, 14 nt, Human
uggacugaggccug

SEQ ID NO: 2316404 - RNA, 15 nt, Human
uggacugaggccuga

SEQ ID NO: 2316405 - RNA, 16 nt, Human
uggacugaggccugag

SEQ ID NO: 2316406 - RNA, 16 nt, Human
uggacucaggaugccc

SEQ ID NO: 2316407 - RNA, 19 nt, Human
uggaccacugggcaaugau

SEQ ID NO: 2316408 - RNA, 15 nt, Human
uggaccacugggcaa

SEQ ID NO: 2316409 - RNA, 12 nt, Human
uggaccacugca

SEQ ID NO: 2316410 - RNA, 20 nt, Human
uggaccacugcaugagcuuu

SEQ ID NO: 2316411 - RNA, 14 nt, Human
uggacuccagccug

SEQ ID NO: 2316412 - RNA, 20 nt, Human
uggacuccagccugccuggc

SEQ ID NO: 2316413 - RNA, 21 nt, Human
uggacuccagccugccuggca

SEQ ID NO: 2316414 - RNA, 18 nt, Human
uggacucaggaugcccag

SEQ ID NO: 2316415 - RNA, 18 nt, Human
uggacuccagacucucug

SEQ ID NO: 2316416 - RNA, 19 nt, Human
uggacuccagacucucugu

SEQ ID NO: 2316417 - RNA, 21 nt, Human
uggacuccagacucucuguga

SEQ ID NO: 2316418 - RNA, 20 nt, Human
uggacucagggcagcgccag

SEQ ID NO: 2316419 - RNA, 18 nt, Human
uggacucagggcagcgcc

SEQ ID NO: 2316420 - RNA, 15 nt, Human
uggacucagggcagc

SEQ ID NO: 2316421 - RNA, 14 nt, Human
uggacucagggcag

SEQ ID NO: 2316422 - RNA, 22 nt, Human
uggagaagucuuagacuugaaa

SEQ ID NO: 2316423 - RNA, 16 nt, Human
uggacuggaguggagc

SEQ ID NO: 2316424 - RNA, 21 nt, Human
uggagaagcucccugaaguaa

SEQ ID NO: 2316425 - RNA, 14 nt, Human
uggacuggaagggg

SEQ ID NO: 2316426 - RNA, 18 nt, Human
uggacuggaaaaucucuu

SEQ ID NO: 2316427 - RNA, 15 nt, Human
uggacugaugcuuuu

SEQ ID NO: 2316428 - RNA, 14 nt, Human
uggagaauuauaua

SEQ ID NO: 2316429 - RNA, 19 nt, Human
uggagacucuguggggccu

SEQ ID NO: 2316430 - RNA, 14 nt, Human
uggagacucugugg

SEQ ID NO: 2316431 - RNA, 19 nt, Human
uggagacuccugcccuguu

SEQ ID NO: 2316432 - RNA, 18 nt, Human
uggagacuaagcccuguc

SEQ ID NO: 2316433 - RNA, 18 nt, Human
uggagacuccuaggcagg

SEQ ID NO: 2316434 - RNA, 19 nt, Human
uggagacuccuaggcagga

SEQ ID NO: 2316435 - RNA, 22 nt, Human
uggagacuccuaggcaggacau

SEQ ID NO: 2316436 - RNA, 13 nt, Human
uggagacuccugc

SEQ ID NO: 2316437 - RNA, 14 nt, Human
uggagacuccugcc

SEQ ID NO: 2316438 - RNA, 18 nt, Human
uggagacuccugcccugu

SEQ ID NO: 2316439 - RNA, 14 nt, Human
uggacaggcuggcu

SEQ ID NO: 2316440 - RNA, 20 nt, Human
uggacacuuugaaauguguu

SEQ ID NO: 2316441 - RNA, 14 nt, Human
uggacaguccuggg

SEQ ID NO: 2316442 - RNA, 13 nt, Human
uggacaguccugg

SEQ ID NO: 2316443 - RNA, 12 nt, Human
uggacaguccug

SEQ ID NO: 2316444 - RNA, 23 nt, Human
uggacaguaucacugucuuuccu

SEQ ID NO: 2316445 - RNA, 23 nt, Human
uggacacuuaauacuaccuugaa

SEQ ID NO: 2316446 - RNA, 14 nt, Human
uggacacuguacaa

SEQ ID NO: 2316447 - RNA, 21 nt, Human
uggacacuccagugccagcaa

SEQ ID NO: 2316448 - RNA, 14 nt, Human
uggacacuuugaaa

SEQ ID NO: 2316449 - RNA, 16 nt, Human
uggacacucagaccug

SEQ ID NO: 2316450 - RNA, 17 nt, Human
uggacacuccagugcca

SEQ ID NO: 2316451 - RNA, 19 nt, Human
uggacacuccagugccagc

SEQ ID NO: 2316452 - RNA, 21 nt, Human
uggaccaacccuguuuccuga

SEQ ID NO: 2316453 - RNA, 20 nt, Human
uggaccaauagggcugagcu

SEQ ID NO: 2316454 - RNA, 21 nt, Human
uggaccaauagggcugagcuc

SEQ ID NO: 2316455 - RNA, 17 nt, Human
uggacaguccugggaga

SEQ ID NO: 2316456 - RNA, 16 nt, Human
uggacaguccugggag

SEQ ID NO: 2316457 - RNA, 15 nt, Human
uggacaguccuggga

SEQ ID NO: 2316458 - RNA, 21 nt, Human
uggacaguaucacugucuuuc

SEQ ID NO: 2316459 - RNA, 14 nt, Human
uggacauagagagg

SEQ ID NO: 2316460 - RNA, 19 nt, Human
uggacauagagagggagaa

SEQ ID NO: 2316461 - RNA, 14 nt, Human
uggacauccuccuc

SEQ ID NO: 2316462 - RNA, 23 nt, Human
uggacauagagagggagaagaag

SEQ ID NO: 2316463 - RNA, 14 nt, Human
ugcuguugccucau

SEQ ID NO: 2316464 - RNA, 21 nt, Human
ugcuguugauuucuuuccaga

SEQ ID NO: 2316465 - RNA, 19 nt, Human
ugcuguugauugcuaaaug

SEQ ID NO: 2316466 - RNA, 20 nt, Human
ugcuguugauugcuaaaugu

SEQ ID NO: 2316467 - RNA, 22 nt, Human
ugcuguugauugcuaaauguaa

SEQ ID NO: 2316468 - RNA, 19 nt, Human
ugcuguugauuucuuucca

SEQ ID NO: 2316469 - RNA, 17 nt, Human
ugcuguugauguuuugu

SEQ ID NO: 2316470 - RNA, 12 nt, Human
ugcuguugauug

SEQ ID NO: 2316471 - RNA, 15 nt, Human
ugcuguugauugcua

SEQ ID NO: 2316472 - RNA, 16 nt, Human
ugcuguugauugcuaa

SEQ ID NO: 2316473 - RNA, 17 nt, Human
ugcuguugauugcuaaa

SEQ ID NO: 2316474 - RNA, 18 nt, Human
ugcuguugauugcuaaau

SEQ ID NO: 2316475 - RNA, 12 nt, Human
ugcuguuguccc

SEQ ID NO: 2316476 - RNA, 13 nt, Human
ugcuguuguuucu

SEQ ID NO: 2316477 - RNA, 12 nt, Human
ugcuguuuccuu

SEQ ID NO: 2316478 - RNA, 11 nt, Human
ugcuguuuccu

SEQ ID NO: 2316479 - RNA, 14 nt, Human
ugcuguuuccuuuu

SEQ ID NO: 2316480 - RNA, 13 nt, Human
ugcuguuugacaa

SEQ ID NO: 2316481 - RNA, 15 nt, Human
uggacacucagaccu

SEQ ID NO: 2316482 - RNA, 20 nt, Human
uggaggagcucaggacacua

SEQ ID NO: 2316483 - RNA, 22 nt, Human
uggaggagcucaggacacuaau

SEQ ID NO: 2316484 - RNA, 22 nt, Human
uggaggaaugcucccccauccu

SEQ ID NO: 2316485 - RNA, 19 nt, Human
uggaggagcucaggacacu

SEQ ID NO: 2316486 - RNA, 17 nt, Human
uggaggaaugcuccccc

SEQ ID NO: 2316487 - RNA, 16 nt, Human
uggaggaaugcucccc

SEQ ID NO: 2316488 - RNA, 15 nt, Human
uggaggaaugcuccc

SEQ ID NO: 2316489 - RNA, 13 nt, Human
uggaggaaggauu

SEQ ID NO: 2316490 - RNA, 18 nt, Human
uggaggaaggauuguaaa

SEQ ID NO: 2316491 - RNA, 19 nt, Human
uggaggaaggauuguaaaa

SEQ ID NO: 2316492 - RNA, 20 nt, Human
uggaggaaggauuguaaaaa

SEQ ID NO: 2316493 - RNA, 16 nt, Human
uggaggaggaggcaau

SEQ ID NO: 2316494 - RNA, 15 nt, Human
uggaggaggaggcaa

SEQ ID NO: 2316495 - RNA, 15 nt, Human
uggaggaggccuggg

SEQ ID NO: 2316496 - RNA, 18 nt, Human
uggaggaggccugggggc

SEQ ID NO: 2316497 - RNA, 14 nt, Human
uggaggaggaggca

SEQ ID NO: 2316498 - RNA, 13 nt, Human
uggaggaggaggc

SEQ ID NO: 2316499 - RNA, 12 nt, Human
uggaggaggagg

SEQ ID NO: 2316500 - RNA, 16 nt, Human
uggaggaggagcaggg

SEQ ID NO: 2316501 - RNA, 22 nt, Human
uggaggagcuugggggaugacu

SEQ ID NO: 2316502 - RNA, 13 nt, Human
uggaggaggaagg

SEQ ID NO: 2316503 - RNA, 14 nt, Human
uggaggaggaaggc

SEQ ID NO: 2316504 - RNA, 15 nt, Human
uggaggaggaaggca

SEQ ID NO: 2316505 - RNA, 16 nt, Human
uggaggaggaaggcaa

SEQ ID NO: 2316506 - RNA, 17 nt, Human
uggaggaggaaggcaag

SEQ ID NO: 2316507 - RNA, 21 nt, Human
uggaggaggaaggcaagaggg

SEQ ID NO: 2316508 - RNA, 14 nt, Human
uggagacugucuca

SEQ ID NO: 2316509 - RNA, 12 nt, Human
uggagacugcuu

SEQ ID NO: 2316510 - RNA, 14 nt, Human
uggagacugcuucc

SEQ ID NO: 2316511 - RNA, 17 nt, Human
uggagacugcuucccau

SEQ ID NO: 2316512 - RNA, 19 nt, Human
uggagacugcuucccaucc

SEQ ID NO: 2316513 - RNA, 20 nt, Human
uggagacugcuucccauccu

SEQ ID NO: 2316514 - RNA, 20 nt, Human
uggagacuggggggcuugaa

SEQ ID NO: 2316515 - RNA, 19 nt, Human
uggagacugguccugugug

SEQ ID NO: 2316516 - RNA, 20 nt, Human
uggagacugguccugugugc

SEQ ID NO: 2316517 - RNA, 21 nt, Human
uggaggaaggaaacccagcuc

SEQ ID NO: 2316518 - RNA, 23 nt, Human
uggaggaaggaaacccagcucug

SEQ ID NO: 2316519 - RNA, 17 nt, Human
uggaggcacacagcugc

SEQ ID NO: 2316520 - RNA, 15 nt, Human
uggaggauggagaga

SEQ ID NO: 2316521 - RNA, 20 nt, Human
uggaggauggagagagggga

SEQ ID NO: 2316522 - RNA, 23 nt, Human
uggaggaggccugggggcaggga

SEQ ID NO: 2316523 - RNA, 21 nt, Human
uggaguuucauguacaagaug

SEQ ID NO: 2316524 - RNA, 17 nt, Human
uggaguuuuaacuguaa

SEQ ID NO: 2316525 - RNA, 21 nt, Human
uggaguuuuuguuuggagagc

SEQ ID NO: 2316526 - RNA, 22 nt, Human
uggaguuuuuguuuggagagca

SEQ ID NO: 2316527 - RNA, 23 nt, Human
uggaguuuuuguuuggagagcac

SEQ ID NO: 2316528 - RNA, 16 nt, Human
uggauaaagccacuga

SEQ ID NO: 2316529 - RNA, 15 nt, Human
uggaucuccccacuc

SEQ ID NO: 2316530 - RNA, 19 nt, Human
uggaucuccccacucuagg

SEQ ID NO: 2316531 - RNA, 21 nt, Human
uggaucuccaaggaccagguu

SEQ ID NO: 2316532 - RNA, 15 nt, Human
uggauaaagccacug

SEQ ID NO: 2316533 - RNA, 21 nt, Human
uggauaacuuagguggcaagc

SEQ ID NO: 2316534 - RNA, 23 nt, Human
uggaucugggacccuuuccuucc

SEQ ID NO: 2316535 - RNA, 19 nt, Human
uggaucugggacccuuucc

SEQ ID NO: 2316536 - RNA, 20 nt, Human
uggaucugggacccuuuccu

SEQ ID NO: 2316537 - RNA, 21 nt, Human
uggaucugggacccuuuccuu

SEQ ID NO: 2316538 - RNA, 16 nt, Human
uggaucuguccaagga

SEQ ID NO: 2316539 - RNA, 18 nt, Human
uggaucuguccaaggaaa

SEQ ID NO: 2316540 - RNA, 20 nt, Human
uggaucuguccaaggaaacu

SEQ ID NO: 2316541 - RNA, 15 nt, Human
uggaucugugagggg

SEQ ID NO: 2316542 - RNA, 22 nt, Human
uggcagaauggggugcaugaag

SEQ ID NO: 2316543 - RNA, 18 nt, Human
uggcagaaugcuagcucu

SEQ ID NO: 2316544 - RNA, 20 nt, Human
uggcagaauaaucuuugggu

SEQ ID NO: 2316545 - RNA, 19 nt, Human
uggcagaauaaucuuuggg

SEQ ID NO: 2316546 - RNA, 18 nt, Human
uggcaauaguguguucug

SEQ ID NO: 2316547 - RNA, 17 nt, Human
uggcaauaguguguucu

SEQ ID NO: 2316548 - RNA, 16 nt, Human
uggcacgucaucuagu

SEQ ID NO: 2316549 - RNA, 18 nt, Human
uggcacgucaucuaguuu

SEQ ID NO: 2316550 - RNA, 22 nt, Human
uggcacuaacguugagccccug

SEQ ID NO: 2316551 - RNA, 23 nt, Human
uggcagaagacaccagagcagau

SEQ ID NO: 2316552 - RNA, 16 nt, Human
uggcacuauaauguaa

SEQ ID NO: 2316553 - RNA, 15 nt, Human
uggcacuauaaugua

SEQ ID NO: 2316554 - RNA, 17 nt, Human
uggcaaggguucaccug

SEQ ID NO: 2316555 - RNA, 23 nt, Human
uggcaaggcugugcucccugguu

SEQ ID NO: 2316556 - RNA, 20 nt, Human
uggcaauagucaaauugugu

SEQ ID NO: 2316557 - RNA, 16 nt, Human
uggcaauaguguguuc

SEQ ID NO: 2316558 - RNA, 15 nt, Human
uggcaauaguguguu

SEQ ID NO: 2316559 - RNA, 18 nt, Human
uggcaauagugggcccuc

SEQ ID NO: 2316560 - RNA, 20 nt, Human
uggcaauagugggcccuccg

SEQ ID NO: 2316561 - RNA, 15 nt, Human
uggcacuaguauuuc

SEQ ID NO: 2316562 - RNA, 17 nt, Human
uggauuuuugucuugug

SEQ ID NO: 2316563 - RNA, 19 nt, Human
uggaucugugaggggcucu

SEQ ID NO: 2316564 - RNA, 12 nt, Human
uggcaaaaaggc

SEQ ID NO: 2316565 - RNA, 16 nt, Human
uggcaaaaaggcagga

SEQ ID NO: 2316566 - RNA, 19 nt, Human
uggauuuuugacucuggca

SEQ ID NO: 2316567 - RNA, 20 nt, Human
uggauuuuugacucuggcaa

SEQ ID NO: 2316568 - RNA, 20 nt, Human
uggcaaaacucuacuuaauc

SEQ ID NO: 2316569 - RNA, 17 nt, Human
uggcaaagacagaagcc

SEQ ID NO: 2316570 - RNA, 13 nt, Human
uggcaaagacaga

SEQ ID NO: 2316571 - RNA, 17 nt, Human
uggcaaacuucagacug

SEQ ID NO: 2316572 - RNA, 21 nt, Human
uggcaaagccuucauugccuu

SEQ ID NO: 2316573 - RNA, 16 nt, Human
uggcaaagcuuuuaga

SEQ ID NO: 2316574 - RNA, 18 nt, Human
uggcaaagcuuuuagaaa

SEQ ID NO: 2316575 - RNA, 17 nt, Human
uggcaaagcuuuuagaa

SEQ ID NO: 2316576 - RNA, 20 nt, Human
uggcaaggcugugcucccug

SEQ ID NO: 2316577 - RNA, 19 nt, Human
uggcaaacucuccaccaca

SEQ ID NO: 2316578 - RNA, 17 nt, Human
uggcaaacgcuaaagag

SEQ ID NO: 2316579 - RNA, 24 nt, Human
uggcaaacgcuaaagagcccuugc

SEQ ID NO: 2316580 - RNA, 21 nt, Human
uggcaaaaggaucuuuguggc

SEQ ID NO: 2316581 - RNA, 20 nt, Human
uggcaaaaggaucuuugugg

SEQ ID NO: 2316582 - RNA, 17 nt, Human
uggcaaaaauggcuaga

SEQ ID NO: 2316583 - RNA, 18 nt, Human
uggccucccacagacuca

SEQ ID NO: 2316584 - RNA, 22 nt, Human
uggccucauuacuuuaccaccc

SEQ ID NO: 2316585 - RNA, 11 nt, Human
uggccucccac

SEQ ID NO: 2316586 - RNA, 13 nt, Human
uggccucccaccc

SEQ ID NO: 2316587 - RNA, 14 nt, Human
uggccucccacccg

SEQ ID NO: 2316588 - RNA, 15 nt, Human
uggccucccacccga

SEQ ID NO: 2316589 - RNA, 21 nt, Human
uggccucccacccgaugcugc

SEQ ID NO: 2316590 - RNA, 22 nt, Human
uggccucccacccgaugcugcu

SEQ ID NO: 2316591 - RNA, 14 nt, Human
uggccuccccugcc

SEQ ID NO: 2316592 - RNA, 15 nt, Human
uggccuccccugcca

SEQ ID NO: 2316593 - RNA, 17 nt, Human
uggccuccccugccacc

SEQ ID NO: 2316594 - RNA, 23 nt, Human
uggccucccaacucaccccagcc

SEQ ID NO: 2316595 - RNA, 18 nt, Human
uggccucauguggcugga

SEQ ID NO: 2316596 - RNA, 19 nt, Human
uggccucauguggcuggaa

SEQ ID NO: 2316597 - RNA, 20 nt, Human
uggccucauguggcuggaag

SEQ ID NO: 2316598 - RNA, 21 nt, Human
uggccucauguggcuggaaga

SEQ ID NO: 2316599 - RNA, 18 nt, Human
uggccucagcugccucac

SEQ ID NO: 2316600 - RNA, 17 nt, Human
uggccucagcugccuca

SEQ ID NO: 2316601 - RNA, 16 nt, Human
uggccucagcugccuc

SEQ ID NO: 2316602 - RNA, 14 nt, Human
uggccucagcugcc

SEQ ID NO: 2316603 - RNA, 19 nt, Human
uggccucagcugccucacu

SEQ ID NO: 2316604 - RNA, 13 nt, Human
uggccucaugugg

SEQ ID NO: 2316605 - RNA, 15 nt, Human
uggccucauguggcu

SEQ ID NO: 2316606 - RNA, 17 nt, Human
uggccucauguggcugg

SEQ ID NO: 2316607 - RNA, 20 nt, Human
uggccucaacccucccucag

SEQ ID NO: 2316608 - RNA, 16 nt, Human
uggccucaacccuccc

SEQ ID NO: 2316609 - RNA, 15 nt, Human
uggccucaacccucc

SEQ ID NO: 2316610 - RNA, 14 nt, Human
uggccucaacccuc

SEQ ID NO: 2316611 - RNA, 21 nt, Human
uggccuauuauauuaaaauau

SEQ ID NO: 2316612 - RNA, 13 nt, Human
uggccucagcugc

SEQ ID NO: 2316613 - RNA, 18 nt, Human
uggccucaacccucccuc

SEQ ID NO: 2316614 - RNA, 17 nt, Human
uggccucaacccucccu

SEQ ID NO: 2316615 - RNA, 19 nt, Human
uggccucaacccucccuca

SEQ ID NO: 2316616 - RNA, 14 nt, Human
uggcgcaagccugu

SEQ ID NO: 2316617 - RNA, 16 nt, Human
uggccuccccugcuga

SEQ ID NO: 2316618 - RNA, 15 nt, Human
uggccuccccugcug

SEQ ID NO: 2316619 - RNA, 19 nt, Human
uggccuccccugccaccag

SEQ ID NO: 2316620 - RNA, 20 nt, Human
uggccuccccugccaccagg

SEQ ID NO: 2316621 - RNA, 21 nt, Human
uggccuccccugccaccaggc

SEQ ID NO: 2316622 - RNA, 23 nt, Human
uggccuccccugccaccaggcca

SEQ ID NO: 2316623 - RNA, 22 nt, Human
uggcgcagcauauucaggaagc

SEQ ID NO: 2316624 - RNA, 23 nt, Human
uggcgcagcauauucaggaagcu

SEQ ID NO: 2316625 - RNA, 16 nt, Human
uggcgcugccccuggc

SEQ ID NO: 2316626 - RNA, 13 nt, Human
uggcgcacccucc

SEQ ID NO: 2316627 - RNA, 14 nt, Human
uggcgcacccuccc

SEQ ID NO: 2316628 - RNA, 15 nt, Human
uggcgcacccucccc

SEQ ID NO: 2316629 - RNA, 16 nt, Human
uggcgcacccuccccu

SEQ ID NO: 2316630 - RNA, 18 nt, Human
uggcgcacccuccccucc

SEQ ID NO: 2316631 - RNA, 12 nt, Human
uggcgcagccaa

SEQ ID NO: 2316632 - RNA, 13 nt, Human
uggcgcagccaag

SEQ ID NO: 2316633 - RNA, 23 nt, Human
uggcgcugccccuggcagccccu

SEQ ID NO: 2316634 - RNA, 16 nt, Human
uggcgcagccaaggcc

SEQ ID NO: 2316635 - RNA, 14 nt, Human
uggcggcagcagcc

SEQ ID NO: 2316636 - RNA, 23 nt, Human
uggcggcagcagccaucauagga

SEQ ID NO: 2316637 - RNA, 23 nt, Human
uggcggcuacucagcagcccucc

SEQ ID NO: 2316638 - RNA, 22 nt, Human
uggcggcuacucagcagcccuc

SEQ ID NO: 2316639 - RNA, 21 nt, Human
uggcggcuacucagcagcccu

SEQ ID NO: 2316640 - RNA, 17 nt, Human
uggcggcuacucagcag

SEQ ID NO: 2316641 - RNA, 16 nt, Human
uggcggcuacucagca

SEQ ID NO: 2316642 - RNA, 15 nt, Human
uggcggcuacucagc

SEQ ID NO: 2316643 - RNA, 15 nt, Human
uggcggcagcagcca

SEQ ID NO: 2316644 - RNA, 17 nt, Human
uggcgggccaaggacug

SEQ ID NO: 2316645 - RNA, 13 nt, Human
uggcgggccaagg

SEQ ID NO: 2316646 - RNA, 14 nt, Human
uggcgggcgccugu

SEQ ID NO: 2316647 - RNA, 17 nt, Human
uggcgggcgccuguagu

SEQ ID NO: 2316648 - RNA, 16 nt, Human
uggcgggaugggccac

SEQ ID NO: 2316649 - RNA, 19 nt, Human
uggcgggaugggccaccgc

SEQ ID NO: 2316650 - RNA, 13 nt, Human
uggcggugccugg

SEQ ID NO: 2316651 - RNA, 15 nt, Human
uggcgggugggggug

SEQ ID NO: 2316652 - RNA, 12 nt, Human
uggcgggugggg

SEQ ID NO: 2316653 - RNA, 15 nt, Human
uggcgggguggggug

SEQ ID NO: 2316654 - RNA, 20 nt, Human
uggcguagaaguuuuuguac

SEQ ID NO: 2316655 - RNA, 14 nt, Human
uggcucccacaggc

SEQ ID NO: 2316656 - RNA, 16 nt, Human
uggcucccacaggagu

SEQ ID NO: 2316657 - RNA, 17 nt, Human
uggcucccacaggcagc

SEQ ID NO: 2316658 - RNA, 18 nt, Human
uggcucccacaggcagcu

SEQ ID NO: 2316659 - RNA, 19 nt, Human
uggcucccacaggcagcuu

SEQ ID NO: 2316660 - RNA, 17 nt, Human
uggcucccacaggcccu

SEQ ID NO: 2316661 - RNA, 20 nt, Human
uggcucccacaggcccuucc

SEQ ID NO: 2316662 - RNA, 20 nt, Human
uggcuccugaggggcaucug

SEQ ID NO: 2316663 - RNA, 14 nt, Human
uggcugcugacuga

SEQ ID NO: 2316664 - RNA, 13 nt, Human
uggcuccucucag

SEQ ID NO: 2316665 - RNA, 11 nt, Human
uggcugcugcc

SEQ ID NO: 2316666 - RNA, 12 nt, Human
uggcugcugccc

SEQ ID NO: 2316667 - RNA, 11 nt, Human
uggcugcuuca

SEQ ID NO: 2316668 - RNA, 15 nt, Human
uggcugcuucaagga

SEQ ID NO: 2316669 - RNA, 20 nt, Human
uggcucccaugaccauacug

SEQ ID NO: 2316670 - RNA, 22 nt, Human
uggcuccucaaacaguagguug

SEQ ID NO: 2316671 - RNA, 12 nt, Human
uggcuccucuca

SEQ ID NO: 2316672 - RNA, 14 nt, Human
uggcuccugagggg

SEQ ID NO: 2316673 - RNA, 14 nt, Human
uggcuccucucagu

SEQ ID NO: 2316674 - RNA, 18 nt, Human
uggcuccucccggugccc

SEQ ID NO: 2316675 - RNA, 19 nt, Human
uggcuccucccggugccca

SEQ ID NO: 2316676 - RNA, 14 nt, Human
uggcucccaugacc

SEQ ID NO: 2316677 - RNA, 14 nt, Human
uggcuccucccggu

SEQ ID NO: 2316678 - RNA, 16 nt, Human
uggcuccucccggugc

SEQ ID NO: 2316679 - RNA, 21 nt, Human
uggccccgccgccugguacuc

SEQ ID NO: 2316680 - RNA, 15 nt, Human
uggccccguuucugg

SEQ ID NO: 2316681 - RNA, 19 nt, Human
uggccccuagaaucagccu

SEQ ID NO: 2316682 - RNA, 19 nt, Human
uggcccccgagcugggggc

SEQ ID NO: 2316683 - RNA, 16 nt, Human
uggccccguuucuggu

SEQ ID NO: 2316684 - RNA, 14 nt, Human
uggccccugcccgg

SEQ ID NO: 2316685 - RNA, 15 nt, Human
uggccccugcccggc

SEQ ID NO: 2316686 - RNA, 16 nt, Human
uggccccugcccggcu

SEQ ID NO: 2316687 - RNA, 13 nt, Human
uggccucaacccu

SEQ ID NO: 2316688 - RNA, 20 nt, Human
uggccuauuauauuaaaaua

SEQ ID NO: 2316689 - RNA, 20 nt, Human
uggccuaugcacauauggac

SEQ ID NO: 2316690 - RNA, 17 nt, Human
uggccuauuauauuaaa

SEQ ID NO: 2316691 - RNA, 13 nt, Human
uggccuaugcaca

SEQ ID NO: 2316692 - RNA, 14 nt, Human
uggccuaugcacau

SEQ ID NO: 2316693 - RNA, 15 nt, Human
uggccuaugcacaua

SEQ ID NO: 2316694 - RNA, 17 nt, Human
uggccuaugcacauaug

SEQ ID NO: 2316695 - RNA, 21 nt, Human
uggccuaggagauaucugagg

SEQ ID NO: 2316696 - RNA, 21 nt, Human
uggccccucaaaucguccagc

SEQ ID NO: 2316697 - RNA, 22 nt, Human
uggccuaggagauaucugaggg

SEQ ID NO: 2316698 - RNA, 20 nt, Human
uggccccugcccggcugcgg

SEQ ID NO: 2316699 - RNA, 13 nt, Human
uggccccgccgcc

SEQ ID NO: 2316700 - RNA, 14 nt, Human
uggcccccuguccu

SEQ ID NO: 2316701 - RNA, 15 nt, Human
uggccccgccgccug

SEQ ID NO: 2316702 - RNA, 20 nt, Human
uggccccgccgccugguacu

SEQ ID NO: 2316703 - RNA, 15 nt, Human
uggcccccgagcugg

SEQ ID NO: 2316704 - RNA, 14 nt, Human
uggcccccgagcug

SEQ ID NO: 2316705 - RNA, 17 nt, Human
uggcccccgagcugggg

SEQ ID NO: 2316706 - RNA, 16 nt, Human
uggcccccgagcuggg

SEQ ID NO: 2316707 - RNA, 13 nt, Human
uggcccccugucc

SEQ ID NO: 2316708 - RNA, 13 nt, Human
uggcccaguguca

SEQ ID NO: 2316709 - RNA, 12 nt, Human
uggcccaguguc

SEQ ID NO: 2316710 - RNA, 12 nt, Human
uggcccaucagu

SEQ ID NO: 2316711 - RNA, 16 nt, Human
uggcccauccccccuc

SEQ ID NO: 2316712 - RNA, 17 nt, Human
uggcccauccccccuca

SEQ ID NO: 2316713 - RNA, 22 nt, Human
uggcccaucaguguacccccgc

SEQ ID NO: 2316714 - RNA, 23 nt, Human
uggcccaucaguguacccccgcc

SEQ ID NO: 2316715 - RNA, 12 nt, Human
uggcccaucccc

SEQ ID NO: 2316716 - RNA, 15 nt, Human
uggcccauccccccu

SEQ ID NO: 2316717 - RNA, 13 nt, Human
uggccaggcuggu

SEQ ID NO: 2316718 - RNA, 20 nt, Human
uggccaggcugcucuugaac

SEQ ID NO: 2316719 - RNA, 17 nt, Human
uggcccagggcccagag

SEQ ID NO: 2316720 - RNA, 23 nt, Human
uggcccagggcccagagcccagc

SEQ ID NO: 2316721 - RNA, 22 nt, Human
uggcccagggcccagagcccag

SEQ ID NO: 2316722 - RNA, 21 nt, Human
uggcccagggcccagagccca

SEQ ID NO: 2316723 - RNA, 20 nt, Human
uggcccagggcccagagccc

SEQ ID NO: 2316724 - RNA, 18 nt, Human
uggcccagggcccagagc

SEQ ID NO: 2316725 - RNA, 19 nt, Human
uggccagaugcaccagccc

SEQ ID NO: 2316726 - RNA, 18 nt, Human
uggccagccccacagccc

SEQ ID NO: 2316727 - RNA, 19 nt, Human
uggccagccccacagccca

SEQ ID NO: 2316728 - RNA, 20 nt, Human
uggccagccccacagcccac

SEQ ID NO: 2316729 - RNA, 23 nt, Human
uggccagccccacagcccacguc

SEQ ID NO: 2316730 - RNA, 11 nt, Human
uggccagcccg

SEQ ID NO: 2316731 - RNA, 12 nt, Human
uggccagcccgg

SEQ ID NO: 2316732 - RNA, 13 nt, Human
uggccagcccggc

SEQ ID NO: 2316733 - RNA, 14 nt, Human
uggccagcccggcu

SEQ ID NO: 2316734 - RNA, 15 nt, Human
uggccagcccggcug

SEQ ID NO: 2316735 - RNA, 20 nt, Human
uggccagcccggcugguuuu

SEQ ID NO: 2316736 - RNA, 19 nt, Human
uggccagcccggcugguuu

SEQ ID NO: 2316737 - RNA, 14 nt, Human
uggccagccuggau

SEQ ID NO: 2316738 - RNA, 13 nt, Human
uggccagccuaca

SEQ ID NO: 2316739 - RNA, 16 nt, Human
uggccagcccggcugg

SEQ ID NO: 2316740 - RNA, 17 nt, Human
uggccagcccggcuggu

SEQ ID NO: 2316741 - RNA, 16 nt, Human
uggccagccuggaucu

SEQ ID NO: 2316742 - RNA, 19 nt, Human
uggccaggccucuuggcag

SEQ ID NO: 2316743 - RNA, 17 nt, Human
uggccaggcugcucuug

SEQ ID NO: 2316744 - RNA, 16 nt, Human
uggccaggcugcucuu

SEQ ID NO: 2316745 - RNA, 17 nt, Human
uggccagaugcaccagc

SEQ ID NO: 2316746 - RNA, 18 nt, Human
uggccagaugcaccagcc

SEQ ID NO: 2316747 - RNA, 17 nt, Human
uggcagaguugaagaca

SEQ ID NO: 2316748 - RNA, 19 nt, Human
uggcagaguugaagacaga

SEQ ID NO: 2316749 - RNA, 21 nt, Human
uggcagaguggauucuugaac

SEQ ID NO: 2316750 - RNA, 13 nt, Human
uggcagagcuucu

SEQ ID NO: 2316751 - RNA, 22 nt, Human
uggcagagcuuggacuggaugc

SEQ ID NO: 2316752 - RNA, 12 nt, Human
uggcagacagac

SEQ ID NO: 2316753 - RNA, 12 nt, Human
uggcagaggagg

SEQ ID NO: 2316754 - RNA, 15 nt, Human
uggcagaguugaaga

SEQ ID NO: 2316755 - RNA, 14 nt, Human
ugcagggagccgag

SEQ ID NO: 2316756 - RNA, 13 nt, Human
ugcagggaguccg

SEQ ID NO: 2316757 - RNA, 23 nt, Human
ugcaggcuggcaccgccuucucu

SEQ ID NO: 2316758 - RNA, 22 nt, Human
ugcaggcuggcaccgccuucuc

SEQ ID NO: 2316759 - RNA, 21 nt, Human
ugcaggcuggcaccgccuucu

SEQ ID NO: 2316760 - RNA, 18 nt, Human
ugcaggcuggcaccgccu

SEQ ID NO: 2316761 - RNA, 22 nt, Human
ugcagggaaaauuauuugcaua

SEQ ID NO: 2316762 - RNA, 21 nt, Human
ugcagggaaaauuauuugcau

SEQ ID NO: 2316763 - RNA, 20 nt, Human
ugcagggaaaauuauuugca

SEQ ID NO: 2316764 - RNA, 15 nt, Human
ugcagggaaaauuau

SEQ ID NO: 2316765 - RNA, 13 nt, Human
ugauuuaauagug

SEQ ID NO: 2316766 - RNA, 22 nt, Human
ugauuuaauaaaauaauucuaa

SEQ ID NO: 2316767 - RNA, 23 nt, Human
ugauuuaauaaaauaauucuaaa

SEQ ID NO: 2316768 - RNA, 17 nt, Human
ugauuuaauaguguuaa

SEQ ID NO: 2316769 - RNA, 18 nt, Human
ugauuuaauaguguuaau

SEQ ID NO: 2316770 - RNA, 20 nt, Human
ugauuuaauaguguuaauca

SEQ ID NO: 2316771 - RNA, 21 nt, Human
ugauuuaauaguguuaaucaa

SEQ ID NO: 2316772 - RNA, 18 nt, Human
ugauuuaagacacuuuuu

SEQ ID NO: 2316773 - RNA, 13 nt, Human
ugauuuaauaaaa

SEQ ID NO: 2316774 - RNA, 14 nt, Human
ugauuuaauaaaau

SEQ ID NO: 2316775 - RNA, 15 nt, Human
ugauuuaauaaaaua

SEQ ID NO: 2316776 - RNA, 17 nt, Human
ugauuuaauaaaauaau

SEQ ID NO: 2316777 - RNA, 19 nt, Human
ugauuuaauaaaauaauuc

SEQ ID NO: 2316778 - RNA, 20 nt, Human
ugauuuaauaaaauaauucu

SEQ ID NO: 2316779 - RNA, 21 nt, Human
ugauuuaauaaaauaauucua

SEQ ID NO: 2316780 - RNA, 21 nt, Human
ugcaggccugcucagggacug

SEQ ID NO: 2316781 - RNA, 16 nt, Human
ugcaggccugcucagg

SEQ ID NO: 2316782 - RNA, 13 nt, Human
ugauuuaauguuu

SEQ ID NO: 2316783 - RNA, 16 nt, Human
ugauuuaauguuuuca

SEQ ID NO: 2316784 - RNA, 22 nt, Human
ugauuuaauaguguuaaucaau

SEQ ID NO: 2316785 - RNA, 21 nt, Human
ugcaguuacacuaaaagguga

SEQ ID NO: 2316786 - RNA, 14 nt, Human
ugcagugugaaaag

SEQ ID NO: 2316787 - RNA, 13 nt, Human
ugcagggccagga

SEQ ID NO: 2316788 - RNA, 15 nt, Human
ugcagggccaggacu

SEQ ID NO: 2316789 - RNA, 23 nt, Human
ugcagggccaggacugagccccg

SEQ ID NO: 2316790 - RNA, 19 nt, Human
ugcaguucagcaccacccu

SEQ ID NO: 2316791 - RNA, 18 nt, Human
ugcaguucagcaccaccc

SEQ ID NO: 2316792 - RNA, 15 nt, Human
ugcaguucagcacca

SEQ ID NO: 2316793 - RNA, 21 nt, Human
ugcaguucccccaaccucaga

SEQ ID NO: 2316794 - RNA, 17 nt, Human
ugcaguucuaguuugca

SEQ ID NO: 2316795 - RNA, 20 nt, Human
ugcaguucccccaaccucag

SEQ ID NO: 2316796 - RNA, 24 nt, Human
ugcagggaggagguggcagcccug

SEQ ID NO: 2316797 - RNA, 23 nt, Human
ugcagggagcauggcugugagga

SEQ ID NO: 2316798 - RNA, 14 nt, Human
ugcagggcagucau

SEQ ID NO: 2316799 - RNA, 13 nt, Human
ugcagggcaguca

SEQ ID NO: 2316800 - RNA, 19 nt, Human
ugcagggauugcugccacu

SEQ ID NO: 2316801 - RNA, 20 nt, Human
ugcaguggugcgaucugggu

SEQ ID NO: 2316802 - RNA, 21 nt, Human
ugcagggcagucauuggcugu

SEQ ID NO: 2316803 - RNA, 21 nt, Human
ugcagggccagaccugccugc

SEQ ID NO: 2316804 - RNA, 12 nt, Human
ugcagggccagg

SEQ ID NO: 2316805 - RNA, 21 nt, Human
ugcaguggugcgaucuggguu

SEQ ID NO: 2316806 - RNA, 19 nt, Human
ugcaguuugagacaggaga

SEQ ID NO: 2316807 - RNA, 10 nt, Human
ugcaguuuau

SEQ ID NO: 2316808 - RNA, 12 nt, Human
ugcaguuuauca

SEQ ID NO: 2316809 - RNA, 16 nt, Human
ugcaguuuaucauuca

SEQ ID NO: 2316810 - RNA, 17 nt, Human
ugcaguuuaucauucaa

SEQ ID NO: 2316811 - RNA, 12 nt, Human
ugcaguuuccaa

SEQ ID NO: 2316812 - RNA, 19 nt, Human
ugcaguuuaucauucaagu

SEQ ID NO: 2316813 - RNA, 20 nt, Human
ugcauaggugaucucauuua

SEQ ID NO: 2316814 - RNA, 20 nt, Human
ugcauaguaccaaucauuuu

SEQ ID NO: 2316815 - RNA, 21 nt, Human
ugcauaguaccaaucauuuua

SEQ ID NO: 2316816 - RNA, 16 nt, Human
ugcaguugccagucac

SEQ ID NO: 2316817 - RNA, 20 nt, Human
ugcaguucuaguuugcauuc

SEQ ID NO: 2316818 - RNA, 18 nt, Human
ugcaguucuaguuugcau

SEQ ID NO: 2316819 - RNA, 19 nt, Human
ugcaguucuaguuugcauu

SEQ ID NO: 2316820 - RNA, 12 nt, Human
ugcaguucugaa

SEQ ID NO: 2316821 - RNA, 14 nt, Human
ugcaguucugaaga

SEQ ID NO: 2316822 - RNA, 21 nt, Human
ugcauaguauuccauugugug

SEQ ID NO: 2316823 - RNA, 18 nt, Human
ugcauauaacuuauauug

SEQ ID NO: 2316824 - RNA, 19 nt, Human
ugcauauguugaauacuuu

SEQ ID NO: 2316825 - RNA, 13 nt, Human
ugcauauguuucg

SEQ ID NO: 2316826 - RNA, 18 nt, Human
ugcauauuauuuuauguu

SEQ ID NO: 2316827 - RNA, 19 nt, Human
ugcauaguucccauguuaa

SEQ ID NO: 2316828 - RNA, 22 nt, Human
ugcauaguaccaaucauuuuaa

SEQ ID NO: 2316829 - RNA, 16 nt, Human
ugcauauaacuuauau

SEQ ID NO: 2316830 - RNA, 15 nt, Human
ugcauauaacuuaua

SEQ ID NO: 2316831 - RNA, 14 nt, Human
ugcauauaacuuau

SEQ ID NO: 2316832 - RNA, 20 nt, Human
ugcauauuguauuacuagaa

SEQ ID NO: 2316833 - RNA, 17 nt, Human
ugcauauuguacacuuu

SEQ ID NO: 2316834 - RNA, 19 nt, Human
ugcauauuguacacuuuuu

SEQ ID NO: 2316835 - RNA, 15 nt, Human
ugcauauuguauuac

SEQ ID NO: 2316836 - RNA, 16 nt, Human
ugcauauuguauuacu

SEQ ID NO: 2316837 - RNA, 22 nt, Human
ugcaucaauuuuucuuauuuca

SEQ ID NO: 2316838 - RNA, 23 nt, Human
ugcauauucuuauguaugugaaa

SEQ ID NO: 2316839 - RNA, 13 nt, Human
ugcauauuccuuu

SEQ ID NO: 2316840 - RNA, 16 nt, Human
ugcauauuccuuucua

SEQ ID NO: 2316841 - RNA, 22 nt, Human
ugcauauuccuuucuaucauuu

SEQ ID NO: 2316842 - RNA, 13 nt, Human
ugcauauuguaca

SEQ ID NO: 2316843 - RNA, 14 nt, Human
ugcauauuguacac

SEQ ID NO: 2316844 - RNA, 15 nt, Human
ugcauauuguacacu

SEQ ID NO: 2316845 - RNA, 16 nt, Human
ugcauauuguacacuu

SEQ ID NO: 2316846 - RNA, 15 nt, Human
ugcauuugucuauuc

SEQ ID NO: 2316847 - RNA, 19 nt, Human
ugccaaaaucauuuuaaug

SEQ ID NO: 2316848 - RNA, 18 nt, Human
ugccaaaaugcucuagug

SEQ ID NO: 2316849 - RNA, 17 nt, Human
ugccaaacaaaaagguu

SEQ ID NO: 2316850 - RNA, 17 nt, Human
ugccaaaaugcucuagu

SEQ ID NO: 2316851 - RNA, 23 nt, Human
ugccaaacaaaaagguucucagg

SEQ ID NO: 2316852 - RNA, 16 nt, Human
ugcauuuggucaagau

SEQ ID NO: 2316853 - RNA, 23 nt, Human
ugcauuuggugguuucagaaaug

SEQ ID NO: 2316854 - RNA, 22 nt, Human
ugccaaagcuaggguggcccuu

SEQ ID NO: 2316855 - RNA, 21 nt, Human
ugccaaagcuaggguggcccu

SEQ ID NO: 2316856 - RNA, 20 nt, Human
ugccaaagcuaggguggccc

SEQ ID NO: 2316857 - RNA, 14 nt, Human
ugccaaagaucacu

SEQ ID NO: 2316858 - RNA, 21 nt, Human
ugccaaagaucacuuguuguu

SEQ ID NO: 2316859 - RNA, 15 nt, Human
ugccaaaggauguga

SEQ ID NO: 2316860 - RNA, 16 nt, Human
ugccaaaggaugugau

SEQ ID NO: 2316861 - RNA, 17 nt, Human
ugccaaaggaugugaua

SEQ ID NO: 2316862 - RNA, 19 nt, Human
ugccaaaggaugugauaua

SEQ ID NO: 2316863 - RNA, 18 nt, Human
ugccaaagggaaauauca

SEQ ID NO: 2316864 - RNA, 14 nt, Human
ugccaaagggaaau

SEQ ID NO: 2316865 - RNA, 16 nt, Human
ugcauuugucuauucu

SEQ ID NO: 2316866 - RNA, 16 nt, Human
ugccaaauaauaaaaa

SEQ ID NO: 2316867 - RNA, 17 nt, Human
ugccaaauauguccugg

SEQ ID NO: 2316868 - RNA, 18 nt, Human
ugccaaauauguccuggg

SEQ ID NO: 2316869 - RNA, 13 nt, Human
ugcaucagcugcu

SEQ ID NO: 2316870 - RNA, 23 nt, Human
ugcauggugcaguugacagcagg

SEQ ID NO: 2316871 - RNA, 16 nt, Human
ugcaugggugaaggga

SEQ ID NO: 2316872 - RNA, 19 nt, Human
ugcaugggcuaaugaagau

SEQ ID NO: 2316873 - RNA, 23 nt, Human
ugcauggggugggguagggcuga

SEQ ID NO: 2316874 - RNA, 19 nt, Human
ugcaucagcugcugaaaca

SEQ ID NO: 2316875 - RNA, 20 nt, Human
ugcauggcuccagaaauguc

SEQ ID NO: 2316876 - RNA, 22 nt, Human
ugcauggcuccagaaaugucua

SEQ ID NO: 2316877 - RNA, 12 nt, Human
ugcaugggagca

SEQ ID NO: 2316878 - RNA, 17 nt, Human
ugcaugggugaagggag

SEQ ID NO: 2316879 - RNA, 16 nt, Human
ugcaugguggcaccag

SEQ ID NO: 2316880 - RNA, 21 nt, Human
ugcauuuggugguuucagaaa

SEQ ID NO: 2316881 - RNA, 20 nt, Human
ugcauggugccccaggacca

SEQ ID NO: 2316882 - RNA, 19 nt, Human
ugcauggugccccaggacc

SEQ ID NO: 2316883 - RNA, 18 nt, Human
ugcauggugccccaggac

SEQ ID NO: 2316884 - RNA, 17 nt, Human
ugcauggugccccagga

SEQ ID NO: 2316885 - RNA, 22 nt, Human
ugcauggugccccaggaccagc

SEQ ID NO: 2316886 - RNA, 21 nt, Human
ugcauggugccccaggaccag

SEQ ID NO: 2316887 - RNA, 22 nt, Human
ugccacguuggagaagcccgug

SEQ ID NO: 2316888 - RNA, 13 nt, Human
ugccaggacacgc

SEQ ID NO: 2316889 - RNA, 20 nt, Human
ugccaggaccagucaaccug

SEQ ID NO: 2316890 - RNA, 12 nt, Human
ugccaggacucc

SEQ ID NO: 2316891 - RNA, 16 nt, Human
ugccaggacuccccag

SEQ ID NO: 2316892 - RNA, 23 nt, Human
ugccaggacuccccaggccaggc

SEQ ID NO: 2316893 - RNA, 21 nt, Human
ugccaggacuccccaggccag

SEQ ID NO: 2316894 - RNA, 22 nt, Human
ugccaggacuccccaggccagg

SEQ ID NO: 2316895 - RNA, 14 nt, Human
ugccaggcauggug

SEQ ID NO: 2316896 - RNA, 16 nt, Human
ugccacuaaauugaca

SEQ ID NO: 2316897 - RNA, 20 nt, Human
ugccaggaagccagcaggcu

SEQ ID NO: 2316898 - RNA, 22 nt, Human
ugccaggaagccagcaggcucu

SEQ ID NO: 2316899 - RNA, 23 nt, Human
ugccaaauuuuggccaaaguguu

SEQ ID NO: 2316900 - RNA, 15 nt, Human
ugccaacaauccuag

SEQ ID NO: 2316901 - RNA, 18 nt, Human
ugccaaauuguaguucuu

SEQ ID NO: 2316902 - RNA, 20 nt, Human
ugccaacaauccuagugcuu

SEQ ID NO: 2316903 - RNA, 20 nt, Human
ugccaacacucaagaagcag

SEQ ID NO: 2316904 - RNA, 21 nt, Human
ugccaacaauccuagugcuuu

SEQ ID NO: 2316905 - RNA, 21 nt, Human
ugccaacacucaagaagcagg

SEQ ID NO: 2316906 - RNA, 22 nt, Human
ugccaacacucaagaagcaggc

SEQ ID NO: 2316907 - RNA, 23 nt, Human
ugccaacacucaagaagcaggcu

SEQ ID NO: 2316908 - RNA, 21 nt, Human
ugccaacaguguuaggccugg

SEQ ID NO: 2316909 - RNA, 20 nt, Human
ugccacccuggggagaaagu

SEQ ID NO: 2316910 - RNA, 13 nt, Human
ugccaccuccccu

SEQ ID NO: 2316911 - RNA, 19 nt, Human
ugccaaccauaccuuccuu

SEQ ID NO: 2316912 - RNA, 22 nt, Human
ugccaaccauaccuuccuuccc

SEQ ID NO: 2316913 - RNA, 12 nt, Human
ugccaacauugc

SEQ ID NO: 2316914 - RNA, 13 nt, Human
ugccaacauugcc

SEQ ID NO: 2316915 - RNA, 14 nt, Human
ugccaacauugccu

SEQ ID NO: 2316916 - RNA, 22 nt, Human
ugccaacauugccuauuucagu

SEQ ID NO: 2316917 - RNA, 19 nt, Human
ugccaccuggggcagucac

SEQ ID NO: 2316918 - RNA, 17 nt, Human
ugccaccuggggcaguc

SEQ ID NO: 2316919 - RNA, 16 nt, Human
ugccaccuggggcagu

SEQ ID NO: 2316920 - RNA, 10 nt, Human
ugccaccugc

SEQ ID NO: 2316921 - RNA, 14 nt, Human
ugccaccucccuga

SEQ ID NO: 2316922 - RNA, 22 nt, Human
ugccaccuccccuauccaccca

SEQ ID NO: 2316923 - RNA, 21 nt, Human
ugccaccuccccuauccaccc

SEQ ID NO: 2316924 - RNA, 18 nt, Human
ugccaccuccccuaucca

SEQ ID NO: 2316925 - RNA, 17 nt, Human
ugccaccuccccuaucc

SEQ ID NO: 2316926 - RNA, 13 nt, Human
ugcccugggccac

SEQ ID NO: 2316927 - RNA, 23 nt, Human
ugcccugguuuccugcccuggga

SEQ ID NO: 2316928 - RNA, 20 nt, Human
ugcccugguuuccugcccug

SEQ ID NO: 2316929 - RNA, 19 nt, Human
ugcccugguuuccugcccu

SEQ ID NO: 2316930 - RNA, 18 nt, Human
ugcccugguccagggaag

SEQ ID NO: 2316931 - RNA, 17 nt, Human
ugcccugguagggcagu

SEQ ID NO: 2316932 - RNA, 12 nt, Human
ugcccuggugcu

SEQ ID NO: 2316933 - RNA, 14 nt, Human
ugcccuggugcugc

SEQ ID NO: 2316934 - RNA, 16 nt, Human
ugcccuggugcugcca

SEQ ID NO: 2316935 - RNA, 21 nt, Human
ugcccugguccagggaagcug

SEQ ID NO: 2316936 - RNA, 17 nt, Human
ugcccuggugcugccac

SEQ ID NO: 2316937 - RNA, 18 nt, Human
ugcccugguuuccugccc

SEQ ID NO: 2316938 - RNA, 17 nt, Human
ugcccugguuuccugcc

SEQ ID NO: 2316939 - RNA, 16 nt, Human
ugcccugggaugucca

SEQ ID NO: 2316940 - RNA, 18 nt, Human
ugcccuggcugcugcccc

SEQ ID NO: 2316941 - RNA, 20 nt, Human
ugcccuggcugcugccccca

SEQ ID NO: 2316942 - RNA, 18 nt, Human
ugcccugggaggcaguga

SEQ ID NO: 2316943 - RNA, 17 nt, Human
ugcccugggaggcagug

SEQ ID NO: 2316944 - RNA, 15 nt, Human
ugcccugggaggcag

SEQ ID NO: 2316945 - RNA, 13 nt, Human
ugcccugggaggc

SEQ ID NO: 2316946 - RNA, 14 nt, Human
ugcccuggcugcug

SEQ ID NO: 2316947 - RNA, 15 nt, Human
ugcccuggcugcugc

SEQ ID NO: 2316948 - RNA, 16 nt, Human
ugcccuggcugcugcc

SEQ ID NO: 2316949 - RNA, 17 nt, Human
ugcccuggcugcugccc

SEQ ID NO: 2316950 - RNA, 11 nt, Human
ugcccuggcug

SEQ ID NO: 2316951 - RNA, 22 nt, Human
ugcccuggcccugagguguggg

SEQ ID NO: 2316952 - RNA, 12 nt, Human
ugcccuggcugc

SEQ ID NO: 2316953 - RNA, 21 nt, Human
ugcccgggaaggucaccagca

SEQ ID NO: 2316954 - RNA, 18 nt, Human
ugcccuggcccugaggug

SEQ ID NO: 2316955 - RNA, 15 nt, Human
ugcccugcccaccug

SEQ ID NO: 2316956 - RNA, 14 nt, Human
ugcccugcccaccu

SEQ ID NO: 2316957 - RNA, 20 nt, Human
ugcccggcuaauuuuuguaa

SEQ ID NO: 2316958 - RNA, 21 nt, Human
ugcccggcgcccucuguccug

SEQ ID NO: 2316959 - RNA, 22 nt, Human
ugcccggcgcccucuguccuga

SEQ ID NO: 2316960 - RNA, 16 nt, Human
ugcccugcccaccugg

SEQ ID NO: 2316961 - RNA, 20 nt, Human
ugcccugcccaccuggccuc

SEQ ID NO: 2316962 - RNA, 23 nt, Human
ugccucaaugugaaucagacccu

SEQ ID NO: 2316963 - RNA, 22 nt, Human
ugccucaaugugaaucagaccc

SEQ ID NO: 2316964 - RNA, 16 nt, Human
ugccucaaugccagua

SEQ ID NO: 2316965 - RNA, 13 nt, Human
ugccucaaugcca

SEQ ID NO: 2316966 - RNA, 15 nt, Human
ugccucaaugccagu

SEQ ID NO: 2316967 - RNA, 24 nt, Human
ugccucaaugugaaucagacccua

SEQ ID NO: 2316968 - RNA, 18 nt, Human
ugccucaaugugaccagg

SEQ ID NO: 2316969 - RNA, 19 nt, Human
ugccucaaugugaccaggg

SEQ ID NO: 2316970 - RNA, 23 nt, Human
ugccucaaugugaccagggguga

SEQ ID NO: 2316971 - RNA, 14 nt, Human
ugccucacagcugg

SEQ ID NO: 2316972 - RNA, 12 nt, Human
ugccuccuccuu

SEQ ID NO: 2316973 - RNA, 13 nt, Human
ugccuccugugua

SEQ ID NO: 2316974 - RNA, 20 nt, Human
ugccucggccucccaaagug

SEQ ID NO: 2316975 - RNA, 13 nt, Human
ugccucggcuccu

SEQ ID NO: 2316976 - RNA, 14 nt, Human
ugccucggcuccug

SEQ ID NO: 2316977 - RNA, 15 nt, Human
ugccucggcuccugc

SEQ ID NO: 2316978 - RNA, 16 nt, Human
ugccucggcuccugcu

SEQ ID NO: 2316979 - RNA, 17 nt, Human
ugccucggcuccugcug

SEQ ID NO: 2316980 - RNA, 18 nt, Human
ugccucggcuccugcugc

SEQ ID NO: 2316981 - RNA, 19 nt, Human
ugccucggcuccugcugca

SEQ ID NO: 2316982 - RNA, 14 nt, Human
ugccuccucuucaa

SEQ ID NO: 2316983 - RNA, 16 nt, Human
ugccuccucuucaacu

SEQ ID NO: 2316984 - RNA, 14 nt, Human
ugccuccugccugc

SEQ ID NO: 2316985 - RNA, 18 nt, Human
ugccuccugccugccccu

SEQ ID NO: 2316986 - RNA, 20 nt, Human
ugccuccuccuucccaaagg

SEQ ID NO: 2316987 - RNA, 13 nt, Human
ugccuauucccac

SEQ ID NO: 2316988 - RNA, 22 nt, Human
ugccuauucccacaccuccaca

SEQ ID NO: 2316989 - RNA, 14 nt, Human
ugccucaagagaag

SEQ ID NO: 2316990 - RNA, 15 nt, Human
ugccucaagagaagg

SEQ ID NO: 2316991 - RNA, 19 nt, Human
ugccucaagccccagagug

SEQ ID NO: 2316992 - RNA, 14 nt, Human
ugccuaacaccagc

SEQ ID NO: 2316993 - RNA, 15 nt, Human
ugccuaacaccagcg

SEQ ID NO: 2316994 - RNA, 14 nt, Human
ugccaggcccgggg

SEQ ID NO: 2316995 - RNA, 11 nt, Human
ugccaggcccg

SEQ ID NO: 2316996 - RNA, 20 nt, Human
ugccaggcuagagugcagug

SEQ ID NO: 2316997 - RNA, 14 nt, Human
ugccaggccagccu

SEQ ID NO: 2316998 - RNA, 15 nt, Human
ugccaggccagccuc

SEQ ID NO: 2316999 - RNA, 16 nt, Human
ugccaggccagccucc

SEQ ID NO: 2317000 - RNA, 17 nt, Human
ugccaggccagccuccg

SEQ ID NO: 2317001 - RNA, 18 nt, Human
ugccaggccagccuccga

SEQ ID NO: 2317002 - RNA, 22 nt, Human
ugcccagaccccucuggccagg

SEQ ID NO: 2317003 - RNA, 19 nt, Human
ugcccagaccccucuggcc

SEQ ID NO: 2317004 - RNA, 18 nt, Human
ugcccagaccccucuggc

SEQ ID NO: 2317005 - RNA, 15 nt, Human
ugcccagaccacacg

SEQ ID NO: 2317006 - RNA, 19 nt, Human
ugcccagaaugaggcugcu

SEQ ID NO: 2317007 - RNA, 18 nt, Human
ugcccagagggcccaggc

SEQ ID NO: 2317008 - RNA, 15 nt, Human
ugcccagagauggga

SEQ ID NO: 2317009 - RNA, 22 nt, Human
ugcccagagaugccuccaccgc

SEQ ID NO: 2317010 - RNA, 21 nt, Human
ugcccagagaugccuccaccg

SEQ ID NO: 2317011 - RNA, 20 nt, Human
ugcccagagaugccuccacc

SEQ ID NO: 2317012 - RNA, 19 nt, Human
ugcccagagaugccuccac

SEQ ID NO: 2317013 - RNA, 18 nt, Human
ugcccagagaugccucca

SEQ ID NO: 2317014 - RNA, 17 nt, Human
ugcccagagaugccucc

SEQ ID NO: 2317015 - RNA, 16 nt, Human
ugcccagagaugccuc

SEQ ID NO: 2317016 - RNA, 12 nt, Human
ugcccagagaug

SEQ ID NO: 2317017 - RNA, 11 nt, Human
ugcccagagau

SEQ ID NO: 2317018 - RNA, 18 nt, Human
ugcccaggcuggcgugca

SEQ ID NO: 2317019 - RNA, 19 nt, Human
ugcccaggcuggcgugcag

SEQ ID NO: 2317020 - RNA, 19 nt, Human
ugcccagagggcccaggca

SEQ ID NO: 2317021 - RNA, 21 nt, Human
ugcccaugucgcgcucagcau

SEQ ID NO: 2317022 - RNA, 23 nt, Human
ugcccaugggcacugcugggugg

SEQ ID NO: 2317023 - RNA, 20 nt, Human
ugcccaggcuggcgugcagu

SEQ ID NO: 2317024 - RNA, 20 nt, Human
ugccccaaacaaauaugcaa

SEQ ID NO: 2317025 - RNA, 15 nt, Human
ugccccaacccccag

SEQ ID NO: 2317026 - RNA, 16 nt, Human
ugccccaacccccagc

SEQ ID NO: 2317027 - RNA, 15 nt, Human
ugcccauuccucacc

SEQ ID NO: 2317028 - RNA, 14 nt, Human
ugccccaaacaaau

SEQ ID NO: 2317029 - RNA, 17 nt, Human
ugcccauuccucaccuu

SEQ ID NO: 2317030 - RNA, 23 nt, Human
ugccccagagcuguuuauggccu

SEQ ID NO: 2317031 - RNA, 17 nt, Human
ugccccagagcuguuua

SEQ ID NO: 2317032 - RNA, 15 nt, Human
ugccccagagcuguu

SEQ ID NO: 2317033 - RNA, 14 nt, Human
ugccccagagcugu

SEQ ID NO: 2317034 - RNA, 13 nt, Human
ugccccagagcug

SEQ ID NO: 2317035 - RNA, 21 nt, Human
ugccccaccuuuauuaaaauc

SEQ ID NO: 2317036 - RNA, 20 nt, Human
ugccccaccccuccccauua

SEQ ID NO: 2317037 - RNA, 15 nt, Human
ugccccaacuccugg

SEQ ID NO: 2317038 - RNA, 13 nt, Human
ugccccaacuccu

SEQ ID NO: 2317039 - RNA, 16 nt, Human
ugccccaacuccugga

SEQ ID NO: 2317040 - RNA, 20 nt, Human
ugccccaacccccagcaccc

SEQ ID NO: 2317041 - RNA, 17 nt, Human
ugccccaacccccagca

SEQ ID NO: 2317042 - RNA, 16 nt, Human
ugccccaaccugcuga

SEQ ID NO: 2317043 - RNA, 19 nt, Human
ugccccaccuuuauuaaaa

SEQ ID NO: 2317044 - RNA, 17 nt, Human
ugcccggauucugggag

SEQ ID NO: 2317045 - RNA, 16 nt, Human
ugcccggauucuggga

SEQ ID NO: 2317046 - RNA, 15 nt, Human
ugcccggauucuggg

SEQ ID NO: 2317047 - RNA, 23 nt, Human
ugcccggagauuggacggccuga

SEQ ID NO: 2317048 - RNA, 22 nt, Human
ugcccggauucugggaggaagc

SEQ ID NO: 2317049 - RNA, 18 nt, Human
ugcccggauucugggagg

SEQ ID NO: 2317050 - RNA, 15 nt, Human
ugcccggcgcccucu

SEQ ID NO: 2317051 - RNA, 17 nt, Human
ugcccgcucccaguguc

SEQ ID NO: 2317052 - RNA, 16 nt, Human
ugcccggcgcccucug

SEQ ID NO: 2317053 - RNA, 18 nt, Human
ugcccggcgcccucuguc

SEQ ID NO: 2317054 - RNA, 12 nt, Human
ugcccggcugcg

SEQ ID NO: 2317055 - RNA, 14 nt, Human
ugcccggcugcgga

SEQ ID NO: 2317056 - RNA, 17 nt, Human
ugccccugcugccuccc

SEQ ID NO: 2317057 - RNA, 16 nt, Human
ugccccugcugccucc

SEQ ID NO: 2317058 - RNA, 14 nt, Human
ugccccugcugccu

SEQ ID NO: 2317059 - RNA, 13 nt, Human
ugccccugcugcc

SEQ ID NO: 2317060 - RNA, 23 nt, Human
ugccccugcugccuccccaaccc

SEQ ID NO: 2317061 - RNA, 13 nt, Human
ugcccgagcuggu

SEQ ID NO: 2317062 - RNA, 14 nt, Human
ugcccgagcuggug

SEQ ID NO: 2317063 - RNA, 21 nt, Human
ugcccggagauuggacggccu

SEQ ID NO: 2317064 - RNA, 14 nt, Human
ugcccgcucccagu

SEQ ID NO: 2317065 - RNA, 15 nt, Human
ugcccgcucccagug

SEQ ID NO: 2317066 - RNA, 13 nt, Human
ugcccgcucccag

SEQ ID NO: 2317067 - RNA, 19 nt, Human
ugcccgagcuggugcauua

SEQ ID NO: 2317068 - RNA, 16 nt, Human
ugcccgagcuggugca

SEQ ID NO: 2317069 - RNA, 20 nt, Human
ugcccgagcuggugcauuac

SEQ ID NO: 2317070 - RNA, 23 nt, Human
ugccccugagcaaugucugugcu

SEQ ID NO: 2317071 - RNA, 16 nt, Human
ugccccuggcagcccc

SEQ ID NO: 2317072 - RNA, 20 nt, Human
ugccccuccucucugcccua

SEQ ID NO: 2317073 - RNA, 19 nt, Human
ugccccuccucucugcccu

SEQ ID NO: 2317074 - RNA, 17 nt, Human
ugccccagcccaagucc

SEQ ID NO: 2317075 - RNA, 20 nt, Human
ugccccucuccaggcgccgg

SEQ ID NO: 2317076 - RNA, 19 nt, Human
ugccccagcucuggcuucc

SEQ ID NO: 2317077 - RNA, 18 nt, Human
ugccccagcucuggcuuc

SEQ ID NO: 2317078 - RNA, 16 nt, Human
ugccccagcucuggcu

SEQ ID NO: 2317079 - RNA, 14 nt, Human
ugccccagcucugg

SEQ ID NO: 2317080 - RNA, 13 nt, Human
ugccccagcucug

SEQ ID NO: 2317081 - RNA, 13 nt, Human
ugccccagcccaa

SEQ ID NO: 2317082 - RNA, 16 nt, Human
ugccccagcccaaguc

SEQ ID NO: 2317083 - RNA, 13 nt, Human
ugccccagaggcc

SEQ ID NO: 2317084 - RNA, 16 nt, Human
ugccccagaggccucu

SEQ ID NO: 2317085 - RNA, 12 nt, Human
ugccccagccag

SEQ ID NO: 2317086 - RNA, 13 nt, Human
ugccccagccaga

SEQ ID NO: 2317087 - RNA, 15 nt, Human
ugccccucccuucaa

SEQ ID NO: 2317088 - RNA, 16 nt, Human
ugccccucccuucaac

SEQ ID NO: 2317089 - RNA, 18 nt, Human
ugccccuccucucugccc

SEQ ID NO: 2317090 - RNA, 17 nt, Human
ugccccuccucucugcc

SEQ ID NO: 2317091 - RNA, 17 nt, Human
ugcuaggcgagugccag

SEQ ID NO: 2317092 - RNA, 18 nt, Human
ugcuaggcgagugccagg

SEQ ID NO: 2317093 - RNA, 22 nt, Human
ugcuaggaacacuccuucacag

SEQ ID NO: 2317094 - RNA, 21 nt, Human
ugcuaggaacacuccuucaca

SEQ ID NO: 2317095 - RNA, 20 nt, Human
ugcuaggaacacuccuucac

SEQ ID NO: 2317096 - RNA, 17 nt, Human
ugcuagaacucccuuuc

SEQ ID NO: 2317097 - RNA, 15 nt, Human
ugcuagaacucccuu

SEQ ID NO: 2317098 - RNA, 14 nt, Human
ugcuagaacucccu

SEQ ID NO: 2317099 - RNA, 13 nt, Human
ugcuagaacuccc

SEQ ID NO: 2317100 - RNA, 19 nt, Human
ugcucagggaaaagcagcu

SEQ ID NO: 2317101 - RNA, 14 nt, Human
ugcucagaccagcu

SEQ ID NO: 2317102 - RNA, 20 nt, Human
ugcucaggagcccugggagg

SEQ ID NO: 2317103 - RNA, 18 nt, Human
ugcucaggagcccuggga

SEQ ID NO: 2317104 - RNA, 19 nt, Human
ugcucaggagcccugggag

SEQ ID NO: 2317105 - RNA, 22 nt, Human
ugcucaccuggggugugggagg

SEQ ID NO: 2317106 - RNA, 14 nt, Human
ugcucaccuggggu

SEQ ID NO: 2317107 - RNA, 13 nt, Human
ugcucaccugggg

SEQ ID NO: 2317108 - RNA, 12 nt, Human
ugcucaccuggg

SEQ ID NO: 2317109 - RNA, 19 nt, Human
ugcuaggcgagugccagga

SEQ ID NO: 2317110 - RNA, 17 nt, Human
ugcucacauaucuguca

SEQ ID NO: 2317111 - RNA, 23 nt, Human
ugcucaccuggggugugggaggc

SEQ ID NO: 2317112 - RNA, 13 nt, Human
ugcucacuaccuc

SEQ ID NO: 2317113 - RNA, 17 nt, Human
ugcucacuaccuccuca

SEQ ID NO: 2317114 - RNA, 18 nt, Human
ugcucacuaccuccucag

SEQ ID NO: 2317115 - RNA, 20 nt, Human
ugcucacuaccuccucaggg

SEQ ID NO: 2317116 - RNA, 21 nt, Human
ugcucacuaccuccucaggga

SEQ ID NO: 2317117 - RNA, 15 nt, Human
ugcucaggagcccug

SEQ ID NO: 2317118 - RNA, 13 nt, Human
ugcucagacagaa

SEQ ID NO: 2317119 - RNA, 13 nt, Human
ugcucuagugccu

SEQ ID NO: 2317120 - RNA, 15 nt, Human
ugcucggccgucuuc

SEQ ID NO: 2317121 - RNA, 19 nt, Human
ugcucgcuguugcugaaua

SEQ ID NO: 2317122 - RNA, 14 nt, Human
ugcucgggcccagg

SEQ ID NO: 2317123 - RNA, 15 nt, Human
ugcucgggcccaggc

SEQ ID NO: 2317124 - RNA, 16 nt, Human
ugcucgggcccaggcc

SEQ ID NO: 2317125 - RNA, 23 nt, Human
ugcucgggcccaggccaucuucc

SEQ ID NO: 2317126 - RNA, 19 nt, Human
ugcucaggcuugaaaugca

SEQ ID NO: 2317127 - RNA, 23 nt, Human
ugcucaguucagaaucacuucug

SEQ ID NO: 2317128 - RNA, 17 nt, Human
ugcucaguucagaauca

SEQ ID NO: 2317129 - RNA, 18 nt, Human
ugcucaguucagaaucac

SEQ ID NO: 2317130 - RNA, 13 nt, Human
ugcucaguuguag

SEQ ID NO: 2317131 - RNA, 15 nt, Human
ugcucaguuguagaa

SEQ ID NO: 2317132 - RNA, 16 nt, Human
ugcucaguuguagaau

SEQ ID NO: 2317133 - RNA, 17 nt, Human
ugcucaguuguagaaug

SEQ ID NO: 2317134 - RNA, 18 nt, Human
ugcucaguuguagaaugu

SEQ ID NO: 2317135 - RNA, 19 nt, Human
ugcucaguuguagaaugua

SEQ ID NO: 2317136 - RNA, 14 nt, Human
ugcucauaacggau

SEQ ID NO: 2317137 - RNA, 20 nt, Human
ugcucaguuguagaauguau

SEQ ID NO: 2317138 - RNA, 21 nt, Human
ugcucaguuguagaauguauu

SEQ ID NO: 2317139 - RNA, 16 nt, Human
ugcucauaacggauca

SEQ ID NO: 2317140 - RNA, 21 nt, Human
ugcucauauugugauucugcc

SEQ ID NO: 2317141 - RNA, 22 nt, Human
ugcucaguuguagaauguauug

SEQ ID NO: 2317142 - RNA, 23 nt, Human
ugcucauauugugauucugccuu

SEQ ID NO: 2317143 - RNA, 22 nt, Human
ugcucauauugugauucugccu

SEQ ID NO: 2317144 - RNA, 19 nt, Human
ugcucuuguccuagcuugg

SEQ ID NO: 2317145 - RNA, 18 nt, Human
ugcucuuguccuagcuug

SEQ ID NO: 2317146 - RNA, 18 nt, Human
ugcucuuucaucucugcu

SEQ ID NO: 2317147 - RNA, 17 nt, Human
ugcucuugaugccuggc

SEQ ID NO: 2317148 - RNA, 17 nt, Human
ugcucuccccugcccug

SEQ ID NO: 2317149 - RNA, 16 nt, Human
ugcucuccccugcccu

SEQ ID NO: 2317150 - RNA, 14 nt, Human
ugcucuagugccuu

SEQ ID NO: 2317151 - RNA, 16 nt, Human
ugcucuagugccuucu

SEQ ID NO: 2317152 - RNA, 23 nt, Human
ugcucuccgaccagacaccuuga

SEQ ID NO: 2317153 - RNA, 20 nt, Human
ugcucuccccugcccugcug

SEQ ID NO: 2317154 - RNA, 20 nt, Human
ugcucucccgguucuuccag

SEQ ID NO: 2317155 - RNA, 21 nt, Human
ugcucucccucuucucaagug

SEQ ID NO: 2317156 - RNA, 22 nt, Human
ugcucucccucuucucaagugc

SEQ ID NO: 2317157 - RNA, 12 nt, Human
ugcucuccucuu

SEQ ID NO: 2317158 - RNA, 14 nt, Human
ugcuacugauuguu

SEQ ID NO: 2317159 - RNA, 20 nt, Human
ugcuacugauuguuucauug

SEQ ID NO: 2317160 - RNA, 14 nt, Human
ugcuacugccaacc

SEQ ID NO: 2317161 - RNA, 15 nt, Human
ugcuacugccaaccu

SEQ ID NO: 2317162 - RNA, 16 nt, Human
ugcuacucuguuccuu

SEQ ID NO: 2317163 - RNA, 15 nt, Human
ugcuacucuguuccu

SEQ ID NO: 2317164 - RNA, 14 nt, Human
ugcuacuacaaaaa

SEQ ID NO: 2317165 - RNA, 22 nt, Human
ugcuaagaauauuugaauguau

SEQ ID NO: 2317166 - RNA, 19 nt, Human
ugcuacgugugauuuuucu

SEQ ID NO: 2317167 - RNA, 21 nt, Human
ugcuaagaauauuugaaugua

SEQ ID NO: 2317168 - RNA, 17 nt, Human
ugcuaagaauauuugaa

SEQ ID NO: 2317169 - RNA, 21 nt, Human
ugcuacuguccuacccacccu

SEQ ID NO: 2317170 - RNA, 22 nt, Human
ugcuacuguccuacccacccuc

SEQ ID NO: 2317171 - RNA, 13 nt, Human
ugcuacuuugccu

SEQ ID NO: 2317172 - RNA, 22 nt, Human
ugcuacuuaauuccuuucucau

SEQ ID NO: 2317173 - RNA, 17 nt, Human
ugcuacuuugccuuuug

SEQ ID NO: 2317174 - RNA, 18 nt, Human
ugcuacuuugccuuuugc

SEQ ID NO: 2317175 - RNA, 22 nt, Human
ugcuacugucucacugaaacau

SEQ ID NO: 2317176 - RNA, 19 nt, Human
ugcuacuuaauuccuuucu

SEQ ID NO: 2317177 - RNA, 22 nt, Human
ugcuaacuagcuuggaaacugg

SEQ ID NO: 2317178 - RNA, 19 nt, Human
ugcuaacuuggagccccag

SEQ ID NO: 2317179 - RNA, 17 nt, Human
ugcuaacuuggagcccc

SEQ ID NO: 2317180 - RNA, 22 nt, Human
ugcuaagaagcgagcacugacc

SEQ ID NO: 2317181 - RNA, 20 nt, Human
ugcuaacuagcuuggaaacu

SEQ ID NO: 2317182 - RNA, 23 nt, Human
ugcuaaccacgucugucuucaca

SEQ ID NO: 2317183 - RNA, 19 nt, Human
ugcguuagaaugaggagga

SEQ ID NO: 2317184 - RNA, 12 nt, Human
ugcuaaaaaugg

SEQ ID NO: 2317185 - RNA, 15 nt, Human
ugcuaaaaaugggac

SEQ ID NO: 2317186 - RNA, 17 nt, Human
ugcuaaaaaugggacuu

SEQ ID NO: 2317187 - RNA, 13 nt, Human
ugcguuuuggaag

SEQ ID NO: 2317188 - RNA, 17 nt, Human
ugcguuccaugaugcug

SEQ ID NO: 2317189 - RNA, 19 nt, Human
ugcuaaaccuuaguacuga

SEQ ID NO: 2317190 - RNA, 21 nt, Human
ugcuaaaccuuaguacugagu

SEQ ID NO: 2317191 - RNA, 13 nt, Human
ugcuaaaccuuag

SEQ ID NO: 2317192 - RNA, 14 nt, Human
ugcuaaaccuuagu

SEQ ID NO: 2317193 - RNA, 17 nt, Human
ugcgcuuuugcugguca

SEQ ID NO: 2317194 - RNA, 18 nt, Human
ugcgcuuuugcuggucac

SEQ ID NO: 2317195 - RNA, 14 nt, Human
ugcgcuugcuuuuc

SEQ ID NO: 2317196 - RNA, 14 nt, Human
ugcggaaucagcuu

SEQ ID NO: 2317197 - RNA, 15 nt, Human
ugcggacaaguuuua

SEQ ID NO: 2317198 - RNA, 12 nt, Human
ugcguguguaga

SEQ ID NO: 2317199 - RNA, 15 nt, Human
ugcggaaucagcuuc

SEQ ID NO: 2317200 - RNA, 14 nt, Human
ugcguguguagagu

SEQ ID NO: 2317201 - RNA, 19 nt, Human
ugcguguguagaguuaaga

SEQ ID NO: 2317202 - RNA, 20 nt, Human
ugcguguguagaguuaagaa

SEQ ID NO: 2317203 - RNA, 21 nt, Human
ugcguguguagaguuaagaag

SEQ ID NO: 2317204 - RNA, 13 nt, Human
ugcguuacuaauu

SEQ ID NO: 2317205 - RNA, 14 nt, Human
ugcguguuugcacg

SEQ ID NO: 2317206 - RNA, 16 nt, Human
ugcguguuugcacguu

SEQ ID NO: 2317207 - RNA, 17 nt, Human
ugcguguguccaugugu

SEQ ID NO: 2317208 - RNA, 24 nt, Human
ugcguguguagaguuaagaagcug

SEQ ID NO: 2317209 - RNA, 19 nt, Human
ugcguguguccaugugugu

SEQ ID NO: 2317210 - RNA, 20 nt, Human
ugcgccacuacacuccagcc

SEQ ID NO: 2317211 - RNA, 23 nt, Human
ugcgcgugcacguggagagcugg

SEQ ID NO: 2317212 - RNA, 13 nt, Human
ugccuuggcuuca

SEQ ID NO: 2317213 - RNA, 19 nt, Human
ugcgcaggcuggcccugcc

SEQ ID NO: 2317214 - RNA, 13 nt, Human
ugcgcauucucau

SEQ ID NO: 2317215 - RNA, 17 nt, Human
ugcgccaccgcccagag

SEQ ID NO: 2317216 - RNA, 17 nt, Human
ugcgcauucucauggag

SEQ ID NO: 2317217 - RNA, 19 nt, Human
ugcgcauucucauggagaa

SEQ ID NO: 2317218 - RNA, 23 nt, Human
ugcgcauucucauggagaaguua

SEQ ID NO: 2317219 - RNA, 20 nt, Human
ugcgcucuagccugggcaac

SEQ ID NO: 2317220 - RNA, 23 nt, Human
ugcgcucagggccaugcugaggc

SEQ ID NO: 2317221 - RNA, 17 nt, Human
ugcgcgcacaauaguaa

SEQ ID NO: 2317222 - RNA, 23 nt, Human
ugcgcugacaaccaccgcucccc

SEQ ID NO: 2317223 - RNA, 17 nt, Human
ugcgcugacaaccaccg

SEQ ID NO: 2317224 - RNA, 13 nt, Human
ugcgcucagggcc

SEQ ID NO: 2317225 - RNA, 14 nt, Human
ugcgcucagggcca

SEQ ID NO: 2317226 - RNA, 15 nt, Human
ugcgcucagggccau

SEQ ID NO: 2317227 - RNA, 19 nt, Human
ugcgcucagggccaugcug

SEQ ID NO: 2317228 - RNA, 21 nt, Human
ugcgcucagggccaugcugag

SEQ ID NO: 2317229 - RNA, 22 nt, Human
ugcgcucagggccaugcugagg

SEQ ID NO: 2317230 - RNA, 15 nt, Human
ugccuugggcugcuc

SEQ ID NO: 2317231 - RNA, 11 nt, Human
ugccuugggcu

SEQ ID NO: 2317232 - RNA, 21 nt, Human
ugcgcaggcuggcccugcccu

SEQ ID NO: 2317233 - RNA, 23 nt, Human
ugcgcaggcuggcccugcccugg

SEQ ID NO: 2317234 - RNA, 22 nt, Human
ugcgcaggcuggcccugcccug

SEQ ID NO: 2317235 - RNA, 18 nt, Human
ugccuuggaaguugcaug

SEQ ID NO: 2317236 - RNA, 21 nt, Human
ugccuuggagggucccaagcu

SEQ ID NO: 2317237 - RNA, 19 nt, Human
ugccuuggagggucccaag

SEQ ID NO: 2317238 - RNA, 20 nt, Human
ugccuuggagggucccaagc

SEQ ID NO: 2317239 - RNA, 19 nt, Human
ugccuuggcucagacaugu

SEQ ID NO: 2317240 - RNA, 17 nt, Human
ugccuuggcucagacau

SEQ ID NO: 2317241 - RNA, 16 nt, Human
ugccuuggcucagaca

SEQ ID NO: 2317242 - RNA, 13 nt, Human
ugccuuggcucag

SEQ ID NO: 2317243 - RNA, 23 nt, Human
ugccucuaccugacacucccuug

SEQ ID NO: 2317244 - RNA, 24 nt, Human
ugccucgggaaccucacucuugcc

SEQ ID NO: 2317245 - RNA, 20 nt, Human
ugccuugcauaauggucaga

SEQ ID NO: 2317246 - RNA, 21 nt, Human
ugccucggcuuuucucagcug

SEQ ID NO: 2317247 - RNA, 20 nt, Human
ugccucggcuuuucucagcu

SEQ ID NO: 2317248 - RNA, 20 nt, Human
ugccucggcuccugcugcac

SEQ ID NO: 2317249 - RNA, 21 nt, Human
ugccucggcuccugcugcacc

SEQ ID NO: 2317250 - RNA, 22 nt, Human
ugccucggcuccugcugcacca

SEQ ID NO: 2317251 - RNA, 24 nt, Human
ugccucggcuuuucucagcuggau

SEQ ID NO: 2317252 - RNA, 18 nt, Human
ugccucgggaaccucacu

SEQ ID NO: 2317253 - RNA, 23 nt, Human
ugccucgggaaccucacucuugc

SEQ ID NO: 2317254 - RNA, 17 nt, Human
ugccucuaccugacacu

SEQ ID NO: 2317255 - RNA, 15 nt, Human
ugccucuaccugaca

SEQ ID NO: 2317256 - RNA, 15 nt, Human
ugcugguuuuccuaa

SEQ ID NO: 2317257 - RNA, 22 nt, Human
ugcugguuuuccuaaaugcagu

SEQ ID NO: 2317258 - RNA, 14 nt, Human
ugcugguuuuccua

SEQ ID NO: 2317259 - RNA, 12 nt, Human
ugcugguuuuuc

SEQ ID NO: 2317260 - RNA, 15 nt, Human
ugcugguuuuucagu

SEQ ID NO: 2317261 - RNA, 23 nt, Human
ugcugguugucauuuuugcagua

SEQ ID NO: 2317262 - RNA, 16 nt, Human
ugcugguugcugugug

SEQ ID NO: 2317263 - RNA, 17 nt, Human
ugcugguugcugugugg

SEQ ID NO: 2317264 - RNA, 22 nt, Human
ugcugguguccugaccacccuc

SEQ ID NO: 2317265 - RNA, 13 nt, Human
ugcugguugcugu

SEQ ID NO: 2317266 - RNA, 14 nt, Human
ugcugguugcugug

SEQ ID NO: 2317267 - RNA, 15 nt, Human
ugcugguugcugugu

SEQ ID NO: 2317268 - RNA, 13 nt, Human
ugcugguuuuagu

SEQ ID NO: 2317269 - RNA, 17 nt, Human
ugcuguaaaaacugugg

SEQ ID NO: 2317270 - RNA, 20 nt, Human
ugcugguuuuccuaaaugca

SEQ ID NO: 2317271 - RNA, 20 nt, Human
ugcuguaaauaaaugcuuua

SEQ ID NO: 2317272 - RNA, 16 nt, Human
ugcugguuuuucaguu

SEQ ID NO: 2317273 - RNA, 18 nt, Human
ugcugguuuuucaguuuu

SEQ ID NO: 2317274 - RNA, 12 nt, Human
ugcugugggaac

SEQ ID NO: 2317275 - RNA, 14 nt, Human
ugcugugggaacga

SEQ ID NO: 2317276 - RNA, 17 nt, Human
ugcugugggaacgagag

SEQ ID NO: 2317277 - RNA, 19 nt, Human
ugcugugggaacgagaggg

SEQ ID NO: 2317278 - RNA, 22 nt, Human
ugcugugggaacgagaggggaa

SEQ ID NO: 2317279 - RNA, 16 nt, Human
ugcugugguguguccc

SEQ ID NO: 2317280 - RNA, 15 nt, Human
ugcuguggugugucc

SEQ ID NO: 2317281 - RNA, 16 nt, Human
ugcuguggggcuggua

SEQ ID NO: 2317282 - RNA, 18 nt, Human
ugcuguggggcugguagc

SEQ ID NO: 2317283 - RNA, 23 nt, Human
ugcuguggggcugguagcucagg

SEQ ID NO: 2317284 - RNA, 21 nt, Human
ugcugugggugauauggacag

SEQ ID NO: 2317285 - RNA, 21 nt, Human
ugcuguguaucugauagcucu

SEQ ID NO: 2317286 - RNA, 13 nt, Human
ugcugugugccuu

SEQ ID NO: 2317287 - RNA, 11 nt, Human
ugcuguguggu

SEQ ID NO: 2317288 - RNA, 14 nt, Human
ugcugugugguuug

SEQ ID NO: 2317289 - RNA, 11 nt, Human
ugcuguguuaa

SEQ ID NO: 2317290 - RNA, 18 nt, Human
ugcuguguuaaauaaacc

SEQ ID NO: 2317291 - RNA, 15 nt, Human
ugcuguguaucugau

SEQ ID NO: 2317292 - RNA, 16 nt, Human
ugcuguguaucugaua

SEQ ID NO: 2317293 - RNA, 13 nt, Human
ugcuguguaaagu

SEQ ID NO: 2317294 - RNA, 14 nt, Human
ugcuguguaaaguu

SEQ ID NO: 2317295 - RNA, 15 nt, Human
ugcuguguaaaguua

SEQ ID NO: 2317296 - RNA, 17 nt, Human
ugcuguguaaaguuagu

SEQ ID NO: 2317297 - RNA, 12 nt, Human
ugcuguguaaag

SEQ ID NO: 2317298 - RNA, 23 nt, Human
ugcuguggugugucccccucugu

SEQ ID NO: 2317299 - RNA, 17 nt, Human
ugcuguggugugucccc

SEQ ID NO: 2317300 - RNA, 22 nt, Human
ugcuguucucuugggaacugaa

SEQ ID NO: 2317301 - RNA, 15 nt, Human
ugcuguguuugagcu

SEQ ID NO: 2317302 - RNA, 21 nt, Human
ugcuguguuugagcucugcag

SEQ ID NO: 2317303 - RNA, 16 nt, Human
ugcuguuaucccugcc

SEQ ID NO: 2317304 - RNA, 16 nt, Human
ugcuggucacugccau

SEQ ID NO: 2317305 - RNA, 19 nt, Human
ugcuggucacagccuccuc

SEQ ID NO: 2317306 - RNA, 20 nt, Human
ugcuggucacagccuccucu

SEQ ID NO: 2317307 - RNA, 13 nt, Human
ugcugguccgugg

SEQ ID NO: 2317308 - RNA, 16 nt, Human
ugcugguccgugggac

SEQ ID NO: 2317309 - RNA, 22 nt, Human
ugcugguaauuuguaucugaag

SEQ ID NO: 2317310 - RNA, 16 nt, Human
ugcuggucacagccuc

SEQ ID NO: 2317311 - RNA, 17 nt, Human
ugcuggucacagccucc

SEQ ID NO: 2317312 - RNA, 14 nt, Human
ugcugguguccuga

SEQ ID NO: 2317313 - RNA, 15 nt, Human
ugcugguguccugac

SEQ ID NO: 2317314 - RNA, 16 nt, Human
ugcugguguccugacc

SEQ ID NO: 2317315 - RNA, 17 nt, Human
ugcugguguccugacca

SEQ ID NO: 2317316 - RNA, 16 nt, Human
ugcuggguaaacugug

SEQ ID NO: 2317317 - RNA, 13 nt, Human
ugcuggguggccc

SEQ ID NO: 2317318 - RNA, 14 nt, Human
ugcuggguggccca

SEQ ID NO: 2317319 - RNA, 15 nt, Human
ugcuggguggcccau

SEQ ID NO: 2317320 - RNA, 16 nt, Human
ugcuggguggcccauc

SEQ ID NO: 2317321 - RNA, 20 nt, Human
ugcuggguggcccauccccc

SEQ ID NO: 2317322 - RNA, 13 nt, Human
ugcuggguguggc

SEQ ID NO: 2317323 - RNA, 22 nt, Human
ugcuggguggcccauccccccu

SEQ ID NO: 2317324 - RNA, 14 nt, Human
ugcuggguuggugc

SEQ ID NO: 2317325 - RNA, 16 nt, Human
ugcuggguuggugcac

SEQ ID NO: 2317326 - RNA, 17 nt, Human
ugcuggguuggugcaca

SEQ ID NO: 2317327 - RNA, 18 nt, Human
ugcuggguuggugcacag

SEQ ID NO: 2317328 - RNA, 19 nt, Human
ugcuggguuggugcacagu

SEQ ID NO: 2317329 - RNA, 21 nt, Human
ugcuggguuggugcacaguga

SEQ ID NO: 2317330 - RNA, 23 nt, Human
ugcuggguuggugcacagugauu

SEQ ID NO: 2317331 - RNA, 18 nt, Human
ugcuggggcaagucccug

SEQ ID NO: 2317332 - RNA, 22 nt, Human
ugcuggggacggggggccccag

SEQ ID NO: 2317333 - RNA, 23 nt, Human
ugcuggggacggggggccccagu

SEQ ID NO: 2317334 - RNA, 23 nt, Human
ugcuggggcaagucccugacucu

SEQ ID NO: 2317335 - RNA, 20 nt, Human
ugcuggggacggggggcccc

SEQ ID NO: 2317336 - RNA, 17 nt, Human
ugcugggcuggggccug

SEQ ID NO: 2317337 - RNA, 14 nt, Human
ugcugggcugggug

SEQ ID NO: 2317338 - RNA, 15 nt, Human
ugcugggcugggugc

SEQ ID NO: 2317339 - RNA, 16 nt, Human
ugcugggcugggugcg

SEQ ID NO: 2317340 - RNA, 20 nt, Human
ugcugggggggauuguaaaa

SEQ ID NO: 2317341 - RNA, 22 nt, Human
ugcugggcucuccaccucagcc

SEQ ID NO: 2317342 - RNA, 20 nt, Human
ugcugggcucuccaccucag

SEQ ID NO: 2317343 - RNA, 18 nt, Human
ugcugggcucuccaccuc

SEQ ID NO: 2317344 - RNA, 17 nt, Human
ugcugggcucuccaccu

SEQ ID NO: 2317345 - RNA, 16 nt, Human
ugcugggcucuccacc

SEQ ID NO: 2317346 - RNA, 15 nt, Human
ugcugggcucuccac

SEQ ID NO: 2317347 - RNA, 14 nt, Human
ugcugggcucucca

SEQ ID NO: 2317348 - RNA, 19 nt, Human
ugcugggcauuuucccaga

SEQ ID NO: 2317349 - RNA, 23 nt, Human
ugcugggcucuccaccucagccu

SEQ ID NO: 2317350 - RNA, 10 nt, Human
ugcugggcug

SEQ ID NO: 2317351 - RNA, 19 nt, Human
ugcugggcugacggugcag

SEQ ID NO: 2317352 - RNA, 21 nt, Human
ugcugggcugacggugcaguc

SEQ ID NO: 2317353 - RNA, 24 nt, Human
ugcugggcugacggugcagucugg

SEQ ID NO: 2317354 - RNA, 11 nt, Human
ugcugggcugg

SEQ ID NO: 2317355 - RNA, 13 nt, Human
ugcugggcugggg

SEQ ID NO: 2317356 - RNA, 14 nt, Human
ugcugggcuggggc

SEQ ID NO: 2317357 - RNA, 17 nt, Human
ugcugggcuugucugua

SEQ ID NO: 2317358 - RNA, 19 nt, Human
ugcugcuauccugccaaaa

SEQ ID NO: 2317359 - RNA, 13 nt, Human
ugcugccuucugg

SEQ ID NO: 2317360 - RNA, 17 nt, Human
ugcugccuucuggauuc

SEQ ID NO: 2317361 - RNA, 13 nt, Human
ugcugccugccug

SEQ ID NO: 2317362 - RNA, 14 nt, Human
ugcugccugccugu

SEQ ID NO: 2317363 - RNA, 15 nt, Human
ugcugccugccuguc

SEQ ID NO: 2317364 - RNA, 16 nt, Human
ugcugccugccugucu

SEQ ID NO: 2317365 - RNA, 14 nt, Human
ugcugccugaguca

SEQ ID NO: 2317366 - RNA, 15 nt, Human
ugcucuuucucugcc

SEQ ID NO: 2317367 - RNA, 23 nt, Human
ugcugcauuuuaauuuuaaccaa

SEQ ID NO: 2317368 - RNA, 17 nt, Human
ugcugccaaccauaccu

SEQ ID NO: 2317369 - RNA, 15 nt, Human
ugcugccugcuuuuu

SEQ ID NO: 2317370 - RNA, 17 nt, Human
ugcugccugcuuuuuau

SEQ ID NO: 2317371 - RNA, 14 nt, Human
ugcugcauuuaaaa

SEQ ID NO: 2317372 - RNA, 21 nt, Human
ugcugccaaccauaccuuccu

SEQ ID NO: 2317373 - RNA, 23 nt, Human
ugcugcauuuaaaagauacaguu

SEQ ID NO: 2317374 - RNA, 19 nt, Human
ugcugcauuuaaaagauac

SEQ ID NO: 2317375 - RNA, 18 nt, Human
ugcugcauuuaaaagaua

SEQ ID NO: 2317376 - RNA, 17 nt, Human
ugcugcauuuaaaagau

SEQ ID NO: 2317377 - RNA, 12 nt, Human
ugcucuuucucu

SEQ ID NO: 2317378 - RNA, 16 nt, Human
ugcucuuucuacucug

SEQ ID NO: 2317379 - RNA, 13 nt, Human
ugcucuuucucug

SEQ ID NO: 2317380 - RNA, 14 nt, Human
ugcucuuucucugc

SEQ ID NO: 2317381 - RNA, 21 nt, Human
ugcugcuucccucugccuguc

SEQ ID NO: 2317382 - RNA, 14 nt, Human
ugcugggccccugc

SEQ ID NO: 2317383 - RNA, 19 nt, Human
ugcugcuugaggcaacuca

SEQ ID NO: 2317384 - RNA, 20 nt, Human
ugcugggauuacagguguga

SEQ ID NO: 2317385 - RNA, 12 nt, Human
ugcugcugcugc

SEQ ID NO: 2317386 - RNA, 15 nt, Human
ugcugcugcgcccuu

SEQ ID NO: 2317387 - RNA, 16 nt, Human
ugcugcugcugcgccc

SEQ ID NO: 2317388 - RNA, 12 nt, Human
ugcugcuugagg

SEQ ID NO: 2317389 - RNA, 20 nt, Human
ugcugcuucccucugccugu

SEQ ID NO: 2317390 - RNA, 17 nt, Human
ugcugcuucccucugcc

SEQ ID NO: 2317391 - RNA, 16 nt, Human
ugcugcuucccucugc

SEQ ID NO: 2317392 - RNA, 15 nt, Human
ugcugcuucccucug

SEQ ID NO: 2317393 - RNA, 17 nt, Human
ugcugcugcugcgcccu

SEQ ID NO: 2317394 - RNA, 16 nt, Human
ugcugggccccugccu

SEQ ID NO: 2317395 - RNA, 17 nt, Human
ugcugggccccugccuc

SEQ ID NO: 2317396 - RNA, 18 nt, Human
ugcugggccccugccucu

SEQ ID NO: 2317397 - RNA, 19 nt, Human
ugcugggccccugccucuc

SEQ ID NO: 2317398 - RNA, 21 nt, Human
ugcugggccccugccucucug

SEQ ID NO: 2317399 - RNA, 22 nt, Human
ugcugggccccugccucucugc

SEQ ID NO: 2317400 - RNA, 23 nt, Human
ugcugggccccugccucucugca

SEQ ID NO: 2317401 - RNA, 24 nt, Human
ugcugggccccugccucucugcag

SEQ ID NO: 2317402 - RNA, 14 nt, Human
ugagggagccuggc

SEQ ID NO: 2317403 - RNA, 18 nt, Human
ugagggacuggaaccagg

SEQ ID NO: 2317404 - RNA, 18 nt, Human
ugagggaccagccaagag

SEQ ID NO: 2317405 - RNA, 13 nt, Human
ugagggacucuga

SEQ ID NO: 2317406 - RNA, 13 nt, Human
ugagggaccagcc

SEQ ID NO: 2317407 - RNA, 22 nt, Human
ugagggaacagacaggagaaau

SEQ ID NO: 2317408 - RNA, 20 nt, Human
ugagggaacagacaggagaa

SEQ ID NO: 2317409 - RNA, 21 nt, Human
ugaggcucugacccagugaga

SEQ ID NO: 2317410 - RNA, 15 nt, Human
ugaggcuccugugcu

SEQ ID NO: 2317411 - RNA, 16 nt, Human
ugaggcuccugugcua

SEQ ID NO: 2317412 - RNA, 17 nt, Human
ugagggaacagacagga

SEQ ID NO: 2317413 - RNA, 17 nt, Human
ugagggaacagagaggu

SEQ ID NO: 2317414 - RNA, 13 nt, Human
ugaggcucugccc

SEQ ID NO: 2317415 - RNA, 14 nt, Human
ugaggcucugcccu

SEQ ID NO: 2317416 - RNA, 20 nt, Human
ugaggcuccacuuggucugu

SEQ ID NO: 2317417 - RNA, 18 nt, Human
ugaggcuccacuuggucu

SEQ ID NO: 2317418 - RNA, 23 nt, Human
ugaggucuaggaacauacuucag

SEQ ID NO: 2317419 - RNA, 14 nt, Human
ugaggucucgcuga

SEQ ID NO: 2317420 - RNA, 15 nt, Human
ugaggucccaggcag

SEQ ID NO: 2317421 - RNA, 13 nt, Human
ugagggaggaggc

SEQ ID NO: 2317422 - RNA, 13 nt, Human
ugaggucccaggc

SEQ ID NO: 2317423 - RNA, 16 nt, Human
ugagggagcuuagcca

SEQ ID NO: 2317424 - RNA, 19 nt, Human
ugaggucccaggcagagaa

SEQ ID NO: 2317425 - RNA, 17 nt, Human
ugaggucccaggcagag

SEQ ID NO: 2317426 - RNA, 14 nt, Human
ugagggagcuuagc

SEQ ID NO: 2317427 - RNA, 16 nt, Human
ugaggucugcucggcc

SEQ ID NO: 2317428 - RNA, 15 nt, Human
ugaggucugcucggc

SEQ ID NO: 2317429 - RNA, 15 nt, Human
ugaggucugaaaugg

SEQ ID NO: 2317430 - RNA, 18 nt, Human
ugaggucucuugagggag

SEQ ID NO: 2317431 - RNA, 17 nt, Human
ugaggucucuugaggga

SEQ ID NO: 2317432 - RNA, 23 nt, Human
ugaggucucgcugaugcugggcu

SEQ ID NO: 2317433 - RNA, 18 nt, Human
ugaggucucgcugaugcu

SEQ ID NO: 2317434 - RNA, 23 nt, Human
ugaggucugcucggccgucuuca

SEQ ID NO: 2317435 - RNA, 15 nt, Human
ugaggucuggcugcu

SEQ ID NO: 2317436 - RNA, 18 nt, Human
ugagguggcacuuuuuca

SEQ ID NO: 2317437 - RNA, 20 nt, Human
ugagguggcacuuuuucauu

SEQ ID NO: 2317438 - RNA, 14 nt, Human
ugaggugggagaug

SEQ ID NO: 2317439 - RNA, 13 nt, Human
ugaggugggagga

SEQ ID NO: 2317440 - RNA, 12 nt, Human
ugaggugggagg

SEQ ID NO: 2317441 - RNA, 21 nt, Human
ugaggcucaggggugugccug

SEQ ID NO: 2317442 - RNA, 17 nt, Human
ugaggcauugcacaggg

SEQ ID NO: 2317443 - RNA, 18 nt, Human
ugaggcauugcacaggga

SEQ ID NO: 2317444 - RNA, 23 nt, Human
ugaggcauuuguuugaacugaua

SEQ ID NO: 2317445 - RNA, 23 nt, Human
ugaggcuagugugguguuuccug

SEQ ID NO: 2317446 - RNA, 21 nt, Human
ugaggcauuuguuugaacuga

SEQ ID NO: 2317447 - RNA, 17 nt, Human
ugaggcuaguguggugu

SEQ ID NO: 2317448 - RNA, 20 nt, Human
ugaggcauuuguuugaacug

SEQ ID NO: 2317449 - RNA, 19 nt, Human
ugaggcauuuguuugaacu

SEQ ID NO: 2317450 - RNA, 22 nt, Human
ugaggcagugggucccacuucc

SEQ ID NO: 2317451 - RNA, 23 nt, Human
ugaggcagugggucccacuuccc

SEQ ID NO: 2317452 - RNA, 23 nt, Human
ugaggcaucgcaauguaagacuc

SEQ ID NO: 2317453 - RNA, 12 nt, Human
ugaggcauuugu

SEQ ID NO: 2317454 - RNA, 16 nt, Human
ugaggagcugcuggcu

SEQ ID NO: 2317455 - RNA, 15 nt, Human
ugaggagcugcuggc

SEQ ID NO: 2317456 - RNA, 14 nt, Human
ugaggagcugcugg

SEQ ID NO: 2317457 - RNA, 13 nt, Human
ugaggagcugcug

SEQ ID NO: 2317458 - RNA, 17 nt, Human
ugaggagcugcuggcuu

SEQ ID NO: 2317459 - RNA, 12 nt, Human
ugaggagcuggg

SEQ ID NO: 2317460 - RNA, 20 nt, Human
ugaggagcuggggaucccuc

SEQ ID NO: 2317461 - RNA, 13 nt, Human
ugaggagcugggg

SEQ ID NO: 2317462 - RNA, 13 nt, Human
ugagcugggauga

SEQ ID NO: 2317463 - RNA, 20 nt, Human
ugagcuggggaugucucuca

SEQ ID NO: 2317464 - RNA, 22 nt, Human
ugagcuggggaccugguacccu

SEQ ID NO: 2317465 - RNA, 19 nt, Human
ugaggcagugggucccacu

SEQ ID NO: 2317466 - RNA, 17 nt, Human
ugaggaggccuccaucu

SEQ ID NO: 2317467 - RNA, 21 nt, Human
ugaggcagugggucccacuuc

SEQ ID NO: 2317468 - RNA, 17 nt, Human
ugaggcagguccccaga

SEQ ID NO: 2317469 - RNA, 16 nt, Human
ugaggcagguccccag

SEQ ID NO: 2317470 - RNA, 14 nt, Human
ugaggcaggucccc

SEQ ID NO: 2317471 - RNA, 18 nt, Human
ugaggaggaaggagagaa

SEQ ID NO: 2317472 - RNA, 16 nt, Human
ugaggaggccuccauc

SEQ ID NO: 2317473 - RNA, 14 nt, Human
ugaggaggccucca

SEQ ID NO: 2317474 - RNA, 21 nt, Human
ugaggaggaaggagagaaggg

SEQ ID NO: 2317475 - RNA, 13 nt, Human
ugaggaggaagga

SEQ ID NO: 2317476 - RNA, 12 nt, Human
ugaggaggaagg

SEQ ID NO: 2317477 - RNA, 16 nt, Human
ugaggagcuugaaacc

SEQ ID NO: 2317478 - RNA, 23 nt, Human
ugaguugacuugacagaacacug

SEQ ID NO: 2317479 - RNA, 19 nt, Human
ugaguuucucucacauuac

SEQ ID NO: 2317480 - RNA, 16 nt, Human
ugaguuugagcugccu

SEQ ID NO: 2317481 - RNA, 17 nt, Human
ugaguuugagcugccuu

SEQ ID NO: 2317482 - RNA, 18 nt, Human
ugaguuugagcugccuuc

SEQ ID NO: 2317483 - RNA, 19 nt, Human
ugaguuugagcugccuucc

SEQ ID NO: 2317484 - RNA, 21 nt, Human
ugaguuugagcugccuucccu

SEQ ID NO: 2317485 - RNA, 22 nt, Human
ugaguuugcccugguuucacug

SEQ ID NO: 2317486 - RNA, 14 nt, Human
ugaguuugcccugg

SEQ ID NO: 2317487 - RNA, 22 nt, Human
ugaguuugggccccagaggcug

SEQ ID NO: 2317488 - RNA, 23 nt, Human
ugaguuugggccccagaggcugg

SEQ ID NO: 2317489 - RNA, 13 nt, Human
ugaguuugcuuau

SEQ ID NO: 2317490 - RNA, 22 nt, Human
ugaguuugcuuauguaaucuca

SEQ ID NO: 2317491 - RNA, 14 nt, Human
ugagugagcaugcc

SEQ ID NO: 2317492 - RNA, 13 nt, Human
ugaguucucaggg

SEQ ID NO: 2317493 - RNA, 16 nt, Human
ugaguucucagggcuc

SEQ ID NO: 2317494 - RNA, 17 nt, Human
ugaguucucagggcucc

SEQ ID NO: 2317495 - RNA, 18 nt, Human
ugaguucucagggcuccu

SEQ ID NO: 2317496 - RNA, 19 nt, Human
ugaguucucagggcuccug

SEQ ID NO: 2317497 - RNA, 22 nt, Human
ugaguucucagggcuccugccu

SEQ ID NO: 2317498 - RNA, 16 nt, Human
ugaguugauagcacag

SEQ ID NO: 2317499 - RNA, 20 nt, Human
ugaguugauagcacagaccc

SEQ ID NO: 2317500 - RNA, 18 nt, Human
ugaguuuuauugagaauu

SEQ ID NO: 2317501 - RNA, 17 nt, Human
ugaguuuucuucuguga

SEQ ID NO: 2317502 - RNA, 19 nt, Human
ugaguuugucgcucaugug

SEQ ID NO: 2317503 - RNA, 20 nt, Human
ugaguuugucgcucaugugu

SEQ ID NO: 2317504 - RNA, 17 nt, Human
ugaguuuuuucucuugg

SEQ ID NO: 2317505 - RNA, 19 nt, Human
ugaguuuuuauggggcuga

SEQ ID NO: 2317506 - RNA, 19 nt, Human
ugaguuuuugauagcuuua

SEQ ID NO: 2317507 - RNA, 18 nt, Human
ugaguuuuugauagcuuu

SEQ ID NO: 2317508 - RNA, 13 nt, Human
ugaguuuuugaua

SEQ ID NO: 2317509 - RNA, 18 nt, Human
ugaguuuuuauggggcug

SEQ ID NO: 2317510 - RNA, 20 nt, Human
ugaguuuuguuuuaaaauua

SEQ ID NO: 2317511 - RNA, 18 nt, Human
ugaguuuucuucugugau

SEQ ID NO: 2317512 - RNA, 19 nt, Human
ugaguuuuuucucuugggc

SEQ ID NO: 2317513 - RNA, 18 nt, Human
ugaguuuuuucucuuggg

SEQ ID NO: 2317514 - RNA, 17 nt, Human
ugauaacaaccuggaga

SEQ ID NO: 2317515 - RNA, 18 nt, Human
ugauaacaaccuggagac

SEQ ID NO: 2317516 - RNA, 23 nt, Human
ugauaacuagauggugcugagaa

SEQ ID NO: 2317517 - RNA, 22 nt, Human
ugauaacuagauggugcugaga

SEQ ID NO: 2317518 - RNA, 21 nt, Human
ugauaacuagauggugcugag

SEQ ID NO: 2317519 - RNA, 18 nt, Human
ugauaacuagauggugcu

SEQ ID NO: 2317520 - RNA, 19 nt, Human
ugauaacugcaauuuuaau

SEQ ID NO: 2317521 - RNA, 14 nt, Human
ugauaacuuugcuu

SEQ ID NO: 2317522 - RNA, 15 nt, Human
ugauaacuuugcuug

SEQ ID NO: 2317523 - RNA, 16 nt, Human
ugauaacuggaaacuu

SEQ ID NO: 2317524 - RNA, 15 nt, Human
ugagucuuggcggca

SEQ ID NO: 2317525 - RNA, 16 nt, Human
ugagucuuggcggcag

SEQ ID NO: 2317526 - RNA, 17 nt, Human
ugagucuuggcggcagc

SEQ ID NO: 2317527 - RNA, 18 nt, Human
ugagucuuggcggcagca

SEQ ID NO: 2317528 - RNA, 21 nt, Human
ugagucuuggcggcagcagcc

SEQ ID NO: 2317529 - RNA, 15 nt, Human
ugagucucuucagaa

SEQ ID NO: 2317530 - RNA, 23 nt, Human
ugagucuuggcggcagcagccau

SEQ ID NO: 2317531 - RNA, 17 nt, Human
ugagugaaccuguauaa

SEQ ID NO: 2317532 - RNA, 15 nt, Human
ugagugaauaaaugu

SEQ ID NO: 2317533 - RNA, 13 nt, Human
ugagucugaaggc

SEQ ID NO: 2317534 - RNA, 15 nt, Human
ugagucugaaggcug

SEQ ID NO: 2317535 - RNA, 17 nt, Human
ugagucugaaggcuggg

SEQ ID NO: 2317536 - RNA, 18 nt, Human
ugagucugaaggcugggu

SEQ ID NO: 2317537 - RNA, 18 nt, Human
ugagucgucaucacuuuu

SEQ ID NO: 2317538 - RNA, 19 nt, Human
ugagucguacagaaagcug

SEQ ID NO: 2317539 - RNA, 17 nt, Human
ugagucguacagaaagc

SEQ ID NO: 2317540 - RNA, 20 nt, Human
ugagucccaggagcugccca

SEQ ID NO: 2317541 - RNA, 21 nt, Human
ugagucccaggagcugcccag

SEQ ID NO: 2317542 - RNA, 14 nt, Human
ugagucucuucaga

SEQ ID NO: 2317543 - RNA, 23 nt, Human
ugagucucccaaggcugcgucug

SEQ ID NO: 2317544 - RNA, 15 nt, Human
ugagucucccaaggc

SEQ ID NO: 2317545 - RNA, 16 nt, Human
ugagucucccaaggcu

SEQ ID NO: 2317546 - RNA, 19 nt, Human
ugagucgaggacagggagg

SEQ ID NO: 2317547 - RNA, 19 nt, Human
ugaguccagaaguuugaga

SEQ ID NO: 2317548 - RNA, 13 nt, Human
ugaguccagaagu

SEQ ID NO: 2317549 - RNA, 21 nt, Human
ugaggugggaggaucucuuga

SEQ ID NO: 2317550 - RNA, 17 nt, Human
ugaguccauucucccag

SEQ ID NO: 2317551 - RNA, 21 nt, Human
ugagguggcacuuuuucauuu

SEQ ID NO: 2317552 - RNA, 23 nt, Human
ugagguggcacuuuuucauuugc

SEQ ID NO: 2317553 - RNA, 15 nt, Human
ugagucccaggcuga

SEQ ID NO: 2317554 - RNA, 19 nt, Human
ugaguccauucucccaggu

SEQ ID NO: 2317555 - RNA, 20 nt, Human
ugaguccauucucccaggua

SEQ ID NO: 2317556 - RNA, 22 nt, Human
ugaguccauucucccagguacc

SEQ ID NO: 2317557 - RNA, 16 nt, Human
ugagucccaggagcug

SEQ ID NO: 2317558 - RNA, 21 nt, Human
ugagcucgguggacccaggga

SEQ ID NO: 2317559 - RNA, 20 nt, Human
ugagcucgguggacccaggg

SEQ ID NO: 2317560 - RNA, 14 nt, Human
ugagcucgguggac

SEQ ID NO: 2317561 - RNA, 22 nt, Human
ugagcucuacccagggccugca

SEQ ID NO: 2317562 - RNA, 19 nt, Human
ugagcucuacccagggccu

SEQ ID NO: 2317563 - RNA, 18 nt, Human
ugagcucuacccagggcc

SEQ ID NO: 2317564 - RNA, 17 nt, Human
ugagcucuacccagggc

SEQ ID NO: 2317565 - RNA, 21 nt, Human
ugagcuggaaggagugagagg

SEQ ID NO: 2317566 - RNA, 12 nt, Human
ugagcuggaagg

SEQ ID NO: 2317567 - RNA, 15 nt, Human
ugagcugccuucccu

SEQ ID NO: 2317568 - RNA, 16 nt, Human
ugagcucucggaacug

SEQ ID NO: 2317569 - RNA, 16 nt, Human
ugagcugccuucccua

SEQ ID NO: 2317570 - RNA, 17 nt, Human
ugagcugccuucccuag

SEQ ID NO: 2317571 - RNA, 19 nt, Human
ugagcugccuucccuagcu

SEQ ID NO: 2317572 - RNA, 14 nt, Human
ugagccugagcaga

SEQ ID NO: 2317573 - RNA, 18 nt, Human
ugagccucugcuccccag

SEQ ID NO: 2317574 - RNA, 17 nt, Human
ugagccucugcucccca

SEQ ID NO: 2317575 - RNA, 16 nt, Human
ugagccucugcucccc

SEQ ID NO: 2317576 - RNA, 14 nt, Human
ugagccucugcucc

SEQ ID NO: 2317577 - RNA, 12 nt, Human
ugagccucugcu

SEQ ID NO: 2317578 - RNA, 13 nt, Human
ugagccucucacc

SEQ ID NO: 2317579 - RNA, 15 nt, Human
ugagccucucaccug

SEQ ID NO: 2317580 - RNA, 19 nt, Human
ugagcuccucugggcagga

SEQ ID NO: 2317581 - RNA, 19 nt, Human
ugagccucucaccuguacu

SEQ ID NO: 2317582 - RNA, 19 nt, Human
ugagccgagaucacgccac

SEQ ID NO: 2317583 - RNA, 18 nt, Human
ugagcccuguccugccua

SEQ ID NO: 2317584 - RNA, 22 nt, Human
ugagcccucagaacccuuggcu

SEQ ID NO: 2317585 - RNA, 15 nt, Human
ugagccccuggaggc

SEQ ID NO: 2317586 - RNA, 20 nt, Human
ugagcccucagaacccuugg

SEQ ID NO: 2317587 - RNA, 21 nt, Human
ugagccgagaucacgccacug

SEQ ID NO: 2317588 - RNA, 17 nt, Human
ugagccucagcauccug

SEQ ID NO: 2317589 - RNA, 22 nt, Human
ugagccucagcauccuggcacc

SEQ ID NO: 2317590 - RNA, 14 nt, Human
ugagccucagucuc

SEQ ID NO: 2317591 - RNA, 18 nt, Human
ugagccucagcauccugg

SEQ ID NO: 2317592 - RNA, 21 nt, Human
ugagccucagcauccuggcac

SEQ ID NO: 2317593 - RNA, 19 nt, Human
ugagcagggcucagcgggg

SEQ ID NO: 2317594 - RNA, 20 nt, Human
ugagauauuuauuguuuauu

SEQ ID NO: 2317595 - RNA, 23 nt, Human
ugagcagugaguuacagcgagag

SEQ ID NO: 2317596 - RNA, 16 nt, Human
ugagcagggcucagcg

SEQ ID NO: 2317597 - RNA, 17 nt, Human
ugagcagggcucagcgg

SEQ ID NO: 2317598 - RNA, 18 nt, Human
ugagcaguggcuggucca

SEQ ID NO: 2317599 - RNA, 22 nt, Human
ugagcaguggcugguccagggc

SEQ ID NO: 2317600 - RNA, 12 nt, Human
ugagcaguggcu

SEQ ID NO: 2317601 - RNA, 13 nt, Human
ugagcaguggcug

SEQ ID NO: 2317602 - RNA, 14 nt, Human
ugagcaguggcugg

SEQ ID NO: 2317603 - RNA, 15 nt, Human
ugagcaguggcuggu

SEQ ID NO: 2317604 - RNA, 16 nt, Human
ugagcaucaggccagg

SEQ ID NO: 2317605 - RNA, 14 nt, Human
ugagcaucacaguu

SEQ ID NO: 2317606 - RNA, 20 nt, Human
ugagcccccccaacacugug

SEQ ID NO: 2317607 - RNA, 22 nt, Human
ugagcccccccaacacugugcc

SEQ ID NO: 2317608 - RNA, 23 nt, Human
ugagcccccccaacacugugccc

SEQ ID NO: 2317609 - RNA, 16 nt, Human
ugagccccgcagaccu

SEQ ID NO: 2317610 - RNA, 17 nt, Human
ugagccccgcagaccuc

SEQ ID NO: 2317611 - RNA, 23 nt, Human
ugagccccgcagaccuccccagc

SEQ ID NO: 2317612 - RNA, 22 nt, Human
ugagccccgcagaccuccccag

SEQ ID NO: 2317613 - RNA, 19 nt, Human
ugagccccuaccccacacc

SEQ ID NO: 2317614 - RNA, 21 nt, Human
ugagccccuaccccacaccag

SEQ ID NO: 2317615 - RNA, 22 nt, Human
ugagccccuaccccacaccagg

SEQ ID NO: 2317616 - RNA, 22 nt, Human
ugagccccaaguccugaagagg

SEQ ID NO: 2317617 - RNA, 23 nt, Human
ugagccccaaguccugaagaggc

SEQ ID NO: 2317618 - RNA, 15 nt, Human
ugagcaucacaguuu

SEQ ID NO: 2317619 - RNA, 14 nt, Human
ugagccccaagucc

SEQ ID NO: 2317620 - RNA, 17 nt, Human
ugagccccaaguccuga

SEQ ID NO: 2317621 - RNA, 21 nt, Human
ugagccccaaguccugaagag

SEQ ID NO: 2317622 - RNA, 18 nt, Human
ugagcaucaggccaggcc

SEQ ID NO: 2317623 - RNA, 19 nt, Human
ugagcaucaggccaggccc

SEQ ID NO: 2317624 - RNA, 20 nt, Human
ugagcaucaggccaggcccu

SEQ ID NO: 2317625 - RNA, 15 nt, Human
ugagaucagccuggg

SEQ ID NO: 2317626 - RNA, 14 nt, Human
ugagaucagccugg

SEQ ID NO: 2317627 - RNA, 15 nt, Human
ugagauauuuauugu

SEQ ID NO: 2317628 - RNA, 15 nt, Human
ugagaucaaaacggu

SEQ ID NO: 2317629 - RNA, 12 nt, Human
ugagcagggcuc

SEQ ID NO: 2317630 - RNA, 13 nt, Human
ugagcagggcuca

SEQ ID NO: 2317631 - RNA, 14 nt, Human
ugagcagggcucag

SEQ ID NO: 2317632 - RNA, 15 nt, Human
ugagcagggcucagc

SEQ ID NO: 2317633 - RNA, 22 nt, Human
ugagagugucuucacggcagga

SEQ ID NO: 2317634 - RNA, 24 nt, Human
ugagagugucuucacggcaggaca

SEQ ID NO: 2317635 - RNA, 20 nt, Human
ugagagucugcacuuaacaa

SEQ ID NO: 2317636 - RNA, 15 nt, Human
ugagaguuuuggaug

SEQ ID NO: 2317637 - RNA, 16 nt, Human
ugagaguuuaguugua

SEQ ID NO: 2317638 - RNA, 17 nt, Human
ugagaguuuuggaugca

SEQ ID NO: 2317639 - RNA, 19 nt, Human
ugagaguuuuggaugcagu

SEQ ID NO: 2317640 - RNA, 16 nt, Human
ugagagugaacaaauu

SEQ ID NO: 2317641 - RNA, 17 nt, Human
ugagacucgagaacuuu

SEQ ID NO: 2317642 - RNA, 20 nt, Human
ugagacucgcgacaaugcaa

SEQ ID NO: 2317643 - RNA, 21 nt, Human
ugagacucgcgacaaugcaaa

SEQ ID NO: 2317644 - RNA, 22 nt, Human
ugagacucgcgacaaugcaaac

SEQ ID NO: 2317645 - RNA, 23 nt, Human
ugagacucgcgacaaugcaaacc

SEQ ID NO: 2317646 - RNA, 16 nt, Human
ugagaacccugcgugg

SEQ ID NO: 2317647 - RNA, 16 nt, Human
ugagaacacugugaaa

SEQ ID NO: 2317648 - RNA, 12 nt, Human
ugagaacacugu

SEQ ID NO: 2317649 - RNA, 14 nt, Human
ugagaacacuguga

SEQ ID NO: 2317650 - RNA, 22 nt, Human
ugagaacccugcguggggacag

SEQ ID NO: 2317651 - RNA, 18 nt, Human
ugagaacccugcgugggg

SEQ ID NO: 2317652 - RNA, 21 nt, Human
ugagaacccugcguggggaca

SEQ ID NO: 2317653 - RNA, 17 nt, Human
ugagaaauuuauaaacu

SEQ ID NO: 2317654 - RNA, 19 nt, Human
ugagaacaaccaaaaucuu

SEQ ID NO: 2317655 - RNA, 19 nt, Human
ugaccucaggcacuagccu

SEQ ID NO: 2317656 - RNA, 20 nt, Human
ugaccucaggugauccaccc

SEQ ID NO: 2317657 - RNA, 21 nt, Human
ugaccucaggugauccaccca

SEQ ID NO: 2317658 - RNA, 16 nt, Human
ugaccucagcuuugau

SEQ ID NO: 2317659 - RNA, 18 nt, Human
ugaccucaggcacuagcc

SEQ ID NO: 2317660 - RNA, 22 nt, Human
ugaccucagcuuugauauuuca

SEQ ID NO: 2317661 - RNA, 16 nt, Human
ugaccgugggcggggc

SEQ ID NO: 2317662 - RNA, 19 nt, Human
ugaccggacuuuucugcaa

SEQ ID NO: 2317663 - RNA, 19 nt, Human
ugaccgcgacuaauuucaa

SEQ ID NO: 2317664 - RNA, 16 nt, Human
ugaccggacuuuucug

SEQ ID NO: 2317665 - RNA, 17 nt, Human
ugagaccagccugggca

SEQ ID NO: 2317666 - RNA, 18 nt, Human
ugagacccagcccucauc

SEQ ID NO: 2317667 - RNA, 12 nt, Human
ugagaccaguug

SEQ ID NO: 2317668 - RNA, 21 nt, Human
ugagaccaguugggagcacug

SEQ ID NO: 2317669 - RNA, 13 nt, Human
ugagacccccaca

SEQ ID NO: 2317670 - RNA, 21 nt, Human
ugagacccauuccuauuucuu

SEQ ID NO: 2317671 - RNA, 20 nt, Human
ugagacccagcccucauccc

SEQ ID NO: 2317672 - RNA, 14 nt, Human
ugagaccacuguua

SEQ ID NO: 2317673 - RNA, 21 nt, Human
ugagaccacagagagagggga

SEQ ID NO: 2317674 - RNA, 13 nt, Human
ugagaccacagag

SEQ ID NO: 2317675 - RNA, 17 nt, Human
ugagacccccacaccuc

SEQ ID NO: 2317676 - RNA, 23 nt, Human
ugagaccaguugggagcacugga

SEQ ID NO: 2317677 - RNA, 16 nt, Human
ugagacccccacaccu

SEQ ID NO: 2317678 - RNA, 15 nt, Human
ugagacccccacacc

SEQ ID NO: 2317679 - RNA, 14 nt, Human
ugagacccccacac

SEQ ID NO: 2317680 - RNA, 23 nt, Human
ugagacguuuuuggaagaguagu

SEQ ID NO: 2317681 - RNA, 18 nt, Human
ugagacuaugcguuuuua

SEQ ID NO: 2317682 - RNA, 20 nt, Human
ugagacucagacaggaaagg

SEQ ID NO: 2317683 - RNA, 12 nt, Human
ugagacucgaga

SEQ ID NO: 2317684 - RNA, 15 nt, Human
ugagacucgagaacu

SEQ ID NO: 2317685 - RNA, 16 nt, Human
ugagacucgagaacuu

SEQ ID NO: 2317686 - RNA, 19 nt, Human
ugagacucgcgacaaugca

SEQ ID NO: 2317687 - RNA, 14 nt, Human
ugauccaacuaaug

SEQ ID NO: 2317688 - RNA, 22 nt, Human
ugaucauuuuccccccacucuc

SEQ ID NO: 2317689 - RNA, 13 nt, Human
ugauccaacuaau

SEQ ID NO: 2317690 - RNA, 21 nt, Human
ugaucauuuuccccccacucu

SEQ ID NO: 2317691 - RNA, 20 nt, Human
ugaucauuuuccccccacuc

SEQ ID NO: 2317692 - RNA, 19 nt, Human
ugaucauuuuccccccacu

SEQ ID NO: 2317693 - RNA, 18 nt, Human
ugaucauuuuccccccac

SEQ ID NO: 2317694 - RNA, 23 nt, Human
ugaucaugcauuguugagguggu

SEQ ID NO: 2317695 - RNA, 17 nt, Human
ugaucaugcauuguuga

SEQ ID NO: 2317696 - RNA, 16 nt, Human
ugaucaugcauuguug

SEQ ID NO: 2317697 - RNA, 15 nt, Human
ugaucaugcauuguu

SEQ ID NO: 2317698 - RNA, 14 nt, Human
ugaucaugcauugu

SEQ ID NO: 2317699 - RNA, 13 nt, Human
ugaucaugcauug

SEQ ID NO: 2317700 - RNA, 17 nt, Human
ugaucauuuucccccca

SEQ ID NO: 2317701 - RNA, 16 nt, Human
ugaucauuuucccccc

SEQ ID NO: 2317702 - RNA, 13 nt, Human
ugauccaagcugg

SEQ ID NO: 2317703 - RNA, 14 nt, Human
ugauccaagcuggu

SEQ ID NO: 2317704 - RNA, 15 nt, Human
ugauccaagcugguc

SEQ ID NO: 2317705 - RNA, 16 nt, Human
ugauccacccaccuca

SEQ ID NO: 2317706 - RNA, 18 nt, Human
ugaucagcuguuugucau

SEQ ID NO: 2317707 - RNA, 24 nt, Human
ugaucagcuuauugucuagugaaa

SEQ ID NO: 2317708 - RNA, 23 nt, Human
ugauagcaagugaauuuuucucu

SEQ ID NO: 2317709 - RNA, 16 nt, Human
ugaucagcuguuuguc

SEQ ID NO: 2317710 - RNA, 17 nt, Human
ugaucagcuguuuguca

SEQ ID NO: 2317711 - RNA, 17 nt, Human
ugaucagcuuauugucu

SEQ ID NO: 2317712 - RNA, 13 nt, Human
ugauagcacagac

SEQ ID NO: 2317713 - RNA, 14 nt, Human
ugauagcacagacc

SEQ ID NO: 2317714 - RNA, 17 nt, Human
ugauaacuuugcuugca

SEQ ID NO: 2317715 - RNA, 19 nt, Human
ugauagacacauaugaggg

SEQ ID NO: 2317716 - RNA, 13 nt, Human
ugauagcaaagcg

SEQ ID NO: 2317717 - RNA, 22 nt, Human
ugauagacacauaugaggggga

SEQ ID NO: 2317718 - RNA, 21 nt, Human
ugauagacacauaugaggggg

SEQ ID NO: 2317719 - RNA, 22 nt, Human
ugaucuguauauacaauaacau

SEQ ID NO: 2317720 - RNA, 19 nt, Human
ugaucuguauauacaauaa

SEQ ID NO: 2317721 - RNA, 15 nt, Human
ugaucuguauauaca

SEQ ID NO: 2317722 - RNA, 13 nt, Human
ugaucuguauaua

SEQ ID NO: 2317723 - RNA, 15 nt, Human
ugaucugugggcaca

SEQ ID NO: 2317724 - RNA, 11 nt, Human
ugaucugugcu

SEQ ID NO: 2317725 - RNA, 12 nt, Human
ugaucugugcuu

SEQ ID NO: 2317726 - RNA, 19 nt, Human
ugaucugugcuuuccagcu

SEQ ID NO: 2317727 - RNA, 20 nt, Human
ugaucugugcuuuccagcuc

SEQ ID NO: 2317728 - RNA, 21 nt, Human
ugaucugugcuuuccagcuca

SEQ ID NO: 2317729 - RNA, 22 nt, Human
ugaucugugcuuuccagcucac

SEQ ID NO: 2317730 - RNA, 20 nt, Human
ugaucuucuuuauaauucua

SEQ ID NO: 2317731 - RNA, 15 nt, Human
ugaucuugugacaua

SEQ ID NO: 2317732 - RNA, 14 nt, Human
ugaucuugugacau

SEQ ID NO: 2317733 - RNA, 21 nt, Human
ugaucuuggcuuacugcagcc

SEQ ID NO: 2317734 - RNA, 14 nt, Human
ugaucuuuaaaaua

SEQ ID NO: 2317735 - RNA, 17 nt, Human
ugaucucccugccgccu

SEQ ID NO: 2317736 - RNA, 16 nt, Human
ugaucucccugccgcc

SEQ ID NO: 2317737 - RNA, 15 nt, Human
ugaucucccugccgc

SEQ ID NO: 2317738 - RNA, 14 nt, Human
ugaucucccugccg

SEQ ID NO: 2317739 - RNA, 18 nt, Human
ugaucucggcucacugca

SEQ ID NO: 2317740 - RNA, 13 nt, Human
ugaucucccugcc

SEQ ID NO: 2317741 - RNA, 20 nt, Human
ugaucuccauggcuuccucc

SEQ ID NO: 2317742 - RNA, 21 nt, Human
ugaucuccauauguuacacua

SEQ ID NO: 2317743 - RNA, 17 nt, Human
ugaucuccauggcuucc

SEQ ID NO: 2317744 - RNA, 19 nt, Human
ugaucuccauauguuacac

SEQ ID NO: 2317745 - RNA, 16 nt, Human
ugaucuccauauguua

SEQ ID NO: 2317746 - RNA, 22 nt, Human
ugaucucauuuaauccucucaa

SEQ ID NO: 2317747 - RNA, 17 nt, Human
ugaucugguuugacucc

SEQ ID NO: 2317748 - RNA, 21 nt, Human
ugaucucggcucacugcaacc

SEQ ID NO: 2317749 - RNA, 19 nt, Human
ugaucuggaacccagacuc

SEQ ID NO: 2317750 - RNA, 18 nt, Human
ugaucuggaacccagacu

SEQ ID NO: 2317751 - RNA, 17 nt, Human
ugaucucucgugauuga

SEQ ID NO: 2317752 - RNA, 17 nt, Human
ugaucuggaacccagac

SEQ ID NO: 2317753 - RNA, 15 nt, Human
ugaucuggaacccag

SEQ ID NO: 2317754 - RNA, 17 nt, Human
ugauccacccaccucag

SEQ ID NO: 2317755 - RNA, 18 nt, Human
ugauccacccaccucagc

SEQ ID NO: 2317756 - RNA, 19 nt, Human
ugauccacccaccucagcc

SEQ ID NO: 2317757 - RNA, 14 nt, Human
ugaucucagguucu

SEQ ID NO: 2317758 - RNA, 15 nt, Human
ugaucucauuuaauc

SEQ ID NO: 2317759 - RNA, 14 nt, Human
ugaugccucccugu

SEQ ID NO: 2317760 - RNA, 21 nt, Human
ugaugcauuaaaagaaaauaa

SEQ ID NO: 2317761 - RNA, 19 nt, Human
ugaugcauuaaaagaaaau

SEQ ID NO: 2317762 - RNA, 18 nt, Human
ugaugcauuaaaagaaaa

SEQ ID NO: 2317763 - RNA, 17 nt, Human
ugaugcauuaaaagaaa

SEQ ID NO: 2317764 - RNA, 23 nt, Human
ugaugcaugcacuguucccccug

SEQ ID NO: 2317765 - RNA, 18 nt, Human
ugaugcaugcacuguucc

SEQ ID NO: 2317766 - RNA, 17 nt, Human
ugaugcaugcacuguuc

SEQ ID NO: 2317767 - RNA, 18 nt, Human
ugaucuuugcagacaggc

SEQ ID NO: 2317768 - RNA, 16 nt, Human
ugaugaugugccuggg

SEQ ID NO: 2317769 - RNA, 19 nt, Human
ugaucuuucuuuccuuucu

SEQ ID NO: 2317770 - RNA, 16 nt, Human
ugaucuuugcagacag

SEQ ID NO: 2317771 - RNA, 17 nt, Human
ugaucuuuaaaauacac

SEQ ID NO: 2317772 - RNA, 16 nt, Human
ugaugcuaaauaggag

SEQ ID NO: 2317773 - RNA, 11 nt, Human
ugaugcuaaau

SEQ ID NO: 2317774 - RNA, 12 nt, Human
ugaugcugggau

SEQ ID NO: 2317775 - RNA, 13 nt, Human
ugaugcugggcug

SEQ ID NO: 2317776 - RNA, 14 nt, Human
ugaugcugggcugg

SEQ ID NO: 2317777 - RNA, 15 nt, Human
ugaugcugggcuggg

SEQ ID NO: 2317778 - RNA, 21 nt, Human
ugaugccugugaacugaacuc

SEQ ID NO: 2317779 - RNA, 23 nt, Human
ugaugcuacaggauuugaaauug

SEQ ID NO: 2317780 - RNA, 20 nt, Human
ugaugcuacaggauuugaaa

SEQ ID NO: 2317781 - RNA, 20 nt, Human
ugaugccugugaacugaacu

SEQ ID NO: 2317782 - RNA, 15 nt, Human
ugaugccugugaacu

SEQ ID NO: 2317783 - RNA, 11 nt, Human
ugaugccuggc

SEQ ID NO: 2317784 - RNA, 18 nt, Human
ugaugugggucaaggaau

SEQ ID NO: 2317785 - RNA, 15 nt, Human
ugauguccagaagaa

SEQ ID NO: 2317786 - RNA, 23 nt, Human
ugauguccagaagaauauucagg

SEQ ID NO: 2317787 - RNA, 19 nt, Human
ugaugucccaacuuguaaa

SEQ ID NO: 2317788 - RNA, 17 nt, Human
ugaugucaucugucacu

SEQ ID NO: 2317789 - RNA, 12 nt, Human
ugauguccagaa

SEQ ID NO: 2317790 - RNA, 13 nt, Human
ugauguccagaag

SEQ ID NO: 2317791 - RNA, 23 nt, Human
ugaugucaauuucuguguugcca

SEQ ID NO: 2317792 - RNA, 18 nt, Human
ugaugucaauuucugugu

SEQ ID NO: 2317793 - RNA, 19 nt, Human
ugaugucaauuucuguguu

SEQ ID NO: 2317794 - RNA, 16 nt, Human
ugauguguuaucucuu

SEQ ID NO: 2317795 - RNA, 15 nt, Human
ugauguggugccuga

SEQ ID NO: 2317796 - RNA, 20 nt, Human
ugauguggugaggcaggcuu

SEQ ID NO: 2317797 - RNA, 16 nt, Human
ugauguggugccugag

SEQ ID NO: 2317798 - RNA, 13 nt, Human
ugauguguacauc

SEQ ID NO: 2317799 - RNA, 14 nt, Human
ugauguuaaaauuc

SEQ ID NO: 2317800 - RNA, 23 nt, Human
ugauguguugugauagcuaacau

SEQ ID NO: 2317801 - RNA, 14 nt, Human
ugauguguuuauuu

SEQ ID NO: 2317802 - RNA, 18 nt, Human
ugauguguuuauuuauag

SEQ ID NO: 2317803 - RNA, 20 nt, Human
ugaugcugugcuaugaauuu

SEQ ID NO: 2317804 - RNA, 22 nt, Human
ugaugguguuuuggggaugaga

SEQ ID NO: 2317805 - RNA, 14 nt, Human
ugaugguuccccug

SEQ ID NO: 2317806 - RNA, 13 nt, Human
ugaugguuguaca

SEQ ID NO: 2317807 - RNA, 17 nt, Human
ugaugguucguucuguu

SEQ ID NO: 2317808 - RNA, 17 nt, Human
ugaugucaauuucugug

SEQ ID NO: 2317809 - RNA, 14 nt, Human
ugaugguuguacau

SEQ ID NO: 2317810 - RNA, 16 nt, Human
ugaugcuucuucagag

SEQ ID NO: 2317811 - RNA, 17 nt, Human
ugaugcuucuucagaga

SEQ ID NO: 2317812 - RNA, 20 nt, Human
ugaugcugggcugggugcga

SEQ ID NO: 2317813 - RNA, 16 nt, Human
ugaugcugggcugggu

SEQ ID NO: 2317814 - RNA, 18 nt, Human
ugaugcugggcugggugc

SEQ ID NO: 2317815 - RNA, 18 nt, Human
ugaugcuucuucagagac

SEQ ID NO: 2317816 - RNA, 15 nt, Human
ugauggugguauguu

SEQ ID NO: 2317817 - RNA, 17 nt, Human
ugauucacugcauggcu

SEQ ID NO: 2317818 - RNA, 14 nt, Human
ugauucagaaauug

SEQ ID NO: 2317819 - RNA, 22 nt, Human
ugauucacccccaaacagugac

SEQ ID NO: 2317820 - RNA, 12 nt, Human
ugauucacugca

SEQ ID NO: 2317821 - RNA, 13 nt, Human
ugauucacugcau

SEQ ID NO: 2317822 - RNA, 12 nt, Human
ugauucacagug

SEQ ID NO: 2317823 - RNA, 21 nt, Human
ugauucaauucaacacucccu

SEQ ID NO: 2317824 - RNA, 13 nt, Human
ugauucagacagc

SEQ ID NO: 2317825 - RNA, 14 nt, Human
ugauucagacagcu

SEQ ID NO: 2317826 - RNA, 15 nt, Human
ugauucagacagcug

SEQ ID NO: 2317827 - RNA, 16 nt, Human
ugauucagacagcugc

SEQ ID NO: 2317828 - RNA, 18 nt, Human
ugauuauucugauuccac

SEQ ID NO: 2317829 - RNA, 13 nt, Human
ugauuauuguauu

SEQ ID NO: 2317830 - RNA, 15 nt, Human
ugauuauuguauuua

SEQ ID NO: 2317831 - RNA, 18 nt, Human
ugauuauuguauuuauuc

SEQ ID NO: 2317832 - RNA, 16 nt, Human
ugauuauuuauuauuu

SEQ ID NO: 2317833 - RNA, 16 nt, Human
ugauuauucaguguca

SEQ ID NO: 2317834 - RNA, 14 nt, Human
ugauuauucagugu

SEQ ID NO: 2317835 - RNA, 16 nt, Human
ugauuauuacuggcaa

SEQ ID NO: 2317836 - RNA, 21 nt, Human
ugauuaugaauuacauuugua

SEQ ID NO: 2317837 - RNA, 22 nt, Human
ugauuaugaauuacauuuguau

SEQ ID NO: 2317838 - RNA, 20 nt, Human
ugauucaacagguuuuccug

SEQ ID NO: 2317839 - RNA, 15 nt, Human
ugauuauuucacuuu

SEQ ID NO: 2317840 - RNA, 16 nt, Human
ugauuauuucacuuua

SEQ ID NO: 2317841 - RNA, 23 nt, Human
ugauuauuucacuuuagaugcug

SEQ ID NO: 2317842 - RNA, 23 nt, Human
ugauucaacuaaaaaaaaaaaag

SEQ ID NO: 2317843 - RNA, 14 nt, Human
ugauucaacuaaaa

SEQ ID NO: 2317844 - RNA, 14 nt, Human
ugauuauuuucaag

SEQ ID NO: 2317845 - RNA, 17 nt, Human
ugauucaaucuguaaac

SEQ ID NO: 2317846 - RNA, 16 nt, Human
ugauucaaucuguaaa

SEQ ID NO: 2317847 - RNA, 12 nt, Human
ugauucaauuca

SEQ ID NO: 2317848 - RNA, 23 nt, Human
ugauucaaucuguaaacugugua

SEQ ID NO: 2317849 - RNA, 22 nt, Human
ugauucaaucuguaaacugugu

SEQ ID NO: 2317850 - RNA, 21 nt, Human
ugauucaaucuguaaacugug

SEQ ID NO: 2317851 - RNA, 16 nt, Human
ugauuacucuuugaga

SEQ ID NO: 2317852 - RNA, 14 nt, Human
ugauuacucuuuga

SEQ ID NO: 2317853 - RNA, 15 nt, Human
ugauguuggcuggga

SEQ ID NO: 2317854 - RNA, 16 nt, Human
ugauguuggcugggaa

SEQ ID NO: 2317855 - RNA, 13 nt, Human
ugauguuggaaga

SEQ ID NO: 2317856 - RNA, 14 nt, Human
ugauguuggcuggg

SEQ ID NO: 2317857 - RNA, 16 nt, Human
ugauuaccagggacug

SEQ ID NO: 2317858 - RNA, 17 nt, Human
ugauguugagggaacag

SEQ ID NO: 2317859 - RNA, 22 nt, Human
ugauguuuagaaacacaacuau

SEQ ID NO: 2317860 - RNA, 13 nt, Human
ugauguucagugu

SEQ ID NO: 2317861 - RNA, 14 nt, Human
ugauguucagugua

SEQ ID NO: 2317862 - RNA, 15 nt, Human
ugauguucaguguaa

SEQ ID NO: 2317863 - RNA, 16 nt, Human
ugauguucaguguaau

SEQ ID NO: 2317864 - RNA, 22 nt, Human
ugauguuaaccagaauaaaguu

SEQ ID NO: 2317865 - RNA, 22 nt, Human
ugauguuaacacauuuuguaua

SEQ ID NO: 2317866 - RNA, 20 nt, Human
ugauguuaacacauuuugua

SEQ ID NO: 2317867 - RNA, 21 nt, Human
ugauguuaacacauuuuguau

SEQ ID NO: 2317868 - RNA, 10 nt, Human
ugauguuaac

SEQ ID NO: 2317869 - RNA, 11 nt, Human
ugauguuaaca

SEQ ID NO: 2317870 - RNA, 17 nt, Human
ugauguuaaaauuccau

SEQ ID NO: 2317871 - RNA, 16 nt, Human
ugauguuaaaauucca

SEQ ID NO: 2317872 - RNA, 15 nt, Human
ugauguuaacacauu

SEQ ID NO: 2317873 - RNA, 16 nt, Human
ugauguuaacacauuu

SEQ ID NO: 2317874 - RNA, 17 nt, Human
ugauguuaacacauuuu

SEQ ID NO: 2317875 - RNA, 18 nt, Human
ugauguuaacacauuuug

SEQ ID NO: 2317876 - RNA, 20 nt, Human
ugauguucuuucacccuuuu

SEQ ID NO: 2317877 - RNA, 21 nt, Human
ugauguucaguguaauuucuu

SEQ ID NO: 2317878 - RNA, 18 nt, Human
ugauguucaguguaauuu

SEQ ID NO: 2317879 - RNA, 20 nt, Human
ugauguucaguguaauuucu

SEQ ID NO: 2317880 - RNA, 13 nt, Human
ugauuacugucaa

SEQ ID NO: 2317881 - RNA, 24 nt, Human
ugauuacugucaaggcugcuuaga

SEQ ID NO: 2317882 - RNA, 21 nt, Human
ugauuagaaggcaaguuucua

SEQ ID NO: 2317883 - RNA, 13 nt, Human
ugauuagcaaguu

SEQ ID NO: 2317884 - RNA, 11 nt, Human
ugauuagauga

SEQ ID NO: 2317885 - RNA, 17 nt, Human
ugauuaguaaagaaaug

SEQ ID NO: 2317886 - RNA, 16 nt, Human
ugauuaguaaagaaau

SEQ ID NO: 2317887 - RNA, 18 nt, Human
ugauuagcaaguuacagu

SEQ ID NO: 2317888 - RNA, 13 nt, Human
ugauuauauguca

SEQ ID NO: 2317889 - RNA, 17 nt, Human
ugauuaugaauuacauu

SEQ ID NO: 2317890 - RNA, 19 nt, Human
ugauuaugaauuacauuug

SEQ ID NO: 2317891 - RNA, 20 nt, Human
ugauuggcaggaguuggaag

SEQ ID NO: 2317892 - RNA, 16 nt, Human
ugauuggauuauucau

SEQ ID NO: 2317893 - RNA, 17 nt, Human
ugauuggauuauucauu

SEQ ID NO: 2317894 - RNA, 18 nt, Human
ugauuggauuauucauuu

SEQ ID NO: 2317895 - RNA, 19 nt, Human
ugauuggauuauucauuua

SEQ ID NO: 2317896 - RNA, 12 nt, Human
ugauuggcucac

SEQ ID NO: 2317897 - RNA, 21 nt, Human
ugauuggauuauucauuuaaa

SEQ ID NO: 2317898 - RNA, 16 nt, Human
ugauuggcauauaaug

SEQ ID NO: 2317899 - RNA, 12 nt, Human
ugauugggaaua

SEQ ID NO: 2317900 - RNA, 16 nt, Human
ugauugggaauaaaua

SEQ ID NO: 2317901 - RNA, 17 nt, Human
ugauugggaauaaauau

SEQ ID NO: 2317902 - RNA, 18 nt, Human
ugauugggaauaaauaug

SEQ ID NO: 2317903 - RNA, 20 nt, Human
ugauugggaauaaauaugcc

SEQ ID NO: 2317904 - RNA, 21 nt, Human
ugauugggaauaaauaugccu

SEQ ID NO: 2317905 - RNA, 22 nt, Human
ugauugggacuggggcugaagg

SEQ ID NO: 2317906 - RNA, 15 nt, Human
ugauugggacagagg

SEQ ID NO: 2317907 - RNA, 17 nt, Human
ugauugggacagagguu

SEQ ID NO: 2317908 - RNA, 13 nt, Human
ugauuggaggggg

SEQ ID NO: 2317909 - RNA, 23 nt, Human
ugauuggacauuuucuucagaga

SEQ ID NO: 2317910 - RNA, 14 nt, Human
ugauuggauuauuc

SEQ ID NO: 2317911 - RNA, 15 nt, Human
ugauuggauuauuca

SEQ ID NO: 2317912 - RNA, 21 nt, Human
ugauuggaggggggagguggg

SEQ ID NO: 2317913 - RNA, 22 nt, Human
ugauuguaacguugcuguggga

SEQ ID NO: 2317914 - RNA, 23 nt, Human
ugauuguaacguugcugugggaa

SEQ ID NO: 2317915 - RNA, 18 nt, Human
ugauuguaacguugcugu

SEQ ID NO: 2317916 - RNA, 19 nt, Human
ugauuguaacguugcugug

SEQ ID NO: 2317917 - RNA, 20 nt, Human
ugauuguaacguugcugugg

SEQ ID NO: 2317918 - RNA, 21 nt, Human
ugauuguaacguugcuguggg

SEQ ID NO: 2317919 - RNA, 14 nt, Human
ugauugucagcuac

SEQ ID NO: 2317920 - RNA, 18 nt, Human
ugauuguggaauggagau

SEQ ID NO: 2317921 - RNA, 14 nt, Human
ugauuguggaaugg

SEQ ID NO: 2317922 - RNA, 21 nt, Human
ugauuggugcaacccuuaccc

SEQ ID NO: 2317923 - RNA, 19 nt, Human
ugauuggugcaacccuuac

SEQ ID NO: 2317924 - RNA, 17 nt, Human
ugauuggugcaacccuu

SEQ ID NO: 2317925 - RNA, 12 nt, Human
ugauuguaaaau

SEQ ID NO: 2317926 - RNA, 14 nt, Human
ugauuguaaaauag

SEQ ID NO: 2317927 - RNA, 17 nt, Human
ugauuguaaaauagcuu

SEQ ID NO: 2317928 - RNA, 23 nt, Human
ugauuguaaaauagcuuguauag

SEQ ID NO: 2317929 - RNA, 17 nt, Human
ugauuguaacguugcug

SEQ ID NO: 2317930 - RNA, 19 nt, Human
ugauuguuaauuuacagcu

SEQ ID NO: 2317931 - RNA, 21 nt, Human
ugauuguggaauggagauuca

SEQ ID NO: 2317932 - RNA, 19 nt, Human
ugauuguucgggugugcaa

SEQ ID NO: 2317933 - RNA, 14 nt, Human
ugauuguuggcaca

SEQ ID NO: 2317934 - RNA, 18 nt, Human
ugauuguucgggugugca

SEQ ID NO: 2317935 - RNA, 16 nt, Human
ugauugugucucuugg

SEQ ID NO: 2317936 - RNA, 16 nt, Human
ugauuguuugcucuga

SEQ ID NO: 2317937 - RNA, 14 nt, Human
ugauuuaaaacaug

SEQ ID NO: 2317938 - RNA, 15 nt, Human
ugauuuaaaacaugu

SEQ ID NO: 2317939 - RNA, 16 nt, Human
ugauuuaaaacaugua

SEQ ID NO: 2317940 - RNA, 13 nt, Human
ugauucugugugu

SEQ ID NO: 2317941 - RNA, 19 nt, Human
ugauucugcuuuuaccaug

SEQ ID NO: 2317942 - RNA, 13 nt, Human
ugauucugccuuu

SEQ ID NO: 2317943 - RNA, 12 nt, Human
ugauucugccuu

SEQ ID NO: 2317944 - RNA, 16 nt, Human
ugauucagaaauugga

SEQ ID NO: 2317945 - RNA, 23 nt, Human
ugauucuccuucagcccucaccc

SEQ ID NO: 2317946 - RNA, 22 nt, Human
ugauucugcaguaaaucuuuua

SEQ ID NO: 2317947 - RNA, 16 nt, Human
ugauucugcaguaaau

SEQ ID NO: 2317948 - RNA, 15 nt, Human
ugauucuugaguuua

SEQ ID NO: 2317949 - RNA, 17 nt, Human
ugauucugcuuuuacca

SEQ ID NO: 2317950 - RNA, 15 nt, Human
ugauucuguguguuu

SEQ ID NO: 2317951 - RNA, 19 nt, Human
ugauucuuuguuacaggca

SEQ ID NO: 2317952 - RNA, 18 nt, Human
ugauucuuuuuaaagugu

SEQ ID NO: 2317953 - RNA, 14 nt, Human
ugauucuuuguuac

SEQ ID NO: 2317954 - RNA, 20 nt, Human
ugauucuugaguuuagugau

SEQ ID NO: 2317955 - RNA, 23 nt, Human
ugauucuuuuuaaaguguuucug

SEQ ID NO: 2317956 - RNA, 22 nt, Human
ugauugaaaauaguaaaugcuu

SEQ ID NO: 2317957 - RNA, 22 nt, Human
ugauugcuaaauguaacagucu

SEQ ID NO: 2317958 - RNA, 19 nt, Human
ugauugcuaaauguaacag

SEQ ID NO: 2317959 - RNA, 20 nt, Human
ugauugcuaaauguaacagu

SEQ ID NO: 2317960 - RNA, 13 nt, Human
ugauugcuaaaug

SEQ ID NO: 2317961 - RNA, 14 nt, Human
ugauugcuaaaugu

SEQ ID NO: 2317962 - RNA, 15 nt, Human
ugauugcuaaaugua

SEQ ID NO: 2317963 - RNA, 16 nt, Human
ugauugcuaaauguaa

SEQ ID NO: 2317964 - RNA, 18 nt, Human
ugauugccaagcucagga

SEQ ID NO: 2317965 - RNA, 22 nt, Human
ugauugaaucugauuggacauu

SEQ ID NO: 2317966 - RNA, 13 nt, Human
ugauugacagcuu

SEQ ID NO: 2317967 - RNA, 12 nt, Human
ugauugacagcu

SEQ ID NO: 2317968 - RNA, 19 nt, Human
ugauugacagcuuugcugc

SEQ ID NO: 2317969 - RNA, 17 nt, Human
ugauugacagcuuugcu

SEQ ID NO: 2317970 - RNA, 14 nt, Human
ugauugauuugaag

SEQ ID NO: 2317971 - RNA, 21 nt, Human
ugauugacagcuuugcugcug

SEQ ID NO: 2317972 - RNA, 17 nt, Human
ugauugagaguaacuua

SEQ ID NO: 2317973 - RNA, 12 nt, Human
ugauugauuuga

SEQ ID NO: 2317974 - RNA, 21 nt, Human
ugauucuccugccucagccuc

SEQ ID NO: 2317975 - RNA, 23 nt, Human
ugauucagacagcugccugggau

SEQ ID NO: 2317976 - RNA, 12 nt, Human
ugauucuccuuc

SEQ ID NO: 2317977 - RNA, 13 nt, Human
ugauucuccuuca

SEQ ID NO: 2317978 - RNA, 14 nt, Human
ugauucuccuucag

SEQ ID NO: 2317979 - RNA, 16 nt, Human
ugauucuccuucagcc

SEQ ID NO: 2317980 - RNA, 18 nt, Human
ugauucuccuucagcccu

SEQ ID NO: 2317981 - RNA, 19 nt, Human
ugauucuccuucagcccuc

SEQ ID NO: 2317982 - RNA, 21 nt, Human
ugauucuccuucagcccucac

SEQ ID NO: 2317983 - RNA, 18 nt, Human
ugauucagacagcugccu

SEQ ID NO: 2317984 - RNA, 19 nt, Human
ugauucagacagcugccug

SEQ ID NO: 2317985 - RNA, 20 nt, Human
ugauucagacagcugccugg

SEQ ID NO: 2317986 - RNA, 21 nt, Human
ugauucagacagcugccuggg

SEQ ID NO: 2317987 - RNA, 19 nt, Human
ugaaucuuuccaauaaacc

SEQ ID NO: 2317988 - RNA, 24 nt, Human
ugaaucuugucucaaugcucauaa

SEQ ID NO: 2317989 - RNA, 17 nt, Human
ugaauccaugcuugggu

SEQ ID NO: 2317990 - RNA, 14 nt, Human
ugaauccaugcuug

SEQ ID NO: 2317991 - RNA, 20 nt, Human
ugaaucccacccacauguga

SEQ ID NO: 2317992 - RNA, 16 nt, Human
ugaauccaaacuaauc

SEQ ID NO: 2317993 - RNA, 15 nt, Human
ugaauccaaacuaau

SEQ ID NO: 2317994 - RNA, 22 nt, Human
ugaaugaaaaauuuaagcauug

SEQ ID NO: 2317995 - RNA, 21 nt, Human
ugaaugaaaaauuuaagcauu

SEQ ID NO: 2317996 - RNA, 20 nt, Human
ugaaugaaaaauuuaagcau

SEQ ID NO: 2317997 - RNA, 19 nt, Human
ugaaugaaaaauuuaagca

SEQ ID NO: 2317998 - RNA, 18 nt, Human
ugaaugaaaaauuuaagc

SEQ ID NO: 2317999 - RNA, 17 nt, Human
ugaaugaaaaauuuaag

SEQ ID NO: 2318000 - RNA, 16 nt, Human
ugaaugaaaaauuuaa

SEQ ID NO: 2318001 - RNA, 11 nt, Human
ugaaugaaaaa

SEQ ID NO: 2318002 - RNA, 20 nt, Human
ugaaugaaacccccacacac

SEQ ID NO: 2318003 - RNA, 19 nt, Human
ugaaugaaacccccacaca

SEQ ID NO: 2318004 - RNA, 18 nt, Human
ugaaugaaacccccacac

SEQ ID NO: 2318005 - RNA, 16 nt, Human
ugaaugaaacccccac

SEQ ID NO: 2318006 - RNA, 14 nt, Human
ugaauaaagacacc

SEQ ID NO: 2318007 - RNA, 15 nt, Human
ugaauaaagacaccu

SEQ ID NO: 2318008 - RNA, 21 nt, Human
ugaaucauguaguaucaaaua

SEQ ID NO: 2318009 - RNA, 18 nt, Human
ugaaucauguaguaucaa

SEQ ID NO: 2318010 - RNA, 19 nt, Human
ugaaucauguaguaucaaa

SEQ ID NO: 2318011 - RNA, 12 nt, Human
ugaaucauguag

SEQ ID NO: 2318012 - RNA, 14 nt, Human
ugaaucauguagua

SEQ ID NO: 2318013 - RNA, 22 nt, Human
ugaaucauuuuaccuuugacaa

SEQ ID NO: 2318014 - RNA, 23 nt, Human
ugaaucauuuuaccuuugacaaa

SEQ ID NO: 2318015 - RNA, 12 nt, Human
ugaauguucuga

SEQ ID NO: 2318016 - RNA, 23 nt, Human
ugaauguuauuuguuauuuucag

SEQ ID NO: 2318017 - RNA, 14 nt, Human
ugaauguuauuugu

SEQ ID NO: 2318018 - RNA, 15 nt, Human
ugaauguuauuuguu

SEQ ID NO: 2318019 - RNA, 20 nt, Human
ugaauguuaaauaaauugua

SEQ ID NO: 2318020 - RNA, 21 nt, Human
ugaauguuaaauaaauuguau

SEQ ID NO: 2318021 - RNA, 13 nt, Human
ugaauguuaaaua

SEQ ID NO: 2318022 - RNA, 15 nt, Human
ugaauguuaaauaaa

SEQ ID NO: 2318023 - RNA, 16 nt, Human
ugaauguuaaauaaau

SEQ ID NO: 2318024 - RNA, 18 nt, Human
ugaauguuaaauaaauug

SEQ ID NO: 2318025 - RNA, 18 nt, Human
ugaaugaucucucugaau

SEQ ID NO: 2318026 - RNA, 15 nt, Human
ugaaugaucucucug

SEQ ID NO: 2318027 - RNA, 22 nt, Human
ugaaugaggucccaggcagaga

SEQ ID NO: 2318028 - RNA, 11 nt, Human
ugaauguuaaa

SEQ ID NO: 2318029 - RNA, 14 nt, Human
ugaaugaaauauca

SEQ ID NO: 2318030 - RNA, 22 nt, Human
ugaaugaaacccccacacacac

SEQ ID NO: 2318031 - RNA, 21 nt, Human
ugaaugaaacccccacacaca

SEQ ID NO: 2318032 - RNA, 19 nt, Human
ugaaugaggucccaggcag

SEQ ID NO: 2318033 - RNA, 18 nt, Human
ugaaugaggucccaggca

SEQ ID NO: 2318034 - RNA, 17 nt, Human
ugaaugaggucccaggc

SEQ ID NO: 2318035 - RNA, 22 nt, Human
ugaaugaggucagcaugucuau

SEQ ID NO: 2318036 - RNA, 17 nt, Human
ugaaugacaacagaagc

SEQ ID NO: 2318037 - RNA, 15 nt, Human
ugaaugacaaagagu

SEQ ID NO: 2318038 - RNA, 15 nt, Human
ugaaugacaacagaa

SEQ ID NO: 2318039 - RNA, 14 nt, Human
ugaaugagaaucua

SEQ ID NO: 2318040 - RNA, 20 nt, Human
ugaauugaggggauuaauau

SEQ ID NO: 2318041 - RNA, 17 nt, Human
ugaauucuuaugcuuau

SEQ ID NO: 2318042 - RNA, 21 nt, Human
ugaauucuugguugaggaaac

SEQ ID NO: 2318043 - RNA, 22 nt, Human
ugaauucuugguugaggaaaca

SEQ ID NO: 2318044 - RNA, 12 nt, Human
ugaauucagauu

SEQ ID NO: 2318045 - RNA, 17 nt, Human
ugaauucagauuuuaaa

SEQ ID NO: 2318046 - RNA, 19 nt, Human
ugaauucugcaauguuuuc

SEQ ID NO: 2318047 - RNA, 20 nt, Human
ugaauucuugguugaggaaa

SEQ ID NO: 2318048 - RNA, 15 nt, Human
ugaauuaucuauaca

SEQ ID NO: 2318049 - RNA, 21 nt, Human
ugaauuaucuugguugaaaau

SEQ ID NO: 2318050 - RNA, 16 nt, Human
ugaauuauuuucucuc

SEQ ID NO: 2318051 - RNA, 23 nt, Human
ugaauguucugacauuaacaguu

SEQ ID NO: 2318052 - RNA, 20 nt, Human
ugaauguucugacauuaaca

SEQ ID NO: 2318053 - RNA, 18 nt, Human
ugaauguucugacauuaa

SEQ ID NO: 2318054 - RNA, 17 nt, Human
ugaauguucugacauua

SEQ ID NO: 2318055 - RNA, 16 nt, Human
ugaauguucugacauu

SEQ ID NO: 2318056 - RNA, 15 nt, Human
ugaauguucugacau

SEQ ID NO: 2318057 - RNA, 14 nt, Human
ugaauguucugaca

SEQ ID NO: 2318058 - RNA, 15 nt, Human
ugaauuacauuugua

SEQ ID NO: 2318059 - RNA, 16 nt, Human
ugaauuacauuuguau

SEQ ID NO: 2318060 - RNA, 18 nt, Human
ugaauuacauuuguauaa

SEQ ID NO: 2318061 - RNA, 21 nt, Human
ugaauguucugacauuaacag

SEQ ID NO: 2318062 - RNA, 21 nt, Human
ugaauguugucuguuuguucu

SEQ ID NO: 2318063 - RNA, 19 nt, Human
ugaauuagaaacauaaaua

SEQ ID NO: 2318064 - RNA, 21 nt, Human
ugaauuagaaacauaaauaaa

SEQ ID NO: 2318065 - RNA, 23 nt, Human
ugaauuagaaacauaaauaaaau

SEQ ID NO: 2318066 - RNA, 14 nt, Human
ugaauuagcucacu

SEQ ID NO: 2318067 - RNA, 16 nt, Human
ugaauuaguccuugcu

SEQ ID NO: 2318068 - RNA, 15 nt, Human
ugaaguuguuacuaa

SEQ ID NO: 2318069 - RNA, 20 nt, Human
ugaauaaaaacuuugcuaaa

SEQ ID NO: 2318070 - RNA, 14 nt, Human
ugaauaaaaacuuu

SEQ ID NO: 2318071 - RNA, 18 nt, Human
ugaaguuguuacuaacua

SEQ ID NO: 2318072 - RNA, 20 nt, Human
ugaaguuguuacuaacuaaa

SEQ ID NO: 2318073 - RNA, 22 nt, Human
ugaaguuguuacuaacuaaacu

SEQ ID NO: 2318074 - RNA, 13 nt, Human
ugaauaaaauuau

SEQ ID NO: 2318075 - RNA, 19 nt, Human
ugaauaaaauuauuccuuu

SEQ ID NO: 2318076 - RNA, 21 nt, Human
ugaauaaaaacuuugcuaaau

SEQ ID NO: 2318077 - RNA, 19 nt, Human
ugaauaaaaauauguacaa

SEQ ID NO: 2318078 - RNA, 14 nt, Human
ugaauaaaaaugca

SEQ ID NO: 2318079 - RNA, 15 nt, Human
ugaauaaaaaugcac

SEQ ID NO: 2318080 - RNA, 20 nt, Human
ugaauaaacuagauuacauu

SEQ ID NO: 2318081 - RNA, 15 nt, Human
ugaauaaaauuauuu

SEQ ID NO: 2318082 - RNA, 20 nt, Human
ugaauaaaauuauuuuggau

SEQ ID NO: 2318083 - RNA, 14 nt, Human
ugaaguuaacagag

SEQ ID NO: 2318084 - RNA, 14 nt, Human
ugaaguuagaauuc

SEQ ID NO: 2318085 - RNA, 15 nt, Human
ugaaguuagaauucc

SEQ ID NO: 2318086 - RNA, 16 nt, Human
ugaaguucaccauuaa

SEQ ID NO: 2318087 - RNA, 19 nt, Human
ugaaguuagaauuccuuca

SEQ ID NO: 2318088 - RNA, 21 nt, Human
ugaaguuagaauuccuucagg

SEQ ID NO: 2318089 - RNA, 16 nt, Human
ugaaguguguuuccuu

SEQ ID NO: 2318090 - RNA, 19 nt, Human
ugaaguguaggcagacaca

SEQ ID NO: 2318091 - RNA, 16 nt, Human
ugaaguguaggcagac

SEQ ID NO: 2318092 - RNA, 17 nt, Human
ugaaguguaggcagaca

SEQ ID NO: 2318093 - RNA, 18 nt, Human
ugaaguguaggcagacac

SEQ ID NO: 2318094 - RNA, 22 nt, Human
ugaaguguguuuccuucagugc

SEQ ID NO: 2318095 - RNA, 18 nt, Human
ugaaguguguuuccuuca

SEQ ID NO: 2318096 - RNA, 20 nt, Human
ugaaguguuuuguucuuucu

SEQ ID NO: 2318097 - RNA, 17 nt, Human
ugaaguguuaauacuag

SEQ ID NO: 2318098 - RNA, 23 nt, Human
ugaaguguuaauacuaguuguga

SEQ ID NO: 2318099 - RNA, 16 nt, Human
ugaagugcauccaaag

SEQ ID NO: 2318100 - RNA, 18 nt, Human
ugaagugcauccaaaggu

SEQ ID NO: 2318101 - RNA, 18 nt, Human
ugaagugagcacagccua

SEQ ID NO: 2318102 - RNA, 23 nt, Human
ugaagugagcugagauugcacca

SEQ ID NO: 2318103 - RNA, 12 nt, Human
ugaagugaaacu

SEQ ID NO: 2318104 - RNA, 13 nt, Human
ugaagugaaacug

SEQ ID NO: 2318105 - RNA, 14 nt, Human
ugaagugaaacugc

SEQ ID NO: 2318106 - RNA, 17 nt, Human
ugaagugagcacagccu

SEQ ID NO: 2318107 - RNA, 13 nt, Human
ugaaguccaagca

SEQ ID NO: 2318108 - RNA, 16 nt, Human
ugaagucagauguggu

SEQ ID NO: 2318109 - RNA, 14 nt, Human
ugaagucagaugug

SEQ ID NO: 2318110 - RNA, 11 nt, Human
ugaaguccaag

SEQ ID NO: 2318111 - RNA, 18 nt, Human
ugaaggcagaaagcaaaa

SEQ ID NO: 2318112 - RNA, 17 nt, Human
ugaaggccccgcccagg

SEQ ID NO: 2318113 - RNA, 16 nt, Human
ugaaggagagcccuuc

SEQ ID NO: 2318114 - RNA, 10 nt, Human
ugaaggacug

SEQ ID NO: 2318115 - RNA, 12 nt, Human
ugaaggacugug

SEQ ID NO: 2318116 - RNA, 14 nt, Human
ugaaggacugugac

SEQ ID NO: 2318117 - RNA, 15 nt, Human
ugaaggcagaaagca

SEQ ID NO: 2318118 - RNA, 23 nt, Human
ugaaggacugugacaggcagcag

SEQ ID NO: 2318119 - RNA, 14 nt, Human
ugaaggcaaugcca

SEQ ID NO: 2318120 - RNA, 18 nt, Human
ugaaggcaaaauugcaaa

SEQ ID NO: 2318121 - RNA, 15 nt, Human
ugaaggccccgccca

SEQ ID NO: 2318122 - RNA, 16 nt, Human
ugaaggccccgcccag

SEQ ID NO: 2318123 - RNA, 22 nt, Human
ugaaggacauugcggacagcca

SEQ ID NO: 2318124 - RNA, 20 nt, Human
ugaaggacacuuccugccua

SEQ ID NO: 2318125 - RNA, 12 nt, Human
ugaaggacccuu

SEQ ID NO: 2318126 - RNA, 18 nt, Human
ugaaggacacuuccugcc

SEQ ID NO: 2318127 - RNA, 19 nt, Human
ugaaggacacuuccugccu

SEQ ID NO: 2318128 - RNA, 19 nt, Human
ugaaggacauugcggacag

SEQ ID NO: 2318129 - RNA, 20 nt, Human
ugaaggacauugcggacagc

SEQ ID NO: 2318130 - RNA, 20 nt, Human
ugaaggaauaaauugcuccu

SEQ ID NO: 2318131 - RNA, 13 nt, Human
ugaaggaauauau

SEQ ID NO: 2318132 - RNA, 14 nt, Human
ugaaggaauauaug

SEQ ID NO: 2318133 - RNA, 15 nt, Human
ugaaggaauauaugg

SEQ ID NO: 2318134 - RNA, 20 nt, Human
ugaaggaauauauggcagag

SEQ ID NO: 2318135 - RNA, 21 nt, Human
ugaaggaauauauggcagagu

SEQ ID NO: 2318136 - RNA, 22 nt, Human
ugaaggaauauauggcagaguu

SEQ ID NO: 2318137 - RNA, 23 nt, Human
ugaaggaauauauggcagaguug

SEQ ID NO: 2318138 - RNA, 17 nt, Human
ugaacuccuggccucaa

SEQ ID NO: 2318139 - RNA, 16 nt, Human
ugaacucugacaacag

SEQ ID NO: 2318140 - RNA, 14 nt, Human
ugaacuccugggcu

SEQ ID NO: 2318141 - RNA, 14 nt, Human
ugaacucuuaauca

SEQ ID NO: 2318142 - RNA, 23 nt, Human
ugaagauaaguguauuuuucaau

SEQ ID NO: 2318143 - RNA, 21 nt, Human
ugaagauaaguguauuuuuca

SEQ ID NO: 2318144 - RNA, 15 nt, Human
ugaacucuuaaucaa

SEQ ID NO: 2318145 - RNA, 17 nt, Human
ugacccuguauauagcc

SEQ ID NO: 2318146 - RNA, 23 nt, Human
ugacccugcgaaggggcccuggu

SEQ ID NO: 2318147 - RNA, 22 nt, Human
ugacccugcgaaggggcccugg

SEQ ID NO: 2318148 - RNA, 19 nt, Human
ugaccauucuccaccugcc

SEQ ID NO: 2318149 - RNA, 18 nt, Human
ugacccuguauauagccc

SEQ ID NO: 2318150 - RNA, 19 nt, Human
ugacccuguauauagccca

SEQ ID NO: 2318151 - RNA, 20 nt, Human
ugacccuguauauagcccag

SEQ ID NO: 2318152 - RNA, 21 nt, Human
ugacccugcgaaggggcccug

SEQ ID NO: 2318153 - RNA, 20 nt, Human
ugacccuuacagccucugac

SEQ ID NO: 2318154 - RNA, 19 nt, Human
ugaccgaaacagcgcuggg

SEQ ID NO: 2318155 - RNA, 22 nt, Human
ugacccuuacagccucugacuu

SEQ ID NO: 2318156 - RNA, 13 nt, Human
ugaccgugaggcc

SEQ ID NO: 2318157 - RNA, 14 nt, Human
ugaccgugaggcca

SEQ ID NO: 2318158 - RNA, 16 nt, Human
ugaccgugaggccaga

SEQ ID NO: 2318159 - RNA, 20 nt, Human
ugaccgugaggccagagaca

SEQ ID NO: 2318160 - RNA, 16 nt, Human
ugaccauacugaggga

SEQ ID NO: 2318161 - RNA, 21 nt, Human
ugaccaguuuaaccugaugca

SEQ ID NO: 2318162 - RNA, 23 nt, Human
ugaccaguuuaaccugaugcagu

SEQ ID NO: 2318163 - RNA, 20 nt, Human
ugaccaguugcacuuggccu

SEQ ID NO: 2318164 - RNA, 20 nt, Human
ugaccaguuuaaccugaugc

SEQ ID NO: 2318165 - RNA, 16 nt, Human
ugaccauucuccaccu

SEQ ID NO: 2318166 - RNA, 17 nt, Human
ugaccauucuccaccug

SEQ ID NO: 2318167 - RNA, 18 nt, Human
ugaccauucuccaccugc

SEQ ID NO: 2318168 - RNA, 23 nt, Human
ugaccagccuccaugcugccucc

SEQ ID NO: 2318169 - RNA, 19 nt, Human
ugaccagcaacuugucuuu

SEQ ID NO: 2318170 - RNA, 20 nt, Human
ugaccagcaccaucucuccu

SEQ ID NO: 2318171 - RNA, 16 nt, Human
ugaccagucugacccu

SEQ ID NO: 2318172 - RNA, 22 nt, Human
ugaccaggggugauuucagaga

SEQ ID NO: 2318173 - RNA, 15 nt, Human
ugaccagucugaccc

SEQ ID NO: 2318174 - RNA, 20 nt, Human
ugaccaggccugggccagag

SEQ ID NO: 2318175 - RNA, 13 nt, Human
ugaccaggccugg

SEQ ID NO: 2318176 - RNA, 15 nt, Human
ugaccaggccugggc

SEQ ID NO: 2318177 - RNA, 12 nt, Human
ugaccaggccug

SEQ ID NO: 2318178 - RNA, 16 nt, Human
ugaccaggcauccucc

SEQ ID NO: 2318179 - RNA, 22 nt, Human
ugaccacgcuuucuagcuguug

SEQ ID NO: 2318180 - RNA, 20 nt, Human
ugaccacggacguuuccauc

SEQ ID NO: 2318181 - RNA, 21 nt, Human
ugaccacggacguuuccauca

SEQ ID NO: 2318182 - RNA, 22 nt, Human
ugaccacggacguuuccaucag

SEQ ID NO: 2318183 - RNA, 23 nt, Human
ugaccacggacguuuccaucagg

SEQ ID NO: 2318184 - RNA, 15 nt, Human
ugaccacucugucuu

SEQ ID NO: 2318185 - RNA, 19 nt, Human
ugaccagcaccaucucucc

SEQ ID NO: 2318186 - RNA, 20 nt, Human
ugaccacugcagaagacagu

SEQ ID NO: 2318187 - RNA, 21 nt, Human
ugaccacgcuuucuagcuguu

SEQ ID NO: 2318188 - RNA, 18 nt, Human
ugaccacccuccccucuc

SEQ ID NO: 2318189 - RNA, 19 nt, Human
ugaccacccuccccucucu

SEQ ID NO: 2318190 - RNA, 12 nt, Human
ugaccacccucc

SEQ ID NO: 2318191 - RNA, 13 nt, Human
ugaccacccuccc

SEQ ID NO: 2318192 - RNA, 15 nt, Human
ugaccacccuccccu

SEQ ID NO: 2318193 - RNA, 16 nt, Human
ugaccacccuccccuc

SEQ ID NO: 2318194 - RNA, 19 nt, Human
ugaccacagcacagccaac

SEQ ID NO: 2318195 - RNA, 14 nt, Human
ugaccacagcacag

SEQ ID NO: 2318196 - RNA, 22 nt, Human
ugaccacagcaucauuuugcau

SEQ ID NO: 2318197 - RNA, 13 nt, Human
ugaccacaggcag

SEQ ID NO: 2318198 - RNA, 18 nt, Human
ugaccacaggcaguuacu

SEQ ID NO: 2318199 - RNA, 18 nt, Human
ugaccacauagcaugagg

SEQ ID NO: 2318200 - RNA, 21 nt, Human
ugaccacauagcaugaggcca

SEQ ID NO: 2318201 - RNA, 15 nt, Human
ugacaugucuuuucu

SEQ ID NO: 2318202 - RNA, 17 nt, Human
ugaccacagcacagcca

SEQ ID NO: 2318203 - RNA, 16 nt, Human
ugaccacagcacagcc

SEQ ID NO: 2318204 - RNA, 15 nt, Human
ugaccacagcacagc

SEQ ID NO: 2318205 - RNA, 12 nt, Human
ugacaugugaaa

SEQ ID NO: 2318206 - RNA, 13 nt, Human
ugacaugugaaac

SEQ ID NO: 2318207 - RNA, 16 nt, Human
ugacauauuaugucuu

SEQ ID NO: 2318208 - RNA, 16 nt, Human
ugacaugggacauuug

SEQ ID NO: 2318209 - RNA, 17 nt, Human
ugacaugggacauuugc

SEQ ID NO: 2318210 - RNA, 16 nt, Human
ugacaugucccuacac

SEQ ID NO: 2318211 - RNA, 17 nt, Human
ugacauguacagagaac

SEQ ID NO: 2318212 - RNA, 13 nt, Human
ugacauguacaga

SEQ ID NO: 2318213 - RNA, 15 nt, Human
ugacauguacagaga

SEQ ID NO: 2318214 - RNA, 13 nt, Human
ugacaugucuuuu

SEQ ID NO: 2318215 - RNA, 15 nt, Human
ugacauggugccuga

SEQ ID NO: 2318216 - RNA, 16 nt, Human
ugacauggugccugag

SEQ ID NO: 2318217 - RNA, 17 nt, Human
ugacauggugccugaga

SEQ ID NO: 2318218 - RNA, 18 nt, Human
ugacauggugccugagag

SEQ ID NO: 2318219 - RNA, 21 nt, Human
ugacauggugccugagaggca

SEQ ID NO: 2318220 - RNA, 13 nt, Human
ugacauguaacag

SEQ ID NO: 2318221 - RNA, 12 nt, Human
ugacauguacag

SEQ ID NO: 2318222 - RNA, 18 nt, Human
ugacaugggacauuugcu

SEQ ID NO: 2318223 - RNA, 13 nt, Human
ugacagaacacug

SEQ ID NO: 2318224 - RNA, 14 nt, Human
ugacagaacacugu

SEQ ID NO: 2318225 - RNA, 15 nt, Human
ugacagaacacuguc

SEQ ID NO: 2318226 - RNA, 22 nt, Human
ugacacuuuaauuaccaaccug

SEQ ID NO: 2318227 - RNA, 20 nt, Human
ugacacuuugccagaaagca

SEQ ID NO: 2318228 - RNA, 16 nt, Human
ugacagaacacugucu

SEQ ID NO: 2318229 - RNA, 17 nt, Human
ugacagaacacugucuu

SEQ ID NO: 2318230 - RNA, 21 nt, Human
ugacagaacacugucuugaag

SEQ ID NO: 2318231 - RNA, 13 nt, Human
ugacagaaagcag

SEQ ID NO: 2318232 - RNA, 15 nt, Human
ugacaaucaacucua

SEQ ID NO: 2318233 - RNA, 17 nt, Human
ugacaauaauuucaggu

SEQ ID NO: 2318234 - RNA, 18 nt, Human
ugacaaucaacucuaaua

SEQ ID NO: 2318235 - RNA, 14 nt, Human
ugacaauaauuuca

SEQ ID NO: 2318236 - RNA, 14 nt, Human
ugacaauaaaugug

SEQ ID NO: 2318237 - RNA, 17 nt, Human
ugacaauaaaacauuaa

SEQ ID NO: 2318238 - RNA, 22 nt, Human
ugacaauuuuguacaaauuugu

SEQ ID NO: 2318239 - RNA, 18 nt, Human
ugacaauuuuguacaaau

SEQ ID NO: 2318240 - RNA, 16 nt, Human
ugacacaaaccugccu

SEQ ID NO: 2318241 - RNA, 16 nt, Human
ugacaauuuuguacaa

SEQ ID NO: 2318242 - RNA, 18 nt, Human
ugacaaggauugcuacug

SEQ ID NO: 2318243 - RNA, 21 nt, Human
ugacaagccccaggcaggcug

SEQ ID NO: 2318244 - RNA, 17 nt, Human
ugacaagccccaggcag

SEQ ID NO: 2318245 - RNA, 22 nt, Human
ugacaagcuccuggucuugaga

SEQ ID NO: 2318246 - RNA, 15 nt, Human
ugacaagcucacaga

SEQ ID NO: 2318247 - RNA, 20 nt, Human
ugacaagcucacagaccuuu

SEQ ID NO: 2318248 - RNA, 15 nt, Human
ugacaagccccaggc

SEQ ID NO: 2318249 - RNA, 13 nt, Human
ugacaagccccag

SEQ ID NO: 2318250 - RNA, 15 nt, Human
ugacaagcacugcua

SEQ ID NO: 2318251 - RNA, 12 nt, Human
ugacaagcucac

SEQ ID NO: 2318252 - RNA, 19 nt, Human
ugacaacuuugccagcuuu

SEQ ID NO: 2318253 - RNA, 18 nt, Human
ugaauuguaacuguucuu

SEQ ID NO: 2318254 - RNA, 16 nt, Human
ugaauugccugcagag

SEQ ID NO: 2318255 - RNA, 22 nt, Human
ugaauugccugcagagagaagc

SEQ ID NO: 2318256 - RNA, 13 nt, Human
ugacagaggcagc

SEQ ID NO: 2318257 - RNA, 16 nt, Human
ugacagacagcccucc

SEQ ID NO: 2318258 - RNA, 14 nt, Human
ugacagacaggcuc

SEQ ID NO: 2318259 - RNA, 15 nt, Human
ugacagacaggcucu

SEQ ID NO: 2318260 - RNA, 20 nt, Human
ugacagacacaggcccggcu

SEQ ID NO: 2318261 - RNA, 23 nt, Human
ugacagacacaggcccggcucca

SEQ ID NO: 2318262 - RNA, 14 nt, Human
ugacagaggcagcc

SEQ ID NO: 2318263 - RNA, 15 nt, Human
ugacagaggcagccc

SEQ ID NO: 2318264 - RNA, 16 nt, Human
ugacagaggcagcccc

SEQ ID NO: 2318265 - RNA, 17 nt, Human
ugacagaggcagcccca

SEQ ID NO: 2318266 - RNA, 18 nt, Human
ugacagaggcagccccau

SEQ ID NO: 2318267 - RNA, 23 nt, Human
ugacagaggcagccccauucugc

SEQ ID NO: 2318268 - RNA, 14 nt, Human
ugacagagugagac

SEQ ID NO: 2318269 - RNA, 17 nt, Human
ugacagagugagacucu

SEQ ID NO: 2318270 - RNA, 21 nt, Human
ugacauaacacuauaaagguu

SEQ ID NO: 2318271 - RNA, 17 nt, Human
ugacauaacacuauaaa

SEQ ID NO: 2318272 - RNA, 17 nt, Human
ugacauacauccaacau

SEQ ID NO: 2318273 - RNA, 23 nt, Human
ugacauaaguauuuaauucaugu

SEQ ID NO: 2318274 - RNA, 19 nt, Human
ugacagagugagacucugu

SEQ ID NO: 2318275 - RNA, 18 nt, Human
ugacagaccacaucuuua

SEQ ID NO: 2318276 - RNA, 17 nt, Human
ugacagaccacaucuuu

SEQ ID NO: 2318277 - RNA, 19 nt, Human
ugacagacaggcucuuagc

SEQ ID NO: 2318278 - RNA, 16 nt, Human
ugaaacccccacacac

SEQ ID NO: 2318279 - RNA, 18 nt, Human
ugaaacccccacacacac

SEQ ID NO: 2318280 - RNA, 17 nt, Human
ugaaacccccacacaca

SEQ ID NO: 2318281 - RNA, 20 nt, Human
ugaaaccaguguuagggaag

SEQ ID NO: 2318282 - RNA, 14 nt, Human
ugaaacauuuuguc

SEQ ID NO: 2318283 - RNA, 22 nt, Human
ugaaacacaccaggcugugggc

SEQ ID NO: 2318284 - RNA, 19 nt, Human
ugaaacacaccaggcugug

SEQ ID NO: 2318285 - RNA, 16 nt, Human
ugaaacaccuucucug

SEQ ID NO: 2318286 - RNA, 14 nt, Human
ugaaacaaagcugc

SEQ ID NO: 2318287 - RNA, 17 nt, Human
ugaaaagcuauuagcca

SEQ ID NO: 2318288 - RNA, 19 nt, Human
ugaaaagcuauuagccagg

SEQ ID NO: 2318289 - RNA, 20 nt, Human
ugaaaagcuauuagccagga

SEQ ID NO: 2318290 - RNA, 23 nt, Human
ugaaaagcuauuagccaggauca

SEQ ID NO: 2318291 - RNA, 22 nt, Human
ugaaacaacaaauaggaauugu

SEQ ID NO: 2318292 - RNA, 18 nt, Human
ugaaacacaccaggcugu

SEQ ID NO: 2318293 - RNA, 17 nt, Human
ugaaacacaccaggcug

SEQ ID NO: 2318294 - RNA, 16 nt, Human
ugaaacacaccaggcu

SEQ ID NO: 2318295 - RNA, 20 nt, Human
ugaaacacaaacaauaguaa

SEQ ID NO: 2318296 - RNA, 21 nt, Human
ugaaacaagauaacugagaau

SEQ ID NO: 2318297 - RNA, 23 nt, Human
ugaaacaauacucauaaugugaa

SEQ ID NO: 2318298 - RNA, 13 nt, Human
ugaaacacaaaca

SEQ ID NO: 2318299 - RNA, 15 nt, Human
ugaaacaacuuggaa

SEQ ID NO: 2318300 - RNA, 14 nt, Human
ugaaacaaagaagg

SEQ ID NO: 2318301 - RNA, 16 nt, Human
ugaaacaacuuggaaa

SEQ ID NO: 2318302 - RNA, 17 nt, Human
ugaaacaagaagccaca

SEQ ID NO: 2318303 - RNA, 14 nt, Human
ucuuuucacauucu

SEQ ID NO: 2318304 - RNA, 13 nt, Human
ugaaaagcuauua

SEQ ID NO: 2318305 - RNA, 12 nt, Human
ucuuuucacaaa

SEQ ID NO: 2318306 - RNA, 13 nt, Human
ucuuuucacaaau

SEQ ID NO: 2318307 - RNA, 14 nt, Human
ucuuuucacaaaua

SEQ ID NO: 2318308 - RNA, 15 nt, Human
ucuuuucacaaauaa

SEQ ID NO: 2318309 - RNA, 16 nt, Human
ucuuuucacaaauaaa

SEQ ID NO: 2318310 - RNA, 22 nt, Human
ucuuuucacauagcugucuaga

SEQ ID NO: 2318311 - RNA, 13 nt, Human
ucuuuucacauuc

SEQ ID NO: 2318312 - RNA, 16 nt, Human
ucuuuucacauucuua

SEQ ID NO: 2318313 - RNA, 20 nt, Human
ugaaaagcuccauuuuuagu

SEQ ID NO: 2318314 - RNA, 13 nt, Human
ugaaaauuuugau

SEQ ID NO: 2318315 - RNA, 21 nt, Human
ugaaaauuuugauguuuuaag

SEQ ID NO: 2318316 - RNA, 19 nt, Human
ugaaaauuuugauguuuua

SEQ ID NO: 2318317 - RNA, 13 nt, Human
ugaaagcccaagu

SEQ ID NO: 2318318 - RNA, 14 nt, Human
ugaaagccauuugu

SEQ ID NO: 2318319 - RNA, 18 nt, Human
ugaaagcccugagcuuuc

SEQ ID NO: 2318320 - RNA, 19 nt, Human
ugaaagauggcugugccuc

SEQ ID NO: 2318321 - RNA, 17 nt, Human
ugaaagcauccaugugu

SEQ ID NO: 2318322 - RNA, 15 nt, Human
ugaaagcauccaugu

SEQ ID NO: 2318323 - RNA, 23 nt, Human
ugaaagccagcugccgaccagag

SEQ ID NO: 2318324 - RNA, 18 nt, Human
ugaaagauggcugugccu

SEQ ID NO: 2318325 - RNA, 17 nt, Human
ugaaagaguaaaggaaa

SEQ ID NO: 2318326 - RNA, 20 nt, Human
ugaaagaguaaaggaaauga

SEQ ID NO: 2318327 - RNA, 16 nt, Human
ugaaagaguaaaggaa

SEQ ID NO: 2318328 - RNA, 21 nt, Human
ugaaagaggcugaggccugga

SEQ ID NO: 2318329 - RNA, 21 nt, Human
ugaaacccuggaccagugguc

SEQ ID NO: 2318330 - RNA, 19 nt, Human
ugaaagaggcugaggccug

SEQ ID NO: 2318331 - RNA, 15 nt, Human
ugaaacccuggacca

SEQ ID NO: 2318332 - RNA, 18 nt, Human
ugaaagaggcagcuugaa

SEQ ID NO: 2318333 - RNA, 22 nt, Human
ugaaagggagcuaucaggaaca

SEQ ID NO: 2318334 - RNA, 20 nt, Human
ugaaagggagcuaucaggaa

SEQ ID NO: 2318335 - RNA, 15 nt, Human
ugaaagguacuucaa

SEQ ID NO: 2318336 - RNA, 19 nt, Human
ugaaagguuacccuguaac

SEQ ID NO: 2318337 - RNA, 16 nt, Human
ugaaagguaauuugag

SEQ ID NO: 2318338 - RNA, 16 nt, Human
ugaaagguacuucaaa

SEQ ID NO: 2318339 - RNA, 13 nt, Human
ugaaagggcccag

SEQ ID NO: 2318340 - RNA, 23 nt, Human
ugaaagggaguauuacaaaaaca

SEQ ID NO: 2318341 - RNA, 13 nt, Human
ugaaagcuagaga

SEQ ID NO: 2318342 - RNA, 22 nt, Human
ugaaagcuccucgagggcaggg

SEQ ID NO: 2318343 - RNA, 19 nt, Human
ugaaaggcauucucugaag

SEQ ID NO: 2318344 - RNA, 17 nt, Human
ugaaaggcauucucuga

SEQ ID NO: 2318345 - RNA, 16 nt, Human
ugaaauauugacuuuu

SEQ ID NO: 2318346 - RNA, 17 nt, Human
ugaaaucaguuacucuu

SEQ ID NO: 2318347 - RNA, 16 nt, Human
ugaaaucaguuacucu

SEQ ID NO: 2318348 - RNA, 16 nt, Human
ugaaauggagguccuu

SEQ ID NO: 2318349 - RNA, 13 nt, Human
ugaaauguguuuc

SEQ ID NO: 2318350 - RNA, 19 nt, Human
ugaaauguguuucuguaua

SEQ ID NO: 2318351 - RNA, 18 nt, Human
ugaaauuaaccauagaug

SEQ ID NO: 2318352 - RNA, 22 nt, Human
ugaaauuaaccauagauguaga

SEQ ID NO: 2318353 - RNA, 14 nt, Human
ugaaauuaaccucu

SEQ ID NO: 2318354 - RNA, 21 nt, Human
ugaaauuaagaaggcaaaaau

SEQ ID NO: 2318355 - RNA, 19 nt, Human
ugaaauuaagaaggcaaaa

SEQ ID NO: 2318356 - RNA, 17 nt, Human
ugaaauuaaccucucac

SEQ ID NO: 2318357 - RNA, 15 nt, Human
ugaaauguguuucug

SEQ ID NO: 2318358 - RNA, 23 nt, Human
ugaaauuagggcccaauuaauaa

SEQ ID NO: 2318359 - RNA, 17 nt, Human
ugaaauuauguauguuu

SEQ ID NO: 2318360 - RNA, 18 nt, Human
ugaaauuauguauguuua

SEQ ID NO: 2318361 - RNA, 23 nt, Human
ugaaauuacuacaaaauuugaaa

SEQ ID NO: 2318362 - RNA, 20 nt, Human
ugaaauuacuacaaaauuug

SEQ ID NO: 2318363 - RNA, 19 nt, Human
ugaaauuacuuaucaucca

SEQ ID NO: 2318364 - RNA, 22 nt, Human
ugaaauuacuuaucauccacau

SEQ ID NO: 2318365 - RNA, 23 nt, Human
ugaaauuaagaaggcaaaaaugu

SEQ ID NO: 2318366 - RNA, 14 nt, Human
ugaaauucuccugg

SEQ ID NO: 2318367 - RNA, 15 nt, Human
ugaaauucuccugga

SEQ ID NO: 2318368 - RNA, 16 nt, Human
ugaaauucuccuggag

SEQ ID NO: 2318369 - RNA, 23 nt, Human
ugaaauuauguauguuuacauau

SEQ ID NO: 2318370 - RNA, 19 nt, Human
ugaaauuauguauguuuac

SEQ ID NO: 2318371 - RNA, 21 nt, Human
ugaaauuauguauguuuacau

SEQ ID NO: 2318372 - RNA, 12 nt, Human
ugaaauuauuca

SEQ ID NO: 2318373 - RNA, 18 nt, Human
ugaacaagaauuggaagc

SEQ ID NO: 2318374 - RNA, 11 nt, Human
ugaacaagaau

SEQ ID NO: 2318375 - RNA, 14 nt, Human
ugaacaagaauugg

SEQ ID NO: 2318376 - RNA, 12 nt, Human
ugaacaagaauu

SEQ ID NO: 2318377 - RNA, 22 nt, Human
ugaacaaguuguuucauugacu

SEQ ID NO: 2318378 - RNA, 18 nt, Human
ugaacacaaacuguaaau

SEQ ID NO: 2318379 - RNA, 16 nt, Human
ugaacaaucaaagcac

SEQ ID NO: 2318380 - RNA, 20 nt, Human
ugaacaaguuguuucauuga

SEQ ID NO: 2318381 - RNA, 19 nt, Human
ugaacaaguuguuucauug

SEQ ID NO: 2318382 - RNA, 15 nt, Human
ugaacaagucccugu

SEQ ID NO: 2318383 - RNA, 22 nt, Human
ugaacagcggcuggacuuggag

SEQ ID NO: 2318384 - RNA, 21 nt, Human
ugaacagcggcuggacuugga

SEQ ID NO: 2318385 - RNA, 13 nt, Human
ugaacaauucucu

SEQ ID NO: 2318386 - RNA, 15 nt, Human
ugaacagcggcugga

SEQ ID NO: 2318387 - RNA, 14 nt, Human
ugaacauuuaucaa

SEQ ID NO: 2318388 - RNA, 22 nt, Human
ugaacauuuaucaaucaguaua

SEQ ID NO: 2318389 - RNA, 12 nt, Human
ugaacaguggag

SEQ ID NO: 2318390 - RNA, 22 nt, Human
ugaacauugcauauaacuuaua

SEQ ID NO: 2318391 - RNA, 12 nt, Human
ugaacauugcau

SEQ ID NO: 2318392 - RNA, 19 nt, Human
ugaaccacaucuugcucug

SEQ ID NO: 2318393 - RNA, 22 nt, Human
ugaaccaagaacuuuccaggaa

SEQ ID NO: 2318394 - RNA, 23 nt, Human
ugaaccacaucuugcucugcuga

SEQ ID NO: 2318395 - RNA, 17 nt, Human
ugaaccaccacacccag

SEQ ID NO: 2318396 - RNA, 20 nt, Human
ugaaccaccacacccagccc

SEQ ID NO: 2318397 - RNA, 16 nt, Human
ugaacuccuggccuca

SEQ ID NO: 2318398 - RNA, 21 nt, Human
ucuuugaaauagucuguguga

SEQ ID NO: 2318399 - RNA, 22 nt, Human
ucuuugaaauagucugugugaa

SEQ ID NO: 2318400 - RNA, 12 nt, Human
ucuuugauguua

SEQ ID NO: 2318401 - RNA, 15 nt, Human
ucuuugauguuaaca

SEQ ID NO: 2318402 - RNA, 20 nt, Human
ucuuugauacuuguucaaaa

SEQ ID NO: 2318403 - RNA, 21 nt, Human
ucuuugauaauguuaaauuug

SEQ ID NO: 2318404 - RNA, 16 nt, Human
ucuuugauaauguuaa

SEQ ID NO: 2318405 - RNA, 17 nt, Human
ucuuugauaauguuaaa

SEQ ID NO: 2318406 - RNA, 13 nt, Human
ucuuugauaaugu

SEQ ID NO: 2318407 - RNA, 14 nt, Human
ucuuugauaauguu

SEQ ID NO: 2318408 - RNA, 12 nt, Human
ucuuugccaagu

SEQ ID NO: 2318409 - RNA, 17 nt, Human
ucuuugauguuaacaca

SEQ ID NO: 2318410 - RNA, 20 nt, Human
ucuuugauucuccuucagcc

SEQ ID NO: 2318411 - RNA, 23 nt, Human
ucuuugauucuccuucagcccuc

SEQ ID NO: 2318412 - RNA, 15 nt, Human
ucuuugauucuccuu

SEQ ID NO: 2318413 - RNA, 19 nt, Human
ucuuugauguuaacacauu

SEQ ID NO: 2318414 - RNA, 16 nt, Human
ucuuugauucuccuuc

SEQ ID NO: 2318415 - RNA, 19 nt, Human
ucuuugauucuccuucagc

SEQ ID NO: 2318416 - RNA, 15 nt, Human
ucuuugcauggaauu

SEQ ID NO: 2318417 - RNA, 12 nt, Human
ucuuugcaugga

SEQ ID NO: 2318418 - RNA, 16 nt, Human
ucuuugccacccucau

SEQ ID NO: 2318419 - RNA, 14 nt, Human
ucuuugccacccuc

SEQ ID NO: 2318420 - RNA, 20 nt, Human
ucuuugccacccucaugcug

SEQ ID NO: 2318421 - RNA, 18 nt, Human
ucuuugccacccucaugc

SEQ ID NO: 2318422 - RNA, 17 nt, Human
ucuuugccacccucaug

SEQ ID NO: 2318423 - RNA, 17 nt, Human
ucuuuggacacucacac

SEQ ID NO: 2318424 - RNA, 18 nt, Human
ucuuugcuuugcuuucug

SEQ ID NO: 2318425 - RNA, 23 nt, Human
ucuuugcuuugcuuucugcucag

SEQ ID NO: 2318426 - RNA, 13 nt, Human
ucuuugcuuugcu

SEQ ID NO: 2318427 - RNA, 17 nt, Human
ucuuugcuuugcccagc

SEQ ID NO: 2318428 - RNA, 12 nt, Human
ucuuugcuuugc

SEQ ID NO: 2318429 - RNA, 13 nt, Human
ucuuugcuuugcc

SEQ ID NO: 2318430 - RNA, 19 nt, Human
ucuuuuauaacuaguccuu

SEQ ID NO: 2318431 - RNA, 16 nt, Human
ucuuuuaguuuuaguu

SEQ ID NO: 2318432 - RNA, 22 nt, Human
ucuuuuauaacuaguccuuuac

SEQ ID NO: 2318433 - RNA, 18 nt, Human
ucuuuuaguuuuaguugc

SEQ ID NO: 2318434 - RNA, 19 nt, Human
ucuuuggacagaagcagcu

SEQ ID NO: 2318435 - RNA, 17 nt, Human
ucuuuggaaggagugag

SEQ ID NO: 2318436 - RNA, 18 nt, Human
ucuuuggaaggagugaga

SEQ ID NO: 2318437 - RNA, 24 nt, Human
ucuuuggaaggagugagaucauuu

SEQ ID NO: 2318438 - RNA, 17 nt, Human
ucuuuuagcugaugaac

SEQ ID NO: 2318439 - RNA, 21 nt, Human
ucuuuggacagaagcagcucu

SEQ ID NO: 2318440 - RNA, 12 nt, Human
ucuuucaugagu

SEQ ID NO: 2318441 - RNA, 14 nt, Human
ucuuucaugaguuu

SEQ ID NO: 2318442 - RNA, 17 nt, Human
ucuuuccaaaguacacu

SEQ ID NO: 2318443 - RNA, 19 nt, Human
ucuuuccacagaagcucca

SEQ ID NO: 2318444 - RNA, 19 nt, Human
ucuuuccacggagccacuc

SEQ ID NO: 2318445 - RNA, 23 nt, Human
ucuuuccacggagccacuccucu

SEQ ID NO: 2318446 - RNA, 22 nt, Human
ucuuuccacggagccacuccuc

SEQ ID NO: 2318447 - RNA, 22 nt, Human
ucuuuccacuccuccuagccac

SEQ ID NO: 2318448 - RNA, 21 nt, Human
ucuuuccacuccuccuagcca

SEQ ID NO: 2318449 - RNA, 19 nt, Human
ucuuuccauuaugauucuu

SEQ ID NO: 2318450 - RNA, 10 nt, Human
ucuuuccaga

SEQ ID NO: 2318451 - RNA, 20 nt, Human
ucuuuccauuggaucucauu

SEQ ID NO: 2318452 - RNA, 22 nt, Human
ucuuucuuuugauucuuccuaa

SEQ ID NO: 2318453 - RNA, 23 nt, Human
ucuuucuuugggaauauuugaau

SEQ ID NO: 2318454 - RNA, 15 nt, Human
ucuuucuuucuuaga

SEQ ID NO: 2318455 - RNA, 22 nt, Human
ucuuucuuugggaauauuugaa

SEQ ID NO: 2318456 - RNA, 17 nt, Human
ucuuucuuuaccugaga

SEQ ID NO: 2318457 - RNA, 21 nt, Human
ucuuucuuuaccugagaccag

SEQ ID NO: 2318458 - RNA, 20 nt, Human
ucuuucagggggguugugag

SEQ ID NO: 2318459 - RNA, 23 nt, Human
ucuuucaucaaucauuguacagu

SEQ ID NO: 2318460 - RNA, 13 nt, Human
ucuuucauccacu

SEQ ID NO: 2318461 - RNA, 21 nt, Human
ucuuucauccacuagugcaaa

SEQ ID NO: 2318462 - RNA, 23 nt, Human
ucuuucauccacuagugcaaauc

SEQ ID NO: 2318463 - RNA, 14 nt, Human
ucuuuccaaaguac

SEQ ID NO: 2318464 - RNA, 13 nt, Human
ucuuuccaaagua

SEQ ID NO: 2318465 - RNA, 16 nt, Human
ucuuucagccaagaau

SEQ ID NO: 2318466 - RNA, 19 nt, Human
ucuuucagccaagaauucu

SEQ ID NO: 2318467 - RNA, 20 nt, Human
ucuuucagccaagaauucuu

SEQ ID NO: 2318468 - RNA, 21 nt, Human
ucuuucagccaagaauucuua

SEQ ID NO: 2318469 - RNA, 15 nt, Human
ucuugcaugaggcua

SEQ ID NO: 2318470 - RNA, 15 nt, Human
ucuugcuaaucagug

SEQ ID NO: 2318471 - RNA, 16 nt, Human
ucuugcuaaucagugu

SEQ ID NO: 2318472 - RNA, 22 nt, Human
ucuugcuaaucagugucucaca

SEQ ID NO: 2318473 - RNA, 23 nt, Human
ucuugcuaaucagugucucacac

SEQ ID NO: 2318474 - RNA, 17 nt, Human
ucuugcuaaucaguguc

SEQ ID NO: 2318475 - RNA, 19 nt, Human
ucuugcuaaucagugucuc

SEQ ID NO: 2318476 - RNA, 20 nt, Human
ucuugcuaaucagugucuca

SEQ ID NO: 2318477 - RNA, 21 nt, Human
ucuugcuaaucagugucucac

SEQ ID NO: 2318478 - RNA, 22 nt, Human
ucuugcugguugucauuuuugc

SEQ ID NO: 2318479 - RNA, 18 nt, Human
ucuugcuucccuaaucua

SEQ ID NO: 2318480 - RNA, 22 nt, Human
ucuugcuucccuaaucuauggu

SEQ ID NO: 2318481 - RNA, 23 nt, Human
ucuugcuucccuaaucuaugguc

SEQ ID NO: 2318482 - RNA, 19 nt, Human
ucuugcucuuucuacucug

SEQ ID NO: 2318483 - RNA, 21 nt, Human
ucuugcucuuucuacucugaa

SEQ ID NO: 2318484 - RNA, 20 nt, Human
ucuugcuaccucagucagua

SEQ ID NO: 2318485 - RNA, 17 nt, Human
ucuugcuaccucaguca

SEQ ID NO: 2318486 - RNA, 18 nt, Human
ucuugcucaaaaaucugu

SEQ ID NO: 2318487 - RNA, 14 nt, Human
ucuugcaggucuca

SEQ ID NO: 2318488 - RNA, 20 nt, Human
ucuugcaggucucaacccuu

SEQ ID NO: 2318489 - RNA, 13 nt, Human
ucuugcaggucuc

SEQ ID NO: 2318490 - RNA, 19 nt, Human
ucuugcacccgccucuccc

SEQ ID NO: 2318491 - RNA, 20 nt, Human
ucuugcacccgccucucccg

SEQ ID NO: 2318492 - RNA, 22 nt, Human
ucuugcaccccaaagcuuuccu

SEQ ID NO: 2318493 - RNA, 23 nt, Human
ucuugcaccccaaagcuuuccug

SEQ ID NO: 2318494 - RNA, 14 nt, Human
ucuugcacccgccu

SEQ ID NO: 2318495 - RNA, 15 nt, Human
ucuugcacccgccuc

SEQ ID NO: 2318496 - RNA, 18 nt, Human
ucuugcacccgccucucc

SEQ ID NO: 2318497 - RNA, 23 nt, Human
ucuugcaauggcagccuuggcaa

SEQ ID NO: 2318498 - RNA, 23 nt, Human
ucuccucuuaaaaaauaaaaacu

SEQ ID NO: 2318499 - RNA, 22 nt, Human
ucuccucuuaaaaaauaaaaac

SEQ ID NO: 2318500 - RNA, 17 nt, Human
ucuccucuugccacugc

SEQ ID NO: 2318501 - RNA, 14 nt, Human
ucuccucuuaaaaa

SEQ ID NO: 2318502 - RNA, 12 nt, Human
ucuccucuuaaa

SEQ ID NO: 2318503 - RNA, 13 nt, Human
ucucccuggcccu

SEQ ID NO: 2318504 - RNA, 13 nt, Human
ucuccucuugcca

SEQ ID NO: 2318505 - RNA, 16 nt, Human
ucuccucuugccacug

SEQ ID NO: 2318506 - RNA, 16 nt, Human
ucucccuucauccuuc

SEQ ID NO: 2318507 - RNA, 20 nt, Human
ucuccucugcugcuggcugg

SEQ ID NO: 2318508 - RNA, 12 nt, Human
ucuuguguuucu

SEQ ID NO: 2318509 - RNA, 21 nt, Human
ucuuguguguuuauugucaaa

SEQ ID NO: 2318510 - RNA, 13 nt, Human
ucuugcuugggaa

SEQ ID NO: 2318511 - RNA, 16 nt, Human
ucuuguguguuuauug

SEQ ID NO: 2318512 - RNA, 22 nt, Human
ucuuguugcucaaaaaaugagc

SEQ ID NO: 2318513 - RNA, 16 nt, Human
ucuuguuaagugcagu

SEQ ID NO: 2318514 - RNA, 22 nt, Human
ucuuguguuuccacagccugca

SEQ ID NO: 2318515 - RNA, 21 nt, Human
ucuuguugcucaaaaaaugag

SEQ ID NO: 2318516 - RNA, 14 nt, Human
ucuuguuucaauuc

SEQ ID NO: 2318517 - RNA, 20 nt, Human
ucuuguuuauaccuuugccu

SEQ ID NO: 2318518 - RNA, 14 nt, Human
ucuuguuuucaguu

SEQ ID NO: 2318519 - RNA, 22 nt, Human
ucuuguuucuuuucacauagcu

SEQ ID NO: 2318520 - RNA, 20 nt, Human
ucuuucaagugaaucuaaaa

SEQ ID NO: 2318521 - RNA, 19 nt, Human
ucuuucaagugaaucuaaa

SEQ ID NO: 2318522 - RNA, 16 nt, Human
ucuuucaagugaaucu

SEQ ID NO: 2318523 - RNA, 15 nt, Human
ucuuucaacuugcau

SEQ ID NO: 2318524 - RNA, 23 nt, Human
ucuuucacccuuuucuguuugcu

SEQ ID NO: 2318525 - RNA, 18 nt, Human
ucuuucaacuugcaucca

SEQ ID NO: 2318526 - RNA, 20 nt, Human
ucuuucaagcagucgugccu

SEQ ID NO: 2318527 - RNA, 21 nt, Human
ucuuucaagcagucgugccug

SEQ ID NO: 2318528 - RNA, 17 nt, Human
ucuuucacauuuaaaua

SEQ ID NO: 2318529 - RNA, 22 nt, Human
ucuuucaaagguagccaucaug

SEQ ID NO: 2318530 - RNA, 20 nt, Human
ucuuucaaagguagccauca

SEQ ID NO: 2318531 - RNA, 22 nt, Human
ucuuucaaauugagagaaugga

SEQ ID NO: 2318532 - RNA, 19 nt, Human
ucuuucaaauugagagaau

SEQ ID NO: 2318533 - RNA, 18 nt, Human
ucuuucaaauugagagaa

SEQ ID NO: 2318534 - RNA, 23 nt, Human
ucuuucaaaaccuuuugaaauua

SEQ ID NO: 2318535 - RNA, 21 nt, Human
ucuuucaaaaccuuuugaaau

SEQ ID NO: 2318536 - RNA, 20 nt, Human
ucuuucaaaaccuuuugaaa

SEQ ID NO: 2318537 - RNA, 11 nt, Human
ucuuucaaaac

SEQ ID NO: 2318538 - RNA, 20 nt, Human
ucuuguuuuuccacuacugc

SEQ ID NO: 2318539 - RNA, 13 nt, Human
ucuuguuuuucca

SEQ ID NO: 2318540 - RNA, 21 nt, Human
ucuuguuuuuccacuacugcu

SEQ ID NO: 2318541 - RNA, 12 nt, Human
ucauuuagaacu

SEQ ID NO: 2318542 - RNA, 16 nt, Human
ucauuuagaacuugca

SEQ ID NO: 2318543 - RNA, 22 nt, Human
ucauuuagaacuugcagcugau

SEQ ID NO: 2318544 - RNA, 19 nt, Human
ucauuuagauugaaaacuu

SEQ ID NO: 2318545 - RNA, 22 nt, Human
ucauuuauaaagcuaaaauaac

SEQ ID NO: 2318546 - RNA, 21 nt, Human
ucauuuauaaaaccaucaaaa

SEQ ID NO: 2318547 - RNA, 19 nt, Human
ucauuuaguuugauuauuc

SEQ ID NO: 2318548 - RNA, 18 nt, Human
ucauuuagucaugugacc

SEQ ID NO: 2318549 - RNA, 13 nt, Human
ucauuuacugugg

SEQ ID NO: 2318550 - RNA, 15 nt, Human
ucauuuacuguggcu

SEQ ID NO: 2318551 - RNA, 20 nt, Human
ucauuuacuguggcuucuua

SEQ ID NO: 2318552 - RNA, 21 nt, Human
ucauuuaauaauauacuugug

SEQ ID NO: 2318553 - RNA, 18 nt, Human
ucauuuaauaauauacuu

SEQ ID NO: 2318554 - RNA, 20 nt, Human
ucauuuaauaauauacuugu

SEQ ID NO: 2318555 - RNA, 23 nt, Human
ucauuguuuauuaacaaauuaug

SEQ ID NO: 2318556 - RNA, 23 nt, Human
ucauuuaaaaaaaaaauuuguuu

SEQ ID NO: 2318557 - RNA, 13 nt, Human
ucauuuaaaauga

SEQ ID NO: 2318558 - RNA, 14 nt, Human
ucauuuaaaaugau

SEQ ID NO: 2318559 - RNA, 15 nt, Human
ucauuuaaaaugauu

SEQ ID NO: 2318560 - RNA, 11 nt, Human
ucauuuaauaa

SEQ ID NO: 2318561 - RNA, 14 nt, Human
ucauuuaauaauau

SEQ ID NO: 2318562 - RNA, 16 nt, Human
ucauuuaaaaugauua

SEQ ID NO: 2318563 - RNA, 17 nt, Human
ucauuuaaaaugauuag

SEQ ID NO: 2318564 - RNA, 23 nt, Human
ucauuguaugauguguugugaua

SEQ ID NO: 2318565 - RNA, 18 nt, Human
ucauugucuguguagagu

SEQ ID NO: 2318566 - RNA, 16 nt, Human
ucauuguauauaugug

SEQ ID NO: 2318567 - RNA, 17 nt, Human
ucauuguauauaugugu

SEQ ID NO: 2318568 - RNA, 21 nt, Human
ucauuguauauauguguguuu

SEQ ID NO: 2318569 - RNA, 22 nt, Human
ucauuguauauauguguguuua

SEQ ID NO: 2318570 - RNA, 14 nt, Human
ucauuguaugaugu

SEQ ID NO: 2318571 - RNA, 15 nt, Human
ucauuguaugaugug

SEQ ID NO: 2318572 - RNA, 17 nt, Human
ucauuguaugauguguu

SEQ ID NO: 2318573 - RNA, 18 nt, Human
ucauuguaugauguguug

SEQ ID NO: 2318574 - RNA, 23 nt, Human
ucaugguggguucaggggacuca

SEQ ID NO: 2318575 - RNA, 13 nt, Human
ucaugguguaaua

SEQ ID NO: 2318576 - RNA, 14 nt, Human
ucaugguguaauaa

SEQ ID NO: 2318577 - RNA, 19 nt, Human
ucauggugaaaauguacug

SEQ ID NO: 2318578 - RNA, 16 nt, Human
ucauggucucagucau

SEQ ID NO: 2318579 - RNA, 14 nt, Human
ucauggugaaaaug

SEQ ID NO: 2318580 - RNA, 14 nt, Human
ucauggugcucaga

SEQ ID NO: 2318581 - RNA, 19 nt, Human
ucaugguguaauaagacau

SEQ ID NO: 2318582 - RNA, 10 nt, Human
ucauuagaac

SEQ ID NO: 2318583 - RNA, 15 nt, Human
ucaugguguaauaag

SEQ ID NO: 2318584 - RNA, 16 nt, Human
ucaugguguaauaaga

SEQ ID NO: 2318585 - RNA, 17 nt, Human
ucaugguguaauaagac

SEQ ID NO: 2318586 - RNA, 18 nt, Human
ucaugguguaauaagaca

SEQ ID NO: 2318587 - RNA, 13 nt, Human
ucauuagagcagg

SEQ ID NO: 2318588 - RNA, 15 nt, Human
ucauuagagcaggcg

SEQ ID NO: 2318589 - RNA, 12 nt, Human
ucauuagagcag

SEQ ID NO: 2318590 - RNA, 13 nt, Human
ucauuagacuccu

SEQ ID NO: 2318591 - RNA, 18 nt, Human
ucauuagacuccuccucc

SEQ ID NO: 2318592 - RNA, 17 nt, Human
ucauuguauaaaaauag

SEQ ID NO: 2318593 - RNA, 15 nt, Human
ucauuguauauaugu

SEQ ID NO: 2318594 - RNA, 16 nt, Human
ucauuguauaaaaaua

SEQ ID NO: 2318595 - RNA, 15 nt, Human
ucauuguauaaaaau

SEQ ID NO: 2318596 - RNA, 14 nt, Human
ucauuguauaaaaa

SEQ ID NO: 2318597 - RNA, 19 nt, Human
ucauuguacaguuuguuua

SEQ ID NO: 2318598 - RNA, 14 nt, Human
ucauuguagaaaag

SEQ ID NO: 2318599 - RNA, 19 nt, Human
ucauuguaauguuacugau

SEQ ID NO: 2318600 - RNA, 17 nt, Human
ucauuguaauguuacug

SEQ ID NO: 2318601 - RNA, 20 nt, Human
ucauuagccugaguagaaag

SEQ ID NO: 2318602 - RNA, 20 nt, Human
ucauuguaauguuacugauc

SEQ ID NO: 2318603 - RNA, 14 nt, Human
ucauuguacaguuu

SEQ ID NO: 2318604 - RNA, 17 nt, Human
ucauuguacaguuuguu

SEQ ID NO: 2318605 - RNA, 18 nt, Human
ucauuagccugaguagaa

SEQ ID NO: 2318606 - RNA, 19 nt, Human
ucauuagccugaguagaaa

SEQ ID NO: 2318607 - RNA, 16 nt, Human
ucauuaggauggcuag

SEQ ID NO: 2318608 - RNA, 21 nt, Human
uccaaaccuccuguuagcugu

SEQ ID NO: 2318609 - RNA, 17 nt, Human
uccaaagaaauguaagg

SEQ ID NO: 2318610 - RNA, 14 nt, Human
uccaaagaaaugua

SEQ ID NO: 2318611 - RNA, 13 nt, Human
uccaaagagaaaa

SEQ ID NO: 2318612 - RNA, 22 nt, Human
uccaaaggccauggagagcugg

SEQ ID NO: 2318613 - RNA, 23 nt, Human
uccaaaggccauggagagcugga

SEQ ID NO: 2318614 - RNA, 14 nt, Human
uccaaaggcccccu

SEQ ID NO: 2318615 - RNA, 20 nt, Human
uccaaagaguagaauugcau

SEQ ID NO: 2318616 - RNA, 13 nt, Human
uccaaaguacacu

SEQ ID NO: 2318617 - RNA, 15 nt, Human
ucauuuaugaaaaga

SEQ ID NO: 2318618 - RNA, 14 nt, Human
ucauuuaugaaaag

SEQ ID NO: 2318619 - RNA, 15 nt, Human
ucauuuaucccucaa

SEQ ID NO: 2318620 - RNA, 17 nt, Human
ucauuuauauagauuau

SEQ ID NO: 2318621 - RNA, 22 nt, Human
ucauuuauauagauuauaacuu

SEQ ID NO: 2318622 - RNA, 19 nt, Human
ucauuucaaauacaucuuu

SEQ ID NO: 2318623 - RNA, 22 nt, Human
uccaaaaagauuuucagaaaau

SEQ ID NO: 2318624 - RNA, 15 nt, Human
uccaaaacuccugcc

SEQ ID NO: 2318625 - RNA, 13 nt, Human
uccaaaacugccu

SEQ ID NO: 2318626 - RNA, 12 nt, Human
uccaaaacugcc

SEQ ID NO: 2318627 - RNA, 14 nt, Human
uccaaaagaagccc

SEQ ID NO: 2318628 - RNA, 18 nt, Human
uccaaaagaagcccccag

SEQ ID NO: 2318629 - RNA, 15 nt, Human
uccaaaagaagcccc

SEQ ID NO: 2318630 - RNA, 23 nt, Human
uccaaaauuugaaauauuaaaau

SEQ ID NO: 2318631 - RNA, 16 nt, Human
uccaaaccaaauaaaa

SEQ ID NO: 2318632 - RNA, 21 nt, Human
uccaaaagaagcccccagcua

SEQ ID NO: 2318633 - RNA, 18 nt, Human
ucauagcagauuuuaauu

SEQ ID NO: 2318634 - RNA, 14 nt, Human
ucauagcacuuccc

SEQ ID NO: 2318635 - RNA, 12 nt, Human
ucauagcagcuu

SEQ ID NO: 2318636 - RNA, 14 nt, Human
ucaguguauuugua

SEQ ID NO: 2318637 - RNA, 15 nt, Human
ucaguguauuuguau

SEQ ID NO: 2318638 - RNA, 16 nt, Human
ucauagacccucucaa

SEQ ID NO: 2318639 - RNA, 11 nt, Human
ucauagcagcu

SEQ ID NO: 2318640 - RNA, 15 nt, Human
ucagugcagcccgug

SEQ ID NO: 2318641 - RNA, 17 nt, Human
ucaguguacccccgccc

SEQ ID NO: 2318642 - RNA, 20 nt, Human
ucaguguacccccgcccagg

SEQ ID NO: 2318643 - RNA, 21 nt, Human
ucaguguacccccgcccaggc

SEQ ID NO: 2318644 - RNA, 22 nt, Human
ucaguguauggaaauaaaugua

SEQ ID NO: 2318645 - RNA, 21 nt, Human
ucaguguauggaaauaaaugu

SEQ ID NO: 2318646 - RNA, 22 nt, Human
ucaguguacccccgcccaggcu

SEQ ID NO: 2318647 - RNA, 23 nt, Human
ucaguguacccccgcccaggcug

SEQ ID NO: 2318648 - RNA, 20 nt, Human
ucaguguacauggaauaaca

SEQ ID NO: 2318649 - RNA, 19 nt, Human
ucaguguaccauuugccuc

SEQ ID NO: 2318650 - RNA, 18 nt, Human
ucaguguaccauuugccu

SEQ ID NO: 2318651 - RNA, 14 nt, Human
ucaucauccuaagc

SEQ ID NO: 2318652 - RNA, 24 nt, Human
ucaucaauugaauggucagcguug

SEQ ID NO: 2318653 - RNA, 23 nt, Human
ucaucaauugaauggucagcguu

SEQ ID NO: 2318654 - RNA, 14 nt, Human
ucaucaaucauugu

SEQ ID NO: 2318655 - RNA, 15 nt, Human
ucaucaaucauugua

SEQ ID NO: 2318656 - RNA, 16 nt, Human
ucaucaaucauuguac

SEQ ID NO: 2318657 - RNA, 19 nt, Human
ucaucaaucauuguacagu

SEQ ID NO: 2318658 - RNA, 17 nt, Human
ucaucaaugaaugaaug

SEQ ID NO: 2318659 - RNA, 18 nt, Human
ucaucaaggcacugccug

SEQ ID NO: 2318660 - RNA, 19 nt, Human
ucaucaaggcacugccuga

SEQ ID NO: 2318661 - RNA, 21 nt, Human
ucaucaaggcacugccugaug

SEQ ID NO: 2318662 - RNA, 17 nt, Human
ucaucauuccuugagaa

SEQ ID NO: 2318663 - RNA, 14 nt, Human
ucaucauuccuuga

SEQ ID NO: 2318664 - RNA, 14 nt, Human
ucaucauucucugu

SEQ ID NO: 2318665 - RNA, 13 nt, Human
ucaucauucucug

SEQ ID NO: 2318666 - RNA, 18 nt, Human
ucaucauucucugucuca

SEQ ID NO: 2318667 - RNA, 20 nt, Human
ucauccaccccaucccuccc

SEQ ID NO: 2318668 - RNA, 19 nt, Human
ucauccacuagugcaaauc

SEQ ID NO: 2318669 - RNA, 20 nt, Human
ucauccacuagugcaaauca

SEQ ID NO: 2318670 - RNA, 22 nt, Human
ucaucauguaucgcuucaugua

SEQ ID NO: 2318671 - RNA, 18 nt, Human
ucaugcuuguguuauaac

SEQ ID NO: 2318672 - RNA, 17 nt, Human
ucaugcuucuuccuuac

SEQ ID NO: 2318673 - RNA, 12 nt, Human
ucauggaauggu

SEQ ID NO: 2318674 - RNA, 21 nt, Human
ucauggaaugguuauaaaagu

SEQ ID NO: 2318675 - RNA, 21 nt, Human
ucauggggugaugcugggcug

SEQ ID NO: 2318676 - RNA, 22 nt, Human
ucauggaaugguuauaaaagug

SEQ ID NO: 2318677 - RNA, 14 nt, Human
ucaugggguccaag

SEQ ID NO: 2318678 - RNA, 22 nt, Human
ucaugguagagaccgagccucu

SEQ ID NO: 2318679 - RNA, 13 nt, Human
ucauggucucagu

SEQ ID NO: 2318680 - RNA, 23 nt, Human
ucaugguagagaccgagccucug

SEQ ID NO: 2318681 - RNA, 23 nt, Human
ucaucuugaccaagcaggaagcu

SEQ ID NO: 2318682 - RNA, 15 nt, Human
ucaucuuguguuuua

SEQ ID NO: 2318683 - RNA, 22 nt, Human
ucaucuugguacuacuagaugu

SEQ ID NO: 2318684 - RNA, 22 nt, Human
ucaucuugaccaagcaggaagc

SEQ ID NO: 2318685 - RNA, 21 nt, Human
ucaucuugaccaagcaggaag

SEQ ID NO: 2318686 - RNA, 22 nt, Human
ucaucuuucauuaaaggcuucu

SEQ ID NO: 2318687 - RNA, 17 nt, Human
ucaucuccaucagcugu

SEQ ID NO: 2318688 - RNA, 16 nt, Human
ucaucuccaucagcug

SEQ ID NO: 2318689 - RNA, 12 nt, Human
ucaucucccacc

SEQ ID NO: 2318690 - RNA, 22 nt, Human
ucaucucccaccuagcagcacc

SEQ ID NO: 2318691 - RNA, 15 nt, Human
ucaucuccugccuuc

SEQ ID NO: 2318692 - RNA, 19 nt, Human
ucaucuugaccaagcagga

SEQ ID NO: 2318693 - RNA, 16 nt, Human
ucaucuugaccaagca

SEQ ID NO: 2318694 - RNA, 18 nt, Human
ucaucuccugccuuccuc

SEQ ID NO: 2318695 - RNA, 13 nt, Human
ucaucuccaucag

SEQ ID NO: 2318696 - RNA, 23 nt, Human
ucaucuccagggaguccccuccc

SEQ ID NO: 2318697 - RNA, 22 nt, Human
ucaucuccagggaguccccucc

SEQ ID NO: 2318698 - RNA, 16 nt, Human
ucaucuccccaucauu

SEQ ID NO: 2318699 - RNA, 20 nt, Human
ucaucucaggccucccucaa

SEQ ID NO: 2318700 - RNA, 16 nt, Human
ucaucucauucaaacc

SEQ ID NO: 2318701 - RNA, 21 nt, Human
ucauccacuagugcaaaucau

SEQ ID NO: 2318702 - RNA, 22 nt, Human
ucauccacuagugcaaaucaua

SEQ ID NO: 2318703 - RNA, 18 nt, Human
ucauccacugugccaugu

SEQ ID NO: 2318704 - RNA, 14 nt, Human
ucauccacugugcc

SEQ ID NO: 2318705 - RNA, 17 nt, Human
ucauccacugugccaug

SEQ ID NO: 2318706 - RNA, 13 nt, Human
ucaggccugugug

SEQ ID NO: 2318707 - RNA, 20 nt, Human
ucaggcgauccaccugucuc

SEQ ID NO: 2318708 - RNA, 18 nt, Human
ucaggccucccucucucu

SEQ ID NO: 2318709 - RNA, 17 nt, Human
ucaggccucccucucuc

SEQ ID NO: 2318710 - RNA, 21 nt, Human
ucaggcgauccaccugucuca

SEQ ID NO: 2318711 - RNA, 23 nt, Human
ucaggcguagaucaccagaauaa

SEQ ID NO: 2318712 - RNA, 15 nt, Human
ucaggcucuucuccu

SEQ ID NO: 2318713 - RNA, 22 nt, Human
ucaggccuauaaccccagcucc

SEQ ID NO: 2318714 - RNA, 18 nt, Human
ucaggccuauaaccccag

SEQ ID NO: 2318715 - RNA, 21 nt, Human
ucaggccugggggcugggcag

SEQ ID NO: 2318716 - RNA, 17 nt, Human
ucaggaugaacccagga

SEQ ID NO: 2318717 - RNA, 15 nt, Human
ucaggaugaacccag

SEQ ID NO: 2318718 - RNA, 16 nt, Human
ucaggaugaacccagg

SEQ ID NO: 2318719 - RNA, 17 nt, Human
ucaggaucaagaaagug

SEQ ID NO: 2318720 - RNA, 16 nt, Human
ucaggaucaagaaagu

SEQ ID NO: 2318721 - RNA, 20 nt, Human
ucaggauacucugucagaug

SEQ ID NO: 2318722 - RNA, 23 nt, Human
ucaggaucucuuagcauuuuaau

SEQ ID NO: 2318723 - RNA, 19 nt, Human
ucaggaguuagaggccagc

SEQ ID NO: 2318724 - RNA, 17 nt, Human
ucaggaguuagaggcca

SEQ ID NO: 2318725 - RNA, 22 nt, Human
ucaggaguuagaggccagccug

SEQ ID NO: 2318726 - RNA, 20 nt, Human
ucaggaguuagaggccagcc

SEQ ID NO: 2318727 - RNA, 12 nt, Human
ucaggaguuccu

SEQ ID NO: 2318728 - RNA, 18 nt, Human
ucaggauacucugucaga

SEQ ID NO: 2318729 - RNA, 16 nt, Human
ucaggauacaugugcc

SEQ ID NO: 2318730 - RNA, 14 nt, Human
ucaggauacaugug

SEQ ID NO: 2318731 - RNA, 15 nt, Human
ucaggauacaugugc

SEQ ID NO: 2318732 - RNA, 20 nt, Human
ucaggaucaaaccccgacca

SEQ ID NO: 2318733 - RNA, 12 nt, Human
ucaggacacuaa

SEQ ID NO: 2318734 - RNA, 10 nt, Human
ucaggagcag

SEQ ID NO: 2318735 - RNA, 21 nt, Human
ucaggagcagccucagaacaa

SEQ ID NO: 2318736 - RNA, 22 nt, Human
ucaggagcagccucagaacaaa

SEQ ID NO: 2318737 - RNA, 20 nt, Human
ucaggaaggaugagcauuua

SEQ ID NO: 2318738 - RNA, 18 nt, Human
ucaggaaggaugagcauu

SEQ ID NO: 2318739 - RNA, 17 nt, Human
ucaggaaggaugagcau

SEQ ID NO: 2318740 - RNA, 16 nt, Human
ucaggaaggaugagca

SEQ ID NO: 2318741 - RNA, 15 nt, Human
ucagcuuccuaccca

SEQ ID NO: 2318742 - RNA, 19 nt, Human
ucagcuuccuacccacacc

SEQ ID NO: 2318743 - RNA, 14 nt, Human
ucaggaaugggcug

SEQ ID NO: 2318744 - RNA, 17 nt, Human
ucaggaauauuuuccaa

SEQ ID NO: 2318745 - RNA, 18 nt, Human
ucaggaauauuuuccaaa

SEQ ID NO: 2318746 - RNA, 11 nt, Human
ucaggagcccu

SEQ ID NO: 2318747 - RNA, 12 nt, Human
ucaggagcccug

SEQ ID NO: 2318748 - RNA, 14 nt, Human
ucaggagcccuggg

SEQ ID NO: 2318749 - RNA, 15 nt, Human
ucaggagcccuggga

SEQ ID NO: 2318750 - RNA, 18 nt, Human
ucagcucugggagaggau

SEQ ID NO: 2318751 - RNA, 23 nt, Human
ucagcuguaagaagagacuggga

SEQ ID NO: 2318752 - RNA, 12 nt, Human
ucagcuguacuu

SEQ ID NO: 2318753 - RNA, 22 nt, Human
ucagcucuucugacuuaagugu

SEQ ID NO: 2318754 - RNA, 19 nt, Human
ucagcucugggccauucuc

SEQ ID NO: 2318755 - RNA, 11 nt, Human
ucagcucuggg

SEQ ID NO: 2318756 - RNA, 12 nt, Human
ucagcucuggga

SEQ ID NO: 2318757 - RNA, 16 nt, Human
ucagcucugggagagg

SEQ ID NO: 2318758 - RNA, 17 nt, Human
ucagcucugggagagga

SEQ ID NO: 2318759 - RNA, 23 nt, Human
ucagcucugcaagaauugaagca

SEQ ID NO: 2318760 - RNA, 16 nt, Human
ucagcuguuugucaua

SEQ ID NO: 2318761 - RNA, 15 nt, Human
ucagcuguuugucau

SEQ ID NO: 2318762 - RNA, 21 nt, Human
ucagcugugaacauggacucu

SEQ ID NO: 2318763 - RNA, 12 nt, Human
ucagcugugaac

SEQ ID NO: 2318764 - RNA, 16 nt, Human
ucagcuguaguccuca

SEQ ID NO: 2318765 - RNA, 17 nt, Human
ucagcuguacuucgucu

SEQ ID NO: 2318766 - RNA, 18 nt, Human
ucagcuuaggggcugcug

SEQ ID NO: 2318767 - RNA, 23 nt, Human
ucagcuucagaauggcauuguac

SEQ ID NO: 2318768 - RNA, 16 nt, Human
ucagcuucauuugugu

SEQ ID NO: 2318769 - RNA, 18 nt, Human
ucagcuucauuuguguca

SEQ ID NO: 2318770 - RNA, 21 nt, Human
ucagcuucauuugugucaaug

SEQ ID NO: 2318771 - RNA, 23 nt, Human
ucaggaagcucagggccuggcuc

SEQ ID NO: 2318772 - RNA, 14 nt, Human
ucaccggagcuuuc

SEQ ID NO: 2318773 - RNA, 22 nt, Human
ucaccgcagucgucgcacaguc

SEQ ID NO: 2318774 - RNA, 23 nt, Human
ucaccgcagucgucgcacagucu

SEQ ID NO: 2318775 - RNA, 15 nt, Human
ucaccggauccuggg

SEQ ID NO: 2318776 - RNA, 23 nt, Human
ucaccggagcuuucaaagaagga

SEQ ID NO: 2318777 - RNA, 18 nt, Human
ucaccggggugguuuagu

SEQ ID NO: 2318778 - RNA, 17 nt, Human
ucaccguggaccuuccu

SEQ ID NO: 2318779 - RNA, 18 nt, Human
ucaccguggaccuuccug

SEQ ID NO: 2318780 - RNA, 19 nt, Human
ucaccguggaccuuccugc

SEQ ID NO: 2318781 - RNA, 20 nt, Human
ucaccguggaccuuccugcc

SEQ ID NO: 2318782 - RNA, 21 nt, Human
ucaccguggaccuuccugcca

SEQ ID NO: 2318783 - RNA, 14 nt, Human
ucaccuaacucaua

SEQ ID NO: 2318784 - RNA, 22 nt, Human
ucaccuaacucauacugugcug

SEQ ID NO: 2318785 - RNA, 19 nt, Human
ucaccgugggcucccugac

SEQ ID NO: 2318786 - RNA, 18 nt, Human
ucaccgugggcucccuga

SEQ ID NO: 2318787 - RNA, 17 nt, Human
ucaccgugggcucccug

SEQ ID NO: 2318788 - RNA, 16 nt, Human
ucaccgugggcucccu

SEQ ID NO: 2318789 - RNA, 15 nt, Human
ucaccgugggcuccc

SEQ ID NO: 2318790 - RNA, 13 nt, Human
ucaccgugggcuc

SEQ ID NO: 2318791 - RNA, 23 nt, Human
ucagcuccagcucaccagcccca

SEQ ID NO: 2318792 - RNA, 24 nt, Human
ucagcuccagcucaccagccccag

SEQ ID NO: 2318793 - RNA, 22 nt, Human
ucaccuaauguuuaugagccag

SEQ ID NO: 2318794 - RNA, 21 nt, Human
ucaccuaauguuuaugagcca

SEQ ID NO: 2318795 - RNA, 14 nt, Human
ucaccuaauguuua

SEQ ID NO: 2318796 - RNA, 13 nt, Human
ucagcuccagcug

SEQ ID NO: 2318797 - RNA, 14 nt, Human
ucagcuccaggugg

SEQ ID NO: 2318798 - RNA, 19 nt, Human
ucagcuccagguggcucug

SEQ ID NO: 2318799 - RNA, 16 nt, Human
ucaggucaggaguucg

SEQ ID NO: 2318800 - RNA, 16 nt, Human
ucagggaccccugccc

SEQ ID NO: 2318801 - RNA, 15 nt, Human
ucagguauuaagaaa

SEQ ID NO: 2318802 - RNA, 17 nt, Human
ucagguauuaagaaaau

SEQ ID NO: 2318803 - RNA, 17 nt, Human
ucagggaccccugcccu

SEQ ID NO: 2318804 - RNA, 21 nt, Human
ucagguauguugccuuuaugg

SEQ ID NO: 2318805 - RNA, 14 nt, Human
ucagggaccccugc

SEQ ID NO: 2318806 - RNA, 12 nt, Human
ucagggaccccu

SEQ ID NO: 2318807 - RNA, 16 nt, Human
ucagggaccacagcaa

SEQ ID NO: 2318808 - RNA, 14 nt, Human
ucagggaccacagc

SEQ ID NO: 2318809 - RNA, 15 nt, Human
ucagggaccacagca

SEQ ID NO: 2318810 - RNA, 23 nt, Human
ucagggaccaaggaccccucacc

SEQ ID NO: 2318811 - RNA, 13 nt, Human
ucagggaccacag

SEQ ID NO: 2318812 - RNA, 20 nt, Human
ucagggaccaaggaccccuc

SEQ ID NO: 2318813 - RNA, 15 nt, Human
ucagggaccaaggac

SEQ ID NO: 2318814 - RNA, 14 nt, Human
ucagggaccaagga

SEQ ID NO: 2318815 - RNA, 15 nt, Human
ucagggacaggauga

SEQ ID NO: 2318816 - RNA, 14 nt, Human
ucagggacagagcc

SEQ ID NO: 2318817 - RNA, 15 nt, Human
ucagggacagagcca

SEQ ID NO: 2318818 - RNA, 23 nt, Human
ucagggacagagacaccugcacc

SEQ ID NO: 2318819 - RNA, 21 nt, Human
ucagggacagagacaccugca

SEQ ID NO: 2318820 - RNA, 18 nt, Human
ucagggacagagacaccu

SEQ ID NO: 2318821 - RNA, 22 nt, Human
ucagggaauuucaggaacuaga

SEQ ID NO: 2318822 - RNA, 16 nt, Human
ucaggcucuucuccuu

SEQ ID NO: 2318823 - RNA, 21 nt, Human
ucaggcucuucuccuuucaca

SEQ ID NO: 2318824 - RNA, 13 nt, Human
ucaggcugaggug

SEQ ID NO: 2318825 - RNA, 19 nt, Human
ucaggcugcuggaggaaaa

SEQ ID NO: 2318826 - RNA, 17 nt, Human
ucaggcugcuggaggaa

SEQ ID NO: 2318827 - RNA, 13 nt, Human
ucaggcugcuggc

SEQ ID NO: 2318828 - RNA, 14 nt, Human
ucaggcugcuggcg

SEQ ID NO: 2318829 - RNA, 16 nt, Human
ucaggcugcuggagga

SEQ ID NO: 2318830 - RNA, 15 nt, Human
ucaggcugcuggagg

SEQ ID NO: 2318831 - RNA, 12 nt, Human
ucaggcugcugg

SEQ ID NO: 2318832 - RNA, 17 nt, Human
ucaggcugcuggcgccu

SEQ ID NO: 2318833 - RNA, 19 nt, Human
ucaggcugcuggcgccucu

SEQ ID NO: 2318834 - RNA, 23 nt, Human
ucaggugagaagcagaggaagga

SEQ ID NO: 2318835 - RNA, 16 nt, Human
ucaggugauccaccca

SEQ ID NO: 2318836 - RNA, 15 nt, Human
ucaggucagggugag

SEQ ID NO: 2318837 - RNA, 16 nt, Human
ucagguccucagagaa

SEQ ID NO: 2318838 - RNA, 12 nt, Human
ucaggucccugc

SEQ ID NO: 2318839 - RNA, 18 nt, Human
ucaggucagggugaggau

SEQ ID NO: 2318840 - RNA, 21 nt, Human
ucaggucucccacgugggaga

SEQ ID NO: 2318841 - RNA, 23 nt, Human
ucaggugauccacccaccucagc

SEQ ID NO: 2318842 - RNA, 15 nt, Human
ucaggugacauguga

SEQ ID NO: 2318843 - RNA, 19 nt, Human
ucaggucucccacguggga

SEQ ID NO: 2318844 - RNA, 16 nt, Human
ucaggugacaugugaa

SEQ ID NO: 2318845 - RNA, 18 nt, Human
ucagguggggcagcuuga

SEQ ID NO: 2318846 - RNA, 19 nt, Human
ucagguggggcagcuugag

SEQ ID NO: 2318847 - RNA, 21 nt, Human
ucagucugauucccaagcucu

SEQ ID NO: 2318848 - RNA, 22 nt, Human
ucagucugauucccaagcucug

SEQ ID NO: 2318849 - RNA, 23 nt, Human
ucagucugauucccaagcucugc

SEQ ID NO: 2318850 - RNA, 23 nt, Human
ucagugcagcccguguggccccu

SEQ ID NO: 2318851 - RNA, 14 nt, Human
ucagugcaaagauu

SEQ ID NO: 2318852 - RNA, 19 nt, Human
ucagugauguaccaugaaa

SEQ ID NO: 2318853 - RNA, 18 nt, Human
ucagugaggcccagggag

SEQ ID NO: 2318854 - RNA, 17 nt, Human
ucagugaggcccaggga

SEQ ID NO: 2318855 - RNA, 14 nt, Human
ucagugaggcccag

SEQ ID NO: 2318856 - RNA, 19 nt, Human
ucagugacagaguucacua

SEQ ID NO: 2318857 - RNA, 15 nt, Human
ucagugacagaguuc

SEQ ID NO: 2318858 - RNA, 11 nt, Human
ucagugacaga

SEQ ID NO: 2318859 - RNA, 22 nt, Human
ucagucuuuaaucugagaggcc

SEQ ID NO: 2318860 - RNA, 23 nt, Human
ucagucucccuuucccuucuugg

SEQ ID NO: 2318861 - RNA, 22 nt, Human
ucagucuuucuuagugccugug

SEQ ID NO: 2318862 - RNA, 15 nt, Human
ucaguccuuugauca

SEQ ID NO: 2318863 - RNA, 23 nt, Human
ucaguccuccccucacagccucu

SEQ ID NO: 2318864 - RNA, 15 nt, Human
ucagucacagccacc

SEQ ID NO: 2318865 - RNA, 23 nt, Human
ucaguauuuuggagaaauuauuu

SEQ ID NO: 2318866 - RNA, 22 nt, Human
ucaguccuccccucacagccuc

SEQ ID NO: 2318867 - RNA, 14 nt, Human
ucagucacagccac

SEQ ID NO: 2318868 - RNA, 13 nt, Human
ucagucacagcca

SEQ ID NO: 2318869 - RNA, 16 nt, Human
ucagucaauauuuuua

SEQ ID NO: 2318870 - RNA, 14 nt, Human
ucagucucaggagc

SEQ ID NO: 2318871 - RNA, 19 nt, Human
ucagucucccuucucccau

SEQ ID NO: 2318872 - RNA, 20 nt, Human
ucagucucccuucucccaug

SEQ ID NO: 2318873 - RNA, 23 nt, Human
ucagucucccuucucccaugagg

SEQ ID NO: 2318874 - RNA, 14 nt, Human
ucagucucccuuuc

SEQ ID NO: 2318875 - RNA, 17 nt, Human
ucagucucccuuucccu

SEQ ID NO: 2318876 - RNA, 20 nt, Human
ucagucucccuuucccuucu

SEQ ID NO: 2318877 - RNA, 16 nt, Human
ucagucucccucccuu

SEQ ID NO: 2318878 - RNA, 18 nt, Human
ucagucuauccacagaga

SEQ ID NO: 2318879 - RNA, 15 nt, Human
ucagucuauccacag

SEQ ID NO: 2318880 - RNA, 16 nt, Human
ucagucuauccacaga

SEQ ID NO: 2318881 - RNA, 20 nt, Human
ucagguggggcagcuugagg

SEQ ID NO: 2318882 - RNA, 22 nt, Human
ucaguauugaagcauuuuauaa

SEQ ID NO: 2318883 - RNA, 23 nt, Human
ucaguauugaagcauuuuauaaa

SEQ ID NO: 2318884 - RNA, 21 nt, Human
ucaggcugcuggcgccucugc

SEQ ID NO: 2318885 - RNA, 17 nt, Human
ucaggugacaugugaaa

SEQ ID NO: 2318886 - RNA, 22 nt, Human
ucaguauuguuuugguuugcua

SEQ ID NO: 2318887 - RNA, 24 nt, Human
ucaguauuguuuugguuugcuacu

SEQ ID NO: 2318888 - RNA, 21 nt, Human
ucaggugcccaucccuggaag

SEQ ID NO: 2318889 - RNA, 14 nt, Human
ucaguauuguuuug

SEQ ID NO: 2318890 - RNA, 15 nt, Human
ucaguauuguuuugg

SEQ ID NO: 2318891 - RNA, 17 nt, Human
ucaguauuguuuugguu

SEQ ID NO: 2318892 - RNA, 16 nt, Human
ucaguauuuucccugc

SEQ ID NO: 2318893 - RNA, 18 nt, Human
ucaguauuuucccugcua

SEQ ID NO: 2318894 - RNA, 19 nt, Human
ucaguauuuuggagaaauu

SEQ ID NO: 2318895 - RNA, 20 nt, Human
ucaguauuuuggagaaauua

SEQ ID NO: 2318896 - RNA, 22 nt, Human
ucaguauuuuggagaaauuauu

SEQ ID NO: 2318897 - RNA, 20 nt, Human
uccacuuuuuuuuguauguu

SEQ ID NO: 2318898 - RNA, 20 nt, Human
uccacuuuguuggaaagcag

SEQ ID NO: 2318899 - RNA, 22 nt, Human
uccacuuuguuucguggggagg

SEQ ID NO: 2318900 - RNA, 23 nt, Human
uccacuuuguuucguggggaggu

SEQ ID NO: 2318901 - RNA, 15 nt, Human
uccacuuuguuucgu

SEQ ID NO: 2318902 - RNA, 13 nt, Human
uccacuuuguucu

SEQ ID NO: 2318903 - RNA, 16 nt, Human
uccacuuuguucuuua

SEQ ID NO: 2318904 - RNA, 18 nt, Human
uccacuuuguuucguggg

SEQ ID NO: 2318905 - RNA, 19 nt, Human
uccacuuuguuucgugggg

SEQ ID NO: 2318906 - RNA, 18 nt, Human
uccagaaaaccccagcau

SEQ ID NO: 2318907 - RNA, 21 nt, Human
uccagaaacggccauucagca

SEQ ID NO: 2318908 - RNA, 23 nt, Human
uccagaaagaaaacuuguauuau

SEQ ID NO: 2318909 - RNA, 11 nt, Human
uccagaaagaa

SEQ ID NO: 2318910 - RNA, 20 nt, Human
uccacuuucuagccagagga

SEQ ID NO: 2318911 - RNA, 21 nt, Human
uccacuuucuagccagaggag

SEQ ID NO: 2318912 - RNA, 23 nt, Human
uccacuuggucugugagaugcua

SEQ ID NO: 2318913 - RNA, 19 nt, Human
uccacuuucuagccagagg

SEQ ID NO: 2318914 - RNA, 16 nt, Human
uccaaaguacacuguu

SEQ ID NO: 2318915 - RNA, 14 nt, Human
uccaaaguacacug

SEQ ID NO: 2318916 - RNA, 17 nt, Human
uccacuuggucugugag

SEQ ID NO: 2318917 - RNA, 21 nt, Human
uccacuuggucugugagaugc

SEQ ID NO: 2318918 - RNA, 21 nt, Human
uccagcaauucuccugccuca

SEQ ID NO: 2318919 - RNA, 14 nt, Human
uccagcaccacacu

SEQ ID NO: 2318920 - RNA, 22 nt, Human
uccagcaauucuccugccucag

SEQ ID NO: 2318921 - RNA, 23 nt, Human
uccagcaccauccgccagggccc

SEQ ID NO: 2318922 - RNA, 21 nt, Human
uccagcuccuccgugcuuccu

SEQ ID NO: 2318923 - RNA, 13 nt, Human
uccagcuccugua

SEQ ID NO: 2318924 - RNA, 12 nt, Human
uccagcucugga

SEQ ID NO: 2318925 - RNA, 13 nt, Human
uccagcucuggag

SEQ ID NO: 2318926 - RNA, 15 nt, Human
uccagcucuggaggg

SEQ ID NO: 2318927 - RNA, 20 nt, Human
uccagcucuggaggggaggg

SEQ ID NO: 2318928 - RNA, 21 nt, Human
uccagcucuuuccuccuucca

SEQ ID NO: 2318929 - RNA, 23 nt, Human
uccagcugacccugguucucucu

SEQ ID NO: 2318930 - RNA, 18 nt, Human
uccagcucuuuccuccuu

SEQ ID NO: 2318931 - RNA, 15 nt, Human
uccagcucuuuccuc

SEQ ID NO: 2318932 - RNA, 16 nt, Human
uccagcugagcgccag

SEQ ID NO: 2318933 - RNA, 19 nt, Human
uccaggggugggacacccu

SEQ ID NO: 2318934 - RNA, 20 nt, Human
uccaggggugggacacccug

SEQ ID NO: 2318935 - RNA, 19 nt, Human
uccaggggccccuccagcu

SEQ ID NO: 2318936 - RNA, 23 nt, Human
uccaggggcugcuuccuccugga

SEQ ID NO: 2318937 - RNA, 21 nt, Human
uccaggggcugcuuccuccug

SEQ ID NO: 2318938 - RNA, 22 nt, Human
uccaggggcugcuuccuccugg

SEQ ID NO: 2318939 - RNA, 16 nt, Human
uccagcugccccgggg

SEQ ID NO: 2318940 - RNA, 18 nt, Human
uccaggggccccuccagc

SEQ ID NO: 2318941 - RNA, 12 nt, Human
uccaggagcagc

SEQ ID NO: 2318942 - RNA, 13 nt, Human
uccaggagcagcc

SEQ ID NO: 2318943 - RNA, 14 nt, Human
uccaggagcagcca

SEQ ID NO: 2318944 - RNA, 15 nt, Human
uccaggagcagccac

SEQ ID NO: 2318945 - RNA, 13 nt, Human
uccauacucagga

SEQ ID NO: 2318946 - RNA, 21 nt, Human
uccauaaucuggacuccucug

SEQ ID NO: 2318947 - RNA, 15 nt, Human
uccauacauuugugu

SEQ ID NO: 2318948 - RNA, 14 nt, Human
uccauagagagcaa

SEQ ID NO: 2318949 - RNA, 15 nt, Human
uccauagagagcaag

SEQ ID NO: 2318950 - RNA, 22 nt, Human
uccaucagcuuaggggcugcug

SEQ ID NO: 2318951 - RNA, 18 nt, Human
uccaucagguuccauccc

SEQ ID NO: 2318952 - RNA, 19 nt, Human
uccaucagguuccaucccg

SEQ ID NO: 2318953 - RNA, 17 nt, Human
uccaucaguuagagcug

SEQ ID NO: 2318954 - RNA, 13 nt, Human
uccaucaucaugu

SEQ ID NO: 2318955 - RNA, 18 nt, Human
uccaucaguuagagcuga

SEQ ID NO: 2318956 - RNA, 12 nt, Human
uccaucaugucc

SEQ ID NO: 2318957 - RNA, 14 nt, Human
uccaucaggccacu

SEQ ID NO: 2318958 - RNA, 15 nt, Human
uccaucagaaugaaa

SEQ ID NO: 2318959 - RNA, 14 nt, Human
uccaucaugucccc

SEQ ID NO: 2318960 - RNA, 13 nt, Human
uccaucauguccc

SEQ ID NO: 2318961 - RNA, 21 nt, Human
uccaugcguguuucugacucu

SEQ ID NO: 2318962 - RNA, 22 nt, Human
uccaugcguguuucugacucug

SEQ ID NO: 2318963 - RNA, 14 nt, Human
uccaugcugccucc

SEQ ID NO: 2318964 - RNA, 15 nt, Human
uccaugcugccucca

SEQ ID NO: 2318965 - RNA, 16 nt, Human
uccauggaaugcuuga

SEQ ID NO: 2318966 - RNA, 17 nt, Human
uccauggaaugcuugaa

SEQ ID NO: 2318967 - RNA, 18 nt, Human
uccauggaaugcuugaaa

SEQ ID NO: 2318968 - RNA, 21 nt, Human
uccauggaaugcuugaaaaau

SEQ ID NO: 2318969 - RNA, 19 nt, Human
uccaugcuuagucacugcc

SEQ ID NO: 2318970 - RNA, 20 nt, Human
uccaugcuuagucacugccu

SEQ ID NO: 2318971 - RNA, 22 nt, Human
uccaugcuuagucacugccugc

SEQ ID NO: 2318972 - RNA, 23 nt, Human
uccaugcuuagucacugccugca

SEQ ID NO: 2318973 - RNA, 15 nt, Human
uccauggaaugcuug

SEQ ID NO: 2318974 - RNA, 20 nt, Human
uccaugggccauaugaaaag

SEQ ID NO: 2318975 - RNA, 22 nt, Human
uccaugggcagagcccaaggga

SEQ ID NO: 2318976 - RNA, 18 nt, Human
uccaugggcagagcccaa

SEQ ID NO: 2318977 - RNA, 17 nt, Human
uccaugggcagagccca

SEQ ID NO: 2318978 - RNA, 16 nt, Human
uccaugggcagagccc

SEQ ID NO: 2318979 - RNA, 15 nt, Human
uccaugggcagagcc

SEQ ID NO: 2318980 - RNA, 18 nt, Human
uccaugggagaaaauaga

SEQ ID NO: 2318981 - RNA, 22 nt, Human
uccauggaaugcuugaaaaaug

SEQ ID NO: 2318982 - RNA, 23 nt, Human
uccauggaaugcuugaaaaaugu

SEQ ID NO: 2318983 - RNA, 15 nt, Human
uccauggcuuccucc

SEQ ID NO: 2318984 - RNA, 16 nt, Human
uccauggcuuccuccu

SEQ ID NO: 2318985 - RNA, 16 nt, Human
uccaggucucacgggc

SEQ ID NO: 2318986 - RNA, 15 nt, Human
uccagguaucuccag

SEQ ID NO: 2318987 - RNA, 17 nt, Human
uccagggugugugcucg

SEQ ID NO: 2318988 - RNA, 22 nt, Human
uccaggggugggacacccugug

SEQ ID NO: 2318989 - RNA, 18 nt, Human
uccaggguugaucacacu

SEQ ID NO: 2318990 - RNA, 19 nt, Human
uccagguagagggugugua

SEQ ID NO: 2318991 - RNA, 20 nt, Human
uccagguuuaagcuguuacu

SEQ ID NO: 2318992 - RNA, 18 nt, Human
uccagguaucuccaggau

SEQ ID NO: 2318993 - RNA, 16 nt, Human
uccagguaucuccagg

SEQ ID NO: 2318994 - RNA, 17 nt, Human
uccagguaucuccagga

SEQ ID NO: 2318995 - RNA, 13 nt, Human
uccagguuuuuca

SEQ ID NO: 2318996 - RNA, 14 nt, Human
uccagguuuuucaa

SEQ ID NO: 2318997 - RNA, 15 nt, Human
uccagguuuuucaau

SEQ ID NO: 2318998 - RNA, 24 nt, Human
uccagguuuuucaauuaaacggau

SEQ ID NO: 2318999 - RNA, 16 nt, Human
uccagguuuuucaauu

SEQ ID NO: 2319000 - RNA, 17 nt, Human
uccagguuuuucaauua

SEQ ID NO: 2319001 - RNA, 18 nt, Human
uccagguuuuucaauuaa

SEQ ID NO: 2319002 - RNA, 19 nt, Human
uccagguuuuucaauuaaa

SEQ ID NO: 2319003 - RNA, 20 nt, Human
uccagguuuuucaauuaaac

SEQ ID NO: 2319004 - RNA, 21 nt, Human
uccagguuuuucaauuaaacg

SEQ ID NO: 2319005 - RNA, 22 nt, Human
uccagguuuuucaauuaaacgg

SEQ ID NO: 2319006 - RNA, 23 nt, Human
uccagguuuuucaauuaaacgga

SEQ ID NO: 2319007 - RNA, 16 nt, Human
uccauaaggaauguag

SEQ ID NO: 2319008 - RNA, 12 nt, Human
uccauaaucacu

SEQ ID NO: 2319009 - RNA, 14 nt, Human
uccauaaccccacc

SEQ ID NO: 2319010 - RNA, 17 nt, Human
uccauaaccccacccuu

SEQ ID NO: 2319011 - RNA, 22 nt, Human
uccauaaucuggacuccucugu

SEQ ID NO: 2319012 - RNA, 20 nt, Human
uccaguuuuuuguuauauag

SEQ ID NO: 2319013 - RNA, 17 nt, Human
uccauaaagaagauguu

SEQ ID NO: 2319014 - RNA, 21 nt, Human
uccauaaagaagauguuuaac

SEQ ID NO: 2319015 - RNA, 13 nt, Human
uccauaaagaagc

SEQ ID NO: 2319016 - RNA, 18 nt, Human
uccauaaagaagcaauaa

SEQ ID NO: 2319017 - RNA, 20 nt, Human
uccauaaagaagcaauaaag

SEQ ID NO: 2319018 - RNA, 13 nt, Human
uccaguucccacu

SEQ ID NO: 2319019 - RNA, 18 nt, Human
uccaguuaauuacauccu

SEQ ID NO: 2319020 - RNA, 21 nt, Human
uccaguuaaaaaaaauuuuaa

SEQ ID NO: 2319021 - RNA, 22 nt, Human
uccaguuaaaaaaaauuuuaau

SEQ ID NO: 2319022 - RNA, 19 nt, Human
uccaguucaugagaaucua

SEQ ID NO: 2319023 - RNA, 18 nt, Human
uccaguucccagaaggca

SEQ ID NO: 2319024 - RNA, 16 nt, Human
uccaguucaugagaau

SEQ ID NO: 2319025 - RNA, 14 nt, Human
uccaguuaguucuc

SEQ ID NO: 2319026 - RNA, 12 nt, Human
uccccagcccag

SEQ ID NO: 2319027 - RNA, 13 nt, Human
uccccagcccaga

SEQ ID NO: 2319028 - RNA, 10 nt, Human
uccccagccc

SEQ ID NO: 2319029 - RNA, 17 nt, Human
uccccagcccagagaca

SEQ ID NO: 2319030 - RNA, 16 nt, Human
uccccagcccagagac

SEQ ID NO: 2319031 - RNA, 15 nt, Human
uccccagcccagaga

SEQ ID NO: 2319032 - RNA, 14 nt, Human
uccccagcccagag

SEQ ID NO: 2319033 - RNA, 19 nt, Human
uccccagcagguggggagg

SEQ ID NO: 2319034 - RNA, 22 nt, Human
uccccagcagggucuuuucauc

SEQ ID NO: 2319035 - RNA, 23 nt, Human
uccccagcagggucuuuucaucu

SEQ ID NO: 2319036 - RNA, 15 nt, Human
uccccagcagguggg

SEQ ID NO: 2319037 - RNA, 20 nt, Human
uccccagcauuccagccccu

SEQ ID NO: 2319038 - RNA, 13 nt, Human
uccccagcccugg

SEQ ID NO: 2319039 - RNA, 19 nt, Human
uccccagccccuagcccag

SEQ ID NO: 2319040 - RNA, 20 nt, Human
uccccagccccuagcccagg

SEQ ID NO: 2319041 - RNA, 11 nt, Human
uccccagcccc

SEQ ID NO: 2319042 - RNA, 13 nt, Human
uccccagccccua

SEQ ID NO: 2319043 - RNA, 15 nt, Human
uccccagccccuagc

SEQ ID NO: 2319044 - RNA, 16 nt, Human
uccccagccccuagcc

SEQ ID NO: 2319045 - RNA, 23 nt, Human
uccccagcccaggguucccccag

SEQ ID NO: 2319046 - RNA, 22 nt, Human
uccccagcccaggguuccccca

SEQ ID NO: 2319047 - RNA, 15 nt, Human
uccccagcccagggu

SEQ ID NO: 2319048 - RNA, 14 nt, Human
uccccagcccaggg

SEQ ID NO: 2319049 - RNA, 13 nt, Human
uccccagcccagg

SEQ ID NO: 2319050 - RNA, 21 nt, Human
uccccagccccuagcccagga

SEQ ID NO: 2319051 - RNA, 15 nt, Human
uccccagcccuggcu

SEQ ID NO: 2319052 - RNA, 18 nt, Human
uccccagcccuggcucug

SEQ ID NO: 2319053 - RNA, 14 nt, Human
uccccaggaggcca

SEQ ID NO: 2319054 - RNA, 17 nt, Human
uccccaggaggccagcc

SEQ ID NO: 2319055 - RNA, 17 nt, Human
ucccccagccccauccu

SEQ ID NO: 2319056 - RNA, 15 nt, Human
uccccaggaggccag

SEQ ID NO: 2319057 - RNA, 16 nt, Human
uccccaggaggccagc

SEQ ID NO: 2319058 - RNA, 21 nt, Human
uccccccacucuccccacacu

SEQ ID NO: 2319059 - RNA, 12 nt, Human
uccccccacucu

SEQ ID NO: 2319060 - RNA, 22 nt, Human
ucccccagccccauccucugua

SEQ ID NO: 2319061 - RNA, 20 nt, Human
ucccccagccccauccucug

SEQ ID NO: 2319062 - RNA, 21 nt, Human
ucccccagccccauccucugu

SEQ ID NO: 2319063 - RNA, 19 nt, Human
uccccagauugcaacaggc

SEQ ID NO: 2319064 - RNA, 20 nt, Human
uccccagauugcaacaggcu

SEQ ID NO: 2319065 - RNA, 22 nt, Human
uccccagauugcaacaggcugg

SEQ ID NO: 2319066 - RNA, 23 nt, Human
uccccagauugcaacaggcuggg

SEQ ID NO: 2319067 - RNA, 20 nt, Human
uccccagcaagugagagcug

SEQ ID NO: 2319068 - RNA, 21 nt, Human
uccccagcaagugagagcugg

SEQ ID NO: 2319069 - RNA, 10 nt, Human
uccccagcag

SEQ ID NO: 2319070 - RNA, 21 nt, Human
uccccagcagggucuuuucau

SEQ ID NO: 2319071 - RNA, 18 nt, Human
uccccagaguuccccaug

SEQ ID NO: 2319072 - RNA, 20 nt, Human
uccccagaguuccccaugca

SEQ ID NO: 2319073 - RNA, 12 nt, Human
uccccagagcac

SEQ ID NO: 2319074 - RNA, 21 nt, Human
uccccagagcacuggguugca

SEQ ID NO: 2319075 - RNA, 19 nt, Human
uccccagaguccucuauga

SEQ ID NO: 2319076 - RNA, 17 nt, Human
uccccagaguuccccau

SEQ ID NO: 2319077 - RNA, 22 nt, Human
uccccagcaagugagagcuggg

SEQ ID NO: 2319078 - RNA, 20 nt, Human
ucccaugagccucagcaucc

SEQ ID NO: 2319079 - RNA, 14 nt, Human
ucccaugacccagg

SEQ ID NO: 2319080 - RNA, 22 nt, Human
ucccauguagcccccuggccuc

SEQ ID NO: 2319081 - RNA, 22 nt, Human
ucccauguauuuaucucuauuu

SEQ ID NO: 2319082 - RNA, 16 nt, Human
ucccauuagcaaaaau

SEQ ID NO: 2319083 - RNA, 21 nt, Human
ucccauuaggacaaucagucc

SEQ ID NO: 2319084 - RNA, 23 nt, Human
ucccauuaggacaaucagucccc

SEQ ID NO: 2319085 - RNA, 10 nt, Human
ucccaugugg

SEQ ID NO: 2319086 - RNA, 13 nt, Human
uccccagauugca

SEQ ID NO: 2319087 - RNA, 18 nt, Human
uccccagauugcaacagg

SEQ ID NO: 2319088 - RNA, 23 nt, Human
uccccagagaaaggggagcccac

SEQ ID NO: 2319089 - RNA, 22 nt, Human
uccccagagaaaggggagccca

SEQ ID NO: 2319090 - RNA, 20 nt, Human
uccauuaacuuagcaugugu

SEQ ID NO: 2319091 - RNA, 13 nt, Human
uccauuaucaugu

SEQ ID NO: 2319092 - RNA, 14 nt, Human
uccauuaggauuug

SEQ ID NO: 2319093 - RNA, 14 nt, Human
uccauuaucaugug

SEQ ID NO: 2319094 - RNA, 15 nt, Human
uccauuaucaugugu

SEQ ID NO: 2319095 - RNA, 16 nt, Human
uccauuaucaugugua

SEQ ID NO: 2319096 - RNA, 17 nt, Human
uccauuaucauguguaa

SEQ ID NO: 2319097 - RNA, 22 nt, Human
uccauuaacuuagcauguguug

SEQ ID NO: 2319098 - RNA, 19 nt, Human
uccauguuuguaaaacuac

SEQ ID NO: 2319099 - RNA, 13 nt, Human
uccauguuuguaa

SEQ ID NO: 2319100 - RNA, 16 nt, Human
uccauguuuguaaaac

SEQ ID NO: 2319101 - RNA, 14 nt, Human
uccauuauuuauau

SEQ ID NO: 2319102 - RNA, 12 nt, Human
uccauuauuuau

SEQ ID NO: 2319103 - RNA, 11 nt, Human
uccauuauuua

SEQ ID NO: 2319104 - RNA, 15 nt, Human
uccauuaugauucuu

SEQ ID NO: 2319105 - RNA, 20 nt, Human
uccauuaucauguguaauca

SEQ ID NO: 2319106 - RNA, 22 nt, Human
ucccaccucucucacuccuuga

SEQ ID NO: 2319107 - RNA, 20 nt, Human
uccaugugggcuaguugggc

SEQ ID NO: 2319108 - RNA, 14 nt, Human
uccaugugcccccu

SEQ ID NO: 2319109 - RNA, 20 nt, Human
uccauggcuuccuccucccu

SEQ ID NO: 2319110 - RNA, 23 nt, Human
uccaugggcagagcccaagggaa

SEQ ID NO: 2319111 - RNA, 19 nt, Human
uccaugugcccccucuacc

SEQ ID NO: 2319112 - RNA, 19 nt, Human
uccauguuaguuuuuacuu

SEQ ID NO: 2319113 - RNA, 12 nt, Human
uccauguugcug

SEQ ID NO: 2319114 - RNA, 18 nt, Human
uccauguuaguuuuuacu

SEQ ID NO: 2319115 - RNA, 18 nt, Human
uccaugugugugcaagug

SEQ ID NO: 2319116 - RNA, 14 nt, Human
uccauguugcugcc

SEQ ID NO: 2319117 - RNA, 15 nt, Human
uccauguugcugcca

SEQ ID NO: 2319118 - RNA, 17 nt, Human
uccauguugcugccaac

SEQ ID NO: 2319119 - RNA, 14 nt, Human
uccaugugugugca

SEQ ID NO: 2319120 - RNA, 13 nt, Human
uccaugugugugc

SEQ ID NO: 2319121 - RNA, 11 nt, Human
uccaugugugu

SEQ ID NO: 2319122 - RNA, 17 nt, Human
uccauguguggacucaa

SEQ ID NO: 2319123 - RNA, 13 nt, Human
uccauguggagaa

SEQ ID NO: 2319124 - RNA, 22 nt, Human
uccauguggagaaaggagugaa

SEQ ID NO: 2319125 - RNA, 18 nt, Human
uccaugugguucuucaaa

SEQ ID NO: 2319126 - RNA, 12 nt, Human
uccauuccagaa

SEQ ID NO: 2319127 - RNA, 11 nt, Human
ucccaccucug

SEQ ID NO: 2319128 - RNA, 13 nt, Human
ucccaccucugug

SEQ ID NO: 2319129 - RNA, 15 nt, Human
uccauuauuuauauu

SEQ ID NO: 2319130 - RNA, 22 nt, Human
uccauucacaguucuuugggcc

SEQ ID NO: 2319131 - RNA, 18 nt, Human
ucccaccucugugaccuc

SEQ ID NO: 2319132 - RNA, 20 nt, Human
ucccaccucugugaccucag

SEQ ID NO: 2319133 - RNA, 21 nt, Human
ucccaccucugugaccucagg

SEQ ID NO: 2319134 - RNA, 22 nt, Human
ucccaccucugugaccucaggc

SEQ ID NO: 2319135 - RNA, 13 nt, Human
ucccaccuuggcu

SEQ ID NO: 2319136 - RNA, 22 nt, Human
ucccaccucuucucuuccugua

SEQ ID NO: 2319137 - RNA, 16 nt, Human
ucccaccuuggcugca

SEQ ID NO: 2319138 - RNA, 17 nt, Human
ucccaccuuggcugcag

SEQ ID NO: 2319139 - RNA, 20 nt, Human
ucccagcugugcucuggaca

SEQ ID NO: 2319140 - RNA, 18 nt, Human
ucccaccuuggcugcagg

SEQ ID NO: 2319141 - RNA, 15 nt, Human
ucccaucuuccaagg

SEQ ID NO: 2319142 - RNA, 16 nt, Human
ucccaggcgccccuuc

SEQ ID NO: 2319143 - RNA, 21 nt, Human
ucccaucugugaaaggaaaga

SEQ ID NO: 2319144 - RNA, 18 nt, Human
ucccaggccaguaaggga

SEQ ID NO: 2319145 - RNA, 18 nt, Human
ucccaugagccucagcau

SEQ ID NO: 2319146 - RNA, 19 nt, Human
ucccaugagccucagcauc

SEQ ID NO: 2319147 - RNA, 14 nt, Human
ucccaugaacacac

SEQ ID NO: 2319148 - RNA, 16 nt, Human
ucccaugaacacacug

SEQ ID NO: 2319149 - RNA, 17 nt, Human
ucccaugaacacacugu

SEQ ID NO: 2319150 - RNA, 19 nt, Human
ucccaugaacacacugugu

SEQ ID NO: 2319151 - RNA, 14 nt, Human
ucccaugacccacc

SEQ ID NO: 2319152 - RNA, 16 nt, Human
ucccaugacccacccc

SEQ ID NO: 2319153 - RNA, 17 nt, Human
ucccaugacccaccccu

SEQ ID NO: 2319154 - RNA, 18 nt, Human
ucccaugacccaccccug

SEQ ID NO: 2319155 - RNA, 20 nt, Human
ucccaugacccaccccugug

SEQ ID NO: 2319156 - RNA, 21 nt, Human
ucccaugacccaccccugugc

SEQ ID NO: 2319157 - RNA, 22 nt, Human
ucccaugacccaccccugugcu

SEQ ID NO: 2319158 - RNA, 24 nt, Human
ucccaugacccaccccugugcucc

SEQ ID NO: 2319159 - RNA, 23 nt, Human
ucccagcugugcucuggacaggc

SEQ ID NO: 2319160 - RNA, 16 nt, Human
ucccaggaacugggcc

SEQ ID NO: 2319161 - RNA, 11 nt, Human
ucccaggaacu

SEQ ID NO: 2319162 - RNA, 21 nt, Human
ucccagcugugcucuggacag

SEQ ID NO: 2319163 - RNA, 22 nt, Human
ucccagcugugcucuggacagg

SEQ ID NO: 2319164 - RNA, 21 nt, Human
ucccaggccaggcuccuuccu

SEQ ID NO: 2319165 - RNA, 15 nt, Human
ucccaggccaggcuc

SEQ ID NO: 2319166 - RNA, 12 nt, Human
ucccaggacccu

SEQ ID NO: 2319167 - RNA, 23 nt, Human
ucccaggcauuccccaggaggcc

SEQ ID NO: 2319168 - RNA, 24 nt, Human
ucccaggcauuccccaggaggcca

SEQ ID NO: 2319169 - RNA, 11 nt, Human
ucccaggaccc

SEQ ID NO: 2319170 - RNA, 23 nt, Human
ucccaggacaccacacccagccu

SEQ ID NO: 2319171 - RNA, 15 nt, Human
ucccaggacaccaca

SEQ ID NO: 2319172 - RNA, 23 nt, Human
ucccaggaacaaucgauggccuu

SEQ ID NO: 2319173 - RNA, 18 nt, Human
ucccaggacaccacaccc

SEQ ID NO: 2319174 - RNA, 19 nt, Human
ucccaggacaccacaccca

SEQ ID NO: 2319175 - RNA, 21 nt, Human
ucccaggacaccacacccagc

SEQ ID NO: 2319176 - RNA, 22 nt, Human
ucccaggacaccacacccagcc

SEQ ID NO: 2319177 - RNA, 23 nt, Human
uccugagccagugucaggaggaa

SEQ ID NO: 2319178 - RNA, 23 nt, Human
uccugagaauaagaaaguuucac

SEQ ID NO: 2319179 - RNA, 16 nt, Human
uccugagaccacagag

SEQ ID NO: 2319180 - RNA, 22 nt, Human
uccugagcuuggccagaagggg

SEQ ID NO: 2319181 - RNA, 16 nt, Human
uccugaggacagcugu

SEQ ID NO: 2319182 - RNA, 18 nt, Human
uccugaggacagcugucc

SEQ ID NO: 2319183 - RNA, 20 nt, Human
uccugagcuuggccagaagg

SEQ ID NO: 2319184 - RNA, 19 nt, Human
uccugagcuuggccagaag

SEQ ID NO: 2319185 - RNA, 16 nt, Human
uccugagcuuggccag

SEQ ID NO: 2319186 - RNA, 15 nt, Human
uccugagcuuggcca

SEQ ID NO: 2319187 - RNA, 12 nt, Human
uccugagcuugg

SEQ ID NO: 2319188 - RNA, 16 nt, Human
uccugacucugccccc

SEQ ID NO: 2319189 - RNA, 17 nt, Human
uccugacucugcccccu

SEQ ID NO: 2319190 - RNA, 22 nt, Human
uccugacucugcccccugcugg

SEQ ID NO: 2319191 - RNA, 23 nt, Human
uccugacucugcccccugcuggc

SEQ ID NO: 2319192 - RNA, 19 nt, Human
uccugacucaacauguuac

SEQ ID NO: 2319193 - RNA, 14 nt, Human
uccugacucugccc

SEQ ID NO: 2319194 - RNA, 15 nt, Human
uccugacucugcccc

SEQ ID NO: 2319195 - RNA, 20 nt, Human
uccucuuaaaaaauaaaaac

SEQ ID NO: 2319196 - RNA, 13 nt, Human
uccucuuauuugc

SEQ ID NO: 2319197 - RNA, 24 nt, Human
uccugagaaaaaagguuccgcuug

SEQ ID NO: 2319198 - RNA, 19 nt, Human
uccugagaaaaaagguucc

SEQ ID NO: 2319199 - RNA, 16 nt, Human
uccugacuucaggggc

SEQ ID NO: 2319200 - RNA, 19 nt, Human
uccugacuucaggggcugc

SEQ ID NO: 2319201 - RNA, 22 nt, Human
uccugacuucaggggcugcccg

SEQ ID NO: 2319202 - RNA, 21 nt, Human
uccugacuucaggggcugccc

SEQ ID NO: 2319203 - RNA, 15 nt, Human
uccuccucccccaga

SEQ ID NO: 2319204 - RNA, 14 nt, Human
uccuccucccugca

SEQ ID NO: 2319205 - RNA, 13 nt, Human
uccuccucccugc

SEQ ID NO: 2319206 - RNA, 18 nt, Human
uccuccucccugcaucug

SEQ ID NO: 2319207 - RNA, 17 nt, Human
uccuccucccugcaucu

SEQ ID NO: 2319208 - RNA, 13 nt, Human
uccuccucuguga

SEQ ID NO: 2319209 - RNA, 11 nt, Human
uccuccucugu

SEQ ID NO: 2319210 - RNA, 20 nt, Human
uccucccacccggcugcaga

SEQ ID NO: 2319211 - RNA, 21 nt, Human
uccucccacccggcugcagag

SEQ ID NO: 2319212 - RNA, 19 nt, Human
uccucccaaguggugccua

SEQ ID NO: 2319213 - RNA, 14 nt, Human
uccuccucccaccc

SEQ ID NO: 2319214 - RNA, 20 nt, Human
uccuccucccacccggcugc

SEQ ID NO: 2319215 - RNA, 16 nt, Human
uccucuguccagggcc

SEQ ID NO: 2319216 - RNA, 14 nt, Human
uccucuguccaggg

SEQ ID NO: 2319217 - RNA, 22 nt, Human
uccucuguccaggcacugcugc

SEQ ID NO: 2319218 - RNA, 12 nt, Human
uccuccucugug

SEQ ID NO: 2319219 - RNA, 23 nt, Human
uccucuguccagggcccugagcu

SEQ ID NO: 2319220 - RNA, 12 nt, Human
uccucugucugc

SEQ ID NO: 2319221 - RNA, 14 nt, Human
uccucugucugccc

SEQ ID NO: 2319222 - RNA, 22 nt, Human
uccucuguuucuccuucugaaa

SEQ ID NO: 2319223 - RNA, 12 nt, Human
uccucugugaag

SEQ ID NO: 2319224 - RNA, 20 nt, Human
uccucugugaccaaugucuu

SEQ ID NO: 2319225 - RNA, 21 nt, Human
uccucugugaccaaugucuug

SEQ ID NO: 2319226 - RNA, 19 nt, Human
uccucugugaccaaugucu

SEQ ID NO: 2319227 - RNA, 15 nt, Human
uccucugucugcccu

SEQ ID NO: 2319228 - RNA, 18 nt, Human
uccucugucugcccuuca

SEQ ID NO: 2319229 - RNA, 17 nt, Human
uccugcccaguccccca

SEQ ID NO: 2319230 - RNA, 21 nt, Human
uccugcccagucccccaaccc

SEQ ID NO: 2319231 - RNA, 13 nt, Human
uccugcccagucc

SEQ ID NO: 2319232 - RNA, 14 nt, Human
uccugcccaguccc

SEQ ID NO: 2319233 - RNA, 15 nt, Human
uccugcccagucccc

SEQ ID NO: 2319234 - RNA, 16 nt, Human
uccugcccaguccccc

SEQ ID NO: 2319235 - RNA, 15 nt, Human
uccugcccccugaaa

SEQ ID NO: 2319236 - RNA, 14 nt, Human
uccugccccaggcc

SEQ ID NO: 2319237 - RNA, 15 nt, Human
uccugccccaggccu

SEQ ID NO: 2319238 - RNA, 23 nt, Human
uccugcccaggagagccagcccu

SEQ ID NO: 2319239 - RNA, 22 nt, Human
uccugcccaggagagccagccc

SEQ ID NO: 2319240 - RNA, 19 nt, Human
uccugcccaggagagccag

SEQ ID NO: 2319241 - RNA, 18 nt, Human
uccugcccaggagagcca

SEQ ID NO: 2319242 - RNA, 16 nt, Human
uccugcccaggagagc

SEQ ID NO: 2319243 - RNA, 14 nt, Human
uccugcccaggaga

SEQ ID NO: 2319244 - RNA, 13 nt, Human
uccugcccaggag

SEQ ID NO: 2319245 - RNA, 12 nt, Human
uccugcccagga

SEQ ID NO: 2319246 - RNA, 20 nt, Human
uccugccaccuggggcaguc

SEQ ID NO: 2319247 - RNA, 18 nt, Human
uccugccaccuggggcag

SEQ ID NO: 2319248 - RNA, 17 nt, Human
uccugccaguguggaac

SEQ ID NO: 2319249 - RNA, 10 nt, Human
uccugcccug

SEQ ID NO: 2319250 - RNA, 16 nt, Human
uccugccccuguucuc

SEQ ID NO: 2319251 - RNA, 14 nt, Human
uccugccccuguuc

SEQ ID NO: 2319252 - RNA, 12 nt, Human
uccugcccuaca

SEQ ID NO: 2319253 - RNA, 18 nt, Human
uccugccccugagcccau

SEQ ID NO: 2319254 - RNA, 17 nt, Human
uccugccccugagccca

SEQ ID NO: 2319255 - RNA, 17 nt, Human
uccugcccccugaaacu

SEQ ID NO: 2319256 - RNA, 19 nt, Human
uccugcccccugaaacuua

SEQ ID NO: 2319257 - RNA, 21 nt, Human
uccugcccccugaaacuuauu

SEQ ID NO: 2319258 - RNA, 22 nt, Human
uccugcccccugaaacuuauuu

SEQ ID NO: 2319259 - RNA, 14 nt, Human
uccugccaggcaug

SEQ ID NO: 2319260 - RNA, 13 nt, Human
uccugccaggcau

SEQ ID NO: 2319261 - RNA, 13 nt, Human
uccugccaccugc

SEQ ID NO: 2319262 - RNA, 14 nt, Human
uccugccaccaguc

SEQ ID NO: 2319263 - RNA, 16 nt, Human
uccugccaccagucac

SEQ ID NO: 2319264 - RNA, 17 nt, Human
uccugccaccagucacu

SEQ ID NO: 2319265 - RNA, 22 nt, Human
uccugccaccagucacuguccc

SEQ ID NO: 2319266 - RNA, 16 nt, Human
uccugccaccacgccc

SEQ ID NO: 2319267 - RNA, 11 nt, Human
uccugccacca

SEQ ID NO: 2319268 - RNA, 11 nt, Human
uccugccaaaa

SEQ ID NO: 2319269 - RNA, 16 nt, Human
uccugcauuugugaaa

SEQ ID NO: 2319270 - RNA, 21 nt, Human
uccugaggcuccacuuggucu

SEQ ID NO: 2319271 - RNA, 19 nt, Human
uccugaggacagcuguccu

SEQ ID NO: 2319272 - RNA, 20 nt, Human
uccugaggcuccacuugguc

SEQ ID NO: 2319273 - RNA, 19 nt, Human
uccugaggcuccacuuggu

SEQ ID NO: 2319274 - RNA, 18 nt, Human
uccugccgcagagcuggc

SEQ ID NO: 2319275 - RNA, 20 nt, Human
uccugccgcagagcuggccg

SEQ ID NO: 2319276 - RNA, 13 nt, Human
uccugccgcagag

SEQ ID NO: 2319277 - RNA, 15 nt, Human
uccugccgcagagcu

SEQ ID NO: 2319278 - RNA, 16 nt, Human
uccugccgcagagcug

SEQ ID NO: 2319279 - RNA, 17 nt, Human
uccugccgcagagcugg

SEQ ID NO: 2319280 - RNA, 20 nt, Human
uccugcccuuaccugccagg

SEQ ID NO: 2319281 - RNA, 18 nt, Human
uccugcccuguuguguau

SEQ ID NO: 2319282 - RNA, 15 nt, Human
uccugcccuuccuca

SEQ ID NO: 2319283 - RNA, 16 nt, Human
uccugcccuuccucag

SEQ ID NO: 2319284 - RNA, 17 nt, Human
uccugcccuuccucagu

SEQ ID NO: 2319285 - RNA, 19 nt, Human
uccugcccuuccucaguuu

SEQ ID NO: 2319286 - RNA, 14 nt, Human
uccugccgacuccu

SEQ ID NO: 2319287 - RNA, 15 nt, Human
uccugccgacuccug

SEQ ID NO: 2319288 - RNA, 16 nt, Human
uccugccgacuccugg

SEQ ID NO: 2319289 - RNA, 15 nt, Human
uccugcccugggagg

SEQ ID NO: 2319290 - RNA, 14 nt, Human
uccugcccugggag

SEQ ID NO: 2319291 - RNA, 12 nt, Human
uccugcccuggg

SEQ ID NO: 2319292 - RNA, 11 nt, Human
uccugcccugg

SEQ ID NO: 2319293 - RNA, 12 nt, Human
uccugcccuguu

SEQ ID NO: 2319294 - RNA, 14 nt, Human
uccugcccuacaga

SEQ ID NO: 2319295 - RNA, 23 nt, Human
uccugcccuacagaggucucugc

SEQ ID NO: 2319296 - RNA, 21 nt, Human
uccugcccugggaggcaguga

SEQ ID NO: 2319297 - RNA, 17 nt, Human
uccugcccuuaccugcc

SEQ ID NO: 2319298 - RNA, 18 nt, Human
uccuggagccuuugaaua

SEQ ID NO: 2319299 - RNA, 22 nt, Human
uccuggagcccagaggagggca

SEQ ID NO: 2319300 - RNA, 14 nt, Human
uccuggaggcccag

SEQ ID NO: 2319301 - RNA, 13 nt, Human
uccuggaggccca

SEQ ID NO: 2319302 - RNA, 15 nt, Human
uccuggagcccagag

SEQ ID NO: 2319303 - RNA, 18 nt, Human
uccuggagcccagaggag

SEQ ID NO: 2319304 - RNA, 18 nt, Human
uccuggagcagaccaccc

SEQ ID NO: 2319305 - RNA, 19 nt, Human
uccuggagcagaccacccc

SEQ ID NO: 2319306 - RNA, 14 nt, Human
uccuggaguucugg

SEQ ID NO: 2319307 - RNA, 21 nt, Human
uccuggagggaagcacugccu

SEQ ID NO: 2319308 - RNA, 18 nt, Human
uccuggaggcccaguuca

SEQ ID NO: 2319309 - RNA, 15 nt, Human
uccuggaggcccagu

SEQ ID NO: 2319310 - RNA, 19 nt, Human
uccuggacauuuuuucagu

SEQ ID NO: 2319311 - RNA, 22 nt, Human
uccuggacaugaagauucuuuc

SEQ ID NO: 2319312 - RNA, 22 nt, Human
uccuggacauccucuucugcuu

SEQ ID NO: 2319313 - RNA, 14 nt, Human
uccuggacauuuuu

SEQ ID NO: 2319314 - RNA, 21 nt, Human
uccuggacauccucuucugcu

SEQ ID NO: 2319315 - RNA, 21 nt, Human
uccuggacaugaagauucuuu

SEQ ID NO: 2319316 - RNA, 19 nt, Human
uccugccuaaggcugaacu

SEQ ID NO: 2319317 - RNA, 16 nt, Human
uccugccuaaggcuga

SEQ ID NO: 2319318 - RNA, 17 nt, Human
uccuguagcaucuucug

SEQ ID NO: 2319319 - RNA, 19 nt, Human
uccuguagcaucuucugga

SEQ ID NO: 2319320 - RNA, 21 nt, Human
uccuguagcaucuucuggagu

SEQ ID NO: 2319321 - RNA, 22 nt, Human
uccuguagcaucuucuggaguc

SEQ ID NO: 2319322 - RNA, 16 nt, Human
uccuguagcucucccu

SEQ ID NO: 2319323 - RNA, 16 nt, Human
uccugucugccagcca

SEQ ID NO: 2319324 - RNA, 14 nt, Human
uccugucugccagc

SEQ ID NO: 2319325 - RNA, 13 nt, Human
uccugucugccag

SEQ ID NO: 2319326 - RNA, 12 nt, Human
uccugucugcca

SEQ ID NO: 2319327 - RNA, 21 nt, Human
uccuguagccuucuguaggaa

SEQ ID NO: 2319328 - RNA, 22 nt, Human
uccuguagccuucuguaggaau

SEQ ID NO: 2319329 - RNA, 15 nt, Human
uccugucuaacugcu

SEQ ID NO: 2319330 - RNA, 15 nt, Human
uccugucucuggccu

SEQ ID NO: 2319331 - RNA, 23 nt, Human
uccuguagaccuagggaggaccu

SEQ ID NO: 2319332 - RNA, 21 nt, Human
uccuguagagguuuuguuguu

SEQ ID NO: 2319333 - RNA, 14 nt, Human
uccuguagcaucuu

SEQ ID NO: 2319334 - RNA, 15 nt, Human
uccuguagcaucuuc

SEQ ID NO: 2319335 - RNA, 20 nt, Human
uccuguagaccuagggagga

SEQ ID NO: 2319336 - RNA, 16 nt, Human
uccuggccuggcuucu

SEQ ID NO: 2319337 - RNA, 16 nt, Human
uccuggcccucugugu

SEQ ID NO: 2319338 - RNA, 23 nt, Human
uccuggccuggcacaucagaaag

SEQ ID NO: 2319339 - RNA, 13 nt, Human
uccuggccuggca

SEQ ID NO: 2319340 - RNA, 13 nt, Human
uccuguagcccua

SEQ ID NO: 2319341 - RNA, 11 nt, Human
uccuguagccc

SEQ ID NO: 2319342 - RNA, 12 nt, Human
uccuggccucaa

SEQ ID NO: 2319343 - RNA, 18 nt, Human
uccuggcccaucagugua

SEQ ID NO: 2319344 - RNA, 17 nt, Human
uccuggcccaucagugu

SEQ ID NO: 2319345 - RNA, 13 nt, Human
uccuggcccucug

SEQ ID NO: 2319346 - RNA, 11 nt, Human
uccuggcccau

SEQ ID NO: 2319347 - RNA, 13 nt, Human
uccuggcccauca

SEQ ID NO: 2319348 - RNA, 14 nt, Human
uccuggcccaucag

SEQ ID NO: 2319349 - RNA, 23 nt, Human
uccuggcacccggccccugcugg

SEQ ID NO: 2319350 - RNA, 17 nt, Human
uccuggcaauagucaaa

SEQ ID NO: 2319351 - RNA, 13 nt, Human
uccuggcacugcu

SEQ ID NO: 2319352 - RNA, 16 nt, Human
uccuggcacugcuucc

SEQ ID NO: 2319353 - RNA, 15 nt, Human
uccuacccugcgccc

SEQ ID NO: 2319354 - RNA, 18 nt, Human
uccuaccccucccagcug

SEQ ID NO: 2319355 - RNA, 17 nt, Human
uccuacccucgggccca

SEQ ID NO: 2319356 - RNA, 21 nt, Human
uccuacccucgggcccaccug

SEQ ID NO: 2319357 - RNA, 18 nt, Human
uccuagucucccucacag

SEQ ID NO: 2319358 - RNA, 20 nt, Human
uccuacauuaauuaucuagu

SEQ ID NO: 2319359 - RNA, 21 nt, Human
uccuaccccaauuccuuguag

SEQ ID NO: 2319360 - RNA, 12 nt, Human
uccuaccccucc

SEQ ID NO: 2319361 - RNA, 13 nt, Human
uccuaccccuccc

SEQ ID NO: 2319362 - RNA, 14 nt, Human
uccuaccccuccca

SEQ ID NO: 2319363 - RNA, 15 nt, Human
uccuaccccucccag

SEQ ID NO: 2319364 - RNA, 16 nt, Human
uccuaccccucccagc

SEQ ID NO: 2319365 - RNA, 17 nt, Human
uccuaccccucccagcu

SEQ ID NO: 2319366 - RNA, 23 nt, Human
uccuagugaaagaggcagcuuga

SEQ ID NO: 2319367 - RNA, 14 nt, Human
uccuagugaaagag

SEQ ID NO: 2319368 - RNA, 22 nt, Human
uccuagugcuuuccuuuuuuaa

SEQ ID NO: 2319369 - RNA, 23 nt, Human
uccuagucucuaucauuaaaguu

SEQ ID NO: 2319370 - RNA, 12 nt, Human
uccuaguuccac

SEQ ID NO: 2319371 - RNA, 23 nt, Human
uccuauauuguuuucaguguaca

SEQ ID NO: 2319372 - RNA, 17 nt, Human
uccuaucaccuccccuc

SEQ ID NO: 2319373 - RNA, 16 nt, Human
uccuaucaccuccccu

SEQ ID NO: 2319374 - RNA, 14 nt, Human
uccuaucaccuccc

SEQ ID NO: 2319375 - RNA, 20 nt, Human
uccuaucaagccaguacgug

SEQ ID NO: 2319376 - RNA, 19 nt, Human
uccuaucaccuauuuccau

SEQ ID NO: 2319377 - RNA, 21 nt, Human
uccuauauuguuuucagugua

SEQ ID NO: 2319378 - RNA, 19 nt, Human
uccuacaagagcagccugu

SEQ ID NO: 2319379 - RNA, 18 nt, Human
uccuaaggacacacuaau

SEQ ID NO: 2319380 - RNA, 16 nt, Human
uccuaaggacacacua

SEQ ID NO: 2319381 - RNA, 17 nt, Human
uccuaaggacacacuaa

SEQ ID NO: 2319382 - RNA, 12 nt, Human
uccuaaggacac

SEQ ID NO: 2319383 - RNA, 23 nt, Human
uccuacaagagcagccuguggca

SEQ ID NO: 2319384 - RNA, 22 nt, Human
uccuacaagagcagccuguggc

SEQ ID NO: 2319385 - RNA, 20 nt, Human
uccuacaagagcagccugug

SEQ ID NO: 2319386 - RNA, 17 nt, Human
uccuacacccuuggacu

SEQ ID NO: 2319387 - RNA, 18 nt, Human
uccuacacccuuggacuu

SEQ ID NO: 2319388 - RNA, 20 nt, Human
uccuacacccuuggacuuga

SEQ ID NO: 2319389 - RNA, 15 nt, Human
uccuacaccuaacuc

SEQ ID NO: 2319390 - RNA, 16 nt, Human
uccuacaccuaacuca

SEQ ID NO: 2319391 - RNA, 16 nt, Human
uccuacagauagucaa

SEQ ID NO: 2319392 - RNA, 17 nt, Human
uccuacagccccuuuuu

SEQ ID NO: 2319393 - RNA, 13 nt, Human
uccuacagccccu

SEQ ID NO: 2319394 - RNA, 21 nt, Human
uccuacaguuggaaauccauc

SEQ ID NO: 2319395 - RNA, 23 nt, Human
uccuacaguuggaaauccaucca

SEQ ID NO: 2319396 - RNA, 14 nt, Human
uccuccaagccagc

SEQ ID NO: 2319397 - RNA, 12 nt, Human
uccuccaagcca

SEQ ID NO: 2319398 - RNA, 21 nt, Human
uccuccaagacacuguggacu

SEQ ID NO: 2319399 - RNA, 15 nt, Human
uccuccacauccuuu

SEQ ID NO: 2319400 - RNA, 16 nt, Human
uccuccacauccuuuc

SEQ ID NO: 2319401 - RNA, 22 nt, Human
uccuccaacaccaagcacagca

SEQ ID NO: 2319402 - RNA, 17 nt, Human
uccuccaagaaucuauc

SEQ ID NO: 2319403 - RNA, 20 nt, Human
uccuccaagacacuguggac

SEQ ID NO: 2319404 - RNA, 17 nt, Human
uccuccaacaccaagca

SEQ ID NO: 2319405 - RNA, 18 nt, Human
uccuccaaaggcccccua

SEQ ID NO: 2319406 - RNA, 23 nt, Human
uccuccaaaggcccccuacgcca

SEQ ID NO: 2319407 - RNA, 19 nt, Human
uccuccacguucugcucau

SEQ ID NO: 2319408 - RNA, 20 nt, Human
uccuccaccugccguggacu

SEQ ID NO: 2319409 - RNA, 18 nt, Human
uccuccaccgccauggcu

SEQ ID NO: 2319410 - RNA, 21 nt, Human
uccuccaccgccauggcuucc

SEQ ID NO: 2319411 - RNA, 22 nt, Human
uccuccaccgccauggcuucca

SEQ ID NO: 2319412 - RNA, 23 nt, Human
uccuccaccgccauggcuuccaa

SEQ ID NO: 2319413 - RNA, 23 nt, Human
uccuccacauccuuucuaaacaa

SEQ ID NO: 2319414 - RNA, 18 nt, Human
uccucauuagcauuuugc

SEQ ID NO: 2319415 - RNA, 17 nt, Human
uccuaucagaaguuucu

SEQ ID NO: 2319416 - RNA, 23 nt, Human
uccuccaaaggaagucuaggagc

SEQ ID NO: 2319417 - RNA, 17 nt, Human
uccuccaaaggcccccu

SEQ ID NO: 2319418 - RNA, 23 nt, Human
uccucauuugggguagcuagagg

SEQ ID NO: 2319419 - RNA, 21 nt, Human
uccucauuugggguagcuaga

SEQ ID NO: 2319420 - RNA, 19 nt, Human
uccucauuugggguagcua

SEQ ID NO: 2319421 - RNA, 14 nt, Human
uccucauuccugaa

SEQ ID NO: 2319422 - RNA, 19 nt, Human
uccuaucaccuccccuccu

SEQ ID NO: 2319423 - RNA, 17 nt, Human
uccuccaucgcaguguu

SEQ ID NO: 2319424 - RNA, 16 nt, Human
uccuccaucuccaaga

SEQ ID NO: 2319425 - RNA, 16 nt, Human
uccuccauacucagga

SEQ ID NO: 2319426 - RNA, 17 nt, Human
uccucccaaguggugcc

SEQ ID NO: 2319427 - RNA, 19 nt, Human
uccuccaucuccaagaaug

SEQ ID NO: 2319428 - RNA, 12 nt, Human
uccuccauggga

SEQ ID NO: 2319429 - RNA, 21 nt, Human
uccucccaauuucagacuccc

SEQ ID NO: 2319430 - RNA, 20 nt, Human
uccucccaauuucagacucc

SEQ ID NO: 2319431 - RNA, 12 nt, Human
uccucccaccuc

SEQ ID NO: 2319432 - RNA, 21 nt, Human
uccuccuccaaaggcccccua

SEQ ID NO: 2319433 - RNA, 21 nt, Human
uccuccagggaugaucaacag

SEQ ID NO: 2319434 - RNA, 14 nt, Human
uccuccagcuucug

SEQ ID NO: 2319435 - RNA, 13 nt, Human
uccuccagcuucu

SEQ ID NO: 2319436 - RNA, 10 nt, Human
uccuccagcu

SEQ ID NO: 2319437 - RNA, 23 nt, Human
uccuccagggccacgugccaggc

SEQ ID NO: 2319438 - RNA, 20 nt, Human
uccuccagggccacgugcca

SEQ ID NO: 2319439 - RNA, 19 nt, Human
uccuccagggccacgugcc

SEQ ID NO: 2319440 - RNA, 13 nt, Human
uccuccagggcca

SEQ ID NO: 2319441 - RNA, 10 nt, Human
uccuccaggu

SEQ ID NO: 2319442 - RNA, 22 nt, Human
ucccccugggcucugccccagc

SEQ ID NO: 2319443 - RNA, 20 nt, Human
ucccccugggcucugcccca

SEQ ID NO: 2319444 - RNA, 15 nt, Human
ucccccugggcucug

SEQ ID NO: 2319445 - RNA, 14 nt, Human
ucccccugggcucu

SEQ ID NO: 2319446 - RNA, 12 nt, Human
ucccccugggcu

SEQ ID NO: 2319447 - RNA, 14 nt, Human
ucccccccggggcu

SEQ ID NO: 2319448 - RNA, 18 nt, Human
ucccccccggggcugggu

SEQ ID NO: 2319449 - RNA, 23 nt, Human
uccccccacugcaggccccgcuu

SEQ ID NO: 2319450 - RNA, 16 nt, Human
uccccccccccuccaa

SEQ ID NO: 2319451 - RNA, 16 nt, Human
uccccccccuguauag

SEQ ID NO: 2319452 - RNA, 17 nt, Human
uccccccccuguauagu

SEQ ID NO: 2319453 - RNA, 19 nt, Human
uccccccacugcaggcccc

SEQ ID NO: 2319454 - RNA, 18 nt, Human
uccccccacugcaggccc

SEQ ID NO: 2319455 - RNA, 13 nt, Human
uccccccacugca

SEQ ID NO: 2319456 - RNA, 12 nt, Human
uccccccacugc

SEQ ID NO: 2319457 - RNA, 12 nt, Human
uccccccaucuu

SEQ ID NO: 2319458 - RNA, 15 nt, Human
uccccccaucuugcu

SEQ ID NO: 2319459 - RNA, 18 nt, Human
ucccccccaugcacugug

SEQ ID NO: 2319460 - RNA, 17 nt, Human
ucccccccaugcacugu

SEQ ID NO: 2319461 - RNA, 13 nt, Human
ucccccccaugca

SEQ ID NO: 2319462 - RNA, 22 nt, Human
uccccccaucuugcuucccuaa

SEQ ID NO: 2319463 - RNA, 23 nt, Human
ucccccugggcucugccccagcu

SEQ ID NO: 2319464 - RNA, 10 nt, Human
ucccccuggg

SEQ ID NO: 2319465 - RNA, 20 nt, Human
ucccccuggggcuucuccug

SEQ ID NO: 2319466 - RNA, 21 nt, Human
ucccccuggggcuucuccuga

SEQ ID NO: 2319467 - RNA, 15 nt, Human
ucccccuguccccuc

SEQ ID NO: 2319468 - RNA, 16 nt, Human
ucccccuguccccuca

SEQ ID NO: 2319469 - RNA, 19 nt, Human
ucccccuguccccucagcu

SEQ ID NO: 2319470 - RNA, 15 nt, Human
ucccccuuccaugga

SEQ ID NO: 2319471 - RNA, 19 nt, Human
ucccuucacauaguuuuua

SEQ ID NO: 2319472 - RNA, 22 nt, Human
ucccuucaaccauuccccaugg

SEQ ID NO: 2319473 - RNA, 15 nt, Human
ucccccuucacaaag

SEQ ID NO: 2319474 - RNA, 14 nt, Human
ucccccuucacaaa

SEQ ID NO: 2319475 - RNA, 20 nt, Human
ucccuuccccucccuggcuc

SEQ ID NO: 2319476 - RNA, 21 nt, Human
ucccuuccccucccuggcucc

SEQ ID NO: 2319477 - RNA, 12 nt, Human
ucccuuccccuc

SEQ ID NO: 2319478 - RNA, 17 nt, Human
ucccuucccccauaagc

SEQ ID NO: 2319479 - RNA, 13 nt, Human
ucccuucaucucc

SEQ ID NO: 2319480 - RNA, 18 nt, Human
ucccuucaucuccaggga

SEQ ID NO: 2319481 - RNA, 22 nt, Human
ucccccuucacaaagcccaagg

SEQ ID NO: 2319482 - RNA, 16 nt, Human
ucccuucaguacccuc

SEQ ID NO: 2319483 - RNA, 18 nt, Human
ucccuucaguacccucuc

SEQ ID NO: 2319484 - RNA, 19 nt, Human
ucccuucaguacccucuca

SEQ ID NO: 2319485 - RNA, 20 nt, Human
ucccuucaguacccucucag

SEQ ID NO: 2319486 - RNA, 21 nt, Human
ucccuucaguacccucucagc

SEQ ID NO: 2319487 - RNA, 23 nt, Human
ucccuucaguacccucucagcuc

SEQ ID NO: 2319488 - RNA, 14 nt, Human
ucccuucacauagu

SEQ ID NO: 2319489 - RNA, 16 nt, Human
ucccuuccucuuucca

SEQ ID NO: 2319490 - RNA, 15 nt, Human
ucccuuccucuuucc

SEQ ID NO: 2319491 - RNA, 12 nt, Human
ucccuugccuca

SEQ ID NO: 2319492 - RNA, 17 nt, Human
uccgccucugcuggcac

SEQ ID NO: 2319493 - RNA, 22 nt, Human
uccgcccugcuccucccuggcu

SEQ ID NO: 2319494 - RNA, 17 nt, Human
uccgccagccuccucug

SEQ ID NO: 2319495 - RNA, 18 nt, Human
uccgccagccuccucugg

SEQ ID NO: 2319496 - RNA, 20 nt, Human
uccgccagccuccucuggac

SEQ ID NO: 2319497 - RNA, 20 nt, Human
uccgcccugcuccucccugg

SEQ ID NO: 2319498 - RNA, 14 nt, Human
uccgccucuugggu

SEQ ID NO: 2319499 - RNA, 11 nt, Human
uccgccagccu

SEQ ID NO: 2319500 - RNA, 12 nt, Human
uccgccagccuc

SEQ ID NO: 2319501 - RNA, 13 nt, Human
uccgccagccucc

SEQ ID NO: 2319502 - RNA, 14 nt, Human
uccgccagccuccu

SEQ ID NO: 2319503 - RNA, 15 nt, Human
uccgccagccuccuc

SEQ ID NO: 2319504 - RNA, 16 nt, Human
uccgccagccuccucu

SEQ ID NO: 2319505 - RNA, 20 nt, Human
ucccuuggaaaccugcccug

SEQ ID NO: 2319506 - RNA, 23 nt, Human
ucccuuggaaaccugcccugccu

SEQ ID NO: 2319507 - RNA, 20 nt, Human
ucccuugccucaaugccagu

SEQ ID NO: 2319508 - RNA, 18 nt, Human
ucccuuggaaaccugccc

SEQ ID NO: 2319509 - RNA, 19 nt, Human
ucccuuggaaaccugcccu

SEQ ID NO: 2319510 - RNA, 14 nt, Human
uccgauccuuccuc

SEQ ID NO: 2319511 - RNA, 12 nt, Human
ucccuuggagcu

SEQ ID NO: 2319512 - RNA, 15 nt, Human
uccgaggggcgggac

SEQ ID NO: 2319513 - RNA, 20 nt, Human
uccgaggggcgggacccagg

SEQ ID NO: 2319514 - RNA, 23 nt, Human
uccgaggggcgggacccaggcac

SEQ ID NO: 2319515 - RNA, 15 nt, Human
uccgauccuuccucc

SEQ ID NO: 2319516 - RNA, 21 nt, Human
uccuaagcuauucaguaauaa

SEQ ID NO: 2319517 - RNA, 20 nt, Human
uccuaagcuauucaguaaua

SEQ ID NO: 2319518 - RNA, 18 nt, Human
uccgcuuucuacccagcg

SEQ ID NO: 2319519 - RNA, 20 nt, Human
uccgcuuucuacccagcgag

SEQ ID NO: 2319520 - RNA, 16 nt, Human
uccgcuuucuacccag

SEQ ID NO: 2319521 - RNA, 12 nt, Human
uccgcuggaggu

SEQ ID NO: 2319522 - RNA, 14 nt, Human
uccgcuggaggugg

SEQ ID NO: 2319523 - RNA, 17 nt, Human
uccgccuucacuccggu

SEQ ID NO: 2319524 - RNA, 20 nt, Human
uccgcucauacaggaaugaa

SEQ ID NO: 2319525 - RNA, 13 nt, Human
ucucauccugcag

SEQ ID NO: 2319526 - RNA, 15 nt, Human
ucucauccugcaggc

SEQ ID NO: 2319527 - RNA, 24 nt, Human
ucucauagcauuaacuaaucuauu

SEQ ID NO: 2319528 - RNA, 20 nt, Human
ucucauagcauuaacuaauc

SEQ ID NO: 2319529 - RNA, 13 nt, Human
ucucauagcauua

SEQ ID NO: 2319530 - RNA, 14 nt, Human
ucucauacguccac

SEQ ID NO: 2319531 - RNA, 15 nt, Human
ucucauacguccacc

SEQ ID NO: 2319532 - RNA, 17 nt, Human
ucucauacguccaccau

SEQ ID NO: 2319533 - RNA, 18 nt, Human
ucucauacucaccucacc

SEQ ID NO: 2319534 - RNA, 16 nt, Human
ucucauacucaccuca

SEQ ID NO: 2319535 - RNA, 17 nt, Human
ucucaucucuuagcucc

SEQ ID NO: 2319536 - RNA, 21 nt, Human
ucucauaggaaaaguacauuu

SEQ ID NO: 2319537 - RNA, 16 nt, Human
ucucauaggaaaagua

SEQ ID NO: 2319538 - RNA, 19 nt, Human
ucucauaggaaaaguacau

SEQ ID NO: 2319539 - RNA, 13 nt, Human
ucucaucugugau

SEQ ID NO: 2319540 - RNA, 20 nt, Human
ucucaucucuuagcuccccu

SEQ ID NO: 2319541 - RNA, 18 nt, Human
ucucaucucuucuuuuaa

SEQ ID NO: 2319542 - RNA, 17 nt, Human
ucucaucugugauuccc

SEQ ID NO: 2319543 - RNA, 12 nt, Human
ucucaucuuucu

SEQ ID NO: 2319544 - RNA, 13 nt, Human
ucucaucuuucuu

SEQ ID NO: 2319545 - RNA, 22 nt, Human
ucucaucuuucuugaucaacau

SEQ ID NO: 2319546 - RNA, 14 nt, Human
ucucaugaaccuca

SEQ ID NO: 2319547 - RNA, 13 nt, Human
ucucaugaaccuc

SEQ ID NO: 2319548 - RNA, 19 nt, Human
ucuaugggacucaaugcac

SEQ ID NO: 2319549 - RNA, 19 nt, Human
ucucagucaugcauaaaua

SEQ ID NO: 2319550 - RNA, 17 nt, Human
ucuaugagaaaagaggc

SEQ ID NO: 2319551 - RNA, 12 nt, Human
ucuaugggacuc

SEQ ID NO: 2319552 - RNA, 13 nt, Human
ucuaugggacuca

SEQ ID NO: 2319553 - RNA, 23 nt, Human
ucucagucaugcauaaauaugca

SEQ ID NO: 2319554 - RNA, 20 nt, Human
ucucagucaugcauaaauau

SEQ ID NO: 2319555 - RNA, 21 nt, Human
ucucagucaugcauaaauaug

SEQ ID NO: 2319556 - RNA, 13 nt, Human
ucucagucucuga

SEQ ID NO: 2319557 - RNA, 11 nt, Human
ucucagucucu

SEQ ID NO: 2319558 - RNA, 23 nt, Human
ucucaguccaugaagauguagag

SEQ ID NO: 2319559 - RNA, 17 nt, Human
ucucagucucugagcag

SEQ ID NO: 2319560 - RNA, 15 nt, Human
ucucagucucugagc

SEQ ID NO: 2319561 - RNA, 18 nt, Human
ucucagucucugagcagu

SEQ ID NO: 2319562 - RNA, 22 nt, Human
ucucaugaaccucaagcugcau

SEQ ID NO: 2319563 - RNA, 14 nt, Human
ucucaugaaucugc

SEQ ID NO: 2319564 - RNA, 18 nt, Human
ucucaugaaucugcaaug

SEQ ID NO: 2319565 - RNA, 13 nt, Human
ucucaugccucag

SEQ ID NO: 2319566 - RNA, 21 nt, Human
ucucaugccccuggcugggac

SEQ ID NO: 2319567 - RNA, 18 nt, Human
ucucaugccccuggcugg

SEQ ID NO: 2319568 - RNA, 13 nt, Human
ucuccacccugcu

SEQ ID NO: 2319569 - RNA, 19 nt, Human
ucucaugccucagccuccu

SEQ ID NO: 2319570 - RNA, 16 nt, Human
ucucaugccucagccu

SEQ ID NO: 2319571 - RNA, 17 nt, Human
ucuccacccugcucucc

SEQ ID NO: 2319572 - RNA, 14 nt, Human
ucuccaccuagugg

SEQ ID NO: 2319573 - RNA, 15 nt, Human
ucuccaccuaguggc

SEQ ID NO: 2319574 - RNA, 16 nt, Human
ucuccaccuaguggcu

SEQ ID NO: 2319575 - RNA, 21 nt, Human
ucuccaccuaguggcugucca

SEQ ID NO: 2319576 - RNA, 14 nt, Human
ucuccacccugcuc

SEQ ID NO: 2319577 - RNA, 16 nt, Human
ucuccacccugcucuc

SEQ ID NO: 2319578 - RNA, 16 nt, Human
ucuccaccucagccuu

SEQ ID NO: 2319579 - RNA, 15 nt, Human
ucuccaccucagccu

SEQ ID NO: 2319580 - RNA, 14 nt, Human
ucuccaccucagcc

SEQ ID NO: 2319581 - RNA, 13 nt, Human
ucuccaccucagc

SEQ ID NO: 2319582 - RNA, 12 nt, Human
ucuccaccucag

SEQ ID NO: 2319583 - RNA, 11 nt, Human
ucuccaccuca

SEQ ID NO: 2319584 - RNA, 22 nt, Human
ucuccaccuaguggcuguccag

SEQ ID NO: 2319585 - RNA, 23 nt, Human
ucuccaccuaguggcuguccagu

SEQ ID NO: 2319586 - RNA, 14 nt, Human
ucuccaccugccag

SEQ ID NO: 2319587 - RNA, 15 nt, Human
ucuccaccugccagg

SEQ ID NO: 2319588 - RNA, 16 nt, Human
ucuccaccugccaggg

SEQ ID NO: 2319589 - RNA, 19 nt, Human
ucuccaccucagccuugga

SEQ ID NO: 2319590 - RNA, 13 nt, Human
ucuccaccugcuc

SEQ ID NO: 2319591 - RNA, 18 nt, Human
ucuccaccucagccuugg

SEQ ID NO: 2319592 - RNA, 17 nt, Human
ucuccaccucagccuug

SEQ ID NO: 2319593 - RNA, 13 nt, Human
ucuccacuccaga

SEQ ID NO: 2319594 - RNA, 22 nt, Human
ucuccaccugccagggacagag

SEQ ID NO: 2319595 - RNA, 17 nt, Human
ucuccaccugccaggga

SEQ ID NO: 2319596 - RNA, 19 nt, Human
ucuccaccugccagggaca

SEQ ID NO: 2319597 - RNA, 13 nt, Human
ucuccccucagag

SEQ ID NO: 2319598 - RNA, 16 nt, Human
ucuccccucaaagucu

SEQ ID NO: 2319599 - RNA, 23 nt, Human
ucuccccucaaagucugcaacuu

SEQ ID NO: 2319600 - RNA, 18 nt, Human
ucuccccucagagugcaa

SEQ ID NO: 2319601 - RNA, 20 nt, Human
ucucccccugggcucugccc

SEQ ID NO: 2319602 - RNA, 11 nt, Human
ucuccccucaa

SEQ ID NO: 2319603 - RNA, 13 nt, Human
ucuccccucaaag

SEQ ID NO: 2319604 - RNA, 12 nt, Human
ucucccccagcc

SEQ ID NO: 2319605 - RNA, 19 nt, Human
ucucccccacccccucccc

SEQ ID NO: 2319606 - RNA, 20 nt, Human
ucucccccacccccuccccg

SEQ ID NO: 2319607 - RNA, 23 nt, Human
ucuccaggcacccuucuuuccuc

SEQ ID NO: 2319608 - RNA, 12 nt, Human
ucucccccaccc

SEQ ID NO: 2319609 - RNA, 15 nt, Human
ucucccccacccccu

SEQ ID NO: 2319610 - RNA, 15 nt, Human
ucuccaggcgccggc

SEQ ID NO: 2319611 - RNA, 19 nt, Human
ucuccccagguccagcucu

SEQ ID NO: 2319612 - RNA, 20 nt, Human
ucuccccagguccagcucug

SEQ ID NO: 2319613 - RNA, 22 nt, Human
ucuccccagguccagcucugga

SEQ ID NO: 2319614 - RNA, 11 nt, Human
ucuccaggcug

SEQ ID NO: 2319615 - RNA, 18 nt, Human
ucuccaggaaggcggggc

SEQ ID NO: 2319616 - RNA, 21 nt, Human
ucuccagcugggcucugcaau

SEQ ID NO: 2319617 - RNA, 19 nt, Human
ucuccaggauugaagagca

SEQ ID NO: 2319618 - RNA, 13 nt, Human
ucuccaggaucca

SEQ ID NO: 2319619 - RNA, 17 nt, Human
ucuccaggcacccuucu

SEQ ID NO: 2319620 - RNA, 15 nt, Human
ucucccugccgccuc

SEQ ID NO: 2319621 - RNA, 14 nt, Human
ucucccugccgccu

SEQ ID NO: 2319622 - RNA, 14 nt, Human
ucucccuggcccuc

SEQ ID NO: 2319623 - RNA, 13 nt, Human
ucucccugccgcc

SEQ ID NO: 2319624 - RNA, 12 nt, Human
ucucccugccgc

SEQ ID NO: 2319625 - RNA, 18 nt, Human
ucucccuccccugccauu

SEQ ID NO: 2319626 - RNA, 12 nt, Human
ucucccuccccu

SEQ ID NO: 2319627 - RNA, 23 nt, Human
ucucccucacagcacagagaaga

SEQ ID NO: 2319628 - RNA, 14 nt, Human
ucucccucccuugg

SEQ ID NO: 2319629 - RNA, 12 nt, Human
ucuccccugccc

SEQ ID NO: 2319630 - RNA, 14 nt, Human
ucuccccugccccc

SEQ ID NO: 2319631 - RNA, 15 nt, Human
ucuccccugccccca

SEQ ID NO: 2319632 - RNA, 23 nt, Human
ucucccucagucuggcccuuccu

SEQ ID NO: 2319633 - RNA, 18 nt, Human
ucucccucagucuggccc

SEQ ID NO: 2319634 - RNA, 20 nt, Human
ucuccagacccccaccccuu

SEQ ID NO: 2319635 - RNA, 19 nt, Human
ucuccagacccccaccccu

SEQ ID NO: 2319636 - RNA, 14 nt, Human
ucuccagauguuuc

SEQ ID NO: 2319637 - RNA, 18 nt, Human
ucuccagauguuuccaga

SEQ ID NO: 2319638 - RNA, 15 nt, Human
ucuccagauguuucc

SEQ ID NO: 2319639 - RNA, 12 nt, Human
ucuccagccagc

SEQ ID NO: 2319640 - RNA, 13 nt, Human
ucuccagccagca

SEQ ID NO: 2319641 - RNA, 19 nt, Human
ucuccagauguuuccagac

SEQ ID NO: 2319642 - RNA, 15 nt, Human
ucuccagacccccac

SEQ ID NO: 2319643 - RNA, 14 nt, Human
ucuccacugccuuc

SEQ ID NO: 2319644 - RNA, 17 nt, Human
ucuccacucaguugcaa

SEQ ID NO: 2319645 - RNA, 16 nt, Human
ucuccaccugcuccca

SEQ ID NO: 2319646 - RNA, 12 nt, Human
ucuccagccccu

SEQ ID NO: 2319647 - RNA, 13 nt, Human
ucuccagccccug

SEQ ID NO: 2319648 - RNA, 14 nt, Human
ucuccagccccugg

SEQ ID NO: 2319649 - RNA, 15 nt, Human
ucuccagccccugga

SEQ ID NO: 2319650 - RNA, 22 nt, Human
ucuccagccccuucucagaauc

SEQ ID NO: 2319651 - RNA, 15 nt, Human
ucuccagccagcaau

SEQ ID NO: 2319652 - RNA, 16 nt, Human
ucuccagccagcaaug

SEQ ID NO: 2319653 - RNA, 23 nt, Human
ucuccagccccuucucagaaucu

SEQ ID NO: 2319654 - RNA, 22 nt, Human
ucuccagccccuggaugcagcc

SEQ ID NO: 2319655 - RNA, 16 nt, Human
ucuccagccccuggau

SEQ ID NO: 2319656 - RNA, 18 nt, Human
ucuccagccccuggaugc

SEQ ID NO: 2319657 - RNA, 14 nt, Human
ucuccagccuggac

SEQ ID NO: 2319658 - RNA, 15 nt, Human
ucuccagccuggacc

SEQ ID NO: 2319659 - RNA, 19 nt, Human
ucuccagccuggaccccca

SEQ ID NO: 2319660 - RNA, 21 nt, Human
ucuccagccuggacccccagc

SEQ ID NO: 2319661 - RNA, 22 nt, Human
ucuccagccuggacccccagcu

SEQ ID NO: 2319662 - RNA, 23 nt, Human
ucuccagccuggacccccagcuu

SEQ ID NO: 2319663 - RNA, 22 nt, Human
ucuccagcuauaacaguaggga

SEQ ID NO: 2319664 - RNA, 14 nt, Human
ucuccagcuccaag

SEQ ID NO: 2319665 - RNA, 11 nt, Human
ucuccagcugg

SEQ ID NO: 2319666 - RNA, 17 nt, Human
ucuccagcugggcucug

SEQ ID NO: 2319667 - RNA, 19 nt, Human
ucuccagcugggcucugca

SEQ ID NO: 2319668 - RNA, 19 nt, Human
ucuagugcagcugauuuua

SEQ ID NO: 2319669 - RNA, 21 nt, Human
ucuaggaagacuuuggaaaga

SEQ ID NO: 2319670 - RNA, 19 nt, Human
ucuaggaagacuuuggaaa

SEQ ID NO: 2319671 - RNA, 15 nt, Human
ucuaggaagacuuug

SEQ ID NO: 2319672 - RNA, 16 nt, Human
ucuaggaagacuuugg

SEQ ID NO: 2319673 - RNA, 14 nt, Human
ucuagugcccucca

SEQ ID NO: 2319674 - RNA, 23 nt, Human
ucuagugcagcugauuuuaacaa

SEQ ID NO: 2319675 - RNA, 22 nt, Human
ucuagugcagcugauuuuaaca

SEQ ID NO: 2319676 - RNA, 20 nt, Human
ucuagugcccuccacagccg

SEQ ID NO: 2319677 - RNA, 18 nt, Human
ucuagugccuucuaaagg

SEQ ID NO: 2319678 - RNA, 14 nt, Human
ucuagugccuucua

SEQ ID NO: 2319679 - RNA, 15 nt, Human
ucuagugcugugaaa

SEQ ID NO: 2319680 - RNA, 14 nt, Human
ucuagugcugugaa

SEQ ID NO: 2319681 - RNA, 13 nt, Human
ucuagugcuguga

SEQ ID NO: 2319682 - RNA, 23 nt, Human
ucuagugccuucuaaagguguug

SEQ ID NO: 2319683 - RNA, 13 nt, Human
ucuagugcugcug

SEQ ID NO: 2319684 - RNA, 23 nt, Human
ucuagugcugugaaaaaaaaaau

SEQ ID NO: 2319685 - RNA, 12 nt, Human
ucuagugggaag

SEQ ID NO: 2319686 - RNA, 19 nt, Human
ucuagugcugugaaaaaaa

SEQ ID NO: 2319687 - RNA, 16 nt, Human
ucuagugcugugaaaa

SEQ ID NO: 2319688 - RNA, 17 nt, Human
ucuagugcugcugaaga

SEQ ID NO: 2319689 - RNA, 15 nt, Human
ucuaguggucuuugu

SEQ ID NO: 2319690 - RNA, 16 nt, Human
ucuaguggucuuugua

SEQ ID NO: 2319691 - RNA, 17 nt, Human
ucuaguggucuuuguaa

SEQ ID NO: 2319692 - RNA, 18 nt, Human
ucuaguggucuuuguaag

SEQ ID NO: 2319693 - RNA, 19 nt, Human
ucuaguggucuuuguaaga

SEQ ID NO: 2319694 - RNA, 21 nt, Human
ucuaguggucuuuguaagagu

SEQ ID NO: 2319695 - RNA, 14 nt, Human
ucuaucagagaaaa

SEQ ID NO: 2319696 - RNA, 14 nt, Human
ucuaucaccaagga

SEQ ID NO: 2319697 - RNA, 16 nt, Human
ucuaucauuaaaguuc

SEQ ID NO: 2319698 - RNA, 15 nt, Human
ucuaucaauagucaa

SEQ ID NO: 2319699 - RNA, 15 nt, Human
ucuaucauuaaaguu

SEQ ID NO: 2319700 - RNA, 14 nt, Human
ucuaucauuaaagu

SEQ ID NO: 2319701 - RNA, 12 nt, Human
ucuaucauuuaa

SEQ ID NO: 2319702 - RNA, 13 nt, Human
ucuaucauuuaau

SEQ ID NO: 2319703 - RNA, 14 nt, Human
ucuaucauuuaaua

SEQ ID NO: 2319704 - RNA, 15 nt, Human
ucuaucauuuaauaa

SEQ ID NO: 2319705 - RNA, 16 nt, Human
ucuaucauuuaauaau

SEQ ID NO: 2319706 - RNA, 17 nt, Human
ucuaucauuuaauaaua

SEQ ID NO: 2319707 - RNA, 18 nt, Human
ucuaucauuuaauaauau

SEQ ID NO: 2319708 - RNA, 22 nt, Human
ucuaucauuuaauaauauacuu

SEQ ID NO: 2319709 - RNA, 17 nt, Human
ucuaugacacaugcaag

SEQ ID NO: 2319710 - RNA, 23 nt, Human
ucuaugaacucuguuuucuuucu

SEQ ID NO: 2319711 - RNA, 15 nt, Human
ucuaucauuuuugua

SEQ ID NO: 2319712 - RNA, 16 nt, Human
ucuaucauuuuuguac

SEQ ID NO: 2319713 - RNA, 17 nt, Human
ucuaucauuuuuguaca

SEQ ID NO: 2319714 - RNA, 17 nt, Human
ucuaugaaguauauaau

SEQ ID NO: 2319715 - RNA, 18 nt, Human
ucuaugaaguauauaaug

SEQ ID NO: 2319716 - RNA, 12 nt, Human
ucuaugagaaaa

SEQ ID NO: 2319717 - RNA, 14 nt, Human
ucuaugacacaugc

SEQ ID NO: 2319718 - RNA, 18 nt, Human
ucuaugaaauauuauguu

SEQ ID NO: 2319719 - RNA, 16 nt, Human
ucuacacauacaugua

SEQ ID NO: 2319720 - RNA, 18 nt, Human
ucuacagacuucuccaga

SEQ ID NO: 2319721 - RNA, 17 nt, Human
ucuacagacuucuccag

SEQ ID NO: 2319722 - RNA, 16 nt, Human
ucuacagacuucucca

SEQ ID NO: 2319723 - RNA, 19 nt, Human
ucuacagagcuucccugac

SEQ ID NO: 2319724 - RNA, 18 nt, Human
ucuacagagcuucccuga

SEQ ID NO: 2319725 - RNA, 17 nt, Human
ucuacagagcuucccug

SEQ ID NO: 2319726 - RNA, 16 nt, Human
ucuacagagcuucccu

SEQ ID NO: 2319727 - RNA, 15 nt, Human
ucuacagaggccaug

SEQ ID NO: 2319728 - RNA, 16 nt, Human
ucuacagaggccaugg

SEQ ID NO: 2319729 - RNA, 17 nt, Human
ucuacaaugugaacuuu

SEQ ID NO: 2319730 - RNA, 15 nt, Human
ucuacaaugugaacu

SEQ ID NO: 2319731 - RNA, 20 nt, Human
ucuacaaugugaacuuuauu

SEQ ID NO: 2319732 - RNA, 19 nt, Human
ucuacaaugugaacuuuau

SEQ ID NO: 2319733 - RNA, 14 nt, Human
ucuacacagagcag

SEQ ID NO: 2319734 - RNA, 17 nt, Human
ucuacacuaagagagaa

SEQ ID NO: 2319735 - RNA, 18 nt, Human
ucuacaaaauccugauga

SEQ ID NO: 2319736 - RNA, 16 nt, Human
ucuaaaguuuacagua

SEQ ID NO: 2319737 - RNA, 17 nt, Human
ucuaaaguuuacaguaa

SEQ ID NO: 2319738 - RNA, 18 nt, Human
ucuaaaguuuacaguaaa

SEQ ID NO: 2319739 - RNA, 19 nt, Human
ucuaaaguuuacaguaaau

SEQ ID NO: 2319740 - RNA, 22 nt, Human
ucuaaaguuuacaguaaauaaa

SEQ ID NO: 2319741 - RNA, 16 nt, Human
ucuaauuuuuaagcaa

SEQ ID NO: 2319742 - RNA, 17 nt, Human
ucuaauuuuuauucaua

SEQ ID NO: 2319743 - RNA, 18 nt, Human
ucuaauuuuuauucauaa

SEQ ID NO: 2319744 - RNA, 19 nt, Human
ucuacuucugcccuugcca

SEQ ID NO: 2319745 - RNA, 21 nt, Human
ucuacuuaauccaauggguuu

SEQ ID NO: 2319746 - RNA, 21 nt, Human
ucuacuguauggaauacaaug

SEQ ID NO: 2319747 - RNA, 19 nt, Human
ucuacugggagccuaccca

SEQ ID NO: 2319748 - RNA, 16 nt, Human
ucuacugggagccuac

SEQ ID NO: 2319749 - RNA, 16 nt, Human
ucuacuggucuugugg

SEQ ID NO: 2319750 - RNA, 23 nt, Human
ucuacuggucuuguggaauuggg

SEQ ID NO: 2319751 - RNA, 20 nt, Human
ucuacuggucuuguggaauu

SEQ ID NO: 2319752 - RNA, 17 nt, Human
ucuacgcucuccuuucu

SEQ ID NO: 2319753 - RNA, 16 nt, Human
ucuacgcucuccuuuc

SEQ ID NO: 2319754 - RNA, 19 nt, Human
ucuacgguguaugguucug

SEQ ID NO: 2319755 - RNA, 14 nt, Human
ucuacuaaaaagaa

SEQ ID NO: 2319756 - RNA, 21 nt, Human
ucuacuaaaaagaaggaaaau

SEQ ID NO: 2319757 - RNA, 15 nt, Human
ucuacgcucuccuuu

SEQ ID NO: 2319758 - RNA, 17 nt, Human
ucuaccuugaggucuuu

SEQ ID NO: 2319759 - RNA, 16 nt, Human
ucuaccuugaggucuu

SEQ ID NO: 2319760 - RNA, 14 nt, Human
ucuaccuucuguag

SEQ ID NO: 2319761 - RNA, 16 nt, Human
ucuaccuucuguaguu

SEQ ID NO: 2319762 - RNA, 21 nt, Human
ucuaccuggucucuccuuguu

SEQ ID NO: 2319763 - RNA, 15 nt, Human
ucuaccuuccaguca

SEQ ID NO: 2319764 - RNA, 21 nt, Human
ucuaccuuccagucaggauga

SEQ ID NO: 2319765 - RNA, 14 nt, Human
ucuaccuuccugca

SEQ ID NO: 2319766 - RNA, 16 nt, Human
ucggcagauacugucu

SEQ ID NO: 2319767 - RNA, 16 nt, Human
ucggcauuucaaaugu

SEQ ID NO: 2319768 - RNA, 20 nt, Human
ucggaucuggggcucuggga

SEQ ID NO: 2319769 - RNA, 16 nt, Human
ucggauuuggggugga

SEQ ID NO: 2319770 - RNA, 19 nt, Human
ucggaguaucugggaacug

SEQ ID NO: 2319771 - RNA, 17 nt, Human
ucggaguaucugggaac

SEQ ID NO: 2319772 - RNA, 22 nt, Human
ucggagggaauugaggucugcu

SEQ ID NO: 2319773 - RNA, 20 nt, Human
ucggagggaauugaggucug

SEQ ID NO: 2319774 - RNA, 21 nt, Human
ucggagacagugaucuccaua

SEQ ID NO: 2319775 - RNA, 15 nt, Human
ucggagacagugauc

SEQ ID NO: 2319776 - RNA, 14 nt, Human
ucggagacagugau

SEQ ID NO: 2319777 - RNA, 13 nt, Human
ucgugacaacacu

SEQ ID NO: 2319778 - RNA, 17 nt, Human
ucgugaaguauacugua

SEQ ID NO: 2319779 - RNA, 10 nt, Human
ucgucuuugc

SEQ ID NO: 2319780 - RNA, 19 nt, Human
ucgugaaguauacuguauu

SEQ ID NO: 2319781 - RNA, 21 nt, Human
ucgugaccaacuagacauucu

SEQ ID NO: 2319782 - RNA, 23 nt, Human
ucggcccacagcucccaccccac

SEQ ID NO: 2319783 - RNA, 16 nt, Human
ucggcccacagcuccc

SEQ ID NO: 2319784 - RNA, 12 nt, Human
ucggcccacagc

SEQ ID NO: 2319785 - RNA, 19 nt, Human
ucggcccacagcucccacc

SEQ ID NO: 2319786 - RNA, 15 nt, Human
ucgucuuucccaugg

SEQ ID NO: 2319787 - RNA, 18 nt, Human
ucgucuuucccaugggga

SEQ ID NO: 2319788 - RNA, 20 nt, Human
ucgucuuucccauggggagg

SEQ ID NO: 2319789 - RNA, 14 nt, Human
ucgugaaacccugu

SEQ ID NO: 2319790 - RNA, 18 nt, Human
ucgugaaacccugucucu

SEQ ID NO: 2319791 - RNA, 17 nt, Human
uccuuagaccuuccaua

SEQ ID NO: 2319792 - RNA, 19 nt, Human
uccuuagagacaucaaaau

SEQ ID NO: 2319793 - RNA, 20 nt, Human
uccuuagaacauuuuaauuc

SEQ ID NO: 2319794 - RNA, 15 nt, Human
uccuuagaacauuuu

SEQ ID NO: 2319795 - RNA, 21 nt, Human
uccugucugccagccagcagc

SEQ ID NO: 2319796 - RNA, 17 nt, Human
uccugucugccagccag

SEQ ID NO: 2319797 - RNA, 22 nt, Human
uccugucugccagccagcagcc

SEQ ID NO: 2319798 - RNA, 20 nt, Human
uccuuagcuuagaccucagc

SEQ ID NO: 2319799 - RNA, 19 nt, Human
uccuuagcuuagaccucag

SEQ ID NO: 2319800 - RNA, 18 nt, Human
uccuuagcuuagaccuca

SEQ ID NO: 2319801 - RNA, 22 nt, Human
uccuuagcuuagaccucagccu

SEQ ID NO: 2319802 - RNA, 21 nt, Human
uccuuagcuuagaccucagcc

SEQ ID NO: 2319803 - RNA, 18 nt, Human
ucggacuuagcugggaga

SEQ ID NO: 2319804 - RNA, 12 nt, Human
ucggagaagagc

SEQ ID NO: 2319805 - RNA, 16 nt, Human
ucggagaagagcuguu

SEQ ID NO: 2319806 - RNA, 14 nt, Human
ucggagaagagcug

SEQ ID NO: 2319807 - RNA, 14 nt, Human
ucgugguaggacug

SEQ ID NO: 2319808 - RNA, 22 nt, Human
ucguggguguguguagccaagg

SEQ ID NO: 2319809 - RNA, 15 nt, Human
ucgugggugugugua

SEQ ID NO: 2319810 - RNA, 21 nt, Human
ucguggcagauaaucagccuc

SEQ ID NO: 2319811 - RNA, 20 nt, Human
ucguggcagauaaucagccu

SEQ ID NO: 2319812 - RNA, 16 nt, Human
ucguggagaugucuuc

SEQ ID NO: 2319813 - RNA, 17 nt, Human
ucguggagaugucuucg

SEQ ID NO: 2319814 - RNA, 19 nt, Human
ucguggagaugucuucgua

SEQ ID NO: 2319815 - RNA, 15 nt, Human
ucgugguaggacugu

SEQ ID NO: 2319816 - RNA, 20 nt, Human
ucgugguaggacuguagaaa

SEQ ID NO: 2319817 - RNA, 22 nt, Human
ucguggugaucaauuaaaugua

SEQ ID NO: 2319818 - RNA, 22 nt, Human
ucgugguccccaacagcgacau

SEQ ID NO: 2319819 - RNA, 13 nt, Human
ucguguauccugg

SEQ ID NO: 2319820 - RNA, 14 nt, Human
ucguguauccuggg

SEQ ID NO: 2319821 - RNA, 15 nt, Human
ucguguauccugggg

SEQ ID NO: 2319822 - RNA, 16 nt, Human
ucguguauccuggggc

SEQ ID NO: 2319823 - RNA, 18 nt, Human
ucguguauccuggggcuc

SEQ ID NO: 2319824 - RNA, 21 nt, Human
ucguggagacagggcauuuga

SEQ ID NO: 2319825 - RNA, 20 nt, Human
ucgugacgcugaauaaaugu

SEQ ID NO: 2319826 - RNA, 17 nt, Human
ucgugacgcugaauaaa

SEQ ID NO: 2319827 - RNA, 18 nt, Human
ucgugacgcugaauaaau

SEQ ID NO: 2319828 - RNA, 18 nt, Human
ucuaaagguggugaggca

SEQ ID NO: 2319829 - RNA, 22 nt, Human
ucguguauccuggggcucccuu

SEQ ID NO: 2319830 - RNA, 14 nt, Human
ucgugucucugguc

SEQ ID NO: 2319831 - RNA, 16 nt, Human
ucguguccccuauccu

SEQ ID NO: 2319832 - RNA, 19 nt, Human
ucuaaaguguguuguugcu

SEQ ID NO: 2319833 - RNA, 12 nt, Human
ucuaaaguuuac

SEQ ID NO: 2319834 - RNA, 13 nt, Human
ucuaaaguuuaca

SEQ ID NO: 2319835 - RNA, 15 nt, Human
ucuaaaguuuacagu

SEQ ID NO: 2319836 - RNA, 20 nt, Human
ucuaaaggcuaccuuuguau

SEQ ID NO: 2319837 - RNA, 19 nt, Human
ucuaaaggcuaccuuugua

SEQ ID NO: 2319838 - RNA, 17 nt, Human
ucuaaaggcuaccuuug

SEQ ID NO: 2319839 - RNA, 18 nt, Human
ucuaaaggcuaccuuugu

SEQ ID NO: 2319840 - RNA, 21 nt, Human
uauuugacaacguuucagcga

SEQ ID NO: 2319841 - RNA, 23 nt, Human
uauuugaauguaugcuucauaca

SEQ ID NO: 2319842 - RNA, 22 nt, Human
uauuugaauguaugcuucauac

SEQ ID NO: 2319843 - RNA, 16 nt, Human
uauuugcacuguagcc

SEQ ID NO: 2319844 - RNA, 16 nt, Human
uauuugcagacuagaa

SEQ ID NO: 2319845 - RNA, 18 nt, Human
uauuugcaguucaccugc

SEQ ID NO: 2319846 - RNA, 23 nt, Human
uauuugcaguucaccugcacuua

SEQ ID NO: 2319847 - RNA, 16 nt, Human
uauuugcauguuaccu

SEQ ID NO: 2319848 - RNA, 15 nt, Human
uauuugcauauguau

SEQ ID NO: 2319849 - RNA, 22 nt, Human
uauuugcauaacaauuccucua

SEQ ID NO: 2319850 - RNA, 21 nt, Human
uauuugcauaacaauuccucu

SEQ ID NO: 2319851 - RNA, 17 nt, Human
ucaaacauauauaacaa

SEQ ID NO: 2319852 - RNA, 22 nt, Human
ucaaacagucucaggaaaucaa

SEQ ID NO: 2319853 - RNA, 23 nt, Human
ucaaaccccgaccaccugcccaa

SEQ ID NO: 2319854 - RNA, 18 nt, Human
ucaaaccauaaacuucau

SEQ ID NO: 2319855 - RNA, 21 nt, Human
ucaaaccauaaacuucauggu

SEQ ID NO: 2319856 - RNA, 20 nt, Human
ucaaaccgcacucacccaug

SEQ ID NO: 2319857 - RNA, 17 nt, Human
ucaaaccuccucuucug

SEQ ID NO: 2319858 - RNA, 19 nt, Human
ucaaacugaggaauuucac

SEQ ID NO: 2319859 - RNA, 16 nt, Human
ucaaacuggggccucc

SEQ ID NO: 2319860 - RNA, 14 nt, Human
ucaaacuggggccu

SEQ ID NO: 2319861 - RNA, 23 nt, Human
ucaaacuggggccuccagaacuc

SEQ ID NO: 2319862 - RNA, 22 nt, Human
ucaaacuggggccuccagaacu

SEQ ID NO: 2319863 - RNA, 20 nt, Human
ucaaacuggggccuccagaa

SEQ ID NO: 2319864 - RNA, 19 nt, Human
ucaaacuggggccuccaga

SEQ ID NO: 2319865 - RNA, 15 nt, Human
ucaaaccauaaacuu

SEQ ID NO: 2319866 - RNA, 16 nt, Human
ucaaaccauaaacuuc

SEQ ID NO: 2319867 - RNA, 20 nt, Human
ucaaaccaaaucacugaacu

SEQ ID NO: 2319868 - RNA, 19 nt, Human
ucaaaccccgaccaccugc

SEQ ID NO: 2319869 - RNA, 20 nt, Human
ucaaaccccgaccaccugcc

SEQ ID NO: 2319870 - RNA, 15 nt, Human
uauuugcauguuacc

SEQ ID NO: 2319871 - RNA, 16 nt, Human
uauuugccaugggcuu

SEQ ID NO: 2319872 - RNA, 17 nt, Human
uauuugccaugggcuuc

SEQ ID NO: 2319873 - RNA, 22 nt, Human
ucaaacaugaaguguguuuccu

SEQ ID NO: 2319874 - RNA, 22 nt, Human
ucaaacuuccagugcaacacug

SEQ ID NO: 2319875 - RNA, 20 nt, Human
ucaaacugccuuggcuucag

SEQ ID NO: 2319876 - RNA, 14 nt, Human
ucaaacuuccaguc

SEQ ID NO: 2319877 - RNA, 17 nt, Human
ucaaacuguagaaauga

SEQ ID NO: 2319878 - RNA, 20 nt, Human
ucaaacuguagaaaugauga

SEQ ID NO: 2319879 - RNA, 14 nt, Human
ucaaacuguagaaa

SEQ ID NO: 2319880 - RNA, 19 nt, Human
ucaaacuggggccucccug

SEQ ID NO: 2319881 - RNA, 21 nt, Human
ucaaagaggcugaggcuggca

SEQ ID NO: 2319882 - RNA, 20 nt, Human
ucaaagagagaaaauaaaga

SEQ ID NO: 2319883 - RNA, 15 nt, Human
ucaaagagagaaaau

SEQ ID NO: 2319884 - RNA, 23 nt, Human
ucaaagagguuuuaaaaaaaucc

SEQ ID NO: 2319885 - RNA, 12 nt, Human
ucaaagagguuu

SEQ ID NO: 2319886 - RNA, 17 nt, Human
ucaaauaugcaaagcac

SEQ ID NO: 2319887 - RNA, 16 nt, Human
ucaaauaugcaaagca

SEQ ID NO: 2319888 - RNA, 16 nt, Human
ucaaaucuccaguauu

SEQ ID NO: 2319889 - RNA, 14 nt, Human
ucaaaucuauucag

SEQ ID NO: 2319890 - RNA, 13 nt, Human
ucaaaucuauuca

SEQ ID NO: 2319891 - RNA, 15 nt, Human
ucaaaucuauucaga

SEQ ID NO: 2319892 - RNA, 16 nt, Human
ucaaaucuauucagac

SEQ ID NO: 2319893 - RNA, 17 nt, Human
ucaaaucuauucagaca

SEQ ID NO: 2319894 - RNA, 18 nt, Human
ucaaaucuauucagacaa

SEQ ID NO: 2319895 - RNA, 21 nt, Human
ucaaaugguaggcauuuccua

SEQ ID NO: 2319896 - RNA, 20 nt, Human
ucaaaugguaggcauuuccu

SEQ ID NO: 2319897 - RNA, 20 nt, Human
ucaaauggggccagauccag

SEQ ID NO: 2319898 - RNA, 19 nt, Human
ucaaauggggccagaucca

SEQ ID NO: 2319899 - RNA, 16 nt, Human
ucaaauccuugaagau

SEQ ID NO: 2319900 - RNA, 14 nt, Human
ucaaauauuagaug

SEQ ID NO: 2319901 - RNA, 15 nt, Human
ucaaauccuugaaga

SEQ ID NO: 2319902 - RNA, 19 nt, Human
ucaaauaugcaaagcacug

SEQ ID NO: 2319903 - RNA, 18 nt, Human
ucaaauaugcaaagcacu

SEQ ID NO: 2319904 - RNA, 20 nt, Human
ucaagccaagcagccaagcu

SEQ ID NO: 2319905 - RNA, 16 nt, Human
ucaagccaauccccuc

SEQ ID NO: 2319906 - RNA, 24 nt, Human
ucaacugaccagccuccaugcugc

SEQ ID NO: 2319907 - RNA, 19 nt, Human
ucaagccaagcagccaagc

SEQ ID NO: 2319908 - RNA, 23 nt, Human
ucaacugaaaagacucaguguuc

SEQ ID NO: 2319909 - RNA, 18 nt, Human
ucaacugaccagccucca

SEQ ID NO: 2319910 - RNA, 20 nt, Human
ucaacucuccuccagaguca

SEQ ID NO: 2319911 - RNA, 22 nt, Human
ucaacucccugccccccagccc

SEQ ID NO: 2319912 - RNA, 21 nt, Human
ucaacucccugccccccagcc

SEQ ID NO: 2319913 - RNA, 15 nt, Human
ucaacucccugcccc

SEQ ID NO: 2319914 - RNA, 14 nt, Human
ucaacucccugccc

SEQ ID NO: 2319915 - RNA, 19 nt, Human
ucaaccucuucuggcucaa

SEQ ID NO: 2319916 - RNA, 13 nt, Human
ucaaccugccuga

SEQ ID NO: 2319917 - RNA, 17 nt, Human
ucaaccugggcaaagcc

SEQ ID NO: 2319918 - RNA, 22 nt, Human
ucaacuccaaacugacucuuaa

SEQ ID NO: 2319919 - RNA, 16 nt, Human
ucaaccuccugggcua

SEQ ID NO: 2319920 - RNA, 18 nt, Human
ucaaccucuucuggcuca

SEQ ID NO: 2319921 - RNA, 17 nt, Human
ucaaccucuucuggcuc

SEQ ID NO: 2319922 - RNA, 20 nt, Human
ucaaccccuucgcuccugug

SEQ ID NO: 2319923 - RNA, 15 nt, Human
ucaaccuccugggcu

SEQ ID NO: 2319924 - RNA, 18 nt, Human
ucaaccccuucgcuccug

SEQ ID NO: 2319925 - RNA, 19 nt, Human
ucaaccccuucgcuccugu

SEQ ID NO: 2319926 - RNA, 16 nt, Human
ucaagcccaggaggac

SEQ ID NO: 2319927 - RNA, 13 nt, Human
ucaagcccaggag

SEQ ID NO: 2319928 - RNA, 22 nt, Human
ucaagcccagccacguggagcc

SEQ ID NO: 2319929 - RNA, 21 nt, Human
ucaagcccagccacguggagc

SEQ ID NO: 2319930 - RNA, 17 nt, Human
ucaagccaauccccucc

SEQ ID NO: 2319931 - RNA, 18 nt, Human
ucaagccaauccccuccu

SEQ ID NO: 2319932 - RNA, 20 nt, Human
ucaagccaauccccuccuug

SEQ ID NO: 2319933 - RNA, 21 nt, Human
ucaagccaauccccuccuugg

SEQ ID NO: 2319934 - RNA, 12 nt, Human
ucaagccaccaa

SEQ ID NO: 2319935 - RNA, 20 nt, Human
ucaagccaccaacauacucc

SEQ ID NO: 2319936 - RNA, 21 nt, Human
ucaagcgauucuucugcuuca

SEQ ID NO: 2319937 - RNA, 19 nt, Human
ucaagcuucaguuuccugg

SEQ ID NO: 2319938 - RNA, 19 nt, Human
ucaaggaaaggggguccca

SEQ ID NO: 2319939 - RNA, 20 nt, Human
ucaaggaaagggggucccag

SEQ ID NO: 2319940 - RNA, 18 nt, Human
ucaaggaauaaugggcuu

SEQ ID NO: 2319941 - RNA, 21 nt, Human
ucaaggaaagggggucccagu

SEQ ID NO: 2319942 - RNA, 18 nt, Human
ucaagcgauucuucugcu

SEQ ID NO: 2319943 - RNA, 19 nt, Human
ucaagcgauucuucugcuu

SEQ ID NO: 2319944 - RNA, 19 nt, Human
ucaaggacuugaaagcauc

SEQ ID NO: 2319945 - RNA, 18 nt, Human
ucaaggacuugaaagcau

SEQ ID NO: 2319946 - RNA, 20 nt, Human
ucaaggacuuucugaagccu

SEQ ID NO: 2319947 - RNA, 13 nt, Human
ucaaggauccuga

SEQ ID NO: 2319948 - RNA, 14 nt, Human
ucaaggauccugag

SEQ ID NO: 2319949 - RNA, 15 nt, Human
ucaaggauccugagc

SEQ ID NO: 2319950 - RNA, 16 nt, Human
ucaaggauccugagcc

SEQ ID NO: 2319951 - RNA, 17 nt, Human
ucaaggauccugagcca

SEQ ID NO: 2319952 - RNA, 11 nt, Human
ucaauuaaacg

SEQ ID NO: 2319953 - RNA, 24 nt, Human
ucaauguucauuguaauguuacug

SEQ ID NO: 2319954 - RNA, 15 nt, Human
ucaauguuuucaguu

SEQ ID NO: 2319955 - RNA, 13 nt, Human
ucaauuaaacgga

SEQ ID NO: 2319956 - RNA, 14 nt, Human
ucaauuaaacggau

SEQ ID NO: 2319957 - RNA, 15 nt, Human
ucaauuaaacggauu

SEQ ID NO: 2319958 - RNA, 16 nt, Human
ucaauuaaacggauua

SEQ ID NO: 2319959 - RNA, 17 nt, Human
ucaauuaaacggauuau

SEQ ID NO: 2319960 - RNA, 18 nt, Human
ucaauuaaacggauuauu

SEQ ID NO: 2319961 - RNA, 19 nt, Human
ucaauuaaacggauuauuu

SEQ ID NO: 2319962 - RNA, 20 nt, Human
ucaauuaaacggauuauuuu

SEQ ID NO: 2319963 - RNA, 14 nt, Human
ucaauuaaauguag

SEQ ID NO: 2319964 - RNA, 19 nt, Human
ucaauuagaauaguguucu

SEQ ID NO: 2319965 - RNA, 12 nt, Human
ucaauuaaaugu

SEQ ID NO: 2319966 - RNA, 21 nt, Human
ucaauuaaacggauuauuuuu

SEQ ID NO: 2319967 - RNA, 13 nt, Human
ucaauuaaaugua

SEQ ID NO: 2319968 - RNA, 13 nt, Human
ucaauaaaaucau

SEQ ID NO: 2319969 - RNA, 14 nt, Human
ucaaggagaggagg

SEQ ID NO: 2319970 - RNA, 14 nt, Human
ucaauaaaauccau

SEQ ID NO: 2319971 - RNA, 18 nt, Human
ucaauguucauuguaaug

SEQ ID NO: 2319972 - RNA, 21 nt, Human
ucaauguuuaugcaaggaagg

SEQ ID NO: 2319973 - RNA, 21 nt, Human
ucaauaaaaucauguacauuu

SEQ ID NO: 2319974 - RNA, 18 nt, Human
ucaauaaaaucauguaca

SEQ ID NO: 2319975 - RNA, 16 nt, Human
ucaauaaaaucaugua

SEQ ID NO: 2319976 - RNA, 14 nt, Human
ucaauaaaaucaug

SEQ ID NO: 2319977 - RNA, 23 nt, Human
ucaauguuuaugcaaggaaggaa

SEQ ID NO: 2319978 - RNA, 22 nt, Human
ucaauguuuaugcaaggaagga

SEQ ID NO: 2319979 - RNA, 18 nt, Human
ucaauguuucuucuaggu

SEQ ID NO: 2319980 - RNA, 14 nt, Human
ucaauuccaccugc

SEQ ID NO: 2319981 - RNA, 13 nt, Human
ucaauucaacacu

SEQ ID NO: 2319982 - RNA, 17 nt, Human
ucaauucaacacucccu

SEQ ID NO: 2319983 - RNA, 14 nt, Human
ucaauuccucuggg

SEQ ID NO: 2319984 - RNA, 22 nt, Human
ucaauucccccuggccaccacc

SEQ ID NO: 2319985 - RNA, 22 nt, Human
ucacaagacccaaaaggcagaa

SEQ ID NO: 2319986 - RNA, 22 nt, Human
ucacaagugaaaaacauccaga

SEQ ID NO: 2319987 - RNA, 16 nt, Human
ucacaagugaaaaaca

SEQ ID NO: 2319988 - RNA, 21 nt, Human
ucacacacaggcaacugaggc

SEQ ID NO: 2319989 - RNA, 20 nt, Human
ucacacacaggcaacugagg

SEQ ID NO: 2319990 - RNA, 12 nt, Human
ucacacaccugu

SEQ ID NO: 2319991 - RNA, 22 nt, Human
ucacaagggcaaacuuuuuccu

SEQ ID NO: 2319992 - RNA, 22 nt, Human
ucacaaggcauucaaguguaca

SEQ ID NO: 2319993 - RNA, 17 nt, Human
ucacaagagcccagcag

SEQ ID NO: 2319994 - RNA, 22 nt, Human
ucaauuccguagccagcugcuc

SEQ ID NO: 2319995 - RNA, 19 nt, Human
ucaauuccguagccagcug

SEQ ID NO: 2319996 - RNA, 12 nt, Human
ucacaccagcca

SEQ ID NO: 2319997 - RNA, 16 nt, Human
ucacaggacucugccu

SEQ ID NO: 2319998 - RNA, 17 nt, Human
ucacaggacucugccuc

SEQ ID NO: 2319999 - RNA, 18 nt, Human
ucacaggacucugccucc

SEQ ID NO: 2320000 - RNA, 21 nt, Human
ucacaccaggcuugccugcag

SEQ ID NO: 2320001 - RNA, 22 nt, Human
ucacaccaggcuugccugcagg

SEQ ID NO: 2320002 - RNA, 11 nt, Human
ucacaccagcc

SEQ ID NO: 2320003 - RNA, 19 nt, Human
ucacacaggacccccuucc

SEQ ID NO: 2320004 - RNA, 20 nt, Human
ucacacaggacccccuuccc

SEQ ID NO: 2320005 - RNA, 21 nt, Human
ucacacaggacccccuucccc

SEQ ID NO: 2320006 - RNA, 22 nt, Human
ucacacaggacccccuuccccu

SEQ ID NO: 2320007 - RNA, 15 nt, Human
ucacacacuuuggcu

SEQ ID NO: 2320008 - RNA, 12 nt, Human
ucacacacugau

SEQ ID NO: 2320009 - RNA, 13 nt, Human
ucacacacgugag

SEQ ID NO: 2320010 - RNA, 18 nt, Human
ucacacagccaggugccu

SEQ ID NO: 2320011 - RNA, 19 nt, Human
ucacacagccaggugccuu

SEQ ID NO: 2320012 - RNA, 20 nt, Human
ucacacagccaggugccuug

SEQ ID NO: 2320013 - RNA, 22 nt, Human
ucacacagccaggugccuugga

SEQ ID NO: 2320014 - RNA, 23 nt, Human
ucacacagccaggugccuuggag

SEQ ID NO: 2320015 - RNA, 22 nt, Human
ucacacaugagcaucaggccag

SEQ ID NO: 2320016 - RNA, 23 nt, Human
ucacacaugagcaucaggccagg

SEQ ID NO: 2320017 - RNA, 13 nt, Human
ucacauucuuaua

SEQ ID NO: 2320018 - RNA, 15 nt, Human
ucacauucuuauaaa

SEQ ID NO: 2320019 - RNA, 17 nt, Human
ucacauucuuauaaaua

SEQ ID NO: 2320020 - RNA, 18 nt, Human
ucacauucuuauaaauau

SEQ ID NO: 2320021 - RNA, 19 nt, Human
ucacauucuuauaaauaug

SEQ ID NO: 2320022 - RNA, 21 nt, Human
ucacauucuuauaaauaugaa

SEQ ID NO: 2320023 - RNA, 17 nt, Human
ucacaggguugggccca

SEQ ID NO: 2320024 - RNA, 16 nt, Human
ucacaggguugggccc

SEQ ID NO: 2320025 - RNA, 14 nt, Human
ucacaggguugggc

SEQ ID NO: 2320026 - RNA, 13 nt, Human
ucacaccagccau

SEQ ID NO: 2320027 - RNA, 23 nt, Human
ucacaggguugggcccagaucug

SEQ ID NO: 2320028 - RNA, 19 nt, Human
ucacaggguugggcccaga

SEQ ID NO: 2320029 - RNA, 24 nt, Human
ucacaggguugggcccagaucugg

SEQ ID NO: 2320030 - RNA, 19 nt, Human
ucacaggacucugccuccu

SEQ ID NO: 2320031 - RNA, 23 nt, Human
ucacaggacucugccuccucuuc

SEQ ID NO: 2320032 - RNA, 23 nt, Human
ucacagggccccagaaggcaggg

SEQ ID NO: 2320033 - RNA, 19 nt, Human
ucacaggagggagggggaa

SEQ ID NO: 2320034 - RNA, 21 nt, Human
ucaccacuucaauagaucaaa

SEQ ID NO: 2320035 - RNA, 18 nt, Human
ucaccaccuucccagcuc

SEQ ID NO: 2320036 - RNA, 16 nt, Human
ucaccaccuucccagc

SEQ ID NO: 2320037 - RNA, 15 nt, Human
ucaccaccuucccag

SEQ ID NO: 2320038 - RNA, 14 nt, Human
ucaccaccuuccca

SEQ ID NO: 2320039 - RNA, 13 nt, Human
ucaccaccucucc

SEQ ID NO: 2320040 - RNA, 13 nt, Human
ucaccaagcccag

SEQ ID NO: 2320041 - RNA, 16 nt, Human
ucaccacaugugcaca

SEQ ID NO: 2320042 - RNA, 20 nt, Human
ucacauucuuauaaauauga

SEQ ID NO: 2320043 - RNA, 23 nt, Human
ucacauuguaacugaacuucagg

SEQ ID NO: 2320044 - RNA, 16 nt, Human
ucacccgaggcugccc

SEQ ID NO: 2320045 - RNA, 19 nt, Human
ucacccgaggcugcccacu

SEQ ID NO: 2320046 - RNA, 14 nt, Human
ucaccccuguccuc

SEQ ID NO: 2320047 - RNA, 16 nt, Human
ucaccccuguccucac

SEQ ID NO: 2320048 - RNA, 17 nt, Human
ucaccccuguccucacu

SEQ ID NO: 2320049 - RNA, 20 nt, Human
ucaccccuguccucacugcu

SEQ ID NO: 2320050 - RNA, 18 nt, Human
ucacccgcuaagagggag

SEQ ID NO: 2320051 - RNA, 21 nt, Human
ucaccccugguucucaucuuu

SEQ ID NO: 2320052 - RNA, 22 nt, Human
ucaccccugguucucaucuuuc

SEQ ID NO: 2320053 - RNA, 13 nt, Human
ucaccagaauaaa

SEQ ID NO: 2320054 - RNA, 13 nt, Human
ucaccccuguccu

SEQ ID NO: 2320055 - RNA, 21 nt, Human
ucaccaaaucagcugcuacua

SEQ ID NO: 2320056 - RNA, 14 nt, Human
ucacauuuauucug

SEQ ID NO: 2320057 - RNA, 17 nt, Human
ucaccaacgucugugcc

SEQ ID NO: 2320058 - RNA, 18 nt, Human
ucaccaacgucugugcca

SEQ ID NO: 2320059 - RNA, 12 nt, Human
ucacauuuaaau

SEQ ID NO: 2320060 - RNA, 22 nt, Human
ucacauuguauucagaguugau

SEQ ID NO: 2320061 - RNA, 21 nt, Human
ucacccuguccaaacugccua

SEQ ID NO: 2320062 - RNA, 19 nt, Human
ucacccuuaccaugugccu

SEQ ID NO: 2320063 - RNA, 18 nt, Human
ucacccuuaccaugugcc

SEQ ID NO: 2320064 - RNA, 13 nt, Human
ucacccuguccaa

SEQ ID NO: 2320065 - RNA, 20 nt, Human
ucacccuggggcuaggaaau

SEQ ID NO: 2320066 - RNA, 12 nt, Human
ucacccuuuucu

SEQ ID NO: 2320067 - RNA, 14 nt, Human
ucaccgaaaacgug

SEQ ID NO: 2320068 - RNA, 15 nt, Human
ucacccguccagacc

SEQ ID NO: 2320069 - RNA, 15 nt, Human
ucacccuaccugugc

SEQ ID NO: 2320070 - RNA, 17 nt, Human
ucacccuaccugugccu

SEQ ID NO: 2320071 - RNA, 19 nt, Human
ucacccgcuaagagggagg

SEQ ID NO: 2320072 - RNA, 23 nt, Human
ucacccugauuuaggagaagcca

SEQ ID NO: 2320073 - RNA, 19 nt, Human
ucacccugagccccuuccu

SEQ ID NO: 2320074 - RNA, 21 nt, Human
ucacccugagccccuuccuug

SEQ ID NO: 2320075 - RNA, 13 nt, Human
ucacccugccuua

SEQ ID NO: 2320076 - RNA, 15 nt, Human
ucacccugccuuauc

SEQ ID NO: 2320077 - RNA, 18 nt, Human
ucacccguccagaccuug

SEQ ID NO: 2320078 - RNA, 13 nt, Human
ucacccuccaccu

SEQ ID NO: 2320079 - RNA, 14 nt, Human
ucacccuccaccuc

SEQ ID NO: 2320080 - RNA, 15 nt, Human
ucacccuccaccucu

SEQ ID NO: 2320081 - RNA, 18 nt, Human
ucacccucguuuccagug

SEQ ID NO: 2320082 - RNA, 20 nt, Human
ucacccuccaccucuucacc

SEQ ID NO: 2320083 - RNA, 13 nt, Human
ucacccugagccc

SEQ ID NO: 2320084 - RNA, 23 nt, Human
ucaccgagaguagccgagagccu

SEQ ID NO: 2320085 - RNA, 20 nt, Human
ucaccgagaguagccgagag

SEQ ID NO: 2320086 - RNA, 16 nt, Human
ucaccgagugggggca

SEQ ID NO: 2320087 - RNA, 19 nt, Human
ucaccgcagucgucgcaca

SEQ ID NO: 2320088 - RNA, 20 nt, Human
ucaccgcagucgucgcacag

SEQ ID NO: 2320089 - RNA, 13 nt, Human
ucacccuuugcug

SEQ ID NO: 2320090 - RNA, 15 nt, Human
ucacccuuugcugug

SEQ ID NO: 2320091 - RNA, 22 nt, Human
ucacccuuugcugugaggcugu

SEQ ID NO: 2320092 - RNA, 15 nt, Human
ucaccgaagccacuu

SEQ ID NO: 2320093 - RNA, 17 nt, Human
ucaccgacgcgucuccu

SEQ ID NO: 2320094 - RNA, 22 nt, Human
ucaccgaaaacguggcugcuuc

SEQ ID NO: 2320095 - RNA, 23 nt, Human
ucaccgaaaacguggcugcuuca

SEQ ID NO: 2320096 - RNA, 15 nt, Human
ucaccgaaaacgugg

SEQ ID NO: 2320097 - RNA, 19 nt, Human
ucaccgaaaacguggcugc

SEQ ID NO: 2320098 - RNA, 20 nt, Human
ucaccgaaaacguggcugcu

SEQ ID NO: 2320099 - RNA, 21 nt, Human
ucaccgaaaacguggcugcuu

SEQ ID NO: 2320100 - RNA, 20 nt, Human
uauuuaugccucuguauuua

SEQ ID NO: 2320101 - RNA, 17 nt, Human
uauuuaugggauccugg

SEQ ID NO: 2320102 - RNA, 16 nt, Human
uauuuaucucuauuua

SEQ ID NO: 2320103 - RNA, 15 nt, Human
uauuuaucugauuaa

SEQ ID NO: 2320104 - RNA, 21 nt, Human
uauuuaucugauuaaguuguc

SEQ ID NO: 2320105 - RNA, 16 nt, Human
uauuuaucugauuaag

SEQ ID NO: 2320106 - RNA, 20 nt, Human
uauuuaucugugcaaauccu

SEQ ID NO: 2320107 - RNA, 21 nt, Human
uauuuaucuguaguaaacuau

SEQ ID NO: 2320108 - RNA, 17 nt, Human
uauuuaucucuauuuaa

SEQ ID NO: 2320109 - RNA, 22 nt, Human
uauuuaucuguguuuuugaaau

SEQ ID NO: 2320110 - RNA, 12 nt, Human
uauuuaucuuua

SEQ ID NO: 2320111 - RNA, 18 nt, Human
uauuuaucagugacagag

SEQ ID NO: 2320112 - RNA, 15 nt, Human
uauuuaucagugaca

SEQ ID NO: 2320113 - RNA, 21 nt, Human
uauuuauauuuuuauuuuauu

SEQ ID NO: 2320114 - RNA, 13 nt, Human
uauuuaucaguga

SEQ ID NO: 2320115 - RNA, 16 nt, Human
uauuuauauuucacua

SEQ ID NO: 2320116 - RNA, 15 nt, Human
uauuuauauuucacu

SEQ ID NO: 2320117 - RNA, 14 nt, Human
uauuuauauuucac

SEQ ID NO: 2320118 - RNA, 15 nt, Human
uauuuauauguacau

SEQ ID NO: 2320119 - RNA, 17 nt, Human
uauuuauauguacauga

SEQ ID NO: 2320120 - RNA, 18 nt, Human
uauuuaaagacaaagaca

SEQ ID NO: 2320121 - RNA, 17 nt, Human
uauuuaaagacaaagac

SEQ ID NO: 2320122 - RNA, 13 nt, Human
uauuuaaagacaa

SEQ ID NO: 2320123 - RNA, 12 nt, Human
uauuuaaagaca

SEQ ID NO: 2320124 - RNA, 18 nt, Human
uauuguuucaauugcauc

SEQ ID NO: 2320125 - RNA, 12 nt, Human
uauuguuucaau

SEQ ID NO: 2320126 - RNA, 22 nt, Human
uauuguuuaaagcaacugucua

SEQ ID NO: 2320127 - RNA, 22 nt, Human
uauuguuuauucuuuuuaaagu

SEQ ID NO: 2320128 - RNA, 24 nt, Human
uauuguuuauucuuuuuaaaguau

SEQ ID NO: 2320129 - RNA, 20 nt, Human
uauuguuuaaaaucauuucu

SEQ ID NO: 2320130 - RNA, 11 nt, Human
uauuguuuaaa

SEQ ID NO: 2320131 - RNA, 17 nt, Human
uauuguuuaaagcaacu

SEQ ID NO: 2320132 - RNA, 19 nt, Human
uauuuauauauuuauaacu

SEQ ID NO: 2320133 - RNA, 18 nt, Human
uauuuauauauuuauaac

SEQ ID NO: 2320134 - RNA, 17 nt, Human
uauuuauauauuuauaa

SEQ ID NO: 2320135 - RNA, 20 nt, Human
uauuuaaaugucuaauguau

SEQ ID NO: 2320136 - RNA, 15 nt, Human
uauuuaacaagaucu

SEQ ID NO: 2320137 - RNA, 19 nt, Human
uauuuaaaugucuaaugua

SEQ ID NO: 2320138 - RNA, 22 nt, Human
uauuuaaauauuaaauauguua

SEQ ID NO: 2320139 - RNA, 12 nt, Human
uauuuaaauguc

SEQ ID NO: 2320140 - RNA, 14 nt, Human
uauuuaaaugucua

SEQ ID NO: 2320141 - RNA, 11 nt, Human
uauuguuucua

SEQ ID NO: 2320142 - RNA, 14 nt, Human
uauuuaaagacagg

SEQ ID NO: 2320143 - RNA, 22 nt, Human
uauuuaaagacagggaagagca

SEQ ID NO: 2320144 - RNA, 13 nt, Human
uauuucuuuguua

SEQ ID NO: 2320145 - RNA, 21 nt, Human
uauuuauucagcuucauuugu

SEQ ID NO: 2320146 - RNA, 19 nt, Human
uauuugaaaacauauaaag

SEQ ID NO: 2320147 - RNA, 14 nt, Human
uauuucuuuguuau

SEQ ID NO: 2320148 - RNA, 14 nt, Human
uauuucuaugaaau

SEQ ID NO: 2320149 - RNA, 15 nt, Human
uauuucuaugaaaua

SEQ ID NO: 2320150 - RNA, 22 nt, Human
uauuugaaaacauauaaagcac

SEQ ID NO: 2320151 - RNA, 19 nt, Human
uauuugaaacugaauguuu

SEQ ID NO: 2320152 - RNA, 14 nt, Human
uauuugaaggccag

SEQ ID NO: 2320153 - RNA, 21 nt, Human
uauuugaauguaugcuucaua

SEQ ID NO: 2320154 - RNA, 19 nt, Human
uauuugaaucuugucucaa

SEQ ID NO: 2320155 - RNA, 20 nt, Human
uauuugaaucuugucucaau

SEQ ID NO: 2320156 - RNA, 12 nt, Human
uauuugaaucuu

SEQ ID NO: 2320157 - RNA, 14 nt, Human
uauuugaaucuugu

SEQ ID NO: 2320158 - RNA, 16 nt, Human
uauuugaaucuugucu

SEQ ID NO: 2320159 - RNA, 18 nt, Human
uauuugaaucuugucuca

SEQ ID NO: 2320160 - RNA, 19 nt, Human
uauuuauuauuuucaccug

SEQ ID NO: 2320161 - RNA, 12 nt, Human
uauuuauucaau

SEQ ID NO: 2320162 - RNA, 13 nt, Human
uauuuauucaaua

SEQ ID NO: 2320163 - RNA, 14 nt, Human
uauuuauucaauaa

SEQ ID NO: 2320164 - RNA, 14 nt, Human
uauuuauuauuuau

SEQ ID NO: 2320165 - RNA, 16 nt, Human
uauuuauucaauaaag

SEQ ID NO: 2320166 - RNA, 18 nt, Human
uauuuauucaauaaagua

SEQ ID NO: 2320167 - RNA, 19 nt, Human
uauuuauucaauaaaguau

SEQ ID NO: 2320168 - RNA, 20 nt, Human
uauuuauucaauaaaguauu

SEQ ID NO: 2320169 - RNA, 13 nt, Human
uauuucuaugaaa

SEQ ID NO: 2320170 - RNA, 14 nt, Human
uauuuaugugugag

SEQ ID NO: 2320171 - RNA, 21 nt, Human
uauuuaugucuauuuaagccu

SEQ ID NO: 2320172 - RNA, 13 nt, Human
uauuuauguuugc

SEQ ID NO: 2320173 - RNA, 23 nt, Human
uauuuauuaaacagauuuuuaca

SEQ ID NO: 2320174 - RNA, 22 nt, Human
uauuuauuaaaugcccagcccc

SEQ ID NO: 2320175 - RNA, 14 nt, Human
uauuuauuacugua

SEQ ID NO: 2320176 - RNA, 19 nt, Human
uauucauuuaaaaugauua

SEQ ID NO: 2320177 - RNA, 16 nt, Human
uauucauuuaaaauga

SEQ ID NO: 2320178 - RNA, 17 nt, Human
uauucauuuaaaaugau

SEQ ID NO: 2320179 - RNA, 12 nt, Human
uauucauuuaaa

SEQ ID NO: 2320180 - RNA, 13 nt, Human
uauucauuuaaaa

SEQ ID NO: 2320181 - RNA, 14 nt, Human
uauucauuuaaaau

SEQ ID NO: 2320182 - RNA, 15 nt, Human
uauucauuuaaaaug

SEQ ID NO: 2320183 - RNA, 13 nt, Human
uauucauguaaac

SEQ ID NO: 2320184 - RNA, 20 nt, Human
uauucauugaagucagaugu

SEQ ID NO: 2320185 - RNA, 13 nt, Human
uauuauuuuccaa

SEQ ID NO: 2320186 - RNA, 14 nt, Human
uauuauuuuccaaa

SEQ ID NO: 2320187 - RNA, 15 nt, Human
uauucaucucaagga

SEQ ID NO: 2320188 - RNA, 17 nt, Human
uauuauuuuuuccacau

SEQ ID NO: 2320189 - RNA, 14 nt, Human
uauucaugcuucuu

SEQ ID NO: 2320190 - RNA, 20 nt, Human
uauugauaugcuuauacacu

SEQ ID NO: 2320191 - RNA, 18 nt, Human
uauugauaacagcacuga

SEQ ID NO: 2320192 - RNA, 14 nt, Human
uauugauaacagca

SEQ ID NO: 2320193 - RNA, 22 nt, Human
uauugcagcgauuaauaacagg

SEQ ID NO: 2320194 - RNA, 23 nt, Human
uauugcacaugucuuaaugaagu

SEQ ID NO: 2320195 - RNA, 13 nt, Human
uauugcacauugu

SEQ ID NO: 2320196 - RNA, 17 nt, Human
uauugcacauuguaaaa

SEQ ID NO: 2320197 - RNA, 11 nt, Human
uauugcaguuu

SEQ ID NO: 2320198 - RNA, 13 nt, Human
uauugcaguuuau

SEQ ID NO: 2320199 - RNA, 15 nt, Human
uauugcaguuuauca

SEQ ID NO: 2320200 - RNA, 12 nt, Human
uauugcacaugu

SEQ ID NO: 2320201 - RNA, 14 nt, Human
uauugcacaugucu

SEQ ID NO: 2320202 - RNA, 16 nt, Human
uauugcacaugucuua

SEQ ID NO: 2320203 - RNA, 17 nt, Human
uauugcacaugucuuaa

SEQ ID NO: 2320204 - RNA, 20 nt, Human
uauugcacaugucuuaauga

SEQ ID NO: 2320205 - RNA, 22 nt, Human
uauugcacaugucuuaaugaag

SEQ ID NO: 2320206 - RNA, 15 nt, Human
uauugcauaugcaua

SEQ ID NO: 2320207 - RNA, 15 nt, Human
uauugcaguuauaga

SEQ ID NO: 2320208 - RNA, 22 nt, Human
uauugcaucuggguagcuguaa

SEQ ID NO: 2320209 - RNA, 14 nt, Human
uauugcaucuguau

SEQ ID NO: 2320210 - RNA, 15 nt, Human
uauugcaucuguaua

SEQ ID NO: 2320211 - RNA, 16 nt, Human
uauugcaucuguauaa

SEQ ID NO: 2320212 - RNA, 17 nt, Human
uauugcaucuguauaag

SEQ ID NO: 2320213 - RNA, 20 nt, Human
uauugcaguuuaucauucaa

SEQ ID NO: 2320214 - RNA, 19 nt, Human
uauugcaguuuaucauuca

SEQ ID NO: 2320215 - RNA, 22 nt, Human
uauugcauuuggauuggggucc

SEQ ID NO: 2320216 - RNA, 21 nt, Human
uauugcaucuguauaaguaag

SEQ ID NO: 2320217 - RNA, 15 nt, Human
uauugcauuaauuuu

SEQ ID NO: 2320218 - RNA, 15 nt, Human
uauugcuugcacaaa

SEQ ID NO: 2320219 - RNA, 21 nt, Human
uauugcuugauacuuuugaca

SEQ ID NO: 2320220 - RNA, 23 nt, Human
uauugcuucuucuccuaugugua

SEQ ID NO: 2320221 - RNA, 23 nt, Human
uauugcugauggugcaaugaccu

SEQ ID NO: 2320222 - RNA, 22 nt, Human
uauugcugauggugcaaugacc

SEQ ID NO: 2320223 - RNA, 22 nt, Human
uauugcugcugguaauuuguau

SEQ ID NO: 2320224 - RNA, 11 nt, Human
uauugcugggg

SEQ ID NO: 2320225 - RNA, 12 nt, Human
uauugcuggggu

SEQ ID NO: 2320226 - RNA, 13 nt, Human
uauugcccacgcu

SEQ ID NO: 2320227 - RNA, 14 nt, Human
uauugcccacgcug

SEQ ID NO: 2320228 - RNA, 15 nt, Human
uauugcccacgcugg

SEQ ID NO: 2320229 - RNA, 13 nt, Human
uauugcccagguu

SEQ ID NO: 2320230 - RNA, 19 nt, Human
uauuguguguuauuuaaau

SEQ ID NO: 2320231 - RNA, 19 nt, Human
uauugugucuuuugcauga

SEQ ID NO: 2320232 - RNA, 17 nt, Human
uauuguguguuauuuaa

SEQ ID NO: 2320233 - RNA, 16 nt, Human
uauugugucuuuugca

SEQ ID NO: 2320234 - RNA, 18 nt, Human
uauugugucuuuugcaug

SEQ ID NO: 2320235 - RNA, 21 nt, Human
uauuguucccagugacacuuc

SEQ ID NO: 2320236 - RNA, 17 nt, Human
uauuguucccagugaca

SEQ ID NO: 2320237 - RNA, 13 nt, Human
uauuguucccagu

SEQ ID NO: 2320238 - RNA, 23 nt, Human
uauuguuccagcaguuuucaagu

SEQ ID NO: 2320239 - RNA, 14 nt, Human
uauuguguugugaa

SEQ ID NO: 2320240 - RNA, 17 nt, Human
uauuguuuaaaaucauu

SEQ ID NO: 2320241 - RNA, 16 nt, Human
uauuguuuaaaaucau

SEQ ID NO: 2320242 - RNA, 15 nt, Human
uauuguuuaaaauca

SEQ ID NO: 2320243 - RNA, 13 nt, Human
uauuguugguaau

SEQ ID NO: 2320244 - RNA, 13 nt, Human
uauguucacuguc

SEQ ID NO: 2320245 - RNA, 22 nt, Human
uauguucuuaguggauguucug

SEQ ID NO: 2320246 - RNA, 14 nt, Human
uauguucacaccua

SEQ ID NO: 2320247 - RNA, 17 nt, Human
uauguucuaagaaguga

SEQ ID NO: 2320248 - RNA, 18 nt, Human
uauguugguagauucuaa

SEQ ID NO: 2320249 - RNA, 14 nt, Human
uauguugccuuuau

SEQ ID NO: 2320250 - RNA, 18 nt, Human
uauguugccuuuaugguu

SEQ ID NO: 2320251 - RNA, 20 nt, Human
uauguugccuuuaugguuuc

SEQ ID NO: 2320252 - RNA, 13 nt, Human
uauguugucaaag

SEQ ID NO: 2320253 - RNA, 14 nt, Human
uauguugcucaguc

SEQ ID NO: 2320254 - RNA, 17 nt, Human
uauguugcucagucucc

SEQ ID NO: 2320255 - RNA, 20 nt, Human
uauguugcucagucucccuu

SEQ ID NO: 2320256 - RNA, 16 nt, Human
uauguugucaaagaga

SEQ ID NO: 2320257 - RNA, 16 nt, Human
uauguuguccaauugu

SEQ ID NO: 2320258 - RNA, 21 nt, Human
uauguuguccaauuguugaca

SEQ ID NO: 2320259 - RNA, 21 nt, Human
uauguugcccaggcaggucuu

SEQ ID NO: 2320260 - RNA, 17 nt, Human
uauguugaagccuuugu

SEQ ID NO: 2320261 - RNA, 15 nt, Human
uauguugaauacuuu

SEQ ID NO: 2320262 - RNA, 12 nt, Human
uauguugaauac

SEQ ID NO: 2320263 - RNA, 16 nt, Human
uauguuguguucuaau

SEQ ID NO: 2320264 - RNA, 13 nt, Human
uauuaaauacaga

SEQ ID NO: 2320265 - RNA, 17 nt, Human
uauuaaauacagacacu

SEQ ID NO: 2320266 - RNA, 18 nt, Human
uauuaaauacagacacua

SEQ ID NO: 2320267 - RNA, 21 nt, Human
uauuaaauacagacacuaagu

SEQ ID NO: 2320268 - RNA, 15 nt, Human
uauuaaaugcccagc

SEQ ID NO: 2320269 - RNA, 17 nt, Human
uauuaaaugcccagccc

SEQ ID NO: 2320270 - RNA, 19 nt, Human
uauuaaaugcccagccccu

SEQ ID NO: 2320271 - RNA, 23 nt, Human
uauuaaauauaugauuagccagg

SEQ ID NO: 2320272 - RNA, 16 nt, Human
uauuaacaaauuaugu

SEQ ID NO: 2320273 - RNA, 23 nt, Human
uauuaacaaacaucacucugcug

SEQ ID NO: 2320274 - RNA, 18 nt, Human
uauuaacaaauuauguua

SEQ ID NO: 2320275 - RNA, 23 nt, Human
uauuaacaacaauaacacugucu

SEQ ID NO: 2320276 - RNA, 16 nt, Human
uauuaagaaagacuau

SEQ ID NO: 2320277 - RNA, 15 nt, Human
uauggaggauggaga

SEQ ID NO: 2320278 - RNA, 13 nt, Human
uauggauaaugcc

SEQ ID NO: 2320279 - RNA, 17 nt, Human
uauggagcucagagagg

SEQ ID NO: 2320280 - RNA, 18 nt, Human
uauggagcucagagaggg

SEQ ID NO: 2320281 - RNA, 19 nt, Human
uauggaggcuuugcauaga

SEQ ID NO: 2320282 - RNA, 13 nt, Human
uauguguguuuaa

SEQ ID NO: 2320283 - RNA, 14 nt, Human
uauguguguuuaaa

SEQ ID NO: 2320284 - RNA, 17 nt, Human
uauguguguuuaaauaa

SEQ ID NO: 2320285 - RNA, 20 nt, Human
uauguguguuuaaauaaagu

SEQ ID NO: 2320286 - RNA, 21 nt, Human
uauguguguuuaaauaaagua

SEQ ID NO: 2320287 - RNA, 13 nt, Human
uauguguguuuua

SEQ ID NO: 2320288 - RNA, 16 nt, Human
uauggacggugcucca

SEQ ID NO: 2320289 - RNA, 13 nt, Human
uauggacuaucug

SEQ ID NO: 2320290 - RNA, 17 nt, Human
uauggacuaucugucug

SEQ ID NO: 2320291 - RNA, 18 nt, Human
uauggacuaucugucugg

SEQ ID NO: 2320292 - RNA, 12 nt, Human
uauggacucugc

SEQ ID NO: 2320293 - RNA, 21 nt, Human
uauggacuaucugucuggugg

SEQ ID NO: 2320294 - RNA, 16 nt, Human
uauggacucugcacau

SEQ ID NO: 2320295 - RNA, 14 nt, Human
uauggaggcaggag

SEQ ID NO: 2320296 - RNA, 15 nt, Human
uauggagagaaaaca

SEQ ID NO: 2320297 - RNA, 21 nt, Human
uauggacggugcuccaggcag

SEQ ID NO: 2320298 - RNA, 15 nt, Human
uauggacucugcaca

SEQ ID NO: 2320299 - RNA, 18 nt, Human
uauggagcccuguaauuu

SEQ ID NO: 2320300 - RNA, 22 nt, Human
uauguuacaucuguuuuaaauu

SEQ ID NO: 2320301 - RNA, 19 nt, Human
uauguuacaucuguuuuaa

SEQ ID NO: 2320302 - RNA, 14 nt, Human
uauguuauaucaac

SEQ ID NO: 2320303 - RNA, 19 nt, Human
uauguuagugcaaauuguc

SEQ ID NO: 2320304 - RNA, 19 nt, Human
uauguuaagcucuuuauga

SEQ ID NO: 2320305 - RNA, 15 nt, Human
uauguuaaguuacuu

SEQ ID NO: 2320306 - RNA, 19 nt, Human
uauguuaagggaagaauuc

SEQ ID NO: 2320307 - RNA, 14 nt, Human
uauguuaagcucuu

SEQ ID NO: 2320308 - RNA, 18 nt, Human
uauguuaagcucuuuaug

SEQ ID NO: 2320309 - RNA, 18 nt, Human
uauguuacuacaugcacu

SEQ ID NO: 2320310 - RNA, 17 nt, Human
uauguguuuuucacauu

SEQ ID NO: 2320311 - RNA, 15 nt, Human
uauguguuugugugu

SEQ ID NO: 2320312 - RNA, 16 nt, Human
uauguguuuuucacau

SEQ ID NO: 2320313 - RNA, 15 nt, Human
uauguguuuuucaca

SEQ ID NO: 2320314 - RNA, 22 nt, Human
uauguuaaccucagugucauuu

SEQ ID NO: 2320315 - RNA, 20 nt, Human
uauguuaaccucagugucau

SEQ ID NO: 2320316 - RNA, 19 nt, Human
uauguuaaccucaguguca

SEQ ID NO: 2320317 - RNA, 20 nt, Human
uauguuaaacuagcauaucu

SEQ ID NO: 2320318 - RNA, 21 nt, Human
uauguuaaacuagcauaucug

SEQ ID NO: 2320319 - RNA, 14 nt, Human
uauguguuggcuug

SEQ ID NO: 2320320 - RNA, 12 nt, Human
uauguuaaaacu

SEQ ID NO: 2320321 - RNA, 15 nt, Human
uauuaaguuguuaau

SEQ ID NO: 2320322 - RNA, 14 nt, Human
uauuaaggaagaca

SEQ ID NO: 2320323 - RNA, 15 nt, Human
uauuaagauuuccaa

SEQ ID NO: 2320324 - RNA, 17 nt, Human
uauuaagauuuccaagu

SEQ ID NO: 2320325 - RNA, 16 nt, Human
uauuauaacuuaaaaa

SEQ ID NO: 2320326 - RNA, 19 nt, Human
uauuaauaaacauucuauc

SEQ ID NO: 2320327 - RNA, 15 nt, Human
uauuauaauuuaaug

SEQ ID NO: 2320328 - RNA, 12 nt, Human
uauuauaauuua

SEQ ID NO: 2320329 - RNA, 15 nt, Human
uauuauaacuuaaaa

SEQ ID NO: 2320330 - RNA, 13 nt, Human
uauuauaccuuuu

SEQ ID NO: 2320331 - RNA, 12 nt, Human
uauuauaccuuu

SEQ ID NO: 2320332 - RNA, 19 nt, Human
uauuauacuaagaaaagau

SEQ ID NO: 2320333 - RNA, 18 nt, Human
uauuauacuaagaaaaga

SEQ ID NO: 2320334 - RNA, 15 nt, Human
uauuauacuaagaaa

SEQ ID NO: 2320335 - RNA, 14 nt, Human
uauuauaauuguau

SEQ ID NO: 2320336 - RNA, 19 nt, Human
uauuauaauuuuuuucaau

SEQ ID NO: 2320337 - RNA, 14 nt, Human
uauuauaccuuuuu

SEQ ID NO: 2320338 - RNA, 13 nt, Human
uauuauacuguau

SEQ ID NO: 2320339 - RNA, 14 nt, Human
uauuauacuguauu

SEQ ID NO: 2320340 - RNA, 15 nt, Human
uauuauacuguauua

SEQ ID NO: 2320341 - RNA, 19 nt, Human
uauuauacuguauuaagag

SEQ ID NO: 2320342 - RNA, 17 nt, Human
uauuauauuuacaaaug

SEQ ID NO: 2320343 - RNA, 15 nt, Human
uauuauuguguguua

SEQ ID NO: 2320344 - RNA, 21 nt, Human
uauuaugucucuucugagcua

SEQ ID NO: 2320345 - RNA, 13 nt, Human
uauuauuuauaua

SEQ ID NO: 2320346 - RNA, 12 nt, Human
uauuauuguucu

SEQ ID NO: 2320347 - RNA, 12 nt, Human
uauuauguguuu

SEQ ID NO: 2320348 - RNA, 16 nt, Human
uauuauuuucaccugu

SEQ ID NO: 2320349 - RNA, 12 nt, Human
uauuauuuucca

SEQ ID NO: 2320350 - RNA, 15 nt, Human
uauuauuuucaccug

SEQ ID NO: 2320351 - RNA, 14 nt, Human
uauuauuuguguuu

SEQ ID NO: 2320352 - RNA, 16 nt, Human
uauuauuucaauguga

SEQ ID NO: 2320353 - RNA, 19 nt, Human
uauuauuucuaggaagaau

SEQ ID NO: 2320354 - RNA, 20 nt, Human
uauuauuucuaggaagaauu

SEQ ID NO: 2320355 - RNA, 22 nt, Human
uauuauuucuaggaagaauuuu

SEQ ID NO: 2320356 - RNA, 20 nt, Human
uauuauggaggcaggaguuu

SEQ ID NO: 2320357 - RNA, 17 nt, Human
uauuaugucucuucuga

SEQ ID NO: 2320358 - RNA, 16 nt, Human
uauuauguuaaaacug

SEQ ID NO: 2320359 - RNA, 21 nt, Human
uauuauggaagauuuuaaauu

SEQ ID NO: 2320360 - RNA, 13 nt, Human
uauuaugcuucuu

SEQ ID NO: 2320361 - RNA, 14 nt, Human
uauuaugcuucuug

SEQ ID NO: 2320362 - RNA, 24 nt, Human
uauuaugcccaguuucugccucug

SEQ ID NO: 2320363 - RNA, 16 nt, Human
uauuauccccauuucu

SEQ ID NO: 2320364 - RNA, 22 nt, Human
uauuaucaugcaaaugcuguau

SEQ ID NO: 2320365 - RNA, 18 nt, Human
uauuaucaugcaaaugcu

SEQ ID NO: 2320366 - RNA, 16 nt, Human
uauuaucaugcaaaug

SEQ ID NO: 2320367 - RNA, 15 nt, Human
uauuaucaacaauag

SEQ ID NO: 2320368 - RNA, 18 nt, Human
uaguaguaugaugauaca

SEQ ID NO: 2320369 - RNA, 19 nt, Human
uaggugcccuuggaggcca

SEQ ID NO: 2320370 - RNA, 18 nt, Human
uaggugcuacaaaaacac

SEQ ID NO: 2320371 - RNA, 21 nt, Human
uaggugaucucauuuaauccu

SEQ ID NO: 2320372 - RNA, 23 nt, Human
uaggugacagagugagacucugu

SEQ ID NO: 2320373 - RNA, 21 nt, Human
uaggugauccacucgccuuca

SEQ ID NO: 2320374 - RNA, 16 nt, Human
uaguauaucuggacaa

SEQ ID NO: 2320375 - RNA, 19 nt, Human
uaguauaucuggacaagcc

SEQ ID NO: 2320376 - RNA, 23 nt, Human
uaguaucaaauauuagaugugau

SEQ ID NO: 2320377 - RNA, 12 nt, Human
uaguauccucca

SEQ ID NO: 2320378 - RNA, 14 nt, Human
uaguaucaaauauu

SEQ ID NO: 2320379 - RNA, 20 nt, Human
uaguaucaaauauuagaugu

SEQ ID NO: 2320380 - RNA, 21 nt, Human
uaguaucaaauauuagaugug

SEQ ID NO: 2320381 - RNA, 13 nt, Human
uaguauccuccag

SEQ ID NO: 2320382 - RNA, 14 nt, Human
uaguauccuccagg

SEQ ID NO: 2320383 - RNA, 15 nt, Human
uaguauccuccaggu

SEQ ID NO: 2320384 - RNA, 19 nt, Human
uaguauacauugucucuaa

SEQ ID NO: 2320385 - RNA, 16 nt, Human
uaguauaaagaaaagu

SEQ ID NO: 2320386 - RNA, 14 nt, Human
uaguauaaagaaaa

SEQ ID NO: 2320387 - RNA, 19 nt, Human
uaguaguuccugcuacaac

SEQ ID NO: 2320388 - RNA, 13 nt, Human
uaguaucaaaaga

SEQ ID NO: 2320389 - RNA, 15 nt, Human
uaguaucuaacaugu

SEQ ID NO: 2320390 - RNA, 14 nt, Human
uaguaucuaacaug

SEQ ID NO: 2320391 - RNA, 19 nt, Human
uaguaucuagcaaucacaa

SEQ ID NO: 2320392 - RNA, 16 nt, Human
uaguauccuccagguu

SEQ ID NO: 2320393 - RNA, 17 nt, Human
uaguauccuccagguuu

SEQ ID NO: 2320394 - RNA, 18 nt, Human
uaguauccuccagguuuu

SEQ ID NO: 2320395 - RNA, 19 nt, Human
uaguauccuccagguuuuu

SEQ ID NO: 2320396 - RNA, 20 nt, Human
uaguauccuccagguuuuuc

SEQ ID NO: 2320397 - RNA, 21 nt, Human
uaguauccuccagguuuuuca

SEQ ID NO: 2320398 - RNA, 22 nt, Human
uaguauccuccagguuuuucaa

SEQ ID NO: 2320399 - RNA, 23 nt, Human
uaguauccuccagguuuuucaau

SEQ ID NO: 2320400 - RNA, 16 nt, Human
uaguauuucuaugaaa

SEQ ID NO: 2320401 - RNA, 16 nt, Human
uaguaucuagcaauca

SEQ ID NO: 2320402 - RNA, 18 nt, Human
uaguauuucuaugaaaua

SEQ ID NO: 2320403 - RNA, 19 nt, Human
uaguauuucuaugaaauau

SEQ ID NO: 2320404 - RNA, 17 nt, Human
uagugcccuccacagcc

SEQ ID NO: 2320405 - RNA, 22 nt, Human
uagugccugagaguauuuaggc

SEQ ID NO: 2320406 - RNA, 23 nt, Human
uagugcccuccacagccgcagcc

SEQ ID NO: 2320407 - RNA, 14 nt, Human
uagugcggacaagu

SEQ ID NO: 2320408 - RNA, 19 nt, Human
uagugccuucuaaaggugu

SEQ ID NO: 2320409 - RNA, 16 nt, Human
uagugccuucuaaagg

SEQ ID NO: 2320410 - RNA, 19 nt, Human
uagugcggacaaguuuuaa

SEQ ID NO: 2320411 - RNA, 17 nt, Human
uagugcggacaaguuuu

SEQ ID NO: 2320412 - RNA, 12 nt, Human
uagugucuauca

SEQ ID NO: 2320413 - RNA, 13 nt, Human
uagugcuaagugu

SEQ ID NO: 2320414 - RNA, 15 nt, Human
uaguguguucugauu

SEQ ID NO: 2320415 - RNA, 22 nt, Human
uaguguggaaauuaagaagaaa

SEQ ID NO: 2320416 - RNA, 18 nt, Human
uaguguggaaauuaagaa

SEQ ID NO: 2320417 - RNA, 19 nt, Human
uaguguguucugauuagaa

SEQ ID NO: 2320418 - RNA, 12 nt, Human
uaguguuaauca

SEQ ID NO: 2320419 - RNA, 20 nt, Human
uaguguguucugauuagaaa

SEQ ID NO: 2320420 - RNA, 14 nt, Human
uaguguuaaucaau

SEQ ID NO: 2320421 - RNA, 15 nt, Human
uaguguuaaucaauu

SEQ ID NO: 2320422 - RNA, 16 nt, Human
uaguguuaaucaauuu

SEQ ID NO: 2320423 - RNA, 23 nt, Human
uaguguuaaucaauuuaaaccca

SEQ ID NO: 2320424 - RNA, 17 nt, Human
uaguugagccagcagac

SEQ ID NO: 2320425 - RNA, 19 nt, Human
uaguugagccagcagacau

SEQ ID NO: 2320426 - RNA, 20 nt, Human
uaguugagccagcagacauu

SEQ ID NO: 2320427 - RNA, 21 nt, Human
uaguugagccagcagacauug

SEQ ID NO: 2320428 - RNA, 22 nt, Human
uaguugagccagcagacauugu

SEQ ID NO: 2320429 - RNA, 20 nt, Human
uaguugcaacuuuguauaaa

SEQ ID NO: 2320430 - RNA, 16 nt, Human
uagucaaauuauguau

SEQ ID NO: 2320431 - RNA, 18 nt, Human
uagucaaaccauaaacuu

SEQ ID NO: 2320432 - RNA, 22 nt, Human
uagugcagcugauuuuaacaau

SEQ ID NO: 2320433 - RNA, 20 nt, Human
uagugcagcugauuuuaaca

SEQ ID NO: 2320434 - RNA, 19 nt, Human
uagugcagcugauuuuaac

SEQ ID NO: 2320435 - RNA, 18 nt, Human
uagugcagcugauuuuaa

SEQ ID NO: 2320436 - RNA, 17 nt, Human
uagugcagcugauuuua

SEQ ID NO: 2320437 - RNA, 15 nt, Human
uagugcagcugauuu

SEQ ID NO: 2320438 - RNA, 14 nt, Human
uagugcagcugauu

SEQ ID NO: 2320439 - RNA, 13 nt, Human
uagugcagcugau

SEQ ID NO: 2320440 - RNA, 12 nt, Human
uagugcagcuga

SEQ ID NO: 2320441 - RNA, 13 nt, Human
uagucaaauugug

SEQ ID NO: 2320442 - RNA, 14 nt, Human
uagucaaauugugu

SEQ ID NO: 2320443 - RNA, 14 nt, Human
uagugcaaauuguc

SEQ ID NO: 2320444 - RNA, 15 nt, Human
uagugcaaauuguca

SEQ ID NO: 2320445 - RNA, 14 nt, Human
uaggucagugaggc

SEQ ID NO: 2320446 - RNA, 24 nt, Human
uaggucacuggcucuccaagugcc

SEQ ID NO: 2320447 - RNA, 14 nt, Human
uaggucacuggcuc

SEQ ID NO: 2320448 - RNA, 19 nt, Human
uaggucacuggcucuccaa

SEQ ID NO: 2320449 - RNA, 20 nt, Human
uaggucacuggcucuccaag

SEQ ID NO: 2320450 - RNA, 21 nt, Human
uaggucacuggcucuccaagu

SEQ ID NO: 2320451 - RNA, 16 nt, Human
uaggucagugcaaaua

SEQ ID NO: 2320452 - RNA, 18 nt, Human
uaggucaagaagaagaug

SEQ ID NO: 2320453 - RNA, 12 nt, Human
uaggucacuggc

SEQ ID NO: 2320454 - RNA, 15 nt, Human
uaggucacuccuggg

SEQ ID NO: 2320455 - RNA, 15 nt, Human
uagguaugaauaagu

SEQ ID NO: 2320456 - RNA, 14 nt, Human
uagguauuucaaaa

SEQ ID NO: 2320457 - RNA, 16 nt, Human
uaggucaagaagaaga

SEQ ID NO: 2320458 - RNA, 11 nt, Human
uagguauuuug

SEQ ID NO: 2320459 - RNA, 14 nt, Human
uagguauacagugg

SEQ ID NO: 2320460 - RNA, 20 nt, Human
uagguauaaguggugugugu

SEQ ID NO: 2320461 - RNA, 20 nt, Human
uaggcucugcacagauggau

SEQ ID NO: 2320462 - RNA, 14 nt, Human
uagguaggguuuaa

SEQ ID NO: 2320463 - RNA, 14 nt, Human
uagguagauguuca

SEQ ID NO: 2320464 - RNA, 15 nt, Human
uagguagauguucag

SEQ ID NO: 2320465 - RNA, 16 nt, Human
uagguaaauuacaguu

SEQ ID NO: 2320466 - RNA, 13 nt, Human
uagguaacuucau

SEQ ID NO: 2320467 - RNA, 14 nt, Human
uagguacacagcuc

SEQ ID NO: 2320468 - RNA, 22 nt, Human
uaggcuccgucaguaucaggcc

SEQ ID NO: 2320469 - RNA, 11 nt, Human
uaggcucugca

SEQ ID NO: 2320470 - RNA, 22 nt, Human
uaggcuccugccaguguggaac

SEQ ID NO: 2320471 - RNA, 15 nt, Human
uaggcuauucacaac

SEQ ID NO: 2320472 - RNA, 19 nt, Human
uaggcucagagaugugcac

SEQ ID NO: 2320473 - RNA, 14 nt, Human
uaggcuauucacaa

SEQ ID NO: 2320474 - RNA, 20 nt, Human
uaggccugggugcuggcugc

SEQ ID NO: 2320475 - RNA, 23 nt, Human
uaggccuuccucucuccagaugu

SEQ ID NO: 2320476 - RNA, 21 nt, Human
uagggaaaaaccagcguguga

SEQ ID NO: 2320477 - RNA, 20 nt, Human
uagggaaaaaccagcgugug

SEQ ID NO: 2320478 - RNA, 19 nt, Human
uagggaaaaaccagcgugu

SEQ ID NO: 2320479 - RNA, 21 nt, Human
uaggcucugcacagauggauu

SEQ ID NO: 2320480 - RNA, 18 nt, Human
uaggcucugcacagaugg

SEQ ID NO: 2320481 - RNA, 15 nt, Human
uaggcucugcacaga

SEQ ID NO: 2320482 - RNA, 13 nt, Human
uaggacccuuccc

SEQ ID NO: 2320483 - RNA, 18 nt, Human
uaggccaugggacaggga

SEQ ID NO: 2320484 - RNA, 16 nt, Human
uaggccaugggacagg

SEQ ID NO: 2320485 - RNA, 22 nt, Human
uaggaccaagcaucuugggggg

SEQ ID NO: 2320486 - RNA, 18 nt, Human
uaggaccaagcaucuugg

SEQ ID NO: 2320487 - RNA, 15 nt, Human
uaggccuggccagau

SEQ ID NO: 2320488 - RNA, 21 nt, Human
uaggcccccacuugccucuuc

SEQ ID NO: 2320489 - RNA, 14 nt, Human
uaggcccccacuug

SEQ ID NO: 2320490 - RNA, 19 nt, Human
uaggcccccacuugccucu

SEQ ID NO: 2320491 - RNA, 13 nt, Human
uaggccugggugc

SEQ ID NO: 2320492 - RNA, 19 nt, Human
uaggccugggugcuggcug

SEQ ID NO: 2320493 - RNA, 16 nt, Human
uaggccugggugcugg

SEQ ID NO: 2320494 - RNA, 21 nt, Human
uaggccuuccucucuccagau

SEQ ID NO: 2320495 - RNA, 18 nt, Human
uaggccuggccagaugca

SEQ ID NO: 2320496 - RNA, 12 nt, Human
uaggaaucagca

SEQ ID NO: 2320497 - RNA, 19 nt, Human
guggcugacccagucccug

SEQ ID NO: 2320498 - RNA, 17 nt, Human
guggcugacccaguccc

SEQ ID NO: 2320499 - RNA, 15 nt, Human
guggcugacccaguc

SEQ ID NO: 2320500 - RNA, 14 nt, Human
guggcugacccagu

SEQ ID NO: 2320501 - RNA, 15 nt, Human
guggcucugcuggcc

SEQ ID NO: 2320502 - RNA, 21 nt, Human
guggcucugaggugccugucc

SEQ ID NO: 2320503 - RNA, 15 nt, Human
guggcugagccccug

SEQ ID NO: 2320504 - RNA, 17 nt, Human
guggcugagccccuguc

SEQ ID NO: 2320505 - RNA, 17 nt, Human
guggcugaggaggccuc

SEQ ID NO: 2320506 - RNA, 18 nt, Human
guggcugaggaggccucc

SEQ ID NO: 2320507 - RNA, 15 nt, Human
guggcugcagcagcg

SEQ ID NO: 2320508 - RNA, 23 nt, Human
guggcugcagcagcgguggccuc

SEQ ID NO: 2320509 - RNA, 20 nt, Human
uaggacaaucaguccccucc

SEQ ID NO: 2320510 - RNA, 17 nt, Human
uaggaccaagcaucuug

SEQ ID NO: 2320511 - RNA, 20 nt, Human
uaggacauaaauuagagguc

SEQ ID NO: 2320512 - RNA, 18 nt, Human
uaggacaaucaguccccu

SEQ ID NO: 2320513 - RNA, 19 nt, Human
uaggaauucuuuuggggaa

SEQ ID NO: 2320514 - RNA, 16 nt, Human
uaggaauuguguuuau

SEQ ID NO: 2320515 - RNA, 21 nt, Human
uaggaauucccagcccaaagc

SEQ ID NO: 2320516 - RNA, 18 nt, Human
uaggaauuaaguuaucuu

SEQ ID NO: 2320517 - RNA, 17 nt, Human
uaggaaugugaaagcac

SEQ ID NO: 2320518 - RNA, 14 nt, Human
uaggaaucagcaag

SEQ ID NO: 2320519 - RNA, 15 nt, Human
uaggaaucagcaaga

SEQ ID NO: 2320520 - RNA, 12 nt, Human
uaggaauugacc

SEQ ID NO: 2320521 - RNA, 15 nt, Human
uauaauacuguauuu

SEQ ID NO: 2320522 - RNA, 17 nt, Human
uauaauauacuauauuu

SEQ ID NO: 2320523 - RNA, 21 nt, Human
uauaauaaaaggaaaagcaaa

SEQ ID NO: 2320524 - RNA, 16 nt, Human
uauaauaaauguacau

SEQ ID NO: 2320525 - RNA, 16 nt, Human
uauaauauauuugugu

SEQ ID NO: 2320526 - RNA, 22 nt, Human
uauaauauauuuguguauuuaa

SEQ ID NO: 2320527 - RNA, 22 nt, Human
uauaauauuuuuaauuaaauaa

SEQ ID NO: 2320528 - RNA, 15 nt, Human
uauaauauccuuugu

SEQ ID NO: 2320529 - RNA, 15 nt, Human
uauaauauauuugug

SEQ ID NO: 2320530 - RNA, 20 nt, Human
uauaauauacuauauuuaug

SEQ ID NO: 2320531 - RNA, 16 nt, Human
uauaaaugguguuuuu

SEQ ID NO: 2320532 - RNA, 16 nt, Human
uauaaaugcuauuuuu

SEQ ID NO: 2320533 - RNA, 20 nt, Human
uauaaauuccucuuugcuuu

SEQ ID NO: 2320534 - RNA, 22 nt, Human
uauaaauuauguuuauauaaau

SEQ ID NO: 2320535 - RNA, 13 nt, Human
uauaauaaaagga

SEQ ID NO: 2320536 - RNA, 14 nt, Human
uauaauaaaaggaa

SEQ ID NO: 2320537 - RNA, 14 nt, Human
uauaaauuccucuu

SEQ ID NO: 2320538 - RNA, 14 nt, Human
uauaaauuauguuu

SEQ ID NO: 2320539 - RNA, 16 nt, Human
uauaaauuauguuuau

SEQ ID NO: 2320540 - RNA, 22 nt, Human
uauaauaaaaggaaaagcaaau

SEQ ID NO: 2320541 - RNA, 22 nt, Human
uauaaagaacaagguaguuuuu

SEQ ID NO: 2320542 - RNA, 18 nt, Human
uauaaagaagaacuugca

SEQ ID NO: 2320543 - RNA, 15 nt, Human
uauaaagaacaaggu

SEQ ID NO: 2320544 - RNA, 21 nt, Human
uauaaacuuuagaguagcaug

SEQ ID NO: 2320545 - RNA, 22 nt, Human
uauaaacuuuagaguagcauga

SEQ ID NO: 2320546 - RNA, 15 nt, Human
uauaaacuuuagagu

SEQ ID NO: 2320547 - RNA, 13 nt, Human
uauaaacuuuaga

SEQ ID NO: 2320548 - RNA, 18 nt, Human
uauaaacuuuaccuuuuu

SEQ ID NO: 2320549 - RNA, 22 nt, Human
uaguugcguggacucugcacau

SEQ ID NO: 2320550 - RNA, 18 nt, Human
uaguugcagacucaguuu

SEQ ID NO: 2320551 - RNA, 23 nt, Human
uaguugcagacucaguuugucag

SEQ ID NO: 2320552 - RNA, 19 nt, Human
uaguugcagaaacauuuug

SEQ ID NO: 2320553 - RNA, 17 nt, Human
uaguugcagaaacauuu

SEQ ID NO: 2320554 - RNA, 16 nt, Human
uaguugcaauugaauu

SEQ ID NO: 2320555 - RNA, 14 nt, Human
uaguugcaauugaa

SEQ ID NO: 2320556 - RNA, 17 nt, Human
uaguugcaauagaacag

SEQ ID NO: 2320557 - RNA, 23 nt, Human
uaguugagccagcagacauuguc

SEQ ID NO: 2320558 - RNA, 12 nt, Human
uaguugagcccc

SEQ ID NO: 2320559 - RNA, 13 nt, Human
uaguugagcccca

SEQ ID NO: 2320560 - RNA, 17 nt, Human
uaguugagccccaaguc

SEQ ID NO: 2320561 - RNA, 21 nt, Human
uauaaaggaaaaaagagaagu

SEQ ID NO: 2320562 - RNA, 23 nt, Human
uauaaaucgcuuuugauaaucaa

SEQ ID NO: 2320563 - RNA, 20 nt, Human
uauaaaucgcuuuugauaau

SEQ ID NO: 2320564 - RNA, 15 nt, Human
uauaaaugcaauauu

SEQ ID NO: 2320565 - RNA, 18 nt, Human
uauaaaugccaaagucuu

SEQ ID NO: 2320566 - RNA, 14 nt, Human
uauaaaugcuauuu

SEQ ID NO: 2320567 - RNA, 17 nt, Human
uauaaagauggcugacu

SEQ ID NO: 2320568 - RNA, 21 nt, Human
uauaaagccuguauucucaaa

SEQ ID NO: 2320569 - RNA, 19 nt, Human
uauaaagaagaacuugcau

SEQ ID NO: 2320570 - RNA, 14 nt, Human
uauaauucuguaaa

SEQ ID NO: 2320571 - RNA, 15 nt, Human
uauaauucuguaaau

SEQ ID NO: 2320572 - RNA, 16 nt, Human
uauaauucuguaaaug

SEQ ID NO: 2320573 - RNA, 13 nt, Human
uauaauucuguac

SEQ ID NO: 2320574 - RNA, 14 nt, Human
uauaauucuguaca

SEQ ID NO: 2320575 - RNA, 15 nt, Human
uauaauucuguacau

SEQ ID NO: 2320576 - RNA, 19 nt, Human
uauaauucuguacauagcc

SEQ ID NO: 2320577 - RNA, 20 nt, Human
uauaauucuguacauagccu

SEQ ID NO: 2320578 - RNA, 21 nt, Human
uauaauucuguacauagccua

SEQ ID NO: 2320579 - RNA, 22 nt, Human
uauaauucuguacauagccuau

SEQ ID NO: 2320580 - RNA, 19 nt, Human
uauaauuaucggaagcagu

SEQ ID NO: 2320581 - RNA, 18 nt, Human
uauaauuacauauuugca

SEQ ID NO: 2320582 - RNA, 15 nt, Human
uauaauucacauugu

SEQ ID NO: 2320583 - RNA, 22 nt, Human
uauaauuguaucguauagcugu

SEQ ID NO: 2320584 - RNA, 12 nt, Human
uauaauuguauc

SEQ ID NO: 2320585 - RNA, 18 nt, Human
uauaauuguaucagaggc

SEQ ID NO: 2320586 - RNA, 13 nt, Human
uauaauuguaucg

SEQ ID NO: 2320587 - RNA, 14 nt, Human
uauaauuguaucgu

SEQ ID NO: 2320588 - RNA, 19 nt, Human
uauaccugugccucggcuu

SEQ ID NO: 2320589 - RNA, 15 nt, Human
uauaccugugccucg

SEQ ID NO: 2320590 - RNA, 18 nt, Human
uauaauucuguacugauu

SEQ ID NO: 2320591 - RNA, 20 nt, Human
uauaaucuuccauacuucuu

SEQ ID NO: 2320592 - RNA, 17 nt, Human
uauaauguuguuauuua

SEQ ID NO: 2320593 - RNA, 19 nt, Human
uauaauguuguuauuuaaa

SEQ ID NO: 2320594 - RNA, 20 nt, Human
uauaaucacuuuuuuccaca

SEQ ID NO: 2320595 - RNA, 18 nt, Human
uauaaucccagcacuuug

SEQ ID NO: 2320596 - RNA, 15 nt, Human
uauaauguuugcuau

SEQ ID NO: 2320597 - RNA, 18 nt, Human
uauaauguuguuauuuaa

SEQ ID NO: 2320598 - RNA, 20 nt, Human
uauacuguaaagaaagagag

SEQ ID NO: 2320599 - RNA, 21 nt, Human
uauaguguaaaauaagaauga

SEQ ID NO: 2320600 - RNA, 13 nt, Human
uauaguguaaaau

SEQ ID NO: 2320601 - RNA, 18 nt, Human
uauaguguaaaauaagaa

SEQ ID NO: 2320602 - RNA, 17 nt, Human
uauaguuaggauagcau

SEQ ID NO: 2320603 - RNA, 17 nt, Human
uauaguuuacuauuuua

SEQ ID NO: 2320604 - RNA, 13 nt, Human
uauaguuucagau

SEQ ID NO: 2320605 - RNA, 19 nt, Human
uauaguuuauugacaauaa

SEQ ID NO: 2320606 - RNA, 16 nt, Human
uauaguuuacuauuuu

SEQ ID NO: 2320607 - RNA, 21 nt, Human
uauaguuguggacauuuaaga

SEQ ID NO: 2320608 - RNA, 15 nt, Human
uauaguuuuacuuuu

SEQ ID NO: 2320609 - RNA, 15 nt, Human
uauaguuuguacaug

SEQ ID NO: 2320610 - RNA, 18 nt, Human
uauaguuuguacaugcau

SEQ ID NO: 2320611 - RNA, 22 nt, Human
uauaguuucagauauauaucau

SEQ ID NO: 2320612 - RNA, 18 nt, Human
uauaguuaggauagcauu

SEQ ID NO: 2320613 - RNA, 19 nt, Human
uauaguuaggauagcauuu

SEQ ID NO: 2320614 - RNA, 14 nt, Human
uauaguugcuugcc

SEQ ID NO: 2320615 - RNA, 22 nt, Human
uauaguugcuugccugauauaa

SEQ ID NO: 2320616 - RNA, 16 nt, Human
uauacuggagaagucu

SEQ ID NO: 2320617 - RNA, 10 nt, Human
uauacuguaa

SEQ ID NO: 2320618 - RNA, 17 nt, Human
uauacugcauacuuuuu

SEQ ID NO: 2320619 - RNA, 22 nt, Human
uauacugaaggaaaaacacaag

SEQ ID NO: 2320620 - RNA, 16 nt, Human
uauacugcauacuuuu

SEQ ID NO: 2320621 - RNA, 12 nt, Human
uauacugcauac

SEQ ID NO: 2320622 - RNA, 19 nt, Human
uauacuguaaagaaagaga

SEQ ID NO: 2320623 - RNA, 17 nt, Human
uauacuguaaagaaaga

SEQ ID NO: 2320624 - RNA, 16 nt, Human
uauacuguaaagaaag

SEQ ID NO: 2320625 - RNA, 15 nt, Human
uauacuguaaagaaa

SEQ ID NO: 2320626 - RNA, 14 nt, Human
uauacuguaaagaa

SEQ ID NO: 2320627 - RNA, 13 nt, Human
uauacuguaaaga

SEQ ID NO: 2320628 - RNA, 12 nt, Human
uauacuguaaag

SEQ ID NO: 2320629 - RNA, 11 nt, Human
uauacuguaaa

SEQ ID NO: 2320630 - RNA, 18 nt, Human
uauacgauaaauaacuuu

SEQ ID NO: 2320631 - RNA, 16 nt, Human
uauaccuuugccuugg

SEQ ID NO: 2320632 - RNA, 15 nt, Human
uauacuaagaaaaga

SEQ ID NO: 2320633 - RNA, 20 nt, Human
uauacugaaggaaaaacaca

SEQ ID NO: 2320634 - RNA, 12 nt, Human
uauacugaagga

SEQ ID NO: 2320635 - RNA, 20 nt, Human
uauacgcagcgugcuuuaaa

SEQ ID NO: 2320636 - RNA, 22 nt, Human
uauacgugaaaauuauuugaaa

SEQ ID NO: 2320637 - RNA, 13 nt, Human
uauacguguagcu

SEQ ID NO: 2320638 - RNA, 14 nt, Human
uauacguguagcua

SEQ ID NO: 2320639 - RNA, 15 nt, Human
uauacguguagcuau

SEQ ID NO: 2320640 - RNA, 17 nt, Human
uauacguguagcuauau

SEQ ID NO: 2320641 - RNA, 19 nt, Human
uauacguguagcuauaucu

SEQ ID NO: 2320642 - RNA, 12 nt, Human
uauaugucaaag

SEQ ID NO: 2320643 - RNA, 16 nt, Human
uauaugugaugaucua

SEQ ID NO: 2320644 - RNA, 22 nt, Human
uauaugugaauccucuucuuua

SEQ ID NO: 2320645 - RNA, 22 nt, Human
uauauguguguguauguuugca

SEQ ID NO: 2320646 - RNA, 19 nt, Human
uauauguguguguauguuu

SEQ ID NO: 2320647 - RNA, 13 nt, Human
uauaugugugugu

SEQ ID NO: 2320648 - RNA, 15 nt, Human
uauauguguguuuaa

SEQ ID NO: 2320649 - RNA, 16 nt, Human
uauauguguguuuaaa

SEQ ID NO: 2320650 - RNA, 19 nt, Human
uauauguguguuuaaauaa

SEQ ID NO: 2320651 - RNA, 22 nt, Human
uauauguguguuuaaauaaagu

SEQ ID NO: 2320652 - RNA, 18 nt, Human
uauaugugaacauuuauc

SEQ ID NO: 2320653 - RNA, 14 nt, Human
uauauguguaugua

SEQ ID NO: 2320654 - RNA, 21 nt, Human
uauaugcucugcauguuacau

SEQ ID NO: 2320655 - RNA, 14 nt, Human
uauaugcuuacuga

SEQ ID NO: 2320656 - RNA, 16 nt, Human
uauaucucucaugcau

SEQ ID NO: 2320657 - RNA, 20 nt, Human
uauaugcucugcauguuaca

SEQ ID NO: 2320658 - RNA, 21 nt, Human
uauaugcuuacugauauauuu

SEQ ID NO: 2320659 - RNA, 17 nt, Human
uauaugcuuacugauau

SEQ ID NO: 2320660 - RNA, 16 nt, Human
uauaugcuuacugaua

SEQ ID NO: 2320661 - RNA, 13 nt, Human
uauaugcuucugu

SEQ ID NO: 2320662 - RNA, 23 nt, Human
uauauaaauuuuuuuuguuucau

SEQ ID NO: 2320663 - RNA, 15 nt, Human
uauaucuaucuuaua

SEQ ID NO: 2320664 - RNA, 18 nt, Human
uauauaaaugguuaaaag

SEQ ID NO: 2320665 - RNA, 12 nt, Human
uauauaaaugcu

SEQ ID NO: 2320666 - RNA, 15 nt, Human
uauauaaaugcuuuu

SEQ ID NO: 2320667 - RNA, 13 nt, Human
uauauaacaaugc

SEQ ID NO: 2320668 - RNA, 17 nt, Human
uauaguuuuacuuuuaa

SEQ ID NO: 2320669 - RNA, 16 nt, Human
uauaguuuuacuuuua

SEQ ID NO: 2320670 - RNA, 11 nt, Human
uauauaaauaa

SEQ ID NO: 2320671 - RNA, 15 nt, Human
uauauaaauaaauau

SEQ ID NO: 2320672 - RNA, 16 nt, Human
uauauaaauaaauaua

SEQ ID NO: 2320673 - RNA, 18 nt, Human
uauauaaauaaauauaua

SEQ ID NO: 2320674 - RNA, 20 nt, Human
uauauaaauauauauaaaua

SEQ ID NO: 2320675 - RNA, 15 nt, Human
uauauaaauauauau

SEQ ID NO: 2320676 - RNA, 16 nt, Human
uauauaaauauauaua

SEQ ID NO: 2320677 - RNA, 19 nt, Human
uauauaaauaaauauauau

SEQ ID NO: 2320678 - RNA, 22 nt, Human
uauauaaauaaauauauauauc

SEQ ID NO: 2320679 - RNA, 12 nt, Human
uauauaaauaua

SEQ ID NO: 2320680 - RNA, 13 nt, Human
uauauaaauauau

SEQ ID NO: 2320681 - RNA, 13 nt, Human
uaugcuucuugga

SEQ ID NO: 2320682 - RNA, 17 nt, Human
uaugcuucauacaggga

SEQ ID NO: 2320683 - RNA, 15 nt, Human
uaugcuuugaaugua

SEQ ID NO: 2320684 - RNA, 16 nt, Human
uauggaaauaaaugua

SEQ ID NO: 2320685 - RNA, 12 nt, Human
uaugcuuugaau

SEQ ID NO: 2320686 - RNA, 15 nt, Human
uaugcuuuaaacauu

SEQ ID NO: 2320687 - RNA, 13 nt, Human
uauggaacacucu

SEQ ID NO: 2320688 - RNA, 16 nt, Human
uauggaacacucugag

SEQ ID NO: 2320689 - RNA, 17 nt, Human
uauggaacacucugaga

SEQ ID NO: 2320690 - RNA, 18 nt, Human
uauggaacacucugagac

SEQ ID NO: 2320691 - RNA, 21 nt, Human
uauggaaacuguugccagaga

SEQ ID NO: 2320692 - RNA, 17 nt, Human
uauggaaauaaauguau

SEQ ID NO: 2320693 - RNA, 13 nt, Human
uauggaacucucu

SEQ ID NO: 2320694 - RNA, 19 nt, Human
uauggaacacucugagacu

SEQ ID NO: 2320695 - RNA, 17 nt, Human
uauggaacucucuccac

SEQ ID NO: 2320696 - RNA, 13 nt, Human
uauggaacuucua

SEQ ID NO: 2320697 - RNA, 15 nt, Human
uauggaacuucuaau

SEQ ID NO: 2320698 - RNA, 17 nt, Human
uauggaacuucuaauau

SEQ ID NO: 2320699 - RNA, 20 nt, Human
uauggaacuucuaauauauu

SEQ ID NO: 2320700 - RNA, 19 nt, Human
uauggaaggguuuguggcu

SEQ ID NO: 2320701 - RNA, 22 nt, Human
uauggaagcauauuguuauuau

SEQ ID NO: 2320702 - RNA, 22 nt, Human
uauggaaggguuuguggcuggg

SEQ ID NO: 2320703 - RNA, 24 nt, Human
uauggaauacaguguuauuuucuu

SEQ ID NO: 2320704 - RNA, 17 nt, Human
uauggaauacaguguua

SEQ ID NO: 2320705 - RNA, 14 nt, Human
uauggaauacagug

SEQ ID NO: 2320706 - RNA, 14 nt, Human
uauggaauuacaug

SEQ ID NO: 2320707 - RNA, 18 nt, Human
uauggaauuacauguaaa

SEQ ID NO: 2320708 - RNA, 22 nt, Human
uauggaauuacauguaaaacau

SEQ ID NO: 2320709 - RNA, 11 nt, Human
uauggaauuga

SEQ ID NO: 2320710 - RNA, 19 nt, Human
uauggaauugauuugcauu

SEQ ID NO: 2320711 - RNA, 23 nt, Human
uauggaauacaguguuauuuucu

SEQ ID NO: 2320712 - RNA, 18 nt, Human
uauggaauugauuugcau

SEQ ID NO: 2320713 - RNA, 20 nt, Human
uauggaauuuuucauugaua

SEQ ID NO: 2320714 - RNA, 17 nt, Human
uauggacaaugacccag

SEQ ID NO: 2320715 - RNA, 19 nt, Human
uaugcuuauuuuaaaauuu

SEQ ID NO: 2320716 - RNA, 17 nt, Human
uaugcuuauuuuaaaau

SEQ ID NO: 2320717 - RNA, 14 nt, Human
uaugcuuauuuuaa

SEQ ID NO: 2320718 - RNA, 17 nt, Human
uaugcaucuaauaaaaa

SEQ ID NO: 2320719 - RNA, 16 nt, Human
uaugcaucuaauaaaa

SEQ ID NO: 2320720 - RNA, 13 nt, Human
uaugcuuauuuua

SEQ ID NO: 2320721 - RNA, 22 nt, Human
uaugcuuauacacuuacacuuu

SEQ ID NO: 2320722 - RNA, 18 nt, Human
uaugcaugaaguaauaug

SEQ ID NO: 2320723 - RNA, 13 nt, Human
uaugcaugaagua

SEQ ID NO: 2320724 - RNA, 16 nt, Human
uaugcuucauacaggg

SEQ ID NO: 2320725 - RNA, 14 nt, Human
uaugcuucauacag

SEQ ID NO: 2320726 - RNA, 13 nt, Human
uaugcuucauaca

SEQ ID NO: 2320727 - RNA, 12 nt, Human
uaugcuucauac

SEQ ID NO: 2320728 - RNA, 15 nt, Human
uaugcuucuguuuua

SEQ ID NO: 2320729 - RNA, 16 nt, Human
uaugcuucuguuuuau

SEQ ID NO: 2320730 - RNA, 17 nt, Human
uaugcaguuuuucagag

SEQ ID NO: 2320731 - RNA, 20 nt, Human
uaugcauauuauuuuauguu

SEQ ID NO: 2320732 - RNA, 15 nt, Human
uaugcauaaagucag

SEQ ID NO: 2320733 - RNA, 14 nt, Human
uaugcauaaaguca

SEQ ID NO: 2320734 - RNA, 19 nt, Human
uaugcaguauugagcacug

SEQ ID NO: 2320735 - RNA, 19 nt, Human
uaugcagugauauggcaga

SEQ ID NO: 2320736 - RNA, 22 nt, Human
uaugcagugauauggcagaaga

SEQ ID NO: 2320737 - RNA, 14 nt, Human
uaugcagaauguuu

SEQ ID NO: 2320738 - RNA, 18 nt, Human
uaugcagagguccacaac

SEQ ID NO: 2320739 - RNA, 14 nt, Human
uaugcaccuugugu

SEQ ID NO: 2320740 - RNA, 19 nt, Human
uaugcacauauggacucug

SEQ ID NO: 2320741 - RNA, 20 nt, Human
uaugcacauauggacucugc

SEQ ID NO: 2320742 - RNA, 18 nt, Human
uaugcaccuugugucugu

SEQ ID NO: 2320743 - RNA, 19 nt, Human
uaugcaccuugugucugua

SEQ ID NO: 2320744 - RNA, 20 nt, Human
uaugcaccuugugucuguac

SEQ ID NO: 2320745 - RNA, 22 nt, Human
uaugcaccuugugucuguacac

SEQ ID NO: 2320746 - RNA, 19 nt, Human
uaugcacuuauaauuuucc

SEQ ID NO: 2320747 - RNA, 15 nt, Human
uaugcacgaccuugg

SEQ ID NO: 2320748 - RNA, 17 nt, Human
uaugcacgaccuuggga

SEQ ID NO: 2320749 - RNA, 20 nt, Human
uaugcacuuauaauuuuccu

SEQ ID NO: 2320750 - RNA, 15 nt, Human
uaugcagaauacuuu

SEQ ID NO: 2320751 - RNA, 22 nt, Human
uaugcacuuauaauuuuccuaa

SEQ ID NO: 2320752 - RNA, 18 nt, Human
uaugaccuucuaggaagc

SEQ ID NO: 2320753 - RNA, 16 nt, Human
uaugaccuucuaggaa

SEQ ID NO: 2320754 - RNA, 16 nt, Human
uaugacggaagaacau

SEQ ID NO: 2320755 - RNA, 20 nt, Human
uaugacauucaugccuggcu

SEQ ID NO: 2320756 - RNA, 17 nt, Human
uaugacuaaagagagaa

SEQ ID NO: 2320757 - RNA, 16 nt, Human
uaugacuaaagagaga

SEQ ID NO: 2320758 - RNA, 15 nt, Human
uaugacuaaagagag

SEQ ID NO: 2320759 - RNA, 14 nt, Human
uaugacuaaagaga

SEQ ID NO: 2320760 - RNA, 13 nt, Human
uaugacuaaagag

SEQ ID NO: 2320761 - RNA, 12 nt, Human
uaugacuaaaga

SEQ ID NO: 2320762 - RNA, 20 nt, Human
uaugacggaagaacauagaa

SEQ ID NO: 2320763 - RNA, 19 nt, Human
uaugacggaagaacauaga

SEQ ID NO: 2320764 - RNA, 21 nt, Human
uaugacuaaagagagaaugua

SEQ ID NO: 2320765 - RNA, 20 nt, Human
uaugacuaaagagagaaugu

SEQ ID NO: 2320766 - RNA, 19 nt, Human
uaugacuaaagagagaaug

SEQ ID NO: 2320767 - RNA, 18 nt, Human
uaugacuaaagagagaau

SEQ ID NO: 2320768 - RNA, 16 nt, Human
uaugacuccagaauuu

SEQ ID NO: 2320769 - RNA, 16 nt, Human
uaugacucccaaauuu

SEQ ID NO: 2320770 - RNA, 17 nt, Human
uaugacugcuccccagc

SEQ ID NO: 2320771 - RNA, 18 nt, Human
uaugacugcuccccagcc

SEQ ID NO: 2320772 - RNA, 22 nt, Human
uaugacugcuccccagcccugg

SEQ ID NO: 2320773 - RNA, 17 nt, Human
uaugacugcuucaugac

SEQ ID NO: 2320774 - RNA, 23 nt, Human
uaugacugcuucaugacauuccu

SEQ ID NO: 2320775 - RNA, 20 nt, Human
uaugacuucauuaauaauaa

SEQ ID NO: 2320776 - RNA, 16 nt, Human
uaugacuucauuaaua

SEQ ID NO: 2320777 - RNA, 17 nt, Human
uaugacuccagaauuuc

SEQ ID NO: 2320778 - RNA, 23 nt, Human
uaugacuccagaauuucccaaag

SEQ ID NO: 2320779 - RNA, 16 nt, Human
uaugagccagacaaau

SEQ ID NO: 2320780 - RNA, 15 nt, Human
uaugagaggcaauga

SEQ ID NO: 2320781 - RNA, 19 nt, Human
uaugagccagacaaaugga

SEQ ID NO: 2320782 - RNA, 17 nt, Human
uaugagccagacaaaug

SEQ ID NO: 2320783 - RNA, 23 nt, Human
uaugagaaaagaggcgucuguau

SEQ ID NO: 2320784 - RNA, 23 nt, Human
uaugagcuggggaugucucucau

SEQ ID NO: 2320785 - RNA, 16 nt, Human
uaugagcugagggggg

SEQ ID NO: 2320786 - RNA, 16 nt, Human
uaugagcucuucaugu

SEQ ID NO: 2320787 - RNA, 12 nt, Human
uaugagcugagg

SEQ ID NO: 2320788 - RNA, 13 nt, Human
uaugagcugaggg

SEQ ID NO: 2320789 - RNA, 15 nt, Human
uaugagcucuucaug

SEQ ID NO: 2320790 - RNA, 14 nt, Human
uaugagcucuucau

SEQ ID NO: 2320791 - RNA, 16 nt, Human
uaugauuaguaaagaa

SEQ ID NO: 2320792 - RNA, 16 nt, Human
uaugauucccagccag

SEQ ID NO: 2320793 - RNA, 19 nt, Human
uaugauucugcuuuuacca

SEQ ID NO: 2320794 - RNA, 21 nt, Human
uaugauucagauuguuaucua

SEQ ID NO: 2320795 - RNA, 14 nt, Human
uaugauucugcuuu

SEQ ID NO: 2320796 - RNA, 18 nt, Human
uaugauuuggaaaauaaa

SEQ ID NO: 2320797 - RNA, 15 nt, Human
uaugauuuggaaaau

SEQ ID NO: 2320798 - RNA, 17 nt, Human
uaugauuuggaaaauaa

SEQ ID NO: 2320799 - RNA, 14 nt, Human
uaugauuuauaguu

SEQ ID NO: 2320800 - RNA, 15 nt, Human
uaugauuuauaguuu

SEQ ID NO: 2320801 - RNA, 18 nt, Human
uaugauuuauaguuugua

SEQ ID NO: 2320802 - RNA, 17 nt, Human
uaugauuuaauaaaaua

SEQ ID NO: 2320803 - RNA, 18 nt, Human
uaugauuuaauaaaauaa

SEQ ID NO: 2320804 - RNA, 14 nt, Human
uaugauuuaaaaca

SEQ ID NO: 2320805 - RNA, 17 nt, Human
uaugauuuaaaacaugu

SEQ ID NO: 2320806 - RNA, 18 nt, Human
uaugauuuaaaacaugua

SEQ ID NO: 2320807 - RNA, 14 nt, Human
uaugauuuaauaaa

SEQ ID NO: 2320808 - RNA, 17 nt, Human
uaugauuuuuuuuucau

SEQ ID NO: 2320809 - RNA, 16 nt, Human
uaugauuuuauuugac

SEQ ID NO: 2320810 - RNA, 12 nt, Human
uaugcaaagcac

SEQ ID NO: 2320811 - RNA, 14 nt, Human
uaugcaaagcacug

SEQ ID NO: 2320812 - RNA, 13 nt, Human
uaugcaaagcacu

SEQ ID NO: 2320813 - RNA, 19 nt, Human
uaugauuuuuuuuucauac

SEQ ID NO: 2320814 - RNA, 22 nt, Human
uaugcaaaaguucugacuugac

SEQ ID NO: 2320815 - RNA, 15 nt, Human
uaugcaaagcacuga

SEQ ID NO: 2320816 - RNA, 18 nt, Human
uaugcaaucaaaucugcu

SEQ ID NO: 2320817 - RNA, 14 nt, Human
uaugcaaauauuuu

SEQ ID NO: 2320818 - RNA, 20 nt, Human
uaugcaaauauuuuuuugua

SEQ ID NO: 2320819 - RNA, 20 nt, Human
uaugcaaggaaggaaagaaa

SEQ ID NO: 2320820 - RNA, 17 nt, Human
uaugcaaggaaggaaag

SEQ ID NO: 2320821 - RNA, 16 nt, Human
uaugcaauuuccuuuu

SEQ ID NO: 2320822 - RNA, 15 nt, Human
uaugcaauauaucua

SEQ ID NO: 2320823 - RNA, 13 nt, Human
uaugcacacauuu

SEQ ID NO: 2320824 - RNA, 13 nt, Human
uaugcacauaugg

SEQ ID NO: 2320825 - RNA, 14 nt, Human
uaugcacacauuuu

SEQ ID NO: 2320826 - RNA, 21 nt, Human
uaucuacaucuuuuuucacaa

SEQ ID NO: 2320827 - RNA, 16 nt, Human
uaucuacaucuuuuuu

SEQ ID NO: 2320828 - RNA, 20 nt, Human
uaucuaauaccucugugugc

SEQ ID NO: 2320829 - RNA, 13 nt, Human
uaucuacucuccu

SEQ ID NO: 2320830 - RNA, 16 nt, Human
uaucuacccagaauua

SEQ ID NO: 2320831 - RNA, 16 nt, Human
uaucuaaauugaauaa

SEQ ID NO: 2320832 - RNA, 17 nt, Human
uaucuaaauugaauaau

SEQ ID NO: 2320833 - RNA, 20 nt, Human
uaucuaaauugaauaauggu

SEQ ID NO: 2320834 - RNA, 21 nt, Human
uaucuaaauugaauaauggua

SEQ ID NO: 2320835 - RNA, 13 nt, Human
uaucuaaauugaa

SEQ ID NO: 2320836 - RNA, 14 nt, Human
uaucuaaauugaau

SEQ ID NO: 2320837 - RNA, 16 nt, Human
uaucgucacugcuuaa

SEQ ID NO: 2320838 - RNA, 21 nt, Human
uaucuaauauguaacaagcca

SEQ ID NO: 2320839 - RNA, 16 nt, Human
uaucuaauaccucugu

SEQ ID NO: 2320840 - RNA, 15 nt, Human
uaucuaauaccucug

SEQ ID NO: 2320841 - RNA, 17 nt, Human
uaucugagggaggaggc

SEQ ID NO: 2320842 - RNA, 18 nt, Human
uaucugagggaggaggcc

SEQ ID NO: 2320843 - RNA, 23 nt, Human
uaucugagggaggaggccaccuc

SEQ ID NO: 2320844 - RNA, 13 nt, Human
uaucugaggucac

SEQ ID NO: 2320845 - RNA, 16 nt, Human
uaucugcaggcagaca

SEQ ID NO: 2320846 - RNA, 17 nt, Human
uaucugcaggcagacac

SEQ ID NO: 2320847 - RNA, 18 nt, Human
uaucugcaggcagacacg

SEQ ID NO: 2320848 - RNA, 15 nt, Human
uaucugcaggcagac

SEQ ID NO: 2320849 - RNA, 23 nt, Human
uaucugggauuaugguuuuguga

SEQ ID NO: 2320850 - RNA, 18 nt, Human
uaucuggacaagccaacu

SEQ ID NO: 2320851 - RNA, 23 nt, Human
uaucugcuuuugguuauaaugug

SEQ ID NO: 2320852 - RNA, 19 nt, Human
uaucuggaaguaaccauuu

SEQ ID NO: 2320853 - RNA, 13 nt, Human
uaucugcugucca

SEQ ID NO: 2320854 - RNA, 17 nt, Human
uaucugcuguccagaca

SEQ ID NO: 2320855 - RNA, 22 nt, Human
uaucugcuguccagacagccug

SEQ ID NO: 2320856 - RNA, 20 nt, Human
uaucugcuucaguggagaau

SEQ ID NO: 2320857 - RNA, 11 nt, Human
uaucugcuguc

SEQ ID NO: 2320858 - RNA, 12 nt, Human
uaucugcugucc

SEQ ID NO: 2320859 - RNA, 20 nt, Human
uaucugccuuuauuguguuu

SEQ ID NO: 2320860 - RNA, 14 nt, Human
uaucugccuuuauu

SEQ ID NO: 2320861 - RNA, 18 nt, Human
uaucugccuuuauugugu

SEQ ID NO: 2320862 - RNA, 19 nt, Human
uaucugcaggcagacacgg

SEQ ID NO: 2320863 - RNA, 21 nt, Human
uaucugcaggcagacacggau

SEQ ID NO: 2320864 - RNA, 13 nt, Human
uaucugccuuuau

SEQ ID NO: 2320865 - RNA, 11 nt, Human
uauccucugau

SEQ ID NO: 2320866 - RNA, 14 nt, Human
uauccucugaucuc

SEQ ID NO: 2320867 - RNA, 20 nt, Human
uauccucugaucuccauggc

SEQ ID NO: 2320868 - RNA, 12 nt, Human
uauccucuguaa

SEQ ID NO: 2320869 - RNA, 14 nt, Human
uauccucuuuagag

SEQ ID NO: 2320870 - RNA, 16 nt, Human
uauccucuuuagaguu

SEQ ID NO: 2320871 - RNA, 17 nt, Human
uauccucuuuagaguua

SEQ ID NO: 2320872 - RNA, 22 nt, Human
uauccucuuuagaguuagacug

SEQ ID NO: 2320873 - RNA, 23 nt, Human
uauccucuuuagaguuagacugu

SEQ ID NO: 2320874 - RNA, 14 nt, Human
uauccugaaauuuc

SEQ ID NO: 2320875 - RNA, 17 nt, Human
uauccugaaauuucaga

SEQ ID NO: 2320876 - RNA, 16 nt, Human
uauccugaaauuucag

SEQ ID NO: 2320877 - RNA, 18 nt, Human
uauauguguuuuucacau

SEQ ID NO: 2320878 - RNA, 23 nt, Human
uauauguguguuuaaauaaagua

SEQ ID NO: 2320879 - RNA, 14 nt, Human
uauauguucacugu

SEQ ID NO: 2320880 - RNA, 20 nt, Human
uauauguucuaauuaauaaa

SEQ ID NO: 2320881 - RNA, 20 nt, Human
uauauguuuaccuuuuaauu

SEQ ID NO: 2320882 - RNA, 23 nt, Human
uauauguuuaccuuuuaauuaau

SEQ ID NO: 2320883 - RNA, 19 nt, Human
uauauguuuuaagaggcag

SEQ ID NO: 2320884 - RNA, 19 nt, Human
uauauguuuuugaaggcag

SEQ ID NO: 2320885 - RNA, 13 nt, Human
uauauuaaaaaua

SEQ ID NO: 2320886 - RNA, 15 nt, Human
uauauuaaaaauaua

SEQ ID NO: 2320887 - RNA, 17 nt, Human
uauauuaaaaauauaaa

SEQ ID NO: 2320888 - RNA, 18 nt, Human
uauauuaaaaauauaaaa

SEQ ID NO: 2320889 - RNA, 15 nt, Human
uauauuaaaauaagc

SEQ ID NO: 2320890 - RNA, 19 nt, Human
uauauuaaaaauauaaaac

SEQ ID NO: 2320891 - RNA, 20 nt, Human
uauauuaaaaauauaaaacu

SEQ ID NO: 2320892 - RNA, 21 nt, Human
uauauuaaaaauauaaaacug

SEQ ID NO: 2320893 - RNA, 23 nt, Human
uauauuaaaaauauaaaacugcg

SEQ ID NO: 2320894 - RNA, 16 nt, Human
uaucuaaauguugaaa

SEQ ID NO: 2320895 - RNA, 18 nt, Human
uaucgggagcagugucuu

SEQ ID NO: 2320896 - RNA, 15 nt, Human
uaucgggagcagugu

SEQ ID NO: 2320897 - RNA, 14 nt, Human
uaucgggagcagug

SEQ ID NO: 2320898 - RNA, 17 nt, Human
uaucgggagcagugucu

SEQ ID NO: 2320899 - RNA, 21 nt, Human
uaucguaaccagccagauccu

SEQ ID NO: 2320900 - RNA, 15 nt, Human
uaucguaaaauuaag

SEQ ID NO: 2320901 - RNA, 18 nt, Human
uaucguaaaauuaagaaa

SEQ ID NO: 2320902 - RNA, 17 nt, Human
uaucgggaacaguguuu

SEQ ID NO: 2320903 - RNA, 16 nt, Human
uaucgggaacaguguu

SEQ ID NO: 2320904 - RNA, 22 nt, Human
uauccuuuguggcaccuuuucu

SEQ ID NO: 2320905 - RNA, 17 nt, Human
uauccuuucuaacaaaa

SEQ ID NO: 2320906 - RNA, 13 nt, Human
uauccugagccau

SEQ ID NO: 2320907 - RNA, 14 nt, Human
uauccuucagccug

SEQ ID NO: 2320908 - RNA, 15 nt, Human
uauccuucagccuga

SEQ ID NO: 2320909 - RNA, 12 nt, Human
uaugaauaacau

SEQ ID NO: 2320910 - RNA, 14 nt, Human
uaucuucugauuug

SEQ ID NO: 2320911 - RNA, 16 nt, Human
uaugaauacagggcau

SEQ ID NO: 2320912 - RNA, 12 nt, Human
uaugaauacagg

SEQ ID NO: 2320913 - RNA, 21 nt, Human
uaugaaucuauuauacuguau

SEQ ID NO: 2320914 - RNA, 23 nt, Human
uaugaaucuauuauacuguauua

SEQ ID NO: 2320915 - RNA, 19 nt, Human
uaugaaugcccccagcugg

SEQ ID NO: 2320916 - RNA, 13 nt, Human
uaugaaucuaugc

SEQ ID NO: 2320917 - RNA, 15 nt, Human
uaugaaucuaugcca

SEQ ID NO: 2320918 - RNA, 20 nt, Human
uaugaaucuaugccaaagau

SEQ ID NO: 2320919 - RNA, 21 nt, Human
uaugaaucuaugccaaagauc

SEQ ID NO: 2320920 - RNA, 22 nt, Human
uaugaaucuaugccaaagauca

SEQ ID NO: 2320921 - RNA, 12 nt, Human
uaugaaucuauu

SEQ ID NO: 2320922 - RNA, 18 nt, Human
uaugaaucuauuauacug

SEQ ID NO: 2320923 - RNA, 15 nt, Human
uaugaauuuaaauau

SEQ ID NO: 2320924 - RNA, 18 nt, Human
uaugaauugaauuaucuu

SEQ ID NO: 2320925 - RNA, 23 nt, Human
uaugaauuacauuuguauaaaau

SEQ ID NO: 2320926 - RNA, 17 nt, Human
uaugaauuacauuugua

SEQ ID NO: 2320927 - RNA, 20 nt, Human
uaugaaugcccccagcuggc

SEQ ID NO: 2320928 - RNA, 21 nt, Human
uaugaaugcccccagcuggcc

SEQ ID NO: 2320929 - RNA, 22 nt, Human
uaugaaugggcaaaacugaauu

SEQ ID NO: 2320930 - RNA, 20 nt, Human
uaugacagcugucccuguca

SEQ ID NO: 2320931 - RNA, 16 nt, Human
uaugacagcugucccu

SEQ ID NO: 2320932 - RNA, 22 nt, Human
uaugacacaugcaaggucauuu

SEQ ID NO: 2320933 - RNA, 23 nt, Human
uaugaauuuaaauauaauucugu

SEQ ID NO: 2320934 - RNA, 17 nt, Human
uaugaauuuaaauauaa

SEQ ID NO: 2320935 - RNA, 19 nt, Human
uaugaauuuaaauauaauu

SEQ ID NO: 2320936 - RNA, 20 nt, Human
uaugaauuuaaauauaauuc

SEQ ID NO: 2320937 - RNA, 21 nt, Human
uaugaauuuaaauauaauucu

SEQ ID NO: 2320938 - RNA, 12 nt, Human
uaugacacaugc

SEQ ID NO: 2320939 - RNA, 15 nt, Human
uaugacaguuauacu

SEQ ID NO: 2320940 - RNA, 19 nt, Human
uaugacaucacuuguacaa

SEQ ID NO: 2320941 - RNA, 19 nt, Human
uaugaccacacuccagcug

SEQ ID NO: 2320942 - RNA, 14 nt, Human
uaugaccacacucc

SEQ ID NO: 2320943 - RNA, 24 nt, Human
uaugacaucacuuguacaaaauaa

SEQ ID NO: 2320944 - RNA, 14 nt, Human
uaugacauucaugc

SEQ ID NO: 2320945 - RNA, 19 nt, Human
uaugacauucaugccuggc

SEQ ID NO: 2320946 - RNA, 23 nt, Human
uaugacaucacuuguacaaaaua

SEQ ID NO: 2320947 - RNA, 20 nt, Human
uaugacaucacuuguacaaa

SEQ ID NO: 2320948 - RNA, 20 nt, Human
uaucuuaauuuugguuguau

SEQ ID NO: 2320949 - RNA, 13 nt, Human
uaucuuaauuuug

SEQ ID NO: 2320950 - RNA, 17 nt, Human
uaucuguguuuuugaaa

SEQ ID NO: 2320951 - RNA, 12 nt, Human
uaucuguucuug

SEQ ID NO: 2320952 - RNA, 16 nt, Human
uaucuguuuacagugu

SEQ ID NO: 2320953 - RNA, 17 nt, Human
uaucuguuuacaguguu

SEQ ID NO: 2320954 - RNA, 14 nt, Human
uaucuguucuuuaa

SEQ ID NO: 2320955 - RNA, 19 nt, Human
uaucuguucuuuaauuuau

SEQ ID NO: 2320956 - RNA, 20 nt, Human
uaucuguucuuuaauuuauu

SEQ ID NO: 2320957 - RNA, 18 nt, Human
uaugaauaaagacaccua

SEQ ID NO: 2320958 - RNA, 14 nt, Human
uaucuugaagacuu

SEQ ID NO: 2320959 - RNA, 20 nt, Human
uaugaaguuuuuuuuauaca

SEQ ID NO: 2320960 - RNA, 20 nt, Human
uaucugucauuugagcaggg

SEQ ID NO: 2320961 - RNA, 23 nt, Human
uaucuguagugagauagcauugu

SEQ ID NO: 2320962 - RNA, 16 nt, Human
uaucuguaucucucuc

SEQ ID NO: 2320963 - RNA, 11 nt, Human
uaucuguauuu

SEQ ID NO: 2320964 - RNA, 15 nt, Human
uaucuguauuuaauu

SEQ ID NO: 2320965 - RNA, 17 nt, Human
uaucuguauuuaauuuu

SEQ ID NO: 2320966 - RNA, 22 nt, Human
uaucuguauuuaauuuugacac

SEQ ID NO: 2320967 - RNA, 18 nt, Human
uaucugggaacugugccu

SEQ ID NO: 2320968 - RNA, 19 nt, Human
uaucugggauucuacuuua

SEQ ID NO: 2320969 - RNA, 21 nt, Human
uaucugggauucuacuuuaag

SEQ ID NO: 2320970 - RNA, 22 nt, Human
uaucuggucaaccuccuggaca

SEQ ID NO: 2320971 - RNA, 18 nt, Human
uaucuguaaguuuugaau

SEQ ID NO: 2320972 - RNA, 19 nt, Human
uaucugggugcaugaucuu

SEQ ID NO: 2320973 - RNA, 21 nt, Human
uaucugucauuugagcagggc

SEQ ID NO: 2320974 - RNA, 23 nt, Human
uaucugucauuugagcagggcuc

SEQ ID NO: 2320975 - RNA, 20 nt, Human
uaucugugcgugaaacacac

SEQ ID NO: 2320976 - RNA, 19 nt, Human
uaucugugcgugaaacaca

SEQ ID NO: 2320977 - RNA, 14 nt, Human
uaucugugcucagg

SEQ ID NO: 2320978 - RNA, 20 nt, Human
uaucuguguuuuugaaauau

SEQ ID NO: 2320979 - RNA, 22 nt, Human
uaucugugcucaggacucagaa

SEQ ID NO: 2320980 - RNA, 18 nt, Human
uaucugugcgugaaacac

SEQ ID NO: 2320981 - RNA, 17 nt, Human
uaucugugcgugaaaca

SEQ ID NO: 2320982 - RNA, 19 nt, Human
uaucugugaaaugcuggca

SEQ ID NO: 2320983 - RNA, 23 nt, Human
gugcugaguugguguugacaugu

SEQ ID NO: 2320984 - RNA, 22 nt, Human
gugcugaucgugcuaaauuuuc

SEQ ID NO: 2320985 - RNA, 22 nt, Human
gugcugaggccuuaucauucau

SEQ ID NO: 2320986 - RNA, 12 nt, Human
gugcugcauuua

SEQ ID NO: 2320987 - RNA, 20 nt, Human
gugcugcauuuaaaagauac

SEQ ID NO: 2320988 - RNA, 19 nt, Human
gugcugcauuuaaaagaua

SEQ ID NO: 2320989 - RNA, 15 nt, Human
gugcugccauccagg

SEQ ID NO: 2320990 - RNA, 12 nt, Human
gugcugccacac

SEQ ID NO: 2320991 - RNA, 20 nt, Human
gugcugaucgugcuaaauuu

SEQ ID NO: 2320992 - RNA, 18 nt, Human
gugcugccauccagguuc

SEQ ID NO: 2320993 - RNA, 19 nt, Human
gugcugccauccagguuca

SEQ ID NO: 2320994 - RNA, 12 nt, Human
gugcugagucug

SEQ ID NO: 2320995 - RNA, 14 nt, Human
gugcugagaagcuu

SEQ ID NO: 2320996 - RNA, 13 nt, Human
gugcugagaagcu

SEQ ID NO: 2320997 - RNA, 11 nt, Human
gugcugagaag

SEQ ID NO: 2320998 - RNA, 23 nt, Human
gugcugacggccagggagaagcu

SEQ ID NO: 2320999 - RNA, 21 nt, Human
gugcugacggccagggagaag

SEQ ID NO: 2321000 - RNA, 17 nt, Human
gugcugacagcugcucc

SEQ ID NO: 2321001 - RNA, 16 nt, Human
gugcugacagcugcuc

SEQ ID NO: 2321002 - RNA, 15 nt, Human
gugcugacagcugcu

SEQ ID NO: 2321003 - RNA, 14 nt, Human
gugcugacccuccu

SEQ ID NO: 2321004 - RNA, 16 nt, Human
gugcugacccuccugu

SEQ ID NO: 2321005 - RNA, 18 nt, Human
gugcugacccuccuguug

SEQ ID NO: 2321006 - RNA, 14 nt, Human
gugcugaccucugg

SEQ ID NO: 2321007 - RNA, 18 nt, Human
gugcugacggccagggag

SEQ ID NO: 2321008 - RNA, 16 nt, Human
gugcugacggccaggg

SEQ ID NO: 2321009 - RNA, 15 nt, Human
gugcugacggccagg

SEQ ID NO: 2321010 - RNA, 15 nt, Human
gugcugaccucuggu

SEQ ID NO: 2321011 - RNA, 15 nt, Human
gugcugacggaagcc

SEQ ID NO: 2321012 - RNA, 16 nt, Human
gugcugagucugaagg

SEQ ID NO: 2321013 - RNA, 17 nt, Human
gugcugagucugaaggc

SEQ ID NO: 2321014 - RNA, 18 nt, Human
gugcugagucugaaggcu

SEQ ID NO: 2321015 - RNA, 19 nt, Human
gugcugagucugaaggcug

SEQ ID NO: 2321016 - RNA, 12 nt, Human
gugcccugcccc

SEQ ID NO: 2321017 - RNA, 16 nt, Human
gugcccuuggaggcca

SEQ ID NO: 2321018 - RNA, 23 nt, Human
gugcccugguggagaaagcacug

SEQ ID NO: 2321019 - RNA, 15 nt, Human
gugcccugguggaga

SEQ ID NO: 2321020 - RNA, 22 nt, Human
gugccgagaaggaagccuccca

SEQ ID NO: 2321021 - RNA, 14 nt, Human
gugccgacagaagg

SEQ ID NO: 2321022 - RNA, 15 nt, Human
gugccgacagaagga

SEQ ID NO: 2321023 - RNA, 20 nt, Human
gugccuuggggaauuuccuc

SEQ ID NO: 2321024 - RNA, 21 nt, Human
gugccuuggggaauuuccucu

SEQ ID NO: 2321025 - RNA, 21 nt, Human
gugccuuggggacaagagcag

SEQ ID NO: 2321026 - RNA, 15 nt, Human
gugcucuggacaggc

SEQ ID NO: 2321027 - RNA, 16 nt, Human
gugcucuggacaggca

SEQ ID NO: 2321028 - RNA, 21 nt, Human
gugccuuugaguuuccucagg

SEQ ID NO: 2321029 - RNA, 14 nt, Human
gugccuuuuauagc

SEQ ID NO: 2321030 - RNA, 18 nt, Human
gugccuuuuauagcuauu

SEQ ID NO: 2321031 - RNA, 22 nt, Human
gugcugaacaaaaaauaaaaau

SEQ ID NO: 2321032 - RNA, 17 nt, Human
gugcucuucuucuuucu

SEQ ID NO: 2321033 - RNA, 15 nt, Human
gugccuuuugcaccc

SEQ ID NO: 2321034 - RNA, 16 nt, Human
gugccuuuugcacccc

SEQ ID NO: 2321035 - RNA, 17 nt, Human
gugccuuuugcaccccu

SEQ ID NO: 2321036 - RNA, 18 nt, Human
gugccuuuugcaccccuc

SEQ ID NO: 2321037 - RNA, 17 nt, Human
gugcucuggacaggcau

SEQ ID NO: 2321038 - RNA, 18 nt, Human
gugcucuggacaggcaug

SEQ ID NO: 2321039 - RNA, 20 nt, Human
gugcugaaugguuuucaaaa

SEQ ID NO: 2321040 - RNA, 19 nt, Human
gugcugaaugguuuucaaa

SEQ ID NO: 2321041 - RNA, 19 nt, Human
gugcugaauguugggacug

SEQ ID NO: 2321042 - RNA, 21 nt, Human
gugcugaacaguggaggaaga

SEQ ID NO: 2321043 - RNA, 23 nt, Human
gugcugaaugguuuucaaaauaa

SEQ ID NO: 2321044 - RNA, 15 nt, Human
gugcuucaauuaaua

SEQ ID NO: 2321045 - RNA, 18 nt, Human
gugcuuauguaugaggua

SEQ ID NO: 2321046 - RNA, 18 nt, Human
gugcuucagccugaggcu

SEQ ID NO: 2321047 - RNA, 15 nt, Human
gugcuucagccugag

SEQ ID NO: 2321048 - RNA, 13 nt, Human
gugcuucagccug

SEQ ID NO: 2321049 - RNA, 16 nt, Human
gugcuuccaaggcaga

SEQ ID NO: 2321050 - RNA, 14 nt, Human
gugcuucgggcccu

SEQ ID NO: 2321051 - RNA, 13 nt, Human
gugcuucuuucuu

SEQ ID NO: 2321052 - RNA, 17 nt, Human
gugcuucgggcccuucc

SEQ ID NO: 2321053 - RNA, 21 nt, Human
gugcuucuaauauuuauugcu

SEQ ID NO: 2321054 - RNA, 12 nt, Human
gugcuuggagga

SEQ ID NO: 2321055 - RNA, 13 nt, Human
gugcuuggaggaa

SEQ ID NO: 2321056 - RNA, 15 nt, Human
gugcuuggaggaagg

SEQ ID NO: 2321057 - RNA, 21 nt, Human
gugcugcccgucuucagccua

SEQ ID NO: 2321058 - RNA, 14 nt, Human
gugcuguggggcug

SEQ ID NO: 2321059 - RNA, 19 nt, Human
gugcuguggggcugguagc

SEQ ID NO: 2321060 - RNA, 23 nt, Human
gugcuguggggcugguagcucag

SEQ ID NO: 2321061 - RNA, 11 nt, Human
gugcugcccug

SEQ ID NO: 2321062 - RNA, 22 nt, Human
gugcugccauccagguucagcu

SEQ ID NO: 2321063 - RNA, 19 nt, Human
gugcugcccgucuucagcc

SEQ ID NO: 2321064 - RNA, 18 nt, Human
gugcugcccgucuucagc

SEQ ID NO: 2321065 - RNA, 21 nt, Human
gugcugccacacuucaggcuc

SEQ ID NO: 2321066 - RNA, 12 nt, Human
gugcuguguaaa

SEQ ID NO: 2321067 - RNA, 13 nt, Human
gugcuguguaaag

SEQ ID NO: 2321068 - RNA, 14 nt, Human
gugcuguguaaagu

SEQ ID NO: 2321069 - RNA, 15 nt, Human
gugcuguguaaaguu

SEQ ID NO: 2321070 - RNA, 16 nt, Human
gugcuguguaaaguua

SEQ ID NO: 2321071 - RNA, 18 nt, Human
gugcuguguaaaguuagu

SEQ ID NO: 2321072 - RNA, 22 nt, Human
gugcuguguaaaguuagucuac

SEQ ID NO: 2321073 - RNA, 11 nt, Human
gugcugugugu

SEQ ID NO: 2321074 - RNA, 21 nt, Human
gugcuuaucccauagccagga

SEQ ID NO: 2321075 - RNA, 22 nt, Human
gugcuuaagcagaagcauuaac

SEQ ID NO: 2321076 - RNA, 17 nt, Human
gugcuuaagcagaagca

SEQ ID NO: 2321077 - RNA, 23 nt, Human
guggaaaguguaaagcauuccaa

SEQ ID NO: 2321078 - RNA, 20 nt, Human
guggaaaguguaaagcauuc

SEQ ID NO: 2321079 - RNA, 21 nt, Human
guggaaaguguaaagcauucc

SEQ ID NO: 2321080 - RNA, 13 nt, Human
guggaaaguguaa

SEQ ID NO: 2321081 - RNA, 15 nt, Human
guggaaaguguaaag

SEQ ID NO: 2321082 - RNA, 16 nt, Human
guggaaaguguaaagc

SEQ ID NO: 2321083 - RNA, 18 nt, Human
guggaaaguguaaagcau

SEQ ID NO: 2321084 - RNA, 20 nt, Human
guggaaauuaagaagaaacu

SEQ ID NO: 2321085 - RNA, 19 nt, Human
guggaaauuaagaagaaac

SEQ ID NO: 2321086 - RNA, 18 nt, Human
guggaaauuaagaagaaa

SEQ ID NO: 2321087 - RNA, 17 nt, Human
guggaaauuaagaagaa

SEQ ID NO: 2321088 - RNA, 19 nt, Human
guggaaagugaauuugaau

SEQ ID NO: 2321089 - RNA, 16 nt, Human
guggaaagugaauuug

SEQ ID NO: 2321090 - RNA, 22 nt, Human
guggaaagggugcugcuucccu

SEQ ID NO: 2321091 - RNA, 20 nt, Human
guggaaagggugcugcuucc

SEQ ID NO: 2321092 - RNA, 23 nt, Human
guggaaagccucugcugccaugg

SEQ ID NO: 2321093 - RNA, 13 nt, Human
guggaaagggugc

SEQ ID NO: 2321094 - RNA, 15 nt, Human
guggaaagccucugc

SEQ ID NO: 2321095 - RNA, 14 nt, Human
guggaaagccucug

SEQ ID NO: 2321096 - RNA, 19 nt, Human
guggaaaaaugagagaagg

SEQ ID NO: 2321097 - RNA, 20 nt, Human
gugcuuucuauuguacagaa

SEQ ID NO: 2321098 - RNA, 22 nt, Human
gugcuuucuauuguacagaagc

SEQ ID NO: 2321099 - RNA, 15 nt, Human
gugcuuuuaaaugca

SEQ ID NO: 2321100 - RNA, 14 nt, Human
gugcuuuucuccaa

SEQ ID NO: 2321101 - RNA, 18 nt, Human
gugcuuuuauagaggcua

SEQ ID NO: 2321102 - RNA, 19 nt, Human
gugcuuuuauagaggcuag

SEQ ID NO: 2321103 - RNA, 17 nt, Human
gugcuuuuccuauuugu

SEQ ID NO: 2321104 - RNA, 19 nt, Human
gugcuuuuccuauuuguuu

SEQ ID NO: 2321105 - RNA, 15 nt, Human
guggaaaaauauuua

SEQ ID NO: 2321106 - RNA, 14 nt, Human
guggaaaaauauuu

SEQ ID NO: 2321107 - RNA, 13 nt, Human
guggaaaaauauu

SEQ ID NO: 2321108 - RNA, 12 nt, Human
guggaaaaauau

SEQ ID NO: 2321109 - RNA, 23 nt, Human
guggaaaagccaagaggcugcag

SEQ ID NO: 2321110 - RNA, 18 nt, Human
guggaaaaauagccugcc

SEQ ID NO: 2321111 - RNA, 14 nt, Human
gugcuuuaugcuga

SEQ ID NO: 2321112 - RNA, 23 nt, Human
gugcuuguuugcucaccuggggu

SEQ ID NO: 2321113 - RNA, 22 nt, Human
gugcuuguuugcucaccugggg

SEQ ID NO: 2321114 - RNA, 21 nt, Human
gugcuuguuugcucaccuggg

SEQ ID NO: 2321115 - RNA, 15 nt, Human
gugcuugugugugug

SEQ ID NO: 2321116 - RNA, 19 nt, Human
gugcuuguuuacagcacua

SEQ ID NO: 2321117 - RNA, 20 nt, Human
gugcuuguucccucucccug

SEQ ID NO: 2321118 - RNA, 16 nt, Human
gugcuugccacagagc

SEQ ID NO: 2321119 - RNA, 22 nt, Human
gugcuuuccguggcacugcaua

SEQ ID NO: 2321120 - RNA, 20 nt, Human
gugcuuuccuuuuuuaaaaa

SEQ ID NO: 2321121 - RNA, 19 nt, Human
gugcuuuccuuuuuuaaaa

SEQ ID NO: 2321122 - RNA, 12 nt, Human
gugcuuucuauu

SEQ ID NO: 2321123 - RNA, 13 nt, Human
gugcuuucuauug

SEQ ID NO: 2321124 - RNA, 17 nt, Human
gugcuuucuauuguaca

SEQ ID NO: 2321125 - RNA, 19 nt, Human
gugcuuucuauuguacaga

SEQ ID NO: 2321126 - RNA, 17 nt, Human
gugcuuuaugcugaaac

SEQ ID NO: 2321127 - RNA, 15 nt, Human
gugcuuuaugcugaa

SEQ ID NO: 2321128 - RNA, 13 nt, Human
gugcuuuccagcu

SEQ ID NO: 2321129 - RNA, 14 nt, Human
gugcuuuccagcuc

SEQ ID NO: 2321130 - RNA, 15 nt, Human
gugcuuuccagcuca

SEQ ID NO: 2321131 - RNA, 16 nt, Human
gugcuuuccagcucac

SEQ ID NO: 2321132 - RNA, 18 nt, Human
gugcuuuccagcucaccc

SEQ ID NO: 2321133 - RNA, 20 nt, Human
gugcuuuccagcucaccccc

SEQ ID NO: 2321134 - RNA, 14 nt, Human
gugcuucuuucuuu

SEQ ID NO: 2321135 - RNA, 19 nt, Human
guggagguugcagugagcu

SEQ ID NO: 2321136 - RNA, 23 nt, Human
guggagguugcagugagccaaga

SEQ ID NO: 2321137 - RNA, 22 nt, Human
guggagguugcagugagccaag

SEQ ID NO: 2321138 - RNA, 22 nt, Human
guggagguuaaggcugaggaaa

SEQ ID NO: 2321139 - RNA, 21 nt, Human
guggagguuaaggcugaggaa

SEQ ID NO: 2321140 - RNA, 22 nt, Human
guggaggugucaggcugcuggc

SEQ ID NO: 2321141 - RNA, 17 nt, Human
guggaggugucaggcug

SEQ ID NO: 2321142 - RNA, 18 nt, Human
guggaggugucaggcugc

SEQ ID NO: 2321143 - RNA, 15 nt, Human
guggagggguguggc

SEQ ID NO: 2321144 - RNA, 16 nt, Human
guggagggguguggca

SEQ ID NO: 2321145 - RNA, 23 nt, Human
guggagggguguggcagugguuu

SEQ ID NO: 2321146 - RNA, 23 nt, Human
guggagggacaaguggacucagg

SEQ ID NO: 2321147 - RNA, 13 nt, Human
guggaggcuuccu

SEQ ID NO: 2321148 - RNA, 12 nt, Human
guggagggccac

SEQ ID NO: 2321149 - RNA, 14 nt, Human
guggaggcuuccug

SEQ ID NO: 2321150 - RNA, 15 nt, Human
guggaggcuuccugc

SEQ ID NO: 2321151 - RNA, 12 nt, Human
guggaggggugu

SEQ ID NO: 2321152 - RNA, 23 nt, Human
guggagggcacauuccuugccug

SEQ ID NO: 2321153 - RNA, 16 nt, Human
guggagggcguggagg

SEQ ID NO: 2321154 - RNA, 16 nt, Human
guggaggagcucagga

SEQ ID NO: 2321155 - RNA, 23 nt, Human
guggaggaaugcucccccauccu

SEQ ID NO: 2321156 - RNA, 15 nt, Human
guggaggagcagugc

SEQ ID NO: 2321157 - RNA, 12 nt, Human
guggaggagcag

SEQ ID NO: 2321158 - RNA, 17 nt, Human
guggaggaaugcucccc

SEQ ID NO: 2321159 - RNA, 16 nt, Human
guggaggaaugcuccc

SEQ ID NO: 2321160 - RNA, 13 nt, Human
guggagcugccug

SEQ ID NO: 2321161 - RNA, 13 nt, Human
guggaggaaggau

SEQ ID NO: 2321162 - RNA, 14 nt, Human
guggaggaaggauu

SEQ ID NO: 2321163 - RNA, 15 nt, Human
guggaggaaggauug

SEQ ID NO: 2321164 - RNA, 16 nt, Human
guggaggaaggauugu

SEQ ID NO: 2321165 - RNA, 19 nt, Human
guggaggaaggauuguaaa

SEQ ID NO: 2321166 - RNA, 20 nt, Human
guggaggaaggauuguaaaa

SEQ ID NO: 2321167 - RNA, 20 nt, Human
guggaggagcucaggacacu

SEQ ID NO: 2321168 - RNA, 23 nt, Human
guggaggagcucaggacacuaau

SEQ ID NO: 2321169 - RNA, 17 nt, Human
guggaggagcagugcag

SEQ ID NO: 2321170 - RNA, 17 nt, Human
guggaggaggaaggcaa

SEQ ID NO: 2321171 - RNA, 19 nt, Human
guggaggaggaaggcaaga

SEQ ID NO: 2321172 - RNA, 14 nt, Human
guggaggaggccug

SEQ ID NO: 2321173 - RNA, 16 nt, Human
guggaggcugcaguga

SEQ ID NO: 2321174 - RNA, 14 nt, Human
guggaggcacuuua

SEQ ID NO: 2321175 - RNA, 13 nt, Human
guggaggcacuuu

SEQ ID NO: 2321176 - RNA, 17 nt, Human
guggaggaguccaggcc

SEQ ID NO: 2321177 - RNA, 15 nt, Human
guggaggaggccugg

SEQ ID NO: 2321178 - RNA, 16 nt, Human
guggaucacagaggcu

SEQ ID NO: 2321179 - RNA, 15 nt, Human
guggaucaccugagg

SEQ ID NO: 2321180 - RNA, 13 nt, Human
guggaucaccuga

SEQ ID NO: 2321181 - RNA, 15 nt, Human
guggaucacagaggc

SEQ ID NO: 2321182 - RNA, 14 nt, Human
guggaucacagagg

SEQ ID NO: 2321183 - RNA, 15 nt, Human
guggaguggggcagu

SEQ ID NO: 2321184 - RNA, 13 nt, Human
guggauauaaaua

SEQ ID NO: 2321185 - RNA, 15 nt, Human
guggauauaaauaua

SEQ ID NO: 2321186 - RNA, 16 nt, Human
guggauauaaauauau

SEQ ID NO: 2321187 - RNA, 13 nt, Human
guggaucacagag

SEQ ID NO: 2321188 - RNA, 20 nt, Human
guggagucccuuuugcauca

SEQ ID NO: 2321189 - RNA, 17 nt, Human
guggaguucaucuugaa

SEQ ID NO: 2321190 - RNA, 16 nt, Human
guggaugccugguggc

SEQ ID NO: 2321191 - RNA, 18 nt, Human
guggaugccugguggcag

SEQ ID NO: 2321192 - RNA, 15 nt, Human
guggaugauguuucg

SEQ ID NO: 2321193 - RNA, 23 nt, Human
guggaucuccaaggaccagguua

SEQ ID NO: 2321194 - RNA, 17 nt, Human
guggaucuguccaagga

SEQ ID NO: 2321195 - RNA, 18 nt, Human
guggaucuguccaaggaa

SEQ ID NO: 2321196 - RNA, 21 nt, Human
guggaucagagaugcaccacc

SEQ ID NO: 2321197 - RNA, 17 nt, Human
guggaucuccaaggacc

SEQ ID NO: 2321198 - RNA, 18 nt, Human
guggaucuccaaggacca

SEQ ID NO: 2321199 - RNA, 19 nt, Human
guggaucuccaaggaccag

SEQ ID NO: 2321200 - RNA, 22 nt, Human
guggaacguuuuuccuguucuu

SEQ ID NO: 2321201 - RNA, 15 nt, Human
guggaaccaggaacc

SEQ ID NO: 2321202 - RNA, 21 nt, Human
guggaaauuaagaagaaacua

SEQ ID NO: 2321203 - RNA, 21 nt, Human
guggaaccacugacuacuggc

SEQ ID NO: 2321204 - RNA, 17 nt, Human
guggacuggccccuggg

SEQ ID NO: 2321205 - RNA, 16 nt, Human
guggacuuagaaagca

SEQ ID NO: 2321206 - RNA, 18 nt, Human
guggacuuagaaagcagg

SEQ ID NO: 2321207 - RNA, 19 nt, Human
guggacuuagaaagcaggg

SEQ ID NO: 2321208 - RNA, 20 nt, Human
guggacuuagaaagcagggg

SEQ ID NO: 2321209 - RNA, 22 nt, Human
guggacuuagaaagcaggggcu

SEQ ID NO: 2321210 - RNA, 16 nt, Human
guggagaacuccuagg

SEQ ID NO: 2321211 - RNA, 17 nt, Human
guggagaagccacaggc

SEQ ID NO: 2321212 - RNA, 20 nt, Human
guggagaagccacaggccug

SEQ ID NO: 2321213 - RNA, 22 nt, Human
guggagaagccacaggccugag

SEQ ID NO: 2321214 - RNA, 20 nt, Human
guggagaagcggcuggcagc

SEQ ID NO: 2321215 - RNA, 22 nt, Human
guggagaaauuccuugauucac

SEQ ID NO: 2321216 - RNA, 22 nt, Human
guggagaaauaaaaauaccucu

SEQ ID NO: 2321217 - RNA, 23 nt, Human
guggagaaauaaaaauaccucuu

SEQ ID NO: 2321218 - RNA, 21 nt, Human
guggagaaacuguagucucag

SEQ ID NO: 2321219 - RNA, 20 nt, Human
guggagaaagcacugaccug

SEQ ID NO: 2321220 - RNA, 22 nt, Human
guggacuuuccacccccucccu

SEQ ID NO: 2321221 - RNA, 20 nt, Human
guggacuuuccacccccucc

SEQ ID NO: 2321222 - RNA, 17 nt, Human
guggacuuuccaccccc

SEQ ID NO: 2321223 - RNA, 16 nt, Human
guggacuuuccacccc

SEQ ID NO: 2321224 - RNA, 13 nt, Human
guggacuuuuauu

SEQ ID NO: 2321225 - RNA, 16 nt, Human
guggagagcuggugcc

SEQ ID NO: 2321226 - RNA, 14 nt, Human
guggagagcuggug

SEQ ID NO: 2321227 - RNA, 18 nt, Human
guggagaggcccggccuc

SEQ ID NO: 2321228 - RNA, 12 nt, Human
guggagagcugg

SEQ ID NO: 2321229 - RNA, 19 nt, Human
guggagacuggggggcuug

SEQ ID NO: 2321230 - RNA, 20 nt, Human
guggagacuggggggcuuga

SEQ ID NO: 2321231 - RNA, 16 nt, Human
guggagacugcuuccc

SEQ ID NO: 2321232 - RNA, 18 nt, Human
guggagacugcuucccau

SEQ ID NO: 2321233 - RNA, 11 nt, Human
guggagacugc

SEQ ID NO: 2321234 - RNA, 13 nt, Human
guggagacagggc

SEQ ID NO: 2321235 - RNA, 20 nt, Human
guggagaagccauugucuuc

SEQ ID NO: 2321236 - RNA, 18 nt, Human
guggagaagccauugucu

SEQ ID NO: 2321237 - RNA, 19 nt, Human
guggagaagccauugucuu

SEQ ID NO: 2321238 - RNA, 12 nt, Human
guggagaagcca

SEQ ID NO: 2321239 - RNA, 13 nt, Human
guggagaagccau

SEQ ID NO: 2321240 - RNA, 14 nt, Human
guggagaagccauu

SEQ ID NO: 2321241 - RNA, 15 nt, Human
guggagaagccauug

SEQ ID NO: 2321242 - RNA, 16 nt, Human
guggagcaugggccug

SEQ ID NO: 2321243 - RNA, 19 nt, Human
guggagaugucuucguaca

SEQ ID NO: 2321244 - RNA, 18 nt, Human
guggagcaaagugagggc

SEQ ID NO: 2321245 - RNA, 15 nt, Human
guggagaugucuucg

SEQ ID NO: 2321246 - RNA, 16 nt, Human
guggagaugucuucgu

SEQ ID NO: 2321247 - RNA, 17 nt, Human
guggagaugucuucgua

SEQ ID NO: 2321248 - RNA, 18 nt, Human
guggagaugucuucguac

SEQ ID NO: 2321249 - RNA, 17 nt, Human
guggagagcuggugccc

SEQ ID NO: 2321250 - RNA, 14 nt, Human
guggagagcccggc

SEQ ID NO: 2321251 - RNA, 22 nt, Human
guggagagggaugaggugcugg

SEQ ID NO: 2321252 - RNA, 19 nt, Human
guggagcaaagugagggcc

SEQ ID NO: 2321253 - RNA, 17 nt, Human
guggagcaugggccugg

SEQ ID NO: 2321254 - RNA, 14 nt, Human
guggagccccacac

SEQ ID NO: 2321255 - RNA, 18 nt, Human
guggagccccacacuggg

SEQ ID NO: 2321256 - RNA, 23 nt, Human
guggagcccgcacccccacccuu

SEQ ID NO: 2321257 - RNA, 14 nt, Human
guggccaaguucuu

SEQ ID NO: 2321258 - RNA, 15 nt, Human
guggccaaggagcug

SEQ ID NO: 2321259 - RNA, 16 nt, Human
guggccaaggagcugc

SEQ ID NO: 2321260 - RNA, 19 nt, Human
guggccaaauuauuugugu

SEQ ID NO: 2321261 - RNA, 19 nt, Human
guggcauguggccuguggc

SEQ ID NO: 2321262 - RNA, 16 nt, Human
guggcauuggcagcag

SEQ ID NO: 2321263 - RNA, 18 nt, Human
guggcauuggcagcaggu

SEQ ID NO: 2321264 - RNA, 22 nt, Human
guggcauuggcagcaggugcug

SEQ ID NO: 2321265 - RNA, 22 nt, Human
guggcauguucaucguauaaca

SEQ ID NO: 2321266 - RNA, 17 nt, Human
guggcauguggccugug

SEQ ID NO: 2321267 - RNA, 18 nt, Human
guggcauguggccugugg

SEQ ID NO: 2321268 - RNA, 14 nt, Human
guggcauguggccu

SEQ ID NO: 2321269 - RNA, 15 nt, Human
guggcauguggccug

SEQ ID NO: 2321270 - RNA, 16 nt, Human
guggcaucccaguggc

SEQ ID NO: 2321271 - RNA, 13 nt, Human
guggcauggccac

SEQ ID NO: 2321272 - RNA, 21 nt, Human
guggcaucuuugccuugggcu

SEQ ID NO: 2321273 - RNA, 20 nt, Human
guggcaucuuugccuugggc

SEQ ID NO: 2321274 - RNA, 18 nt, Human
guggcaucuuugccuugg

SEQ ID NO: 2321275 - RNA, 22 nt, Human
guggcaucaccuuaggcaggga

SEQ ID NO: 2321276 - RNA, 20 nt, Human
guggcaucaccuuaggcagg

SEQ ID NO: 2321277 - RNA, 14 nt, Human
guggcaucaccuua

SEQ ID NO: 2321278 - RNA, 17 nt, Human
guggcauagcccagaca

SEQ ID NO: 2321279 - RNA, 21 nt, Human
guggcagugguuuuggcaaac

SEQ ID NO: 2321280 - RNA, 15 nt, Human
guggcauagcccaga

SEQ ID NO: 2321281 - RNA, 15 nt, Human
guggcaguuuggcaa

SEQ ID NO: 2321282 - RNA, 19 nt, Human
guggcagugggagcugccu

SEQ ID NO: 2321283 - RNA, 21 nt, Human
guggcagugggagcugccugu

SEQ ID NO: 2321284 - RNA, 23 nt, Human
guggccagagcugggaggcaugg

SEQ ID NO: 2321285 - RNA, 17 nt, Human
guggccagagcugggag

SEQ ID NO: 2321286 - RNA, 21 nt, Human
guggccacuccagaccccugg

SEQ ID NO: 2321287 - RNA, 19 nt, Human
guggccaaggagcugcuau

SEQ ID NO: 2321288 - RNA, 18 nt, Human
guggccaaggagcugcua

SEQ ID NO: 2321289 - RNA, 17 nt, Human
guggccaaggagcugcu

SEQ ID NO: 2321290 - RNA, 13 nt, Human
guggccacucagc

SEQ ID NO: 2321291 - RNA, 14 nt, Human
guggccacucagcu

SEQ ID NO: 2321292 - RNA, 13 nt, Human
guggccaggguga

SEQ ID NO: 2321293 - RNA, 11 nt, Human
guggccagccc

SEQ ID NO: 2321294 - RNA, 13 nt, Human
guggccagcccgg

SEQ ID NO: 2321295 - RNA, 14 nt, Human
guggccagcccggc

SEQ ID NO: 2321296 - RNA, 15 nt, Human
guggccagcccggcu

SEQ ID NO: 2321297 - RNA, 16 nt, Human
guggccagcccggcug

SEQ ID NO: 2321298 - RNA, 14 nt, Human
guggccagccugga

SEQ ID NO: 2321299 - RNA, 15 nt, Human
guggccagccuggau

SEQ ID NO: 2321300 - RNA, 21 nt, Human
guggcccauccccccucacca

SEQ ID NO: 2321301 - RNA, 15 nt, Human
guggccccacccugg

SEQ ID NO: 2321302 - RNA, 13 nt, Human
guggcccaggacc

SEQ ID NO: 2321303 - RNA, 17 nt, Human
guggcccauccccccuc

SEQ ID NO: 2321304 - RNA, 20 nt, Human
guggcccauccccccucacc

SEQ ID NO: 2321305 - RNA, 23 nt, Human
guggccauuuagccaccaucuuu

SEQ ID NO: 2321306 - RNA, 18 nt, Human
guggccccacccugggcc

SEQ ID NO: 2321307 - RNA, 19 nt, Human
guggccccacccugggccc

SEQ ID NO: 2321308 - RNA, 20 nt, Human
guggccccacccugggcccu

SEQ ID NO: 2321309 - RNA, 21 nt, Human
guggcucuacaacugaguccu

SEQ ID NO: 2321310 - RNA, 13 nt, Human
guggcucuccagu

SEQ ID NO: 2321311 - RNA, 15 nt, Human
guggcagugggagcu

SEQ ID NO: 2321312 - RNA, 11 nt, Human
guggcagucug

SEQ ID NO: 2321313 - RNA, 16 nt, Human
guggcagugggagcug

SEQ ID NO: 2321314 - RNA, 17 nt, Human
guggcagugggagcugc

SEQ ID NO: 2321315 - RNA, 21 nt, Human
guggcaggugaccuucuggga

SEQ ID NO: 2321316 - RNA, 23 nt, Human
guggcagguggaggugucaggcu

SEQ ID NO: 2321317 - RNA, 20 nt, Human
guggcaggggacaggagucc

SEQ ID NO: 2321318 - RNA, 16 nt, Human
guggcaggggacagga

SEQ ID NO: 2321319 - RNA, 18 nt, Human
guggcaggggacaggagu

SEQ ID NO: 2321320 - RNA, 18 nt, Human
guggcagggccuagcugc

SEQ ID NO: 2321321 - RNA, 22 nt, Human
guggcagggccuagcugcuaca

SEQ ID NO: 2321322 - RNA, 23 nt, Human
guggcagggccuagcugcuacaa

SEQ ID NO: 2321323 - RNA, 12 nt, Human
guggcagggcuc

SEQ ID NO: 2321324 - RNA, 13 nt, Human
guggcagggcuca

SEQ ID NO: 2321325 - RNA, 16 nt, Human
guggcagggcucagga

SEQ ID NO: 2321326 - RNA, 17 nt, Human
guggcagggcucaggau

SEQ ID NO: 2321327 - RNA, 12 nt, Human
guggcaggcagc

SEQ ID NO: 2321328 - RNA, 19 nt, Human
guggcaggcagcgccaagc

SEQ ID NO: 2321329 - RNA, 13 nt, Human
guggcaggaccag

SEQ ID NO: 2321330 - RNA, 15 nt, Human
guggcaggaccagga

SEQ ID NO: 2321331 - RNA, 17 nt, Human
guggcaggaccaggacu

SEQ ID NO: 2321332 - RNA, 19 nt, Human
guggcagcugcgguccacc

SEQ ID NO: 2321333 - RNA, 20 nt, Human
guggaugccugguggcagcu

SEQ ID NO: 2321334 - RNA, 21 nt, Human
guggcagcugcgguccaccca

SEQ ID NO: 2321335 - RNA, 22 nt, Human
guggcagcugcgguccacccag

SEQ ID NO: 2321336 - RNA, 23 nt, Human
guggcagcugcgguccacccagg

SEQ ID NO: 2321337 - RNA, 12 nt, Human
guggcagcugcu

SEQ ID NO: 2321338 - RNA, 13 nt, Human
guggcagcugcuu

SEQ ID NO: 2321339 - RNA, 19 nt, Human
guggcagcugcuuuugucu

SEQ ID NO: 2321340 - RNA, 22 nt, Human
gugagcauuguggcugucagca

SEQ ID NO: 2321341 - RNA, 16 nt, Human
gugagcuccuaagcca

SEQ ID NO: 2321342 - RNA, 22 nt, Human
gugagccaccgugccuggccac

SEQ ID NO: 2321343 - RNA, 14 nt, Human
gugagcuacaaaug

SEQ ID NO: 2321344 - RNA, 16 nt, Human
gugagcuuugcugcua

SEQ ID NO: 2321345 - RNA, 15 nt, Human
gugagcuuugcugcu

SEQ ID NO: 2321346 - RNA, 15 nt, Human
gugaggaaagucauu

SEQ ID NO: 2321347 - RNA, 11 nt, Human
gugaggaagcc

SEQ ID NO: 2321348 - RNA, 16 nt, Human
gugaggaagccgcugg

SEQ ID NO: 2321349 - RNA, 19 nt, Human
gugaggaagccgcuggggc

SEQ ID NO: 2321350 - RNA, 16 nt, Human
gugacugccccaacuc

SEQ ID NO: 2321351 - RNA, 21 nt, Human
gugacugauguuacaucacag

SEQ ID NO: 2321352 - RNA, 16 nt, Human
gugacucuuuuuaggg

SEQ ID NO: 2321353 - RNA, 18 nt, Human
gugacucuuuuuagggcc

SEQ ID NO: 2321354 - RNA, 20 nt, Human
gugacucuuuuuagggccag

SEQ ID NO: 2321355 - RNA, 22 nt, Human
gugacucuuuuuagggccaggc

SEQ ID NO: 2321356 - RNA, 17 nt, Human
gugacugaucucucgug

SEQ ID NO: 2321357 - RNA, 23 nt, Human
gugacugccccaacuccuggaag

SEQ ID NO: 2321358 - RNA, 17 nt, Human
gugacugcgaucuucag

SEQ ID NO: 2321359 - RNA, 21 nt, Human
gugacugccccaacuccugga

SEQ ID NO: 2321360 - RNA, 20 nt, Human
gugacugccccaacuccugg

SEQ ID NO: 2321361 - RNA, 17 nt, Human
gugagcaggcugugagu

SEQ ID NO: 2321362 - RNA, 16 nt, Human
gugagcagucaggaaa

SEQ ID NO: 2321363 - RNA, 13 nt, Human
gugagccacugca

SEQ ID NO: 2321364 - RNA, 21 nt, Human
gugagccaccgugccuggcca

SEQ ID NO: 2321365 - RNA, 17 nt, Human
gugagccaccgugccug

SEQ ID NO: 2321366 - RNA, 15 nt, Human
gugacuguauauaaa

SEQ ID NO: 2321367 - RNA, 15 nt, Human
gugagccaccacgcc

SEQ ID NO: 2321368 - RNA, 15 nt, Human
gugagccaccgugcc

SEQ ID NO: 2321369 - RNA, 16 nt, Human
gugagccaccacgccc

SEQ ID NO: 2321370 - RNA, 23 nt, Human
gugaccuguggggauuucuccca

SEQ ID NO: 2321371 - RNA, 15 nt, Human
gugaccuuaguguuu

SEQ ID NO: 2321372 - RNA, 20 nt, Human
gugaccuuaguguuucugug

SEQ ID NO: 2321373 - RNA, 23 nt, Human
gugaccugccccgcccagcugca

SEQ ID NO: 2321374 - RNA, 17 nt, Human
gugacucgggcuccugu

SEQ ID NO: 2321375 - RNA, 18 nt, Human
gugacucgggcuccugug

SEQ ID NO: 2321376 - RNA, 19 nt, Human
gugacucgggcuccugugc

SEQ ID NO: 2321377 - RNA, 18 nt, Human
gugacucauccucuugaa

SEQ ID NO: 2321378 - RNA, 12 nt, Human
gugacuccagga

SEQ ID NO: 2321379 - RNA, 14 nt, Human
gugacuccaggaga

SEQ ID NO: 2321380 - RNA, 19 nt, Human
gugacuccaggagaggagc

SEQ ID NO: 2321381 - RNA, 20 nt, Human
gugaccuuccaagagccuga

SEQ ID NO: 2321382 - RNA, 22 nt, Human
gugaccuuaguguuucugugca

SEQ ID NO: 2321383 - RNA, 23 nt, Human
gugaccuuaguguuucugugcau

SEQ ID NO: 2321384 - RNA, 19 nt, Human
gugaccuuccaagagccug

SEQ ID NO: 2321385 - RNA, 15 nt, Human
gugacugaauuucuu

SEQ ID NO: 2321386 - RNA, 14 nt, Human
gugacucugaagcu

SEQ ID NO: 2321387 - RNA, 20 nt, Human
gugacucgggcuccugugcc

SEQ ID NO: 2321388 - RNA, 21 nt, Human
gugacucgggcuccugugccc

SEQ ID NO: 2321389 - RNA, 18 nt, Human
gugacugaauuucuuuug

SEQ ID NO: 2321390 - RNA, 16 nt, Human
gugacugaauuucuuu

SEQ ID NO: 2321391 - RNA, 16 nt, Human
gugaauuuuucucuaa

SEQ ID NO: 2321392 - RNA, 16 nt, Human
gugacaacacuugugu

SEQ ID NO: 2321393 - RNA, 16 nt, Human
gugacaagcucacaga

SEQ ID NO: 2321394 - RNA, 17 nt, Human
gugaauuuuuuuuuccu

SEQ ID NO: 2321395 - RNA, 15 nt, Human
gugacccggaggcca

SEQ ID NO: 2321396 - RNA, 18 nt, Human
gugacccggaggccacau

SEQ ID NO: 2321397 - RNA, 18 nt, Human
gugaccuccacagcuacc

SEQ ID NO: 2321398 - RNA, 19 nt, Human
gugaccucaggcacuagcc

SEQ ID NO: 2321399 - RNA, 23 nt, Human
gugaccugaggauuuaagggaug

SEQ ID NO: 2321400 - RNA, 13 nt, Human
gugaccugagggc

SEQ ID NO: 2321401 - RNA, 16 nt, Human
gugaccugaggaagcg

SEQ ID NO: 2321402 - RNA, 14 nt, Human
gugaccugaggaag

SEQ ID NO: 2321403 - RNA, 14 nt, Human
gugaccugaaguuc

SEQ ID NO: 2321404 - RNA, 19 nt, Human
gugaccugaaguucaccau

SEQ ID NO: 2321405 - RNA, 12 nt, Human
gugaccucaggc

SEQ ID NO: 2321406 - RNA, 21 nt, Human
gugaccggacuuuucugcaaa

SEQ ID NO: 2321407 - RNA, 16 nt, Human
gugaccucagcuuuga

SEQ ID NO: 2321408 - RNA, 13 nt, Human
gugacccucugaa

SEQ ID NO: 2321409 - RNA, 21 nt, Human
gugacccucugaaugguccag

SEQ ID NO: 2321410 - RNA, 15 nt, Human
gugaccggacuuuuc

SEQ ID NO: 2321411 - RNA, 19 nt, Human
gugaccggacuuuucugca

SEQ ID NO: 2321412 - RNA, 12 nt, Human
gugaaacccugu

SEQ ID NO: 2321413 - RNA, 21 nt, Human
gugaaacacaccaggcugugg

SEQ ID NO: 2321414 - RNA, 16 nt, Human
gugaaacccugucucu

SEQ ID NO: 2321415 - RNA, 23 nt, Human
gugaaacacaccaggcugugggc

SEQ ID NO: 2321416 - RNA, 20 nt, Human
gugaaacacaccaggcugug

SEQ ID NO: 2321417 - RNA, 18 nt, Human
gugaaacacaccaggcug

SEQ ID NO: 2321418 - RNA, 17 nt, Human
gugaaacacaccaggcu

SEQ ID NO: 2321419 - RNA, 16 nt, Human
gugaaacacaccaggc

SEQ ID NO: 2321420 - RNA, 19 nt, Human
gugaaaauagguauacagu

SEQ ID NO: 2321421 - RNA, 14 nt, Human
gugaaaauguacug

SEQ ID NO: 2321422 - RNA, 16 nt, Human
gugaaaaugugugugu

SEQ ID NO: 2321423 - RNA, 17 nt, Human
gugaaaaugguccagga

SEQ ID NO: 2321424 - RNA, 15 nt, Human
gugaaaaugguccag

SEQ ID NO: 2321425 - RNA, 16 nt, Human
gucugccagccagcag

SEQ ID NO: 2321426 - RNA, 20 nt, Human
gugaaaagagaggauauguu

SEQ ID NO: 2321427 - RNA, 19 nt, Human
gugaaaaguccuugauugu

SEQ ID NO: 2321428 - RNA, 21 nt, Human
gugaaaauagguauacagugg

SEQ ID NO: 2321429 - RNA, 15 nt, Human
gucugccagccagca

SEQ ID NO: 2321430 - RNA, 14 nt, Human
gucugccagccagc

SEQ ID NO: 2321431 - RNA, 15 nt, Human
gugaaaacggagcug

SEQ ID NO: 2321432 - RNA, 23 nt, Human
gugaaaagaaaaaugagccuggc

SEQ ID NO: 2321433 - RNA, 14 nt, Human
gugaaaagaaaaau

SEQ ID NO: 2321434 - RNA, 20 nt, Human
gugaaagcaucacuugggau

SEQ ID NO: 2321435 - RNA, 19 nt, Human
gugaaacuaacagauaagc

SEQ ID NO: 2321436 - RNA, 16 nt, Human
gugaaacuuccuaagu

SEQ ID NO: 2321437 - RNA, 23 nt, Human
gugaaacugcuuguuuccuagca

SEQ ID NO: 2321438 - RNA, 19 nt, Human
gugaaagaaaauaacaaua

SEQ ID NO: 2321439 - RNA, 12 nt, Human
gugaaacuggau

SEQ ID NO: 2321440 - RNA, 21 nt, Human
gugaaacugcuuguuuccuag

SEQ ID NO: 2321441 - RNA, 20 nt, Human
gugaaacugcuuguuuccua

SEQ ID NO: 2321442 - RNA, 18 nt, Human
gugaaaccuuuuuuaaga

SEQ ID NO: 2321443 - RNA, 19 nt, Human
gugaaaccuuuuuuaagau

SEQ ID NO: 2321444 - RNA, 21 nt, Human
gugaaaccuuuuuuaagauuu

SEQ ID NO: 2321445 - RNA, 22 nt, Human
gugaaaccuuuuuuaagauuuu

SEQ ID NO: 2321446 - RNA, 20 nt, Human
gugaaacucguuaauuugua

SEQ ID NO: 2321447 - RNA, 18 nt, Human
gugaaaccuuuagggcag

SEQ ID NO: 2321448 - RNA, 19 nt, Human
gugaaaccuuuagggcagc

SEQ ID NO: 2321449 - RNA, 20 nt, Human
gugaaaccuuuagggcagcu

SEQ ID NO: 2321450 - RNA, 22 nt, Human
gugaaaccuuuagggcagcuug

SEQ ID NO: 2321451 - RNA, 23 nt, Human
gugaaaccuuuagggcagcuugc

SEQ ID NO: 2321452 - RNA, 13 nt, Human
gugaaaccuuuuu

SEQ ID NO: 2321453 - RNA, 14 nt, Human
gugaaaccuuuuuu

SEQ ID NO: 2321454 - RNA, 17 nt, Human
gugaaaccuuuuuuaag

SEQ ID NO: 2321455 - RNA, 17 nt, Human
gugaaaucaaaggugcu

SEQ ID NO: 2321456 - RNA, 21 nt, Human
gugaaauuuauuaguuaauau

SEQ ID NO: 2321457 - RNA, 18 nt, Human
gugaaauuauucauaauu

SEQ ID NO: 2321458 - RNA, 20 nt, Human
gugaaauuauucauaauuau

SEQ ID NO: 2321459 - RNA, 21 nt, Human
gugaaagucagaugcccagag

SEQ ID NO: 2321460 - RNA, 21 nt, Human
gugaaagggagcuaucaggaa

SEQ ID NO: 2321461 - RNA, 17 nt, Human
gugaaaguacauuugga

SEQ ID NO: 2321462 - RNA, 19 nt, Human
gugaaaggaaagagggagg

SEQ ID NO: 2321463 - RNA, 21 nt, Human
gugaaauaguucaaagccaag

SEQ ID NO: 2321464 - RNA, 17 nt, Human
gugaaauaguucaaagc

SEQ ID NO: 2321465 - RNA, 17 nt, Human
gugaaauaccagugugg

SEQ ID NO: 2321466 - RNA, 13 nt, Human
gugaaaucauuca

SEQ ID NO: 2321467 - RNA, 16 nt, Human
gugaaucacguaaagc

SEQ ID NO: 2321468 - RNA, 22 nt, Human
gugaauauuuccauauggauuu

SEQ ID NO: 2321469 - RNA, 16 nt, Human
gugaauauuguucaua

SEQ ID NO: 2321470 - RNA, 18 nt, Human
gugaaucacguaaagcua

SEQ ID NO: 2321471 - RNA, 14 nt, Human
gugaaucagagcac

SEQ ID NO: 2321472 - RNA, 15 nt, Human
gugaaucagacccua

SEQ ID NO: 2321473 - RNA, 15 nt, Human
gugaaugggaaaaga

SEQ ID NO: 2321474 - RNA, 15 nt, Human
gugaauuuuucucua

SEQ ID NO: 2321475 - RNA, 14 nt, Human
gugaauuuuucucu

SEQ ID NO: 2321476 - RNA, 15 nt, Human
gugcagguggggaga

SEQ ID NO: 2321477 - RNA, 22 nt, Human
gugcaguaucaugcccugugca

SEQ ID NO: 2321478 - RNA, 14 nt, Human
gugcagucacugga

SEQ ID NO: 2321479 - RNA, 19 nt, Human
gugcaguggcccccacaga

SEQ ID NO: 2321480 - RNA, 16 nt, Human
gugcaguccugaucag

SEQ ID NO: 2321481 - RNA, 12 nt, Human
gugcaguccugg

SEQ ID NO: 2321482 - RNA, 22 nt, Human
gugcaguccugggauguggcug

SEQ ID NO: 2321483 - RNA, 19 nt, Human
gugcauaaguuaacuucca

SEQ ID NO: 2321484 - RNA, 23 nt, Human
gugcagggaggagguggcagccc

SEQ ID NO: 2321485 - RNA, 24 nt, Human
gugcaacaggguauggacuaucug

SEQ ID NO: 2321486 - RNA, 14 nt, Human
gugcaacaggguau

SEQ ID NO: 2321487 - RNA, 20 nt, Human
gugcaacagcacuggcucuc

SEQ ID NO: 2321488 - RNA, 23 nt, Human
gugcaacagcacuggcucucucc

SEQ ID NO: 2321489 - RNA, 12 nt, Human
gugcaacagcac

SEQ ID NO: 2321490 - RNA, 15 nt, Human
gugcaacagcacugg

SEQ ID NO: 2321491 - RNA, 22 nt, Human
gugcaacaagguccucugucag

SEQ ID NO: 2321492 - RNA, 19 nt, Human
gugauuuaauaguguuaau

SEQ ID NO: 2321493 - RNA, 19 nt, Human
gugcaaaugucagauacaa

SEQ ID NO: 2321494 - RNA, 23 nt, Human
gugcaaaugucagauacaaugua

SEQ ID NO: 2321495 - RNA, 22 nt, Human
gugcaaaguucccuacuuccug

SEQ ID NO: 2321496 - RNA, 18 nt, Human
gugcaaauugucacagga

SEQ ID NO: 2321497 - RNA, 22 nt, Human
gugcaugaagguuucugaaaau

SEQ ID NO: 2321498 - RNA, 14 nt, Human
gugcaucucagccc

SEQ ID NO: 2321499 - RNA, 18 nt, Human
gugcaucucagcccacau

SEQ ID NO: 2321500 - RNA, 13 nt, Human
gugcaugcucucu

SEQ ID NO: 2321501 - RNA, 18 nt, Human
gugcaugaucuugagcaa

SEQ ID NO: 2321502 - RNA, 18 nt, Human
gugcaugcagcaucuaag

SEQ ID NO: 2321503 - RNA, 20 nt, Human
gugccagguuuuuggucuga

SEQ ID NO: 2321504 - RNA, 22 nt, Human
gugccagguuuuuggucugacc

SEQ ID NO: 2321505 - RNA, 15 nt, Human
gugcaucucagccca

SEQ ID NO: 2321506 - RNA, 12 nt, Human
gugcagucuggg

SEQ ID NO: 2321507 - RNA, 14 nt, Human
gugcagucugggug

SEQ ID NO: 2321508 - RNA, 21 nt, Human
gugcauaccacuuuuguucuu

SEQ ID NO: 2321509 - RNA, 14 nt, Human
gugcauaccacuuu

SEQ ID NO: 2321510 - RNA, 13 nt, Human
gugcauaccacuu

SEQ ID NO: 2321511 - RNA, 12 nt, Human
gugcccccagac

SEQ ID NO: 2321512 - RNA, 19 nt, Human
gugcccccacugaccagaa

SEQ ID NO: 2321513 - RNA, 17 nt, Human
gugccccccauccuggc

SEQ ID NO: 2321514 - RNA, 21 nt, Human
gugccccaugccuguccagcc

SEQ ID NO: 2321515 - RNA, 13 nt, Human
gugcccccacuga

SEQ ID NO: 2321516 - RNA, 18 nt, Human
gugcccccacugaccaga

SEQ ID NO: 2321517 - RNA, 15 nt, Human
gugcccccacugacc

SEQ ID NO: 2321518 - RNA, 19 nt, Human
gugccccccauccuggccc

SEQ ID NO: 2321519 - RNA, 20 nt, Human
gugccccccauccuggccca

SEQ ID NO: 2321520 - RNA, 22 nt, Human
gugccccccauccuggcccauc

SEQ ID NO: 2321521 - RNA, 15 nt, Human
gugcccucgcugcuu

SEQ ID NO: 2321522 - RNA, 17 nt, Human
gugcccauuccucaccu

SEQ ID NO: 2321523 - RNA, 12 nt, Human
gugccccaggac

SEQ ID NO: 2321524 - RNA, 15 nt, Human
gugccccaggaccag

SEQ ID NO: 2321525 - RNA, 14 nt, Human
gugccccaggacca

SEQ ID NO: 2321526 - RNA, 18 nt, Human
gugccccaugccugucca

SEQ ID NO: 2321527 - RNA, 16 nt, Human
gugccccaugccuguc

SEQ ID NO: 2321528 - RNA, 21 nt, Human
gugccccaggaccagcucagg

SEQ ID NO: 2321529 - RNA, 19 nt, Human
gugccccaggaccagcuca

SEQ ID NO: 2321530 - RNA, 17 nt, Human
gugcccaucccuggaag

SEQ ID NO: 2321531 - RNA, 14 nt, Human
gugcccaugggcac

SEQ ID NO: 2321532 - RNA, 16 nt, Human
gugcccaugggcacug

SEQ ID NO: 2321533 - RNA, 19 nt, Human
gugcccaugggcacugcug

SEQ ID NO: 2321534 - RNA, 20 nt, Human
gugcccaugggcacugcugg

SEQ ID NO: 2321535 - RNA, 21 nt, Human
gugcccaugggcacugcuggg

SEQ ID NO: 2321536 - RNA, 16 nt, Human
gugcccauuccucacc

SEQ ID NO: 2321537 - RNA, 19 nt, Human
gugcccaggggcccacagg

SEQ ID NO: 2321538 - RNA, 23 nt, Human
gugcccagcuauaccugugccuc

SEQ ID NO: 2321539 - RNA, 22 nt, Human
gugcccagaacuggacucagga

SEQ ID NO: 2321540 - RNA, 23 nt, Human
gugcccaccaacaucccauugcc

SEQ ID NO: 2321541 - RNA, 20 nt, Human
gugcccagagaugggacugg

SEQ ID NO: 2321542 - RNA, 20 nt, Human
gugcccacaucccaggcuuc

SEQ ID NO: 2321543 - RNA, 16 nt, Human
gugcccagaauaaguu

SEQ ID NO: 2321544 - RNA, 22 nt, Human
gugcccagcuauaccugugccu

SEQ ID NO: 2321545 - RNA, 21 nt, Human
gugcccagcuauaccugugcc

SEQ ID NO: 2321546 - RNA, 20 nt, Human
gugcccagcuauaccugugc

SEQ ID NO: 2321547 - RNA, 18 nt, Human
gugcccagcccggaccuu

SEQ ID NO: 2321548 - RNA, 23 nt, Human
gugcccagcuagcugcagagcca

SEQ ID NO: 2321549 - RNA, 13 nt, Human
gugcccacaggcc

SEQ ID NO: 2321550 - RNA, 21 nt, Human
gugcccacaggccgcccugcg

SEQ ID NO: 2321551 - RNA, 15 nt, Human
gugcccacaucccag

SEQ ID NO: 2321552 - RNA, 20 nt, Human
gugcccacaggaucagucug

SEQ ID NO: 2321553 - RNA, 18 nt, Human
gugccagucuugugucug

SEQ ID NO: 2321554 - RNA, 21 nt, Human
gugccagucgcgcugccugug

SEQ ID NO: 2321555 - RNA, 22 nt, Human
gugccagucgcgcugccugugu

SEQ ID NO: 2321556 - RNA, 16 nt, Human
gugccagucgcgcugc

SEQ ID NO: 2321557 - RNA, 17 nt, Human
gugccagucgcgcugcc

SEQ ID NO: 2321558 - RNA, 18 nt, Human
gugccagucgcgcugccu

SEQ ID NO: 2321559 - RNA, 19 nt, Human
gugccagucgcgcugccug

SEQ ID NO: 2321560 - RNA, 19 nt, Human
gugcaugcucucugcagcc

SEQ ID NO: 2321561 - RNA, 18 nt, Human
gugcaugcucucugcagc

SEQ ID NO: 2321562 - RNA, 16 nt, Human
gugcaugcucucugca

SEQ ID NO: 2321563 - RNA, 15 nt, Human
gugcaugcucucugc

SEQ ID NO: 2321564 - RNA, 21 nt, Human
gugcaugcucucugcagccag

SEQ ID NO: 2321565 - RNA, 15 nt, Human
gugccagucgcgcug

SEQ ID NO: 2321566 - RNA, 23 nt, Human
gugcccaagaauagaugcugacu

SEQ ID NO: 2321567 - RNA, 17 nt, Human
gugccauagucacaugg

SEQ ID NO: 2321568 - RNA, 12 nt, Human
gugcccaagcca

SEQ ID NO: 2321569 - RNA, 19 nt, Human
gugcccaagccagaggcug

SEQ ID NO: 2321570 - RNA, 20 nt, Human
gugcccaagccagaggcugg

SEQ ID NO: 2321571 - RNA, 23 nt, Human
gugccauagaguuuaacacaagu

SEQ ID NO: 2321572 - RNA, 16 nt, Human
gugcccaagcucagaa

SEQ ID NO: 2321573 - RNA, 20 nt, Human
gugcccaagcucagaaggcu

SEQ ID NO: 2321574 - RNA, 23 nt, Human
gugcccaaguuguggugcugaca

SEQ ID NO: 2321575 - RNA, 13 nt, Human
gugauucuccugc

SEQ ID NO: 2321576 - RNA, 17 nt, Human
gugauugacagcuuugc

SEQ ID NO: 2321577 - RNA, 21 nt, Human
gugauuccuuugaagaggaaa

SEQ ID NO: 2321578 - RNA, 13 nt, Human
gugauucugccuu

SEQ ID NO: 2321579 - RNA, 23 nt, Human
gugauucuccugccucagccucc

SEQ ID NO: 2321580 - RNA, 23 nt, Human
gugauuguggaauggagauucag

SEQ ID NO: 2321581 - RNA, 19 nt, Human
gugauuguggaauggagau

SEQ ID NO: 2321582 - RNA, 14 nt, Human
gugauuguggaaug

SEQ ID NO: 2321583 - RNA, 20 nt, Human
gugauugggaauaaauaugc

SEQ ID NO: 2321584 - RNA, 16 nt, Human
gugauugggacagagg

SEQ ID NO: 2321585 - RNA, 23 nt, Human
gugauugacagcuuugcugcuga

SEQ ID NO: 2321586 - RNA, 22 nt, Human
gugauugacagcuuugcugcug

SEQ ID NO: 2321587 - RNA, 21 nt, Human
gugauugacagcuuugcugcu

SEQ ID NO: 2321588 - RNA, 17 nt, Human
gugauugggaauaaaua

SEQ ID NO: 2321589 - RNA, 16 nt, Human
gugauuuugcuguaga

SEQ ID NO: 2321590 - RNA, 19 nt, Human
gugauuuaagacacuuuuu

SEQ ID NO: 2321591 - RNA, 15 nt, Human
gugauuuaauagugu

SEQ ID NO: 2321592 - RNA, 20 nt, Human
gugauuuaauaguguuaauc

SEQ ID NO: 2321593 - RNA, 16 nt, Human
gugauuuaauaguguu

SEQ ID NO: 2321594 - RNA, 18 nt, Human
gugauuuaauaguguuaa

SEQ ID NO: 2321595 - RNA, 14 nt, Human
gugauucuccugcc

SEQ ID NO: 2321596 - RNA, 16 nt, Human
gugauucuaaugucuu

SEQ ID NO: 2321597 - RNA, 19 nt, Human
gugauuccuuugaagagga

SEQ ID NO: 2321598 - RNA, 20 nt, Human
gugauucucaugccucagcc

SEQ ID NO: 2321599 - RNA, 16 nt, Human
gugauucuccugccuc

SEQ ID NO: 2321600 - RNA, 17 nt, Human
gugauucuccugccuca

SEQ ID NO: 2321601 - RNA, 18 nt, Human
gugauucuccugccucag

SEQ ID NO: 2321602 - RNA, 19 nt, Human
gugauucuccugccucagc

SEQ ID NO: 2321603 - RNA, 20 nt, Human
gugauucuccugccucagcc

SEQ ID NO: 2321604 - RNA, 22 nt, Human
gugauucuccugccucagccuc

SEQ ID NO: 2321605 - RNA, 23 nt, Human
gugauccucccaccucagccucc

SEQ ID NO: 2321606 - RNA, 22 nt, Human
gugaucccuagcugugaccucu

SEQ ID NO: 2321607 - RNA, 21 nt, Human
gugaucccuagcugugaccuc

SEQ ID NO: 2321608 - RNA, 20 nt, Human
gugauucacagugugaaucu

SEQ ID NO: 2321609 - RNA, 22 nt, Human
gugauuccacuacaccuggcug

SEQ ID NO: 2321610 - RNA, 23 nt, Human
gugauuccacuacaccuggcuga

SEQ ID NO: 2321611 - RNA, 20 nt, Human
gugauccucccaccucagcc

SEQ ID NO: 2321612 - RNA, 22 nt, Human
gugauccucccaccucagccuc

SEQ ID NO: 2321613 - RNA, 14 nt, Human
gugauccucccacc

SEQ ID NO: 2321614 - RNA, 14 nt, Human
gugauccacucgcc

SEQ ID NO: 2321615 - RNA, 15 nt, Human
gugauccucccaccu

SEQ ID NO: 2321616 - RNA, 18 nt, Human
gugauccucccaccucag

SEQ ID NO: 2321617 - RNA, 13 nt, Human
gugaggcaguggg

SEQ ID NO: 2321618 - RNA, 17 nt, Human
gugaggcaggggcggag

SEQ ID NO: 2321619 - RNA, 12 nt, Human
gugaggcagggg

SEQ ID NO: 2321620 - RNA, 15 nt, Human
gugaggcaggcuuug

SEQ ID NO: 2321621 - RNA, 23 nt, Human
gugaggcagugggucccacuucc

SEQ ID NO: 2321622 - RNA, 11 nt, Human
gugaggccaga

SEQ ID NO: 2321623 - RNA, 11 nt, Human
gugaggagcug

SEQ ID NO: 2321624 - RNA, 23 nt, Human
gugaggcaaugggagcugaggcc

SEQ ID NO: 2321625 - RNA, 23 nt, Human
gugaggauuaaauaauguaaaua

SEQ ID NO: 2321626 - RNA, 14 nt, Human
gugaggagcugcug

SEQ ID NO: 2321627 - RNA, 18 nt, Human
gugaggaaggcaggaaga

SEQ ID NO: 2321628 - RNA, 20 nt, Human
gugaggaauaguugagcccc

SEQ ID NO: 2321629 - RNA, 16 nt, Human
gugaggaccacuccug

SEQ ID NO: 2321630 - RNA, 15 nt, Human
gugauccacccaccu

SEQ ID NO: 2321631 - RNA, 13 nt, Human
gugaggccagaga

SEQ ID NO: 2321632 - RNA, 18 nt, Human
gugauccacccaccucag

SEQ ID NO: 2321633 - RNA, 20 nt, Human
gugauccacccaccucagcc

SEQ ID NO: 2321634 - RNA, 16 nt, Human
guccucccauccccug

SEQ ID NO: 2321635 - RNA, 17 nt, Human
guccucccauccccugg

SEQ ID NO: 2321636 - RNA, 21 nt, Human
guccucccaauuucagacucc

SEQ ID NO: 2321637 - RNA, 12 nt, Human
guccucccaucu

SEQ ID NO: 2321638 - RNA, 13 nt, Human
guccucccaucuc

SEQ ID NO: 2321639 - RNA, 14 nt, Human
guccucccaucuca

SEQ ID NO: 2321640 - RNA, 15 nt, Human
guccuccccucacag

SEQ ID NO: 2321641 - RNA, 12 nt, Human
guccuccccuca

SEQ ID NO: 2321642 - RNA, 16 nt, Human
guccuccccucacagc

SEQ ID NO: 2321643 - RNA, 22 nt, Human
guccucccccugccagugccuu

SEQ ID NO: 2321644 - RNA, 11 nt, Human
guccuccccuc

SEQ ID NO: 2321645 - RNA, 21 nt, Human
guccucccccugccagugccu

SEQ ID NO: 2321646 - RNA, 20 nt, Human
guccucccccugccagugcc

SEQ ID NO: 2321647 - RNA, 13 nt, Human
guccuccccuugg

SEQ ID NO: 2321648 - RNA, 21 nt, Human
guccuccccucacagccucug

SEQ ID NO: 2321649 - RNA, 22 nt, Human
guccuccccucacagccucuga

SEQ ID NO: 2321650 - RNA, 17 nt, Human
guccuccccucacagcc

SEQ ID NO: 2321651 - RNA, 18 nt, Human
guccuccccucacagccu

SEQ ID NO: 2321652 - RNA, 19 nt, Human
guccuccccucacagccuc

SEQ ID NO: 2321653 - RNA, 20 nt, Human
guccuccccucacagccucu

SEQ ID NO: 2321654 - RNA, 19 nt, Human
guccucccccugccagugc

SEQ ID NO: 2321655 - RNA, 17 nt, Human
guccucccccugccagu

SEQ ID NO: 2321656 - RNA, 16 nt, Human
guccucccccugccag

SEQ ID NO: 2321657 - RNA, 15 nt, Human
guccucccccugcca

SEQ ID NO: 2321658 - RNA, 18 nt, Human
guccucccauccccugga

SEQ ID NO: 2321659 - RNA, 19 nt, Human
guccucccauccccuggac

SEQ ID NO: 2321660 - RNA, 20 nt, Human
guccucccauccccuggacu

SEQ ID NO: 2321661 - RNA, 21 nt, Human
guccucccauccccuggacug

SEQ ID NO: 2321662 - RNA, 23 nt, Human
guccucccaucucacacaugagc

SEQ ID NO: 2321663 - RNA, 21 nt, Human
guccugggagaaccucaggcu

SEQ ID NO: 2321664 - RNA, 20 nt, Human
guccugggagaaccucaggc

SEQ ID NO: 2321665 - RNA, 19 nt, Human
guccugggagaaccucagg

SEQ ID NO: 2321666 - RNA, 19 nt, Human
guccuggcuccugaggggc

SEQ ID NO: 2321667 - RNA, 17 nt, Human
guccuggcuccugaggg

SEQ ID NO: 2321668 - RNA, 14 nt, Human
guccuggcuccuga

SEQ ID NO: 2321669 - RNA, 11 nt, Human
guccuggcucc

SEQ ID NO: 2321670 - RNA, 20 nt, Human
guccuggccuggcuucuccu

SEQ ID NO: 2321671 - RNA, 15 nt, Human
guccugggagugagc

SEQ ID NO: 2321672 - RNA, 16 nt, Human
guccugggagugagcu

SEQ ID NO: 2321673 - RNA, 17 nt, Human
guccuggcaugggaaug

SEQ ID NO: 2321674 - RNA, 18 nt, Human
guccuggccaucccacaa

SEQ ID NO: 2321675 - RNA, 17 nt, Human
guccuggccaucccaca

SEQ ID NO: 2321676 - RNA, 14 nt, Human
guccuggccuggcu

SEQ ID NO: 2321677 - RNA, 17 nt, Human
guccuggccuggcuucu

SEQ ID NO: 2321678 - RNA, 16 nt, Human
guccuggccaucccac

SEQ ID NO: 2321679 - RNA, 15 nt, Human
guccuggccauccca

SEQ ID NO: 2321680 - RNA, 22 nt, Human
guccucccgggcccucccuugg

SEQ ID NO: 2321681 - RNA, 22 nt, Human
guccuccuaccgaaaccuugcc

SEQ ID NO: 2321682 - RNA, 15 nt, Human
guccucccgggcccu

SEQ ID NO: 2321683 - RNA, 16 nt, Human
guccucccgggcccuc

SEQ ID NO: 2321684 - RNA, 17 nt, Human
guccucccgggcccucc

SEQ ID NO: 2321685 - RNA, 21 nt, Human
guccucccgggcccucccuug

SEQ ID NO: 2321686 - RNA, 12 nt, Human
guccucccgggc

SEQ ID NO: 2321687 - RNA, 14 nt, Human
guccuccccuuggg

SEQ ID NO: 2321688 - RNA, 15 nt, Human
guccuccccuugggc

SEQ ID NO: 2321689 - RNA, 18 nt, Human
guccuccccuugggcggc

SEQ ID NO: 2321690 - RNA, 19 nt, Human
guccuccccuugggcggcu

SEQ ID NO: 2321691 - RNA, 19 nt, Human
guccugggagugagcuggu

SEQ ID NO: 2321692 - RNA, 17 nt, Human
guccugggccugcagaa

SEQ ID NO: 2321693 - RNA, 14 nt, Human
guccugggccugca

SEQ ID NO: 2321694 - RNA, 13 nt, Human
guccugggccugc

SEQ ID NO: 2321695 - RNA, 17 nt, Human
guccugggagugagcug

SEQ ID NO: 2321696 - RNA, 18 nt, Human
guccugggagugagcugg

SEQ ID NO: 2321697 - RNA, 17 nt, Human
guccuggggcucugugc

SEQ ID NO: 2321698 - RNA, 16 nt, Human
guccuggggcucugug

SEQ ID NO: 2321699 - RNA, 15 nt, Human
guccuggggcucugu

SEQ ID NO: 2321700 - RNA, 22 nt, Human
guccuggggccucggagccuca

SEQ ID NO: 2321701 - RNA, 14 nt, Human
guccuggggccucg

SEQ ID NO: 2321702 - RNA, 20 nt, Human
guccugggcgcccuggaagc

SEQ ID NO: 2321703 - RNA, 23 nt, Human
guccugggcgcccuggaagccgg

SEQ ID NO: 2321704 - RNA, 20 nt, Human
guccuggggaaccugacccc

SEQ ID NO: 2321705 - RNA, 19 nt, Human
guccuggggaaccugaccc

SEQ ID NO: 2321706 - RNA, 14 nt, Human
guccugggcgcccu

SEQ ID NO: 2321707 - RNA, 16 nt, Human
guccugggcgcccugg

SEQ ID NO: 2321708 - RNA, 17 nt, Human
guccugggcgcccugga

SEQ ID NO: 2321709 - RNA, 19 nt, Human
guccugggcgcccuggaag

SEQ ID NO: 2321710 - RNA, 18 nt, Human
guccugugaaugccacug

SEQ ID NO: 2321711 - RNA, 19 nt, Human
guccuguccacacccagcu

SEQ ID NO: 2321712 - RNA, 22 nt, Human
guccuguccacacccagcucag

SEQ ID NO: 2321713 - RNA, 19 nt, Human
guccugugaaugccacugc

SEQ ID NO: 2321714 - RNA, 15 nt, Human
guccugugaauuucu

SEQ ID NO: 2321715 - RNA, 18 nt, Human
guccuguccacacccagc

SEQ ID NO: 2321716 - RNA, 21 nt, Human
guccugucagugccgccgccu

SEQ ID NO: 2321717 - RNA, 22 nt, Human
guccugucagugccgccgccuc

SEQ ID NO: 2321718 - RNA, 14 nt, Human
guccugucagugcc

SEQ ID NO: 2321719 - RNA, 15 nt, Human
guccugucagugccg

SEQ ID NO: 2321720 - RNA, 16 nt, Human
guccugucagugccgc

SEQ ID NO: 2321721 - RNA, 19 nt, Human
guccugucagugccgccgc

SEQ ID NO: 2321722 - RNA, 13 nt, Human
guccugucagugc

SEQ ID NO: 2321723 - RNA, 21 nt, Human
guccuguaguugcguggacuc

SEQ ID NO: 2321724 - RNA, 23 nt, Human
guccuguaguugcguggacucug

SEQ ID NO: 2321725 - RNA, 11 nt, Human
guccugguguc

SEQ ID NO: 2321726 - RNA, 13 nt, Human
guccuggugucac

SEQ ID NO: 2321727 - RNA, 15 nt, Human
guccuguacauugug

SEQ ID NO: 2321728 - RNA, 16 nt, Human
guccuggugucacuua

SEQ ID NO: 2321729 - RNA, 11 nt, Human
guccuggugcu

SEQ ID NO: 2321730 - RNA, 12 nt, Human
guccugggcugg

SEQ ID NO: 2321731 - RNA, 14 nt, Human
guccuggugcucuc

SEQ ID NO: 2321732 - RNA, 15 nt, Human
guccuggugcucucu

SEQ ID NO: 2321733 - RNA, 16 nt, Human
guccuggugcucucug

SEQ ID NO: 2321734 - RNA, 19 nt, Human
guccuggugcucucugcca

SEQ ID NO: 2321735 - RNA, 17 nt, Human
guccuggugcucucugc

SEQ ID NO: 2321736 - RNA, 18 nt, Human
guccuggugcucucugcc

SEQ ID NO: 2321737 - RNA, 16 nt, Human
guccucagguggccau

SEQ ID NO: 2321738 - RNA, 17 nt, Human
guccucagguggccaug

SEQ ID NO: 2321739 - RNA, 23 nt, Human
guccucagguggccaugccucag

SEQ ID NO: 2321740 - RNA, 14 nt, Human
guccuccaagccag

SEQ ID NO: 2321741 - RNA, 14 nt, Human
guccuccacaauaa

SEQ ID NO: 2321742 - RNA, 22 nt, Human
guccuccaacaccaagcacagc

SEQ ID NO: 2321743 - RNA, 21 nt, Human
guccuccaacaccaagcacag

SEQ ID NO: 2321744 - RNA, 22 nt, Human
guccuccagaagccucuggcua

SEQ ID NO: 2321745 - RNA, 21 nt, Human
guccuccagaagccucuggcu

SEQ ID NO: 2321746 - RNA, 20 nt, Human
guccuccagaagccucuggc

SEQ ID NO: 2321747 - RNA, 19 nt, Human
guccuccagaagccucugg

SEQ ID NO: 2321748 - RNA, 18 nt, Human
guccuccagaagccucug

SEQ ID NO: 2321749 - RNA, 14 nt, Human
guccuccagaagcc

SEQ ID NO: 2321750 - RNA, 13 nt, Human
guccuccagaagc

SEQ ID NO: 2321751 - RNA, 14 nt, Human
guccucagguggcc

SEQ ID NO: 2321752 - RNA, 15 nt, Human
guccucagguggcca

SEQ ID NO: 2321753 - RNA, 17 nt, Human
guccucagcuucuuaau

SEQ ID NO: 2321754 - RNA, 13 nt, Human
guccucagcuucu

SEQ ID NO: 2321755 - RNA, 21 nt, Human
guccucagccuugccagagau

SEQ ID NO: 2321756 - RNA, 20 nt, Human
guccucagccuugccagaga

SEQ ID NO: 2321757 - RNA, 16 nt, Human
guccucagccuugcca

SEQ ID NO: 2321758 - RNA, 18 nt, Human
guccucacucccagucca

SEQ ID NO: 2321759 - RNA, 18 nt, Human
guccucacugcucccuga

SEQ ID NO: 2321760 - RNA, 19 nt, Human
guccucacugcucccugaa

SEQ ID NO: 2321761 - RNA, 20 nt, Human
guccucagagaauuucuacc

SEQ ID NO: 2321762 - RNA, 20 nt, Human
guccucacugcucccugaag

SEQ ID NO: 2321763 - RNA, 21 nt, Human
guccucacugcucccugaagc

SEQ ID NO: 2321764 - RNA, 14 nt, Human
guccucagccuugc

SEQ ID NO: 2321765 - RNA, 12 nt, Human
guccucagccuu

SEQ ID NO: 2321766 - RNA, 19 nt, Human
guccuagccacucaggagg

SEQ ID NO: 2321767 - RNA, 20 nt, Human
guccuagcugcacagggcag

SEQ ID NO: 2321768 - RNA, 18 nt, Human
guccuagccacucaggag

SEQ ID NO: 2321769 - RNA, 19 nt, Human
guccuaggaguauccucau

SEQ ID NO: 2321770 - RNA, 12 nt, Human
guccuaggagua

SEQ ID NO: 2321771 - RNA, 23 nt, Human
guccuagcuugggaggcuucccc

SEQ ID NO: 2321772 - RNA, 22 nt, Human
guccuaggccacaccaucuccu

SEQ ID NO: 2321773 - RNA, 17 nt, Human
guccucacucccagucc

SEQ ID NO: 2321774 - RNA, 16 nt, Human
guccucacucccaguc

SEQ ID NO: 2321775 - RNA, 14 nt, Human
guccucacucccag

SEQ ID NO: 2321776 - RNA, 23 nt, Human
guccucaccccuguccucacugc

SEQ ID NO: 2321777 - RNA, 18 nt, Human
guccucacggugccuuuu

SEQ ID NO: 2321778 - RNA, 18 nt, Human
guccucacaucuuucaca

SEQ ID NO: 2321779 - RNA, 13 nt, Human
guccucaccacau

SEQ ID NO: 2321780 - RNA, 14 nt, Human
guccucaccccugu

SEQ ID NO: 2321781 - RNA, 15 nt, Human
guccucaccccuguc

SEQ ID NO: 2321782 - RNA, 17 nt, Human
guccucaccccuguccu

SEQ ID NO: 2321783 - RNA, 20 nt, Human
guccucaccccuguccucac

SEQ ID NO: 2321784 - RNA, 21 nt, Human
guccucaccccuguccucacu

SEQ ID NO: 2321785 - RNA, 22 nt, Human
guccucaccccuguccucacug

SEQ ID NO: 2321786 - RNA, 19 nt, Human
guccucaaggggccauccu

SEQ ID NO: 2321787 - RNA, 20 nt, Human
guccucaaggggccauccug

SEQ ID NO: 2321788 - RNA, 13 nt, Human
guccucacacuca

SEQ ID NO: 2321789 - RNA, 23 nt, Human
guccuagaaauuccccacccuga

SEQ ID NO: 2321790 - RNA, 15 nt, Human
gucccugguaauaag

SEQ ID NO: 2321791 - RNA, 15 nt, Human
guccuacucuguguc

SEQ ID NO: 2321792 - RNA, 23 nt, Human
guccuacucugugucaggugggg

SEQ ID NO: 2321793 - RNA, 23 nt, Human
gucccugggggaagcccuggauu

SEQ ID NO: 2321794 - RNA, 22 nt, Human
gucccugggggaagcccuggau

SEQ ID NO: 2321795 - RNA, 21 nt, Human
gucccugggggaagcccugga

SEQ ID NO: 2321796 - RNA, 20 nt, Human
gucccugggggaagcccugg

SEQ ID NO: 2321797 - RNA, 19 nt, Human
gucccugggggaagcccug

SEQ ID NO: 2321798 - RNA, 22 nt, Human
gucccuggggcuagggggagcc

SEQ ID NO: 2321799 - RNA, 16 nt, Human
gucccugguggcagcu

SEQ ID NO: 2321800 - RNA, 13 nt, Human
guccuacucugug

SEQ ID NO: 2321801 - RNA, 17 nt, Human
gucccugguggcagcuc

SEQ ID NO: 2321802 - RNA, 15 nt, Human
gucccuggggcuagg

SEQ ID NO: 2321803 - RNA, 16 nt, Human
gucccauaggcccagu

SEQ ID NO: 2321804 - RNA, 23 nt, Human
gucccagugggaggggcaggcug

SEQ ID NO: 2321805 - RNA, 18 nt, Human
gucccauaggcccaguga

SEQ ID NO: 2321806 - RNA, 12 nt, Human
gucccagugccg

SEQ ID NO: 2321807 - RNA, 19 nt, Human
gucccaggagcugcccaga

SEQ ID NO: 2321808 - RNA, 17 nt, Human
gucccagguuaucuggg

SEQ ID NO: 2321809 - RNA, 17 nt, Human
gucccagucucuggcag

SEQ ID NO: 2321810 - RNA, 10 nt, Human
gucccagugg

SEQ ID NO: 2321811 - RNA, 11 nt, Human
gucccaguggg

SEQ ID NO: 2321812 - RNA, 14 nt, Human
gucccagugggagg

SEQ ID NO: 2321813 - RNA, 15 nt, Human
gucccagugggaggc

SEQ ID NO: 2321814 - RNA, 17 nt, Human
gucccagugggaggcgc

SEQ ID NO: 2321815 - RNA, 18 nt, Human
gucccagugggaggcgcg

SEQ ID NO: 2321816 - RNA, 18 nt, Human
gucccagugggaggggca

SEQ ID NO: 2321817 - RNA, 19 nt, Human
gucccagugggaggggcag

SEQ ID NO: 2321818 - RNA, 20 nt, Human
gucccagugggaggggcagg

SEQ ID NO: 2321819 - RNA, 21 nt, Human
gucccagugggaggggcaggc

SEQ ID NO: 2321820 - RNA, 22 nt, Human
gucccagugggaggggcaggcu

SEQ ID NO: 2321821 - RNA, 14 nt, Human
gucugagugaaccu

SEQ ID NO: 2321822 - RNA, 14 nt, Human
gucugagucauggc

SEQ ID NO: 2321823 - RNA, 21 nt, Human
gucugagucauggccgggugg

SEQ ID NO: 2321824 - RNA, 22 nt, Human
gucugaggggcaacugagucug

SEQ ID NO: 2321825 - RNA, 21 nt, Human
gucugaggaauccagacccgg

SEQ ID NO: 2321826 - RNA, 14 nt, Human
gucugacugugugu

SEQ ID NO: 2321827 - RNA, 17 nt, Human
gucugauucccaagcuc

SEQ ID NO: 2321828 - RNA, 14 nt, Human
gucugauauucaaa

SEQ ID NO: 2321829 - RNA, 19 nt, Human
gucugaucgugacgcugaa

SEQ ID NO: 2321830 - RNA, 20 nt, Human
gucugaucgugacgcugaau

SEQ ID NO: 2321831 - RNA, 21 nt, Human
gucugaucgugacgcugaaua

SEQ ID NO: 2321832 - RNA, 13 nt, Human
gucugaucugugc

SEQ ID NO: 2321833 - RNA, 15 nt, Human
gucugaucugugcuu

SEQ ID NO: 2321834 - RNA, 17 nt, Human
gucugaucugugcuuuc

SEQ ID NO: 2321835 - RNA, 18 nt, Human
gucugauucccaagcucu

SEQ ID NO: 2321836 - RNA, 19 nt, Human
gucugauucccaagcucug

SEQ ID NO: 2321837 - RNA, 18 nt, Human
gucugcagcccggcgcca

SEQ ID NO: 2321838 - RNA, 17 nt, Human
gucugcacccaggggug

SEQ ID NO: 2321839 - RNA, 22 nt, Human
gucugcacucuaacccuaggca

SEQ ID NO: 2321840 - RNA, 21 nt, Human
gucugcaagucagaggauggc

SEQ ID NO: 2321841 - RNA, 16 nt, Human
gucugcacaugcagcu

SEQ ID NO: 2321842 - RNA, 13 nt, Human
gucugcacccagg

SEQ ID NO: 2321843 - RNA, 15 nt, Human
gucugcacccagggg

SEQ ID NO: 2321844 - RNA, 22 nt, Human
gucugcaagauucugaaacauu

SEQ ID NO: 2321845 - RNA, 13 nt, Human
gucugcaagucag

SEQ ID NO: 2321846 - RNA, 14 nt, Human
gucugcaagucaga

SEQ ID NO: 2321847 - RNA, 15 nt, Human
gucugcaagucagag

SEQ ID NO: 2321848 - RNA, 16 nt, Human
gucugcaagucagagg

SEQ ID NO: 2321849 - RNA, 17 nt, Human
gucugcaagucagagga

SEQ ID NO: 2321850 - RNA, 18 nt, Human
gucugcaagucagaggau

SEQ ID NO: 2321851 - RNA, 19 nt, Human
gucugcaagucagaggaug

SEQ ID NO: 2321852 - RNA, 18 nt, Human
gucugccaauuuuugccu

SEQ ID NO: 2321853 - RNA, 18 nt, Human
gucugccaccauccugcu

SEQ ID NO: 2321854 - RNA, 21 nt, Human
gucugccaauuuuugccuuca

SEQ ID NO: 2321855 - RNA, 17 nt, Human
gucugccacacaaacgu

SEQ ID NO: 2321856 - RNA, 12 nt, Human
gucugcaggcag

SEQ ID NO: 2321857 - RNA, 22 nt, Human
gucugcaggauugauuaugcag

SEQ ID NO: 2321858 - RNA, 19 nt, Human
gucugcagcccggcgccac

SEQ ID NO: 2321859 - RNA, 13 nt, Human
gucugcaggcagg

SEQ ID NO: 2321860 - RNA, 16 nt, Human
gucugcaggugcacca

SEQ ID NO: 2321861 - RNA, 21 nt, Human
gucugcauuucgguggcuagu

SEQ ID NO: 2321862 - RNA, 20 nt, Human
gucugcauuucgguggcuag

SEQ ID NO: 2321863 - RNA, 22 nt, Human
gucugauuucaggauacucugu

SEQ ID NO: 2321864 - RNA, 20 nt, Human
gucugauuggcucacccaag

SEQ ID NO: 2321865 - RNA, 21 nt, Human
gucugaucugugcuuuccagc

SEQ ID NO: 2321866 - RNA, 22 nt, Human
gucugaucugugcuuuccagcu

SEQ ID NO: 2321867 - RNA, 23 nt, Human
gucugaucugugcuuuccagcuc

SEQ ID NO: 2321868 - RNA, 24 nt, Human
gucugaucugugcuuuccagcuca

SEQ ID NO: 2321869 - RNA, 16 nt, Human
gucugauuugugauga

SEQ ID NO: 2321870 - RNA, 21 nt, Human
gucugcaaaaugaggaaugua

SEQ ID NO: 2321871 - RNA, 23 nt, Human
gucugcaaaaugaggaauguaua

SEQ ID NO: 2321872 - RNA, 15 nt, Human
gucugcaacuuuaag

SEQ ID NO: 2321873 - RNA, 20 nt, Human
gucugcaacuuuaagcagcu

SEQ ID NO: 2321874 - RNA, 22 nt, Human
gucugcaacuuuaagcagcucu

SEQ ID NO: 2321875 - RNA, 23 nt, Human
gucugcaacuuuaagcagcucuu

SEQ ID NO: 2321876 - RNA, 15 nt, Human
gucugcaagaaccug

SEQ ID NO: 2321877 - RNA, 20 nt, Human
gucugauucccaagcucugc

SEQ ID NO: 2321878 - RNA, 21 nt, Human
gucugauucccaagcucugcu

SEQ ID NO: 2321879 - RNA, 16 nt, Human
gucucuaucauuaaag

SEQ ID NO: 2321880 - RNA, 23 nt, Human
gucucuaugccagcucaguccca

SEQ ID NO: 2321881 - RNA, 17 nt, Human
gucucuaugccagcuca

SEQ ID NO: 2321882 - RNA, 17 nt, Human
gucucuaucauuaaagu

SEQ ID NO: 2321883 - RNA, 18 nt, Human
gucucuaucauuaaaguu

SEQ ID NO: 2321884 - RNA, 19 nt, Human
gucucuaucauuaaaguuc

SEQ ID NO: 2321885 - RNA, 20 nt, Human
gucucuaucauuaaaguucu

SEQ ID NO: 2321886 - RNA, 23 nt, Human
gucucgcuuuguugcccaggcug

SEQ ID NO: 2321887 - RNA, 19 nt, Human
gucucgcuuuguugcccag

SEQ ID NO: 2321888 - RNA, 17 nt, Human
gucucgcuuuguugccc

SEQ ID NO: 2321889 - RNA, 16 nt, Human
gucucgcuuuguugcc

SEQ ID NO: 2321890 - RNA, 23 nt, Human
gucucggguggcuagucagagag

SEQ ID NO: 2321891 - RNA, 16 nt, Human
gucucggugguaccag

SEQ ID NO: 2321892 - RNA, 22 nt, Human
gucucggugguaccaggucucc

SEQ ID NO: 2321893 - RNA, 16 nt, Human
gucucggacuaagccu

SEQ ID NO: 2321894 - RNA, 12 nt, Human
gucucucuccca

SEQ ID NO: 2321895 - RNA, 15 nt, Human
gucucugugagacuc

SEQ ID NO: 2321896 - RNA, 14 nt, Human
gucucugugcuuug

SEQ ID NO: 2321897 - RNA, 12 nt, Human
gucucucagaau

SEQ ID NO: 2321898 - RNA, 15 nt, Human
gucucucaugaaccu

SEQ ID NO: 2321899 - RNA, 16 nt, Human
gucucucaugaaccuc

SEQ ID NO: 2321900 - RNA, 13 nt, Human
gucugacccacug

SEQ ID NO: 2321901 - RNA, 14 nt, Human
gucugacccacugc

SEQ ID NO: 2321902 - RNA, 15 nt, Human
gucucuucuccacug

SEQ ID NO: 2321903 - RNA, 16 nt, Human
gucucuucuccacugg

SEQ ID NO: 2321904 - RNA, 11 nt, Human
gucucuucaga

SEQ ID NO: 2321905 - RNA, 14 nt, Human
gucucuucuccacu

SEQ ID NO: 2321906 - RNA, 15 nt, Human
gucugacccacugcu

SEQ ID NO: 2321907 - RNA, 17 nt, Human
gucucuucuccacugga

SEQ ID NO: 2321908 - RNA, 14 nt, Human
gucugacccucucc

SEQ ID NO: 2321909 - RNA, 13 nt, Human
gucucuuccccuc

SEQ ID NO: 2321910 - RNA, 18 nt, Human
gucugaggaauccagacc

SEQ ID NO: 2321911 - RNA, 19 nt, Human
gucugaggaauccagaccc

SEQ ID NO: 2321912 - RNA, 13 nt, Human
gucuacccagaga

SEQ ID NO: 2321913 - RNA, 17 nt, Human
gucuacccagagaagcc

SEQ ID NO: 2321914 - RNA, 20 nt, Human
gucuacccagagaagccccu

SEQ ID NO: 2321915 - RNA, 21 nt, Human
gucuacccagagaagccccuu

SEQ ID NO: 2321916 - RNA, 15 nt, Human
gucuacacugugcug

SEQ ID NO: 2321917 - RNA, 23 nt, Human
gucuacacuaagagagaaugaga

SEQ ID NO: 2321918 - RNA, 20 nt, Human
gucuaaggaugcuaaaccuu

SEQ ID NO: 2321919 - RNA, 21 nt, Human
gucuaaucuagauaucgacuu

SEQ ID NO: 2321920 - RNA, 17 nt, Human
gucuacacuaagagaga

SEQ ID NO: 2321921 - RNA, 21 nt, Human
gucuaaacaaugcugauuugg

SEQ ID NO: 2321922 - RNA, 10 nt, Human
gucuaaacug

SEQ ID NO: 2321923 - RNA, 14 nt, Human
gucuaaagagcuuu

SEQ ID NO: 2321924 - RNA, 23 nt, Human
gucuaagauaguaacaaugaaga

SEQ ID NO: 2321925 - RNA, 20 nt, Human
gucuaaaauuuuuaaggacu

SEQ ID NO: 2321926 - RNA, 16 nt, Human
gucuaaacaaugcuga

SEQ ID NO: 2321927 - RNA, 14 nt, Human
gucuaaaacaauaa

SEQ ID NO: 2321928 - RNA, 13 nt, Human
gucuaaaacaaua

SEQ ID NO: 2321929 - RNA, 14 nt, Human
gucuaaaaauaaaa

SEQ ID NO: 2321930 - RNA, 12 nt, Human
gucuaaaaacac

SEQ ID NO: 2321931 - RNA, 17 nt, Human
gucguugacuuuaggga

SEQ ID NO: 2321932 - RNA, 19 nt, Human
gucguugacuuuagggacu

SEQ ID NO: 2321933 - RNA, 13 nt, Human
gucguugugaggg

SEQ ID NO: 2321934 - RNA, 14 nt, Human
gucgugggugugug

SEQ ID NO: 2321935 - RNA, 19 nt, Human
gucguggggugugcuggga

SEQ ID NO: 2321936 - RNA, 21 nt, Human
gucguggggugugcugggagc

SEQ ID NO: 2321937 - RNA, 20 nt, Human
guccuuaaugauccguucca

SEQ ID NO: 2321938 - RNA, 23 nt, Human
guccuuaaacagggcaucuccag

SEQ ID NO: 2321939 - RNA, 21 nt, Human
guccuguguuuuuucugccac

SEQ ID NO: 2321940 - RNA, 15 nt, Human
guccuguggcaggca

SEQ ID NO: 2321941 - RNA, 21 nt, Human
guccuguggcaggcagcgcca

SEQ ID NO: 2321942 - RNA, 16 nt, Human
guccuguggcaggcag

SEQ ID NO: 2321943 - RNA, 17 nt, Human
guccuguggcaggcagc

SEQ ID NO: 2321944 - RNA, 15 nt, Human
guccuuaccagcaga

SEQ ID NO: 2321945 - RNA, 16 nt, Human
guccuuaccagcagag

SEQ ID NO: 2321946 - RNA, 17 nt, Human
guccuuaccagcagagc

SEQ ID NO: 2321947 - RNA, 20 nt, Human
gucucacuauguugcccagg

SEQ ID NO: 2321948 - RNA, 21 nt, Human
gucucacuauguugcccaggc

SEQ ID NO: 2321949 - RNA, 13 nt, Human
gucucacuguugc

SEQ ID NO: 2321950 - RNA, 23 nt, Human
gucucacuauguugcccaggcag

SEQ ID NO: 2321951 - RNA, 16 nt, Human
gucucacuguugccca

SEQ ID NO: 2321952 - RNA, 17 nt, Human
gucucacuguugcccag

SEQ ID NO: 2321953 - RNA, 18 nt, Human
gucucacuguugcccagg

SEQ ID NO: 2321954 - RNA, 19 nt, Human
gucucacuguugcccaggc

SEQ ID NO: 2321955 - RNA, 20 nt, Human
gucucacuguugcccaggcu

SEQ ID NO: 2321956 - RNA, 21 nt, Human
gucucacuguugcccaggcug

SEQ ID NO: 2321957 - RNA, 22 nt, Human
gucucacuguugcccaggcugg

SEQ ID NO: 2321958 - RNA, 23 nt, Human
gucucacuguugcccaggcuggc

SEQ ID NO: 2321959 - RNA, 24 nt, Human
gucucagacucuuuuuguaccugg

SEQ ID NO: 2321960 - RNA, 22 nt, Human
gucucacuugugcaguguugac

SEQ ID NO: 2321961 - RNA, 17 nt, Human
gucucgcugaugcuggg

SEQ ID NO: 2321962 - RNA, 18 nt, Human
gucucgcucugucaccca

SEQ ID NO: 2321963 - RNA, 18 nt, Human
gucucgcugaugcugggc

SEQ ID NO: 2321964 - RNA, 19 nt, Human
gucucgcugaugcugggcu

SEQ ID NO: 2321965 - RNA, 20 nt, Human
gucucgcugaugcugggcug

SEQ ID NO: 2321966 - RNA, 21 nt, Human
gucucgcugaugcugggcugg

SEQ ID NO: 2321967 - RNA, 13 nt, Human
gucucgcucuguc

SEQ ID NO: 2321968 - RNA, 18 nt, Human
guauucaauauccuuugc

SEQ ID NO: 2321969 - RNA, 22 nt, Human
guauucagugagggucuucuua

SEQ ID NO: 2321970 - RNA, 19 nt, Human
guauuccagaccugaagaa

SEQ ID NO: 2321971 - RNA, 19 nt, Human
guauucccauuagaccaag

SEQ ID NO: 2321972 - RNA, 14 nt, Human
guauuccugccucc

SEQ ID NO: 2321973 - RNA, 18 nt, Human
guauuccuuaaauaaacu

SEQ ID NO: 2321974 - RNA, 23 nt, Human
guauuccuuuuguguacagugug

SEQ ID NO: 2321975 - RNA, 20 nt, Human
guauuccuuuuguguacagu

SEQ ID NO: 2321976 - RNA, 13 nt, Human
guauuuauucaau

SEQ ID NO: 2321977 - RNA, 14 nt, Human
guauuuauucaaua

SEQ ID NO: 2321978 - RNA, 16 nt, Human
guauuuauucaauaaa

SEQ ID NO: 2321979 - RNA, 22 nt, Human
guauucgugcagcauaugagga

SEQ ID NO: 2321980 - RNA, 13 nt, Human
guauuuauuccau

SEQ ID NO: 2321981 - RNA, 23 nt, Human
guauuuauucaauaaaguauuua

SEQ ID NO: 2321982 - RNA, 15 nt, Human
guauuuauuccauau

SEQ ID NO: 2321983 - RNA, 21 nt, Human
guauuuauuccauauucaugu

SEQ ID NO: 2321984 - RNA, 22 nt, Human
guauuuauuccauauucaugua

SEQ ID NO: 2321985 - RNA, 23 nt, Human
guauuuauuccauauucauguaa

SEQ ID NO: 2321986 - RNA, 17 nt, Human
guauuuauucaauaaag

SEQ ID NO: 2321987 - RNA, 19 nt, Human
guauuuauucaauaaagua

SEQ ID NO: 2321988 - RNA, 20 nt, Human
guauuuauucaauaaaguau

SEQ ID NO: 2321989 - RNA, 22 nt, Human
guauuuauucaauaaaguauuu

SEQ ID NO: 2321990 - RNA, 22 nt, Human
guauuuauuuuccuccccagca

SEQ ID NO: 2321991 - RNA, 20 nt, Human
guauuuauuuuccuccccag

SEQ ID NO: 2321992 - RNA, 19 nt, Human
guauuuauuuuccucccca

SEQ ID NO: 2321993 - RNA, 18 nt, Human
guauuuauuuuccucccc

SEQ ID NO: 2321994 - RNA, 17 nt, Human
guauuuauuuuccuccc

SEQ ID NO: 2321995 - RNA, 21 nt, Human
guauuuauuuaaaagauucau

SEQ ID NO: 2321996 - RNA, 13 nt, Human
guauuuauuuaaa

SEQ ID NO: 2321997 - RNA, 14 nt, Human
guauuuauuuaaaa

SEQ ID NO: 2321998 - RNA, 18 nt, Human
guauuuauuuaaaagauu

SEQ ID NO: 2321999 - RNA, 19 nt, Human
guauuuauuuaguauuuau

SEQ ID NO: 2322000 - RNA, 23 nt, Human
guauuuauuuuccuccccagcag

SEQ ID NO: 2322001 - RNA, 11 nt, Human
guauuucagac

SEQ ID NO: 2322002 - RNA, 13 nt, Human
guauuucaaauug

SEQ ID NO: 2322003 - RNA, 17 nt, Human
guauuucuaugaaauau

SEQ ID NO: 2322004 - RNA, 16 nt, Human
guauuuccagugcaau

SEQ ID NO: 2322005 - RNA, 12 nt, Human
guauuucccagc

SEQ ID NO: 2322006 - RNA, 22 nt, Human
guauuucuaugaaauauuaugu

SEQ ID NO: 2322007 - RNA, 14 nt, Human
guauuugaaacuga

SEQ ID NO: 2322008 - RNA, 19 nt, Human
guauuugagaguucuaaau

SEQ ID NO: 2322009 - RNA, 21 nt, Human
guauuugagaguucuaaauuu

SEQ ID NO: 2322010 - RNA, 13 nt, Human
guauuugcaguuc

SEQ ID NO: 2322011 - RNA, 12 nt, Human
guauuugcuuuu

SEQ ID NO: 2322012 - RNA, 22 nt, Human
guauuugcuuuuuuguuuuggc

SEQ ID NO: 2322013 - RNA, 19 nt, Human
guauuagggguaauauauu

SEQ ID NO: 2322014 - RNA, 22 nt, Human
guauuagggguaauauauugcu

SEQ ID NO: 2322015 - RNA, 12 nt, Human
guauuauaaauu

SEQ ID NO: 2322016 - RNA, 18 nt, Human
guauuauaaauuauguuu

SEQ ID NO: 2322017 - RNA, 19 nt, Human
guauuauaaauuauguuua

SEQ ID NO: 2322018 - RNA, 14 nt, Human
guauuauaccuuuu

SEQ ID NO: 2322019 - RNA, 12 nt, Human
guauuagauguu

SEQ ID NO: 2322020 - RNA, 13 nt, Human
guauuagauguuc

SEQ ID NO: 2322021 - RNA, 14 nt, Human
guauuagauguucu

SEQ ID NO: 2322022 - RNA, 15 nt, Human
guauuagauguucuc

SEQ ID NO: 2322023 - RNA, 17 nt, Human
guauuagauguucucua

SEQ ID NO: 2322024 - RNA, 18 nt, Human
guauuagauguucucuau

SEQ ID NO: 2322025 - RNA, 21 nt, Human
guauuagauguucucuaucau

SEQ ID NO: 2322026 - RNA, 22 nt, Human
guauuagauguucucuaucauu

SEQ ID NO: 2322027 - RNA, 16 nt, Human
guauuauucugcagca

SEQ ID NO: 2322028 - RNA, 21 nt, Human
guauuauguacucuacugaua

SEQ ID NO: 2322029 - RNA, 16 nt, Human
guauuaugucucuucu

SEQ ID NO: 2322030 - RNA, 15 nt, Human
guauuaugcuucuug

SEQ ID NO: 2322031 - RNA, 17 nt, Human
guauuaugcuucuugga

SEQ ID NO: 2322032 - RNA, 15 nt, Human
guauuauucugcagc

SEQ ID NO: 2322033 - RNA, 14 nt, Human
guauuauuuuccaa

SEQ ID NO: 2322034 - RNA, 19 nt, Human
guauuauaggccaaacugg

SEQ ID NO: 2322035 - RNA, 20 nt, Human
guauuauaaauuauguuuau

SEQ ID NO: 2322036 - RNA, 12 nt, Human
guauuaugcuuc

SEQ ID NO: 2322037 - RNA, 14 nt, Human
guauuaugcuucuu

SEQ ID NO: 2322038 - RNA, 15 nt, Human
guauuauguguguuu

SEQ ID NO: 2322039 - RNA, 13 nt, Human
guagagugggagc

SEQ ID NO: 2322040 - RNA, 15 nt, Human
guagagucaucucca

SEQ ID NO: 2322041 - RNA, 14 nt, Human
guagagguuuuguu

SEQ ID NO: 2322042 - RNA, 23 nt, Human
guagagucaucuccaucagcugu

SEQ ID NO: 2322043 - RNA, 15 nt, Human
guagagugggagcug

SEQ ID NO: 2322044 - RNA, 21 nt, Human
guauuacuagaagaugaauac

SEQ ID NO: 2322045 - RNA, 22 nt, Human
guauuacacuguauuuguaucu

SEQ ID NO: 2322046 - RNA, 13 nt, Human
guauuacuucugc

SEQ ID NO: 2322047 - RNA, 14 nt, Human
guauuacuucugcu

SEQ ID NO: 2322048 - RNA, 15 nt, Human
guauuacuucugcua

SEQ ID NO: 2322049 - RNA, 14 nt, Human
gucaaugugcagug

SEQ ID NO: 2322050 - RNA, 15 nt, Human
gucaauguuuucagu

SEQ ID NO: 2322051 - RNA, 18 nt, Human
gucaaugugcaguguagc

SEQ ID NO: 2322052 - RNA, 16 nt, Human
gucaauuacaggaagu

SEQ ID NO: 2322053 - RNA, 13 nt, Human
gucaauuacagga

SEQ ID NO: 2322054 - RNA, 15 nt, Human
gucaauuacaggaag

SEQ ID NO: 2322055 - RNA, 16 nt, Human
gucaaguugugcuugu

SEQ ID NO: 2322056 - RNA, 17 nt, Human
gucaaguugugcuuguu

SEQ ID NO: 2322057 - RNA, 18 nt, Human
gucaaguugugcuuguuu

SEQ ID NO: 2322058 - RNA, 21 nt, Human
gucaauaaaauccauacauuu

SEQ ID NO: 2322059 - RNA, 17 nt, Human
gucaaguuccuuugggu

SEQ ID NO: 2322060 - RNA, 16 nt, Human
gucaagugggaucugu

SEQ ID NO: 2322061 - RNA, 14 nt, Human
gucaagugggaucu

SEQ ID NO: 2322062 - RNA, 15 nt, Human
gucaauaaaauccau

SEQ ID NO: 2322063 - RNA, 19 nt, Human
gucaccggauccugggugg

SEQ ID NO: 2322064 - RNA, 17 nt, Human
gucaccggauccugggu

SEQ ID NO: 2322065 - RNA, 16 nt, Human
gucaccggauccuggg

SEQ ID NO: 2322066 - RNA, 16 nt, Human
gucacccuccaccucu

SEQ ID NO: 2322067 - RNA, 15 nt, Human
gucaccccggccacc

SEQ ID NO: 2322068 - RNA, 13 nt, Human
gucaccccggcca

SEQ ID NO: 2322069 - RNA, 21 nt, Human
gucaccaucucaggccaccug

SEQ ID NO: 2322070 - RNA, 20 nt, Human
gucaccaucucaggccaccu

SEQ ID NO: 2322071 - RNA, 17 nt, Human
gucaccaucucaggcca

SEQ ID NO: 2322072 - RNA, 16 nt, Human
gucaccaucucaggcc

SEQ ID NO: 2322073 - RNA, 23 nt, Human
gucaccaucuuaagagaugccuc

SEQ ID NO: 2322074 - RNA, 20 nt, Human
gucacccaggcuggaguaca

SEQ ID NO: 2322075 - RNA, 20 nt, Human
gucacccaggcuggagugca

SEQ ID NO: 2322076 - RNA, 20 nt, Human
gucaccugaagacucauucu

SEQ ID NO: 2322077 - RNA, 14 nt, Human
gucaccucauggaa

SEQ ID NO: 2322078 - RNA, 23 nt, Human
gucaccggauccuggguggucug

SEQ ID NO: 2322079 - RNA, 18 nt, Human
gucaccguggaccuuccu

SEQ ID NO: 2322080 - RNA, 19 nt, Human
gucaccguggaccuuccug

SEQ ID NO: 2322081 - RNA, 20 nt, Human
gucaccguggaccuuccugc

SEQ ID NO: 2322082 - RNA, 21 nt, Human
gucaccguggaccuuccugcc

SEQ ID NO: 2322083 - RNA, 16 nt, Human
gucaccucagagacau

SEQ ID NO: 2322084 - RNA, 14 nt, Human
guauuuguuaaugg

SEQ ID NO: 2322085 - RNA, 18 nt, Human
guauuugugacuaauugu

SEQ ID NO: 2322086 - RNA, 20 nt, Human
guauuugugacuaauuguau

SEQ ID NO: 2322087 - RNA, 21 nt, Human
guauuugugacuaauuguaua

SEQ ID NO: 2322088 - RNA, 20 nt, Human
guauuugggaagugaagacu

SEQ ID NO: 2322089 - RNA, 11 nt, Human
guauuugugac

SEQ ID NO: 2322090 - RNA, 16 nt, Human
guauuuuaaaagaaug

SEQ ID NO: 2322091 - RNA, 17 nt, Human
guauuuuaaaagaauga

SEQ ID NO: 2322092 - RNA, 15 nt, Human
gucaacuucuggcuc

SEQ ID NO: 2322093 - RNA, 17 nt, Human
gucaacuucuggcuccu

SEQ ID NO: 2322094 - RNA, 23 nt, Human
guauuuguuugcauaggugaucu

SEQ ID NO: 2322095 - RNA, 12 nt, Human
gucaacuucugg

SEQ ID NO: 2322096 - RNA, 12 nt, Human
guauuuguuugc

SEQ ID NO: 2322097 - RNA, 18 nt, Human
guauuuuaaaagaaugau

SEQ ID NO: 2322098 - RNA, 18 nt, Human
gucaagagggucugagga

SEQ ID NO: 2322099 - RNA, 19 nt, Human
gucaagagggucugaggaa

SEQ ID NO: 2322100 - RNA, 15 nt, Human
gucaaggaguggcuu

SEQ ID NO: 2322101 - RNA, 21 nt, Human
gucaagcuccuccucccugca

SEQ ID NO: 2322102 - RNA, 20 nt, Human
gucaagcuccuccucccugc

SEQ ID NO: 2322103 - RNA, 19 nt, Human
gucaagcuccuccucccug

SEQ ID NO: 2322104 - RNA, 17 nt, Human
gucaagcuccuccuccc

SEQ ID NO: 2322105 - RNA, 15 nt, Human
gucaagcuccuccuc

SEQ ID NO: 2322106 - RNA, 14 nt, Human
gucaagauuuugaa

SEQ ID NO: 2322107 - RNA, 11 nt, Human
gucaagcacuc

SEQ ID NO: 2322108 - RNA, 14 nt, Human
gucaagcccaggag

SEQ ID NO: 2322109 - RNA, 13 nt, Human
gucaagcuccucc

SEQ ID NO: 2322110 - RNA, 17 nt, Human
gucaagaagaagaugga

SEQ ID NO: 2322111 - RNA, 18 nt, Human
gucaagugaaaaaggagg

SEQ ID NO: 2322112 - RNA, 16 nt, Human
gucaagugaaaaagga

SEQ ID NO: 2322113 - RNA, 19 nt, Human
gucaagugaaaaaggagga

SEQ ID NO: 2322114 - RNA, 18 nt, Human
gucaaggcugcuuagaau

SEQ ID NO: 2322115 - RNA, 17 nt, Human
gucaagugcguccacga

SEQ ID NO: 2322116 - RNA, 15 nt, Human
guccagaagaauauu

SEQ ID NO: 2322117 - RNA, 17 nt, Human
guccagaagaauauuca

SEQ ID NO: 2322118 - RNA, 19 nt, Human
guccagaagaauauucagg

SEQ ID NO: 2322119 - RNA, 21 nt, Human
guccagaagaauauucaggac

SEQ ID NO: 2322120 - RNA, 23 nt, Human
guccacuguguauagaaguagau

SEQ ID NO: 2322121 - RNA, 20 nt, Human
guccacugucacuguuucuc

SEQ ID NO: 2322122 - RNA, 14 nt, Human
guccacuguguaua

SEQ ID NO: 2322123 - RNA, 17 nt, Human
guccagcuugcucuuca

SEQ ID NO: 2322124 - RNA, 16 nt, Human
guccagcuugcucuuc

SEQ ID NO: 2322125 - RNA, 14 nt, Human
guccagcuugcucu

SEQ ID NO: 2322126 - RNA, 13 nt, Human
guccaggagccug

SEQ ID NO: 2322127 - RNA, 18 nt, Human
guccaggaaaugugcaca

SEQ ID NO: 2322128 - RNA, 17 nt, Human
guccagcugagcgccag

SEQ ID NO: 2322129 - RNA, 14 nt, Human
guccagcuccaacc

SEQ ID NO: 2322130 - RNA, 15 nt, Human
guccagacagccugu

SEQ ID NO: 2322131 - RNA, 12 nt, Human
guccagcucugg

SEQ ID NO: 2322132 - RNA, 11 nt, Human
guccagacagc

SEQ ID NO: 2322133 - RNA, 22 nt, Human
guccagaagaauauucaggacu

SEQ ID NO: 2322134 - RNA, 12 nt, Human
guccagacagcc

SEQ ID NO: 2322135 - RNA, 14 nt, Human
guccagacagccug

SEQ ID NO: 2322136 - RNA, 13 nt, Human
guccagcucugga

SEQ ID NO: 2322137 - RNA, 14 nt, Human
guccagcucuggag

SEQ ID NO: 2322138 - RNA, 16 nt, Human
guccagcucuggaggg

SEQ ID NO: 2322139 - RNA, 21 nt, Human
guccagcucuggaggggaggg

SEQ ID NO: 2322140 - RNA, 20 nt, Human
gucauguaagcugaaaauau

SEQ ID NO: 2322141 - RNA, 20 nt, Human
gucauggcuuaauguuuauu

SEQ ID NO: 2322142 - RNA, 22 nt, Human
gucauggcugugcccucuugau

SEQ ID NO: 2322143 - RNA, 15 nt, Human
gucauggcuuaaugu

SEQ ID NO: 2322144 - RNA, 15 nt, Human
gucaugugacaggua

SEQ ID NO: 2322145 - RNA, 11 nt, Human
gucaugugacc

SEQ ID NO: 2322146 - RNA, 18 nt, Human
gucaugcccuccucuccc

SEQ ID NO: 2322147 - RNA, 17 nt, Human
gucaugcccuccucucc

SEQ ID NO: 2322148 - RNA, 16 nt, Human
gucaugcccuccucuc

SEQ ID NO: 2322149 - RNA, 15 nt, Human
gucaugcuuguguua

SEQ ID NO: 2322150 - RNA, 14 nt, Human
guccacccaggagc

SEQ ID NO: 2322151 - RNA, 15 nt, Human
gucauguuuaagaaa

SEQ ID NO: 2322152 - RNA, 17 nt, Human
gucauguuccuucaaga

SEQ ID NO: 2322153 - RNA, 23 nt, Human
gucauguuggucaaaagcuggau

SEQ ID NO: 2322154 - RNA, 15 nt, Human
guccacccaggagcc

SEQ ID NO: 2322155 - RNA, 16 nt, Human
guccacccaggagccc

SEQ ID NO: 2322156 - RNA, 21 nt, Human
guccaggaugcuaacaucuaa

SEQ ID NO: 2322157 - RNA, 17 nt, Human
guccaggccccaaaacc

SEQ ID NO: 2322158 - RNA, 15 nt, Human
guccaggcacugaga

SEQ ID NO: 2322159 - RNA, 13 nt, Human
guccaggcugccg

SEQ ID NO: 2322160 - RNA, 21 nt, Human
guccagggagcauuuuccucc

SEQ ID NO: 2322161 - RNA, 20 nt, Human
guccagggaagcuggccgag

SEQ ID NO: 2322162 - RNA, 15 nt, Human
guccagggaagcugg

SEQ ID NO: 2322163 - RNA, 13 nt, Human
guccagggaagcu

SEQ ID NO: 2322164 - RNA, 14 nt, Human
guccaggcugccgu

SEQ ID NO: 2322165 - RNA, 16 nt, Human
guccaggcugccgugg

SEQ ID NO: 2322166 - RNA, 20 nt, Human
guccaggcugccguggggcc

SEQ ID NO: 2322167 - RNA, 13 nt, Human
guccagggaagag

SEQ ID NO: 2322168 - RNA, 23 nt, Human
guccagggaagagaaagugauuu

SEQ ID NO: 2322169 - RNA, 12 nt, Human
gucccacucaag

SEQ ID NO: 2322170 - RNA, 17 nt, Human
guccagggcccugagcu

SEQ ID NO: 2322171 - RNA, 16 nt, Human
guccagggcccugagc

SEQ ID NO: 2322172 - RNA, 15 nt, Human
guccagggcccugag

SEQ ID NO: 2322173 - RNA, 14 nt, Human
guccagggcccuga

SEQ ID NO: 2322174 - RNA, 14 nt, Human
gucccacucagucc

SEQ ID NO: 2322175 - RNA, 15 nt, Human
gucccacucagucca

SEQ ID NO: 2322176 - RNA, 22 nt, Human
gucccacucaagccaagcagcc

SEQ ID NO: 2322177 - RNA, 21 nt, Human
gucccacucaagccaagcagc

SEQ ID NO: 2322178 - RNA, 18 nt, Human
gucccacucaagccaagc

SEQ ID NO: 2322179 - RNA, 16 nt, Human
gucccacucaagccaa

SEQ ID NO: 2322180 - RNA, 11 nt, Human
gucccacugcc

SEQ ID NO: 2322181 - RNA, 17 nt, Human
gucccacugccucaggu

SEQ ID NO: 2322182 - RNA, 17 nt, Human
gucccagauacuugggg

SEQ ID NO: 2322183 - RNA, 17 nt, Human
gucccagauuggcucac

SEQ ID NO: 2322184 - RNA, 18 nt, Human
gucccagagcaggaggcc

SEQ ID NO: 2322185 - RNA, 19 nt, Human
gucccagagcaggaggccc

SEQ ID NO: 2322186 - RNA, 21 nt, Human
gucccagauuggcucacacug

SEQ ID NO: 2322187 - RNA, 22 nt, Human
gucccagauuggcucacacuga

SEQ ID NO: 2322188 - RNA, 20 nt, Human
gucccagaaugccuccugca

SEQ ID NO: 2322189 - RNA, 19 nt, Human
gucccacuuggcaucagcu

SEQ ID NO: 2322190 - RNA, 16 nt, Human
gucccagagcaggagg

SEQ ID NO: 2322191 - RNA, 22 nt, Human
gucccagaaaaagcaucauggc

SEQ ID NO: 2322192 - RNA, 17 nt, Human
gucccacuuccccuccu

SEQ ID NO: 2322193 - RNA, 21 nt, Human
gucccacuuccccuccuaccc

SEQ ID NO: 2322194 - RNA, 19 nt, Human
gucccacugccucagguuc

SEQ ID NO: 2322195 - RNA, 18 nt, Human
gucccacugccucagguu

SEQ ID NO: 2322196 - RNA, 16 nt, Human
gucccacuuccccucc

SEQ ID NO: 2322197 - RNA, 22 nt, Human
gucccagcuacucagaagccug

SEQ ID NO: 2322198 - RNA, 23 nt, Human
gucccagccaccccgggcucucu

SEQ ID NO: 2322199 - RNA, 14 nt, Human
gucccagcuacucg

SEQ ID NO: 2322200 - RNA, 21 nt, Human
gucccagccaccccgggcucu

SEQ ID NO: 2322201 - RNA, 18 nt, Human
gucccagccaccccgggc

SEQ ID NO: 2322202 - RNA, 16 nt, Human
gucccagccaccccgg

SEQ ID NO: 2322203 - RNA, 15 nt, Human
gucccagccaccccg

SEQ ID NO: 2322204 - RNA, 14 nt, Human
gucccagccacccc

SEQ ID NO: 2322205 - RNA, 22 nt, Human
gucccagagcaggaggccccug

SEQ ID NO: 2322206 - RNA, 15 nt, Human
gucauagguuaauau

SEQ ID NO: 2322207 - RNA, 21 nt, Human
gucauauaagauucauauuua

SEQ ID NO: 2322208 - RNA, 18 nt, Human
gucauauguaggugucug

SEQ ID NO: 2322209 - RNA, 12 nt, Human
gucauauuuuga

SEQ ID NO: 2322210 - RNA, 20 nt, Human
gucauauuuugauuauugua

SEQ ID NO: 2322211 - RNA, 16 nt, Human
gucauauuuugauuau

SEQ ID NO: 2322212 - RNA, 15 nt, Human
gucaucacuuuucag

SEQ ID NO: 2322213 - RNA, 17 nt, Human
gucaucacuuuucagug

SEQ ID NO: 2322214 - RNA, 16 nt, Human
gucaucacuuuucagu

SEQ ID NO: 2322215 - RNA, 14 nt, Human
gucaucagccacca

SEQ ID NO: 2322216 - RNA, 19 nt, Human
gucaucuccaucagcugua

SEQ ID NO: 2322217 - RNA, 17 nt, Human
gucaucuccaucagcug

SEQ ID NO: 2322218 - RNA, 16 nt, Human
gucaucuaguuuuaaa

SEQ ID NO: 2322219 - RNA, 16 nt, Human
gucaucucagcuggau

SEQ ID NO: 2322220 - RNA, 12 nt, Human
gucaucuaguuu

SEQ ID NO: 2322221 - RNA, 15 nt, Human
gucaucuaguuuuaa

SEQ ID NO: 2322222 - RNA, 21 nt, Human
gucaucauuguauauaugugu

SEQ ID NO: 2322223 - RNA, 17 nt, Human
gucaucaggagaaaaag

SEQ ID NO: 2322224 - RNA, 13 nt, Human
gucaucauacaug

SEQ ID NO: 2322225 - RNA, 15 nt, Human
gucaugaucucccug

SEQ ID NO: 2322226 - RNA, 14 nt, Human
gucaugaucucccu

SEQ ID NO: 2322227 - RNA, 16 nt, Human
gucaugagcugagcag

SEQ ID NO: 2322228 - RNA, 20 nt, Human
gucaugaauucuuaugcuua

SEQ ID NO: 2322229 - RNA, 18 nt, Human
gucaugagcugagcaggg

SEQ ID NO: 2322230 - RNA, 14 nt, Human
gucaugaagcccaa

SEQ ID NO: 2322231 - RNA, 22 nt, Human
gucaucuuuuucucuaaaauag

SEQ ID NO: 2322232 - RNA, 18 nt, Human
gucaugaacauguuccug

SEQ ID NO: 2322233 - RNA, 18 nt, Human
gucaucuuuuucucuaaa

SEQ ID NO: 2322234 - RNA, 22 nt, Human
gucaucuugaccaagcaggaag

SEQ ID NO: 2322235 - RNA, 20 nt, Human
gucaucuugaccaagcagga

SEQ ID NO: 2322236 - RNA, 16 nt, Human
gucaucugguagauuu

SEQ ID NO: 2322237 - RNA, 18 nt, Human
gucaucuugaccaagcag

SEQ ID NO: 2322238 - RNA, 19 nt, Human
gucaugaucucccugccgc

SEQ ID NO: 2322239 - RNA, 18 nt, Human
gucaugaucucccugccg

SEQ ID NO: 2322240 - RNA, 17 nt, Human
gucaugaucucccugcc

SEQ ID NO: 2322241 - RNA, 16 nt, Human
gucaugaucucccugc

SEQ ID NO: 2322242 - RNA, 22 nt, Human
gucaugaucucccugccgccuc

SEQ ID NO: 2322243 - RNA, 20 nt, Human
gucaugaucucccugccgcc

SEQ ID NO: 2322244 - RNA, 15 nt, Human
gucaugauggcacca

SEQ ID NO: 2322245 - RNA, 16 nt, Human
gucaugcaaaggcugg

SEQ ID NO: 2322246 - RNA, 17 nt, Human
gucaugcaaaggcuggg

SEQ ID NO: 2322247 - RNA, 18 nt, Human
gucaugcaaaggcuggga

SEQ ID NO: 2322248 - RNA, 13 nt, Human
gucaugcauaaau

SEQ ID NO: 2322249 - RNA, 14 nt, Human
gucaugcauaaaua

SEQ ID NO: 2322250 - RNA, 17 nt, Human
gucaugcauaaauaugc

SEQ ID NO: 2322251 - RNA, 18 nt, Human
gucaugcauaaauaugca

SEQ ID NO: 2322252 - RNA, 19 nt, Human
gucaugcauaaauaugcag

SEQ ID NO: 2322253 - RNA, 15 nt, Human
gucaugccccccuca

SEQ ID NO: 2322254 - RNA, 16 nt, Human
gucaugccccccucaa

SEQ ID NO: 2322255 - RNA, 16 nt, Human
gucagccagggccagg

SEQ ID NO: 2322256 - RNA, 22 nt, Human
gucagcccaaaccaccagaagc

SEQ ID NO: 2322257 - RNA, 23 nt, Human
gucagcccaaaccaccagaagcc

SEQ ID NO: 2322258 - RNA, 22 nt, Human
gucagcccuaggguggagagcc

SEQ ID NO: 2322259 - RNA, 13 nt, Human
gucagcccuaggg

SEQ ID NO: 2322260 - RNA, 11 nt, Human
gucagccaggg

SEQ ID NO: 2322261 - RNA, 14 nt, Human
gucagccagggcca

SEQ ID NO: 2322262 - RNA, 12 nt, Human
gucagccagggc

SEQ ID NO: 2322263 - RNA, 15 nt, Human
gucagccagggccag

SEQ ID NO: 2322264 - RNA, 15 nt, Human
gucagccaaauguaa

SEQ ID NO: 2322265 - RNA, 13 nt, Human
gucagcaggaagc

SEQ ID NO: 2322266 - RNA, 23 nt, Human
gucagcagccucccugaagacca

SEQ ID NO: 2322267 - RNA, 20 nt, Human
gucagcagccucccugaaga

SEQ ID NO: 2322268 - RNA, 17 nt, Human
gucagcaaauuaauugg

SEQ ID NO: 2322269 - RNA, 22 nt, Human
gucagcaaauuaauuggcagca

SEQ ID NO: 2322270 - RNA, 22 nt, Human
gucacguggaggagcagugcag

SEQ ID NO: 2322271 - RNA, 13 nt, Human
gucaccugugcuu

SEQ ID NO: 2322272 - RNA, 23 nt, Human
gucaccugcccagaucccagaag

SEQ ID NO: 2322273 - RNA, 21 nt, Human
gucaccucagagacauacacc

SEQ ID NO: 2322274 - RNA, 14 nt, Human
gucagcuacuaaug

SEQ ID NO: 2322275 - RNA, 17 nt, Human
gucauacaauccauucu

SEQ ID NO: 2322276 - RNA, 16 nt, Human
gucauaccaggccgcc

SEQ ID NO: 2322277 - RNA, 21 nt, Human
gucauacuaucuacucuccuc

SEQ ID NO: 2322278 - RNA, 20 nt, Human
gucauacuaucuacucuccu

SEQ ID NO: 2322279 - RNA, 16 nt, Human
gucauaccaaugaaaa

SEQ ID NO: 2322280 - RNA, 15 nt, Human
gucauaccaaugaaa

SEQ ID NO: 2322281 - RNA, 22 nt, Human
gucauacuaucuacucuccuca

SEQ ID NO: 2322282 - RNA, 22 nt, Human
gucauagaaauuacacccaaag

SEQ ID NO: 2322283 - RNA, 13 nt, Human
gucauagaaauua

SEQ ID NO: 2322284 - RNA, 16 nt, Human
gucagcguugcauguc

SEQ ID NO: 2322285 - RNA, 18 nt, Human
gucagcguugcaugucgu

SEQ ID NO: 2322286 - RNA, 19 nt, Human
gucagcguugcaugucgug

SEQ ID NO: 2322287 - RNA, 22 nt, Human
gucagccuucccccucccaggg

SEQ ID NO: 2322288 - RNA, 20 nt, Human
gucagccucucucccagucu

SEQ ID NO: 2322289 - RNA, 21 nt, Human
gucagccucucucccagucua

SEQ ID NO: 2322290 - RNA, 21 nt, Human
gucagcgcagguuuaguuuac

SEQ ID NO: 2322291 - RNA, 20 nt, Human
gucagcgugcuuagccuccu

SEQ ID NO: 2322292 - RNA, 15 nt, Human
gucagcguugcaugu

SEQ ID NO: 2322293 - RNA, 11 nt, Human
gucagccucuc

SEQ ID NO: 2322294 - RNA, 16 nt, Human
gucagccucucuccca

SEQ ID NO: 2322295 - RNA, 15 nt, Human
gucagccuccagccu

SEQ ID NO: 2322296 - RNA, 16 nt, Human
gucagccuccagccuc

SEQ ID NO: 2322297 - RNA, 18 nt, Human
gucagccuccagccucug

SEQ ID NO: 2322298 - RNA, 19 nt, Human
gucagccuccagccucugu

SEQ ID NO: 2322299 - RNA, 16 nt, Human
gucagccgagccgggc

SEQ ID NO: 2322300 - RNA, 20 nt, Human
gucagccgagccgggccugg

SEQ ID NO: 2322301 - RNA, 21 nt, Human
gucagccgagccgggccuggg

SEQ ID NO: 2322302 - RNA, 15 nt, Human
gucagccgggcccug

SEQ ID NO: 2322303 - RNA, 16 nt, Human
gucagccgggcccuga

SEQ ID NO: 2322304 - RNA, 17 nt, Human
gucagccgggcccugag

SEQ ID NO: 2322305 - RNA, 12 nt, Human
gucagccuccag

SEQ ID NO: 2322306 - RNA, 14 nt, Human
gucagccuccagcc

SEQ ID NO: 2322307 - RNA, 20 nt, Human
gggccuggcgggaugggcca

SEQ ID NO: 2322308 - RNA, 19 nt, Human
gggccuggccugagcuggg

SEQ ID NO: 2322309 - RNA, 12 nt, Human
gggccuggcuca

SEQ ID NO: 2322310 - RNA, 22 nt, Human
gggccuggcagccgugccuuca

SEQ ID NO: 2322311 - RNA, 12 nt, Human
gggccuggccug

SEQ ID NO: 2322312 - RNA, 10 nt, Human
gggccuggca

SEQ ID NO: 2322313 - RNA, 18 nt, Human
gggccuggagcaggccuu

SEQ ID NO: 2322314 - RNA, 20 nt, Human
gggccuggauucauuuccug

SEQ ID NO: 2322315 - RNA, 21 nt, Human
gggccuggauucauuuccugc

SEQ ID NO: 2322316 - RNA, 19 nt, Human
gggccuggucccugggagg

SEQ ID NO: 2322317 - RNA, 22 nt, Human
gggccuggcgggaugggccacc

SEQ ID NO: 2322318 - RNA, 18 nt, Human
gggccuggucguuuucaa

SEQ ID NO: 2322319 - RNA, 14 nt, Human
gggccuggcucagg

SEQ ID NO: 2322320 - RNA, 16 nt, Human
gggccuggcucaggug

SEQ ID NO: 2322321 - RNA, 20 nt, Human
ggcucccacaggcccuuccu

SEQ ID NO: 2322322 - RNA, 21 nt, Human
ggcucccacaggcccuuccuc

SEQ ID NO: 2322323 - RNA, 17 nt, Human
ggcucccacaggcagcu

SEQ ID NO: 2322324 - RNA, 13 nt, Human
gggcccggccagc

SEQ ID NO: 2322325 - RNA, 23 nt, Human
gggcccgcuugccucggcuccug

SEQ ID NO: 2322326 - RNA, 16 nt, Human
gggcccggccagccau

SEQ ID NO: 2322327 - RNA, 20 nt, Human
gggcccggccauguccuuag

SEQ ID NO: 2322328 - RNA, 13 nt, Human
gggcccgcuugcc

SEQ ID NO: 2322329 - RNA, 14 nt, Human
gggcccgcuugccu

SEQ ID NO: 2322330 - RNA, 20 nt, Human
gggcccgcuugccucggcuc

SEQ ID NO: 2322331 - RNA, 21 nt, Human
gggcccgcuugccucggcucc

SEQ ID NO: 2322332 - RNA, 23 nt, Human
gggcccuccugaaacuuacacac

SEQ ID NO: 2322333 - RNA, 12 nt, Human
gggcccuccuga

SEQ ID NO: 2322334 - RNA, 16 nt, Human
gggcccucucugcucu

SEQ ID NO: 2322335 - RNA, 13 nt, Human
gggccuggaccug

SEQ ID NO: 2322336 - RNA, 14 nt, Human
gggccuggaccugc

SEQ ID NO: 2322337 - RNA, 16 nt, Human
gggccuggaccugccu

SEQ ID NO: 2322338 - RNA, 12 nt, Human
gggccuggagau

SEQ ID NO: 2322339 - RNA, 21 nt, Human
gggccuggagauccuccugca

SEQ ID NO: 2322340 - RNA, 23 nt, Human
gggcccuccgacagcccccucug

SEQ ID NO: 2322341 - RNA, 16 nt, Human
gggcccuccgacagcc

SEQ ID NO: 2322342 - RNA, 19 nt, Human
gggcccuccgacagccccc

SEQ ID NO: 2322343 - RNA, 21 nt, Human
gggcccguugucucccuggcc

SEQ ID NO: 2322344 - RNA, 22 nt, Human
gggcccguugucucccuggccc

SEQ ID NO: 2322345 - RNA, 23 nt, Human
gggcccguugucucccuggcccu

SEQ ID NO: 2322346 - RNA, 14 nt, Human
gggcccucccuugg

SEQ ID NO: 2322347 - RNA, 16 nt, Human
gggcccguugucuccc

SEQ ID NO: 2322348 - RNA, 18 nt, Human
gggcccguugucucccug

SEQ ID NO: 2322349 - RNA, 20 nt, Human
gggcccguugucucccuggc

SEQ ID NO: 2322350 - RNA, 17 nt, Human
gggcccguugaggauga

SEQ ID NO: 2322351 - RNA, 22 nt, Human
gggcgccgcaaaccacacugga

SEQ ID NO: 2322352 - RNA, 15 nt, Human
gggcgcggccagccc

SEQ ID NO: 2322353 - RNA, 15 nt, Human
gggcgcccuggaagc

SEQ ID NO: 2322354 - RNA, 22 nt, Human
gggcgccuguagucccagccac

SEQ ID NO: 2322355 - RNA, 22 nt, Human
gggcgaucgcggcggagcuggc

SEQ ID NO: 2322356 - RNA, 13 nt, Human
gggcgcccaccuc

SEQ ID NO: 2322357 - RNA, 18 nt, Human
gggcgagucacugccucu

SEQ ID NO: 2322358 - RNA, 14 nt, Human
gggcgcccuggaag

SEQ ID NO: 2322359 - RNA, 21 nt, Human
gggcgcccaccuccccacgcc

SEQ ID NO: 2322360 - RNA, 18 nt, Human
gggcgaucgcggcggagc

SEQ ID NO: 2322361 - RNA, 13 nt, Human
gggcgaggcagag

SEQ ID NO: 2322362 - RNA, 16 nt, Human
gggcgaggcagaggac

SEQ ID NO: 2322363 - RNA, 12 nt, Human
gggcgaggcaga

SEQ ID NO: 2322364 - RNA, 20 nt, Human
gggcgagacuccgucucaaa

SEQ ID NO: 2322365 - RNA, 19 nt, Human
gggcgaagcccaggccccu

SEQ ID NO: 2322366 - RNA, 20 nt, Human
gggcgaccccgucacagccu

SEQ ID NO: 2322367 - RNA, 16 nt, Human
gggccuuuggcaggug

SEQ ID NO: 2322368 - RNA, 23 nt, Human
gggccuugcuaccucaaggggga

SEQ ID NO: 2322369 - RNA, 22 nt, Human
gggccuuggccuccccugcuga

SEQ ID NO: 2322370 - RNA, 22 nt, Human
gggccuugcccagagaugccuc

SEQ ID NO: 2322371 - RNA, 21 nt, Human
gggccuugcgguauccgcccc

SEQ ID NO: 2322372 - RNA, 17 nt, Human
gggccuugcccagagau

SEQ ID NO: 2322373 - RNA, 15 nt, Human
gggccuugcccagag

SEQ ID NO: 2322374 - RNA, 14 nt, Human
gggccuugcccaga

SEQ ID NO: 2322375 - RNA, 12 nt, Human
gggccuugccca

SEQ ID NO: 2322376 - RNA, 20 nt, Human
gggcgcucgcuuccgcaucc

SEQ ID NO: 2322377 - RNA, 18 nt, Human
gggcgcggccagccccgg

SEQ ID NO: 2322378 - RNA, 23 nt, Human
gggcgcggccagccccggcccug

SEQ ID NO: 2322379 - RNA, 16 nt, Human
gggcgcgguggcucac

SEQ ID NO: 2322380 - RNA, 13 nt, Human
gggcucccuuccc

SEQ ID NO: 2322381 - RNA, 21 nt, Human
gggcucccuguaaccucuuca

SEQ ID NO: 2322382 - RNA, 18 nt, Human
gggcucccugacugggag

SEQ ID NO: 2322383 - RNA, 14 nt, Human
gggcucccugacug

SEQ ID NO: 2322384 - RNA, 12 nt, Human
gggcgcuggccc

SEQ ID NO: 2322385 - RNA, 13 nt, Human
gggcgcuggccca

SEQ ID NO: 2322386 - RNA, 14 nt, Human
gggcucccuuccca

SEQ ID NO: 2322387 - RNA, 17 nt, Human
gggcucccuucccaccu

SEQ ID NO: 2322388 - RNA, 18 nt, Human
gggcucccuucccaccuc

SEQ ID NO: 2322389 - RNA, 23 nt, Human
gggcucccuucccaccucucuca

SEQ ID NO: 2322390 - RNA, 14 nt, Human
gggcuuagagcagu

SEQ ID NO: 2322391 - RNA, 24 nt, Human
gggcuuagagcaguuucuguccug

SEQ ID NO: 2322392 - RNA, 21 nt, Human
gggcuucaaccuugagacagc

SEQ ID NO: 2322393 - RNA, 14 nt, Human
gggcuucaguggca

SEQ ID NO: 2322394 - RNA, 13 nt, Human
gggcuuagagcag

SEQ ID NO: 2322395 - RNA, 15 nt, Human
gggcuuaagaaaucu

SEQ ID NO: 2322396 - RNA, 11 nt, Human
gggcugugcua

SEQ ID NO: 2322397 - RNA, 16 nt, Human
gggcuguuggcacuca

SEQ ID NO: 2322398 - RNA, 12 nt, Human
gggcugugaucg

SEQ ID NO: 2322399 - RNA, 17 nt, Human
gggcugucaucugugca

SEQ ID NO: 2322400 - RNA, 19 nt, Human
gggcuguccaguucccaga

SEQ ID NO: 2322401 - RNA, 14 nt, Human
gggcugagggagcc

SEQ ID NO: 2322402 - RNA, 23 nt, Human
gggcugguucuguaauugugugu

SEQ ID NO: 2322403 - RNA, 16 nt, Human
gggcugucaucugugc

SEQ ID NO: 2322404 - RNA, 18 nt, Human
gggcuguaaaaugcauga

SEQ ID NO: 2322405 - RNA, 16 nt, Human
gggcugaggugggagg

SEQ ID NO: 2322406 - RNA, 14 nt, Human
gggcugcaccggcu

SEQ ID NO: 2322407 - RNA, 15 nt, Human
gggcugagcccuggc

SEQ ID NO: 2322408 - RNA, 13 nt, Human
gggcugagcccug

SEQ ID NO: 2322409 - RNA, 18 nt, Human
gggcugagagaaccucac

SEQ ID NO: 2322410 - RNA, 14 nt, Human
gggcugagccccua

SEQ ID NO: 2322411 - RNA, 15 nt, Human
gggcugagccccuac

SEQ ID NO: 2322412 - RNA, 23 nt, Human
gggcugagccccuaccccacacc

SEQ ID NO: 2322413 - RNA, 17 nt, Human
gggcugagcccuggcag

SEQ ID NO: 2322414 - RNA, 16 nt, Human
gggcugagcccuggca

SEQ ID NO: 2322415 - RNA, 18 nt, Human
gggcugagcccuggcagg

SEQ ID NO: 2322416 - RNA, 16 nt, Human
gggcugagcugccugu

SEQ ID NO: 2322417 - RNA, 23 nt, Human
gggcugagcuggggaccugguac

SEQ ID NO: 2322418 - RNA, 13 nt, Human
gggcugagggagc

SEQ ID NO: 2322419 - RNA, 12 nt, Human
gggcugagggag

SEQ ID NO: 2322420 - RNA, 13 nt, Human
gggcucuggagag

SEQ ID NO: 2322421 - RNA, 14 nt, Human
gggcucuggagaga

SEQ ID NO: 2322422 - RNA, 15 nt, Human
gggcucuggagagaa

SEQ ID NO: 2322423 - RNA, 21 nt, Human
gggcucugccccagcucuggc

SEQ ID NO: 2322424 - RNA, 20 nt, Human
gggcucugccccagcucugg

SEQ ID NO: 2322425 - RNA, 12 nt, Human
gggcucuucuca

SEQ ID NO: 2322426 - RNA, 14 nt, Human
gggcucugugggcu

SEQ ID NO: 2322427 - RNA, 16 nt, Human
gggcucugugggcugc

SEQ ID NO: 2322428 - RNA, 16 nt, Human
gggcucugugcaguca

SEQ ID NO: 2322429 - RNA, 16 nt, Human
gggcucuggagagaaa

SEQ ID NO: 2322430 - RNA, 11 nt, Human
gggcucugugg

SEQ ID NO: 2322431 - RNA, 18 nt, Human
gggcugaacggggagaaa

SEQ ID NO: 2322432 - RNA, 19 nt, Human
gggcucugugggcugcacu

SEQ ID NO: 2322433 - RNA, 15 nt, Human
gggcucuucucauuu

SEQ ID NO: 2322434 - RNA, 17 nt, Human
gggcugaagguugaaga

SEQ ID NO: 2322435 - RNA, 19 nt, Human
gggcugaagguugaagagg

SEQ ID NO: 2322436 - RNA, 16 nt, Human
gggcugaccuuccucg

SEQ ID NO: 2322437 - RNA, 20 nt, Human
gggcugaccuuccucgcaga

SEQ ID NO: 2322438 - RNA, 20 nt, Human
gggcugacuagaagggccag

SEQ ID NO: 2322439 - RNA, 21 nt, Human
gggcugaccuuccucgcagag

SEQ ID NO: 2322440 - RNA, 23 nt, Human
gggcugaccuuccucgcagagag

SEQ ID NO: 2322441 - RNA, 10 nt, Human
gggcugagac

SEQ ID NO: 2322442 - RNA, 14 nt, Human
gggcugacugggac

SEQ ID NO: 2322443 - RNA, 23 nt, Human
gggcuccuggaaaggcucagucu

SEQ ID NO: 2322444 - RNA, 20 nt, Human
gggcuccuggaaaggcucag

SEQ ID NO: 2322445 - RNA, 12 nt, Human
gggcuccuggaa

SEQ ID NO: 2322446 - RNA, 11 nt, Human
gggcuccugga

SEQ ID NO: 2322447 - RNA, 21 nt, Human
gggcuccugccuucuguccug

SEQ ID NO: 2322448 - RNA, 14 nt, Human
gggcuccugugccc

SEQ ID NO: 2322449 - RNA, 15 nt, Human
gggcuccugugcccu

SEQ ID NO: 2322450 - RNA, 14 nt, Human
gggcgcuggcccag

SEQ ID NO: 2322451 - RNA, 13 nt, Human
gggcucccuucau

SEQ ID NO: 2322452 - RNA, 11 nt, Human
gggcuccugca

SEQ ID NO: 2322453 - RNA, 18 nt, Human
gggcuccugcacuuacuu

SEQ ID NO: 2322454 - RNA, 22 nt, Human
gggcuccugcacuuacuugcuu

SEQ ID NO: 2322455 - RNA, 17 nt, Human
gggcuccugccuucugu

SEQ ID NO: 2322456 - RNA, 18 nt, Human
gggcuccugccuucuguc

SEQ ID NO: 2322457 - RNA, 21 nt, Human
gggcucuccaccucagccuug

SEQ ID NO: 2322458 - RNA, 19 nt, Human
gggcucuccaccucagccu

SEQ ID NO: 2322459 - RNA, 18 nt, Human
gggcucuccaccucagcc

SEQ ID NO: 2322460 - RNA, 17 nt, Human
gggcucuccaccucagc

SEQ ID NO: 2322461 - RNA, 14 nt, Human
gggcucuccaccuc

SEQ ID NO: 2322462 - RNA, 13 nt, Human
gggcucuccaccu

SEQ ID NO: 2322463 - RNA, 23 nt, Human
gggcucucauguuuucaacugcc

SEQ ID NO: 2322464 - RNA, 13 nt, Human
gggcucucagcuc

SEQ ID NO: 2322465 - RNA, 18 nt, Human
gggcuccuuucuccagcc

SEQ ID NO: 2322466 - RNA, 22 nt, Human
gggcuccuuucuccagccagca

SEQ ID NO: 2322467 - RNA, 20 nt, Human
gggcuccuuucuccagccag

SEQ ID NO: 2322468 - RNA, 21 nt, Human
gggcuccuuucuccagccagc

SEQ ID NO: 2322469 - RNA, 14 nt, Human
gggcucgccaugcc

SEQ ID NO: 2322470 - RNA, 20 nt, Human
gggcucgccaugccgggggu

SEQ ID NO: 2322471 - RNA, 14 nt, Human
gggcucggaggcug

SEQ ID NO: 2322472 - RNA, 17 nt, Human
gggcucgucuuugcaga

SEQ ID NO: 2322473 - RNA, 15 nt, Human
gggcucggaggcugc

SEQ ID NO: 2322474 - RNA, 14 nt, Human
gggcucgucuuugc

SEQ ID NO: 2322475 - RNA, 19 nt, Human
gggcucucugcuguacaua

SEQ ID NO: 2322476 - RNA, 20 nt, Human
gggcucugcaauuccccucu

SEQ ID NO: 2322477 - RNA, 21 nt, Human
gggcucugcaauuccccucug

SEQ ID NO: 2322478 - RNA, 23 nt, Human
gggcucugcaauuccccucugcu

SEQ ID NO: 2322479 - RNA, 19 nt, Human
gggcucugccccagcucug

SEQ ID NO: 2322480 - RNA, 15 nt, Human
gggcucugccacccu

SEQ ID NO: 2322481 - RNA, 23 nt, Human
gggcucugccccagaggccucuc

SEQ ID NO: 2322482 - RNA, 12 nt, Human
gggcucugcccc

SEQ ID NO: 2322483 - RNA, 11 nt, Human
gggcucugccc

SEQ ID NO: 2322484 - RNA, 13 nt, Human
gggcucugccucc

SEQ ID NO: 2322485 - RNA, 15 nt, Human
gggcucugccuccca

SEQ ID NO: 2322486 - RNA, 16 nt, Human
gggcucugccucccau

SEQ ID NO: 2322487 - RNA, 17 nt, Human
gggcucugccucccauc

SEQ ID NO: 2322488 - RNA, 20 nt, Human
gggcucugccucccaucacc

SEQ ID NO: 2322489 - RNA, 20 nt, Human
ggggagggugacaguggccg

SEQ ID NO: 2322490 - RNA, 12 nt, Human
ggggaggagggc

SEQ ID NO: 2322491 - RNA, 16 nt, Human
ggggagucugaagcag

SEQ ID NO: 2322492 - RNA, 14 nt, Human
ggggaguaugcaaa

SEQ ID NO: 2322493 - RNA, 18 nt, Human
ggggaggaaacucaccug

SEQ ID NO: 2322494 - RNA, 11 nt, Human
ggggagcccuc

SEQ ID NO: 2322495 - RNA, 22 nt, Human
ggggagccccuucugcucagcu

SEQ ID NO: 2322496 - RNA, 19 nt, Human
ggggagugggacagagucu

SEQ ID NO: 2322497 - RNA, 13 nt, Human
ggggaguggaaua

SEQ ID NO: 2322498 - RNA, 17 nt, Human
ggggagucugaagcaga

SEQ ID NO: 2322499 - RNA, 11 nt, Human
ggggaguggaa

SEQ ID NO: 2322500 - RNA, 21 nt, Human
ggggaguuaagaccuggcagc

SEQ ID NO: 2322501 - RNA, 17 nt, Human
ggggaguuaagaccugg

SEQ ID NO: 2322502 - RNA, 13 nt, Human
ggggaguggccac

SEQ ID NO: 2322503 - RNA, 14 nt, Human
ggggagcagagaca

SEQ ID NO: 2322504 - RNA, 11 nt, Human
ggggagcaggg

SEQ ID NO: 2322505 - RNA, 19 nt, Human
ggggagcccacuguccugg

SEQ ID NO: 2322506 - RNA, 11 nt, Human
ggggagcccac

SEQ ID NO: 2322507 - RNA, 18 nt, Human
ggggagacugggcugagg

SEQ ID NO: 2322508 - RNA, 18 nt, Human
ggggagagcaggcuggca

SEQ ID NO: 2322509 - RNA, 14 nt, Human
ggggagagccugcu

SEQ ID NO: 2322510 - RNA, 16 nt, Human
ggggagagccugcugg

SEQ ID NO: 2322511 - RNA, 18 nt, Human
ggggagagccugcuggca

SEQ ID NO: 2322512 - RNA, 19 nt, Human
ggggagaacuuacauugug

SEQ ID NO: 2322513 - RNA, 17 nt, Human
ggggagacugggcugag

SEQ ID NO: 2322514 - RNA, 21 nt, Human
gggcuuggggaccagagcugc

SEQ ID NO: 2322515 - RNA, 20 nt, Human
ggggagugggacagagucug

SEQ ID NO: 2322516 - RNA, 20 nt, Human
ggggaguuucuuuccugccu

SEQ ID NO: 2322517 - RNA, 13 nt, Human
ggggauaugcuua

SEQ ID NO: 2322518 - RNA, 13 nt, Human
ggggaucacagag

SEQ ID NO: 2322519 - RNA, 22 nt, Human
ggggaucaucugccgugccugg

SEQ ID NO: 2322520 - RNA, 21 nt, Human
ggggaucccucccccccaugc

SEQ ID NO: 2322521 - RNA, 14 nt, Human
ggggaugugggagg

SEQ ID NO: 2322522 - RNA, 21 nt, Human
ggggaugacuagaggcaggga

SEQ ID NO: 2322523 - RNA, 20 nt, Human
ggggaugagagggugcuauc

SEQ ID NO: 2322524 - RNA, 23 nt, Human
ggggaucccucccccccaugcac

SEQ ID NO: 2322525 - RNA, 13 nt, Human
ggggaucucaggg

SEQ ID NO: 2322526 - RNA, 17 nt, Human
ggggaucacagccucug

SEQ ID NO: 2322527 - RNA, 13 nt, Human
ggggauagaugug

SEQ ID NO: 2322528 - RNA, 21 nt, Human
ggggcagccaaacccaugagg

SEQ ID NO: 2322529 - RNA, 15 nt, Human
ggggcagcccuugcu

SEQ ID NO: 2322530 - RNA, 22 nt, Human
ggggcagagggcagaggcugga

SEQ ID NO: 2322531 - RNA, 18 nt, Human
ggggcagagggcagaggc

SEQ ID NO: 2322532 - RNA, 14 nt, Human
ggggcagcugccag

SEQ ID NO: 2322533 - RNA, 20 nt, Human
ggggcagcugauacaaauug

SEQ ID NO: 2322534 - RNA, 20 nt, Human
ggggcagcgggggccaggga

SEQ ID NO: 2322535 - RNA, 13 nt, Human
ggggcagcugacc

SEQ ID NO: 2322536 - RNA, 16 nt, Human
ggggcagagggcagag

SEQ ID NO: 2322537 - RNA, 18 nt, Human
ggggaugugggagggagc

SEQ ID NO: 2322538 - RNA, 19 nt, Human
gggcuugcaaguauguuuu

SEQ ID NO: 2322539 - RNA, 13 nt, Human
gggcuugacuuuu

SEQ ID NO: 2322540 - RNA, 16 nt, Human
gggcuugacuuuugua

SEQ ID NO: 2322541 - RNA, 13 nt, Human
gggcuugaagcca

SEQ ID NO: 2322542 - RNA, 15 nt, Human
gggcuugaagccaaa

SEQ ID NO: 2322543 - RNA, 17 nt, Human
gggcuugaagccaaaga

SEQ ID NO: 2322544 - RNA, 15 nt, Human
gggcuucugcacccu

SEQ ID NO: 2322545 - RNA, 16 nt, Human
gggcuucugcacccuc

SEQ ID NO: 2322546 - RNA, 17 nt, Human
gggcuucugcacccucc

SEQ ID NO: 2322547 - RNA, 18 nt, Human
gggcuucugcacccucca

SEQ ID NO: 2322548 - RNA, 19 nt, Human
gggcuucugcacccuccac

SEQ ID NO: 2322549 - RNA, 21 nt, Human
gggcuucugcacccuccaccc

SEQ ID NO: 2322550 - RNA, 23 nt, Human
gggcuucugcacccuccacccug

SEQ ID NO: 2322551 - RNA, 20 nt, Human
gggcuuggggaccagagcug

SEQ ID NO: 2322552 - RNA, 13 nt, Human
gggcuuggccugc

SEQ ID NO: 2322553 - RNA, 16 nt, Human
gggcuuggccugcugu

SEQ ID NO: 2322554 - RNA, 17 nt, Human
gggcuuggccugcugug

SEQ ID NO: 2322555 - RNA, 23 nt, Human
gggcuuccauuugugugugugca

SEQ ID NO: 2322556 - RNA, 20 nt, Human
gggcuucccaguggcugcug

SEQ ID NO: 2322557 - RNA, 19 nt, Human
gggcuucauacacaugaga

SEQ ID NO: 2322558 - RNA, 20 nt, Human
gggcuucauccuccucagau

SEQ ID NO: 2322559 - RNA, 19 nt, Human
gggcuuccucuagaagcca

SEQ ID NO: 2322560 - RNA, 21 nt, Human
gggcuucccaguggcugcugc

SEQ ID NO: 2322561 - RNA, 22 nt, Human
gggcuucccaguggcugcugcc

SEQ ID NO: 2322562 - RNA, 23 nt, Human
gggcuucccaguggcugcugccc

SEQ ID NO: 2322563 - RNA, 13 nt, Human
gggcuucuccuga

SEQ ID NO: 2322564 - RNA, 16 nt, Human
gggcuucuccugaccc

SEQ ID NO: 2322565 - RNA, 14 nt, Human
gggcuucugcaccc

SEQ ID NO: 2322566 - RNA, 19 nt, Human
gggcuucaguggcagcugc

SEQ ID NO: 2322567 - RNA, 20 nt, Human
gggcuucaguggcagcugcu

SEQ ID NO: 2322568 - RNA, 19 nt, Human
gggcuucauccuccucaga

SEQ ID NO: 2322569 - RNA, 13 nt, Human
gggcuucauacac

SEQ ID NO: 2322570 - RNA, 16 nt, Human
gggcuucacuguauaa

SEQ ID NO: 2322571 - RNA, 15 nt, Human
gggcuucaguggcag

SEQ ID NO: 2322572 - RNA, 16 nt, Human
gggcuucaguggcagc

SEQ ID NO: 2322573 - RNA, 17 nt, Human
gggcuucaguggcagcu

SEQ ID NO: 2322574 - RNA, 18 nt, Human
gggcuucaguggcagcug

SEQ ID NO: 2322575 - RNA, 13 nt, Human
ggggcugcccgcu

SEQ ID NO: 2322576 - RNA, 15 nt, Human
ggggcugcccgcucc

SEQ ID NO: 2322577 - RNA, 16 nt, Human
ggggcugcccgcuccc

SEQ ID NO: 2322578 - RNA, 23 nt, Human
ggggcugcccgcucccagugucu

SEQ ID NO: 2322579 - RNA, 11 nt, Human
ggggcagucug

SEQ ID NO: 2322580 - RNA, 13 nt, Human
ggggcugcagcau

SEQ ID NO: 2322581 - RNA, 21 nt, Human
ggggcagggaaggggaggcag

SEQ ID NO: 2322582 - RNA, 14 nt, Human
ggggcagucaccug

SEQ ID NO: 2322583 - RNA, 16 nt, Human
ggggcugcuccuccag

SEQ ID NO: 2322584 - RNA, 15 nt, Human
ggggcugcuccucca

SEQ ID NO: 2322585 - RNA, 14 nt, Human
ggggcugcuccucc

SEQ ID NO: 2322586 - RNA, 21 nt, Human
ggggcugcugaccuccacagc

SEQ ID NO: 2322587 - RNA, 20 nt, Human
ggggcugcuccuccagggcc

SEQ ID NO: 2322588 - RNA, 15 nt, Human
ggggcugcuggccug

SEQ ID NO: 2322589 - RNA, 16 nt, Human
ggggcugcuuccuccu

SEQ ID NO: 2322590 - RNA, 18 nt, Human
ggggcugcuuccuccugg

SEQ ID NO: 2322591 - RNA, 19 nt, Human
ggggcugcuuccuccugga

SEQ ID NO: 2322592 - RNA, 12 nt, Human
ggggcaggcagu

SEQ ID NO: 2322593 - RNA, 11 nt, Human
ggggcaggcag

SEQ ID NO: 2322594 - RNA, 15 nt, Human
ggggcaggcacagca

SEQ ID NO: 2322595 - RNA, 17 nt, Human
ggggcaggcacagcaca

SEQ ID NO: 2322596 - RNA, 10 nt, Human
ggggcaggca

SEQ ID NO: 2322597 - RNA, 13 nt, Human
ggggcaggcacag

SEQ ID NO: 2322598 - RNA, 14 nt, Human
ggggcaggcacagc

SEQ ID NO: 2322599 - RNA, 16 nt, Human
ggggcaggagggcccu

SEQ ID NO: 2322600 - RNA, 19 nt, Human
ggggcagcugccagagaag

SEQ ID NO: 2322601 - RNA, 23 nt, Human
ggggcagcuucuauuagccaguc

SEQ ID NO: 2322602 - RNA, 13 nt, Human
ggggcaggcccug

SEQ ID NO: 2322603 - RNA, 15 nt, Human
ggggcaggcccugca

SEQ ID NO: 2322604 - RNA, 16 nt, Human
ggggcaggcccugcac

SEQ ID NO: 2322605 - RNA, 18 nt, Human
ggggcaggcccugcacug

SEQ ID NO: 2322606 - RNA, 21 nt, Human
ggggcaggcccugcacugucc

SEQ ID NO: 2322607 - RNA, 22 nt, Human
ggggcaggcccugcacuguccu

SEQ ID NO: 2322608 - RNA, 23 nt, Human
ggggcaggcccugcacuguccug

SEQ ID NO: 2322609 - RNA, 12 nt, Human
ggggcaggcuga

SEQ ID NO: 2322610 - RNA, 10 nt, Human
ggggcugggu

SEQ ID NO: 2322611 - RNA, 13 nt, Human
ggggcuggguugg

SEQ ID NO: 2322612 - RNA, 19 nt, Human
ggggcuggguuggcgcacc

SEQ ID NO: 2322613 - RNA, 19 nt, Human
ggggcuggcggcuacucag

SEQ ID NO: 2322614 - RNA, 16 nt, Human
ggggcuggccuuccug

SEQ ID NO: 2322615 - RNA, 19 nt, Human
ggggcuggccuuccugccc

SEQ ID NO: 2322616 - RNA, 22 nt, Human
ggggcuuagggucggaacccaa

SEQ ID NO: 2322617 - RNA, 19 nt, Human
ggggcugguagcucaggug

SEQ ID NO: 2322618 - RNA, 22 nt, Human
ggggcuggguuggcgcacccuc

SEQ ID NO: 2322619 - RNA, 23 nt, Human
ggggcuggguuggcgcacccucc

SEQ ID NO: 2322620 - RNA, 15 nt, Human
ggggcuuucuggaga

SEQ ID NO: 2322621 - RNA, 12 nt, Human
gggggaaagcac

SEQ ID NO: 2322622 - RNA, 17 nt, Human
ggggcuugaagccaaag

SEQ ID NO: 2322623 - RNA, 17 nt, Human
gggggaacucagaucca

SEQ ID NO: 2322624 - RNA, 12 nt, Human
ggggcuuauuuu

SEQ ID NO: 2322625 - RNA, 22 nt, Human
ggggcuucaaccuugagacagc

SEQ ID NO: 2322626 - RNA, 17 nt, Human
ggggcuggcacugacug

SEQ ID NO: 2322627 - RNA, 12 nt, Human
ggggcuggccua

SEQ ID NO: 2322628 - RNA, 13 nt, Human
ggggcugggacau

SEQ ID NO: 2322629 - RNA, 16 nt, Human
ggggcugggcagagga

SEQ ID NO: 2322630 - RNA, 17 nt, Human
ggggcugggcagaggaa

SEQ ID NO: 2322631 - RNA, 16 nt, Human
ggggugcccacaggcc

SEQ ID NO: 2322632 - RNA, 13 nt, Human
ggggugcccccuc

SEQ ID NO: 2322633 - RNA, 20 nt, Human
ggggugcccccuccucuccc

SEQ ID NO: 2322634 - RNA, 23 nt, Human
ggggugcccccuccucucccauc

SEQ ID NO: 2322635 - RNA, 17 nt, Human
ggggugauuucagagag

SEQ ID NO: 2322636 - RNA, 18 nt, Human
ggggugauuucagagagg

SEQ ID NO: 2322637 - RNA, 13 nt, Human
ggggugaggacca

SEQ ID NO: 2322638 - RNA, 18 nt, Human
ggggugacgccugcccuc

SEQ ID NO: 2322639 - RNA, 15 nt, Human
ggggugaggagcugg

SEQ ID NO: 2322640 - RNA, 14 nt, Human
ggggugaggagcug

SEQ ID NO: 2322641 - RNA, 22 nt, Human
ggggucuuugugagagugagcu

SEQ ID NO: 2322642 - RNA, 17 nt, Human
gggggaagagcacagcc

SEQ ID NO: 2322643 - RNA, 19 nt, Human
gggggaagagcacagcccu

SEQ ID NO: 2322644 - RNA, 16 nt, Human
gggguucagccccucc

SEQ ID NO: 2322645 - RNA, 17 nt, Human
ggggugccgccugcccg

SEQ ID NO: 2322646 - RNA, 13 nt, Human
ggggugccgccug

SEQ ID NO: 2322647 - RNA, 14 nt, Human
ggggugccgccugc

SEQ ID NO: 2322648 - RNA, 23 nt, Human
gggguucccuuuuuuggcugcug

SEQ ID NO: 2322649 - RNA, 20 nt, Human
gggguucuuucuuccucugc

SEQ ID NO: 2322650 - RNA, 22 nt, Human
gggguucuuucuuccucugcug

SEQ ID NO: 2322651 - RNA, 22 nt, Human
gggguucagccccuccucugcc

SEQ ID NO: 2322652 - RNA, 17 nt, Human
gggguucagccccuccu

SEQ ID NO: 2322653 - RNA, 20 nt, Human
gggguucauaggucacuggc

SEQ ID NO: 2322654 - RNA, 23 nt, Human
gggguucagccccuccucugcca

SEQ ID NO: 2322655 - RNA, 21 nt, Human
gggguucgagaccagucuggc

SEQ ID NO: 2322656 - RNA, 18 nt, Human
ggguacccacugcucugg

SEQ ID NO: 2322657 - RNA, 23 nt, Human
ggguaccuugaacacugggggag

SEQ ID NO: 2322658 - RNA, 19 nt, Human
ggguacauuucccugugcu

SEQ ID NO: 2322659 - RNA, 20 nt, Human
gggguugccacaggccuccc

SEQ ID NO: 2322660 - RNA, 13 nt, Human
ggguacccacugc

SEQ ID NO: 2322661 - RNA, 15 nt, Human
ggguacccacugcuc

SEQ ID NO: 2322662 - RNA, 19 nt, Human
ggguacuuguggacacagc

SEQ ID NO: 2322663 - RNA, 22 nt, Human
ggguacuuguggacacagcucu

SEQ ID NO: 2322664 - RNA, 23 nt, Human
ggguacuuguggacacagcucuu

SEQ ID NO: 2322665 - RNA, 23 nt, Human
ggguagagcggagaaaggaaggg

SEQ ID NO: 2322666 - RNA, 22 nt, Human
gguagacacacaugaaguccaa

SEQ ID NO: 2322667 - RNA, 23 nt, Human
gguacuuuuaugauguauauuua

SEQ ID NO: 2322668 - RNA, 15 nt, Human
gguagacacacauga

SEQ ID NO: 2322669 - RNA, 17 nt, Human
ggucaagcccaggagga

SEQ ID NO: 2322670 - RNA, 19 nt, Human
ggucaagcccaggaggacu

SEQ ID NO: 2322671 - RNA, 15 nt, Human
ggucaagcccaggag

SEQ ID NO: 2322672 - RNA, 13 nt, Human
ggucaagcccagg

SEQ ID NO: 2322673 - RNA, 20 nt, Human
ggucaagauuuugaaugcuu

SEQ ID NO: 2322674 - RNA, 17 nt, Human
gguagagauggaggagg

SEQ ID NO: 2322675 - RNA, 20 nt, Human
ggucaauacaguacaggcag

SEQ ID NO: 2322676 - RNA, 17 nt, Human
ggucaauccugugggug

SEQ ID NO: 2322677 - RNA, 22 nt, Human
ggucacaaauccuaaaagaagc

SEQ ID NO: 2322678 - RNA, 20 nt, Human
ggucaaguaagaagacauga

SEQ ID NO: 2322679 - RNA, 14 nt, Human
ggucacacacugau

SEQ ID NO: 2322680 - RNA, 13 nt, Human
ggucacagccucc

SEQ ID NO: 2322681 - RNA, 15 nt, Human
ggucacagccuccuc

SEQ ID NO: 2322682 - RNA, 15 nt, Human
ggucacagcggaggu

SEQ ID NO: 2322683 - RNA, 16 nt, Human
ggucacagccuccucu

SEQ ID NO: 2322684 - RNA, 17 nt, Human
ggucacagccuccucug

SEQ ID NO: 2322685 - RNA, 12 nt, Human
ggucacucuggc

SEQ ID NO: 2322686 - RNA, 12 nt, Human
ggucagagccug

SEQ ID NO: 2322687 - RNA, 22 nt, Human
ggucacucuggcagcucagaga

SEQ ID NO: 2322688 - RNA, 16 nt, Human
ggucacucuggcagcu

SEQ ID NO: 2322689 - RNA, 20 nt, Human
ggucacucuggcagcucaga

SEQ ID NO: 2322690 - RNA, 13 nt, Human
ggucagagccugc

SEQ ID NO: 2322691 - RNA, 14 nt, Human
ggucagagccugca

SEQ ID NO: 2322692 - RNA, 15 nt, Human
ggucagagccugcag

SEQ ID NO: 2322693 - RNA, 16 nt, Human
ggucagagccugcagu

SEQ ID NO: 2322694 - RNA, 13 nt, Human
ggucagccagggc

SEQ ID NO: 2322695 - RNA, 21 nt, Human
ggucagcaugucuauucagcu

SEQ ID NO: 2322696 - RNA, 18 nt, Human
ggucagccagggccaggg

SEQ ID NO: 2322697 - RNA, 12 nt, Human
ggucagccaggg

SEQ ID NO: 2322698 - RNA, 15 nt, Human
ggucagccagggcca

SEQ ID NO: 2322699 - RNA, 21 nt, Human
ggucacucuuccugcaaggac

SEQ ID NO: 2322700 - RNA, 22 nt, Human
ggucacucuuccugcaaggacu

SEQ ID NO: 2322701 - RNA, 22 nt, Human
ggucccaccccacacacgccag

SEQ ID NO: 2322702 - RNA, 23 nt, Human
ggucagcccaaaccaccagaagc

SEQ ID NO: 2322703 - RNA, 16 nt, Human
ggucagcguugcaugu

SEQ ID NO: 2322704 - RNA, 22 nt, Human
ggucccacucaguccauagcag

SEQ ID NO: 2322705 - RNA, 14 nt, Human
ggucccagccaccc

SEQ ID NO: 2322706 - RNA, 17 nt, Human
ggucccacuuccccucc

SEQ ID NO: 2322707 - RNA, 22 nt, Human
ggucccacgaauuugcugggga

SEQ ID NO: 2322708 - RNA, 12 nt, Human
ggucccacuucc

SEQ ID NO: 2322709 - RNA, 13 nt, Human
ggucccacuuccc

SEQ ID NO: 2322710 - RNA, 12 nt, Human
ggucccacucag

SEQ ID NO: 2322711 - RNA, 14 nt, Human
ggucccacucaguc

SEQ ID NO: 2322712 - RNA, 15 nt, Human
ggucccagccacccc

SEQ ID NO: 2322713 - RNA, 14 nt, Human
ggucccaggcagag

SEQ ID NO: 2322714 - RNA, 11 nt, Human
ggucccagugg

SEQ ID NO: 2322715 - RNA, 15 nt, Human
ggucccagugggagg

SEQ ID NO: 2322716 - RNA, 18 nt, Human
ggucccagugggaggggc

SEQ ID NO: 2322717 - RNA, 16 nt, Human
gguccccaccugggac

SEQ ID NO: 2322718 - RNA, 17 nt, Human
ggucccauccaggcagu

SEQ ID NO: 2322719 - RNA, 17 nt, Human
ggucccauuucucacug

SEQ ID NO: 2322720 - RNA, 14 nt, Human
ggucccauccaggc

SEQ ID NO: 2322721 - RNA, 16 nt, Human
ggucccauccaggcag

SEQ ID NO: 2322722 - RNA, 20 nt, Human
ggucccaucugcagggcccc

SEQ ID NO: 2322723 - RNA, 11 nt, Human
ggucccaucca

SEQ ID NO: 2322724 - RNA, 23 nt, Human
ggucccagugggaggggcaggcu

SEQ ID NO: 2322725 - RNA, 12 nt, Human
ggucccauccag

SEQ ID NO: 2322726 - RNA, 13 nt, Human
ggucccauccagg

SEQ ID NO: 2322727 - RNA, 19 nt, Human
ggucccagugggaggggca

SEQ ID NO: 2322728 - RNA, 20 nt, Human
ggucccagugggaggggcag

SEQ ID NO: 2322729 - RNA, 21 nt, Human
ggucccagugggaggggcagg

SEQ ID NO: 2322730 - RNA, 22 nt, Human
ggucccagugggaggggcaggc

SEQ ID NO: 2322731 - RNA, 18 nt, Human
ggucagcucccuucucug

SEQ ID NO: 2322732 - RNA, 16 nt, Human
gguccccaucauccca

SEQ ID NO: 2322733 - RNA, 18 nt, Human
gguccccaucaucccagc

SEQ ID NO: 2322734 - RNA, 21 nt, Human
gguccccaucaucccagcugc

SEQ ID NO: 2322735 - RNA, 13 nt, Human
ggucccccuucca

SEQ ID NO: 2322736 - RNA, 18 nt, Human
ggucccccuuccauggac

SEQ ID NO: 2322737 - RNA, 23 nt, Human
ggucccccuuccauggacuuugu

SEQ ID NO: 2322738 - RNA, 20 nt, Human
ggguuucaccauguuggcca

SEQ ID NO: 2322739 - RNA, 20 nt, Human
ggguuucacuguguuagcca

SEQ ID NO: 2322740 - RNA, 23 nt, Human
ggguugugaggccuggccaggca

SEQ ID NO: 2322741 - RNA, 16 nt, Human
gguacccacugcucug

SEQ ID NO: 2322742 - RNA, 17 nt, Human
gguacccacugcucugg

SEQ ID NO: 2322743 - RNA, 19 nt, Human
gguaccccuuucuggcucu

SEQ ID NO: 2322744 - RNA, 12 nt, Human
gguacccagcca

SEQ ID NO: 2322745 - RNA, 20 nt, Human
gguacccagccaucugccca

SEQ ID NO: 2322746 - RNA, 21 nt, Human
gguacccagccaucugcccag

SEQ ID NO: 2322747 - RNA, 16 nt, Human
gguacccccuucuggg

SEQ ID NO: 2322748 - RNA, 15 nt, Human
ggguugggcuggugu

SEQ ID NO: 2322749 - RNA, 22 nt, Human
ggguugggcccagaucuggucc

SEQ ID NO: 2322750 - RNA, 14 nt, Human
ggguugggcccaga

SEQ ID NO: 2322751 - RNA, 12 nt, Human
ggguugggccca

SEQ ID NO: 2322752 - RNA, 22 nt, Human
ggguuuaauccccaguaaaauu

SEQ ID NO: 2322753 - RNA, 23 nt, Human
ggguuuaauccccaguaaaauug

SEQ ID NO: 2322754 - RNA, 19 nt, Human
ggguuuaauccccaguaaa

SEQ ID NO: 2322755 - RNA, 15 nt, Human
ggguugugugucugu

SEQ ID NO: 2322756 - RNA, 14 nt, Human
ggguugugaggccu

SEQ ID NO: 2322757 - RNA, 18 nt, Human
ggguugguccucuugccu

SEQ ID NO: 2322758 - RNA, 21 nt, Human
ggguugugaggccuggccagg

SEQ ID NO: 2322759 - RNA, 21 nt, Human
ggguuggguucaucugagcaa

SEQ ID NO: 2322760 - RNA, 19 nt, Human
ggguuggugcacagugauu

SEQ ID NO: 2322761 - RNA, 22 nt, Human
gguacuuguggacacagcucuu

SEQ ID NO: 2322762 - RNA, 20 nt, Human
gguacuuguggacacagcuc

SEQ ID NO: 2322763 - RNA, 20 nt, Human
gguacuucaggggcacuuca

SEQ ID NO: 2322764 - RNA, 21 nt, Human
gguacuuuuaugauguauauu

SEQ ID NO: 2322765 - RNA, 22 nt, Human
gguacuuuuaugauguauauuu

SEQ ID NO: 2322766 - RNA, 21 nt, Human
gguacuuguggacacagcucu

SEQ ID NO: 2322767 - RNA, 22 nt, Human
gguacuucaaauccuugaagau

SEQ ID NO: 2322768 - RNA, 12 nt, Human
gguaccuugaac

SEQ ID NO: 2322769 - RNA, 14 nt, Human
gguaccuauuuuca

SEQ ID NO: 2322770 - RNA, 14 nt, Human
gguacccuccuggc

SEQ ID NO: 2322771 - RNA, 13 nt, Human
gguacccucugga

SEQ ID NO: 2322772 - RNA, 18 nt, Human
gguaccuugaacacuggg

SEQ ID NO: 2322773 - RNA, 16 nt, Human
gguacucuccuagaga

SEQ ID NO: 2322774 - RNA, 19 nt, Human
gguacuauucugauuacac

SEQ ID NO: 2322775 - RNA, 12 nt, Human
gguacucuccua

SEQ ID NO: 2322776 - RNA, 14 nt, Human
gguacucuccuaga

SEQ ID NO: 2322777 - RNA, 16 nt, Human
ggguagcuagaggaac

SEQ ID NO: 2322778 - RNA, 22 nt, Human
ggguagcccgccugccaguccu

SEQ ID NO: 2322779 - RNA, 15 nt, Human
ggguagcuagaggaa

SEQ ID NO: 2322780 - RNA, 18 nt, Human
gggugcugggccccugcc

SEQ ID NO: 2322781 - RNA, 19 nt, Human
gggugcugggccccugccu

SEQ ID NO: 2322782 - RNA, 12 nt, Human
ggguagcccgcc

SEQ ID NO: 2322783 - RNA, 14 nt, Human
ggguagcccgccug

SEQ ID NO: 2322784 - RNA, 18 nt, Human
ggguagcccgccugccag

SEQ ID NO: 2322785 - RNA, 21 nt, Human
ggguagcccgccugccagucc

SEQ ID NO: 2322786 - RNA, 22 nt, Human
ggguagcagguaccacugauuu

SEQ ID NO: 2322787 - RNA, 22 nt, Human
ggguagcagcuggacuacccac

SEQ ID NO: 2322788 - RNA, 15 nt, Human
ggguagcagcuggac

SEQ ID NO: 2322789 - RNA, 17 nt, Human
ggguagcagcuggacua

SEQ ID NO: 2322790 - RNA, 14 nt, Human
ggguagagcugauc

SEQ ID NO: 2322791 - RNA, 13 nt, Human
ggguagcagcugg

SEQ ID NO: 2322792 - RNA, 14 nt, Human
ggguagcagcugga

SEQ ID NO: 2322793 - RNA, 15 nt, Human
ggguucccccagccc

SEQ ID NO: 2322794 - RNA, 14 nt, Human
ggguucauuugugu

SEQ ID NO: 2322795 - RNA, 19 nt, Human
ggguuccagcaccacacuc

SEQ ID NO: 2322796 - RNA, 22 nt, Human
ggguuccagcaauucuccugcc

SEQ ID NO: 2322797 - RNA, 13 nt, Human
ggguucauuugug

SEQ ID NO: 2322798 - RNA, 14 nt, Human
ggguggauauaaau

SEQ ID NO: 2322799 - RNA, 21 nt, Human
ggguggauauaaauauauaua

SEQ ID NO: 2322800 - RNA, 16 nt, Human
ggguggaggcuuccug

SEQ ID NO: 2322801 - RNA, 23 nt, Human
ggguggagacugcuucccauccu

SEQ ID NO: 2322802 - RNA, 14 nt, Human
ggguggaggggugu

SEQ ID NO: 2322803 - RNA, 14 nt, Human
ggguggagaagcca

SEQ ID NO: 2322804 - RNA, 15 nt, Human
ggguggagaagccau

SEQ ID NO: 2322805 - RNA, 16 nt, Human
ggguggagaagccauu

SEQ ID NO: 2322806 - RNA, 22 nt, Human
ggguggagacugcuucccaucc

SEQ ID NO: 2322807 - RNA, 20 nt, Human
ggguggagaacuccuagggu

SEQ ID NO: 2322808 - RNA, 12 nt, Human
ggguggagaagc

SEQ ID NO: 2322809 - RNA, 13 nt, Human
ggguggagaagcc

SEQ ID NO: 2322810 - RNA, 20 nt, Human
gggugcuuuuauagaggcua

SEQ ID NO: 2322811 - RNA, 21 nt, Human
gggugcuuuuauagaggcuag

SEQ ID NO: 2322812 - RNA, 22 nt, Human
gggugcuuuuauagaggcuagc

SEQ ID NO: 2322813 - RNA, 15 nt, Human
ggguucucacagugg

SEQ ID NO: 2322814 - RNA, 17 nt, Human
ggguucuacccaggugc

SEQ ID NO: 2322815 - RNA, 22 nt, Human
ggguucuacccaggugcuagga

SEQ ID NO: 2322816 - RNA, 21 nt, Human
ggguucccuuuccuuccaucc

SEQ ID NO: 2322817 - RNA, 18 nt, Human
ggguucccuuuccuucca

SEQ ID NO: 2322818 - RNA, 14 nt, Human
ggguucccccagcc

SEQ ID NO: 2322819 - RNA, 23 nt, Human
ggguucccuuuuuuggcugcuga

SEQ ID NO: 2322820 - RNA, 18 nt, Human
ggguucuccucuccccuc

SEQ ID NO: 2322821 - RNA, 16 nt, Human
ggguucuccucucccc

SEQ ID NO: 2322822 - RNA, 20 nt, Human
ggguucugccugccagcugc

SEQ ID NO: 2322823 - RNA, 21 nt, Human
ggguucugccugccagcugca

SEQ ID NO: 2322824 - RNA, 16 nt, Human
ggguuggccccugccc

SEQ ID NO: 2322825 - RNA, 19 nt, Human
ggguuggccccugcccggc

SEQ ID NO: 2322826 - RNA, 20 nt, Human
ggguuggcugggcccagaag

SEQ ID NO: 2322827 - RNA, 22 nt, Human
ggguuggcgcacccuccccucc

SEQ ID NO: 2322828 - RNA, 20 nt, Human
ggguuggcgcacccuccccu

SEQ ID NO: 2322829 - RNA, 14 nt, Human
ggguucuuucuucc

SEQ ID NO: 2322830 - RNA, 18 nt, Human
ggugaagggagagccagc

SEQ ID NO: 2322831 - RNA, 16 nt, Human
ggugaagggagagcca

SEQ ID NO: 2322832 - RNA, 18 nt, Human
ggugaagcuauuuaucug

SEQ ID NO: 2322833 - RNA, 14 nt, Human
ggugaaggaauaua

SEQ ID NO: 2322834 - RNA, 21 nt, Human
ggugaagcucacuucugggcu

SEQ ID NO: 2322835 - RNA, 18 nt, Human
ggugaagugaagacaaug

SEQ ID NO: 2322836 - RNA, 20 nt, Human
ggucucgcugaugcugggcu

SEQ ID NO: 2322837 - RNA, 21 nt, Human
ggucucgcugaugcugggcug

SEQ ID NO: 2322838 - RNA, 19 nt, Human
ggucugaggaauccagacc

SEQ ID NO: 2322839 - RNA, 17 nt, Human
ggugaagcuauuuaucu

SEQ ID NO: 2322840 - RNA, 20 nt, Human
ggugaagagaaccgagcaaa

SEQ ID NO: 2322841 - RNA, 19 nt, Human
ggugaagaugggaacgcag

SEQ ID NO: 2322842 - RNA, 22 nt, Human
ggucugaggggcaacugagucu

SEQ ID NO: 2322843 - RNA, 23 nt, Human
ggugaaccaugucagcaaaaagc

SEQ ID NO: 2322844 - RNA, 16 nt, Human
ggugaagaaaacuccu

SEQ ID NO: 2322845 - RNA, 16 nt, Human
ggugaacuugguuccc

SEQ ID NO: 2322846 - RNA, 22 nt, Human
ggucucccucuccugccuacuc

SEQ ID NO: 2322847 - RNA, 21 nt, Human
ggucucacuauguugcccagg

SEQ ID NO: 2322848 - RNA, 18 nt, Human
ggucucccucuccugccu

SEQ ID NO: 2322849 - RNA, 17 nt, Human
ggucucccucuccugcc

SEQ ID NO: 2322850 - RNA, 19 nt, Human
ggucucccucuccugccua

SEQ ID NO: 2322851 - RNA, 19 nt, Human
ggucuccucacucccuucu

SEQ ID NO: 2322852 - RNA, 12 nt, Human
ggucucacucug

SEQ ID NO: 2322853 - RNA, 16 nt, Human
ggucucacucugucgc

SEQ ID NO: 2322854 - RNA, 15 nt, Human
ggucugacccacugc

SEQ ID NO: 2322855 - RNA, 16 nt, Human
ggucugacccacugcu

SEQ ID NO: 2322856 - RNA, 16 nt, Human
ggucuccuuggaaauc

SEQ ID NO: 2322857 - RNA, 19 nt, Human
ggucucgcugaugcugggc

SEQ ID NO: 2322858 - RNA, 22 nt, Human
ggucuccuccaccgccauggcu

SEQ ID NO: 2322859 - RNA, 20 nt, Human
ggucucgaacuccugaccuu

SEQ ID NO: 2322860 - RNA, 14 nt, Human
ggucuccuccaccg

SEQ ID NO: 2322861 - RNA, 19 nt, Human
ggucucgaacuccugaccu

SEQ ID NO: 2322862 - RNA, 21 nt, Human
ggucccuugagaccucagcca

SEQ ID NO: 2322863 - RNA, 20 nt, Human
ggucccuugagaccucagcc

SEQ ID NO: 2322864 - RNA, 19 nt, Human
ggucccuugagaccucagc

SEQ ID NO: 2322865 - RNA, 21 nt, Human
ggucccuucuuacucacacac

SEQ ID NO: 2322866 - RNA, 23 nt, Human
ggucccugggaggaaauuugaau

SEQ ID NO: 2322867 - RNA, 13 nt, Human
ggucccugggagg

SEQ ID NO: 2322868 - RNA, 22 nt, Human
ggucccugguggcagcucaccu

SEQ ID NO: 2322869 - RNA, 17 nt, Human
gguccgguguccuuuuc

SEQ ID NO: 2322870 - RNA, 23 nt, Human
ggucccuugcagcuaguuuucua

SEQ ID NO: 2322871 - RNA, 17 nt, Human
gguccggacacuccuag

SEQ ID NO: 2322872 - RNA, 18 nt, Human
gguccggacacuccuaga

SEQ ID NO: 2322873 - RNA, 20 nt, Human
gguccggacacuccuagaga

SEQ ID NO: 2322874 - RNA, 21 nt, Human
gguccggacacuccuagagaa

SEQ ID NO: 2322875 - RNA, 22 nt, Human
gguccuaccaauagauucccca

SEQ ID NO: 2322876 - RNA, 20 nt, Human
gguccuacccauccccgcag

SEQ ID NO: 2322877 - RNA, 17 nt, Human
gguccuacccauccccg

SEQ ID NO: 2322878 - RNA, 13 nt, Human
gguccgugggacg

SEQ ID NO: 2322879 - RNA, 23 nt, Human
gguccuagaaauuccccacccug

SEQ ID NO: 2322880 - RNA, 22 nt, Human
ggucucacuauguugcccaggc

SEQ ID NO: 2322881 - RNA, 21 nt, Human
ggucccgugcagcuucugucc

SEQ ID NO: 2322882 - RNA, 18 nt, Human
ggucccuaauaaagcugu

SEQ ID NO: 2322883 - RNA, 14 nt, Human
ggucccugguggca

SEQ ID NO: 2322884 - RNA, 14 nt, Human
ggucccucugugua

SEQ ID NO: 2322885 - RNA, 20 nt, Human
ggucccugauaacaaccugg

SEQ ID NO: 2322886 - RNA, 23 nt, Human
ggucccugauaacaaccuggaga

SEQ ID NO: 2322887 - RNA, 22 nt, Human
ggucccugauaacaaccuggag

SEQ ID NO: 2322888 - RNA, 18 nt, Human
ggucccugcuguguuccc

SEQ ID NO: 2322889 - RNA, 12 nt, Human
ggucccuaauaa

SEQ ID NO: 2322890 - RNA, 13 nt, Human
ggucccuaauaaa

SEQ ID NO: 2322891 - RNA, 16 nt, Human
ggucccuaauaaagcu

SEQ ID NO: 2322892 - RNA, 17 nt, Human
ggucccuaauaaagcug

SEQ ID NO: 2322893 - RNA, 22 nt, Human
ggugcuaaauggucgcccagga

SEQ ID NO: 2322894 - RNA, 21 nt, Human
ggugcuaaauggucgcccagg

SEQ ID NO: 2322895 - RNA, 23 nt, Human
ggugcuaaauggucgcccaggag

SEQ ID NO: 2322896 - RNA, 21 nt, Human
ggugcuacaaaaacacagcaa

SEQ ID NO: 2322897 - RNA, 22 nt, Human
ggugcuaucucccccagcccca

SEQ ID NO: 2322898 - RNA, 15 nt, Human
ggugcucagggcuga

SEQ ID NO: 2322899 - RNA, 19 nt, Human
ggugcucacaccccauugg

SEQ ID NO: 2322900 - RNA, 21 nt, Human
ggugcuaucucccccagcccc

SEQ ID NO: 2322901 - RNA, 23 nt, Human
ggugcuaucucccccagccccau

SEQ ID NO: 2322902 - RNA, 20 nt, Human
ggugcuaaauggucgcccag

SEQ ID NO: 2322903 - RNA, 22 nt, Human
ggugcggcugugcagccugucc

SEQ ID NO: 2322904 - RNA, 12 nt, Human
ggugcggcugug

SEQ ID NO: 2322905 - RNA, 19 nt, Human
ggugcuacaaaaacacagc

SEQ ID NO: 2322906 - RNA, 15 nt, Human
ggugcgaucuggguu

SEQ ID NO: 2322907 - RNA, 13 nt, Human
ggugccuccaggu

SEQ ID NO: 2322908 - RNA, 14 nt, Human
ggugccuccaggug

SEQ ID NO: 2322909 - RNA, 16 nt, Human
ggugccuccaggugug

SEQ ID NO: 2322910 - RNA, 17 nt, Human
ggugccuccaggugugc

SEQ ID NO: 2322911 - RNA, 15 nt, Human
ggugccugagaggca

SEQ ID NO: 2322912 - RNA, 17 nt, Human
ggugccugagaggcagg

SEQ ID NO: 2322913 - RNA, 18 nt, Human
ggugccugagaggcaggc

SEQ ID NO: 2322914 - RNA, 16 nt, Human
ggugcucagggcugac

SEQ ID NO: 2322915 - RNA, 15 nt, Human
ggugcuccaggcagg

SEQ ID NO: 2322916 - RNA, 14 nt, Human
gguggcaggaccag

SEQ ID NO: 2322917 - RNA, 14 nt, Human
ggugcucucugcca

SEQ ID NO: 2322918 - RNA, 16 nt, Human
ggugcucucugccacu

SEQ ID NO: 2322919 - RNA, 18 nt, Human
gguggcaggaccaggacu

SEQ ID NO: 2322920 - RNA, 15 nt, Human
gguggcaggaccagg

SEQ ID NO: 2322921 - RNA, 17 nt, Human
gguggcaggaccaggac

SEQ ID NO: 2322922 - RNA, 16 nt, Human
gguggcagugggagcu

SEQ ID NO: 2322923 - RNA, 18 nt, Human
gguggccauuuagccacc

SEQ ID NO: 2322924 - RNA, 15 nt, Human
gguggcagcugcggu

SEQ ID NO: 2322925 - RNA, 23 nt, Human
gguggcagcugcgguccacccag

SEQ ID NO: 2322926 - RNA, 11 nt, Human
gguggcagcug

SEQ ID NO: 2322927 - RNA, 13 nt, Human
gguggcagcucac

SEQ ID NO: 2322928 - RNA, 12 nt, Human
gguggcagcugc

SEQ ID NO: 2322929 - RNA, 13 nt, Human
gguggcagcugcg

SEQ ID NO: 2322930 - RNA, 22 nt, Human
ggugcccuuggaggccagccag

SEQ ID NO: 2322931 - RNA, 18 nt, Human
ggugcccuuggaggccag

SEQ ID NO: 2322932 - RNA, 17 nt, Human
ggugcccuuggaggcca

SEQ ID NO: 2322933 - RNA, 14 nt, Human
ggugccgccugccc

SEQ ID NO: 2322934 - RNA, 21 nt, Human
ggugccuaggauugugccugu

SEQ ID NO: 2322935 - RNA, 19 nt, Human
ggugcccuguucucuacca

SEQ ID NO: 2322936 - RNA, 22 nt, Human
ggugccccccuugccagacaug

SEQ ID NO: 2322937 - RNA, 23 nt, Human
ggugccccaggaccagcucagga

SEQ ID NO: 2322938 - RNA, 12 nt, Human
ggugcccccucc

SEQ ID NO: 2322939 - RNA, 17 nt, Human
ggugcccccuccucucc

SEQ ID NO: 2322940 - RNA, 19 nt, Human
ggugcccccuccucuccca

SEQ ID NO: 2322941 - RNA, 20 nt, Human
ggugcccccuccucucccau

SEQ ID NO: 2322942 - RNA, 22 nt, Human
ggugcccccuccucucccaucc

SEQ ID NO: 2322943 - RNA, 23 nt, Human
ggugcccccuccucucccauccc

SEQ ID NO: 2322944 - RNA, 21 nt, Human
ggugaguuugagcugccuucc

SEQ ID NO: 2322945 - RNA, 22 nt, Human
ggugauagguauaaguggugug

SEQ ID NO: 2322946 - RNA, 15 nt, Human
ggugauauccauucu

SEQ ID NO: 2322947 - RNA, 22 nt, Human
ggugcccagcuauaccugugcc

SEQ ID NO: 2322948 - RNA, 22 nt, Human
ggugccccaggaccagcucagg

SEQ ID NO: 2322949 - RNA, 21 nt, Human
ggugccccaggaccagcucag

SEQ ID NO: 2322950 - RNA, 20 nt, Human
ggugccccaggaccagcuca

SEQ ID NO: 2322951 - RNA, 17 nt, Human
ggugccccaggaccagc

SEQ ID NO: 2322952 - RNA, 16 nt, Human
ggugccccaggaccag

SEQ ID NO: 2322953 - RNA, 15 nt, Human
ggugccccaggacca

SEQ ID NO: 2322954 - RNA, 14 nt, Human
ggugccccaggacc

SEQ ID NO: 2322955 - RNA, 13 nt, Human
ggugccccaggac

SEQ ID NO: 2322956 - RNA, 16 nt, Human
ggugacaccagccuuu

SEQ ID NO: 2322957 - RNA, 18 nt, Human
ggugacaagauagagagc

SEQ ID NO: 2322958 - RNA, 17 nt, Human
ggugacaagauagagag

SEQ ID NO: 2322959 - RNA, 13 nt, Human
ggugacaccagcc

SEQ ID NO: 2322960 - RNA, 14 nt, Human
ggugaccucugccu

SEQ ID NO: 2322961 - RNA, 21 nt, Human
ggugaccccuuuucagcuucu

SEQ ID NO: 2322962 - RNA, 16 nt, Human
ggugaccucugccuga

SEQ ID NO: 2322963 - RNA, 15 nt, Human
ggugaggcaauaaaa

SEQ ID NO: 2322964 - RNA, 14 nt, Human
ggugaggcaggcuu

SEQ ID NO: 2322965 - RNA, 20 nt, Human
ggugaggcagugggucccac

SEQ ID NO: 2322966 - RNA, 17 nt, Human
ggugaggggcuggcacu

SEQ ID NO: 2322967 - RNA, 15 nt, Human
ggugaggccuugcuc

SEQ ID NO: 2322968 - RNA, 12 nt, Human
ggugagggaugu

SEQ ID NO: 2322969 - RNA, 13 nt, Human
ggugagggaugug

SEQ ID NO: 2322970 - RNA, 18 nt, Human
ggugaguccauucuccca

SEQ ID NO: 2322971 - RNA, 17 nt, Human
ggugagucuuggcggca

SEQ ID NO: 2322972 - RNA, 20 nt, Human
ggugagucuuggcggcagca

SEQ ID NO: 2322973 - RNA, 19 nt, Human
ggugaguuugagcugccuu

SEQ ID NO: 2322974 - RNA, 23 nt, Human
ggugagucuuggcggcagcagcc

SEQ ID NO: 2322975 - RNA, 20 nt, Human
ggugaguuugagcugccuuc

SEQ ID NO: 2322976 - RNA, 14 nt, Human
guaaaauaaaauua

SEQ ID NO: 2322977 - RNA, 22 nt, Human
guaaaaggccaaaccucuguuc

SEQ ID NO: 2322978 - RNA, 15 nt, Human
guaaaagugugagca

SEQ ID NO: 2322979 - RNA, 16 nt, Human
guaaaauaaaaggucg

SEQ ID NO: 2322980 - RNA, 20 nt, Human
guaaaaggccaaaccucugu

SEQ ID NO: 2322981 - RNA, 17 nt, Human
guaaaagguauuaaauu

SEQ ID NO: 2322982 - RNA, 11 nt, Human
guaaagugugg

SEQ ID NO: 2322983 - RNA, 21 nt, Human
guaaaguguggucccaacagg

SEQ ID NO: 2322984 - RNA, 22 nt, Human
guaaaguguggucccaacagga

SEQ ID NO: 2322985 - RNA, 13 nt, Human
guaaauaaaaaga

SEQ ID NO: 2322986 - RNA, 14 nt, Human
guaaaguuagucua

SEQ ID NO: 2322987 - RNA, 18 nt, Human
guaaaguuagucuacucu

SEQ ID NO: 2322988 - RNA, 23 nt, Human
guaaagugauaauuucuggaauu

SEQ ID NO: 2322989 - RNA, 18 nt, Human
guaaagugauaauuucug

SEQ ID NO: 2322990 - RNA, 17 nt, Human
guaaagugauaauuucu

SEQ ID NO: 2322991 - RNA, 13 nt, Human
guaaauaaagccc

SEQ ID NO: 2322992 - RNA, 14 nt, Human
guaaauaaagcccu

SEQ ID NO: 2322993 - RNA, 15 nt, Human
guaaauaaagcccug

SEQ ID NO: 2322994 - RNA, 18 nt, Human
guaaauaaauuguuugac

SEQ ID NO: 2322995 - RNA, 14 nt, Human
guaaauaaauuguu

SEQ ID NO: 2322996 - RNA, 16 nt, Human
guaaauaaaggaacca

SEQ ID NO: 2322997 - RNA, 19 nt, Human
guaaauacacaacacacac

SEQ ID NO: 2322998 - RNA, 12 nt, Human
guaaauacacca

SEQ ID NO: 2322999 - RNA, 15 nt, Human
guaaauaguauuuga

SEQ ID NO: 2323000 - RNA, 16 nt, Human
guaaauaguauuugag

SEQ ID NO: 2323001 - RNA, 17 nt, Human
guaaauaguauuugaga

SEQ ID NO: 2323002 - RNA, 11 nt, Human
guaaauauuua

SEQ ID NO: 2323003 - RNA, 14 nt, Human
guaaauauucuaua

SEQ ID NO: 2323004 - RNA, 15 nt, Human
guaaauauucuauau

SEQ ID NO: 2323005 - RNA, 12 nt, Human
guaaauauuuau

SEQ ID NO: 2323006 - RNA, 20 nt, Human
guaaauaguuacuccagugc

SEQ ID NO: 2323007 - RNA, 16 nt, Human
guaaauauauaaauau

SEQ ID NO: 2323008 - RNA, 19 nt, Human
guaaauauauaaauauaua

SEQ ID NO: 2323009 - RNA, 13 nt, Human
guaaauauucuau

SEQ ID NO: 2323010 - RNA, 20 nt, Human
guaaauauauaaauauauau

SEQ ID NO: 2323011 - RNA, 17 nt, Human
guaaauguuuagguuuu

SEQ ID NO: 2323012 - RNA, 15 nt, Human
guaaauuaacuuuua

SEQ ID NO: 2323013 - RNA, 22 nt, Human
guaaauggcuuauccagcuggu

SEQ ID NO: 2323014 - RNA, 16 nt, Human
guaaaugguguacaua

SEQ ID NO: 2323015 - RNA, 20 nt, Human
guaaaugguguacauaaugu

SEQ ID NO: 2323016 - RNA, 12 nt, Human
guaaaugaugug

SEQ ID NO: 2323017 - RNA, 17 nt, Human
guaaaugcagcgugaag

SEQ ID NO: 2323018 - RNA, 24 nt, Human
guaaaugcaucuguccucaugugu

SEQ ID NO: 2323019 - RNA, 22 nt, Human
guaaauuaacuuuuauaaacuu

SEQ ID NO: 2323020 - RNA, 21 nt, Human
guaaauuaacuuuuauaaacu

SEQ ID NO: 2323021 - RNA, 17 nt, Human
guaaauuaacuuuuaua

SEQ ID NO: 2323022 - RNA, 16 nt, Human
guaaauuaacuuuuau

SEQ ID NO: 2323023 - RNA, 22 nt, Human
guaaauccuuuuucuuuauaaa

SEQ ID NO: 2323024 - RNA, 16 nt, Human
guaaauccuuuuucuu

SEQ ID NO: 2323025 - RNA, 15 nt, Human
guaaauccuuuuucu

SEQ ID NO: 2323026 - RNA, 20 nt, Human
guaaaugggggugcauuuga

SEQ ID NO: 2323027 - RNA, 19 nt, Human
guaaaugggggugcauuug

SEQ ID NO: 2323028 - RNA, 18 nt, Human
guaaaugggggugcauuu

SEQ ID NO: 2323029 - RNA, 14 nt, Human
guaaaucuuuuaca

SEQ ID NO: 2323030 - RNA, 19 nt, Human
guaagaucguucucugccu

SEQ ID NO: 2323031 - RNA, 18 nt, Human
guaagaguguagaagcau

SEQ ID NO: 2323032 - RNA, 22 nt, Human
guaagaguguagaagcauuccu

SEQ ID NO: 2323033 - RNA, 14 nt, Human
guaagaguguagaa

SEQ ID NO: 2323034 - RNA, 15 nt, Human
guaagaguguagaag

SEQ ID NO: 2323035 - RNA, 17 nt, Human
guaagaguguagaagca

SEQ ID NO: 2323036 - RNA, 16 nt, Human
guaagagcuggugucu

SEQ ID NO: 2323037 - RNA, 14 nt, Human
guaagagcuggugu

SEQ ID NO: 2323038 - RNA, 20 nt, Human
guaagagcaccuuccucacu

SEQ ID NO: 2323039 - RNA, 21 nt, Human
guaagagcaccuuccucacuu

SEQ ID NO: 2323040 - RNA, 11 nt, Human
guaagaugcug

SEQ ID NO: 2323041 - RNA, 20 nt, Human
guaagaugcuggguuggugc

SEQ ID NO: 2323042 - RNA, 12 nt, Human
guaagaugcugg

SEQ ID NO: 2323043 - RNA, 16 nt, Human
guaagaugcuggguug

SEQ ID NO: 2323044 - RNA, 15 nt, Human
guaagaagagacugg

SEQ ID NO: 2323045 - RNA, 11 nt, Human
guaagaagccg

SEQ ID NO: 2323046 - RNA, 13 nt, Human
guaagaagagacu

SEQ ID NO: 2323047 - RNA, 15 nt, Human
guaagaagacaugaa

SEQ ID NO: 2323048 - RNA, 16 nt, Human
guaagacaauccaugu

SEQ ID NO: 2323049 - RNA, 15 nt, Human
guaagacaaagguuu

SEQ ID NO: 2323050 - RNA, 17 nt, Human
guaagagcaccuuccuc

SEQ ID NO: 2323051 - RNA, 17 nt, Human
guaagaaauacuguaca

SEQ ID NO: 2323052 - RNA, 15 nt, Human
guaagaaccuugccu

SEQ ID NO: 2323053 - RNA, 16 nt, Human
guaagaaccuugccug

SEQ ID NO: 2323054 - RNA, 17 nt, Human
guaagaaccuugccuga

SEQ ID NO: 2323055 - RNA, 13 nt, Human
guaagaaauacug

SEQ ID NO: 2323056 - RNA, 12 nt, Human
guaagaaauacu

SEQ ID NO: 2323057 - RNA, 19 nt, Human
guaacuuuuguaaauacac

SEQ ID NO: 2323058 - RNA, 16 nt, Human
guaacuuuauguguaa

SEQ ID NO: 2323059 - RNA, 18 nt, Human
guaacuuggauguagcca

SEQ ID NO: 2323060 - RNA, 14 nt, Human
guaacuuuaugugu

SEQ ID NO: 2323061 - RNA, 15 nt, Human
guaacuuuaugugua

SEQ ID NO: 2323062 - RNA, 12 nt, Human
guaacuuuaugu

SEQ ID NO: 2323063 - RNA, 20 nt, Human
guaagaaacacacugaggca

SEQ ID NO: 2323064 - RNA, 23 nt, Human
guaagaaaauauuuugucuaaaa

SEQ ID NO: 2323065 - RNA, 20 nt, Human
guaagaaagugaagcaaauc

SEQ ID NO: 2323066 - RNA, 17 nt, Human
guaagaaaagugguugu

SEQ ID NO: 2323067 - RNA, 13 nt, Human
guaagaaaauauu

SEQ ID NO: 2323068 - RNA, 14 nt, Human
guaagaaaauauuu

SEQ ID NO: 2323069 - RNA, 22 nt, Human
guaagaaaauauuuugucuaaa

SEQ ID NO: 2323070 - RNA, 17 nt, Human
guaacuuuuguaagaca

SEQ ID NO: 2323071 - RNA, 15 nt, Human
guaacuuuuguaaga

SEQ ID NO: 2323072 - RNA, 14 nt, Human
guaacuuuuguaag

SEQ ID NO: 2323073 - RNA, 22 nt, Human
guaacuguuaaauugcugugua

SEQ ID NO: 2323074 - RNA, 14 nt, Human
guaacugugucaug

SEQ ID NO: 2323075 - RNA, 19 nt, Human
guaacuguuaaauugcugu

SEQ ID NO: 2323076 - RNA, 23 nt, Human
guaaauuaacuuuuauaaacuuu

SEQ ID NO: 2323077 - RNA, 13 nt, Human
guaacuguucuug

SEQ ID NO: 2323078 - RNA, 18 nt, Human
guaacuucuuauggaauu

SEQ ID NO: 2323079 - RNA, 21 nt, Human
guaacuucuuauggaauugau

SEQ ID NO: 2323080 - RNA, 20 nt, Human
guaacuucuuauggaauuga

SEQ ID NO: 2323081 - RNA, 22 nt, Human
guaaguauucuuauuuaaugaa

SEQ ID NO: 2323082 - RNA, 18 nt, Human
guaaguaccacucaggcc

SEQ ID NO: 2323083 - RNA, 12 nt, Human
guaagugccuuc

SEQ ID NO: 2323084 - RNA, 12 nt, Human
guaagucuuuuu

SEQ ID NO: 2323085 - RNA, 23 nt, Human
guaaguaauuaucgggaacagug

SEQ ID NO: 2323086 - RNA, 13 nt, Human
guaaguaauuauc

SEQ ID NO: 2323087 - RNA, 12 nt, Human
guaaggugccuu

SEQ ID NO: 2323088 - RNA, 14 nt, Human
guaaggugagggaa

SEQ ID NO: 2323089 - RNA, 13 nt, Human
guaaggugcaguu

SEQ ID NO: 2323090 - RNA, 16 nt, Human
guaaggugcaguuccc

SEQ ID NO: 2323091 - RNA, 14 nt, Human
guaaggcaugaagg

SEQ ID NO: 2323092 - RNA, 23 nt, Human
guaaggcagggucccauuucuca

SEQ ID NO: 2323093 - RNA, 17 nt, Human
guaagggaaacugccag

SEQ ID NO: 2323094 - RNA, 18 nt, Human
guaagggaaacugccagc

SEQ ID NO: 2323095 - RNA, 20 nt, Human
guaaggcuguguacacugac

SEQ ID NO: 2323096 - RNA, 15 nt, Human
guaagggaaauagaa

SEQ ID NO: 2323097 - RNA, 17 nt, Human
guaagcugcucuauugu

SEQ ID NO: 2323098 - RNA, 17 nt, Human
guaagcucuggcuuucu

SEQ ID NO: 2323099 - RNA, 12 nt, Human
guaagcuguuua

SEQ ID NO: 2323100 - RNA, 19 nt, Human
guaagcuguuuauuuuaua

SEQ ID NO: 2323101 - RNA, 18 nt, Human
guaaggaauaccuguccc

SEQ ID NO: 2323102 - RNA, 13 nt, Human
guaagcucuggcu

SEQ ID NO: 2323103 - RNA, 20 nt, Human
guaaggaauaccuguccccc

SEQ ID NO: 2323104 - RNA, 21 nt, Human
guaaggaauaccugucccccu

SEQ ID NO: 2323105 - RNA, 23 nt, Human
guaaggaauaccugucccccuga

SEQ ID NO: 2323106 - RNA, 13 nt, Human
guaaggaaugauu

SEQ ID NO: 2323107 - RNA, 18 nt, Human
gguuuucuuaaccaucuu

SEQ ID NO: 2323108 - RNA, 17 nt, Human
gguuuucuuaaccaucu

SEQ ID NO: 2323109 - RNA, 14 nt, Human
gguuuucuucccau

SEQ ID NO: 2323110 - RNA, 13 nt, Human
gguuuugacugga

SEQ ID NO: 2323111 - RNA, 15 nt, Human
gguuuucuguucuuu

SEQ ID NO: 2323112 - RNA, 13 nt, Human
gguuuucuguucu

SEQ ID NO: 2323113 - RNA, 12 nt, Human
gguuuucuguuc

SEQ ID NO: 2323114 - RNA, 13 nt, Human
gguuuuccccucc

SEQ ID NO: 2323115 - RNA, 18 nt, Human
gguuuuccccucccuggg

SEQ ID NO: 2323116 - RNA, 19 nt, Human
gguuuucgaagcucagccc

SEQ ID NO: 2323117 - RNA, 15 nt, Human
gguuuucuggguguc

SEQ ID NO: 2323118 - RNA, 14 nt, Human
gguuuucuggaugg

SEQ ID NO: 2323119 - RNA, 23 nt, Human
gguuuacucuguggccaaaggag

SEQ ID NO: 2323120 - RNA, 19 nt, Human
gguuuacauucaucucauu

SEQ ID NO: 2323121 - RNA, 22 nt, Human
gguuuacauucaucucauucca

SEQ ID NO: 2323122 - RNA, 19 nt, Human
gguuuaauccccaguaaaa

SEQ ID NO: 2323123 - RNA, 22 nt, Human
gguuuaauccccaguaaaauug

SEQ ID NO: 2323124 - RNA, 21 nt, Human
gguuuacaauuuacaaagugu

SEQ ID NO: 2323125 - RNA, 17 nt, Human
gguuuacaauuuacaaa

SEQ ID NO: 2323126 - RNA, 13 nt, Human
gguuuuguacaau

SEQ ID NO: 2323127 - RNA, 11 nt, Human
gguuuuguaca

SEQ ID NO: 2323128 - RNA, 19 nt, Human
gguuuuguaagaugcuggg

SEQ ID NO: 2323129 - RNA, 20 nt, Human
gguuuuguaagaugcugggu

SEQ ID NO: 2323130 - RNA, 21 nt, Human
gguuuuggcaaacgcuaaaga

SEQ ID NO: 2323131 - RNA, 19 nt, Human
gguuuugcuauuagacugu

SEQ ID NO: 2323132 - RNA, 17 nt, Human
gguuuuguaagaugcug

SEQ ID NO: 2323133 - RNA, 23 nt, Human
gguuuugccauguuggccaggcu

SEQ ID NO: 2323134 - RNA, 19 nt, Human
gguuuuguuccccuccucc

SEQ ID NO: 2323135 - RNA, 22 nt, Human
gguuuuguuccccuccuccacu

SEQ ID NO: 2323136 - RNA, 16 nt, Human
gguuuuuaaaacccag

SEQ ID NO: 2323137 - RNA, 14 nt, Human
gguuuuguuccccu

SEQ ID NO: 2323138 - RNA, 19 nt, Human
gguuuuguauucucugagc

SEQ ID NO: 2323139 - RNA, 18 nt, Human
gguuuuguauucucugag

SEQ ID NO: 2323140 - RNA, 17 nt, Human
gguuuuguauucucuga

SEQ ID NO: 2323141 - RNA, 12 nt, Human
gguuuuucaauu

SEQ ID NO: 2323142 - RNA, 13 nt, Human
gguuuuucaauua

SEQ ID NO: 2323143 - RNA, 14 nt, Human
gguuuuucaauuaa

SEQ ID NO: 2323144 - RNA, 15 nt, Human
gguuuuucaauuaaa

SEQ ID NO: 2323145 - RNA, 16 nt, Human
gguuuuucaauuaaac

SEQ ID NO: 2323146 - RNA, 15 nt, Human
gguuuuuauuaguac

SEQ ID NO: 2323147 - RNA, 14 nt, Human
gguuuuuacuguua

SEQ ID NO: 2323148 - RNA, 12 nt, Human
gguuuuguuugc

SEQ ID NO: 2323149 - RNA, 15 nt, Human
gguuuuguuugcuau

SEQ ID NO: 2323150 - RNA, 20 nt, Human
gguuuuuuguguacuuuuug

SEQ ID NO: 2323151 - RNA, 14 nt, Human
gguuuuuuaauaua

SEQ ID NO: 2323152 - RNA, 21 nt, Human
gguuuuuuuguacuuuguaca

SEQ ID NO: 2323153 - RNA, 16 nt, Human
guaaaaaaaaaaaagu

SEQ ID NO: 2323154 - RNA, 23 nt, Human
gguuuuuguuuguuuccuuuguu

SEQ ID NO: 2323155 - RNA, 12 nt, Human
gguuuuucccug

SEQ ID NO: 2323156 - RNA, 17 nt, Human
gguuuuucaauuaaacg

SEQ ID NO: 2323157 - RNA, 18 nt, Human
gguuuuucaauuaaacgg

SEQ ID NO: 2323158 - RNA, 19 nt, Human
gguuuuucaauuaaacgga

SEQ ID NO: 2323159 - RNA, 20 nt, Human
gguuuuucaauuaaacggau

SEQ ID NO: 2323160 - RNA, 12 nt, Human
guaaaaauacaa

SEQ ID NO: 2323161 - RNA, 14 nt, Human
guaaaaauaaaauu

SEQ ID NO: 2323162 - RNA, 20 nt, Human
guaaaacaaaaauguaauga

SEQ ID NO: 2323163 - RNA, 14 nt, Human
guaaaaauuaaaaa

SEQ ID NO: 2323164 - RNA, 13 nt, Human
guaaaaauaaaau

SEQ ID NO: 2323165 - RNA, 21 nt, Human
guaaaaacagcauugcuuucu

SEQ ID NO: 2323166 - RNA, 19 nt, Human
guaaaaacagcauugcuuu

SEQ ID NO: 2323167 - RNA, 23 nt, Human
guaaaaacagcauugcuuucuga

SEQ ID NO: 2323168 - RNA, 18 nt, Human
guaaaaacagcauugcuu

SEQ ID NO: 2323169 - RNA, 20 nt, Human
guaaaaaaaaaugccuuuga

SEQ ID NO: 2323170 - RNA, 23 nt, Human
guaaaaaaaaaugccuuugagac

SEQ ID NO: 2323171 - RNA, 20 nt, Human
guaaaaacaaagaaauuaug

SEQ ID NO: 2323172 - RNA, 18 nt, Human
guaaaaacaaagaaauua

SEQ ID NO: 2323173 - RNA, 18 nt, Human
guaaaaaaaaaaaaguua

SEQ ID NO: 2323174 - RNA, 13 nt, Human
guaaaaaaaaaug

SEQ ID NO: 2323175 - RNA, 19 nt, Human
guaaaaaaaaaugccuuug

SEQ ID NO: 2323176 - RNA, 18 nt, Human
guaaaagaacaguaaaca

SEQ ID NO: 2323177 - RNA, 15 nt, Human
guaaaacugaggcac

SEQ ID NO: 2323178 - RNA, 13 nt, Human
guaaaacugaggc

SEQ ID NO: 2323179 - RNA, 21 nt, Human
guaaaacuacacaucccuaau

SEQ ID NO: 2323180 - RNA, 15 nt, Human
guaaaagacuuuuuu

SEQ ID NO: 2323181 - RNA, 17 nt, Human
guaaaagauaacaagau

SEQ ID NO: 2323182 - RNA, 23 nt, Human
guaaaaccacagcaguugaaaag

SEQ ID NO: 2323183 - RNA, 18 nt, Human
guaaaaccacagcaguug

SEQ ID NO: 2323184 - RNA, 16 nt, Human
guaaaaccacagcagu

SEQ ID NO: 2323185 - RNA, 15 nt, Human
guaaaaccacagcag

SEQ ID NO: 2323186 - RNA, 14 nt, Human
guaaaaccacagca

SEQ ID NO: 2323187 - RNA, 20 nt, Human
gguugccacaggccucccug

SEQ ID NO: 2323188 - RNA, 16 nt, Human
gguugcggggggaggg

SEQ ID NO: 2323189 - RNA, 13 nt, Human
gguugccacaggc

SEQ ID NO: 2323190 - RNA, 14 nt, Human
gguugccacaggcc

SEQ ID NO: 2323191 - RNA, 18 nt, Human
gguugccacaggccuccc

SEQ ID NO: 2323192 - RNA, 18 nt, Human
gguugcuguuuuccuccc

SEQ ID NO: 2323193 - RNA, 22 nt, Human
gguugcuguugaugaggccucu

SEQ ID NO: 2323194 - RNA, 17 nt, Human
gguugcugguugcugug

SEQ ID NO: 2323195 - RNA, 18 nt, Human
gguugcugguugcugugu

SEQ ID NO: 2323196 - RNA, 16 nt, Human
gguugcugguugcugu

SEQ ID NO: 2323197 - RNA, 12 nt, Human
gguugccacagg

SEQ ID NO: 2323198 - RNA, 18 nt, Human
gguugcagugagccaaga

SEQ ID NO: 2323199 - RNA, 16 nt, Human
gguugaccccagagga

SEQ ID NO: 2323200 - RNA, 15 nt, Human
gguugaccccagagg

SEQ ID NO: 2323201 - RNA, 11 nt, Human
gguugaauaaa

SEQ ID NO: 2323202 - RNA, 15 nt, Human
gguucuuuguuuuaa

SEQ ID NO: 2323203 - RNA, 19 nt, Human
gguugaagaggugagcacg

SEQ ID NO: 2323204 - RNA, 17 nt, Human
gguugggcccagaucug

SEQ ID NO: 2323205 - RNA, 23 nt, Human
gguugggauugggggcuggugcc

SEQ ID NO: 2323206 - RNA, 15 nt, Human
gguuggagagcuaga

SEQ ID NO: 2323207 - RNA, 19 nt, Human
gguugguccucuugccucc

SEQ ID NO: 2323208 - RNA, 14 nt, Human
gguugggcuggugu

SEQ ID NO: 2323209 - RNA, 22 nt, Human
gguuggaagugagggucagaga

SEQ ID NO: 2323210 - RNA, 21 nt, Human
gguuggaagcuagcuccccuc

SEQ ID NO: 2323211 - RNA, 21 nt, Human
gguugcuguuuuccucccuuc

SEQ ID NO: 2323212 - RNA, 20 nt, Human
gguugcuguuuuccucccuu

SEQ ID NO: 2323213 - RNA, 19 nt, Human
gguugcuguuuuccucccu

SEQ ID NO: 2323214 - RNA, 18 nt, Human
gguuggcaaaaaggcagg

SEQ ID NO: 2323215 - RNA, 13 nt, Human
gguuuaagcuguu

SEQ ID NO: 2323216 - RNA, 14 nt, Human
gguuuaacucagau

SEQ ID NO: 2323217 - RNA, 17 nt, Human
gguuuaacucagaucac

SEQ ID NO: 2323218 - RNA, 18 nt, Human
gguuuaacucagaucacu

SEQ ID NO: 2323219 - RNA, 20 nt, Human
gguuuaacucagaucacuac

SEQ ID NO: 2323220 - RNA, 23 nt, Human
gguuuaacucagaucacuacugc

SEQ ID NO: 2323221 - RNA, 22 nt, Human
gguugugaggccuggccaggca

SEQ ID NO: 2323222 - RNA, 19 nt, Human
gguuuaaacuucucugaag

SEQ ID NO: 2323223 - RNA, 13 nt, Human
gguuuaacucaga

SEQ ID NO: 2323224 - RNA, 13 nt, Human
gguugucaauauu

SEQ ID NO: 2323225 - RNA, 22 nt, Human
gguuguauucuuugauguuaac

SEQ ID NO: 2323226 - RNA, 10 nt, Human
gguugucaau

SEQ ID NO: 2323227 - RNA, 15 nt, Human
gguuguauucuuuga

SEQ ID NO: 2323228 - RNA, 16 nt, Human
gguuguauucuuugau

SEQ ID NO: 2323229 - RNA, 19 nt, Human
gguuguauucuuugauguu

SEQ ID NO: 2323230 - RNA, 20 nt, Human
gguuguauucuuugauguua

SEQ ID NO: 2323231 - RNA, 21 nt, Human
gguugucuguuuuuguaacuu

SEQ ID NO: 2323232 - RNA, 13 nt, Human
gguugugaggccu

SEQ ID NO: 2323233 - RNA, 14 nt, Human
gguugugaggccug

SEQ ID NO: 2323234 - RNA, 16 nt, Human
gguugugaggccuggc

SEQ ID NO: 2323235 - RNA, 21 nt, Human
gguugugaggccuggccaggc

SEQ ID NO: 2323236 - RNA, 13 nt, Human
gguuggugggggc

SEQ ID NO: 2323237 - RNA, 18 nt, Human
gguuguauuagauguucu

SEQ ID NO: 2323238 - RNA, 14 nt, Human
gguuggugcacagu

SEQ ID NO: 2323239 - RNA, 16 nt, Human
gguuggugcacaguga

SEQ ID NO: 2323240 - RNA, 19 nt, Human
gguuguauuagauguucuc

SEQ ID NO: 2323241 - RNA, 17 nt, Human
gguuggugcacagugau

SEQ ID NO: 2323242 - RNA, 14 nt, Human
gguuguauucuuug

SEQ ID NO: 2323243 - RNA, 16 nt, Human
gguucagaaaugcugc

SEQ ID NO: 2323244 - RNA, 22 nt, Human
gguucagaaaugcugccugccu

SEQ ID NO: 2323245 - RNA, 18 nt, Human
gguucagaaaugcugccu

SEQ ID NO: 2323246 - RNA, 19 nt, Human
gguucagaaaugcugccug

SEQ ID NO: 2323247 - RNA, 20 nt, Human
gguucacugcaaccuccgcc

SEQ ID NO: 2323248 - RNA, 22 nt, Human
gguucaagcgauucuucugcuu

SEQ ID NO: 2323249 - RNA, 23 nt, Human
gguucaagcgauucuucugcuuc

SEQ ID NO: 2323250 - RNA, 20 nt, Human
gguucagccccuccucugcc

SEQ ID NO: 2323251 - RNA, 19 nt, Human
gguucagccccuccucugc

SEQ ID NO: 2323252 - RNA, 18 nt, Human
gguucagccccuccucug

SEQ ID NO: 2323253 - RNA, 17 nt, Human
gguucagccccuccucu

SEQ ID NO: 2323254 - RNA, 16 nt, Human
gguucagccccuccuc

SEQ ID NO: 2323255 - RNA, 14 nt, Human
gguucagccccucc

SEQ ID NO: 2323256 - RNA, 16 nt, Human
gguucagagacucagg

SEQ ID NO: 2323257 - RNA, 12 nt, Human
gguucagcuugu

SEQ ID NO: 2323258 - RNA, 17 nt, Human
gguucuuucuuccucug

SEQ ID NO: 2323259 - RNA, 14 nt, Human
gguugaagcaccaa

SEQ ID NO: 2323260 - RNA, 22 nt, Human
gguucagccccuccucugccac

SEQ ID NO: 2323261 - RNA, 21 nt, Human
gguucagccccuccucugcca

SEQ ID NO: 2323262 - RNA, 15 nt, Human
gguucuuuggaagga

SEQ ID NO: 2323263 - RNA, 17 nt, Human
gguucuuuggaaggagu

SEQ ID NO: 2323264 - RNA, 18 nt, Human
gguucuuucuuccucugc

SEQ ID NO: 2323265 - RNA, 21 nt, Human
gguucaagcgauucuucugcu

SEQ ID NO: 2323266 - RNA, 17 nt, Human
gguggccucccaacuca

SEQ ID NO: 2323267 - RNA, 13 nt, Human
gguggccucccaa

SEQ ID NO: 2323268 - RNA, 19 nt, Human
gguggccuaagaguugagc

SEQ ID NO: 2323269 - RNA, 21 nt, Human
gguggccgcugaguggcaggg

SEQ ID NO: 2323270 - RNA, 20 nt, Human
gguggccgcugaguggcagg

SEQ ID NO: 2323271 - RNA, 19 nt, Human
gguggcccacgccuguaau

SEQ ID NO: 2323272 - RNA, 13 nt, Human
gguggcccauccc

SEQ ID NO: 2323273 - RNA, 22 nt, Human
gguggcccauccccccucacca

SEQ ID NO: 2323274 - RNA, 16 nt, Human
gguggcccgacagccu

SEQ ID NO: 2323275 - RNA, 17 nt, Human
gguggcccgacagccug

SEQ ID NO: 2323276 - RNA, 18 nt, Human
gguggcccgacagccugg

SEQ ID NO: 2323277 - RNA, 19 nt, Human
gguggcccgacagccuggc

SEQ ID NO: 2323278 - RNA, 20 nt, Human
gguggcccgacagccuggca

SEQ ID NO: 2323279 - RNA, 13 nt, Human
gguggcccugucc

SEQ ID NO: 2323280 - RNA, 23 nt, Human
gguggcccugucccucccaccuc

SEQ ID NO: 2323281 - RNA, 15 nt, Human
guaauugaacuuauc

SEQ ID NO: 2323282 - RNA, 16 nt, Human
guaauugaauaaaguu

SEQ ID NO: 2323283 - RNA, 12 nt, Human
guaauugcuuac

SEQ ID NO: 2323284 - RNA, 15 nt, Human
guaauugacaugugc

SEQ ID NO: 2323285 - RNA, 15 nt, Human
guaauuggaaaggca

SEQ ID NO: 2323286 - RNA, 13 nt, Human
guaauugugaaaa

SEQ ID NO: 2323287 - RNA, 23 nt, Human
guaauugcuuacauuuuuacaau

SEQ ID NO: 2323288 - RNA, 15 nt, Human
guaauugcuuacauu

SEQ ID NO: 2323289 - RNA, 16 nt, Human
guaauugcuuacauuu

SEQ ID NO: 2323290 - RNA, 17 nt, Human
guaauugcuuacauuuu

SEQ ID NO: 2323291 - RNA, 22 nt, Human
guaauugcuuacauuuuuacaa

SEQ ID NO: 2323292 - RNA, 18 nt, Human
guacacuguuucaaacuu

SEQ ID NO: 2323293 - RNA, 21 nt, Human
guaauuaucgggaacaguguu

SEQ ID NO: 2323294 - RNA, 23 nt, Human
guaauuauugugauuucccgugg

SEQ ID NO: 2323295 - RNA, 17 nt, Human
guaauuauuuugguacu

SEQ ID NO: 2323296 - RNA, 13 nt, Human
guaauucaagaaa

SEQ ID NO: 2323297 - RNA, 14 nt, Human
guaauucaagaaaa

SEQ ID NO: 2323298 - RNA, 18 nt, Human
guaauucuaaaugaaugu

SEQ ID NO: 2323299 - RNA, 22 nt, Human
guaauucuaaaugaauguuuac

SEQ ID NO: 2323300 - RNA, 12 nt, Human
guaauucuaaau

SEQ ID NO: 2323301 - RNA, 21 nt, Human
guaauuccucucacuaaacuu

SEQ ID NO: 2323302 - RNA, 14 nt, Human
guaauucuaaauga

SEQ ID NO: 2323303 - RNA, 15 nt, Human
guaauucuaaaugaa

SEQ ID NO: 2323304 - RNA, 20 nt, Human
guaauuaaguacuauguauc

SEQ ID NO: 2323305 - RNA, 17 nt, Human
guaauuaaguacuaugu

SEQ ID NO: 2323306 - RNA, 14 nt, Human
guaauuaaguacua

SEQ ID NO: 2323307 - RNA, 23 nt, Human
guaauguuacugaucaugcauug

SEQ ID NO: 2323308 - RNA, 22 nt, Human
guaauguuacugaucaugcauu

SEQ ID NO: 2323309 - RNA, 21 nt, Human
guaauuaaguacuauguauca

SEQ ID NO: 2323310 - RNA, 15 nt, Human
guaauuaguaacaug

SEQ ID NO: 2323311 - RNA, 19 nt, Human
guaauuaaaagaauuuucc

SEQ ID NO: 2323312 - RNA, 22 nt, Human
guaauuaucgggaacaguguuu

SEQ ID NO: 2323313 - RNA, 12 nt, Human
guaauuauugug

SEQ ID NO: 2323314 - RNA, 20 nt, Human
guaauuaucgggaacagugu

SEQ ID NO: 2323315 - RNA, 23 nt, Human
guaauuaguaacauguguuaagu

SEQ ID NO: 2323316 - RNA, 16 nt, Human
guaaucucguuucaaa

SEQ ID NO: 2323317 - RNA, 18 nt, Human
guaaucucguuucaaaaa

SEQ ID NO: 2323318 - RNA, 20 nt, Human
guaaucucguuucaaaaaca

SEQ ID NO: 2323319 - RNA, 12 nt, Human
guaaucugugua

SEQ ID NO: 2323320 - RNA, 16 nt, Human
guaaucuguguacaaa

SEQ ID NO: 2323321 - RNA, 16 nt, Human
guaaucugauggcuuc

SEQ ID NO: 2323322 - RNA, 16 nt, Human
guaaucguuaugugug

SEQ ID NO: 2323323 - RNA, 17 nt, Human
guaaucgcuuaaagaug

SEQ ID NO: 2323324 - RNA, 22 nt, Human
guaagugggguugcaaccacug

SEQ ID NO: 2323325 - RNA, 18 nt, Human
guaaucguuaugugugua

SEQ ID NO: 2323326 - RNA, 22 nt, Human
guaaucuccacagucaaagaag

SEQ ID NO: 2323327 - RNA, 22 nt, Human
guaaucuaugaauucuaaguga

SEQ ID NO: 2323328 - RNA, 15 nt, Human
guaaucguguccccu

SEQ ID NO: 2323329 - RNA, 13 nt, Human
guaagugccuucc

SEQ ID NO: 2323330 - RNA, 14 nt, Human
guaagugccuucca

SEQ ID NO: 2323331 - RNA, 21 nt, Human
guaagugggguugcaaccacu

SEQ ID NO: 2323332 - RNA, 11 nt, Human
guaaugaaaac

SEQ ID NO: 2323333 - RNA, 13 nt, Human
guaaugaaaacca

SEQ ID NO: 2323334 - RNA, 16 nt, Human
guaaugaaacuuggau

SEQ ID NO: 2323335 - RNA, 10 nt, Human
guaaugaaac

SEQ ID NO: 2323336 - RNA, 22 nt, Human
guaaugaaacaccuucucugga

SEQ ID NO: 2323337 - RNA, 17 nt, Human
guaaugaaccgcugaau

SEQ ID NO: 2323338 - RNA, 19 nt, Human
guaaugaaccgcugaauau

SEQ ID NO: 2323339 - RNA, 20 nt, Human
guaaucuguguacaaagaaa

SEQ ID NO: 2323340 - RNA, 15 nt, Human
guaaugaaacuugga

SEQ ID NO: 2323341 - RNA, 21 nt, Human
guaaugaauuuuuaugauauu

SEQ ID NO: 2323342 - RNA, 14 nt, Human
guaaugagggacug

SEQ ID NO: 2323343 - RNA, 18 nt, Human
guaaugaugucguuugaa

SEQ ID NO: 2323344 - RNA, 19 nt, Human
guaaugauaacuggaaacu

SEQ ID NO: 2323345 - RNA, 22 nt, Human
guaaugcuacgugugauuuuuc

SEQ ID NO: 2323346 - RNA, 20 nt, Human
guaaugcuuagagaauguuc

SEQ ID NO: 2323347 - RNA, 16 nt, Human
guaaugcuucaaucag

SEQ ID NO: 2323348 - RNA, 18 nt, Human
guaaugcuacgugugauu

SEQ ID NO: 2323349 - RNA, 21 nt, Human
guaaugauauagccagaaaaa

SEQ ID NO: 2323350 - RNA, 20 nt, Human
guaaugcuacgugugauuuu

SEQ ID NO: 2323351 - RNA, 15 nt, Human
guaaugagggacugg

SEQ ID NO: 2323352 - RNA, 20 nt, Human
guaaugauauagccagaaaa

SEQ ID NO: 2323353 - RNA, 16 nt, Human
guaaugugaauaaauu

SEQ ID NO: 2323354 - RNA, 14 nt, Human
guaaugugaauaaa

SEQ ID NO: 2323355 - RNA, 21 nt, Human
guaauguuacugaucaugcau

SEQ ID NO: 2323356 - RNA, 20 nt, Human
guaauguuacugaucaugca

SEQ ID NO: 2323357 - RNA, 17 nt, Human
guaauguuacugaucau

SEQ ID NO: 2323358 - RNA, 14 nt, Human
guaauguuacugau

SEQ ID NO: 2323359 - RNA, 13 nt, Human
guaauguuacuga

SEQ ID NO: 2323360 - RNA, 22 nt, Human
guaaugucaccaccuucccagc

SEQ ID NO: 2323361 - RNA, 20 nt, Human
guaaugucaccaccuuccca

SEQ ID NO: 2323362 - RNA, 19 nt, Human
guaaugucaccaccuuccc

SEQ ID NO: 2323363 - RNA, 12 nt, Human
guaaugucacca

SEQ ID NO: 2323364 - RNA, 12 nt, Human
guacaggcagca

SEQ ID NO: 2323365 - RNA, 18 nt, Human
guacagcuguuuaagaug

SEQ ID NO: 2323366 - RNA, 19 nt, Human
guacagaugaaugauaaac

SEQ ID NO: 2323367 - RNA, 20 nt, Human
guacagcaaggagauuuaca

SEQ ID NO: 2323368 - RNA, 12 nt, Human
guacagagccca

SEQ ID NO: 2323369 - RNA, 18 nt, Human
guacagagcccacgcccc

SEQ ID NO: 2323370 - RNA, 22 nt, Human
guacagagcccacgcccccacu

SEQ ID NO: 2323371 - RNA, 14 nt, Human
guaauugugaaaaa

SEQ ID NO: 2323372 - RNA, 21 nt, Human
guacacuguuucaaacuuuac

SEQ ID NO: 2323373 - RNA, 20 nt, Human
guacacuguuucaaacuuua

SEQ ID NO: 2323374 - RNA, 19 nt, Human
guacacuguuucaaacuuu

SEQ ID NO: 2323375 - RNA, 17 nt, Human
guacagacguaugcuua

SEQ ID NO: 2323376 - RNA, 20 nt, Human
guacagagaacuaacacuau

SEQ ID NO: 2323377 - RNA, 21 nt, Human
guacagagaacuaacacuauu

SEQ ID NO: 2323378 - RNA, 14 nt, Human
guacagaaagcugc

SEQ ID NO: 2323379 - RNA, 12 nt, Human
guacacuuuuuu

SEQ ID NO: 2323380 - RNA, 15 nt, Human
guacagacagaaaaa

SEQ ID NO: 2323381 - RNA, 20 nt, Human
guacagaauucugcuaccuc

SEQ ID NO: 2323382 - RNA, 13 nt, Human
guacagaaagcug

SEQ ID NO: 2323383 - RNA, 16 nt, Human
guacagacaacaaacc

SEQ ID NO: 2323384 - RNA, 19 nt, Human
guacaguuuguuuacacac

SEQ ID NO: 2323385 - RNA, 16 nt, Human
guacaguuuguuuaca

SEQ ID NO: 2323386 - RNA, 18 nt, Human
guacaguuuguuuacaca

SEQ ID NO: 2323387 - RNA, 22 nt, Human
guacaguucuucgggaagagag

SEQ ID NO: 2323388 - RNA, 23 nt, Human
guacaguucuucgggaagagagg

SEQ ID NO: 2323389 - RNA, 15 nt, Human
guacaguuugcugua

SEQ ID NO: 2323390 - RNA, 16 nt, Human
guacaguuugcuguac

SEQ ID NO: 2323391 - RNA, 14 nt, Human
guacaguuugcugu

SEQ ID NO: 2323392 - RNA, 22 nt, Human
guacaguucaguuccucuuugc

SEQ ID NO: 2323393 - RNA, 23 nt, Human
guacaguucaguuccucuuugca

SEQ ID NO: 2323394 - RNA, 12 nt, Human
guacaguucuuc

SEQ ID NO: 2323395 - RNA, 16 nt, Human
guacaguucuucggga

SEQ ID NO: 2323396 - RNA, 16 nt, Human
guacaguguguaaagu

SEQ ID NO: 2323397 - RNA, 14 nt, Human
guacaguguucugu

SEQ ID NO: 2323398 - RNA, 16 nt, Human
guacaguguucuguuu

SEQ ID NO: 2323399 - RNA, 17 nt, Human
guacaguguucuguuua

SEQ ID NO: 2323400 - RNA, 21 nt, Human
guacaguuauuuaugccucug

SEQ ID NO: 2323401 - RNA, 14 nt, Human
guacaguucaguuc

SEQ ID NO: 2323402 - RNA, 16 nt, Human
guacaguucaguuccu

SEQ ID NO: 2323403 - RNA, 19 nt, Human
guacaguucaguuccucuu

SEQ ID NO: 2323404 - RNA, 16 nt, Human
guacagucuuguauua

SEQ ID NO: 2323405 - RNA, 12 nt, Human
guacagucuguc

SEQ ID NO: 2323406 - RNA, 19 nt, Human
guacagucuugcagcagga

SEQ ID NO: 2323407 - RNA, 13 nt, Human
guacagucuugua

SEQ ID NO: 2323408 - RNA, 14 nt, Human
guacagucuuguau

SEQ ID NO: 2323409 - RNA, 17 nt, Human
guacaggcagcacagag

SEQ ID NO: 2323410 - RNA, 15 nt, Human
guacaggcagcacag

SEQ ID NO: 2323411 - RNA, 15 nt, Human
guacagguaagguga

SEQ ID NO: 2323412 - RNA, 14 nt, Human
guacagucugucau

SEQ ID NO: 2323413 - RNA, 12 nt, Human
guacaguuuuua

SEQ ID NO: 2323414 - RNA, 13 nt, Human
guacaguuuuuau

SEQ ID NO: 2323415 - RNA, 23 nt, Human
guacauaaaggugguaugugugu

SEQ ID NO: 2323416 - RNA, 22 nt, Human
guacauaaaggugguaugugug

SEQ ID NO: 2323417 - RNA, 14 nt, Human
guacauaacugaaa

SEQ ID NO: 2323418 - RNA, 19 nt, Human
guacauacccuggccgccc

SEQ ID NO: 2323419 - RNA, 22 nt, Human
guacauacccuggccgcccccu

SEQ ID NO: 2323420 - RNA, 20 nt, Human
guacauaaugcgugcauacc

SEQ ID NO: 2323421 - RNA, 12 nt, Human
guacauagccua

SEQ ID NO: 2323422 - RNA, 18 nt, Human
guacauaguuauuuauuu

SEQ ID NO: 2323423 - RNA, 17 nt, Human
guacauaguuauuuauu

SEQ ID NO: 2323424 - RNA, 13 nt, Human
guacauagccuau

SEQ ID NO: 2323425 - RNA, 14 nt, Human
guacauagccuaua

SEQ ID NO: 2323426 - RNA, 15 nt, Human
guacauagccuauau

SEQ ID NO: 2323427 - RNA, 22 nt, Human
guacauagccuauauuuacagu

SEQ ID NO: 2323428 - RNA, 15 nt, Human
guacccacugcucug

SEQ ID NO: 2323429 - RNA, 18 nt, Human
guacauauguaaaauaaa

SEQ ID NO: 2323430 - RNA, 14 nt, Human
guacauaugugcug

SEQ ID NO: 2323431 - RNA, 16 nt, Human
guacauaugugcugga

SEQ ID NO: 2323432 - RNA, 23 nt, Human
guaccuugaacacugggggaggg

SEQ ID NO: 2323433 - RNA, 18 nt, Human
guaccuugaacacugggg

SEQ ID NO: 2323434 - RNA, 14 nt, Human
guaccuugaacacu

SEQ ID NO: 2323435 - RNA, 17 nt, Human
guaccuggugaccccuu

SEQ ID NO: 2323436 - RNA, 19 nt, Human
guaccuguuccuuagaccu

SEQ ID NO: 2323437 - RNA, 15 nt, Human
guaccuggaggagga

SEQ ID NO: 2323438 - RNA, 17 nt, Human
guaccugcccccaaucc

SEQ ID NO: 2323439 - RNA, 18 nt, Human
guaccugaaaaguaacuu

SEQ ID NO: 2323440 - RNA, 23 nt, Human
guaccugaaaaguaacuuggcuu

SEQ ID NO: 2323441 - RNA, 14 nt, Human
guaccuauaaagua

SEQ ID NO: 2323442 - RNA, 19 nt, Human
guaccuauaaaguaaagcu

SEQ ID NO: 2323443 - RNA, 20 nt, Human
guaccuauaaaguaaagcua

SEQ ID NO: 2323444 - RNA, 21 nt, Human
guaccuauaaaguaaagcuaa

SEQ ID NO: 2323445 - RNA, 14 nt, Human
guaccuauuuucau

SEQ ID NO: 2323446 - RNA, 12 nt, Human
guaccugaaaag

SEQ ID NO: 2323447 - RNA, 14 nt, Human
guaccugaaaagua

SEQ ID NO: 2323448 - RNA, 22 nt, Human
guaccucuugagccuugaacuu

SEQ ID NO: 2323449 - RNA, 21 nt, Human
guaccucuugagccuugaacu

SEQ ID NO: 2323450 - RNA, 13 nt, Human
guaccucuugagc

SEQ ID NO: 2323451 - RNA, 18 nt, Human
guaccuauuuucauugua

SEQ ID NO: 2323452 - RNA, 23 nt, Human
guaccccacccucagcaccccuu

SEQ ID NO: 2323453 - RNA, 19 nt, Human
guaccccacccucagcacc

SEQ ID NO: 2323454 - RNA, 22 nt, Human
guaccccacccucagcaccccu

SEQ ID NO: 2323455 - RNA, 21 nt, Human
guacccagccaucugcccagg

SEQ ID NO: 2323456 - RNA, 12 nt, Human
guaccccacccu

SEQ ID NO: 2323457 - RNA, 13 nt, Human
guaccccacccuc

SEQ ID NO: 2323458 - RNA, 14 nt, Human
guaccccacccuca

SEQ ID NO: 2323459 - RNA, 14 nt, Human
guaccccccaaccc

SEQ ID NO: 2323460 - RNA, 21 nt, Human
guaccccccaaccccugagga

SEQ ID NO: 2323461 - RNA, 13 nt, Human
guacccccgccca

SEQ ID NO: 2323462 - RNA, 17 nt, Human
guacccccgcccaggcu

SEQ ID NO: 2323463 - RNA, 19 nt, Human
guacauauuuguggaauaa

SEQ ID NO: 2323464 - RNA, 17 nt, Human
guacauauuuguggaau

SEQ ID NO: 2323465 - RNA, 12 nt, Human
guacccagccau

SEQ ID NO: 2323466 - RNA, 15 nt, Human
guacccagccaucug

SEQ ID NO: 2323467 - RNA, 18 nt, Human
guacccagccaucugccc

SEQ ID NO: 2323468 - RNA, 20 nt, Human
guacccagccaucugcccag

SEQ ID NO: 2323469 - RNA, 16 nt, Human
guacccacugcucugg

SEQ ID NO: 2323470 - RNA, 15 nt, Human
guaccgcaaugugac

SEQ ID NO: 2323471 - RNA, 15 nt, Human
guacccucuggaggg

SEQ ID NO: 2323472 - RNA, 13 nt, Human
guaccuauaaagu

SEQ ID NO: 2323473 - RNA, 23 nt, Human
guaccgccuugcacacucagaag

SEQ ID NO: 2323474 - RNA, 15 nt, Human
guacccccuucuggg

SEQ ID NO: 2323475 - RNA, 12 nt, Human
guacccccuucu

SEQ ID NO: 2323476 - RNA, 14 nt, Human
guacccccuucugg

SEQ ID NO: 2323477 - RNA, 18 nt, Human
guacccccgcccaggcug

SEQ ID NO: 2323478 - RNA, 19 nt, Human
guacccccgcccaggcugg

SEQ ID NO: 2323479 - RNA, 20 nt, Human
guacccccgcccaggcuggc

SEQ ID NO: 2323480 - RNA, 23 nt, Human
guacccccgcccaggcuggccag

SEQ ID NO: 2323481 - RNA, 17 nt, Human
guacccuccuggcucuu

SEQ ID NO: 2323482 - RNA, 17 nt, Human
guacccucucagcucca

SEQ ID NO: 2323483 - RNA, 18 nt, Human
guacccucucagcuccag

SEQ ID NO: 2323484 - RNA, 19 nt, Human
guacccucucagcuccagg

SEQ ID NO: 2323485 - RNA, 15 nt, Human
guacuacaauuuaaa

SEQ ID NO: 2323486 - RNA, 12 nt, Human
guacuacaauuu

SEQ ID NO: 2323487 - RNA, 22 nt, Human
guacuaacuccuaggaaaauac

SEQ ID NO: 2323488 - RNA, 14 nt, Human
guacuucuccaccc

SEQ ID NO: 2323489 - RNA, 15 nt, Human
guacuucuccacccu

SEQ ID NO: 2323490 - RNA, 23 nt, Human
guacuaaggaaucuuucugcuuu

SEQ ID NO: 2323491 - RNA, 15 nt, Human
guacuaaggaaucuu

SEQ ID NO: 2323492 - RNA, 15 nt, Human
guacguggagaggga

SEQ ID NO: 2323493 - RNA, 21 nt, Human
guacguuauuguugacuuauu

SEQ ID NO: 2323494 - RNA, 14 nt, Human
guacguuuguaugu

SEQ ID NO: 2323495 - RNA, 17 nt, Human
guacguuuguaugugug

SEQ ID NO: 2323496 - RNA, 17 nt, Human
guacguugugcauuugg

SEQ ID NO: 2323497 - RNA, 17 nt, Human
guacgucugacaggcaa

SEQ ID NO: 2323498 - RNA, 14 nt, Human
guacguugugcauu

SEQ ID NO: 2323499 - RNA, 16 nt, Human
guacguugugcauuug

SEQ ID NO: 2323500 - RNA, 15 nt, Human
guacguugugcauuu

SEQ ID NO: 2323501 - RNA, 14 nt, Human
guacgucugacagg

SEQ ID NO: 2323502 - RNA, 15 nt, Human
guacgucugacaggc

SEQ ID NO: 2323503 - RNA, 13 nt, Human
guaccuuugucac

SEQ ID NO: 2323504 - RNA, 13 nt, Human
guaccuuuuaaca

SEQ ID NO: 2323505 - RNA, 21 nt, Human
guaccuuuugaggagccccag

SEQ ID NO: 2323506 - RNA, 23 nt, Human
guaccuuuugaggagccccagcu

SEQ ID NO: 2323507 - RNA, 19 nt, Human
guaccuuuuaacaccugau

SEQ ID NO: 2323508 - RNA, 10 nt, Human
guacuuugug

SEQ ID NO: 2323509 - RNA, 20 nt, Human
guacuuuuaugauguauauu

SEQ ID NO: 2323510 - RNA, 14 nt, Human
guacuuuggaggcc

SEQ ID NO: 2323511 - RNA, 21 nt, Human
guacuuguggacacagcucuu

SEQ ID NO: 2323512 - RNA, 17 nt, Human
guacuugucaaagaagg

SEQ ID NO: 2323513 - RNA, 15 nt, Human
guacuugucaaagaa

SEQ ID NO: 2323514 - RNA, 16 nt, Human
guacuugucaaagaag

SEQ ID NO: 2323515 - RNA, 23 nt, Human
guacuuuauuuucuauaauuuaa

SEQ ID NO: 2323516 - RNA, 18 nt, Human
guagaaagacagagcugg

SEQ ID NO: 2323517 - RNA, 21 nt, Human
guagaaagacagagcugggau

SEQ ID NO: 2323518 - RNA, 19 nt, Human
guagaaacugcagggaaaa

SEQ ID NO: 2323519 - RNA, 15 nt, Human
guagaaacugcaggg

SEQ ID NO: 2323520 - RNA, 20 nt, Human
guagaaaagggaacugaaca

SEQ ID NO: 2323521 - RNA, 22 nt, Human
guacuuuuaugauguauauuua

SEQ ID NO: 2323522 - RNA, 13 nt, Human
guagaaaagcuau

SEQ ID NO: 2323523 - RNA, 21 nt, Human
guagagcuagaacauggagag

SEQ ID NO: 2323524 - RNA, 15 nt, Human
guagaggagaaacug

SEQ ID NO: 2323525 - RNA, 16 nt, Human
guagagcggagaaagg

SEQ ID NO: 2323526 - RNA, 14 nt, Human
guagaaaggccuuu

SEQ ID NO: 2323527 - RNA, 16 nt, Human
guagaaaggccuuuaa

SEQ ID NO: 2323528 - RNA, 17 nt, Human
guagaaaggccuuuaaa

SEQ ID NO: 2323529 - RNA, 14 nt, Human
guacuugucaaaga

SEQ ID NO: 2323530 - RNA, 11 nt, Human
guacuugucaa

SEQ ID NO: 2323531 - RNA, 21 nt, Human
guacuuggaguauuggggucu

SEQ ID NO: 2323532 - RNA, 22 nt, Human
guacuugcucuugaugccuggc

SEQ ID NO: 2323533 - RNA, 16 nt, Human
guacuuguggacacag

SEQ ID NO: 2323534 - RNA, 20 nt, Human
guacuuguggacacagcucu

SEQ ID NO: 2323535 - RNA, 15 nt, Human
guacuugcucuugau

SEQ ID NO: 2323536 - RNA, 16 nt, Human
guacuugcucuugaug

SEQ ID NO: 2323537 - RNA, 18 nt, Human
guacuugcucuugaugcc

SEQ ID NO: 2323538 - RNA, 19 nt, Human
guacuugcucuugaugccu

SEQ ID NO: 2323539 - RNA, 20 nt, Human
guacuucuccacccugcucu

SEQ ID NO: 2323540 - RNA, 21 nt, Human
guacuucuccacccugcucuc

SEQ ID NO: 2323541 - RNA, 14 nt, Human
guacuugcucuuga

SEQ ID NO: 2323542 - RNA, 22 nt, Human
guacuugccuuauuagaguguc

SEQ ID NO: 2323543 - RNA, 22 nt, Human
guacuugaaaucuaggauuauu

SEQ ID NO: 2323544 - RNA, 16 nt, Human
guacuucuccacccug

SEQ ID NO: 2323545 - RNA, 17 nt, Human
guacuucuccacccugc

SEQ ID NO: 2323546 - RNA, 18 nt, Human
guacuucuccacccugcu

SEQ ID NO: 2323547 - RNA, 19 nt, Human
guacuucuccacccugcuc

SEQ ID NO: 2323548 - RNA, 22 nt, Human
gcugcaucccccccaccucucc

SEQ ID NO: 2323549 - RNA, 18 nt, Human
gcugauguucaguguaau

SEQ ID NO: 2323550 - RNA, 22 nt, Human
gcugcaucugggauucccacca

SEQ ID NO: 2323551 - RNA, 18 nt, Human
gcugcauccuccaagaau

SEQ ID NO: 2323552 - RNA, 22 nt, Human
gcugcauggggugggguagggc

SEQ ID NO: 2323553 - RNA, 20 nt, Human
gcugcaugccuggucuuucc

SEQ ID NO: 2323554 - RNA, 14 nt, Human
gcugcaugccuggu

SEQ ID NO: 2323555 - RNA, 18 nt, Human
gcugcaugccuggucuuu

SEQ ID NO: 2323556 - RNA, 22 nt, Human
gcugcauccuccaagaaucuau

SEQ ID NO: 2323557 - RNA, 23 nt, Human
gcugccaaggccagaguggccug

SEQ ID NO: 2323558 - RNA, 22 nt, Human
gcugccaaggccagaguggccu

SEQ ID NO: 2323559 - RNA, 18 nt, Human
gcugccaaggccagagug

SEQ ID NO: 2323560 - RNA, 18 nt, Human
gcugauggugcaaugacc

SEQ ID NO: 2323561 - RNA, 21 nt, Human
gcugauggugcaaugaccuuu

SEQ ID NO: 2323562 - RNA, 23 nt, Human
gcugauggauaaccuauaugauu

SEQ ID NO: 2323563 - RNA, 17 nt, Human
gcugaugucaauuucug

SEQ ID NO: 2323564 - RNA, 20 nt, Human
gcugaugucaauuucugugu

SEQ ID NO: 2323565 - RNA, 23 nt, Human
gcugaugucaauuucuguguugc

SEQ ID NO: 2323566 - RNA, 20 nt, Human
gcugauguccucaccacaug

SEQ ID NO: 2323567 - RNA, 13 nt, Human
gcugauguucagu

SEQ ID NO: 2323568 - RNA, 14 nt, Human
gcugauguucagug

SEQ ID NO: 2323569 - RNA, 15 nt, Human
gcugauguucagugu

SEQ ID NO: 2323570 - RNA, 16 nt, Human
gcugauguucagugua

SEQ ID NO: 2323571 - RNA, 17 nt, Human
gcugauguucaguguaa

SEQ ID NO: 2323572 - RNA, 21 nt, Human
gcugcaguugccagucacccc

SEQ ID NO: 2323573 - RNA, 20 nt, Human
gcugauguucaguguaauuu

SEQ ID NO: 2323574 - RNA, 18 nt, Human
gcugcaguugccagucac

SEQ ID NO: 2323575 - RNA, 20 nt, Human
gcugcaguugccagucaccc

SEQ ID NO: 2323576 - RNA, 20 nt, Human
gcugaugauuuguuuuugua

SEQ ID NO: 2323577 - RNA, 14 nt, Human
gcugaugcugggcu

SEQ ID NO: 2323578 - RNA, 15 nt, Human
gcugaugcugggcug

SEQ ID NO: 2323579 - RNA, 16 nt, Human
gcugaugcugggcugg

SEQ ID NO: 2323580 - RNA, 19 nt, Human
gcugaugcugggcugggug

SEQ ID NO: 2323581 - RNA, 20 nt, Human
gcugaugcugggcugggugc

SEQ ID NO: 2323582 - RNA, 15 nt, Human
gcugauggugcaaug

SEQ ID NO: 2323583 - RNA, 16 nt, Human
gcugauggugcaauga

SEQ ID NO: 2323584 - RNA, 13 nt, Human
gcugaguuggugu

SEQ ID NO: 2323585 - RNA, 21 nt, Human
gcugaguggcaggggacagga

SEQ ID NO: 2323586 - RNA, 23 nt, Human
gcugagugggggaucacagccuc

SEQ ID NO: 2323587 - RNA, 22 nt, Human
gcugagugggggaucacagccu

SEQ ID NO: 2323588 - RNA, 17 nt, Human
gcugaguggcaggggac

SEQ ID NO: 2323589 - RNA, 19 nt, Human
gcugaguggcaggggacag

SEQ ID NO: 2323590 - RNA, 17 nt, Human
gcugagucucccaaggc

SEQ ID NO: 2323591 - RNA, 19 nt, Human
gcugagucugaaggcuggg

SEQ ID NO: 2323592 - RNA, 16 nt, Human
gcugagucugaaggcu

SEQ ID NO: 2323593 - RNA, 18 nt, Human
gcugagucugaaggcugg

SEQ ID NO: 2323594 - RNA, 18 nt, Human
gcugacugauguugaggg

SEQ ID NO: 2323595 - RNA, 13 nt, Human
gcugagucuccca

SEQ ID NO: 2323596 - RNA, 14 nt, Human
gcugagucucccaa

SEQ ID NO: 2323597 - RNA, 15 nt, Human
gcugagucucccaag

SEQ ID NO: 2323598 - RNA, 16 nt, Human
gcugagucucccaagg

SEQ ID NO: 2323599 - RNA, 15 nt, Human
gcugagucugaaggc

SEQ ID NO: 2323600 - RNA, 21 nt, Human
gcugacuguacuccucccagg

SEQ ID NO: 2323601 - RNA, 17 nt, Human
gcugagucccaggcuga

SEQ ID NO: 2323602 - RNA, 22 nt, Human
gcugagucccaggcugagccuc

SEQ ID NO: 2323603 - RNA, 21 nt, Human
gcugagucccaggcugagccu

SEQ ID NO: 2323604 - RNA, 20 nt, Human
gcucuuccgaaaaccaggcc

SEQ ID NO: 2323605 - RNA, 12 nt, Human
gcucuucucauu

SEQ ID NO: 2323606 - RNA, 22 nt, Human
gcucuuccaggcugggagagcc

SEQ ID NO: 2323607 - RNA, 12 nt, Human
gcucuucuccag

SEQ ID NO: 2323608 - RNA, 14 nt, Human
gcucuucucauuuc

SEQ ID NO: 2323609 - RNA, 15 nt, Human
gcucuucucauuuca

SEQ ID NO: 2323610 - RNA, 16 nt, Human
gcucuucucauuucac

SEQ ID NO: 2323611 - RNA, 20 nt, Human
gcucuucucauuucaccccu

SEQ ID NO: 2323612 - RNA, 17 nt, Human
gcucuggaccagccugu

SEQ ID NO: 2323613 - RNA, 15 nt, Human
gcucuggaagagagg

SEQ ID NO: 2323614 - RNA, 11 nt, Human
gcucuggacca

SEQ ID NO: 2323615 - RNA, 22 nt, Human
gcucuggaccaacccuguuucc

SEQ ID NO: 2323616 - RNA, 16 nt, Human
gcucuggaccagccug

SEQ ID NO: 2323617 - RNA, 22 nt, Human
gcucuggacagccccacccugg

SEQ ID NO: 2323618 - RNA, 20 nt, Human
gcucuggacagccccacccu

SEQ ID NO: 2323619 - RNA, 19 nt, Human
gcucuuccaggcugggaga

SEQ ID NO: 2323620 - RNA, 18 nt, Human
gcucuuccaggcugggag

SEQ ID NO: 2323621 - RNA, 23 nt, Human
gcucuucuccuuucacaaccuuc

SEQ ID NO: 2323622 - RNA, 13 nt, Human
gcucuucugacua

SEQ ID NO: 2323623 - RNA, 23 nt, Human
gcucuucugcccaauuggaggaa

SEQ ID NO: 2323624 - RNA, 14 nt, Human
gcucuugaugccug

SEQ ID NO: 2323625 - RNA, 15 nt, Human
gcucuugaugccugg

SEQ ID NO: 2323626 - RNA, 16 nt, Human
gcucuugaugccuggc

SEQ ID NO: 2323627 - RNA, 13 nt, Human
gcucuucuccuuu

SEQ ID NO: 2323628 - RNA, 22 nt, Human
gcucuucucauuucaccccucc

SEQ ID NO: 2323629 - RNA, 23 nt, Human
gcucuucucauuucaccccuccc

SEQ ID NO: 2323630 - RNA, 17 nt, Human
gcucuucuccuuucaca

SEQ ID NO: 2323631 - RNA, 21 nt, Human
gcucuucuccuuucacaaccu

SEQ ID NO: 2323632 - RNA, 14 nt, Human
gcucuucuccaggc

SEQ ID NO: 2323633 - RNA, 16 nt, Human
gcucuucuccaggcug

SEQ ID NO: 2323634 - RNA, 20 nt, Human
gcugacugauguugagggaa

SEQ ID NO: 2323635 - RNA, 23 nt, Human
gcugacucuaggugcccuuggag

SEQ ID NO: 2323636 - RNA, 18 nt, Human
gcugacuguacuccuccc

SEQ ID NO: 2323637 - RNA, 19 nt, Human
gcugacuguacuccuccca

SEQ ID NO: 2323638 - RNA, 13 nt, Human
gcugaccucuggu

SEQ ID NO: 2323639 - RNA, 17 nt, Human
gcugaccuccacagcuu

SEQ ID NO: 2323640 - RNA, 16 nt, Human
gcugaccuccacagcu

SEQ ID NO: 2323641 - RNA, 15 nt, Human
gcugaccuccacagc

SEQ ID NO: 2323642 - RNA, 14 nt, Human
gcugaccuccacag

SEQ ID NO: 2323643 - RNA, 15 nt, Human
gcugacccuccuguu

SEQ ID NO: 2323644 - RNA, 22 nt, Human
gcugacccuccuguugcaccca

SEQ ID NO: 2323645 - RNA, 23 nt, Human
gcugacuagaagggccaguccug

SEQ ID NO: 2323646 - RNA, 15 nt, Human
gcugacuagaagggc

SEQ ID NO: 2323647 - RNA, 18 nt, Human
gcugaccucuguuguccu

SEQ ID NO: 2323648 - RNA, 16 nt, Human
gcugaccucugguggc

SEQ ID NO: 2323649 - RNA, 14 nt, Human
gcugaccucuguug

SEQ ID NO: 2323650 - RNA, 22 nt, Human
gcugacccagccccuugagaaa

SEQ ID NO: 2323651 - RNA, 22 nt, Human
gcugaccaugcucaucugcugg

SEQ ID NO: 2323652 - RNA, 21 nt, Human
gcugaccaugcucaucugcug

SEQ ID NO: 2323653 - RNA, 16 nt, Human
gcugacaucuguguuu

SEQ ID NO: 2323654 - RNA, 19 nt, Human
gcugacaucuguguuucaa

SEQ ID NO: 2323655 - RNA, 18 nt, Human
gcugacagcugcuccuag

SEQ ID NO: 2323656 - RNA, 12 nt, Human
gcugacaguccu

SEQ ID NO: 2323657 - RNA, 17 nt, Human
gcugacagcugcuccua

SEQ ID NO: 2323658 - RNA, 15 nt, Human
gcugacagcugcucc

SEQ ID NO: 2323659 - RNA, 14 nt, Human
gcugacaguccucu

SEQ ID NO: 2323660 - RNA, 16 nt, Human
gcugacaguccucucc

SEQ ID NO: 2323661 - RNA, 19 nt, Human
gcugacaguccucuccacc

SEQ ID NO: 2323662 - RNA, 13 nt, Human
gcugacaucugug

SEQ ID NO: 2323663 - RNA, 16 nt, Human
gcugacccagucccug

SEQ ID NO: 2323664 - RNA, 15 nt, Human
gcugacccagucccu

SEQ ID NO: 2323665 - RNA, 13 nt, Human
gcugacccagucc

SEQ ID NO: 2323666 - RNA, 13 nt, Human
gcugacccagccu

SEQ ID NO: 2323667 - RNA, 19 nt, Human
gcugacccagucccugggg

SEQ ID NO: 2323668 - RNA, 17 nt, Human
gcugacccagucccugg

SEQ ID NO: 2323669 - RNA, 14 nt, Human
gcugacccuccugu

SEQ ID NO: 2323670 - RNA, 18 nt, Human
gcugaccccaaagagccu

SEQ ID NO: 2323671 - RNA, 19 nt, Human
gcugaccccaaagagccug

SEQ ID NO: 2323672 - RNA, 21 nt, Human
gcucuuuaugaaugaaaaaac

SEQ ID NO: 2323673 - RNA, 13 nt, Human
gcucuuucagggg

SEQ ID NO: 2323674 - RNA, 14 nt, Human
gcucuuuagccagu

SEQ ID NO: 2323675 - RNA, 12 nt, Human
gcucuuucaggg

SEQ ID NO: 2323676 - RNA, 17 nt, Human
gcucuugugaggaaagu

SEQ ID NO: 2323677 - RNA, 19 nt, Human
gcucuugugaggaaaguca

SEQ ID NO: 2323678 - RNA, 20 nt, Human
gcucuugugaggaaagucau

SEQ ID NO: 2323679 - RNA, 22 nt, Human
gcucuugugcuggauggagccc

SEQ ID NO: 2323680 - RNA, 22 nt, Human
gcucuugugguacacacagauu

SEQ ID NO: 2323681 - RNA, 17 nt, Human
gcucuugaugccuggcg

SEQ ID NO: 2323682 - RNA, 16 nt, Human
gcucuugugaggaaag

SEQ ID NO: 2323683 - RNA, 21 nt, Human
gcucuucugacuacugggcaa

SEQ ID NO: 2323684 - RNA, 22 nt, Human
gcucuugauaccccccucuguc

SEQ ID NO: 2323685 - RNA, 23 nt, Human
gcucuugauaccccccucugucu

SEQ ID NO: 2323686 - RNA, 21 nt, Human
gcugacagacacaggcccggc

SEQ ID NO: 2323687 - RNA, 17 nt, Human
gcugacagacagcccuc

SEQ ID NO: 2323688 - RNA, 14 nt, Human
gcugacagcugcuc

SEQ ID NO: 2323689 - RNA, 13 nt, Human
gcugacagcugcu

SEQ ID NO: 2323690 - RNA, 16 nt, Human
gcucuuucucugccag

SEQ ID NO: 2323691 - RNA, 14 nt, Human
gcucuuuccuccuu

SEQ ID NO: 2323692 - RNA, 17 nt, Human
gcucuuuccuccuucca

SEQ ID NO: 2323693 - RNA, 15 nt, Human
gcucuuuccuccuuc

SEQ ID NO: 2323694 - RNA, 15 nt, Human
gcucuuuccuugcuc

SEQ ID NO: 2323695 - RNA, 16 nt, Human
gcucuuuccuugcuca

SEQ ID NO: 2323696 - RNA, 18 nt, Human
gcucuuuccuugcucaac

SEQ ID NO: 2323697 - RNA, 17 nt, Human
gcucuuucuacucugaa

SEQ ID NO: 2323698 - RNA, 14 nt, Human
gcucuuucucugcc

SEQ ID NO: 2323699 - RNA, 15 nt, Human
gcucuuucucugcca

SEQ ID NO: 2323700 - RNA, 17 nt, Human
gcucuuucucugccagu

SEQ ID NO: 2323701 - RNA, 14 nt, Human
gcucuggaagagag

SEQ ID NO: 2323702 - RNA, 22 nt, Human
gcucuggaaaaugugacccaga

SEQ ID NO: 2323703 - RNA, 21 nt, Human
gcucuggaaaaugugacccag

SEQ ID NO: 2323704 - RNA, 19 nt, Human
gcucuggacagccccaccc

SEQ ID NO: 2323705 - RNA, 16 nt, Human
gcucuggacagcccca

SEQ ID NO: 2323706 - RNA, 14 nt, Human
gcucuggacaggca

SEQ ID NO: 2323707 - RNA, 13 nt, Human
gcucugcuggccu

SEQ ID NO: 2323708 - RNA, 22 nt, Human
gcucugcgugucaccugugcuu

SEQ ID NO: 2323709 - RNA, 21 nt, Human
gcucugcuggccuggccggca

SEQ ID NO: 2323710 - RNA, 21 nt, Human
gcucugcuugacaacaucuga

SEQ ID NO: 2323711 - RNA, 14 nt, Human
gcucugcuugacaa

SEQ ID NO: 2323712 - RNA, 15 nt, Human
gcucugcuggccugg

SEQ ID NO: 2323713 - RNA, 17 nt, Human
gcucugcuggccuggcc

SEQ ID NO: 2323714 - RNA, 18 nt, Human
gcucugcuggccuggccg

SEQ ID NO: 2323715 - RNA, 19 nt, Human
gcucugcuggccuggccgg

SEQ ID NO: 2323716 - RNA, 15 nt, Human
gcucuggacaggcau

SEQ ID NO: 2323717 - RNA, 16 nt, Human
gcucuggacaggcaug

SEQ ID NO: 2323718 - RNA, 21 nt, Human
gcucuggacaggcauguucuc

SEQ ID NO: 2323719 - RNA, 22 nt, Human
gcucuggacaggcauguucucu

SEQ ID NO: 2323720 - RNA, 19 nt, Human
gcucugcuccucuccccag

SEQ ID NO: 2323721 - RNA, 21 nt, Human
gcucugcuccucuccccagca

SEQ ID NO: 2323722 - RNA, 13 nt, Human
gcucugcugacag

SEQ ID NO: 2323723 - RNA, 14 nt, Human
gcucugcugacaga

SEQ ID NO: 2323724 - RNA, 18 nt, Human
gcucugcugacagacaca

SEQ ID NO: 2323725 - RNA, 19 nt, Human
gcucugcugacagacacag

SEQ ID NO: 2323726 - RNA, 20 nt, Human
gcucugcugacagacacagg

SEQ ID NO: 2323727 - RNA, 23 nt, Human
gcucugcugacagacacaggccc

SEQ ID NO: 2323728 - RNA, 13 nt, Human
gcucugcuccucu

SEQ ID NO: 2323729 - RNA, 14 nt, Human
gcucugcuccucuc

SEQ ID NO: 2323730 - RNA, 17 nt, Human
gcucugcgugucaccug

SEQ ID NO: 2323731 - RNA, 13 nt, Human
gcucucugcugua

SEQ ID NO: 2323732 - RNA, 21 nt, Human
gcucugcccuuguucccuagg

SEQ ID NO: 2323733 - RNA, 18 nt, Human
gcucugcccuuguucccu

SEQ ID NO: 2323734 - RNA, 13 nt, Human
gcucugccuccca

SEQ ID NO: 2323735 - RNA, 14 nt, Human
gcucugccucccau

SEQ ID NO: 2323736 - RNA, 15 nt, Human
gcucugccucccauc

SEQ ID NO: 2323737 - RNA, 22 nt, Human
gcucugccucccaucacccgcu

SEQ ID NO: 2323738 - RNA, 11 nt, Human
gcucucugcug

SEQ ID NO: 2323739 - RNA, 18 nt, Human
gcucucuggccuuuuccu

SEQ ID NO: 2323740 - RNA, 14 nt, Human
gcucugcccuuggu

SEQ ID NO: 2323741 - RNA, 23 nt, Human
gcucugcccuugguuaggcauug

SEQ ID NO: 2323742 - RNA, 11 nt, Human
gcucugccucc

SEQ ID NO: 2323743 - RNA, 20 nt, Human
gcucucuggccuucggccuc

SEQ ID NO: 2323744 - RNA, 19 nt, Human
gcucucuggccuucggccu

SEQ ID NO: 2323745 - RNA, 15 nt, Human
gcucucuggccuucg

SEQ ID NO: 2323746 - RNA, 14 nt, Human
gcucucuggccuuc

SEQ ID NO: 2323747 - RNA, 16 nt, Human
gcucuccuuucuuucu

SEQ ID NO: 2323748 - RNA, 22 nt, Human
gcucuccuuccuggagcccaga

SEQ ID NO: 2323749 - RNA, 11 nt, Human
gcucuccuucc

SEQ ID NO: 2323750 - RNA, 12 nt, Human
gcucuccuuccu

SEQ ID NO: 2323751 - RNA, 15 nt, Human
gcucucugcagccag

SEQ ID NO: 2323752 - RNA, 14 nt, Human
gcucucugcagcca

SEQ ID NO: 2323753 - RNA, 13 nt, Human
gcucucugcagcc

SEQ ID NO: 2323754 - RNA, 13 nt, Human
gcucucuccagga

SEQ ID NO: 2323755 - RNA, 21 nt, Human
gcucucggaacugcaugcugc

SEQ ID NO: 2323756 - RNA, 12 nt, Human
gcucucuccagg

SEQ ID NO: 2323757 - RNA, 19 nt, Human
gcucucucauugucugugu

SEQ ID NO: 2323758 - RNA, 19 nt, Human
gcucucggaacugcaugcu

SEQ ID NO: 2323759 - RNA, 19 nt, Human
gcucucggguugugugucu

SEQ ID NO: 2323760 - RNA, 22 nt, Human
gcucucugcagccagcccagcc

SEQ ID NO: 2323761 - RNA, 21 nt, Human
gcucucugcagccagcccagc

SEQ ID NO: 2323762 - RNA, 20 nt, Human
gcucucugcaucuacuccca

SEQ ID NO: 2323763 - RNA, 11 nt, Human
gcucucugcca

SEQ ID NO: 2323764 - RNA, 20 nt, Human
gcucucugcagccagcccag

SEQ ID NO: 2323765 - RNA, 19 nt, Human
gcucucugcagccagccca

SEQ ID NO: 2323766 - RNA, 18 nt, Human
gcucucugcagccagccc

SEQ ID NO: 2323767 - RNA, 17 nt, Human
gcucucugcagccagcc

SEQ ID NO: 2323768 - RNA, 11 nt, Human
gcucucuggcc

SEQ ID NO: 2323769 - RNA, 13 nt, Human
gcucucuggccuu

SEQ ID NO: 2323770 - RNA, 12 nt, Human
gcucucuggccu

SEQ ID NO: 2323771 - RNA, 19 nt, Human
gcucuccgaccagacaccu

SEQ ID NO: 2323772 - RNA, 19 nt, Human
gcucuccucagaagaaaga

SEQ ID NO: 2323773 - RNA, 24 nt, Human
gcucucccucuucucaagugccuu

SEQ ID NO: 2323774 - RNA, 15 nt, Human
gcucucccucuucuc

SEQ ID NO: 2323775 - RNA, 16 nt, Human
gcucucccucuucuca

SEQ ID NO: 2323776 - RNA, 21 nt, Human
gcucucccucuucucaagugc

SEQ ID NO: 2323777 - RNA, 23 nt, Human
gcucucccucuucucaagugccu

SEQ ID NO: 2323778 - RNA, 19 nt, Human
gcucuccucuugccacugc

SEQ ID NO: 2323779 - RNA, 22 nt, Human
gcucuccucuugccacugccuc

SEQ ID NO: 2323780 - RNA, 15 nt, Human
gcucuccucuugcca

SEQ ID NO: 2323781 - RNA, 23 nt, Human
gcucucccucuggcccugccuuc

SEQ ID NO: 2323782 - RNA, 14 nt, Human
gcucucccucuucu

SEQ ID NO: 2323783 - RNA, 21 nt, Human
gcucucccucuggcccugccu

SEQ ID NO: 2323784 - RNA, 20 nt, Human
gcucucccucuggcccugcc

SEQ ID NO: 2323785 - RNA, 19 nt, Human
gcucucccucuggcccugc

SEQ ID NO: 2323786 - RNA, 18 nt, Human
gcucucccucuggcccug

SEQ ID NO: 2323787 - RNA, 17 nt, Human
gcucucccucuggcccu

SEQ ID NO: 2323788 - RNA, 15 nt, Human
gcucucccucuggcc

SEQ ID NO: 2323789 - RNA, 14 nt, Human
gcucucccucuggc

SEQ ID NO: 2323790 - RNA, 11 nt, Human
gcucucccucu

SEQ ID NO: 2323791 - RNA, 19 nt, Human
gcucucccgguucuuccag

SEQ ID NO: 2323792 - RNA, 20 nt, Human
gcucucccgguucuuccagu

SEQ ID NO: 2323793 - RNA, 19 nt, Human
gcucuccccugcccugcug

SEQ ID NO: 2323794 - RNA, 18 nt, Human
gcucucccgguucuucca

SEQ ID NO: 2323795 - RNA, 13 nt, Human
gcucuccgaccag

SEQ ID NO: 2323796 - RNA, 17 nt, Human
gcucuccgaccagacac

SEQ ID NO: 2323797 - RNA, 15 nt, Human
gcuccuucuguccua

SEQ ID NO: 2323798 - RNA, 13 nt, Human
gcucccuggagcc

SEQ ID NO: 2323799 - RNA, 21 nt, Human
gcucccuucaucuccagggag

SEQ ID NO: 2323800 - RNA, 19 nt, Human
gcucccuucccaccucucu

SEQ ID NO: 2323801 - RNA, 13 nt, Human
gcuccuugggagg

SEQ ID NO: 2323802 - RNA, 16 nt, Human
gcuccuugggaggaag

SEQ ID NO: 2323803 - RNA, 18 nt, Human
gcucccuuccaccuguca

SEQ ID NO: 2323804 - RNA, 15 nt, Human
gcuccuugacuccuu

SEQ ID NO: 2323805 - RNA, 17 nt, Human
gcuccuugggaggaagc

SEQ ID NO: 2323806 - RNA, 18 nt, Human
gcuccuugggaggaagca

SEQ ID NO: 2323807 - RNA, 19 nt, Human
gcuccuugggaggaagcag

SEQ ID NO: 2323808 - RNA, 20 nt, Human
gcuccuugggaggaagcaga

SEQ ID NO: 2323809 - RNA, 21 nt, Human
gcuccuucuguccuacucugu

SEQ ID NO: 2323810 - RNA, 15 nt, Human
gcucccuucccaccu

SEQ ID NO: 2323811 - RNA, 21 nt, Human
gcucccuguaaccucuucaga

SEQ ID NO: 2323812 - RNA, 16 nt, Human
gcucccuucccaccuc

SEQ ID NO: 2323813 - RNA, 18 nt, Human
gcucccuucccaccucuc

SEQ ID NO: 2323814 - RNA, 17 nt, Human
gcucgagcaguccugcc

SEQ ID NO: 2323815 - RNA, 19 nt, Human
gcucgaaucucugugccuu

SEQ ID NO: 2323816 - RNA, 15 nt, Human
gcucgaaucucugug

SEQ ID NO: 2323817 - RNA, 16 nt, Human
gcucgaaucucugugc

SEQ ID NO: 2323818 - RNA, 16 nt, Human
gcucgagcaugccugg

SEQ ID NO: 2323819 - RNA, 14 nt, Human
gcuccuugggaggc

SEQ ID NO: 2323820 - RNA, 23 nt, Human
gcuccuugggaggaagcagaaua

SEQ ID NO: 2323821 - RNA, 21 nt, Human
gcuccuugggaggaagcagaa

SEQ ID NO: 2323822 - RNA, 22 nt, Human
gcuccuugggaggaagcagaau

SEQ ID NO: 2323823 - RNA, 22 nt, Human
gcuccuugggaggccccacugg

SEQ ID NO: 2323824 - RNA, 21 nt, Human
gcuccuugggaggccccacug

SEQ ID NO: 2323825 - RNA, 11 nt, Human
gcuccuugggc

SEQ ID NO: 2323826 - RNA, 14 nt, Human
gcuccuuuuucucc

SEQ ID NO: 2323827 - RNA, 16 nt, Human
gcuccuuuuucucccu

SEQ ID NO: 2323828 - RNA, 18 nt, Human
gcuccuuuuucucccucu

SEQ ID NO: 2323829 - RNA, 19 nt, Human
gcuccuuuuucucccucug

SEQ ID NO: 2323830 - RNA, 20 nt, Human
gcuccuuuuucucccucugg

SEQ ID NO: 2323831 - RNA, 14 nt, Human
gcucgaaaacaauu

SEQ ID NO: 2323832 - RNA, 20 nt, Human
gcucuccaccucagccuugg

SEQ ID NO: 2323833 - RNA, 13 nt, Human
gcucuccagcucc

SEQ ID NO: 2323834 - RNA, 21 nt, Human
gcucuccaccucagccuugga

SEQ ID NO: 2323835 - RNA, 20 nt, Human
gcucuccagucaggaggcau

SEQ ID NO: 2323836 - RNA, 15 nt, Human
gcucuccagcuccaa

SEQ ID NO: 2323837 - RNA, 19 nt, Human
gcucuccagucaggaggca

SEQ ID NO: 2323838 - RNA, 16 nt, Human
gcucuccccugcccug

SEQ ID NO: 2323839 - RNA, 17 nt, Human
gcucucccauuuccuga

SEQ ID NO: 2323840 - RNA, 19 nt, Human
gcucuccaccucagccuug

SEQ ID NO: 2323841 - RNA, 18 nt, Human
gcucuccaccucagccuu

SEQ ID NO: 2323842 - RNA, 17 nt, Human
gcucuccaccucagccu

SEQ ID NO: 2323843 - RNA, 16 nt, Human
gcucuccaccucagcc

SEQ ID NO: 2323844 - RNA, 15 nt, Human
gcucuccaccucagc

SEQ ID NO: 2323845 - RNA, 14 nt, Human
gcucuccaccucag

SEQ ID NO: 2323846 - RNA, 13 nt, Human
gcucuccaccuca

SEQ ID NO: 2323847 - RNA, 20 nt, Human
gcucuccaagugccagaggu

SEQ ID NO: 2323848 - RNA, 21 nt, Human
gcucgagcaguccugccucag

SEQ ID NO: 2323849 - RNA, 20 nt, Human
gcucgagcaguccugccuca

SEQ ID NO: 2323850 - RNA, 17 nt, Human
gcucgagcaugccugga

SEQ ID NO: 2323851 - RNA, 19 nt, Human
gcuccaaacccucgaggcg

SEQ ID NO: 2323852 - RNA, 16 nt, Human
gcuccaaaugcagcuu

SEQ ID NO: 2323853 - RNA, 16 nt, Human
gcuccaagaccuguug

SEQ ID NO: 2323854 - RNA, 18 nt, Human
gcuccaagaccuguuggu

SEQ ID NO: 2323855 - RNA, 22 nt, Human
gcuccaagaccuguugguucca

SEQ ID NO: 2323856 - RNA, 21 nt, Human
gcuccaaccugcaaagaucug

SEQ ID NO: 2323857 - RNA, 18 nt, Human
gcuccaaccugcaaagau

SEQ ID NO: 2323858 - RNA, 15 nt, Human
gcuccaaccugcaaa

SEQ ID NO: 2323859 - RNA, 13 nt, Human
gcuccaagcuccc

SEQ ID NO: 2323860 - RNA, 16 nt, Human
gcuccaagccccaucu

SEQ ID NO: 2323861 - RNA, 19 nt, Human
gcuccaagccccaucuucu

SEQ ID NO: 2323862 - RNA, 14 nt, Human
gcuccaagcuccca

SEQ ID NO: 2323863 - RNA, 15 nt, Human
gcuccaagcucccag

SEQ ID NO: 2323864 - RNA, 20 nt, Human
gcuccagcugcucugucuuc

SEQ ID NO: 2323865 - RNA, 19 nt, Human
gcuccacacccucucccag

SEQ ID NO: 2323866 - RNA, 16 nt, Human
gcuccacacccucucc

SEQ ID NO: 2323867 - RNA, 23 nt, Human
gcuccagcuggccgggagccuga

SEQ ID NO: 2323868 - RNA, 17 nt, Human
gcuccagcuggccggga

SEQ ID NO: 2323869 - RNA, 21 nt, Human
gcuccaagcucccaggcauuc

SEQ ID NO: 2323870 - RNA, 23 nt, Human
gcuccaaggggaaucagaacuca

SEQ ID NO: 2323871 - RNA, 21 nt, Human
gcuccaaggggaaucagaacu

SEQ ID NO: 2323872 - RNA, 20 nt, Human
gcuccaaggggaaucagaac

SEQ ID NO: 2323873 - RNA, 16 nt, Human
gcuccaagcucccagg

SEQ ID NO: 2323874 - RNA, 17 nt, Human
gcuccaagcucccaggc

SEQ ID NO: 2323875 - RNA, 18 nt, Human
gcuccaagcucccaggca

SEQ ID NO: 2323876 - RNA, 19 nt, Human
gcuccaagcucccaggcau

SEQ ID NO: 2323877 - RNA, 11 nt, Human
gcuccagcugu

SEQ ID NO: 2323878 - RNA, 13 nt, Human
gcuccaggcuccu

SEQ ID NO: 2323879 - RNA, 16 nt, Human
gcuccaggcuccuuua

SEQ ID NO: 2323880 - RNA, 23 nt, Human
gcuccaggcuccuuuagcgccca

SEQ ID NO: 2323881 - RNA, 20 nt, Human
gcuccagcuguucagcuggu

SEQ ID NO: 2323882 - RNA, 21 nt, Human
gcuccagcugcucugucuucu

SEQ ID NO: 2323883 - RNA, 14 nt, Human
gcuccaucuccacu

SEQ ID NO: 2323884 - RNA, 18 nt, Human
gcuccaugugcccccucu

SEQ ID NO: 2323885 - RNA, 20 nt, Human
gcuccaugugcccccucuac

SEQ ID NO: 2323886 - RNA, 20 nt, Human
gcucccuaccaccuccccag

SEQ ID NO: 2323887 - RNA, 16 nt, Human
gcucccuaccaccucc

SEQ ID NO: 2323888 - RNA, 20 nt, Human
gcuccauuuuuagugaaaua

SEQ ID NO: 2323889 - RNA, 17 nt, Human
gcucccuccccugcccu

SEQ ID NO: 2323890 - RNA, 16 nt, Human
gcucccucccaucccu

SEQ ID NO: 2323891 - RNA, 20 nt, Human
gcucccuccccugcccuggu

SEQ ID NO: 2323892 - RNA, 19 nt, Human
gcucccuccccugcccugg

SEQ ID NO: 2323893 - RNA, 23 nt, Human
gcucccuccccugcccuggucca

SEQ ID NO: 2323894 - RNA, 23 nt, Human
gcucccucugccugaaccuucca

SEQ ID NO: 2323895 - RNA, 13 nt, Human
gcucccucugccu

SEQ ID NO: 2323896 - RNA, 17 nt, Human
gcucccucuuggucuuc

SEQ ID NO: 2323897 - RNA, 19 nt, Human
gcucccucuuggucuuccc

SEQ ID NO: 2323898 - RNA, 24 nt, Human
gcucccugaagccagccuucuucc

SEQ ID NO: 2323899 - RNA, 16 nt, Human
gcucccugacugggag

SEQ ID NO: 2323900 - RNA, 18 nt, Human
gcucccugacugggaguu

SEQ ID NO: 2323901 - RNA, 12 nt, Human
gcucccugaagc

SEQ ID NO: 2323902 - RNA, 13 nt, Human
gcucccugaagcc

SEQ ID NO: 2323903 - RNA, 14 nt, Human
gcucccugaagcca

SEQ ID NO: 2323904 - RNA, 15 nt, Human
gcucccugaagccag

SEQ ID NO: 2323905 - RNA, 16 nt, Human
gcucccugaagccagc

SEQ ID NO: 2323906 - RNA, 17 nt, Human
gcucccugaagccagcc

SEQ ID NO: 2323907 - RNA, 18 nt, Human
gcucccugaagccagccu

SEQ ID NO: 2323908 - RNA, 20 nt, Human
gcucccugaagccagccuuc

SEQ ID NO: 2323909 - RNA, 11 nt, Human
gcucagccugg

SEQ ID NO: 2323910 - RNA, 16 nt, Human
gcucagcccuggaggu

SEQ ID NO: 2323911 - RNA, 20 nt, Human
gcucagcccuggaggugcca

SEQ ID NO: 2323912 - RNA, 14 nt, Human
gcucagccagcacu

SEQ ID NO: 2323913 - RNA, 14 nt, Human
gcucagcccuggag

SEQ ID NO: 2323914 - RNA, 15 nt, Human
gcucagcccuggagg

SEQ ID NO: 2323915 - RNA, 11 nt, Human
gcucagcagcu

SEQ ID NO: 2323916 - RNA, 13 nt, Human
gcucagccagcac

SEQ ID NO: 2323917 - RNA, 12 nt, Human
gcucagccagca

SEQ ID NO: 2323918 - RNA, 23 nt, Human
gcucagaggguuguucuccuaga

SEQ ID NO: 2323919 - RNA, 20 nt, Human
gcucaccccccacacucacu

SEQ ID NO: 2323920 - RNA, 23 nt, Human
gcucagcaaaagaugcuucucac

SEQ ID NO: 2323921 - RNA, 22 nt, Human
gcucagcaaaagaugcuucuca

SEQ ID NO: 2323922 - RNA, 20 nt, Human
gcucagcaaaagaugcuucu

SEQ ID NO: 2323923 - RNA, 17 nt, Human
gcucagcaaaagaugcu

SEQ ID NO: 2323924 - RNA, 20 nt, Human
gcucaccagccccagugccc

SEQ ID NO: 2323925 - RNA, 23 nt, Human
gcucaccagccccagugcccaca

SEQ ID NO: 2323926 - RNA, 18 nt, Human
gcucaccagccccagugc

SEQ ID NO: 2323927 - RNA, 17 nt, Human
gcuaugagcuggggaug

SEQ ID NO: 2323928 - RNA, 19 nt, Human
gcucaccagccccagugcc

SEQ ID NO: 2323929 - RNA, 20 nt, Human
gcucacccaauaaacauuaa

SEQ ID NO: 2323930 - RNA, 18 nt, Human
gcucacccagccccaggg

SEQ ID NO: 2323931 - RNA, 16 nt, Human
gcucacccccuucucc

SEQ ID NO: 2323932 - RNA, 17 nt, Human
gcucaccccccacacuc

SEQ ID NO: 2323933 - RNA, 19 nt, Human
gcucaccccccacacucac

SEQ ID NO: 2323934 - RNA, 16 nt, Human
gcucaccccccacacu

SEQ ID NO: 2323935 - RNA, 20 nt, Human
gcucacccccuucuccaucc

SEQ ID NO: 2323936 - RNA, 18 nt, Human
gcucacccccuucuccau

SEQ ID NO: 2323937 - RNA, 15 nt, Human
gcucaccccuggagg

SEQ ID NO: 2323938 - RNA, 22 nt, Human
gcucacccccuucuccauccac

SEQ ID NO: 2323939 - RNA, 16 nt, Human
gcucauauuccugcag

SEQ ID NO: 2323940 - RNA, 19 nt, Human
gcucauauggggcugggag

SEQ ID NO: 2323941 - RNA, 16 nt, Human
gcuccaaacccucgag

SEQ ID NO: 2323942 - RNA, 18 nt, Human
gcuccaaacccucgaggc

SEQ ID NO: 2323943 - RNA, 17 nt, Human
gcuccaaacccucgagg

SEQ ID NO: 2323944 - RNA, 16 nt, Human
gcucaguucagaauca

SEQ ID NO: 2323945 - RNA, 22 nt, Human
gcucagugucuggcugcagagc

SEQ ID NO: 2323946 - RNA, 18 nt, Human
gcucauaacggaucagaa

SEQ ID NO: 2323947 - RNA, 23 nt, Human
gcucaguuguagaauguauugua

SEQ ID NO: 2323948 - RNA, 20 nt, Human
gcucauacaggaaugaagcc

SEQ ID NO: 2323949 - RNA, 17 nt, Human
gcucaguucagaaucac

SEQ ID NO: 2323950 - RNA, 16 nt, Human
gcucaguucuagucuc

SEQ ID NO: 2323951 - RNA, 12 nt, Human
gcucaguuguag

SEQ ID NO: 2323952 - RNA, 17 nt, Human
gcucaguuguagaaugu

SEQ ID NO: 2323953 - RNA, 20 nt, Human
gcucagucucaggagcaugg

SEQ ID NO: 2323954 - RNA, 17 nt, Human
gcucagucucaggagca

SEQ ID NO: 2323955 - RNA, 14 nt, Human
gcucagucucagga

SEQ ID NO: 2323956 - RNA, 23 nt, Human
gcucagucccaucagagagcgag

SEQ ID NO: 2323957 - RNA, 21 nt, Human
gcucagucucaggagcauggg

SEQ ID NO: 2323958 - RNA, 14 nt, Human
gcucagucucccuu

SEQ ID NO: 2323959 - RNA, 16 nt, Human
gcucagucucccuuuc

SEQ ID NO: 2323960 - RNA, 19 nt, Human
gcucagucucccuuucccu

SEQ ID NO: 2323961 - RNA, 12 nt, Human
gcucagucccau

SEQ ID NO: 2323962 - RNA, 21 nt, Human
gcucaguaauuugaggacaac

SEQ ID NO: 2323963 - RNA, 16 nt, Human
gcucaguaauuugagg

SEQ ID NO: 2323964 - RNA, 15 nt, Human
gcucagcgccagccu

SEQ ID NO: 2323965 - RNA, 19 nt, Human
gcucaggugucccugcacu

SEQ ID NO: 2323966 - RNA, 18 nt, Human
gcucagccuggugggccu

SEQ ID NO: 2323967 - RNA, 17 nt, Human
gcucagccuggugggcc

SEQ ID NO: 2323968 - RNA, 15 nt, Human
gcucagccugguggg

SEQ ID NO: 2323969 - RNA, 14 nt, Human
gcucagccuggugg

SEQ ID NO: 2323970 - RNA, 15 nt, Human
gcucagcggggacag

SEQ ID NO: 2323971 - RNA, 20 nt, Human
gcucagcggggacagcuccu

SEQ ID NO: 2323972 - RNA, 21 nt, Human
gcucagcggggacagcuccuu

SEQ ID NO: 2323973 - RNA, 22 nt, Human
gcucagcggggacagcuccuuc

SEQ ID NO: 2323974 - RNA, 20 nt, Human
gcucagccuggugggccucc

SEQ ID NO: 2323975 - RNA, 19 nt, Human
gcucagccuggugggccuc

SEQ ID NO: 2323976 - RNA, 18 nt, Human
gcucaggugucccugcac

SEQ ID NO: 2323977 - RNA, 14 nt, Human
gcuagcaucccuga

SEQ ID NO: 2323978 - RNA, 15 nt, Human
gcuagcgcugccgca

SEQ ID NO: 2323979 - RNA, 14 nt, Human
gcuagcgcugccgc

SEQ ID NO: 2323980 - RNA, 23 nt, Human
gcuagcgcugccgcaccccagag

SEQ ID NO: 2323981 - RNA, 22 nt, Human
gcuagcgcugccgcaccccaga

SEQ ID NO: 2323982 - RNA, 21 nt, Human
gcuagcgcugccgcaccccag

SEQ ID NO: 2323983 - RNA, 20 nt, Human
gcuagcgcugccgcacccca

SEQ ID NO: 2323984 - RNA, 16 nt, Human
gcuagaguccucacuc

SEQ ID NO: 2323985 - RNA, 13 nt, Human
gcuagaguccuca

SEQ ID NO: 2323986 - RNA, 14 nt, Human
gcuacucagaagcc

SEQ ID NO: 2323987 - RNA, 13 nt, Human
gcuagaggccuga

SEQ ID NO: 2323988 - RNA, 18 nt, Human
gcuagaguccucacuccc

SEQ ID NO: 2323989 - RNA, 16 nt, Human
gcuagaggccugagga

SEQ ID NO: 2323990 - RNA, 16 nt, Human
gcuagcuccccuccuc

SEQ ID NO: 2323991 - RNA, 18 nt, Human
gcuagcuccccuccucuc

SEQ ID NO: 2323992 - RNA, 21 nt, Human
gcuagcuccccuccucucccc

SEQ ID NO: 2323993 - RNA, 22 nt, Human
gcuagcuccccuccucuccccu

SEQ ID NO: 2323994 - RNA, 16 nt, Human
gcuaucucccccagcc

SEQ ID NO: 2323995 - RNA, 17 nt, Human
gcuaucucccccagccc

SEQ ID NO: 2323996 - RNA, 18 nt, Human
gcuaucucccccagcccc

SEQ ID NO: 2323997 - RNA, 12 nt, Human
gcuaugaauuuu

SEQ ID NO: 2323998 - RNA, 14 nt, Human
gcuaucuuaauuuu

SEQ ID NO: 2323999 - RNA, 15 nt, Human
gcuaucuuaauuuug

SEQ ID NO: 2324000 - RNA, 16 nt, Human
gcuaucuuaauuuugg

SEQ ID NO: 2324001 - RNA, 20 nt, Human
gcuaucucugugugcacaaa

SEQ ID NO: 2324002 - RNA, 17 nt, Human
gcuaucuggucaaccuc

SEQ ID NO: 2324003 - RNA, 12 nt, Human
gcuaucuuaauu

SEQ ID NO: 2324004 - RNA, 16 nt, Human
gcuaucucugugugca

SEQ ID NO: 2324005 - RNA, 13 nt, Human
gcuaucucugugu

SEQ ID NO: 2324006 - RNA, 23 nt, Human
gcuaucucucagugaacugugag

SEQ ID NO: 2324007 - RNA, 16 nt, Human
gcuagcugcagagcca

SEQ ID NO: 2324008 - RNA, 12 nt, Human
gcuagcuucugc

SEQ ID NO: 2324009 - RNA, 23 nt, Human
gcuaucucccccagccccauccu

SEQ ID NO: 2324010 - RNA, 19 nt, Human
gcuaucucccccagcccca

SEQ ID NO: 2324011 - RNA, 20 nt, Human
gcuaucucccccagccccau

SEQ ID NO: 2324012 - RNA, 21 nt, Human
gcuaucucccccagccccauc

SEQ ID NO: 2324013 - RNA, 22 nt, Human
gcuaucucccccagccccaucc

SEQ ID NO: 2324014 - RNA, 16 nt, Human
gcuacccgcagaguuc

SEQ ID NO: 2324015 - RNA, 20 nt, Human
gcuaaggacauuucccaggg

SEQ ID NO: 2324016 - RNA, 17 nt, Human
gcuaaggacauuuccca

SEQ ID NO: 2324017 - RNA, 18 nt, Human
gcuaagccccagcaagca

SEQ ID NO: 2324018 - RNA, 20 nt, Human
gcuaagccccagcaagcaau

SEQ ID NO: 2324019 - RNA, 19 nt, Human
gcuaagcuaggaaugaaau

SEQ ID NO: 2324020 - RNA, 15 nt, Human
gcuaagcuaggaaug

SEQ ID NO: 2324021 - RNA, 14 nt, Human
gcuacccgggaagg

SEQ ID NO: 2324022 - RNA, 15 nt, Human
gcuacccgggaaggg

SEQ ID NO: 2324023 - RNA, 19 nt, Human
gcuaagaguguccuaggag

SEQ ID NO: 2324024 - RNA, 17 nt, Human
gcuaagccccagcaagc

SEQ ID NO: 2324025 - RNA, 12 nt, Human
gcuaagaugcuc

SEQ ID NO: 2324026 - RNA, 18 nt, Human
gcuaagauuaucugggga

SEQ ID NO: 2324027 - RNA, 14 nt, Human
gcuaagcauuccaa

SEQ ID NO: 2324028 - RNA, 23 nt, Human
gcuaagagggagggagggcucca

SEQ ID NO: 2324029 - RNA, 17 nt, Human
gcuaagcaaaaugugau

SEQ ID NO: 2324030 - RNA, 22 nt, Human
gcuacccgcagaguucucagaa

SEQ ID NO: 2324031 - RNA, 13 nt, Human
gcuacccucccug

SEQ ID NO: 2324032 - RNA, 12 nt, Human
gcuacgccugca

SEQ ID NO: 2324033 - RNA, 14 nt, Human
gcuacccucccugc

SEQ ID NO: 2324034 - RNA, 21 nt, Human
gcuacccgggaagggggcugg

SEQ ID NO: 2324035 - RNA, 18 nt, Human
gcuacuaaugauguuuuc

SEQ ID NO: 2324036 - RNA, 16 nt, Human
gcuacuaaugauguuu

SEQ ID NO: 2324037 - RNA, 14 nt, Human
gcuacuaaugaugu

SEQ ID NO: 2324038 - RNA, 15 nt, Human
gcuacgugugauuuu

SEQ ID NO: 2324039 - RNA, 18 nt, Human
gcuacguacaugugaggc

SEQ ID NO: 2324040 - RNA, 17 nt, Human
gcuacgugugauuuuuc

SEQ ID NO: 2324041 - RNA, 19 nt, Human
gcuacgugugauuuuucug

SEQ ID NO: 2324042 - RNA, 20 nt, Human
gcuacgugugauuuuucugg

SEQ ID NO: 2324043 - RNA, 19 nt, Human
gcuacguuccuauugucau

SEQ ID NO: 2324044 - RNA, 21 nt, Human
gcuacucaagaggcugaggca

SEQ ID NO: 2324045 - RNA, 20 nt, Human
gcuacucaagaggcugaggc

SEQ ID NO: 2324046 - RNA, 17 nt, Human
gcuacucaagaggcuga

SEQ ID NO: 2324047 - RNA, 16 nt, Human
gcuacucaagaggcug

SEQ ID NO: 2324048 - RNA, 18 nt, Human
gcuagagguucaaagaua

SEQ ID NO: 2324049 - RNA, 21 nt, Human
gcuagagguucaaagauauuu

SEQ ID NO: 2324050 - RNA, 19 nt, Human
gcuagagguucaaagauau

SEQ ID NO: 2324051 - RNA, 16 nt, Human
gcuaacaccagacaga

SEQ ID NO: 2324052 - RNA, 17 nt, Human
gcuaacacuggccccua

SEQ ID NO: 2324053 - RNA, 16 nt, Human
gcuaacacuggccccu

SEQ ID NO: 2324054 - RNA, 15 nt, Human
gcuaacacuggcccc

SEQ ID NO: 2324055 - RNA, 20 nt, Human
gcuaacacacagcucccaua

SEQ ID NO: 2324056 - RNA, 21 nt, Human
gcuaagagggagggagggcuc

SEQ ID NO: 2324057 - RNA, 22 nt, Human
gcuaagagggagggagggcucc

SEQ ID NO: 2324058 - RNA, 17 nt, Human
gcuaaauguaacagucu

SEQ ID NO: 2324059 - RNA, 14 nt, Human
gcuaaauguaacag

SEQ ID NO: 2324060 - RNA, 22 nt, Human
gcuaaauuacucaggaagaaca

SEQ ID NO: 2324061 - RNA, 18 nt, Human
gcuaaauuacaauuguca

SEQ ID NO: 2324062 - RNA, 16 nt, Human
gcuaaaugugaaugau

SEQ ID NO: 2324063 - RNA, 23 nt, Human
gcuaaauggucgcccaggagaca

SEQ ID NO: 2324064 - RNA, 19 nt, Human
gcuaaauggucgcccagga

SEQ ID NO: 2324065 - RNA, 19 nt, Human
gcuaaauccuuuacuguua

SEQ ID NO: 2324066 - RNA, 21 nt, Human
gcuaaauaaaauuuguugcau

SEQ ID NO: 2324067 - RNA, 13 nt, Human
gcuaaaugugaau

SEQ ID NO: 2324068 - RNA, 19 nt, Human
gcuaaauaaaauuuguugc

SEQ ID NO: 2324069 - RNA, 20 nt, Human
gcuaaauaaaauuuguugca

SEQ ID NO: 2324070 - RNA, 16 nt, Human
gcuaaagcccagagac

SEQ ID NO: 2324071 - RNA, 19 nt, Human
gcgugaucaaagccacacu

SEQ ID NO: 2324072 - RNA, 15 nt, Human
gcgugaucaaagcca

SEQ ID NO: 2324073 - RNA, 18 nt, Human
gcgugaggaugggaagga

SEQ ID NO: 2324074 - RNA, 14 nt, Human
gcgugacucaccca

SEQ ID NO: 2324075 - RNA, 13 nt, Human
gcgugacucaccc

SEQ ID NO: 2324076 - RNA, 16 nt, Human
gcgugacucacccaag

SEQ ID NO: 2324077 - RNA, 16 nt, Human
gcgugaaggccgagaa

SEQ ID NO: 2324078 - RNA, 13 nt, Human
gcgugacaauaaa

SEQ ID NO: 2324079 - RNA, 23 nt, Human
gcgugagccacugcaccgggcca

SEQ ID NO: 2324080 - RNA, 15 nt, Human
gcgugaaggccgaga

SEQ ID NO: 2324081 - RNA, 13 nt, Human
gcgugaaggccga

SEQ ID NO: 2324082 - RNA, 23 nt, Human
gcgugaacccgggaggcggagcu

SEQ ID NO: 2324083 - RNA, 23 nt, Human
gcgugaaacacaccaggcugugg

SEQ ID NO: 2324084 - RNA, 20 nt, Human
gcgugaaacacaccaggcug

SEQ ID NO: 2324085 - RNA, 19 nt, Human
gcgugaaacacaccaggcu

SEQ ID NO: 2324086 - RNA, 12 nt, Human
gcgugaaacaca

SEQ ID NO: 2324087 - RNA, 11 nt, Human
gcgugaaacac

SEQ ID NO: 2324088 - RNA, 21 nt, Human
gcgucuuccugaguggugcca

SEQ ID NO: 2324089 - RNA, 13 nt, Human
gcgucuuccugag

SEQ ID NO: 2324090 - RNA, 14 nt, Human
gcgucuuccugagu

SEQ ID NO: 2324091 - RNA, 18 nt, Human
gcgugagccacugcaccg

SEQ ID NO: 2324092 - RNA, 20 nt, Human
gcgucagccuccagccucug

SEQ ID NO: 2324093 - RNA, 12 nt, Human
gcgucuuccuga

SEQ ID NO: 2324094 - RNA, 19 nt, Human
gcgucccagucucuggcag

SEQ ID NO: 2324095 - RNA, 14 nt, Human
gcgucccccugccg

SEQ ID NO: 2324096 - RNA, 18 nt, Human
gcgucccccugccggccg

SEQ ID NO: 2324097 - RNA, 13 nt, Human
gcguaugucuguu

SEQ ID NO: 2324098 - RNA, 11 nt, Human
gcgucagccuc

SEQ ID NO: 2324099 - RNA, 21 nt, Human
gcguaugucuguuaccauguc

SEQ ID NO: 2324100 - RNA, 12 nt, Human
gcgucagccucc

SEQ ID NO: 2324101 - RNA, 15 nt, Human
gcgucagccuccagc

SEQ ID NO: 2324102 - RNA, 16 nt, Human
gcgucagccuccagcc

SEQ ID NO: 2324103 - RNA, 17 nt, Human
gcgucagccuccagccu

SEQ ID NO: 2324104 - RNA, 18 nt, Human
gcgucagccuccagccuc

SEQ ID NO: 2324105 - RNA, 21 nt, Human
gcgucagccuccagccucugu

SEQ ID NO: 2324106 - RNA, 16 nt, Human
gcgucaguauuuuccc

SEQ ID NO: 2324107 - RNA, 14 nt, Human
gcgggcugggcagc

SEQ ID NO: 2324108 - RNA, 14 nt, Human
gcgggcucaaggaa

SEQ ID NO: 2324109 - RNA, 16 nt, Human
gcgggcugggcagcug

SEQ ID NO: 2324110 - RNA, 18 nt, Human
gcgguccacccaggagcc

SEQ ID NO: 2324111 - RNA, 19 nt, Human
gcgguccacccaggagccc

SEQ ID NO: 2324112 - RNA, 12 nt, Human
gcggggacagcu

SEQ ID NO: 2324113 - RNA, 15 nt, Human
gcgggcuuccuccug

SEQ ID NO: 2324114 - RNA, 13 nt, Human
gcggggacagcuc

SEQ ID NO: 2324115 - RNA, 16 nt, Human
gcgguccacccaggag

SEQ ID NO: 2324116 - RNA, 24 nt, Human
gccugugaggugcagagugcccag

SEQ ID NO: 2324117 - RNA, 23 nt, Human
gccugugaggugcagagugccca

SEQ ID NO: 2324118 - RNA, 17 nt, Human
gccugugaggugcagag

SEQ ID NO: 2324119 - RNA, 18 nt, Human
gccugugaggcaggggcg

SEQ ID NO: 2324120 - RNA, 14 nt, Human
gccugugaggcagg

SEQ ID NO: 2324121 - RNA, 12 nt, Human
gccugugcagug

SEQ ID NO: 2324122 - RNA, 19 nt, Human
gccugugccacccaccagg

SEQ ID NO: 2324123 - RNA, 19 nt, Human
gccugugcauguaugucuu

SEQ ID NO: 2324124 - RNA, 17 nt, Human
gccugugaacugaacuc

SEQ ID NO: 2324125 - RNA, 23 nt, Human
gccugugagcuaggaauuguguu

SEQ ID NO: 2324126 - RNA, 17 nt, Human
gcccuggccugcugggc

SEQ ID NO: 2324127 - RNA, 16 nt, Human
gcccuggccugcuggg

SEQ ID NO: 2324128 - RNA, 15 nt, Human
gcccuggccugcugg

SEQ ID NO: 2324129 - RNA, 14 nt, Human
gcccuggccugcug

SEQ ID NO: 2324130 - RNA, 13 nt, Human
gcccuggccugcu

SEQ ID NO: 2324131 - RNA, 12 nt, Human
gcccuggccugc

SEQ ID NO: 2324132 - RNA, 18 nt, Human
gcccuggcccugaggugu

SEQ ID NO: 2324133 - RNA, 19 nt, Human
gcccuggccuccccugcca

SEQ ID NO: 2324134 - RNA, 20 nt, Human
gcccuggccuccccugccac

SEQ ID NO: 2324135 - RNA, 21 nt, Human
gcccuggccuccccugccacc

SEQ ID NO: 2324136 - RNA, 24 nt, Human
gcccuggccuccccugccaccagg

SEQ ID NO: 2324137 - RNA, 15 nt, Human
gcccuggcucccaca

SEQ ID NO: 2324138 - RNA, 19 nt, Human
gcccuggcucccacaggcc

SEQ ID NO: 2324139 - RNA, 20 nt, Human
gcccuggcucccacaggccc

SEQ ID NO: 2324140 - RNA, 14 nt, Human
gcccuggcucugca

SEQ ID NO: 2324141 - RNA, 12 nt, Human
gcccuggcucug

SEQ ID NO: 2324142 - RNA, 10 nt, Human
gcccuggcug

SEQ ID NO: 2324143 - RNA, 12 nt, Human
gcccuggcagga

SEQ ID NO: 2324144 - RNA, 19 nt, Human
gcccuggcaggaugacccu

SEQ ID NO: 2324145 - RNA, 15 nt, Human
gcccuggccagaggc

SEQ ID NO: 2324146 - RNA, 14 nt, Human
gcccuggccagagg

SEQ ID NO: 2324147 - RNA, 13 nt, Human
gcccuggccagag

SEQ ID NO: 2324148 - RNA, 16 nt, Human
gcccuggccagaggcu

SEQ ID NO: 2324149 - RNA, 12 nt, Human
gcccuggcccug

SEQ ID NO: 2324150 - RNA, 13 nt, Human
gcccuggcccuga

SEQ ID NO: 2324151 - RNA, 17 nt, Human
gcccuggcccugaggug

SEQ ID NO: 2324152 - RNA, 12 nt, Human
gcccuggccucc

SEQ ID NO: 2324153 - RNA, 14 nt, Human
gcccuggccucccc

SEQ ID NO: 2324154 - RNA, 16 nt, Human
gcccuggccuccccug

SEQ ID NO: 2324155 - RNA, 17 nt, Human
gcccuggccuccccugc

SEQ ID NO: 2324156 - RNA, 14 nt, Human
gcccugggaggcag

SEQ ID NO: 2324157 - RNA, 11 nt, Human
gcccugggagg

SEQ ID NO: 2324158 - RNA, 17 nt, Human
gcccuggcugcugcccc

SEQ ID NO: 2324159 - RNA, 19 nt, Human
gcccuggcugcugccccca

SEQ ID NO: 2324160 - RNA, 22 nt, Human
gcccuggcugcugcccccaccc

SEQ ID NO: 2324161 - RNA, 13 nt, Human
gcccuggcugaag

SEQ ID NO: 2324162 - RNA, 14 nt, Human
gcccuggcugaagg

SEQ ID NO: 2324163 - RNA, 15 nt, Human
gcccuggcugaagga

SEQ ID NO: 2324164 - RNA, 16 nt, Human
gcccuggcugaaggac

SEQ ID NO: 2324165 - RNA, 17 nt, Human
gcccuggcugaaggacu

SEQ ID NO: 2324166 - RNA, 18 nt, Human
gcccuggcugaaggacug

SEQ ID NO: 2324167 - RNA, 19 nt, Human
gcccuggcugaaggacugu

SEQ ID NO: 2324168 - RNA, 20 nt, Human
gcccuggcugaaggacugug

SEQ ID NO: 2324169 - RNA, 21 nt, Human
gcccuggcugaaggacuguga

SEQ ID NO: 2324170 - RNA, 12 nt, Human
gcccuggcugac

SEQ ID NO: 2324171 - RNA, 11 nt, Human
gcccuggcugc

SEQ ID NO: 2324172 - RNA, 12 nt, Human
gcccuggcugcu

SEQ ID NO: 2324173 - RNA, 14 nt, Human
gcccuggcugcugc

SEQ ID NO: 2324174 - RNA, 15 nt, Human
gcccuggcugcugcc

SEQ ID NO: 2324175 - RNA, 16 nt, Human
gcccuggcugcugccc

SEQ ID NO: 2324176 - RNA, 13 nt, Human
gcccugggaggcu

SEQ ID NO: 2324177 - RNA, 14 nt, Human
gcccugggaggcuc

SEQ ID NO: 2324178 - RNA, 15 nt, Human
gcccugggaggcucu

SEQ ID NO: 2324179 - RNA, 16 nt, Human
gcccugggaggcucug

SEQ ID NO: 2324180 - RNA, 17 nt, Human
gcccugggaucacugug

SEQ ID NO: 2324181 - RNA, 16 nt, Human
gcccugggaggcagug

SEQ ID NO: 2324182 - RNA, 23 nt, Human
gcccugggaggcucuggagccca

SEQ ID NO: 2324183 - RNA, 19 nt, Human
gcccugggccccaccaccu

SEQ ID NO: 2324184 - RNA, 18 nt, Human
gcccugggccccaccacc

SEQ ID NO: 2324185 - RNA, 15 nt, Human
gcccugggccccacc

SEQ ID NO: 2324186 - RNA, 17 nt, Human
gcccugggccacacuga

SEQ ID NO: 2324187 - RNA, 22 nt, Human
gcccugggccccaccaccuagg

SEQ ID NO: 2324188 - RNA, 20 nt, Human
gcccugggccccaccaccua

SEQ ID NO: 2324189 - RNA, 15 nt, Human
gcccugggcucggag

SEQ ID NO: 2324190 - RNA, 16 nt, Human
gcccugggcucggagg

SEQ ID NO: 2324191 - RNA, 17 nt, Human
gcccugggcucggaggc

SEQ ID NO: 2324192 - RNA, 19 nt, Human
gcccugggcucggaggcug

SEQ ID NO: 2324193 - RNA, 21 nt, Human
gcccugggcucggaggcugcc

SEQ ID NO: 2324194 - RNA, 17 nt, Human
gcccugggaggcucugg

SEQ ID NO: 2324195 - RNA, 18 nt, Human
gcccugggaggcucugga

SEQ ID NO: 2324196 - RNA, 19 nt, Human
gcccugggaggcucuggag

SEQ ID NO: 2324197 - RNA, 21 nt, Human
gcccugggaggcucuggagcc

SEQ ID NO: 2324198 - RNA, 14 nt, Human
gcccugguccaggg

SEQ ID NO: 2324199 - RNA, 13 nt, Human
gcccugguccagg

SEQ ID NO: 2324200 - RNA, 21 nt, Human
gcccugggucuaagggguugg

SEQ ID NO: 2324201 - RNA, 16 nt, Human
gcccugguagggcagu

SEQ ID NO: 2324202 - RNA, 23 nt, Human
gcccugggcucggaggcugcccc

SEQ ID NO: 2324203 - RNA, 16 nt, Human
gcccugggcuggaauc

SEQ ID NO: 2324204 - RNA, 18 nt, Human
gcccugggcuggaaucag

SEQ ID NO: 2324205 - RNA, 11 nt, Human
gcccugggcug

SEQ ID NO: 2324206 - RNA, 12 nt, Human
gcccugggcugg

SEQ ID NO: 2324207 - RNA, 13 nt, Human
gcccugggcugga

SEQ ID NO: 2324208 - RNA, 14 nt, Human
gcccugggcuggaa

SEQ ID NO: 2324209 - RNA, 18 nt, Human
gcccugguccuuccaggc

SEQ ID NO: 2324210 - RNA, 14 nt, Human
gcccuggucucagc

SEQ ID NO: 2324211 - RNA, 16 nt, Human
gcccuggucucagcag

SEQ ID NO: 2324212 - RNA, 15 nt, Human
gcccugguccuucca

SEQ ID NO: 2324213 - RNA, 23 nt, Human
gcccugguccagggaagcuggcc

SEQ ID NO: 2324214 - RNA, 20 nt, Human
gcccugguccagggaagcug

SEQ ID NO: 2324215 - RNA, 18 nt, Human
gcccugguccagggaagc

SEQ ID NO: 2324216 - RNA, 17 nt, Human
gcccugguccagggaag

SEQ ID NO: 2324217 - RNA, 16 nt, Human
gcccugguccagggaa

SEQ ID NO: 2324218 - RNA, 15 nt, Human
gcccuggugcugcca

SEQ ID NO: 2324219 - RNA, 16 nt, Human
gcccuggugcugccac

SEQ ID NO: 2324220 - RNA, 17 nt, Human
gcccuggugcugccaca

SEQ ID NO: 2324221 - RNA, 21 nt, Human
gcccuggugcugccacacuuc

SEQ ID NO: 2324222 - RNA, 14 nt, Human
gcccugguggcagu

SEQ ID NO: 2324223 - RNA, 17 nt, Human
gcccugguggcaguggg

SEQ ID NO: 2324224 - RNA, 18 nt, Human
gcccugguggcaguggga

SEQ ID NO: 2324225 - RNA, 19 nt, Human
gcccugguggcagugggag

SEQ ID NO: 2324226 - RNA, 20 nt, Human
gcccugguggcagugggagc

SEQ ID NO: 2324227 - RNA, 21 nt, Human
gcccugguggcagugggagcu

SEQ ID NO: 2324228 - RNA, 22 nt, Human
gcccugguggcagugggagcug

SEQ ID NO: 2324229 - RNA, 23 nt, Human
gcccugguggcagugggagcugc

SEQ ID NO: 2324230 - RNA, 15 nt, Human
gcccugucagugcag

SEQ ID NO: 2324231 - RNA, 14 nt, Human
gcccugucagugca

SEQ ID NO: 2324232 - RNA, 23 nt, Human
gcccugguuuccugcccugggag

SEQ ID NO: 2324233 - RNA, 21 nt, Human
gcccugguuuccugcccuggg

SEQ ID NO: 2324234 - RNA, 20 nt, Human
gcccugguuuccugcccugg

SEQ ID NO: 2324235 - RNA, 19 nt, Human
gcccugguuuccugcccug

SEQ ID NO: 2324236 - RNA, 18 nt, Human
gcccugguuuccugcccu

SEQ ID NO: 2324237 - RNA, 17 nt, Human
gcccugguuuccugccc

SEQ ID NO: 2324238 - RNA, 22 nt, Human
gcccugguuucacuggcccaag

SEQ ID NO: 2324239 - RNA, 20 nt, Human
gcccugguuucacuggccca

SEQ ID NO: 2324240 - RNA, 18 nt, Human
gcccugguuucacuggcc

SEQ ID NO: 2324241 - RNA, 16 nt, Human
gcccugguuucacugg

SEQ ID NO: 2324242 - RNA, 15 nt, Human
gcccugguuuccugc

SEQ ID NO: 2324243 - RNA, 14 nt, Human
gcccugguuuccug

SEQ ID NO: 2324244 - RNA, 18 nt, Human
gcccugguguuucuagca

SEQ ID NO: 2324245 - RNA, 21 nt, Human
gcccugguggagaaagcacug

SEQ ID NO: 2324246 - RNA, 17 nt, Human
gcccuggucucagcagc

SEQ ID NO: 2324247 - RNA, 13 nt, Human
gcccugguggaga

SEQ ID NO: 2324248 - RNA, 14 nt, Human
gcccugguggagaa

SEQ ID NO: 2324249 - RNA, 18 nt, Human
gcccugguggagaaagca

SEQ ID NO: 2324250 - RNA, 21 nt, Human
gcccuuccucuccacugccuu

SEQ ID NO: 2324251 - RNA, 19 nt, Human
gcccuucucuccagccccu

SEQ ID NO: 2324252 - RNA, 17 nt, Human
gcccuuccucuccacug

SEQ ID NO: 2324253 - RNA, 16 nt, Human
gcccuuccucuccacu

SEQ ID NO: 2324254 - RNA, 18 nt, Human
gcccuuccucuccacugc

SEQ ID NO: 2324255 - RNA, 19 nt, Human
gcccuuccucuccacugcc

SEQ ID NO: 2324256 - RNA, 20 nt, Human
gcccuuccucuccacugccu

SEQ ID NO: 2324257 - RNA, 21 nt, Human
gcccuucucuccagccccugg

SEQ ID NO: 2324258 - RNA, 22 nt, Human
gcccuucucuccagccccugga

SEQ ID NO: 2324259 - RNA, 17 nt, Human
gccgagauugcaccacu

SEQ ID NO: 2324260 - RNA, 18 nt, Human
gccgagauugcaccacug

SEQ ID NO: 2324261 - RNA, 18 nt, Human
gccgagaucacgccacug

SEQ ID NO: 2324262 - RNA, 19 nt, Human
gccgagaucacgccacugc

SEQ ID NO: 2324263 - RNA, 13 nt, Human
gcccuuuccucag

SEQ ID NO: 2324264 - RNA, 14 nt, Human
gcccuuuccucagg

SEQ ID NO: 2324265 - RNA, 17 nt, Human
gcccuuugggaggcuga

SEQ ID NO: 2324266 - RNA, 12 nt, Human
gcccuuucugug

SEQ ID NO: 2324267 - RNA, 18 nt, Human
gcccuuugagugcagucc

SEQ ID NO: 2324268 - RNA, 13 nt, Human
gcccuuucugugu

SEQ ID NO: 2324269 - RNA, 16 nt, Human
gccgagaucacgccac

SEQ ID NO: 2324270 - RNA, 21 nt, Human
gcccuuugggaggcugaggcg

SEQ ID NO: 2324271 - RNA, 14 nt, Human
gcccuuuuuaagga

SEQ ID NO: 2324272 - RNA, 14 nt, Human
gcagacgccgggga

SEQ ID NO: 2324273 - RNA, 21 nt, Human
gcagacuagaauucuagugcu

SEQ ID NO: 2324274 - RNA, 15 nt, Human
gcagacuaugcaaac

SEQ ID NO: 2324275 - RNA, 17 nt, Human
gcagacaggaggaauca

SEQ ID NO: 2324276 - RNA, 22 nt, Human
gcagaccuccccagccccuagc

SEQ ID NO: 2324277 - RNA, 23 nt, Human
gcagaccuccccagccccuagcc

SEQ ID NO: 2324278 - RNA, 14 nt, Human
gcagaccuguccuc

SEQ ID NO: 2324279 - RNA, 16 nt, Human
gcagaccuguccuccu

SEQ ID NO: 2324280 - RNA, 19 nt, Human
gcagaccuguccuccuggu

SEQ ID NO: 2324281 - RNA, 20 nt, Human
gcagaccuguccuccuggug

SEQ ID NO: 2324282 - RNA, 20 nt, Human
gcagacucaauaaaaucaug

SEQ ID NO: 2324283 - RNA, 13 nt, Human
gcagacucacugu

SEQ ID NO: 2324284 - RNA, 17 nt, Human
gcagacucaguuuguca

SEQ ID NO: 2324285 - RNA, 15 nt, Human
gcagacucuacagag

SEQ ID NO: 2324286 - RNA, 12 nt, Human
gccccucccuuc

SEQ ID NO: 2324287 - RNA, 14 nt, Human
gccccucccuucaa

SEQ ID NO: 2324288 - RNA, 15 nt, Human
gccccucccuucaac

SEQ ID NO: 2324289 - RNA, 18 nt, Human
gccccuccucucugcccu

SEQ ID NO: 2324290 - RNA, 21 nt, Human
gccccuccucugccaccuccc

SEQ ID NO: 2324291 - RNA, 20 nt, Human
gccccuccucugccaccucc

SEQ ID NO: 2324292 - RNA, 18 nt, Human
gccccuccucugccaccu

SEQ ID NO: 2324293 - RNA, 17 nt, Human
gccccuccucugccacc

SEQ ID NO: 2324294 - RNA, 16 nt, Human
gccccuccucugccac

SEQ ID NO: 2324295 - RNA, 15 nt, Human
gccccuccucugcca

SEQ ID NO: 2324296 - RNA, 14 nt, Human
gccccuccucugcc

SEQ ID NO: 2324297 - RNA, 13 nt, Human
gccccuccucugc

SEQ ID NO: 2324298 - RNA, 12 nt, Human
gccccuccucug

SEQ ID NO: 2324299 - RNA, 18 nt, Human
gcagacucaguuugucag

SEQ ID NO: 2324300 - RNA, 19 nt, Human
gccccuccucucugcccua

SEQ ID NO: 2324301 - RNA, 11 nt, Human
gccccucugcc

SEQ ID NO: 2324302 - RNA, 12 nt, Human
gccccucugccc

SEQ ID NO: 2324303 - RNA, 13 nt, Human
gccccugccaccc

SEQ ID NO: 2324304 - RNA, 22 nt, Human
gccccuccucugccaccucccc

SEQ ID NO: 2324305 - RNA, 23 nt, Human
gccccuccucugccaccuccccu

SEQ ID NO: 2324306 - RNA, 21 nt, Human
gccccucucccgccagacugu

SEQ ID NO: 2324307 - RNA, 14 nt, Human
gccccugccacccu

SEQ ID NO: 2324308 - RNA, 15 nt, Human
gccccugccacccug

SEQ ID NO: 2324309 - RNA, 21 nt, Human
gccccuguucuggcagaguug

SEQ ID NO: 2324310 - RNA, 14 nt, Human
gccccucugcccag

SEQ ID NO: 2324311 - RNA, 15 nt, Human
gccccucugcccagc

SEQ ID NO: 2324312 - RNA, 16 nt, Human
gccccucugcccagcu

SEQ ID NO: 2324313 - RNA, 18 nt, Human
gccccucugcccagcuug

SEQ ID NO: 2324314 - RNA, 13 nt, Human
gcccgccuggcag

SEQ ID NO: 2324315 - RNA, 22 nt, Human
gcccgccugccaguccuagcug

SEQ ID NO: 2324316 - RNA, 17 nt, Human
gcccgccugccaguccu

SEQ ID NO: 2324317 - RNA, 18 nt, Human
gcccgccugccaguccua

SEQ ID NO: 2324318 - RNA, 23 nt, Human
gcccgccugccaguccuagcugc

SEQ ID NO: 2324319 - RNA, 22 nt, Human
gcccgcccacuguccugggcgc

SEQ ID NO: 2324320 - RNA, 20 nt, Human
gcccgcccacuguccugggc

SEQ ID NO: 2324321 - RNA, 12 nt, Human
gcccgccugcca

SEQ ID NO: 2324322 - RNA, 13 nt, Human
gcccgccugccag

SEQ ID NO: 2324323 - RNA, 14 nt, Human
gcccgccugccagu

SEQ ID NO: 2324324 - RNA, 15 nt, Human
gcccgccugccaguc

SEQ ID NO: 2324325 - RNA, 16 nt, Human
gcccgccugccagucc

SEQ ID NO: 2324326 - RNA, 16 nt, Human
gcccggauucugggag

SEQ ID NO: 2324327 - RNA, 15 nt, Human
gcccggauucuggga

SEQ ID NO: 2324328 - RNA, 17 nt, Human
gcccggauucugggagg

SEQ ID NO: 2324329 - RNA, 18 nt, Human
gcccgccuggcagaacug

SEQ ID NO: 2324330 - RNA, 14 nt, Human
gcccgccuggcaga

SEQ ID NO: 2324331 - RNA, 14 nt, Human
gcccggaugcuucu

SEQ ID NO: 2324332 - RNA, 21 nt, Human
gcccggcgcgguggcucacgc

SEQ ID NO: 2324333 - RNA, 18 nt, Human
gcccggcgcccucugucc

SEQ ID NO: 2324334 - RNA, 18 nt, Human
gcccggcuaauuuuugua

SEQ ID NO: 2324335 - RNA, 16 nt, Human
gcccggcuccaggcuc

SEQ ID NO: 2324336 - RNA, 18 nt, Human
gcccggccagccaugucu

SEQ ID NO: 2324337 - RNA, 12 nt, Human
gcccggccagcc

SEQ ID NO: 2324338 - RNA, 14 nt, Human
gcccggccugcucc

SEQ ID NO: 2324339 - RNA, 15 nt, Human
gcccggccugcuccc

SEQ ID NO: 2324340 - RNA, 18 nt, Human
gcccggccugcucccagc

SEQ ID NO: 2324341 - RNA, 22 nt, Human
gcccggccugcucccagcagcc

SEQ ID NO: 2324342 - RNA, 17 nt, Human
gcccggcgccccugcca

SEQ ID NO: 2324343 - RNA, 14 nt, Human
gcccggcgcccucu

SEQ ID NO: 2324344 - RNA, 15 nt, Human
gcccggcgcccucug

SEQ ID NO: 2324345 - RNA, 17 nt, Human
gcccggcgcccucuguc

SEQ ID NO: 2324346 - RNA, 20 nt, Human
gcccggcgcccucuguccug

SEQ ID NO: 2324347 - RNA, 23 nt, Human
gccccuucacuucugaccacacu

SEQ ID NO: 2324348 - RNA, 21 nt, Human
gccccuucacuucugaccaca

SEQ ID NO: 2324349 - RNA, 20 nt, Human
gccccuucacuucugaccac

SEQ ID NO: 2324350 - RNA, 19 nt, Human
gccccuucccacucacccc

SEQ ID NO: 2324351 - RNA, 15 nt, Human
gccccuucccaucuc

SEQ ID NO: 2324352 - RNA, 15 nt, Human
gccccuuccccaugg

SEQ ID NO: 2324353 - RNA, 16 nt, Human
gccccuuccccauggg

SEQ ID NO: 2324354 - RNA, 23 nt, Human
gccccugcauccccuuggcugug

SEQ ID NO: 2324355 - RNA, 19 nt, Human
gccccucugcccagcuugg

SEQ ID NO: 2324356 - RNA, 20 nt, Human
gccccugcauccccuuggcu

SEQ ID NO: 2324357 - RNA, 17 nt, Human
gccccuuagcccccacc

SEQ ID NO: 2324358 - RNA, 22 nt, Human
gccccuuagcccccacccacuu

SEQ ID NO: 2324359 - RNA, 12 nt, Human
gccccuuccccc

SEQ ID NO: 2324360 - RNA, 16 nt, Human
gcccgacagccuggca

SEQ ID NO: 2324361 - RNA, 17 nt, Human
gcccgacagccuggcac

SEQ ID NO: 2324362 - RNA, 19 nt, Human
gcccgacagccuggcacag

SEQ ID NO: 2324363 - RNA, 12 nt, Human
gcccgagcuggu

SEQ ID NO: 2324364 - RNA, 23 nt, Human
gcccgacuugcuguuuuguucug

SEQ ID NO: 2324365 - RNA, 13 nt, Human
gcccgacuugcug

SEQ ID NO: 2324366 - RNA, 18 nt, Human
gcccgacuugcuguuuug

SEQ ID NO: 2324367 - RNA, 15 nt, Human
gcccgagcuggugca

SEQ ID NO: 2324368 - RNA, 14 nt, Human
gcccgagcuggugc

SEQ ID NO: 2324369 - RNA, 13 nt, Human
gcccgagcuggug

SEQ ID NO: 2324370 - RNA, 17 nt, Human
gcccgcaugcggcccag

SEQ ID NO: 2324371 - RNA, 19 nt, Human
gcccgcaugcggcccagga

SEQ ID NO: 2324372 - RNA, 21 nt, Human
gcccgccaagguagccauccc

SEQ ID NO: 2324373 - RNA, 13 nt, Human
gcccgcccacugu

SEQ ID NO: 2324374 - RNA, 14 nt, Human
gcccgcccacuguc

SEQ ID NO: 2324375 - RNA, 15 nt, Human
gcccgcccacugucc

SEQ ID NO: 2324376 - RNA, 17 nt, Human
gcccgcccacuguccug

SEQ ID NO: 2324377 - RNA, 18 nt, Human
gcccgcccacuguccugg

SEQ ID NO: 2324378 - RNA, 19 nt, Human
gcccgcccacuguccuggg

SEQ ID NO: 2324379 - RNA, 18 nt, Human
gcccuggauuucagaaag

SEQ ID NO: 2324380 - RNA, 20 nt, Human
gcccuggagguggcugagcc

SEQ ID NO: 2324381 - RNA, 18 nt, Human
gcccuggagguggcugag

SEQ ID NO: 2324382 - RNA, 15 nt, Human
gcccuggagguggcu

SEQ ID NO: 2324383 - RNA, 14 nt, Human
gcccuggagguggc

SEQ ID NO: 2324384 - RNA, 20 nt, Human
gcccuggagucaugccaagc

SEQ ID NO: 2324385 - RNA, 15 nt, Human
gcccuggagucaugc

SEQ ID NO: 2324386 - RNA, 19 nt, Human
gcccuggagucaugccaag

SEQ ID NO: 2324387 - RNA, 13 nt, Human
gcccuggaggugg

SEQ ID NO: 2324388 - RNA, 24 nt, Human
gcccuggaggugccagcaaagccc

SEQ ID NO: 2324389 - RNA, 22 nt, Human
gcccuggaggugccagcaaagc

SEQ ID NO: 2324390 - RNA, 23 nt, Human
gcccuggaggugccagcaaagcc

SEQ ID NO: 2324391 - RNA, 21 nt, Human
gcccuggagccaacugcugcu

SEQ ID NO: 2324392 - RNA, 17 nt, Human
gcccuggaggugccagc

SEQ ID NO: 2324393 - RNA, 18 nt, Human
gcccuggaggugccagca

SEQ ID NO: 2324394 - RNA, 20 nt, Human
gcccuggaggugccagcaaa

SEQ ID NO: 2324395 - RNA, 18 nt, Human
gcccuggagccaacugcu

SEQ ID NO: 2324396 - RNA, 20 nt, Human
gcccuggaagccggcggccc

SEQ ID NO: 2324397 - RNA, 19 nt, Human
gcccuggagccaacugcug

SEQ ID NO: 2324398 - RNA, 20 nt, Human
gcccuggagccaacugcugc

SEQ ID NO: 2324399 - RNA, 23 nt, Human
gcccuggagccaacugcugcuuu

SEQ ID NO: 2324400 - RNA, 22 nt, Human
gcccugcuuugggcugcccugg

SEQ ID NO: 2324401 - RNA, 23 nt, Human
gcccugcuuugggcugcccuggu

SEQ ID NO: 2324402 - RNA, 12 nt, Human
gcccuggacugu

SEQ ID NO: 2324403 - RNA, 16 nt, Human
gcccuggacugugugc

SEQ ID NO: 2324404 - RNA, 22 nt, Human
gcccuggacugugugcucagga

SEQ ID NO: 2324405 - RNA, 22 nt, Human
gcccugaggugaaagggagcua

SEQ ID NO: 2324406 - RNA, 21 nt, Human
gcccugaggugaaagggagcu

SEQ ID NO: 2324407 - RNA, 13 nt, Human
gcccugaggugug

SEQ ID NO: 2324408 - RNA, 14 nt, Human
gcccugaggugugg

SEQ ID NO: 2324409 - RNA, 15 nt, Human
gcccugagguguggg

SEQ ID NO: 2324410 - RNA, 21 nt, Human
gcccugaggugugggggcugc

SEQ ID NO: 2324411 - RNA, 22 nt, Human
gcccugaggugugggggcugca

SEQ ID NO: 2324412 - RNA, 23 nt, Human
gcccugaggugugggggcugcag

SEQ ID NO: 2324413 - RNA, 24 nt, Human
gcccugaggugugggggcugcagc

SEQ ID NO: 2324414 - RNA, 22 nt, Human
gcccugaguaaucgcuuaaaga

SEQ ID NO: 2324415 - RNA, 21 nt, Human
gcccugaguggaucuccaagg

SEQ ID NO: 2324416 - RNA, 22 nt, Human
gcccugaguggaucuccaagga

SEQ ID NO: 2324417 - RNA, 23 nt, Human
gcccugaguggaucuccaaggac

SEQ ID NO: 2324418 - RNA, 14 nt, Human
gcccugauuugcug

SEQ ID NO: 2324419 - RNA, 18 nt, Human
gcccugcaaaaggacucu

SEQ ID NO: 2324420 - RNA, 14 nt, Human
gcccugcaaaagga

SEQ ID NO: 2324421 - RNA, 18 nt, Human
gcccugaguuccuagcca

SEQ ID NO: 2324422 - RNA, 16 nt, Human
gcccugaguuccuagc

SEQ ID NO: 2324423 - RNA, 20 nt, Human
gcccugcuuugggcugcccu

SEQ ID NO: 2324424 - RNA, 21 nt, Human
gcccugcuuugggcugcccug

SEQ ID NO: 2324425 - RNA, 19 nt, Human
gcccugcuuugggcugccc

SEQ ID NO: 2324426 - RNA, 23 nt, Human
gcccugcacuguccugcuccaca

SEQ ID NO: 2324427 - RNA, 21 nt, Human
gcccugcaaaaggacucucag

SEQ ID NO: 2324428 - RNA, 16 nt, Human
gcccugcaccugugca

SEQ ID NO: 2324429 - RNA, 17 nt, Human
gcccugcaccugugcag

SEQ ID NO: 2324430 - RNA, 14 nt, Human
gcccugcacugucc

SEQ ID NO: 2324431 - RNA, 15 nt, Human
gcccugcacuguccu

SEQ ID NO: 2324432 - RNA, 16 nt, Human
gcccugcacuguccug

SEQ ID NO: 2324433 - RNA, 17 nt, Human
gcccugcacuguccugc

SEQ ID NO: 2324434 - RNA, 18 nt, Human
gcccugcacuguccugcu

SEQ ID NO: 2324435 - RNA, 19 nt, Human
gcccugcacuguccugcuc

SEQ ID NO: 2324436 - RNA, 20 nt, Human
gcccugcacuguccugcucc

SEQ ID NO: 2324437 - RNA, 21 nt, Human
gcccugcacuguccugcucca

SEQ ID NO: 2324438 - RNA, 22 nt, Human
gcccugcacuguccugcuccac

SEQ ID NO: 2324439 - RNA, 18 nt, Human
gcccucgggcgagucacu

SEQ ID NO: 2324440 - RNA, 14 nt, Human
gcccucguggccag

SEQ ID NO: 2324441 - RNA, 20 nt, Human
gcccucgggcccagccccca

SEQ ID NO: 2324442 - RNA, 22 nt, Human
gcccucgggcccagcccccaca

SEQ ID NO: 2324443 - RNA, 15 nt, Human
gcccucgggcccagc

SEQ ID NO: 2324444 - RNA, 16 nt, Human
gcccucgggcccagcc

SEQ ID NO: 2324445 - RNA, 17 nt, Human
gcccucgggcccagccc

SEQ ID NO: 2324446 - RNA, 18 nt, Human
gcccucgggcccagcccc

SEQ ID NO: 2324447 - RNA, 13 nt, Human
gcccucuaccccu

SEQ ID NO: 2324448 - RNA, 19 nt, Human
gcccucguggccagcccgg

SEQ ID NO: 2324449 - RNA, 20 nt, Human
gcccucguggccagcccggc

SEQ ID NO: 2324450 - RNA, 15 nt, Human
gcccucguggccagc

SEQ ID NO: 2324451 - RNA, 16 nt, Human
gcccucguggccagcc

SEQ ID NO: 2324452 - RNA, 17 nt, Human
gcccucguggccagccc

SEQ ID NO: 2324453 - RNA, 18 nt, Human
gcccucguggccagcccg

SEQ ID NO: 2324454 - RNA, 17 nt, Human
gcccucuagggagggac

SEQ ID NO: 2324455 - RNA, 17 nt, Human
gcccggcuccaggcucc

SEQ ID NO: 2324456 - RNA, 18 nt, Human
gcccggcuccaggcuccu

SEQ ID NO: 2324457 - RNA, 17 nt, Human
gcccucgcugccagcuc

SEQ ID NO: 2324458 - RNA, 15 nt, Human
gcccucgcugcuucu

SEQ ID NO: 2324459 - RNA, 16 nt, Human
gcccucgcugcuucug

SEQ ID NO: 2324460 - RNA, 15 nt, Human
gcccucgcugccagc

SEQ ID NO: 2324461 - RNA, 14 nt, Human
gcccucgcugccag

SEQ ID NO: 2324462 - RNA, 16 nt, Human
gcccucgcccccgccc

SEQ ID NO: 2324463 - RNA, 19 nt, Human
gcccuccuuguccacccac

SEQ ID NO: 2324464 - RNA, 16 nt, Human
gcccugagcuuucugc

SEQ ID NO: 2324465 - RNA, 12 nt, Human
gcccucugccca

SEQ ID NO: 2324466 - RNA, 16 nt, Human
gcccucucugcucugc

SEQ ID NO: 2324467 - RNA, 14 nt, Human
gcccucuccgagcu

SEQ ID NO: 2324468 - RNA, 14 nt, Human
gccuggccaccucu

SEQ ID NO: 2324469 - RNA, 15 nt, Human
gccuggccaaaggga

SEQ ID NO: 2324470 - RNA, 16 nt, Human
gccuggccaccucucu

SEQ ID NO: 2324471 - RNA, 17 nt, Human
gccuggccaccucucuc

SEQ ID NO: 2324472 - RNA, 18 nt, Human
gccuggccaccucucucc

SEQ ID NO: 2324473 - RNA, 19 nt, Human
gccuggccaccucucuccu

SEQ ID NO: 2324474 - RNA, 13 nt, Human
gccuggccacgcc

SEQ ID NO: 2324475 - RNA, 17 nt, Human
gccuggccagacacagg

SEQ ID NO: 2324476 - RNA, 16 nt, Human
gccuggccagacacag

SEQ ID NO: 2324477 - RNA, 14 nt, Human
gccuggccagacac

SEQ ID NO: 2324478 - RNA, 13 nt, Human
gccuggccagaca

SEQ ID NO: 2324479 - RNA, 14 nt, Human
gccuggcaggcugu

SEQ ID NO: 2324480 - RNA, 20 nt, Human
gccuggaugcggauggccgg

SEQ ID NO: 2324481 - RNA, 21 nt, Human
gccuggauauuauucuuguag

SEQ ID NO: 2324482 - RNA, 12 nt, Human
gccuggaucucc

SEQ ID NO: 2324483 - RNA, 15 nt, Human
gccuggauggggcug

SEQ ID NO: 2324484 - RNA, 22 nt, Human
gccuggaggccgggugcucagg

SEQ ID NO: 2324485 - RNA, 24 nt, Human
gccuggaguguaugacugcacaug

SEQ ID NO: 2324486 - RNA, 14 nt, Human
gccuggauggggcu

SEQ ID NO: 2324487 - RNA, 14 nt, Human
gccuggccaggcag

SEQ ID NO: 2324488 - RNA, 13 nt, Human
gccuggccaggca

SEQ ID NO: 2324489 - RNA, 15 nt, Human
gccuggccaggcacc

SEQ ID NO: 2324490 - RNA, 19 nt, Human
gccuggccaggagcucuuc

SEQ ID NO: 2324491 - RNA, 12 nt, Human
gccuggccaggc

SEQ ID NO: 2324492 - RNA, 15 nt, Human
gccuggccaggagcu

SEQ ID NO: 2324493 - RNA, 14 nt, Human
gccuggccaggagc

SEQ ID NO: 2324494 - RNA, 21 nt, Human
gccuggccagccuacaauggg

SEQ ID NO: 2324495 - RNA, 16 nt, Human
gccuggccagccuaca

SEQ ID NO: 2324496 - RNA, 17 nt, Human
gccuggccaggcagauc

SEQ ID NO: 2324497 - RNA, 15 nt, Human
gccuggccaggcaga

SEQ ID NO: 2324498 - RNA, 23 nt, Human
gccuggccaggcagaucugugcc

SEQ ID NO: 2324499 - RNA, 17 nt, Human
gccuggccagggccugg

SEQ ID NO: 2324500 - RNA, 15 nt, Human
gccugggcagaagga

SEQ ID NO: 2324501 - RNA, 14 nt, Human
gccuggccagaugc

SEQ ID NO: 2324502 - RNA, 15 nt, Human
gccuggccagaugca

SEQ ID NO: 2324503 - RNA, 23 nt, Human
gccuggccagcagguccccagcu

SEQ ID NO: 2324504 - RNA, 21 nt, Human
gccuggccagacacaggcccu

SEQ ID NO: 2324505 - RNA, 20 nt, Human
gccuggccagacacaggccc

SEQ ID NO: 2324506 - RNA, 20 nt, Human
gccugggugacagagugaga

SEQ ID NO: 2324507 - RNA, 20 nt, Human
gccugggugacagagcaaga

SEQ ID NO: 2324508 - RNA, 14 nt, Human
gccugggugcuggc

SEQ ID NO: 2324509 - RNA, 12 nt, Human
gccugggugcug

SEQ ID NO: 2324510 - RNA, 13 nt, Human
gccugggugacag

SEQ ID NO: 2324511 - RNA, 23 nt, Human
gccugggugacagagugagacuc

SEQ ID NO: 2324512 - RNA, 23 nt, Human
gccugggugacaaagugagacuc

SEQ ID NO: 2324513 - RNA, 23 nt, Human
gccugggucugugucucuuuucu

SEQ ID NO: 2324514 - RNA, 19 nt, Human
gccugggucugugucucuu

SEQ ID NO: 2324515 - RNA, 16 nt, Human
gccugggucugugucu

SEQ ID NO: 2324516 - RNA, 14 nt, Human
gccugggucugugu

SEQ ID NO: 2324517 - RNA, 16 nt, Human
gccuggguggggcugc

SEQ ID NO: 2324518 - RNA, 15 nt, Human
gccuggguggggcug

SEQ ID NO: 2324519 - RNA, 15 nt, Human
gccuggguggacaug

SEQ ID NO: 2324520 - RNA, 21 nt, Human
gccugggugcuggcugcccag

SEQ ID NO: 2324521 - RNA, 20 nt, Human
gccugggugcuggcugccca

SEQ ID NO: 2324522 - RNA, 17 nt, Human
gccugggugcuggcugc

SEQ ID NO: 2324523 - RNA, 15 nt, Human
gccugggugcuggcu

SEQ ID NO: 2324524 - RNA, 22 nt, Human
gccuggguggggcugcuccucc

SEQ ID NO: 2324525 - RNA, 20 nt, Human
gccuggguggggcugcuccu

SEQ ID NO: 2324526 - RNA, 19 nt, Human
gccuggguggggcugcucc

SEQ ID NO: 2324527 - RNA, 18 nt, Human
gccuggguggggcugcuc

SEQ ID NO: 2324528 - RNA, 23 nt, Human
gccuguaguuaggaaauaaaacc

SEQ ID NO: 2324529 - RNA, 22 nt, Human
gccuguaguuaggaaauaaaac

SEQ ID NO: 2324530 - RNA, 19 nt, Human
gccuguaguuaggaaauaa

SEQ ID NO: 2324531 - RNA, 18 nt, Human
gccuguaguuaggaaaua

SEQ ID NO: 2324532 - RNA, 17 nt, Human
gccuguaguuaggaaau

SEQ ID NO: 2324533 - RNA, 16 nt, Human
gccuguaguuaggaaa

SEQ ID NO: 2324534 - RNA, 14 nt, Human
gccuguaguuagga

SEQ ID NO: 2324535 - RNA, 13 nt, Human
gccuguagcccac

SEQ ID NO: 2324536 - RNA, 14 nt, Human
gccuguagcaguga

SEQ ID NO: 2324537 - RNA, 22 nt, Human
gccuguagcccacucugcucgc

SEQ ID NO: 2324538 - RNA, 19 nt, Human
gccuguagcccacucugcu

SEQ ID NO: 2324539 - RNA, 19 nt, Human
gccuguagucccagccacu

SEQ ID NO: 2324540 - RNA, 21 nt, Human
gccugggggcugggcagagga

SEQ ID NO: 2324541 - RNA, 20 nt, Human
gccugggggcugggcagagg

SEQ ID NO: 2324542 - RNA, 14 nt, Human
gccuggggcuggcc

SEQ ID NO: 2324543 - RNA, 22 nt, Human
gccugggggcagggagaggagu

SEQ ID NO: 2324544 - RNA, 17 nt, Human
gccuggggcuggccucc

SEQ ID NO: 2324545 - RNA, 18 nt, Human
gccugggcagaaggaaga

SEQ ID NO: 2324546 - RNA, 21 nt, Human
gccuggcccacagcaggugcu

SEQ ID NO: 2324547 - RNA, 22 nt, Human
gccuggcccacagcaggugcug

SEQ ID NO: 2324548 - RNA, 16 nt, Human
gccugggcagaaggaa

SEQ ID NO: 2324549 - RNA, 17 nt, Human
gccugggcagaaggaag

SEQ ID NO: 2324550 - RNA, 14 nt, Human
gccugauauaaaug

SEQ ID NO: 2324551 - RNA, 15 nt, Human
gccugauauaaaugc

SEQ ID NO: 2324552 - RNA, 16 nt, Human
gccugagucuccugug

SEQ ID NO: 2324553 - RNA, 15 nt, Human
gccugagugccuggc

SEQ ID NO: 2324554 - RNA, 20 nt, Human
gccugaucagaccacggcuc

SEQ ID NO: 2324555 - RNA, 16 nt, Human
gccugaucagaccacg

SEQ ID NO: 2324556 - RNA, 22 nt, Human
gccugauccagccucuccccug

SEQ ID NO: 2324557 - RNA, 19 nt, Human
gccugaugcucccuccccu

SEQ ID NO: 2324558 - RNA, 17 nt, Human
gccugaugcucccuccc

SEQ ID NO: 2324559 - RNA, 16 nt, Human
gccugaugcucccucc

SEQ ID NO: 2324560 - RNA, 14 nt, Human
gccugaugcucccu

SEQ ID NO: 2324561 - RNA, 12 nt, Human
gccugaugacag

SEQ ID NO: 2324562 - RNA, 17 nt, Human
gccugaugacagagcga

SEQ ID NO: 2324563 - RNA, 18 nt, Human
gccugauccagccucucc

SEQ ID NO: 2324564 - RNA, 21 nt, Human
gccugauccagccucuccccu

SEQ ID NO: 2324565 - RNA, 22 nt, Human
gccugacauuuggaguguuccc

SEQ ID NO: 2324566 - RNA, 22 nt, Human
gccugaaugcuuauagguggcc

SEQ ID NO: 2324567 - RNA, 20 nt, Human
gccugacaaccacuggucug

SEQ ID NO: 2324568 - RNA, 21 nt, Human
gccugacaaccacuggucugu

SEQ ID NO: 2324569 - RNA, 13 nt, Human
gccugagucaccu

SEQ ID NO: 2324570 - RNA, 23 nt, Human
gccugacccuacuucuuuugcuc

SEQ ID NO: 2324571 - RNA, 13 nt, Human
gccugagucuccu

SEQ ID NO: 2324572 - RNA, 15 nt, Human
gccugagucuccugu

SEQ ID NO: 2324573 - RNA, 12 nt, Human
gccucugccugu

SEQ ID NO: 2324574 - RNA, 23 nt, Human
gccucucugcaggucccuaauaa

SEQ ID NO: 2324575 - RNA, 18 nt, Human
gccucucugcaggucccu

SEQ ID NO: 2324576 - RNA, 20 nt, Human
gccucucugcaggucccuaa

SEQ ID NO: 2324577 - RNA, 21 nt, Human
gccucucugcaggucccuaau

SEQ ID NO: 2324578 - RNA, 22 nt, Human
gccugaagucacacagugaguc

SEQ ID NO: 2324579 - RNA, 18 nt, Human
gccugaaguuggagugag

SEQ ID NO: 2324580 - RNA, 11 nt, Human
gccucugcugc

SEQ ID NO: 2324581 - RNA, 19 nt, Human
gccucugcugauccuccca

SEQ ID NO: 2324582 - RNA, 19 nt, Human
gccucucgguggccagcag

SEQ ID NO: 2324583 - RNA, 13 nt, Human
gccucugccuguc

SEQ ID NO: 2324584 - RNA, 18 nt, Human
gccucugcugauccuccc

SEQ ID NO: 2324585 - RNA, 18 nt, Human
gccugcuccagcuguuca

SEQ ID NO: 2324586 - RNA, 16 nt, Human
gccugcuccagcuguu

SEQ ID NO: 2324587 - RNA, 17 nt, Human
gccugcucccagcagcc

SEQ ID NO: 2324588 - RNA, 16 nt, Human
gccugcuuccugucuu

SEQ ID NO: 2324589 - RNA, 22 nt, Human
gccugcugugauuccacuacac

SEQ ID NO: 2324590 - RNA, 16 nt, Human
gccugcagagagaagc

SEQ ID NO: 2324591 - RNA, 17 nt, Human
gccugcagagagaagcc

SEQ ID NO: 2324592 - RNA, 18 nt, Human
gccugcagagagaagccu

SEQ ID NO: 2324593 - RNA, 13 nt, Human
gccugcucccagc

SEQ ID NO: 2324594 - RNA, 15 nt, Human
gccugcucccagcag

SEQ ID NO: 2324595 - RNA, 16 nt, Human
gccugcucccagcagc

SEQ ID NO: 2324596 - RNA, 20 nt, Human
gccugcucccagcagcccua

SEQ ID NO: 2324597 - RNA, 22 nt, Human
gccugcuggucacagccuccuc

SEQ ID NO: 2324598 - RNA, 18 nt, Human
gccugcuuuuuauggccu

SEQ ID NO: 2324599 - RNA, 19 nt, Human
gccugcuuuuuauggccug

SEQ ID NO: 2324600 - RNA, 22 nt, Human
gccugcuuuuuauggccuguga

SEQ ID NO: 2324601 - RNA, 18 nt, Human
gccugcuuuucacugcug

SEQ ID NO: 2324602 - RNA, 20 nt, Human
gccugcuuuucacugcugca

SEQ ID NO: 2324603 - RNA, 21 nt, Human
gccugcuuuucacugcugcaa

SEQ ID NO: 2324604 - RNA, 22 nt, Human
gccugcuuuucacugcugcaag

SEQ ID NO: 2324605 - RNA, 20 nt, Human
gccugaugcucccuccccug

SEQ ID NO: 2324606 - RNA, 13 nt, Human
gccugauggaccu

SEQ ID NO: 2324607 - RNA, 14 nt, Human
gccugauggaccug

SEQ ID NO: 2324608 - RNA, 17 nt, Human
gccugauggggaggguc

SEQ ID NO: 2324609 - RNA, 17 nt, Human
gccugauucggcugucu

SEQ ID NO: 2324610 - RNA, 20 nt, Human
gccugauucggcugucucag

SEQ ID NO: 2324611 - RNA, 19 nt, Human
gccugauugccaagcucag

SEQ ID NO: 2324612 - RNA, 16 nt, Human
gccugcacaauaaaaa

SEQ ID NO: 2324613 - RNA, 18 nt, Human
gccugcaaacgcugccug

SEQ ID NO: 2324614 - RNA, 17 nt, Human
gccugcaaacgcugccu

SEQ ID NO: 2324615 - RNA, 16 nt, Human
gccugcaaacgcugcc

SEQ ID NO: 2324616 - RNA, 20 nt, Human
gccugauugccaagcucagg

SEQ ID NO: 2324617 - RNA, 21 nt, Human
gccugauugccaagcucagga

SEQ ID NO: 2324618 - RNA, 15 nt, Human
gccugcuccagcugu

SEQ ID NO: 2324619 - RNA, 15 nt, Human
gccugcagagcugcg

SEQ ID NO: 2324620 - RNA, 12 nt, Human
gccugcagagcu

SEQ ID NO: 2324621 - RNA, 21 nt, Human
gccugcacggugggccuugcu

SEQ ID NO: 2324622 - RNA, 22 nt, Human
gccugcacggugggccuugcug

SEQ ID NO: 2324623 - RNA, 16 nt, Human
gccugcagaauuuggg

SEQ ID NO: 2324624 - RNA, 16 nt, Human
gccugcagacucacug

SEQ ID NO: 2324625 - RNA, 11 nt, Human
gccugcagaga

SEQ ID NO: 2324626 - RNA, 12 nt, Human
gccugcagagag

SEQ ID NO: 2324627 - RNA, 14 nt, Human
gccugcagagagaa

SEQ ID NO: 2324628 - RNA, 12 nt, Human
gccucccacugg

SEQ ID NO: 2324629 - RNA, 18 nt, Human
gccuccccucuccuuccu

SEQ ID NO: 2324630 - RNA, 21 nt, Human
gccucccacgacugcccggca

SEQ ID NO: 2324631 - RNA, 14 nt, Human
gccucccacgacug

SEQ ID NO: 2324632 - RNA, 17 nt, Human
gccucccacccccaucu

SEQ ID NO: 2324633 - RNA, 12 nt, Human
gccucccacccg

SEQ ID NO: 2324634 - RNA, 18 nt, Human
gccucccacccgaugcug

SEQ ID NO: 2324635 - RNA, 19 nt, Human
gccucccacccgaugcugc

SEQ ID NO: 2324636 - RNA, 20 nt, Human
gccucccacccgaugcugcu

SEQ ID NO: 2324637 - RNA, 21 nt, Human
gccucccacccgaugcugcuu

SEQ ID NO: 2324638 - RNA, 21 nt, Human
gccucccgaauagcugggacu

SEQ ID NO: 2324639 - RNA, 18 nt, Human
gccuccccugccagggca

SEQ ID NO: 2324640 - RNA, 17 nt, Human
gccuccccugccagggc

SEQ ID NO: 2324641 - RNA, 15 nt, Human
gccuccccugccagg

SEQ ID NO: 2324642 - RNA, 14 nt, Human
gccuccccugccag

SEQ ID NO: 2324643 - RNA, 21 nt, Human
gccuccccucuccuuccugug

SEQ ID NO: 2324644 - RNA, 19 nt, Human
gccuccccucuccuuccug

SEQ ID NO: 2324645 - RNA, 14 nt, Human
gccuccccugccac

SEQ ID NO: 2324646 - RNA, 15 nt, Human
gccuccccugccacc

SEQ ID NO: 2324647 - RNA, 16 nt, Human
gccuccccugccacca

SEQ ID NO: 2324648 - RNA, 19 nt, Human
gccuccccugccaccaggc

SEQ ID NO: 2324649 - RNA, 13 nt, Human
gccucccacagac

SEQ ID NO: 2324650 - RNA, 22 nt, Human
gccucauccgaggcagggucag

SEQ ID NO: 2324651 - RNA, 19 nt, Human
gccucauccgaggcagggu

SEQ ID NO: 2324652 - RNA, 18 nt, Human
gccucauccgaggcaggg

SEQ ID NO: 2324653 - RNA, 12 nt, Human
gccucccacccc

SEQ ID NO: 2324654 - RNA, 23 nt, Human
gccucccacagugacucgggcuc

SEQ ID NO: 2324655 - RNA, 12 nt, Human
gccucccacagu

SEQ ID NO: 2324656 - RNA, 13 nt, Human
gccucccacagug

SEQ ID NO: 2324657 - RNA, 14 nt, Human
gccucccacaguga

SEQ ID NO: 2324658 - RNA, 16 nt, Human
gccucccacagugacu

SEQ ID NO: 2324659 - RNA, 22 nt, Human
gccucccaacucaccccagccc

SEQ ID NO: 2324660 - RNA, 23 nt, Human
gccucccaacucaccccagcccc

SEQ ID NO: 2324661 - RNA, 17 nt, Human
gccucauccgaggcagg

SEQ ID NO: 2324662 - RNA, 16 nt, Human
gccucauccgaggcag

SEQ ID NO: 2324663 - RNA, 14 nt, Human
gccucaguguauuu

SEQ ID NO: 2324664 - RNA, 13 nt, Human
gccucauauuuaa

SEQ ID NO: 2324665 - RNA, 15 nt, Human
gccucauauuuaaag

SEQ ID NO: 2324666 - RNA, 22 nt, Human
gccucauauuuaaagacaggga

SEQ ID NO: 2324667 - RNA, 21 nt, Human
gccucccaacucaccccagcc

SEQ ID NO: 2324668 - RNA, 22 nt, Human
gccucaguggacuuuccacccc

SEQ ID NO: 2324669 - RNA, 21 nt, Human
gccucaguggacuuuccaccc

SEQ ID NO: 2324670 - RNA, 11 nt, Human
gccucagugga

SEQ ID NO: 2324671 - RNA, 22 nt, Human
gccucagucucccuucucccau

SEQ ID NO: 2324672 - RNA, 24 nt, Human
gccucaguccuccccucacagccu

SEQ ID NO: 2324673 - RNA, 21 nt, Human
gccucagucucccuucuccca

SEQ ID NO: 2324674 - RNA, 15 nt, Human
gccucagugccacua

SEQ ID NO: 2324675 - RNA, 16 nt, Human
gccucucccuggcccu

SEQ ID NO: 2324676 - RNA, 15 nt, Human
gccucucccuggccc

SEQ ID NO: 2324677 - RNA, 14 nt, Human
gccucucccuggcc

SEQ ID NO: 2324678 - RNA, 20 nt, Human
gccucuccuuguggccuggg

SEQ ID NO: 2324679 - RNA, 21 nt, Human
gccucuccuuguggccugggc

SEQ ID NO: 2324680 - RNA, 19 nt, Human
gccucucugcaggucccua

SEQ ID NO: 2324681 - RNA, 23 nt, Human
gccucuccuuuguauauuauuuc

SEQ ID NO: 2324682 - RNA, 16 nt, Human
gccucuccuuuguaua

SEQ ID NO: 2324683 - RNA, 17 nt, Human
gccucuccuuuguauau

SEQ ID NO: 2324684 - RNA, 22 nt, Human
gccucuccuuguggccugggcc

SEQ ID NO: 2324685 - RNA, 12 nt, Human
gccucuccuuug

SEQ ID NO: 2324686 - RNA, 14 nt, Human
gccucuccuuugua

SEQ ID NO: 2324687 - RNA, 15 nt, Human
gccucuccuuuguau

SEQ ID NO: 2324688 - RNA, 13 nt, Human
gccucuagggacc

SEQ ID NO: 2324689 - RNA, 17 nt, Human
gccucuagggaccccuc

SEQ ID NO: 2324690 - RNA, 18 nt, Human
gccucuagggaccccucc

SEQ ID NO: 2324691 - RNA, 19 nt, Human
gccucuagggaccccuccu

SEQ ID NO: 2324692 - RNA, 20 nt, Human
gccucuagggaccccuccuc

SEQ ID NO: 2324693 - RNA, 23 nt, Human
gccucucaccuguacucuuccga

SEQ ID NO: 2324694 - RNA, 23 nt, Human
gccucuagggaccccuccucccu

SEQ ID NO: 2324695 - RNA, 15 nt, Human
gccucuaaccccagg

SEQ ID NO: 2324696 - RNA, 22 nt, Human
gccucgggacaccugcccugcc

SEQ ID NO: 2324697 - RNA, 13 nt, Human
gccucgggaccuc

SEQ ID NO: 2324698 - RNA, 16 nt, Human
gccucuaaccccaggc

SEQ ID NO: 2324699 - RNA, 17 nt, Human
gccucuaaccccaggcc

SEQ ID NO: 2324700 - RNA, 18 nt, Human
gccucuaaccccaggccc

SEQ ID NO: 2324701 - RNA, 19 nt, Human
gccucuaaccccaggcccc

SEQ ID NO: 2324702 - RNA, 23 nt, Human
gccucuaccugacacucccuugg

SEQ ID NO: 2324703 - RNA, 20 nt, Human
gccucuaaccccaggccccg

SEQ ID NO: 2324704 - RNA, 21 nt, Human
gccucuaaccccaggccccga

SEQ ID NO: 2324705 - RNA, 23 nt, Human
gccucggagccucauccgaggca

SEQ ID NO: 2324706 - RNA, 17 nt, Human
gccucggagccucaucc

SEQ ID NO: 2324707 - RNA, 15 nt, Human
gccucggagccucau

SEQ ID NO: 2324708 - RNA, 14 nt, Human
gccucggagccuca

SEQ ID NO: 2324709 - RNA, 17 nt, Human
gccucggccucccaaag

SEQ ID NO: 2324710 - RNA, 14 nt, Human
gccucggcuccugc

SEQ ID NO: 2324711 - RNA, 20 nt, Human
gccucggcuuuucucagcug

SEQ ID NO: 2324712 - RNA, 19 nt, Human
gccucggcuuuucucagcu

SEQ ID NO: 2324713 - RNA, 17 nt, Human
gccucggcuccugcugc

SEQ ID NO: 2324714 - RNA, 18 nt, Human
gccucgggaaccucacuc

SEQ ID NO: 2324715 - RNA, 23 nt, Human
gccucgggaaccucacucuugcc

SEQ ID NO: 2324716 - RNA, 21 nt, Human
gccucgggacaccugcccugc

SEQ ID NO: 2324717 - RNA, 18 nt, Human
gccucggcuuuucucagc

SEQ ID NO: 2324718 - RNA, 15 nt, Human
gccucggcuccugcu

SEQ ID NO: 2324719 - RNA, 16 nt, Human
gccucggcuccugcug

SEQ ID NO: 2324720 - RNA, 18 nt, Human
gccucggcuccugcugca

SEQ ID NO: 2324721 - RNA, 23 nt, Human
gccucccacccgaugcugcuuuc

SEQ ID NO: 2324722 - RNA, 15 nt, Human
gccuccccugcugaa

SEQ ID NO: 2324723 - RNA, 20 nt, Human
gccuccccugcugaaggugg

SEQ ID NO: 2324724 - RNA, 16 nt, Human
gccuccccugugcagu

SEQ ID NO: 2324725 - RNA, 21 nt, Human
gccucggacuuagcugggaga

SEQ ID NO: 2324726 - RNA, 20 nt, Human
gccucggacuuagcugggag

SEQ ID NO: 2324727 - RNA, 23 nt, Human
gccucccgaauagcugggacuac

SEQ ID NO: 2324728 - RNA, 15 nt, Human
gccucccgaguagcu

SEQ ID NO: 2324729 - RNA, 16 nt, Human
gccucaggugggccgc

SEQ ID NO: 2324730 - RNA, 13 nt, Human
gccucagguuccu

SEQ ID NO: 2324731 - RNA, 14 nt, Human
gccucagguuccua

SEQ ID NO: 2324732 - RNA, 15 nt, Human
gccucagcugccuca

SEQ ID NO: 2324733 - RNA, 14 nt, Human
gccucagcugccuc

SEQ ID NO: 2324734 - RNA, 19 nt, Human
gccucagcugccucacuuc

SEQ ID NO: 2324735 - RNA, 16 nt, Human
gccucagcugccucac

SEQ ID NO: 2324736 - RNA, 20 nt, Human
gccucagcugccucacuucc

SEQ ID NO: 2324737 - RNA, 12 nt, Human
gccucagugcca

SEQ ID NO: 2324738 - RNA, 14 nt, Human
gccucagugccacu

SEQ ID NO: 2324739 - RNA, 18 nt, Human
gccucagucucccucccu

SEQ ID NO: 2324740 - RNA, 15 nt, Human
gccucagucucccuc

SEQ ID NO: 2324741 - RNA, 22 nt, Human
gccucaguaaguaucuggagga

SEQ ID NO: 2324742 - RNA, 20 nt, Human
gccucaguaagacgacaagg

SEQ ID NO: 2324743 - RNA, 15 nt, Human
gccucaguccucccc

SEQ ID NO: 2324744 - RNA, 16 nt, Human
gccucaguccuccccu

SEQ ID NO: 2324745 - RNA, 18 nt, Human
gccucaguccuccccuca

SEQ ID NO: 2324746 - RNA, 22 nt, Human
gccucaguccuccccucacagc

SEQ ID NO: 2324747 - RNA, 23 nt, Human
gccucaguccuccccucacagcc

SEQ ID NO: 2324748 - RNA, 16 nt, Human
gccucagccuccugag

SEQ ID NO: 2324749 - RNA, 14 nt, Human
gccucagccucccg

SEQ ID NO: 2324750 - RNA, 18 nt, Human
gccucagccuccugagua

SEQ ID NO: 2324751 - RNA, 23 nt, Human
gccucagaauugaucauuuuccc

SEQ ID NO: 2324752 - RNA, 16 nt, Human
gccucagccucccaag

SEQ ID NO: 2324753 - RNA, 23 nt, Human
gccucagccucccaaagugcugg

SEQ ID NO: 2324754 - RNA, 16 nt, Human
gccucacccccucggg

SEQ ID NO: 2324755 - RNA, 22 nt, Human
gccucacccccucgggucuccu

SEQ ID NO: 2324756 - RNA, 23 nt, Human
gccucacccccucgggucuccuc

SEQ ID NO: 2324757 - RNA, 16 nt, Human
gccucacuugaaugug

SEQ ID NO: 2324758 - RNA, 22 nt, Human
gccucaccuuggggcuugacuu

SEQ ID NO: 2324759 - RNA, 20 nt, Human
gccucacuugaaugugucac

SEQ ID NO: 2324760 - RNA, 18 nt, Human
gccucacuugaauguguc

SEQ ID NO: 2324761 - RNA, 23 nt, Human
gccucaacccucccucagccccu

SEQ ID NO: 2324762 - RNA, 22 nt, Human
gccucaacccucccucagcccc

SEQ ID NO: 2324763 - RNA, 18 nt, Human
gccucaagucacucccaa

SEQ ID NO: 2324764 - RNA, 15 nt, Human
gccucacccccucgg

SEQ ID NO: 2324765 - RNA, 17 nt, Human
gccuaaguggcugcuga

SEQ ID NO: 2324766 - RNA, 16 nt, Human
gccuaaguggcugcug

SEQ ID NO: 2324767 - RNA, 22 nt, Human
gccgagcucguguauccugggg

SEQ ID NO: 2324768 - RNA, 16 nt, Human
gccgaggguccuggcu

SEQ ID NO: 2324769 - RNA, 21 nt, Human
gccuauaaugaagcuuuauac

SEQ ID NO: 2324770 - RNA, 23 nt, Human
gccuaucaaagaccuugugugua

SEQ ID NO: 2324771 - RNA, 16 nt, Human
gccuauaaugaagcuu

SEQ ID NO: 2324772 - RNA, 22 nt, Human
gccuauauuuuuuguuaaauga

SEQ ID NO: 2324773 - RNA, 15 nt, Human
gccgagccgggccug

SEQ ID NO: 2324774 - RNA, 16 nt, Human
gccgagccgggccugg

SEQ ID NO: 2324775 - RNA, 17 nt, Human
gccgagccgggccuggg

SEQ ID NO: 2324776 - RNA, 19 nt, Human
gccgagccgggccuggggc

SEQ ID NO: 2324777 - RNA, 19 nt, Human
gccgagauagccaaggcca

SEQ ID NO: 2324778 - RNA, 16 nt, Human
gccuaaggcugaacuu

SEQ ID NO: 2324779 - RNA, 20 nt, Human
gccgagccgggccuggggcu

SEQ ID NO: 2324780 - RNA, 21 nt, Human
gccgagcucguguauccuggg

SEQ ID NO: 2324781 - RNA, 23 nt, Human
gccgagcucguguauccuggggc

SEQ ID NO: 2324782 - RNA, 17 nt, Human
gccuaagugcagccccg

SEQ ID NO: 2324783 - RNA, 14 nt, Human
gccucaaccuccug

SEQ ID NO: 2324784 - RNA, 16 nt, Human
gccucaaccuccuggg

SEQ ID NO: 2324785 - RNA, 23 nt, Human
gccuaucagugugccccccaucc

SEQ ID NO: 2324786 - RNA, 20 nt, Human
gccuaucagaguugcugcaa

SEQ ID NO: 2324787 - RNA, 13 nt, Human
gccuaucagugug

SEQ ID NO: 2324788 - RNA, 14 nt, Human
gccuaucagugugc

SEQ ID NO: 2324789 - RNA, 15 nt, Human
gccuaucagugugcc

SEQ ID NO: 2324790 - RNA, 16 nt, Human
gccuaucagugugccc

SEQ ID NO: 2324791 - RNA, 18 nt, Human
gccuaucagugugccccc

SEQ ID NO: 2324792 - RNA, 19 nt, Human
gccuaucagugugcccccc

SEQ ID NO: 2324793 - RNA, 21 nt, Human
gccucaacccucccucagccc

SEQ ID NO: 2324794 - RNA, 19 nt, Human
gccucaacccucccucagc

SEQ ID NO: 2324795 - RNA, 18 nt, Human
gccucaacccucccucag

SEQ ID NO: 2324796 - RNA, 17 nt, Human
gccucaacccucccuca

SEQ ID NO: 2324797 - RNA, 19 nt, Human
gccucaagugauucuccug

SEQ ID NO: 2324798 - RNA, 20 nt, Human
gccucaagugauucuccugc

SEQ ID NO: 2324799 - RNA, 21 nt, Human
gccucaagugauucuccugcc

SEQ ID NO: 2324800 - RNA, 22 nt, Human
gcuucucauccugcaggcagcu

SEQ ID NO: 2324801 - RNA, 13 nt, Human
gcuucuccagccu

SEQ ID NO: 2324802 - RNA, 21 nt, Human
gcuuccagguaucuccaggau

SEQ ID NO: 2324803 - RNA, 22 nt, Human
gcuuccagguaucuccaggauu

SEQ ID NO: 2324804 - RNA, 19 nt, Human
gcuucucccacuuggccaa

SEQ ID NO: 2324805 - RNA, 14 nt, Human
gcuucuccagccug

SEQ ID NO: 2324806 - RNA, 17 nt, Human
gcuucuccagccuggac

SEQ ID NO: 2324807 - RNA, 12 nt, Human
gcuucuccaggc

SEQ ID NO: 2324808 - RNA, 18 nt, Human
gcuucucccacuuggcca

SEQ ID NO: 2324809 - RNA, 16 nt, Human
gcuuccagugaggcuc

SEQ ID NO: 2324810 - RNA, 21 nt, Human
gcuuccaggaaacuccacauc

SEQ ID NO: 2324811 - RNA, 19 nt, Human
gcuuccagguaucuccagg

SEQ ID NO: 2324812 - RNA, 20 nt, Human
gcuuccagguaucuccagga

SEQ ID NO: 2324813 - RNA, 17 nt, Human
gcuucauuuccuguguc

SEQ ID NO: 2324814 - RNA, 19 nt, Human
gcuuccaggaaacuccaca

SEQ ID NO: 2324815 - RNA, 15 nt, Human
gcuuccagugaggcu

SEQ ID NO: 2324816 - RNA, 12 nt, Human
gcuucugcaccc

SEQ ID NO: 2324817 - RNA, 23 nt, Human
gcuucuccgccagccuccucugg

SEQ ID NO: 2324818 - RNA, 19 nt, Human
gcuucugaaugcugcuacu

SEQ ID NO: 2324819 - RNA, 22 nt, Human
gcuucucugugaacgauuuaga

SEQ ID NO: 2324820 - RNA, 20 nt, Human
gcuucuccgccagccuccuc

SEQ ID NO: 2324821 - RNA, 21 nt, Human
gcuucuccgccagccuccucu

SEQ ID NO: 2324822 - RNA, 14 nt, Human
gcuucuccgccagc

SEQ ID NO: 2324823 - RNA, 15 nt, Human
gcuucuccgccagcc

SEQ ID NO: 2324824 - RNA, 16 nt, Human
gcuucuccgccagccu

SEQ ID NO: 2324825 - RNA, 17 nt, Human
gcuucuccgccagccuc

SEQ ID NO: 2324826 - RNA, 18 nt, Human
gcuucuccgccagccucc

SEQ ID NO: 2324827 - RNA, 19 nt, Human
gcuucuccgccagccuccu

SEQ ID NO: 2324828 - RNA, 12 nt, Human
gcuucugccacu

SEQ ID NO: 2324829 - RNA, 13 nt, Human
gcuucugccacuu

SEQ ID NO: 2324830 - RNA, 14 nt, Human
gcuucugccacuuc

SEQ ID NO: 2324831 - RNA, 16 nt, Human
gcuucugccacuuccc

SEQ ID NO: 2324832 - RNA, 18 nt, Human
gcuucugccacuucccag

SEQ ID NO: 2324833 - RNA, 19 nt, Human
gcuucugccacuucccagg

SEQ ID NO: 2324834 - RNA, 21 nt, Human
gcuucugccacuucccaggua

SEQ ID NO: 2324835 - RNA, 13 nt, Human
gcuucugcacccu

SEQ ID NO: 2324836 - RNA, 14 nt, Human
gcuucugcacccuc

SEQ ID NO: 2324837 - RNA, 15 nt, Human
gcuucugcacccucc

SEQ ID NO: 2324838 - RNA, 17 nt, Human
gcuucugcacccuccac

SEQ ID NO: 2324839 - RNA, 18 nt, Human
gcuucugcacccuccacc

SEQ ID NO: 2324840 - RNA, 19 nt, Human
gcuucugcacccuccaccc

SEQ ID NO: 2324841 - RNA, 21 nt, Human
gcuucugcacccuccacccug

SEQ ID NO: 2324842 - RNA, 13 nt, Human
gcuucugccugca

SEQ ID NO: 2324843 - RNA, 12 nt, Human
gcuucugccugc

SEQ ID NO: 2324844 - RNA, 16 nt, Human
gcuugaggguugggcu

SEQ ID NO: 2324845 - RNA, 19 nt, Human
gcuuaucucaggggugugc

SEQ ID NO: 2324846 - RNA, 13 nt, Human
gcuuaucucaggg

SEQ ID NO: 2324847 - RNA, 12 nt, Human
gcuuauacacuu

SEQ ID NO: 2324848 - RNA, 18 nt, Human
gcuuagucacugccugca

SEQ ID NO: 2324849 - RNA, 20 nt, Human
gcuuaguuuguguguugucu

SEQ ID NO: 2324850 - RNA, 21 nt, Human
gcuuaguuuguguguugucuc

SEQ ID NO: 2324851 - RNA, 16 nt, Human
gcuucaguggcagcug

SEQ ID NO: 2324852 - RNA, 23 nt, Human
gcuuaugacaucacuuguacaaa

SEQ ID NO: 2324853 - RNA, 22 nt, Human
gcuuaugacaucacuuguacaa

SEQ ID NO: 2324854 - RNA, 18 nt, Human
gcuuaugacaucacuugu

SEQ ID NO: 2324855 - RNA, 17 nt, Human
gcuucaguggcagcugc

SEQ ID NO: 2324856 - RNA, 18 nt, Human
gcuucaguggcagcugcu

SEQ ID NO: 2324857 - RNA, 23 nt, Human
gcuucauacuucaugaaauccug

SEQ ID NO: 2324858 - RNA, 22 nt, Human
gcuucauacagggaugguguuc

SEQ ID NO: 2324859 - RNA, 11 nt, Human
gcuucauacag

SEQ ID NO: 2324860 - RNA, 13 nt, Human
gcuucauuuccug

SEQ ID NO: 2324861 - RNA, 16 nt, Human
gcuucauuuccugugu

SEQ ID NO: 2324862 - RNA, 12 nt, Human
gcuucauccucc

SEQ ID NO: 2324863 - RNA, 15 nt, Human
gcuucauccuccuca

SEQ ID NO: 2324864 - RNA, 21 nt, Human
gcuguccucagguggccaugc

SEQ ID NO: 2324865 - RNA, 22 nt, Human
gcuguccuuacccaucugcacc

SEQ ID NO: 2324866 - RNA, 17 nt, Human
gcuguccuuacccaucu

SEQ ID NO: 2324867 - RNA, 20 nt, Human
gcuguccucagguggccaug

SEQ ID NO: 2324868 - RNA, 14 nt, Human
gcugucuccagacc

SEQ ID NO: 2324869 - RNA, 13 nt, Human
gcugucuccagac

SEQ ID NO: 2324870 - RNA, 22 nt, Human
gcugucgauguaggcauucugg

SEQ ID NO: 2324871 - RNA, 20 nt, Human
gcugucuacacuaagagaga

SEQ ID NO: 2324872 - RNA, 15 nt, Human
gcugccaaugggagc

SEQ ID NO: 2324873 - RNA, 16 nt, Human
gcugccaaugggagcu

SEQ ID NO: 2324874 - RNA, 19 nt, Human
gcugccaaugggagcucau

SEQ ID NO: 2324875 - RNA, 13 nt, Human
gcuguucagcugg

SEQ ID NO: 2324876 - RNA, 14 nt, Human
gcuguucagcuggu

SEQ ID NO: 2324877 - RNA, 22 nt, Human
gcuguucccauguagcccccug

SEQ ID NO: 2324878 - RNA, 19 nt, Human
gcugugggccucaaggacu

SEQ ID NO: 2324879 - RNA, 21 nt, Human
gcuguggggcugguagcucag

SEQ ID NO: 2324880 - RNA, 18 nt, Human
gcugugggccucaaggac

SEQ ID NO: 2324881 - RNA, 23 nt, Human
gcugugggcaggugggagcuuga

SEQ ID NO: 2324882 - RNA, 16 nt, Human
gcuguggggcugguag

SEQ ID NO: 2324883 - RNA, 23 nt, Human
gcugugguagggggugucucagg

SEQ ID NO: 2324884 - RNA, 18 nt, Human
gcuguggguacagagagg

SEQ ID NO: 2324885 - RNA, 22 nt, Human
gcuguggggcugguagcucagg

SEQ ID NO: 2324886 - RNA, 23 nt, Human
gcuguggugugucccccucuguc

SEQ ID NO: 2324887 - RNA, 22 nt, Human
gcugucuccagacccccacccc

SEQ ID NO: 2324888 - RNA, 15 nt, Human
gcugucuccagaccc

SEQ ID NO: 2324889 - RNA, 20 nt, Human
gcugugggcgugagaccugc

SEQ ID NO: 2324890 - RNA, 22 nt, Human
gcugugggcgugagaccugccc

SEQ ID NO: 2324891 - RNA, 21 nt, Human
gcugugggcgugagaccugcc

SEQ ID NO: 2324892 - RNA, 23 nt, Human
gcuuagaccucagccugugcugc

SEQ ID NO: 2324893 - RNA, 19 nt, Human
gcuuagaccucagccugug

SEQ ID NO: 2324894 - RNA, 21 nt, Human
gcuuagacuucgacucaggau

SEQ ID NO: 2324895 - RNA, 23 nt, Human
gcuuagacuucgacucaggaucc

SEQ ID NO: 2324896 - RNA, 16 nt, Human
gcuuagagaauguucu

SEQ ID NO: 2324897 - RNA, 18 nt, Human
gcuuagagaauguucucc

SEQ ID NO: 2324898 - RNA, 13 nt, Human
gcuuagagacagu

SEQ ID NO: 2324899 - RNA, 12 nt, Human
gcuuagagcagu

SEQ ID NO: 2324900 - RNA, 16 nt, Human
gcuuagagccucccuc

SEQ ID NO: 2324901 - RNA, 18 nt, Human
gcuuagcuuugcucugcc

SEQ ID NO: 2324902 - RNA, 22 nt, Human
gcuuagccuccugaccugaggc

SEQ ID NO: 2324903 - RNA, 17 nt, Human
gcuuagcuuugcucugc

SEQ ID NO: 2324904 - RNA, 11 nt, Human
gcuuagcagga

SEQ ID NO: 2324905 - RNA, 16 nt, Human
gcuuagcaggagagga

SEQ ID NO: 2324906 - RNA, 18 nt, Human
gcuuagcaggagaggaga

SEQ ID NO: 2324907 - RNA, 21 nt, Human
gcuuagcaggagaggagagcc

SEQ ID NO: 2324908 - RNA, 22 nt, Human
gcuuagcaggagaggagagcca

SEQ ID NO: 2324909 - RNA, 23 nt, Human
gcuuagcaggagaggagagccag

SEQ ID NO: 2324910 - RNA, 12 nt, Human
gcuguugagcug

SEQ ID NO: 2324911 - RNA, 15 nt, Human
gcuguugagcuguuu

SEQ ID NO: 2324912 - RNA, 16 nt, Human
gcuguugagcuguuuu

SEQ ID NO: 2324913 - RNA, 18 nt, Human
gcuguugagcuguuuucc

SEQ ID NO: 2324914 - RNA, 15 nt, Human
gcuguugccucaucu

SEQ ID NO: 2324915 - RNA, 13 nt, Human
gcuguugccucau

SEQ ID NO: 2324916 - RNA, 21 nt, Human
gcuguugcguaacuggcugug

SEQ ID NO: 2324917 - RNA, 23 nt, Human
gcuguugcguaacuggcuguguu

SEQ ID NO: 2324918 - RNA, 12 nt, Human
gcuguugcugaa

SEQ ID NO: 2324919 - RNA, 21 nt, Human
gcuguugaugaggccucuugg

SEQ ID NO: 2324920 - RNA, 15 nt, Human
gcuguugauugcuaa

SEQ ID NO: 2324921 - RNA, 16 nt, Human
gcuguugauugcuaaa

SEQ ID NO: 2324922 - RNA, 19 nt, Human
gcuguugauugcuaaaugu

SEQ ID NO: 2324923 - RNA, 20 nt, Human
gcuguugauugcuaaaugua

SEQ ID NO: 2324924 - RNA, 18 nt, Human
gcuguugauuucuuucca

SEQ ID NO: 2324925 - RNA, 13 nt, Human
gcuguugcaguga

SEQ ID NO: 2324926 - RNA, 21 nt, Human
gcuuagucacugagacagccc

SEQ ID NO: 2324927 - RNA, 12 nt, Human
gcuuaguuugug

SEQ ID NO: 2324928 - RNA, 15 nt, Human
gcuuagucacugccu

SEQ ID NO: 2324929 - RNA, 17 nt, Human
gcuuagucacugccugc

SEQ ID NO: 2324930 - RNA, 14 nt, Human
gcuuaguuugugug

SEQ ID NO: 2324931 - RNA, 16 nt, Human
gcuuaguuuguguguu

SEQ ID NO: 2324932 - RNA, 19 nt, Human
gcuuagucacugagacagc

SEQ ID NO: 2324933 - RNA, 20 nt, Human
gcuuagucacugagacagcc

SEQ ID NO: 2324934 - RNA, 15 nt, Human
gcuuagucacugaga

SEQ ID NO: 2324935 - RNA, 17 nt, Human
gcuuagucacugagaca

SEQ ID NO: 2324936 - RNA, 12 nt, Human
gcuuaggauguu

SEQ ID NO: 2324937 - RNA, 13 nt, Human
gcuuaggcagggc

SEQ ID NO: 2324938 - RNA, 19 nt, Human
gcuuagcuuugcucugcca

SEQ ID NO: 2324939 - RNA, 12 nt, Human
gcuuaggagaga

SEQ ID NO: 2324940 - RNA, 13 nt, Human
gcuuaggagagac

SEQ ID NO: 2324941 - RNA, 22 nt, Human
gcuuaggaugugugcaugugug

SEQ ID NO: 2324942 - RNA, 18 nt, Human
gcuuaggcagggcucucu

SEQ ID NO: 2324943 - RNA, 23 nt, Human
gcuuaguaaugcuacgugugauu

SEQ ID NO: 2324944 - RNA, 13 nt, Human
ggaaccagggaga

SEQ ID NO: 2324945 - RNA, 13 nt, Human
ggaaccagagcca

SEQ ID NO: 2324946 - RNA, 12 nt, Human
ggaaccagagcc

SEQ ID NO: 2324947 - RNA, 22 nt, Human
ggaaccaaagcgaauuuuaaaa

SEQ ID NO: 2324948 - RNA, 19 nt, Human
ggaaccagagccauggacu

SEQ ID NO: 2324949 - RNA, 17 nt, Human
ggaaccagggagaccga

SEQ ID NO: 2324950 - RNA, 11 nt, Human
ggaacccagac

SEQ ID NO: 2324951 - RNA, 14 nt, Human
ggaacccagacuca

SEQ ID NO: 2324952 - RNA, 13 nt, Human
ggaacccagacuc

SEQ ID NO: 2324953 - RNA, 15 nt, Human
ggaacccagacucag

SEQ ID NO: 2324954 - RNA, 18 nt, Human
ggaaccaugaagacagga

SEQ ID NO: 2324955 - RNA, 15 nt, Human
ggaaccccccuccca

SEQ ID NO: 2324956 - RNA, 22 nt, Human
ggaaccccccucccacccaccg

SEQ ID NO: 2324957 - RNA, 17 nt, Human
ggaaccccccucccacc

SEQ ID NO: 2324958 - RNA, 21 nt, Human
ggaaccccccucccacccacc

SEQ ID NO: 2324959 - RNA, 18 nt, Human
ggaacaguguuucccaua

SEQ ID NO: 2324960 - RNA, 23 nt, Human
ggaacaggcucagaucucauggg

SEQ ID NO: 2324961 - RNA, 23 nt, Human
ggaacaguguuucccauaauuuu

SEQ ID NO: 2324962 - RNA, 16 nt, Human
ggaacaggaaacugau

SEQ ID NO: 2324963 - RNA, 21 nt, Human
ggaaccaaagcgaauuuuaaa

SEQ ID NO: 2324964 - RNA, 15 nt, Human
ggaacaucaucaagg

SEQ ID NO: 2324965 - RNA, 22 nt, Human
ggaacaucaucaaggcacugcc

SEQ ID NO: 2324966 - RNA, 23 nt, Human
ggaacaucaucaaggcacugccu

SEQ ID NO: 2324967 - RNA, 23 nt, Human
ggaacagcuaugggagccccagg

SEQ ID NO: 2324968 - RNA, 22 nt, Human
ggaaauaucaguuacucagccc

SEQ ID NO: 2324969 - RNA, 14 nt, Human
ggaaauaugaaugc

SEQ ID NO: 2324970 - RNA, 21 nt, Human
ggaaaucaccgaaaacguggc

SEQ ID NO: 2324971 - RNA, 14 nt, Human
ggaaaucaccgaaa

SEQ ID NO: 2324972 - RNA, 17 nt, Human
ggaaaucaaauaugcaa

SEQ ID NO: 2324973 - RNA, 16 nt, Human
ggaaauaucaguuacu

SEQ ID NO: 2324974 - RNA, 14 nt, Human
ggaaauauauaugu

SEQ ID NO: 2324975 - RNA, 20 nt, Human
ggaaauaauaaagaugcucu

SEQ ID NO: 2324976 - RNA, 16 nt, Human
ggaaauaccaguucug

SEQ ID NO: 2324977 - RNA, 22 nt, Human
ggaaauaaaaccuuucaaauuu

SEQ ID NO: 2324978 - RNA, 17 nt, Human
ggaaauaagaaaaauca

SEQ ID NO: 2324979 - RNA, 20 nt, Human
ggaaauaaaaccuuucaaau

SEQ ID NO: 2324980 - RNA, 19 nt, Human
ggaaauaaaaccuuucaaa

SEQ ID NO: 2324981 - RNA, 18 nt, Human
ggaaauaaaaccuuucaa

SEQ ID NO: 2324982 - RNA, 16 nt, Human
ggaaauaaaaccuuuc

SEQ ID NO: 2324983 - RNA, 15 nt, Human
ggaaauaaaaccuuu

SEQ ID NO: 2324984 - RNA, 21 nt, Human
ggaaaggggcaggccagagcu

SEQ ID NO: 2324985 - RNA, 21 nt, Human
ggaaaggggagagccugcugg

SEQ ID NO: 2324986 - RNA, 14 nt, Human
ggaaaggggggagc

SEQ ID NO: 2324987 - RNA, 22 nt, Human
ggaaagggggucccagugggag

SEQ ID NO: 2324988 - RNA, 18 nt, Human
ggaaaguguaaagcauuc

SEQ ID NO: 2324989 - RNA, 18 nt, Human
ggaaaggggggagcuggg

SEQ ID NO: 2324990 - RNA, 19 nt, Human
ggaaaguguaaagcauucc

SEQ ID NO: 2324991 - RNA, 12 nt, Human
ggaaaggggaga

SEQ ID NO: 2324992 - RNA, 13 nt, Human
ggaaaggggagag

SEQ ID NO: 2324993 - RNA, 14 nt, Human
ggaaaggggagagc

SEQ ID NO: 2324994 - RNA, 18 nt, Human
ggaaaggggagagccugc

SEQ ID NO: 2324995 - RNA, 19 nt, Human
ggaaaggggagagccugcu

SEQ ID NO: 2324996 - RNA, 20 nt, Human
ggaaaggcucugaaagccag

SEQ ID NO: 2324997 - RNA, 15 nt, Human
ggaaaggcucugaaa

SEQ ID NO: 2324998 - RNA, 23 nt, Human
ggaaaggcucagucucaggagca

SEQ ID NO: 2324999 - RNA, 22 nt, Human
ggaaaggcuccaggagcagcca

SEQ ID NO: 2325000 - RNA, 17 nt, Human
ggaaaggcuccaggagc

SEQ ID NO: 2325001 - RNA, 19 nt, Human
ggaaaggcuccaggagcag

SEQ ID NO: 2325002 - RNA, 20 nt, Human
ggaaaggcuccaggagcagc

SEQ ID NO: 2325003 - RNA, 21 nt, Human
ggaaaggcuccaggagcagcc

SEQ ID NO: 2325004 - RNA, 20 nt, Human
ggaaaggcucagucucagga

SEQ ID NO: 2325005 - RNA, 12 nt, Human
ggaaaauuauuu

SEQ ID NO: 2325006 - RNA, 12 nt, Human
ggaaaggcucca

SEQ ID NO: 2325007 - RNA, 13 nt, Human
ggaaaggcuccag

SEQ ID NO: 2325008 - RNA, 14 nt, Human
ggaaaggcuccagg

SEQ ID NO: 2325009 - RNA, 19 nt, Human
ggaaaaucagccugcucca

SEQ ID NO: 2325010 - RNA, 18 nt, Human
ggaaaagguuuuauuuug

SEQ ID NO: 2325011 - RNA, 15 nt, Human
ggaaaaguacauuua

SEQ ID NO: 2325012 - RNA, 16 nt, Human
ggaaaaugcauuguau

SEQ ID NO: 2325013 - RNA, 20 nt, Human
ggaaaaugcagcagggaugc

SEQ ID NO: 2325014 - RNA, 14 nt, Human
ggaaaaugcauugu

SEQ ID NO: 2325015 - RNA, 19 nt, Human
ggaaaaucucuuuuugacu

SEQ ID NO: 2325016 - RNA, 14 nt, Human
ggaaaaugaauaau

SEQ ID NO: 2325017 - RNA, 23 nt, Human
ggaaaaucagccugcuccagcug

SEQ ID NO: 2325018 - RNA, 21 nt, Human
gcuuuagacacuggcugccag

SEQ ID NO: 2325019 - RNA, 14 nt, Human
gcuuuagacccugg

SEQ ID NO: 2325020 - RNA, 16 nt, Human
gcuuuacuguuuguua

SEQ ID NO: 2325021 - RNA, 18 nt, Human
gcuugaggguugggcugg

SEQ ID NO: 2325022 - RNA, 20 nt, Human
gcuugaggguugggcuggug

SEQ ID NO: 2325023 - RNA, 21 nt, Human
gcuuuauuuuuuaaguauuua

SEQ ID NO: 2325024 - RNA, 19 nt, Human
gcuuuauuuuuuaaguauu

SEQ ID NO: 2325025 - RNA, 20 nt, Human
gcuuuauacguguagcuaua

SEQ ID NO: 2325026 - RNA, 21 nt, Human
gcuuucaauuccguagccagc

SEQ ID NO: 2325027 - RNA, 23 nt, Human
gcuuuauuuuuuaaguauuuaua

SEQ ID NO: 2325028 - RNA, 14 nt, Human
gcuuuauaaauaaa

SEQ ID NO: 2325029 - RNA, 10 nt, Human
gcuuuauaaa

SEQ ID NO: 2325030 - RNA, 23 nt, Human
gcuuuaguccuagaggaccugag

SEQ ID NO: 2325031 - RNA, 17 nt, Human
gcuuuagacccugggug

SEQ ID NO: 2325032 - RNA, 15 nt, Human
gcuuuagacccuggg

SEQ ID NO: 2325033 - RNA, 16 nt, Human
gcuuuagacccugggu

SEQ ID NO: 2325034 - RNA, 16 nt, Human
gcuuucaauuccguag

SEQ ID NO: 2325035 - RNA, 17 nt, Human
gcuuucacuauuuccuu

SEQ ID NO: 2325036 - RNA, 19 nt, Human
gcuuucacuauuuccuuua

SEQ ID NO: 2325037 - RNA, 15 nt, Human
gcuuuguaugcacuu

SEQ ID NO: 2325038 - RNA, 15 nt, Human
gcuuugugugauuga

SEQ ID NO: 2325039 - RNA, 16 nt, Human
gcuuugugugauugaa

SEQ ID NO: 2325040 - RNA, 15 nt, Human
gcuuucagccucugg

SEQ ID NO: 2325041 - RNA, 15 nt, Human
gcuuugugauuuuug

SEQ ID NO: 2325042 - RNA, 20 nt, Human
ggaaaaggcagggagcgagg

SEQ ID NO: 2325043 - RNA, 20 nt, Human
ggaaaagggucuugggaaau

SEQ ID NO: 2325044 - RNA, 21 nt, Human
ggaaaagggucuugggaaaua

SEQ ID NO: 2325045 - RNA, 18 nt, Human
ggaaaagcugcugacagu

SEQ ID NO: 2325046 - RNA, 20 nt, Human
ggaaaagcugcugacagugu

SEQ ID NO: 2325047 - RNA, 19 nt, Human
ggaaaagcggacaucagcu

SEQ ID NO: 2325048 - RNA, 14 nt, Human
ggaaaagccucugu

SEQ ID NO: 2325049 - RNA, 20 nt, Human
ggaaaagccaagaggcugca

SEQ ID NO: 2325050 - RNA, 14 nt, Human
ggaaaagcugcuga

SEQ ID NO: 2325051 - RNA, 18 nt, Human
ggaaaagcagcucucccc

SEQ ID NO: 2325052 - RNA, 14 nt, Human
ggaaaagcagcucu

SEQ ID NO: 2325053 - RNA, 21 nt, Human
ggaaaaccaagccguggcuuc

SEQ ID NO: 2325054 - RNA, 21 nt, Human
ggaaaagaggaguuucgaggu

SEQ ID NO: 2325055 - RNA, 18 nt, Human
ggaaaacagacucagguu

SEQ ID NO: 2325056 - RNA, 22 nt, Human
ggaaaacagaacaucauuagaa

SEQ ID NO: 2325057 - RNA, 15 nt, Human
ggaaaacauuccauc

SEQ ID NO: 2325058 - RNA, 15 nt, Human
ggaaaaauccagaaa

SEQ ID NO: 2325059 - RNA, 17 nt, Human
ggaaaaaugagagaagg

SEQ ID NO: 2325060 - RNA, 15 nt, Human
ggaaaaaugaguaau

SEQ ID NO: 2325061 - RNA, 12 nt, Human
ggaaaaaugugu

SEQ ID NO: 2325062 - RNA, 18 nt, Human
ggaaaacaugcuacacac

SEQ ID NO: 2325063 - RNA, 15 nt, Human
ggaaaaauauuuaag

SEQ ID NO: 2325064 - RNA, 14 nt, Human
ggaaaaauauuuaa

SEQ ID NO: 2325065 - RNA, 13 nt, Human
ggaaaaauauuua

SEQ ID NO: 2325066 - RNA, 16 nt, Human
gcuuuucacugcugca

SEQ ID NO: 2325067 - RNA, 17 nt, Human
gcuuuucacugcugcaa

SEQ ID NO: 2325068 - RNA, 22 nt, Human
gcuuuucacugcuggcugccuu

SEQ ID NO: 2325069 - RNA, 23 nt, Human
gcuuuucacugcuggcugccuua

SEQ ID NO: 2325070 - RNA, 21 nt, Human
gcuuuguuuguugucagcuga

SEQ ID NO: 2325071 - RNA, 14 nt, Human
gcuuuguuuugcac

SEQ ID NO: 2325072 - RNA, 13 nt, Human
gcuuuucacugcu

SEQ ID NO: 2325073 - RNA, 23 nt, Human
gcuuuguuuugcacacuuugcca

SEQ ID NO: 2325074 - RNA, 14 nt, Human
gcuuuucacugcug

SEQ ID NO: 2325075 - RNA, 18 nt, Human
gcuuuucacugcuggcug

SEQ ID NO: 2325076 - RNA, 19 nt, Human
ggagaugaagcaaacacau

SEQ ID NO: 2325077 - RNA, 23 nt, Human
ggagaugaaaucuuacagcuggg

SEQ ID NO: 2325078 - RNA, 23 nt, Human
ggagauauuuauggggggagaac

SEQ ID NO: 2325079 - RNA, 13 nt, Human
ggagauccuccug

SEQ ID NO: 2325080 - RNA, 15 nt, Human
ggagauccuccugca

SEQ ID NO: 2325081 - RNA, 22 nt, Human
ggagauauuuauggggggagaa

SEQ ID NO: 2325082 - RNA, 22 nt, Human
ggagauaucugagggaggaggc

SEQ ID NO: 2325083 - RNA, 20 nt, Human
ggagaucaaggagaggaggc

SEQ ID NO: 2325084 - RNA, 14 nt, Human
ggagauagggaaag

SEQ ID NO: 2325085 - RNA, 23 nt, Human
ggagaguucaauggcugcugaag

SEQ ID NO: 2325086 - RNA, 21 nt, Human
ggagauagccccacaggaggu

SEQ ID NO: 2325087 - RNA, 20 nt, Human
ggagauagccccacaggagg

SEQ ID NO: 2325088 - RNA, 23 nt, Human
ggagagguuauaggucacuccug

SEQ ID NO: 2325089 - RNA, 20 nt, Human
ggagaguacagugagccaag

SEQ ID NO: 2325090 - RNA, 17 nt, Human
ggagaguacagugagcc

SEQ ID NO: 2325091 - RNA, 17 nt, Human
ggagagucccagagcag

SEQ ID NO: 2325092 - RNA, 20 nt, Human
ggagagucccagagcaggag

SEQ ID NO: 2325093 - RNA, 21 nt, Human
ggagagucccagagcaggagg

SEQ ID NO: 2325094 - RNA, 21 nt, Human
ggagaguccccugaaggucug

SEQ ID NO: 2325095 - RNA, 22 nt, Human
ggagagucccagagcaggaggc

SEQ ID NO: 2325096 - RNA, 18 nt, Human
ggagaguuuccugaaaca

SEQ ID NO: 2325097 - RNA, 21 nt, Human
ggagagguuauaggucacucc

SEQ ID NO: 2325098 - RNA, 13 nt, Human
ggagagguggagc

SEQ ID NO: 2325099 - RNA, 15 nt, Human
ggagaggugccagca

SEQ ID NO: 2325100 - RNA, 16 nt, Human
ggagaggugccagcaa

SEQ ID NO: 2325101 - RNA, 23 nt, Human
ggagaggucuuuuuuaaaaggaa

SEQ ID NO: 2325102 - RNA, 14 nt, Human
ggagaggugccagc

SEQ ID NO: 2325103 - RNA, 18 nt, Human
ggagaggucuuuuuuaaa

SEQ ID NO: 2325104 - RNA, 11 nt, Human
ggagaggucuu

SEQ ID NO: 2325105 - RNA, 13 nt, Human
ggagaggccauga

SEQ ID NO: 2325106 - RNA, 21 nt, Human
ggagaggaugagagcccagag

SEQ ID NO: 2325107 - RNA, 22 nt, Human
ggagaggaugagagcccagagg

SEQ ID NO: 2325108 - RNA, 23 nt, Human
ggagagggucuggagaagcagug

SEQ ID NO: 2325109 - RNA, 21 nt, Human
ggagaggcuagaaccaagaag

SEQ ID NO: 2325110 - RNA, 22 nt, Human
ggagaggcccucuggaguggcc

SEQ ID NO: 2325111 - RNA, 15 nt, Human
ggagacaagaaaucc

SEQ ID NO: 2325112 - RNA, 18 nt, Human
ggagacaagaaaucccug

SEQ ID NO: 2325113 - RNA, 22 nt, Human
ggagaauuuagguuuuuauuag

SEQ ID NO: 2325114 - RNA, 16 nt, Human
ggagaauuuuacugug

SEQ ID NO: 2325115 - RNA, 20 nt, Human
ggagacacuggccccucaaa

SEQ ID NO: 2325116 - RNA, 17 nt, Human
ggagacacuggccccuc

SEQ ID NO: 2325117 - RNA, 21 nt, Human
ggagacacaacaacuccuagg

SEQ ID NO: 2325118 - RNA, 22 nt, Human
ggagaaugucaguauguggaag

SEQ ID NO: 2325119 - RNA, 19 nt, Human
ggagaaucaugugaacccg

SEQ ID NO: 2325120 - RNA, 17 nt, Human
ggagaagccauugucuu

SEQ ID NO: 2325121 - RNA, 17 nt, Human
ggagaaucaugugaacc

SEQ ID NO: 2325122 - RNA, 14 nt, Human
ggagaaucauguga

SEQ ID NO: 2325123 - RNA, 18 nt, Human
ggagaagcccgugugaga

SEQ ID NO: 2325124 - RNA, 20 nt, Human
ggagaggagugacugagcuu

SEQ ID NO: 2325125 - RNA, 13 nt, Human
ggagaggaugaga

SEQ ID NO: 2325126 - RNA, 20 nt, Human
ggagaggaugagagcccaga

SEQ ID NO: 2325127 - RNA, 16 nt, Human
ggagaggagagccaga

SEQ ID NO: 2325128 - RNA, 20 nt, Human
ggagaggagagccagagaag

SEQ ID NO: 2325129 - RNA, 13 nt, Human
ggagaggagagag

SEQ ID NO: 2325130 - RNA, 14 nt, Human
ggagaggagagagg

SEQ ID NO: 2325131 - RNA, 15 nt, Human
ggagaggagagaggc

SEQ ID NO: 2325132 - RNA, 18 nt, Human
ggagaggagagaggcaga

SEQ ID NO: 2325133 - RNA, 12 nt, Human
ggagaggagagc

SEQ ID NO: 2325134 - RNA, 13 nt, Human
ggagaggagagcc

SEQ ID NO: 2325135 - RNA, 14 nt, Human
ggagaggagagcca

SEQ ID NO: 2325136 - RNA, 15 nt, Human
ggagaggagagccag

SEQ ID NO: 2325137 - RNA, 12 nt, Human
ggagaggagaga

SEQ ID NO: 2325138 - RNA, 12 nt, Human
ggagaggaaaga

SEQ ID NO: 2325139 - RNA, 19 nt, Human
ggagacagccccagagcag

SEQ ID NO: 2325140 - RNA, 17 nt, Human
ggagacagccccagagc

SEQ ID NO: 2325141 - RNA, 17 nt, Human
ggagaggaaaaguaagg

SEQ ID NO: 2325142 - RNA, 14 nt, Human
ggagacagcaucag

SEQ ID NO: 2325143 - RNA, 17 nt, Human
ggagacagcaucagggu

SEQ ID NO: 2325144 - RNA, 18 nt, Human
ggagacagcaucaggguu

SEQ ID NO: 2325145 - RNA, 14 nt, Human
ggagacagccccag

SEQ ID NO: 2325146 - RNA, 15 nt, Human
ggagacagccccaga

SEQ ID NO: 2325147 - RNA, 18 nt, Human
ggagaagcggcuggcagc

SEQ ID NO: 2325148 - RNA, 17 nt, Human
ggagaagcggcuggcag

SEQ ID NO: 2325149 - RNA, 19 nt, Human
ggagaaucacuugaacccg

SEQ ID NO: 2325150 - RNA, 15 nt, Human
ggagaaucacuugaa

SEQ ID NO: 2325151 - RNA, 17 nt, Human
ggacugugugcucagga

SEQ ID NO: 2325152 - RNA, 12 nt, Human
ggagaagccagg

SEQ ID NO: 2325153 - RNA, 15 nt, Human
ggagaagccaggaau

SEQ ID NO: 2325154 - RNA, 13 nt, Human
ggagaagccagga

SEQ ID NO: 2325155 - RNA, 20 nt, Human
ggagaagccacaggccugag

SEQ ID NO: 2325156 - RNA, 11 nt, Human
ggagaagccau

SEQ ID NO: 2325157 - RNA, 12 nt, Human
ggagaagccauu

SEQ ID NO: 2325158 - RNA, 16 nt, Human
ggagaagccauugucu

SEQ ID NO: 2325159 - RNA, 22 nt, Human
ggacuggcuagaguccucacuc

SEQ ID NO: 2325160 - RNA, 20 nt, Human
ggacuggcuagaguccucac

SEQ ID NO: 2325161 - RNA, 19 nt, Human
ggacuggcuagaguccuca

SEQ ID NO: 2325162 - RNA, 16 nt, Human
ggacuggccccugggu

SEQ ID NO: 2325163 - RNA, 17 nt, Human
ggacuggccccuggguc

SEQ ID NO: 2325164 - RNA, 15 nt, Human
ggacuggaguggagc

SEQ ID NO: 2325165 - RNA, 18 nt, Human
ggacuggaaccagggaga

SEQ ID NO: 2325166 - RNA, 14 nt, Human
ggacuggccccugg

SEQ ID NO: 2325167 - RNA, 15 nt, Human
ggacuggccccuggg

SEQ ID NO: 2325168 - RNA, 18 nt, Human
ggacuggccucugcugau

SEQ ID NO: 2325169 - RNA, 22 nt, Human
ggacuggcgaguccagagagga

SEQ ID NO: 2325170 - RNA, 23 nt, Human
ggacuggcuagaguccucacucc

SEQ ID NO: 2325171 - RNA, 19 nt, Human
ggacugugacaggcagcag

SEQ ID NO: 2325172 - RNA, 20 nt, Human
ggacugugacaggcagcaga

SEQ ID NO: 2325173 - RNA, 21 nt, Human
ggacugugacaggcagcagag

SEQ ID NO: 2325174 - RNA, 15 nt, Human
ggacgcucucuggcc

SEQ ID NO: 2325175 - RNA, 20 nt, Human
ggacgccugggggugccagg

SEQ ID NO: 2325176 - RNA, 17 nt, Human
ggacgcucccugcucca

SEQ ID NO: 2325177 - RNA, 14 nt, Human
ggacuggaaccagg

SEQ ID NO: 2325178 - RNA, 15 nt, Human
ggacuggaaccaggg

SEQ ID NO: 2325179 - RNA, 17 nt, Human
ggacuggaaccagggag

SEQ ID NO: 2325180 - RNA, 22 nt, Human
ggacuggaaccagggagaccga

SEQ ID NO: 2325181 - RNA, 14 nt, Human
ggacgcucucuggc

SEQ ID NO: 2325182 - RNA, 13 nt, Human
ggacgcucucugg

SEQ ID NO: 2325183 - RNA, 17 nt, Human
ggaccaaggagaugaag

SEQ ID NO: 2325184 - RNA, 11 nt, Human
ggaccaaggca

SEQ ID NO: 2325185 - RNA, 15 nt, Human
ggaccaaggcaaggc

SEQ ID NO: 2325186 - RNA, 15 nt, Human
ggaccaaggaccccu

SEQ ID NO: 2325187 - RNA, 22 nt, Human
ggaccaacccuguuuccugagu

SEQ ID NO: 2325188 - RNA, 16 nt, Human
ggaccaagcaucuugg

SEQ ID NO: 2325189 - RNA, 17 nt, Human
ggaccaacccuguuucc

SEQ ID NO: 2325190 - RNA, 18 nt, Human
ggaccaacccuguuuccu

SEQ ID NO: 2325191 - RNA, 20 nt, Human
ggaccaacccuguuuccuga

SEQ ID NO: 2325192 - RNA, 14 nt, Human
ggacauuucucuaa

SEQ ID NO: 2325193 - RNA, 16 nt, Human
ggacauuugcucaugg

SEQ ID NO: 2325194 - RNA, 21 nt, Human
ggacagcagaagggggagacc

SEQ ID NO: 2325195 - RNA, 18 nt, Human
ggacauggccccugugag

SEQ ID NO: 2325196 - RNA, 17 nt, Human
ggacauuccaagacagu

SEQ ID NO: 2325197 - RNA, 17 nt, Human
ggacauguuuugauaaa

SEQ ID NO: 2325198 - RNA, 16 nt, Human
ggacauuccaagacag

SEQ ID NO: 2325199 - RNA, 16 nt, Human
ggacauguuuugauaa

SEQ ID NO: 2325200 - RNA, 21 nt, Human
ggacauguuuuuguuuucuuu

SEQ ID NO: 2325201 - RNA, 20 nt, Human
ggacauugcggacagccacg

SEQ ID NO: 2325202 - RNA, 19 nt, Human
ggacagauccagggacuga

SEQ ID NO: 2325203 - RNA, 23 nt, Human
ggacagauccagggacugaagcc

SEQ ID NO: 2325204 - RNA, 21 nt, Human
ggacagagguuaucuguccca

SEQ ID NO: 2325205 - RNA, 16 nt, Human
ggacagaguaugaaca

SEQ ID NO: 2325206 - RNA, 15 nt, Human
ggacagaucaauggc

SEQ ID NO: 2325207 - RNA, 18 nt, Human
ggacagaucaauggcgca

SEQ ID NO: 2325208 - RNA, 19 nt, Human
ggacagaucaauggcgcag

SEQ ID NO: 2325209 - RNA, 23 nt, Human
ggacagaucaauggcgcagugcc

SEQ ID NO: 2325210 - RNA, 22 nt, Human
ggacacucaaaagcugggcagg

SEQ ID NO: 2325211 - RNA, 17 nt, Human
ggacacucaaaagcugg

SEQ ID NO: 2325212 - RNA, 15 nt, Human
ggacagccacggcca

SEQ ID NO: 2325213 - RNA, 19 nt, Human
ggacagccacggccaggcc

SEQ ID NO: 2325214 - RNA, 20 nt, Human
ggacagccacggccaggcca

SEQ ID NO: 2325215 - RNA, 21 nt, Human
ggacagccacggccaggccag

SEQ ID NO: 2325216 - RNA, 13 nt, Human
ggaccuccugagc

SEQ ID NO: 2325217 - RNA, 14 nt, Human
ggaccuccccugag

SEQ ID NO: 2325218 - RNA, 17 nt, Human
ggaccuccccugaggcu

SEQ ID NO: 2325219 - RNA, 23 nt, Human
ggaccucaggugagaagcagagg

SEQ ID NO: 2325220 - RNA, 19 nt, Human
ggaccucaggugagaagca

SEQ ID NO: 2325221 - RNA, 19 nt, Human
ggaccagaagccaaagacu

SEQ ID NO: 2325222 - RNA, 22 nt, Human
ggaccacaaaaaugaaagcaug

SEQ ID NO: 2325223 - RNA, 23 nt, Human
ggaccaaggcaaggcaggugccu

SEQ ID NO: 2325224 - RNA, 13 nt, Human
ggaccacaccucc

SEQ ID NO: 2325225 - RNA, 17 nt, Human
ggaccaaggcaaggcag

SEQ ID NO: 2325226 - RNA, 19 nt, Human
ggaccaaggcaaggcaggu

SEQ ID NO: 2325227 - RNA, 20 nt, Human
ggaccaaggcaaggcaggug

SEQ ID NO: 2325228 - RNA, 22 nt, Human
ggaccaaggcaaggcaggugcc

SEQ ID NO: 2325229 - RNA, 21 nt, Human
ggaccacaccucccugaacca

SEQ ID NO: 2325230 - RNA, 20 nt, Human
ggaccacagcaaggcaccug

SEQ ID NO: 2325231 - RNA, 13 nt, Human
ggaccacauuuua

SEQ ID NO: 2325232 - RNA, 14 nt, Human
ggaccacauuuuau

SEQ ID NO: 2325233 - RNA, 13 nt, Human
ggaccagagcugc

SEQ ID NO: 2325234 - RNA, 21 nt, Human
ggaccacugcaugagcuuuua

SEQ ID NO: 2325235 - RNA, 14 nt, Human
ggaccuccugagcg

SEQ ID NO: 2325236 - RNA, 19 nt, Human
ggacgccugggggugccag

SEQ ID NO: 2325237 - RNA, 14 nt, Human
ggacgccugggggu

SEQ ID NO: 2325238 - RNA, 17 nt, Human
ggacgcuacccgggaag

SEQ ID NO: 2325239 - RNA, 19 nt, Human
ggacgcuacccgggaaggg

SEQ ID NO: 2325240 - RNA, 20 nt, Human
ggacgcuacccgggaagggg

SEQ ID NO: 2325241 - RNA, 15 nt, Human
ggaccuugaacuggg

SEQ ID NO: 2325242 - RNA, 17 nt, Human
ggaccuugaacugggua

SEQ ID NO: 2325243 - RNA, 20 nt, Human
ggaccuucgggcugugcccg

SEQ ID NO: 2325244 - RNA, 19 nt, Human
ggaccuucgggcugugccc

SEQ ID NO: 2325245 - RNA, 18 nt, Human
ggaccuucgggcugugcc

SEQ ID NO: 2325246 - RNA, 17 nt, Human
ggaccuucgggcugugc

SEQ ID NO: 2325247 - RNA, 17 nt, Human
ggaaggggacccccgcc

SEQ ID NO: 2325248 - RNA, 22 nt, Human
ggaaggggacccccgcccccug

SEQ ID NO: 2325249 - RNA, 17 nt, Human
ggaaggggccagaggcu

SEQ ID NO: 2325250 - RNA, 15 nt, Human
ggaaggggccagagg

SEQ ID NO: 2325251 - RNA, 18 nt, Human
ggaaggggcccgugggag

SEQ ID NO: 2325252 - RNA, 21 nt, Human
ggaaggggcccgugggaguca

SEQ ID NO: 2325253 - RNA, 16 nt, Human
ggaaggggguccaccc

SEQ ID NO: 2325254 - RNA, 11 nt, Human
ggaaggugggg

SEQ ID NO: 2325255 - RNA, 19 nt, Human
ggaaggucccuuguuucca

SEQ ID NO: 2325256 - RNA, 16 nt, Human
ggaagguggggacagg

SEQ ID NO: 2325257 - RNA, 19 nt, Human
ggaagguuuggugugugga

SEQ ID NO: 2325258 - RNA, 23 nt, Human
ggaaguaacaguaacgcagggga

SEQ ID NO: 2325259 - RNA, 18 nt, Human
ggaaggguuuguggcugg

SEQ ID NO: 2325260 - RNA, 13 nt, Human
ggaaggguggugg

SEQ ID NO: 2325261 - RNA, 18 nt, Human
ggaagguuuguauauugu

SEQ ID NO: 2325262 - RNA, 16 nt, Human
ggaaguaggaaguaaa

SEQ ID NO: 2325263 - RNA, 18 nt, Human
ggaaguacuggagaaaau

SEQ ID NO: 2325264 - RNA, 12 nt, Human
ggaaguacugga

SEQ ID NO: 2325265 - RNA, 16 nt, Human
ggaaguacuggagaaa

SEQ ID NO: 2325266 - RNA, 17 nt, Human
ggaagugacaaggcccc

SEQ ID NO: 2325267 - RNA, 17 nt, Human
ggaagucuaggagcugg

SEQ ID NO: 2325268 - RNA, 23 nt, Human
ggaagugaagagggagaagggau

SEQ ID NO: 2325269 - RNA, 14 nt, Human
ggaagucuaggagc

SEQ ID NO: 2325270 - RNA, 20 nt, Human
ggaagugaagacuggaagcu

SEQ ID NO: 2325271 - RNA, 23 nt, Human
ggaaguccccaggccccaggaag

SEQ ID NO: 2325272 - RNA, 21 nt, Human
ggaaguccccaggccccagga

SEQ ID NO: 2325273 - RNA, 13 nt, Human
ggaaguccucugg

SEQ ID NO: 2325274 - RNA, 14 nt, Human
ggaaguccucuggg

SEQ ID NO: 2325275 - RNA, 18 nt, Human
ggaaguccccaggcccca

SEQ ID NO: 2325276 - RNA, 18 nt, Human
ggaagucauccugccaac

SEQ ID NO: 2325277 - RNA, 17 nt, Human
ggaaguccaauguggca

SEQ ID NO: 2325278 - RNA, 16 nt, Human
ggaaguccaauguggc

SEQ ID NO: 2325279 - RNA, 15 nt, Human
ggaaguccaaugugg

SEQ ID NO: 2325280 - RNA, 13 nt, Human
ggaagucaaagca

SEQ ID NO: 2325281 - RNA, 21 nt, Human
ggaagugagggucagagagga

SEQ ID NO: 2325282 - RNA, 16 nt, Human
ggaagugaggaagcca

SEQ ID NO: 2325283 - RNA, 21 nt, Human
ggaagugacaaggccccagag

SEQ ID NO: 2325284 - RNA, 14 nt, Human
ggaagugaggaagc

SEQ ID NO: 2325285 - RNA, 22 nt, Human
ggaagugacaaggccccagaga

SEQ ID NO: 2325286 - RNA, 19 nt, Human
ggaagugacaaggccccag

SEQ ID NO: 2325287 - RNA, 18 nt, Human
ggaagugacaaggcccca

SEQ ID NO: 2325288 - RNA, 20 nt, Human
ggaagugacgguuuaauggg

SEQ ID NO: 2325289 - RNA, 17 nt, Human
ggaaguguaacagcuga

SEQ ID NO: 2325290 - RNA, 16 nt, Human
ggaaguguaacagcug

SEQ ID NO: 2325291 - RNA, 14 nt, Human
ggaaugauuaauua

SEQ ID NO: 2325292 - RNA, 18 nt, Human
ggaagugcuaauuuugaa

SEQ ID NO: 2325293 - RNA, 16 nt, Human
ggaaggggacccccgc

SEQ ID NO: 2325294 - RNA, 12 nt, Human
ggaagggccagu

SEQ ID NO: 2325295 - RNA, 21 nt, Human
ggaagggccagucugggcugc

SEQ ID NO: 2325296 - RNA, 21 nt, Human
ggaagggcaggaaggagagcc

SEQ ID NO: 2325297 - RNA, 17 nt, Human
ggaagggcauccuucug

SEQ ID NO: 2325298 - RNA, 11 nt, Human
ggaagggccag

SEQ ID NO: 2325299 - RNA, 23 nt, Human
ggaaggggagauaaggguaucug

SEQ ID NO: 2325300 - RNA, 15 nt, Human
ggaagggcaggaagg

SEQ ID NO: 2325301 - RNA, 12 nt, Human
ggaagggcagga

SEQ ID NO: 2325302 - RNA, 14 nt, Human
ggaagggcaaaacc

SEQ ID NO: 2325303 - RNA, 16 nt, Human
ggaagggacuaggagc

SEQ ID NO: 2325304 - RNA, 23 nt, Human
ggaagggaccaaggcaaggcagg

SEQ ID NO: 2325305 - RNA, 15 nt, Human
ggaagggaccaaggc

SEQ ID NO: 2325306 - RNA, 16 nt, Human
ggaagggaccaaggca

SEQ ID NO: 2325307 - RNA, 20 nt, Human
ggaagggaccaaggcaaggc

SEQ ID NO: 2325308 - RNA, 22 nt, Human
ggaagggaccaaggcaaggcag

SEQ ID NO: 2325309 - RNA, 17 nt, Human
ggaaggcuggcugggca

SEQ ID NO: 2325310 - RNA, 14 nt, Human
ggaaggcuggcugg

SEQ ID NO: 2325311 - RNA, 17 nt, Human
ggaaggcugagaggaga

SEQ ID NO: 2325312 - RNA, 23 nt, Human
ggaagggacaccaagccuuggcu

SEQ ID NO: 2325313 - RNA, 19 nt, Human
ggaaggcggggcuucaacc

SEQ ID NO: 2325314 - RNA, 21 nt, Human
ggaaggcucuucuccccagag

SEQ ID NO: 2325315 - RNA, 13 nt, Human
ggaacgcagauga

SEQ ID NO: 2325316 - RNA, 14 nt, Human
ggaacgacugggca

SEQ ID NO: 2325317 - RNA, 14 nt, Human
ggaacgagagggga

SEQ ID NO: 2325318 - RNA, 13 nt, Human
ggaaccugacccc

SEQ ID NO: 2325319 - RNA, 18 nt, Human
ggaaccugacguagcugc

SEQ ID NO: 2325320 - RNA, 12 nt, Human
ggaaccuccuuu

SEQ ID NO: 2325321 - RNA, 13 nt, Human
ggaaggauuguaa

SEQ ID NO: 2325322 - RNA, 16 nt, Human
ggaaggauuguaaaaa

SEQ ID NO: 2325323 - RNA, 23 nt, Human
ggaaggauuguaaaaaaaaaugc

SEQ ID NO: 2325324 - RNA, 16 nt, Human
ggaaggcaggaagaga

SEQ ID NO: 2325325 - RNA, 14 nt, Human
ggaaggcagggagg

SEQ ID NO: 2325326 - RNA, 19 nt, Human
ggaauuuguaaguuuaugu

SEQ ID NO: 2325327 - RNA, 22 nt, Human
ggacaaaaaugaacugaaguuu

SEQ ID NO: 2325328 - RNA, 15 nt, Human
ggacaaaacccaccu

SEQ ID NO: 2325329 - RNA, 19 nt, Human
ggaauuuucaucuaggauu

SEQ ID NO: 2325330 - RNA, 15 nt, Human
ggacaaacagcucag

SEQ ID NO: 2325331 - RNA, 18 nt, Human
ggacaaaacccaccuugu

SEQ ID NO: 2325332 - RNA, 23 nt, Human
ggacaaaucaagcuucaguuucc

SEQ ID NO: 2325333 - RNA, 21 nt, Human
ggaauuugcaagucauggcug

SEQ ID NO: 2325334 - RNA, 16 nt, Human
ggaauuuguaaccuca

SEQ ID NO: 2325335 - RNA, 17 nt, Human
ggaauuuguaaccucag

SEQ ID NO: 2325336 - RNA, 18 nt, Human
ggaauuuguaaccucagc

SEQ ID NO: 2325337 - RNA, 12 nt, Human
ggaauuuguaag

SEQ ID NO: 2325338 - RNA, 19 nt, Human
ggaauuucccaggacccug

SEQ ID NO: 2325339 - RNA, 18 nt, Human
ggaauuucccaggacccu

SEQ ID NO: 2325340 - RNA, 17 nt, Human
ggaauuucccaggaccc

SEQ ID NO: 2325341 - RNA, 16 nt, Human
ggaauuucccaggacc

SEQ ID NO: 2325342 - RNA, 15 nt, Human
ggaauuucccaggac

SEQ ID NO: 2325343 - RNA, 14 nt, Human
ggaauuucccagga

SEQ ID NO: 2325344 - RNA, 23 nt, Human
ggaauuucucccagucauuuaau

SEQ ID NO: 2325345 - RNA, 14 nt, Human
ggaauugugugaug

SEQ ID NO: 2325346 - RNA, 23 nt, Human
ggaauuggguggggggcuucaua

SEQ ID NO: 2325347 - RNA, 12 nt, Human
ggaauuguguuu

SEQ ID NO: 2325348 - RNA, 16 nt, Human
ggaauuggagcucgug

SEQ ID NO: 2325349 - RNA, 22 nt, Human
ggaauuggagcucgugggacag

SEQ ID NO: 2325350 - RNA, 20 nt, Human
ggaauucaucucucuuuaau

SEQ ID NO: 2325351 - RNA, 20 nt, Human
ggaauugacuucgacuguga

SEQ ID NO: 2325352 - RNA, 19 nt, Human
ggaauugauuugcauugaa

SEQ ID NO: 2325353 - RNA, 18 nt, Human
ggaauugauuugcauuga

SEQ ID NO: 2325354 - RNA, 17 nt, Human
ggaauugauuugcauug

SEQ ID NO: 2325355 - RNA, 15 nt, Human
ggaauugauuugcau

SEQ ID NO: 2325356 - RNA, 17 nt, Human
ggaauuauuuuaaaaga

SEQ ID NO: 2325357 - RNA, 16 nt, Human
ggaauuauuuuaaaag

SEQ ID NO: 2325358 - RNA, 20 nt, Human
ggaauuaaccuggugcugga

SEQ ID NO: 2325359 - RNA, 22 nt, Human
ggaauuaaguuaucuuuaaaau

SEQ ID NO: 2325360 - RNA, 19 nt, Human
ggaauuacauguaaaacau

SEQ ID NO: 2325361 - RNA, 15 nt, Human
ggaauuauuuuaaaa

SEQ ID NO: 2325362 - RNA, 14 nt, Human
ggaauuauuuuaaa

SEQ ID NO: 2325363 - RNA, 17 nt, Human
ggaauuaaccuggugcu

SEQ ID NO: 2325364 - RNA, 16 nt, Human
ggaauuaaccuggugc

SEQ ID NO: 2325365 - RNA, 14 nt, Human
ggaauuaaccuggu

SEQ ID NO: 2325366 - RNA, 16 nt, Human
ggaauguuaaagucag

SEQ ID NO: 2325367 - RNA, 19 nt, Human
ggaauguuugggcagaagg

SEQ ID NO: 2325368 - RNA, 21 nt, Human
ggaauguuugggcagaaggga

SEQ ID NO: 2325369 - RNA, 19 nt, Human
ggaauguuugccucugccu

SEQ ID NO: 2325370 - RNA, 15 nt, Human
ggaauggcacagccc

SEQ ID NO: 2325371 - RNA, 12 nt, Human
ggaaugggcugu

SEQ ID NO: 2325372 - RNA, 15 nt, Human
ggaauguguggccug

SEQ ID NO: 2325373 - RNA, 16 nt, Human
ggaaugggggccucuu

SEQ ID NO: 2325374 - RNA, 20 nt, Human
ggaauguaacugcugaaaac

SEQ ID NO: 2325375 - RNA, 21 nt, Human
ggaauggaaaaagcagaaggc

SEQ ID NO: 2325376 - RNA, 14 nt, Human
ggaaugcuguguua

SEQ ID NO: 2325377 - RNA, 16 nt, Human
ggaaugcuuccuagaa

SEQ ID NO: 2325378 - RNA, 18 nt, Human
ggaaugcuugaaaaaugu

SEQ ID NO: 2325379 - RNA, 23 nt, Human
ggaaugcucccccauccuccccu

SEQ ID NO: 2325380 - RNA, 23 nt, Human
ggaaugcugcccgcucugcagac

SEQ ID NO: 2325381 - RNA, 13 nt, Human
ggaaugcuccccc

SEQ ID NO: 2325382 - RNA, 23 nt, Human
ggaaugcggccgcauucccugag

SEQ ID NO: 2325383 - RNA, 22 nt, Human
ggaaugcggccgcauucccuga

SEQ ID NO: 2325384 - RNA, 16 nt, Human
ggaaugcggcaagaag

SEQ ID NO: 2325385 - RNA, 14 nt, Human
ggaaugcggcaaga

SEQ ID NO: 2325386 - RNA, 23 nt, Human
ggaaugccugagugccuggccaa

SEQ ID NO: 2325387 - RNA, 21 nt, Human
ggaaguguaacagcugagguc

SEQ ID NO: 2325388 - RNA, 19 nt, Human
ggaaguguaacagcugagg

SEQ ID NO: 2325389 - RNA, 14 nt, Human
ggaaugccugagug

SEQ ID NO: 2325390 - RNA, 18 nt, Human
ggaaugccugagugccug

SEQ ID NO: 2325391 - RNA, 19 nt, Human
ggaaugccugagugccugg

SEQ ID NO: 2325392 - RNA, 12 nt, Human
ggaaugcagugg

SEQ ID NO: 2325393 - RNA, 24 nt, Human
ggaaugauuaauuaaaacacaaca

SEQ ID NO: 2325394 - RNA, 16 nt, Human
ggcucacaccuguaau

SEQ ID NO: 2325395 - RNA, 18 nt, Human
ggcucacacaccuguagc

SEQ ID NO: 2325396 - RNA, 12 nt, Human
ggcucacacuga

SEQ ID NO: 2325397 - RNA, 22 nt, Human
ggcuccagagggcacucugcuu

SEQ ID NO: 2325398 - RNA, 19 nt, Human
ggcuccagaugcagggcag

SEQ ID NO: 2325399 - RNA, 18 nt, Human
ggcuccagaugcagggca

SEQ ID NO: 2325400 - RNA, 17 nt, Human
ggcuccagaugcagggc

SEQ ID NO: 2325401 - RNA, 16 nt, Human
ggcuccagaugcaggg

SEQ ID NO: 2325402 - RNA, 15 nt, Human
ggcucaaguccucuu

SEQ ID NO: 2325403 - RNA, 21 nt, Human
ggcucaaguccucuuuucuga

SEQ ID NO: 2325404 - RNA, 12 nt, Human
ggcuccagcugg

SEQ ID NO: 2325405 - RNA, 12 nt, Human
ggcuccaggagc

SEQ ID NO: 2325406 - RNA, 13 nt, Human
ggcuccaggagca

SEQ ID NO: 2325407 - RNA, 19 nt, Human
ggcuccaggagcagccaca

SEQ ID NO: 2325408 - RNA, 15 nt, Human
ggcuccaggcuccuu

SEQ ID NO: 2325409 - RNA, 18 nt, Human
ggcuccaggccagggggc

SEQ ID NO: 2325410 - RNA, 11 nt, Human
ggcuccaggcu

SEQ ID NO: 2325411 - RNA, 16 nt, Human
ggcuccaggccagggg

SEQ ID NO: 2325412 - RNA, 14 nt, Human
ggcuccaggccagg

SEQ ID NO: 2325413 - RNA, 16 nt, Human
ggcuccaggcuccuuu

SEQ ID NO: 2325414 - RNA, 22 nt, Human
ggcuccagucugcugcccucca

SEQ ID NO: 2325415 - RNA, 18 nt, Human
ggcuccagucugcugccc

SEQ ID NO: 2325416 - RNA, 15 nt, Human
ggcuccagucugcug

SEQ ID NO: 2325417 - RNA, 24 nt, Human
ggcuccagucugcugcccuccauc

SEQ ID NO: 2325418 - RNA, 17 nt, Human
ggcucccacaggcccuu

SEQ ID NO: 2325419 - RNA, 16 nt, Human
ggcucccacaggcagc

SEQ ID NO: 2325420 - RNA, 18 nt, Human
ggcucccacaggcccuuc

SEQ ID NO: 2325421 - RNA, 19 nt, Human
ggcucccacaggcccuucc

SEQ ID NO: 2325422 - RNA, 19 nt, Human
ggcuagaguccucacuccc

SEQ ID NO: 2325423 - RNA, 18 nt, Human
ggcuagaguccucacucc

SEQ ID NO: 2325424 - RNA, 14 nt, Human
ggcuagaguccuca

SEQ ID NO: 2325425 - RNA, 13 nt, Human
ggcuagaguccuc

SEQ ID NO: 2325426 - RNA, 22 nt, Human
ggcuagagguucaaagauauuu

SEQ ID NO: 2325427 - RNA, 17 nt, Human
ggcuagagguucaaaga

SEQ ID NO: 2325428 - RNA, 18 nt, Human
ggcggcucggaggaagcc

SEQ ID NO: 2325429 - RNA, 14 nt, Human
ggcggcugagagcc

SEQ ID NO: 2325430 - RNA, 18 nt, Human
ggcggcugagagccccag

SEQ ID NO: 2325431 - RNA, 22 nt, Human
ggcuaggaccccuccauguggg

SEQ ID NO: 2325432 - RNA, 20 nt, Human
ggcuagcuucugcuuuucug

SEQ ID NO: 2325433 - RNA, 14 nt, Human
ggcuagggggagcc

SEQ ID NO: 2325434 - RNA, 20 nt, Human
ggcuagaguccucacuccca

SEQ ID NO: 2325435 - RNA, 23 nt, Human
ggcggcugagagccccagcugac

SEQ ID NO: 2325436 - RNA, 20 nt, Human
ggcuagagugcaguggcaug

SEQ ID NO: 2325437 - RNA, 15 nt, Human
ggcuagaucaugaag

SEQ ID NO: 2325438 - RNA, 16 nt, Human
ggcuaggaccccucca

SEQ ID NO: 2325439 - RNA, 13 nt, Human
ggcuauucacaac

SEQ ID NO: 2325440 - RNA, 19 nt, Human
ggcuauguauggaauacag

SEQ ID NO: 2325441 - RNA, 23 nt, Human
ggcucaagcagucuacccaccuc

SEQ ID NO: 2325442 - RNA, 19 nt, Human
ggcucaagcgauucuccug

SEQ ID NO: 2325443 - RNA, 14 nt, Human
ggcucaagcagucu

SEQ ID NO: 2325444 - RNA, 19 nt, Human
ggcuaugggggcacugagg

SEQ ID NO: 2325445 - RNA, 21 nt, Human
ggcuauggggauagaugugug

SEQ ID NO: 2325446 - RNA, 15 nt, Human
ggcuaugcauuugaa

SEQ ID NO: 2325447 - RNA, 20 nt, Human
ggcuauagcuacaggaagca

SEQ ID NO: 2325448 - RNA, 19 nt, Human
ggcuauagcuacaggaagc

SEQ ID NO: 2325449 - RNA, 22 nt, Human
ggcuagcuucugcuuuucugcc

SEQ ID NO: 2325450 - RNA, 16 nt, Human
ggcuaguugggcuucc

SEQ ID NO: 2325451 - RNA, 15 nt, Human
ggcuaguugggcuuc

SEQ ID NO: 2325452 - RNA, 23 nt, Human
ggcuagugugguguuuccuggca

SEQ ID NO: 2325453 - RNA, 23 nt, Human
ggccugaagaguccucugaauga

SEQ ID NO: 2325454 - RNA, 22 nt, Human
ggccugaaugcuuauagguggc

SEQ ID NO: 2325455 - RNA, 23 nt, Human
ggccuggcgggaugggccaccgc

SEQ ID NO: 2325456 - RNA, 19 nt, Human
ggccuggccugagcuggga

SEQ ID NO: 2325457 - RNA, 12 nt, Human
ggccuggcuccu

SEQ ID NO: 2325458 - RNA, 15 nt, Human
ggccuggcuucuccu

SEQ ID NO: 2325459 - RNA, 19 nt, Human
ggccugaagaguccucuga

SEQ ID NO: 2325460 - RNA, 13 nt, Human
ggccugaagaguc

SEQ ID NO: 2325461 - RNA, 22 nt, Human
ggccugaaaggagcccuuaucu

SEQ ID NO: 2325462 - RNA, 16 nt, Human
ggccugaaaggagccc

SEQ ID NO: 2325463 - RNA, 23 nt, Human
ggccugaaagaggcugaggccug

SEQ ID NO: 2325464 - RNA, 19 nt, Human
ggccucuugggucccccac

SEQ ID NO: 2325465 - RNA, 13 nt, Human
ggccucuuggcag

SEQ ID NO: 2325466 - RNA, 17 nt, Human
ggccucuuggaccucug

SEQ ID NO: 2325467 - RNA, 22 nt, Human
ggccucuuggaccucugcucug

SEQ ID NO: 2325468 - RNA, 23 nt, Human
ggccucuuugucuaaaacaauaa

SEQ ID NO: 2325469 - RNA, 17 nt, Human
ggccugaaagaggcuga

SEQ ID NO: 2325470 - RNA, 13 nt, Human
ggccucuugagca

SEQ ID NO: 2325471 - RNA, 16 nt, Human
ggccucuugagcagug

SEQ ID NO: 2325472 - RNA, 18 nt, Human
ggccucuugagcaguggc

SEQ ID NO: 2325473 - RNA, 22 nt, Human
ggccucuugagcaguggcuggu

SEQ ID NO: 2325474 - RNA, 14 nt, Human
ggccuguccuccaa

SEQ ID NO: 2325475 - RNA, 18 nt, Human
ggccugggggcagggaga

SEQ ID NO: 2325476 - RNA, 14 nt, Human
ggccuggggcuccu

SEQ ID NO: 2325477 - RNA, 16 nt, Human
ggccuggggcuccuuu

SEQ ID NO: 2325478 - RNA, 18 nt, Human
ggccuggggcuccuuucu

SEQ ID NO: 2325479 - RNA, 23 nt, Human
ggccuggggcuccuuucuccagc

SEQ ID NO: 2325480 - RNA, 20 nt, Human
ggccugucucauccccaggg

SEQ ID NO: 2325481 - RNA, 19 nt, Human
ggccugucucauccccagg

SEQ ID NO: 2325482 - RNA, 18 nt, Human
ggccugucucauccccag

SEQ ID NO: 2325483 - RNA, 17 nt, Human
ggccugucucaucccca

SEQ ID NO: 2325484 - RNA, 11 nt, Human
ggccugugagc

SEQ ID NO: 2325485 - RNA, 14 nt, Human
ggccugggggcugg

SEQ ID NO: 2325486 - RNA, 20 nt, Human
ggccugggggcugggcagag

SEQ ID NO: 2325487 - RNA, 22 nt, Human
ggccugggggcugggcagagga

SEQ ID NO: 2325488 - RNA, 20 nt, Human
ggcgccgcaaaccacacugg

SEQ ID NO: 2325489 - RNA, 22 nt, Human
ggcgccgcaaaccacacuggac

SEQ ID NO: 2325490 - RNA, 20 nt, Human
ggcgccgucuccaggggcug

SEQ ID NO: 2325491 - RNA, 23 nt, Human
ggccugucucauccccagggguc

SEQ ID NO: 2325492 - RNA, 22 nt, Human
ggcgcgcaccuguaaucccagc

SEQ ID NO: 2325493 - RNA, 20 nt, Human
ggcgccuguagucccagcca

SEQ ID NO: 2325494 - RNA, 14 nt, Human
ggcgcggccagccc

SEQ ID NO: 2325495 - RNA, 21 nt, Human
ggcgccgucuccaggggcugc

SEQ ID NO: 2325496 - RNA, 13 nt, Human
ggcgccucugcaa

SEQ ID NO: 2325497 - RNA, 19 nt, Human
ggcgccggcgggcgggccg

SEQ ID NO: 2325498 - RNA, 18 nt, Human
ggcgccuguagucccagc

SEQ ID NO: 2325499 - RNA, 18 nt, Human
ggcgcugccccuggcagc

SEQ ID NO: 2325500 - RNA, 19 nt, Human
ggcgcugccccuggcagcc

SEQ ID NO: 2325501 - RNA, 21 nt, Human
ggcgcugccccuggcagcccc

SEQ ID NO: 2325502 - RNA, 23 nt, Human
ggcgcugccccuggcagccccug

SEQ ID NO: 2325503 - RNA, 13 nt, Human
ggcggagcuggcc

SEQ ID NO: 2325504 - RNA, 20 nt, Human
ggcggagaguacagugagcc

SEQ ID NO: 2325505 - RNA, 21 nt, Human
ggcggagaguacagugagcca

SEQ ID NO: 2325506 - RNA, 14 nt, Human
ggcggagcuggccc

SEQ ID NO: 2325507 - RNA, 15 nt, Human
ggcggagcuggcccc

SEQ ID NO: 2325508 - RNA, 20 nt, Human
ggcggacaccuggcccccga

SEQ ID NO: 2325509 - RNA, 19 nt, Human
ggcgcuggcccagccggcc

SEQ ID NO: 2325510 - RNA, 15 nt, Human
ggcggacguuccagc

SEQ ID NO: 2325511 - RNA, 16 nt, Human
ggcggacguuccagcc

SEQ ID NO: 2325512 - RNA, 17 nt, Human
ggcggacguuccagccg

SEQ ID NO: 2325513 - RNA, 19 nt, Human
ggcggagaguacagugagc

SEQ ID NO: 2325514 - RNA, 16 nt, Human
ggcgcggccagccccg

SEQ ID NO: 2325515 - RNA, 11 nt, Human
ggcgcuggccc

SEQ ID NO: 2325516 - RNA, 12 nt, Human
ggcgcuggccca

SEQ ID NO: 2325517 - RNA, 13 nt, Human
ggcgcuggcccag

SEQ ID NO: 2325518 - RNA, 14 nt, Human
ggcgcuggcccagc

SEQ ID NO: 2325519 - RNA, 15 nt, Human
ggcgcuggcccagcc

SEQ ID NO: 2325520 - RNA, 16 nt, Human
ggcgcuggcccagccg

SEQ ID NO: 2325521 - RNA, 18 nt, Human
ggcgcuggcccagccggc

SEQ ID NO: 2325522 - RNA, 20 nt, Human
ggcgcuggcccagccggccu

SEQ ID NO: 2325523 - RNA, 17 nt, Human
ggcggagcuggccccgc

SEQ ID NO: 2325524 - RNA, 20 nt, Human
ggcggagcuggccccgccgc

SEQ ID NO: 2325525 - RNA, 23 nt, Human
ggcggagcuggccccgccgccug

SEQ ID NO: 2325526 - RNA, 20 nt, Human
ggcggagcuugcagugagcc

SEQ ID NO: 2325527 - RNA, 21 nt, Human
ggcggagcuugcagugagccg

SEQ ID NO: 2325528 - RNA, 20 nt, Human
ggcggauguugaagugagcu

SEQ ID NO: 2325529 - RNA, 14 nt, Human
ggcggcacagccuu

SEQ ID NO: 2325530 - RNA, 15 nt, Human
ggcggcacagccuuc

SEQ ID NO: 2325531 - RNA, 12 nt, Human
ggcggcagcagc

SEQ ID NO: 2325532 - RNA, 23 nt, Human
ggcggcuacucagcagcccuccu

SEQ ID NO: 2325533 - RNA, 22 nt, Human
ggcggcuacucagcagcccucc

SEQ ID NO: 2325534 - RNA, 21 nt, Human
ggcggcuacucagcagcccuc

SEQ ID NO: 2325535 - RNA, 20 nt, Human
ggcggcuacucagcagcccu

SEQ ID NO: 2325536 - RNA, 11 nt, Human
ggcggcgccgg

SEQ ID NO: 2325537 - RNA, 17 nt, Human
ggcggccccucccgccc

SEQ ID NO: 2325538 - RNA, 17 nt, Human
ggcggcaggggccugga

SEQ ID NO: 2325539 - RNA, 14 nt, Human
ggcggcagcagcca

SEQ ID NO: 2325540 - RNA, 16 nt, Human
ggcggcagcagccauc

SEQ ID NO: 2325541 - RNA, 18 nt, Human
ggcggcaggggccuggag

SEQ ID NO: 2325542 - RNA, 17 nt, Human
ggcggccaugauggugc

SEQ ID NO: 2325543 - RNA, 18 nt, Human
ggcggcccaagcccgacu

SEQ ID NO: 2325544 - RNA, 14 nt, Human
ggccucuguguccu

SEQ ID NO: 2325545 - RNA, 20 nt, Human
ggccucuguguccuucccug

SEQ ID NO: 2325546 - RNA, 18 nt, Human
ggccucuucaaauuagaa

SEQ ID NO: 2325547 - RNA, 19 nt, Human
ggccucuuccgugacguca

SEQ ID NO: 2325548 - RNA, 18 nt, Human
ggccucuuaugggcuggg

SEQ ID NO: 2325549 - RNA, 21 nt, Human
ggccucugcaaaggaaauacc

SEQ ID NO: 2325550 - RNA, 16 nt, Human
ggccucugugccuucu

SEQ ID NO: 2325551 - RNA, 17 nt, Human
ggccucuuaugggcugg

SEQ ID NO: 2325552 - RNA, 13 nt, Human
ggccucugcacuc

SEQ ID NO: 2325553 - RNA, 14 nt, Human
ggccucugcacucc

SEQ ID NO: 2325554 - RNA, 15 nt, Human
ggccucugcacuccc

SEQ ID NO: 2325555 - RNA, 16 nt, Human
ggccucugcacucccc

SEQ ID NO: 2325556 - RNA, 15 nt, Human
ggccuagucccuucc

SEQ ID NO: 2325557 - RNA, 20 nt, Human
ggccuaggccucagccagag

SEQ ID NO: 2325558 - RNA, 20 nt, Human
ggccuauaaugaagcuuuau

SEQ ID NO: 2325559 - RNA, 15 nt, Human
ggccuaucagugugc

SEQ ID NO: 2325560 - RNA, 16 nt, Human
ggccuaucagugugcc

SEQ ID NO: 2325561 - RNA, 20 nt, Human
ggccuaugcacauauggacu

SEQ ID NO: 2325562 - RNA, 16 nt, Human
ggccuaucuaaacugg

SEQ ID NO: 2325563 - RNA, 17 nt, Human
ggccuaucagugugccc

SEQ ID NO: 2325564 - RNA, 18 nt, Human
ggccuaucagugugcccc

SEQ ID NO: 2325565 - RNA, 20 nt, Human
ggccuaucagugugcccccc

SEQ ID NO: 2325566 - RNA, 23 nt, Human
ggccuaucagugugccccccauc

SEQ ID NO: 2325567 - RNA, 21 nt, Human
ggccuaugcacauauggacuc

SEQ ID NO: 2325568 - RNA, 19 nt, Human
ggccuauuauauuaaaaua

SEQ ID NO: 2325569 - RNA, 18 nt, Human
ggccucaaaggcccgcuc

SEQ ID NO: 2325570 - RNA, 19 nt, Human
ggccucaaaggcccgcucu

SEQ ID NO: 2325571 - RNA, 22 nt, Human
ggccucggagccucauccgagg

SEQ ID NO: 2325572 - RNA, 19 nt, Human
ggccucggagccucauccg

SEQ ID NO: 2325573 - RNA, 16 nt, Human
ggccucgggacaccug

SEQ ID NO: 2325574 - RNA, 22 nt, Human
ggccucgggacaccugcccugc

SEQ ID NO: 2325575 - RNA, 23 nt, Human
ggccucgggacaccugcccugcc

SEQ ID NO: 2325576 - RNA, 16 nt, Human
ggccucgggaccucag

SEQ ID NO: 2325577 - RNA, 15 nt, Human
ggccucggagccuca

SEQ ID NO: 2325578 - RNA, 13 nt, Human
ggccucggagccu

SEQ ID NO: 2325579 - RNA, 22 nt, Human
ggccucggacuuagcugggaga

SEQ ID NO: 2325580 - RNA, 18 nt, Human
ggccucaacccucccuca

SEQ ID NO: 2325581 - RNA, 17 nt, Human
ggccucaacccucccuc

SEQ ID NO: 2325582 - RNA, 16 nt, Human
ggccucaacccucccu

SEQ ID NO: 2325583 - RNA, 22 nt, Human
ggccucaaaguuggggcaggcu

SEQ ID NO: 2325584 - RNA, 15 nt, Human
ggccucaacccuccc

SEQ ID NO: 2325585 - RNA, 20 nt, Human
ggccucaaaggcccgcucua

SEQ ID NO: 2325586 - RNA, 19 nt, Human
ggccucaacccucccucag

SEQ ID NO: 2325587 - RNA, 17 nt, Human
ggccucggacuuagcug

SEQ ID NO: 2325588 - RNA, 20 nt, Human
ggccucggacuuagcuggga

SEQ ID NO: 2325589 - RNA, 17 nt, Human
ggcccugguccuuccag

SEQ ID NO: 2325590 - RNA, 15 nt, Human
ggcccugguccuucc

SEQ ID NO: 2325591 - RNA, 19 nt, Human
ggcccugguguuucuagca

SEQ ID NO: 2325592 - RNA, 15 nt, Human
ggcccugucccuccc

SEQ ID NO: 2325593 - RNA, 12 nt, Human
ggcccugguccu

SEQ ID NO: 2325594 - RNA, 15 nt, Human
ggcccugggguccca

SEQ ID NO: 2325595 - RNA, 11 nt, Human
ggcccuggggc

SEQ ID NO: 2325596 - RNA, 21 nt, Human
ggcccugggcucggaggcugc

SEQ ID NO: 2325597 - RNA, 14 nt, Human
ggcccugggcugga

SEQ ID NO: 2325598 - RNA, 15 nt, Human
ggcccugggcuggaa

SEQ ID NO: 2325599 - RNA, 16 nt, Human
ggcccugggcucggag

SEQ ID NO: 2325600 - RNA, 18 nt, Human
ggcccugggcucggaggc

SEQ ID NO: 2325601 - RNA, 12 nt, Human
ggcccugggcug

SEQ ID NO: 2325602 - RNA, 13 nt, Human
ggcccugggcugg

SEQ ID NO: 2325603 - RNA, 15 nt, Human
ggccggugugggcug

SEQ ID NO: 2325604 - RNA, 23 nt, Human
ggccggucugcaagucagaggau

SEQ ID NO: 2325605 - RNA, 23 nt, Human
ggccgguuucgaaguugaugcaa

SEQ ID NO: 2325606 - RNA, 22 nt, Human
ggccguaccccacccucagcac

SEQ ID NO: 2325607 - RNA, 14 nt, Human
ggccguaccccacc

SEQ ID NO: 2325608 - RNA, 17 nt, Human
ggccguaccccacccuc

SEQ ID NO: 2325609 - RNA, 19 nt, Human
ggccgucaggacccaccau

SEQ ID NO: 2325610 - RNA, 12 nt, Human
ggccgucaggac

SEQ ID NO: 2325611 - RNA, 19 nt, Human
ggccgucacuugugggggu

SEQ ID NO: 2325612 - RNA, 12 nt, Human
ggcccugugccu

SEQ ID NO: 2325613 - RNA, 16 nt, Human
ggcccugucccuccca

SEQ ID NO: 2325614 - RNA, 17 nt, Human
ggcccugucccucccac

SEQ ID NO: 2325615 - RNA, 18 nt, Human
ggcccugucccucccacc

SEQ ID NO: 2325616 - RNA, 20 nt, Human
ggcccugucccucccaccuc

SEQ ID NO: 2325617 - RNA, 21 nt, Human
ggcccugucccucccaccucu

SEQ ID NO: 2325618 - RNA, 22 nt, Human
ggcccugucccucccaccucug

SEQ ID NO: 2325619 - RNA, 23 nt, Human
ggcccugucccucccaccucugu

SEQ ID NO: 2325620 - RNA, 13 nt, Human
ggccggggcugag

SEQ ID NO: 2325621 - RNA, 17 nt, Human
ggccggucugcaaguca

SEQ ID NO: 2325622 - RNA, 18 nt, Human
ggccggucugcaagucag

SEQ ID NO: 2325623 - RNA, 20 nt, Human
ggccggucugcaagucagag

SEQ ID NO: 2325624 - RNA, 21 nt, Human
ggccggucugcaagucagagg

SEQ ID NO: 2325625 - RNA, 20 nt, Human
ggccgucuucacucgccccc

SEQ ID NO: 2325626 - RNA, 22 nt, Human
ggccguccucccgggcccuccc

SEQ ID NO: 2325627 - RNA, 20 nt, Human
ggccguccucccgggcccuc

SEQ ID NO: 2325628 - RNA, 21 nt, Human
ggccguccucccgggcccucc

SEQ ID NO: 2325629 - RNA, 13 nt, Human
ggccguccucccg

SEQ ID NO: 2325630 - RNA, 14 nt, Human
ggccguccucccgg

SEQ ID NO: 2325631 - RNA, 15 nt, Human
ggccguccucccggg

SEQ ID NO: 2325632 - RNA, 18 nt, Human
ggccguccucccgggccc

SEQ ID NO: 2325633 - RNA, 13 nt, Human
ggccgugcccagg

SEQ ID NO: 2325634 - RNA, 17 nt, Human
ggccuacaugcuuugug

SEQ ID NO: 2325635 - RNA, 23 nt, Human
ggccuacagcuuugaucccugac

SEQ ID NO: 2325636 - RNA, 20 nt, Human
ggccuacagcuuugaucccu

SEQ ID NO: 2325637 - RNA, 19 nt, Human
ggccuaagaguugagcucu

SEQ ID NO: 2325638 - RNA, 23 nt, Human
ggccuacaugcuuugugaacaag

SEQ ID NO: 2325639 - RNA, 18 nt, Human
ggccuacaugcuuuguga

SEQ ID NO: 2325640 - RNA, 16 nt, Human
ggccuaccccgcagac

SEQ ID NO: 2325641 - RNA, 20 nt, Human
ggccuaccccgcagacaccu

SEQ ID NO: 2325642 - RNA, 23 nt, Human
ggccuagcauacguacacauuuu

SEQ ID NO: 2325643 - RNA, 23 nt, Human
ggccuaccccgcagacaccuugg

SEQ ID NO: 2325644 - RNA, 24 nt, Human
ggccuacuagagucugaacagcug

SEQ ID NO: 2325645 - RNA, 14 nt, Human
ggccuaggccucag

SEQ ID NO: 2325646 - RNA, 21 nt, Human
ggccuagcugcuacaaagaag

SEQ ID NO: 2325647 - RNA, 16 nt, Human
ggccuagcugcuacaa

SEQ ID NO: 2325648 - RNA, 19 nt, Human
ggccuagcugcuacaaaga

SEQ ID NO: 2325649 - RNA, 20 nt, Human
ggccuagcugcuacaaagaa

SEQ ID NO: 2325650 - RNA, 22 nt, Human
ggcccuggccugcugggcucuc

SEQ ID NO: 2325651 - RNA, 22 nt, Human
ggcccuggcucccacaggcccu

SEQ ID NO: 2325652 - RNA, 17 nt, Human
ggcccuggccugcuggg

SEQ ID NO: 2325653 - RNA, 16 nt, Human
ggcccuggccugcugg

SEQ ID NO: 2325654 - RNA, 15 nt, Human
ggcccuggccugcug

SEQ ID NO: 2325655 - RNA, 14 nt, Human
ggcccuggccugcu

SEQ ID NO: 2325656 - RNA, 13 nt, Human
ggcccuggcuccc

SEQ ID NO: 2325657 - RNA, 12 nt, Human
ggcccuggccug

SEQ ID NO: 2325658 - RNA, 17 nt, Human
ggcccuggccuccccug

SEQ ID NO: 2325659 - RNA, 13 nt, Human
ggcccuggccucc

SEQ ID NO: 2325660 - RNA, 14 nt, Human
ggcccuggccuccc

SEQ ID NO: 2325661 - RNA, 10 nt, Human
ggcccugccu

SEQ ID NO: 2325662 - RNA, 13 nt, Human
ggcccugccucug

SEQ ID NO: 2325663 - RNA, 22 nt, Human
ggcccugcccugguuuccugcc

SEQ ID NO: 2325664 - RNA, 14 nt, Human
ggcccugccuucuu

SEQ ID NO: 2325665 - RNA, 14 nt, Human
ggcccugccuccuu

SEQ ID NO: 2325666 - RNA, 15 nt, Human
ggcccugccuccuuu

SEQ ID NO: 2325667 - RNA, 21 nt, Human
ggcccugagcucgguggaccc

SEQ ID NO: 2325668 - RNA, 13 nt, Human
ggcccugagcuga

SEQ ID NO: 2325669 - RNA, 19 nt, Human
ggcccugagcucgguggac

SEQ ID NO: 2325670 - RNA, 14 nt, Human
ggcccugagcucgg

SEQ ID NO: 2325671 - RNA, 14 nt, Human
ggcccugagcugag

SEQ ID NO: 2325672 - RNA, 15 nt, Human
ggcccugaggugugg

SEQ ID NO: 2325673 - RNA, 16 nt, Human
ggcccugagguguggg

SEQ ID NO: 2325674 - RNA, 17 nt, Human
ggcccugaggugugggg

SEQ ID NO: 2325675 - RNA, 18 nt, Human
ggcccugagguguggggg

SEQ ID NO: 2325676 - RNA, 19 nt, Human
ggcccugaggugugggggc

SEQ ID NO: 2325677 - RNA, 22 nt, Human
ggcccugaggugugggggcugc

SEQ ID NO: 2325678 - RNA, 22 nt, Human
ggcccugcaaaaggacucucag

SEQ ID NO: 2325679 - RNA, 19 nt, Human
ggcccugcaaaaggacucu

SEQ ID NO: 2325680 - RNA, 21 nt, Human
ggcccugaggugugggggcug

SEQ ID NO: 2325681 - RNA, 18 nt, Human
ggcccugcaccugugcag

SEQ ID NO: 2325682 - RNA, 14 nt, Human
ggcccugcacuguc

SEQ ID NO: 2325683 - RNA, 15 nt, Human
ggcccugcacugucc

SEQ ID NO: 2325684 - RNA, 16 nt, Human
ggcccugcacuguccu

SEQ ID NO: 2325685 - RNA, 17 nt, Human
ggcccugcacuguccug

SEQ ID NO: 2325686 - RNA, 18 nt, Human
ggcccugcacuguccugc

SEQ ID NO: 2325687 - RNA, 19 nt, Human
ggcccugcacuguccugcu

SEQ ID NO: 2325688 - RNA, 20 nt, Human
ggcccugcacuguccugcuc

SEQ ID NO: 2325689 - RNA, 21 nt, Human
ggcccugcacuguccugcucc

SEQ ID NO: 2325690 - RNA, 23 nt, Human
ggcccugcacuguccugcuccac

SEQ ID NO: 2325691 - RNA, 12 nt, Human
ggcccugcccug

SEQ ID NO: 2325692 - RNA, 20 nt, Human
ggcccugccaucuucccagc

SEQ ID NO: 2325693 - RNA, 18 nt, Human
ggcccugccaucuuccca

SEQ ID NO: 2325694 - RNA, 22 nt, Human
ggcccugcacuguccugcucca

SEQ ID NO: 2325695 - RNA, 11 nt, Human
ggcccugcccu

SEQ ID NO: 2325696 - RNA, 20 nt, Human
ggcccugcccugguuuccug

SEQ ID NO: 2325697 - RNA, 13 nt, Human
ggcccugcccugg

SEQ ID NO: 2325698 - RNA, 13 nt, Human
ggcccugccuccu

SEQ ID NO: 2325699 - RNA, 19 nt, Human
ggcccugacauuggagccu

SEQ ID NO: 2325700 - RNA, 19 nt, Human
ggcccucuggaguggccac

SEQ ID NO: 2325701 - RNA, 18 nt, Human
ggcccucuggaguggcca

SEQ ID NO: 2325702 - RNA, 14 nt, Human
ggcccucuggagug

SEQ ID NO: 2325703 - RNA, 21 nt, Human
ggcccucucugcucugcgugu

SEQ ID NO: 2325704 - RNA, 21 nt, Human
ggcccucugcccacucccugc

SEQ ID NO: 2325705 - RNA, 19 nt, Human
ggcccucugcccacucccu

SEQ ID NO: 2325706 - RNA, 20 nt, Human
ggcccucugcccacucccug

SEQ ID NO: 2325707 - RNA, 13 nt, Human
ggcccucugccca

SEQ ID NO: 2325708 - RNA, 15 nt, Human
ggcccucugcccacu

SEQ ID NO: 2325709 - RNA, 16 nt, Human
ggcccucugcccacuc

SEQ ID NO: 2325710 - RNA, 17 nt, Human
ggcccucugcccacucc

SEQ ID NO: 2325711 - RNA, 11 nt, Human
ggcccagagag

SEQ ID NO: 2325712 - RNA, 15 nt, Human
ggcccagagaagcca

SEQ ID NO: 2325713 - RNA, 12 nt, Human
ggcccagagagg

SEQ ID NO: 2325714 - RNA, 15 nt, Human
ggcccucucugcucu

SEQ ID NO: 2325715 - RNA, 14 nt, Human
ggcccucucugcuc

SEQ ID NO: 2325716 - RNA, 22 nt, Human
ggcccacgccuguaaucccagc

SEQ ID NO: 2325717 - RNA, 22 nt, Human
ggcccacguagggcggcacuca

SEQ ID NO: 2325718 - RNA, 18 nt, Human
ggcccaccuggccaccug

SEQ ID NO: 2325719 - RNA, 19 nt, Human
ggcccaccuggccaccuga

SEQ ID NO: 2325720 - RNA, 22 nt, Human
ggcccaccuggccaccugaggu

SEQ ID NO: 2325721 - RNA, 21 nt, Human
ggcccaccuuccccagaacca

SEQ ID NO: 2325722 - RNA, 22 nt, Human
ggcccaagucccuguuuucuga

SEQ ID NO: 2325723 - RNA, 17 nt, Human
ggcccaccuggccaccu

SEQ ID NO: 2325724 - RNA, 17 nt, Human
ggcccaaggcggccccu

SEQ ID NO: 2325725 - RNA, 21 nt, Human
ggcccaaggcggccccucccg

SEQ ID NO: 2325726 - RNA, 14 nt, Human
ggcccaagucccug

SEQ ID NO: 2325727 - RNA, 15 nt, Human
ggcccaagucccugu

SEQ ID NO: 2325728 - RNA, 21 nt, Human
ggcccaaaggccuuggacaac

SEQ ID NO: 2325729 - RNA, 23 nt, Human
ggcccaacacaauucuucuucca

SEQ ID NO: 2325730 - RNA, 19 nt, Human
ggcccaagagaugaagagu

SEQ ID NO: 2325731 - RNA, 17 nt, Human
ggcccaacccugucugu

SEQ ID NO: 2325732 - RNA, 13 nt, Human
ggcccaacccugu

SEQ ID NO: 2325733 - RNA, 16 nt, Human
ggcccaacccugucug

SEQ ID NO: 2325734 - RNA, 13 nt, Human
ggcccaaggcggc

SEQ ID NO: 2325735 - RNA, 14 nt, Human
ggcccaaggcggcc

SEQ ID NO: 2325736 - RNA, 13 nt, Human
ggcauuccugcuu

SEQ ID NO: 2325737 - RNA, 21 nt, Human
ggcaugggaaagccaccucuc

SEQ ID NO: 2325738 - RNA, 16 nt, Human
ggcauuccccaggagg

SEQ ID NO: 2325739 - RNA, 19 nt, Human
ggccacaugggaggcucac

SEQ ID NO: 2325740 - RNA, 16 nt, Human
ggccacaugaguccca

SEQ ID NO: 2325741 - RNA, 16 nt, Human
ggccacauggggcugg

SEQ ID NO: 2325742 - RNA, 18 nt, Human
ggccacaugggaggcuca

SEQ ID NO: 2325743 - RNA, 20 nt, Human
ggccacaugagucccagugg

SEQ ID NO: 2325744 - RNA, 18 nt, Human
ggcauuccccaggaggcc

SEQ ID NO: 2325745 - RNA, 19 nt, Human
ggcauuccccaggaggcca

SEQ ID NO: 2325746 - RNA, 22 nt, Human
ggcaugggaaugaaugucagug

SEQ ID NO: 2325747 - RNA, 17 nt, Human
ggcauuccccaggaggc

SEQ ID NO: 2325748 - RNA, 18 nt, Human
ggcaugggaaugaauguc

SEQ ID NO: 2325749 - RNA, 14 nt, Human
ggcauggcugggaa

SEQ ID NO: 2325750 - RNA, 15 nt, Human
ggccacucugccucu

SEQ ID NO: 2325751 - RNA, 13 nt, Human
ggccacuccucca

SEQ ID NO: 2325752 - RNA, 13 nt, Human
ggccagccuggau

SEQ ID NO: 2325753 - RNA, 17 nt, Human
ggccacgugccaggccc

SEQ ID NO: 2325754 - RNA, 16 nt, Human
ggccacgugccaggcc

SEQ ID NO: 2325755 - RNA, 23 nt, Human
ggccacgugggcaaacaggcagu

SEQ ID NO: 2325756 - RNA, 18 nt, Human
ggccacgugccaggcccg

SEQ ID NO: 2325757 - RNA, 11 nt, Human
ggccacuaagc

SEQ ID NO: 2325758 - RNA, 21 nt, Human
ggccacuaagcagaggagggg

SEQ ID NO: 2325759 - RNA, 20 nt, Human
ggccacuaagcagaggaggg

SEQ ID NO: 2325760 - RNA, 12 nt, Human
ggccacuccucc

SEQ ID NO: 2325761 - RNA, 23 nt, Human
ggccacucccggcacuccaugcu

SEQ ID NO: 2325762 - RNA, 13 nt, Human
ggccacuccgaga

SEQ ID NO: 2325763 - RNA, 17 nt, Human
ggccacuccagaccccu

SEQ ID NO: 2325764 - RNA, 12 nt, Human
ggccacgugcca

SEQ ID NO: 2325765 - RNA, 11 nt, Human
ggccacgugcc

SEQ ID NO: 2325766 - RNA, 18 nt, Human
ggccacgugauguggagg

SEQ ID NO: 2325767 - RNA, 19 nt, Human
ggccacgucuuccuucugc

SEQ ID NO: 2325768 - RNA, 14 nt, Human
ggccaccaggcugg

SEQ ID NO: 2325769 - RNA, 15 nt, Human
ggccaccaggcuggc

SEQ ID NO: 2325770 - RNA, 16 nt, Human
ggccaccaggcuggcg

SEQ ID NO: 2325771 - RNA, 19 nt, Human
ggccaccaggcuggcgcag

SEQ ID NO: 2325772 - RNA, 21 nt, Human
ggccaccaggcuggcgcagcc

SEQ ID NO: 2325773 - RNA, 21 nt, Human
ggccacccguucugcuggccu

SEQ ID NO: 2325774 - RNA, 23 nt, Human
ggccacccguucugcuggccugg

SEQ ID NO: 2325775 - RNA, 24 nt, Human
ggccacccguucugcuggccugga

SEQ ID NO: 2325776 - RNA, 18 nt, Human
ggccaccaccccccacuc

SEQ ID NO: 2325777 - RNA, 14 nt, Human
ggccaccacccccc

SEQ ID NO: 2325778 - RNA, 17 nt, Human
ggccaccaccccccacu

SEQ ID NO: 2325779 - RNA, 11 nt, Human
ggccaccagga

SEQ ID NO: 2325780 - RNA, 14 nt, Human
ggccaccaggaugg

SEQ ID NO: 2325781 - RNA, 12 nt, Human
ggccaccaggcu

SEQ ID NO: 2325782 - RNA, 13 nt, Human
ggccaccaggcug

SEQ ID NO: 2325783 - RNA, 19 nt, Human
ggccacauggggcugggca

SEQ ID NO: 2325784 - RNA, 17 nt, Human
ggccacauggggcuggg

SEQ ID NO: 2325785 - RNA, 12 nt, Human
ggccauucagca

SEQ ID NO: 2325786 - RNA, 20 nt, Human
ggccauucuccacagcaacc

SEQ ID NO: 2325787 - RNA, 23 nt, Human
ggccauguuccaauaaacaggag

SEQ ID NO: 2325788 - RNA, 20 nt, Human
ggccauucuauuguggcaag

SEQ ID NO: 2325789 - RNA, 20 nt, Human
ggccaugguacccccuucug

SEQ ID NO: 2325790 - RNA, 13 nt, Human
ggccauguccuua

SEQ ID NO: 2325791 - RNA, 13 nt, Human
ggccauguuccaa

SEQ ID NO: 2325792 - RNA, 17 nt, Human
ggccauguuccaauaaa

SEQ ID NO: 2325793 - RNA, 16 nt, Human
ggccaggcuccuuccu

SEQ ID NO: 2325794 - RNA, 21 nt, Human
ggccaggcugaugggacagaa

SEQ ID NO: 2325795 - RNA, 19 nt, Human
ggccaugguacccccuucu

SEQ ID NO: 2325796 - RNA, 16 nt, Human
ggccaugggccuccug

SEQ ID NO: 2325797 - RNA, 11 nt, Human
ggccaggcucc

SEQ ID NO: 2325798 - RNA, 11 nt, Human
ggccaggcugc

SEQ ID NO: 2325799 - RNA, 15 nt, Human
ggccaggcugcucuu

SEQ ID NO: 2325800 - RNA, 14 nt, Human
ggccaggcugcucu

SEQ ID NO: 2325801 - RNA, 17 nt, Human
ggccagcuggcagcaga

SEQ ID NO: 2325802 - RNA, 16 nt, Human
ggccagcuggcagcag

SEQ ID NO: 2325803 - RNA, 14 nt, Human
ggccagcuggcagc

SEQ ID NO: 2325804 - RNA, 18 nt, Human
ggccagcuggcagcagag

SEQ ID NO: 2325805 - RNA, 18 nt, Human
ggccaggcccucugccca

SEQ ID NO: 2325806 - RNA, 19 nt, Human
ggccagcugccccagccag

SEQ ID NO: 2325807 - RNA, 20 nt, Human
ggccagcugccccagccaga

SEQ ID NO: 2325808 - RNA, 23 nt, Human
ggccagcugcuugggcuucaucc

SEQ ID NO: 2325809 - RNA, 20 nt, Human
ggccagccuugaccauucuc

SEQ ID NO: 2325810 - RNA, 22 nt, Human
ggccagccuugaccauucucca

SEQ ID NO: 2325811 - RNA, 17 nt, Human
ggccagcugcuugggcu

SEQ ID NO: 2325812 - RNA, 21 nt, Human
ggcagcguacucaucaucaac

SEQ ID NO: 2325813 - RNA, 18 nt, Human
ggcagcgcggggagcccg

SEQ ID NO: 2325814 - RNA, 17 nt, Human
ggcagcgcccuuccucu

SEQ ID NO: 2325815 - RNA, 19 nt, Human
ggcagcgcccuuccucucc

SEQ ID NO: 2325816 - RNA, 20 nt, Human
ggcagcgcccuuccucucca

SEQ ID NO: 2325817 - RNA, 21 nt, Human
ggcagcgcccuuccucuccac

SEQ ID NO: 2325818 - RNA, 22 nt, Human
ggcagcgccaggcugaccacag

SEQ ID NO: 2325819 - RNA, 21 nt, Human
ggcagcgccaggcugaccaca

SEQ ID NO: 2325820 - RNA, 16 nt, Human
ggcagcgcccuuccuc

SEQ ID NO: 2325821 - RNA, 15 nt, Human
ggcacuagccuuugg

SEQ ID NO: 2325822 - RNA, 20 nt, Human
ggcacuagccuuuggcucug

SEQ ID NO: 2325823 - RNA, 21 nt, Human
ggcacuagccuuuggcucugg

SEQ ID NO: 2325824 - RNA, 12 nt, Human
ggcagcucaccu

SEQ ID NO: 2325825 - RNA, 14 nt, Human
ggcagcucaccucu

SEQ ID NO: 2325826 - RNA, 15 nt, Human
ggcaccgagaauguu

SEQ ID NO: 2325827 - RNA, 15 nt, Human
ggcaccuaauccagg

SEQ ID NO: 2325828 - RNA, 14 nt, Human
ggcaccuggggagu

SEQ ID NO: 2325829 - RNA, 16 nt, Human
ggcaccuaauccaggc

SEQ ID NO: 2325830 - RNA, 17 nt, Human
ggcaccuggggaguggg

SEQ ID NO: 2325831 - RNA, 17 nt, Human
ggcaccuuaguggcuuu

SEQ ID NO: 2325832 - RNA, 18 nt, Human
ggcacgcugugggcaggu

SEQ ID NO: 2325833 - RNA, 13 nt, Human
ggcacgcuguggg

SEQ ID NO: 2325834 - RNA, 20 nt, Human
ggcacgagcaaagugaagac

SEQ ID NO: 2325835 - RNA, 20 nt, Human
ggcacgaacccaccugcuga

SEQ ID NO: 2325836 - RNA, 19 nt, Human
ggcacgaacccaccugcug

SEQ ID NO: 2325837 - RNA, 18 nt, Human
ggcacgaacccaccugcu

SEQ ID NO: 2325838 - RNA, 17 nt, Human
ggcacgaacccaccugc

SEQ ID NO: 2325839 - RNA, 15 nt, Human
ggcacgggcccguga

SEQ ID NO: 2325840 - RNA, 21 nt, Human
ggcacgcuugcguaugucugu

SEQ ID NO: 2325841 - RNA, 18 nt, Human
ggcacgucaucuaguuuu

SEQ ID NO: 2325842 - RNA, 14 nt, Human
ggcacuagccuuug

SEQ ID NO: 2325843 - RNA, 23 nt, Human
ggcacuaacguugagccccugga

SEQ ID NO: 2325844 - RNA, 21 nt, Human
ggcagcugaacuauuggaggg

SEQ ID NO: 2325845 - RNA, 21 nt, Human
ggcagcucuccagucaggagg

SEQ ID NO: 2325846 - RNA, 20 nt, Human
ggcagcucuggacagcccca

SEQ ID NO: 2325847 - RNA, 16 nt, Human
ggcagcuggaugagac

SEQ ID NO: 2325848 - RNA, 12 nt, Human
ggcagcugggcc

SEQ ID NO: 2325849 - RNA, 13 nt, Human
ggcagcugggccc

SEQ ID NO: 2325850 - RNA, 14 nt, Human
ggcagcugggccca

SEQ ID NO: 2325851 - RNA, 22 nt, Human
ggcagcugcuuuugucuauggg

SEQ ID NO: 2325852 - RNA, 17 nt, Human
ggcagcuugaggguugg

SEQ ID NO: 2325853 - RNA, 22 nt, Human
ggcagcugggcccaacccuguc

SEQ ID NO: 2325854 - RNA, 18 nt, Human
ggcagcugggcccaaccc

SEQ ID NO: 2325855 - RNA, 19 nt, Human
ggcagcugggcccaacccu

SEQ ID NO: 2325856 - RNA, 20 nt, Human
ggcagcuucuauuagccagu

SEQ ID NO: 2325857 - RNA, 16 nt, Human
ggcagcucaccucucc

SEQ ID NO: 2325858 - RNA, 13 nt, Human
ggcagcucagaga

SEQ ID NO: 2325859 - RNA, 21 nt, Human
ggcagcucagagaggguggga

SEQ ID NO: 2325860 - RNA, 12 nt, Human
ggcagcucagcu

SEQ ID NO: 2325861 - RNA, 15 nt, Human
ggcagcucaucucug

SEQ ID NO: 2325862 - RNA, 15 nt, Human
ggcagcucuggacag

SEQ ID NO: 2325863 - RNA, 14 nt, Human
ggcagcucuccagu

SEQ ID NO: 2325864 - RNA, 16 nt, Human
ggcagcucuccaguca

SEQ ID NO: 2325865 - RNA, 11 nt, Human
ggcagcucucc

SEQ ID NO: 2325866 - RNA, 13 nt, Human
ggcagcucuccag

SEQ ID NO: 2325867 - RNA, 14 nt, Human
ggcagggugacccu

SEQ ID NO: 2325868 - RNA, 17 nt, Human
ggcagguaaacuccugu

SEQ ID NO: 2325869 - RNA, 14 nt, Human
ggcagguagccagg

SEQ ID NO: 2325870 - RNA, 15 nt, Human
ggcagguagccaggg

SEQ ID NO: 2325871 - RNA, 20 nt, Human
ggcagguagccagggggacu

SEQ ID NO: 2325872 - RNA, 21 nt, Human
ggcagggugggauggaggaga

SEQ ID NO: 2325873 - RNA, 16 nt, Human
ggcagggugggaugga

SEQ ID NO: 2325874 - RNA, 23 nt, Human
ggcagggugggauggaggagaag

SEQ ID NO: 2325875 - RNA, 19 nt, Human
ggcagggucucacucuguc

SEQ ID NO: 2325876 - RNA, 20 nt, Human
ggcagggucucacucugucg

SEQ ID NO: 2325877 - RNA, 13 nt, Human
ggcagugggagcu

SEQ ID NO: 2325878 - RNA, 14 nt, Human
ggcagugggagcug

SEQ ID NO: 2325879 - RNA, 16 nt, Human
ggcagugggagcugcc

SEQ ID NO: 2325880 - RNA, 23 nt, Human
ggcaucuuugccuugggcugcuc

SEQ ID NO: 2325881 - RNA, 22 nt, Human
ggcaucuuugccuugggcugcu

SEQ ID NO: 2325882 - RNA, 21 nt, Human
ggcagugggacagggcauggc

SEQ ID NO: 2325883 - RNA, 12 nt, Human
ggcauggcccug

SEQ ID NO: 2325884 - RNA, 16 nt, Human
ggcauggcuccagucu

SEQ ID NO: 2325885 - RNA, 17 nt, Human
ggcauggcccugggguc

SEQ ID NO: 2325886 - RNA, 13 nt, Human
ggcauggcccugg

SEQ ID NO: 2325887 - RNA, 16 nt, Human
ggcauggcccuggggu

SEQ ID NO: 2325888 - RNA, 17 nt, Human
ggcauggccagguggcc

SEQ ID NO: 2325889 - RNA, 18 nt, Human
ggcauggccagguggcca

SEQ ID NO: 2325890 - RNA, 12 nt, Human
ggcaugcugggg

SEQ ID NO: 2325891 - RNA, 19 nt, Human
ggcaugcgcacaaggcuga

SEQ ID NO: 2325892 - RNA, 16 nt, Human
ggcaugccugugugac

SEQ ID NO: 2325893 - RNA, 14 nt, Human
ggcaugcuggggca

SEQ ID NO: 2325894 - RNA, 13 nt, Human
ggcaugcuggggc

SEQ ID NO: 2325895 - RNA, 16 nt, Human
ggcaugcuggggcaag

SEQ ID NO: 2325896 - RNA, 14 nt, Human
ggcaugccugugug

SEQ ID NO: 2325897 - RNA, 23 nt, Human
ggcaugaaguuuccuuggcuggu

SEQ ID NO: 2325898 - RNA, 13 nt, Human
ggcaugccugugu

SEQ ID NO: 2325899 - RNA, 14 nt, Human
ggcaugaacaugua

SEQ ID NO: 2325900 - RNA, 18 nt, Human
ggcaugaacauguacugu

SEQ ID NO: 2325901 - RNA, 22 nt, Human
ggcaugaaguuuccuuggcugg

SEQ ID NO: 2325902 - RNA, 18 nt, Human
ggcaugacacgaauauug

SEQ ID NO: 2325903 - RNA, 15 nt, Human
ggcaugaagacagau

SEQ ID NO: 2325904 - RNA, 13 nt, Human
ggcacccacccug

SEQ ID NO: 2325905 - RNA, 14 nt, Human
ggcacccacccugg

SEQ ID NO: 2325906 - RNA, 18 nt, Human
ggcaaugucaggaacaga

SEQ ID NO: 2325907 - RNA, 16 nt, Human
ggcacccacccagcac

SEQ ID NO: 2325908 - RNA, 20 nt, Human
ggcacccaccguggaggagg

SEQ ID NO: 2325909 - RNA, 21 nt, Human
ggcacccaccguggaggagga

SEQ ID NO: 2325910 - RNA, 20 nt, Human
ggcacccagugagcacuccc

SEQ ID NO: 2325911 - RNA, 23 nt, Human
ggcacccaccaucaugucuggcu

SEQ ID NO: 2325912 - RNA, 21 nt, Human
ggcaaugggagcugaggccac

SEQ ID NO: 2325913 - RNA, 20 nt, Human
ggcaaugggagcugaggcca

SEQ ID NO: 2325914 - RNA, 22 nt, Human
ggcacccggccccugcugguuc

SEQ ID NO: 2325915 - RNA, 14 nt, Human
ggcaccgagaaugu

SEQ ID NO: 2325916 - RNA, 18 nt, Human
ggcaccggggccucggac

SEQ ID NO: 2325917 - RNA, 12 nt, Human
ggcacccuucuu

SEQ ID NO: 2325918 - RNA, 17 nt, Human
ggcacccuucuuuccuc

SEQ ID NO: 2325919 - RNA, 20 nt, Human
ggcacccuucuuuccucuuc

SEQ ID NO: 2325920 - RNA, 22 nt, Human
ggcacccuucuuuccucuuccc

SEQ ID NO: 2325921 - RNA, 21 nt, Human
ggcaauauagcaagaucccau

SEQ ID NO: 2325922 - RNA, 18 nt, Human
ggcaauaguguguucuga

SEQ ID NO: 2325923 - RNA, 19 nt, Human
ggcaaucauggugcucaga

SEQ ID NO: 2325924 - RNA, 18 nt, Human
ggcaacccccagccugcu

SEQ ID NO: 2325925 - RNA, 22 nt, Human
ggauuguaaaaaaaaaugccuu

SEQ ID NO: 2325926 - RNA, 23 nt, Human
ggauuguaaaaaaaaaugccuuu

SEQ ID NO: 2325927 - RNA, 22 nt, Human
ggcaaccccaguucugcuccuc

SEQ ID NO: 2325928 - RNA, 23 nt, Human
ggcaaccccaguucugcuccucu

SEQ ID NO: 2325929 - RNA, 14 nt, Human
ggcaaugcuggcug

SEQ ID NO: 2325930 - RNA, 15 nt, Human
ggcaaugauggcaau

SEQ ID NO: 2325931 - RNA, 18 nt, Human
ggcaaucuauuaauagcu

SEQ ID NO: 2325932 - RNA, 15 nt, Human
ggcaaugcuggcugu

SEQ ID NO: 2325933 - RNA, 23 nt, Human
ggcaaugcuggcuguuggcuggg

SEQ ID NO: 2325934 - RNA, 12 nt, Human
ggauuggggaag

SEQ ID NO: 2325935 - RNA, 18 nt, Human
ggauuggauuauuuaaua

SEQ ID NO: 2325936 - RNA, 20 nt, Human
ggauuggcuuguguguuuca

SEQ ID NO: 2325937 - RNA, 18 nt, Human
ggauugggccccugccag

SEQ ID NO: 2325938 - RNA, 17 nt, Human
ggauugggccccugcca

SEQ ID NO: 2325939 - RNA, 15 nt, Human
ggauugcugccacuu

SEQ ID NO: 2325940 - RNA, 16 nt, Human
ggauuggauuauuuaa

SEQ ID NO: 2325941 - RNA, 22 nt, Human
ggauuggauuauuuaauaacau

SEQ ID NO: 2325942 - RNA, 17 nt, Human
ggauugcuugagcccag

SEQ ID NO: 2325943 - RNA, 14 nt, Human
ggauugcugccacu

SEQ ID NO: 2325944 - RNA, 16 nt, Human
ggauugcuaugaauga

SEQ ID NO: 2325945 - RNA, 17 nt, Human
ggauugcuacuguccua

SEQ ID NO: 2325946 - RNA, 19 nt, Human
ggauuggggaagacugugg

SEQ ID NO: 2325947 - RNA, 18 nt, Human
ggauuggggaagacugug

SEQ ID NO: 2325948 - RNA, 17 nt, Human
ggauuggggucccucua

SEQ ID NO: 2325949 - RNA, 16 nt, Human
ggauuggggucccucu

SEQ ID NO: 2325950 - RNA, 14 nt, Human
ggauugggggcugg

SEQ ID NO: 2325951 - RNA, 18 nt, Human
ggauugggggcuggugcc

SEQ ID NO: 2325952 - RNA, 15 nt, Human
ggauuguaaaauggu

SEQ ID NO: 2325953 - RNA, 16 nt, Human
ggcaacccccagccug

SEQ ID NO: 2325954 - RNA, 17 nt, Human
ggcaacccccagccugc

SEQ ID NO: 2325955 - RNA, 16 nt, Human
ggauucuuccucccuc

SEQ ID NO: 2325956 - RNA, 18 nt, Human
ggauugauuaugcagaau

SEQ ID NO: 2325957 - RNA, 15 nt, Human
ggauugcacguggcc

SEQ ID NO: 2325958 - RNA, 17 nt, Human
ggauugcacguggccuc

SEQ ID NO: 2325959 - RNA, 18 nt, Human
ggauugcacguggccucu

SEQ ID NO: 2325960 - RNA, 16 nt, Human
ggauucuuauggacaa

SEQ ID NO: 2325961 - RNA, 15 nt, Human
ggauuacccaagcaa

SEQ ID NO: 2325962 - RNA, 16 nt, Human
ggauucuuccaucuga

SEQ ID NO: 2325963 - RNA, 23 nt, Human
ggauuacaagcgugagccacugc

SEQ ID NO: 2325964 - RNA, 19 nt, Human
ggauuacaggcuccugcca

SEQ ID NO: 2325965 - RNA, 21 nt, Human
ggauggagcccaggcgggagc

SEQ ID NO: 2325966 - RNA, 22 nt, Human
ggauuaaugguccugugaugcu

SEQ ID NO: 2325967 - RNA, 17 nt, Human
ggauuagggagagaaga

SEQ ID NO: 2325968 - RNA, 13 nt, Human
ggaugcagcauua

SEQ ID NO: 2325969 - RNA, 18 nt, Human
ggaugcagagucagcaga

SEQ ID NO: 2325970 - RNA, 16 nt, Human
ggaugcagagucagca

SEQ ID NO: 2325971 - RNA, 17 nt, Human
ggaugauuggauuauuc

SEQ ID NO: 2325972 - RNA, 19 nt, Human
ggaugcagccucacagucc

SEQ ID NO: 2325973 - RNA, 19 nt, Human
ggaugccaagaaguuuaag

SEQ ID NO: 2325974 - RNA, 21 nt, Human
ggaugcauguuuuccagcucc

SEQ ID NO: 2325975 - RNA, 15 nt, Human
ggaugcauuucucug

SEQ ID NO: 2325976 - RNA, 21 nt, Human
ggaugccuuccccugggcccu

SEQ ID NO: 2325977 - RNA, 16 nt, Human
ggaugcauggagauag

SEQ ID NO: 2325978 - RNA, 14 nt, Human
ggaugcagugcucg

SEQ ID NO: 2325979 - RNA, 22 nt, Human
ggaugcagugcucgcuguugcu

SEQ ID NO: 2325980 - RNA, 21 nt, Human
ggaugcuugccuagggccugg

SEQ ID NO: 2325981 - RNA, 14 nt, Human
ggaugcugccugag

SEQ ID NO: 2325982 - RNA, 16 nt, Human
ggaugcggauggccgg

SEQ ID NO: 2325983 - RNA, 16 nt, Human
ggaugcuaacaucuaa

SEQ ID NO: 2325984 - RNA, 15 nt, Human
ggaugcuuguacaua

SEQ ID NO: 2325985 - RNA, 19 nt, Human
ggauggaaaaggaagacua

SEQ ID NO: 2325986 - RNA, 21 nt, Human
ggaugcuccucccuucucuac

SEQ ID NO: 2325987 - RNA, 16 nt, Human
ggauggagagagggga

SEQ ID NO: 2325988 - RNA, 17 nt, Human
ggauggaaugauggguc

SEQ ID NO: 2325989 - RNA, 19 nt, Human
ggauuacaagcgugagcca

SEQ ID NO: 2325990 - RNA, 23 nt, Human
ggaugcacagaguuguuacauuu

SEQ ID NO: 2325991 - RNA, 21 nt, Human
ggaugauuggaggggggaggu

SEQ ID NO: 2325992 - RNA, 16 nt, Human
ggaugcagccucacag

SEQ ID NO: 2325993 - RNA, 17 nt, Human
ggaugcagccucacagu

SEQ ID NO: 2325994 - RNA, 18 nt, Human
ggaucccucugggcacug

SEQ ID NO: 2325995 - RNA, 17 nt, Human
ggauccgacugcuuugg

SEQ ID NO: 2325996 - RNA, 19 nt, Human
ggauccgacugcuuuggac

SEQ ID NO: 2325997 - RNA, 21 nt, Human
ggauccgacugcuuuggaccu

SEQ ID NO: 2325998 - RNA, 12 nt, Human
ggauccuccagg

SEQ ID NO: 2325999 - RNA, 21 nt, Human
ggauccuauucucaccaggaa

SEQ ID NO: 2326000 - RNA, 23 nt, Human
ggauccuauucucaccaggaagg

SEQ ID NO: 2326001 - RNA, 18 nt, Human
ggauccuagccuuauccu

SEQ ID NO: 2326002 - RNA, 20 nt, Human
ggauccuagccuuauccucu

SEQ ID NO: 2326003 - RNA, 14 nt, Human
ggauccuauucuca

SEQ ID NO: 2326004 - RNA, 20 nt, Human
ggauccuauucucaccagga

SEQ ID NO: 2326005 - RNA, 13 nt, Human
ggauccuccaggu

SEQ ID NO: 2326006 - RNA, 20 nt, Human
ggagugcaaugacacagucu

SEQ ID NO: 2326007 - RNA, 15 nt, Human
ggagugcagggagga

SEQ ID NO: 2326008 - RNA, 18 nt, Human
ggagugcagggaggagag

SEQ ID NO: 2326009 - RNA, 14 nt, Human
ggagugcagugagc

SEQ ID NO: 2326010 - RNA, 12 nt, Human
ggagugcaguga

SEQ ID NO: 2326011 - RNA, 23 nt, Human
ggagugaguugauagcacagacc

SEQ ID NO: 2326012 - RNA, 16 nt, Human
ggauacugcccggggc

SEQ ID NO: 2326013 - RNA, 14 nt, Human
ggauagaugcuggc

SEQ ID NO: 2326014 - RNA, 13 nt, Human
ggauagaugcugg

SEQ ID NO: 2326015 - RNA, 18 nt, Human
ggauacucugucagaugg

SEQ ID NO: 2326016 - RNA, 15 nt, Human
ggauacugcagggcc

SEQ ID NO: 2326017 - RNA, 16 nt, Human
ggauacugcagggcca

SEQ ID NO: 2326018 - RNA, 21 nt, Human
ggauacugcagggccaggacu

SEQ ID NO: 2326019 - RNA, 21 nt, Human
ggauacgcaucagacagaugg

SEQ ID NO: 2326020 - RNA, 18 nt, Human
ggauacaaaagcauguga

SEQ ID NO: 2326021 - RNA, 22 nt, Human
ggaucaaaccccgaccaccugc

SEQ ID NO: 2326022 - RNA, 14 nt, Human
ggaucacagagaca

SEQ ID NO: 2326023 - RNA, 13 nt, Human
ggauauuuucaaa

SEQ ID NO: 2326024 - RNA, 16 nt, Human
ggauaugcuuaguaau

SEQ ID NO: 2326025 - RNA, 18 nt, Human
ggauaguugcuccgccuc

SEQ ID NO: 2326026 - RNA, 13 nt, Human
ggauauaaauaua

SEQ ID NO: 2326027 - RNA, 20 nt, Human
ggauauaguuuuacuuuuaa

SEQ ID NO: 2326028 - RNA, 16 nt, Human
ggauauaguuuuacuu

SEQ ID NO: 2326029 - RNA, 14 nt, Human
ggauauaaauauau

SEQ ID NO: 2326030 - RNA, 15 nt, Human
ggauauaggagagga

SEQ ID NO: 2326031 - RNA, 22 nt, Human
ggaucccucauccucauaccca

SEQ ID NO: 2326032 - RNA, 17 nt, Human
ggaucccucccccccau

SEQ ID NO: 2326033 - RNA, 22 nt, Human
ggaucccucaucugucccuccg

SEQ ID NO: 2326034 - RNA, 18 nt, Human
ggaucccucaucuguccc

SEQ ID NO: 2326035 - RNA, 13 nt, Human
ggaucccucaucu

SEQ ID NO: 2326036 - RNA, 13 nt, Human
ggaucccucaucc

SEQ ID NO: 2326037 - RNA, 17 nt, Human
ggaucccucauccucau

SEQ ID NO: 2326038 - RNA, 21 nt, Human
gaggccucaguggacuuucca

SEQ ID NO: 2326039 - RNA, 18 nt, Human
gaggccucuuggaccucu

SEQ ID NO: 2326040 - RNA, 19 nt, Human
gaggccucuuggaccucug

SEQ ID NO: 2326041 - RNA, 21 nt, Human
gaggccucuuggaccucugcu

SEQ ID NO: 2326042 - RNA, 22 nt, Human
gaggccucuuggaccucugcuc

SEQ ID NO: 2326043 - RNA, 16 nt, Human
gaggccuucucugaag

SEQ ID NO: 2326044 - RNA, 16 nt, Human
gaggccucaguggacu

SEQ ID NO: 2326045 - RNA, 22 nt, Human
gaggccucucauuccagaggaa

SEQ ID NO: 2326046 - RNA, 23 nt, Human
gaggccuauaaugaagcuuuaua

SEQ ID NO: 2326047 - RNA, 18 nt, Human
gaggccuacucuuccauc

SEQ ID NO: 2326048 - RNA, 19 nt, Human
gaggccuaaaaguaaacau

SEQ ID NO: 2326049 - RNA, 18 nt, Human
gaggccuaccccgcagac

SEQ ID NO: 2326050 - RNA, 18 nt, Human
gaggccuucucugaagga

SEQ ID NO: 2326051 - RNA, 19 nt, Human
gaggccuucucugaaggac

SEQ ID NO: 2326052 - RNA, 12 nt, Human
gaggccuugcuc

SEQ ID NO: 2326053 - RNA, 15 nt, Human
gaggccuugagaggc

SEQ ID NO: 2326054 - RNA, 24 nt, Human
gaggccucuuggaccucugcucug

SEQ ID NO: 2326055 - RNA, 22 nt, Human
gaggcgcacuuuccuccuggca

SEQ ID NO: 2326056 - RNA, 21 nt, Human
gaggcgcaugaauuugugaag

SEQ ID NO: 2326057 - RNA, 18 nt, Human
gaggcggacguuccagcc

SEQ ID NO: 2326058 - RNA, 14 nt, Human
gaggcgcgggggcc

SEQ ID NO: 2326059 - RNA, 19 nt, Human
gaggcggacguuccagccg

SEQ ID NO: 2326060 - RNA, 14 nt, Human
gaggcuggaggcag

SEQ ID NO: 2326061 - RNA, 15 nt, Human
gaggcuggaggcagg

SEQ ID NO: 2326062 - RNA, 15 nt, Human
gaggcuggagcuggc

SEQ ID NO: 2326063 - RNA, 19 nt, Human
gaggcuggaggcagggccu

SEQ ID NO: 2326064 - RNA, 18 nt, Human
gaggcuggaggcagggcc

SEQ ID NO: 2326065 - RNA, 17 nt, Human
gaggcuggaggcagggc

SEQ ID NO: 2326066 - RNA, 16 nt, Human
gaggcuggaggcaggg

SEQ ID NO: 2326067 - RNA, 23 nt, Human
gaggcuggauccuagccuuaucc

SEQ ID NO: 2326068 - RNA, 13 nt, Human
gaggcuggcacag

SEQ ID NO: 2326069 - RNA, 13 nt, Human
gaggcuggcaggu

SEQ ID NO: 2326070 - RNA, 12 nt, Human
gaggcuggcagg

SEQ ID NO: 2326071 - RNA, 12 nt, Human
gaggcuggcugg

SEQ ID NO: 2326072 - RNA, 13 nt, Human
gaggcuggcuggg

SEQ ID NO: 2326073 - RNA, 16 nt, Human
gaggcuggcuggggcc

SEQ ID NO: 2326074 - RNA, 16 nt, Human
gaggcugggcucccuu

SEQ ID NO: 2326075 - RNA, 23 nt, Human
gaggccccagccucccugaagcc

SEQ ID NO: 2326076 - RNA, 22 nt, Human
gaggcccuucucuccagccccu

SEQ ID NO: 2326077 - RNA, 21 nt, Human
gaggcccuucucuccagcccc

SEQ ID NO: 2326078 - RNA, 15 nt, Human
gaggcccuucucucc

SEQ ID NO: 2326079 - RNA, 20 nt, Human
gaggcccuucucuccagccc

SEQ ID NO: 2326080 - RNA, 12 nt, Human
gaggcccaggga

SEQ ID NO: 2326081 - RNA, 13 nt, Human
gaggcccaguuca

SEQ ID NO: 2326082 - RNA, 13 nt, Human
gaggcccagggag

SEQ ID NO: 2326083 - RNA, 13 nt, Human
gaggccccaaagg

SEQ ID NO: 2326084 - RNA, 14 nt, Human
gaggccccaaagga

SEQ ID NO: 2326085 - RNA, 19 nt, Human
gaggccccaaaggaaaaag

SEQ ID NO: 2326086 - RNA, 20 nt, Human
gaggcccaguucacccugau

SEQ ID NO: 2326087 - RNA, 18 nt, Human
gaggcccaguucacccug

SEQ ID NO: 2326088 - RNA, 14 nt, Human
gaggccccacuggg

SEQ ID NO: 2326089 - RNA, 13 nt, Human
gaggccccagccu

SEQ ID NO: 2326090 - RNA, 12 nt, Human
gaggccccagcc

SEQ ID NO: 2326091 - RNA, 22 nt, Human
gaggccccagccucccugaagc

SEQ ID NO: 2326092 - RNA, 19 nt, Human
gaggccccagccucccuga

SEQ ID NO: 2326093 - RNA, 14 nt, Human
gaggcccccagccc

SEQ ID NO: 2326094 - RNA, 23 nt, Human
gaggccaugauucgcccaaagcc

SEQ ID NO: 2326095 - RNA, 20 nt, Human
gaggccaugauucgcccaaa

SEQ ID NO: 2326096 - RNA, 19 nt, Human
gaggccauugugugagccu

SEQ ID NO: 2326097 - RNA, 11 nt, Human
gaggcccagag

SEQ ID NO: 2326098 - RNA, 13 nt, Human
gaggcccagaggg

SEQ ID NO: 2326099 - RNA, 14 nt, Human
gaggcccagagggc

SEQ ID NO: 2326100 - RNA, 19 nt, Human
gaggcccagagggccugca

SEQ ID NO: 2326101 - RNA, 23 nt, Human
gaggccauguuccaauaaacagg

SEQ ID NO: 2326102 - RNA, 15 nt, Human
gaggcccagagggcc

SEQ ID NO: 2326103 - RNA, 16 nt, Human
gaggcccagagggccu

SEQ ID NO: 2326104 - RNA, 21 nt, Human
gaggcagggccuugcccagag

SEQ ID NO: 2326105 - RNA, 20 nt, Human
gaggcagggccuugcccaga

SEQ ID NO: 2326106 - RNA, 18 nt, Human
gaggcagggccuugccca

SEQ ID NO: 2326107 - RNA, 17 nt, Human
gaggcagggccuugccc

SEQ ID NO: 2326108 - RNA, 15 nt, Human
gaggcagggccuugc

SEQ ID NO: 2326109 - RNA, 16 nt, Human
gaggcagggaggggac

SEQ ID NO: 2326110 - RNA, 22 nt, Human
gaggcagggccuugcccagaga

SEQ ID NO: 2326111 - RNA, 14 nt, Human
gaggccaugggccu

SEQ ID NO: 2326112 - RNA, 17 nt, Human
gaggccaugggccuccu

SEQ ID NO: 2326113 - RNA, 18 nt, Human
gaggccaugggccuccug

SEQ ID NO: 2326114 - RNA, 20 nt, Human
gaggccaugggccuccugug

SEQ ID NO: 2326115 - RNA, 21 nt, Human
gaggccaugggccuccugugu

SEQ ID NO: 2326116 - RNA, 23 nt, Human
gaggccaugggccuccugugugu

SEQ ID NO: 2326117 - RNA, 17 nt, Human
gaggcagggaggggacu

SEQ ID NO: 2326118 - RNA, 15 nt, Human
gaggcagggagggga

SEQ ID NO: 2326119 - RNA, 14 nt, Human
gaggcagggaaguc

SEQ ID NO: 2326120 - RNA, 22 nt, Human
gaggcagggaaguccccaggcc

SEQ ID NO: 2326121 - RNA, 14 nt, Human
gaggcaggcuccag

SEQ ID NO: 2326122 - RNA, 21 nt, Human
gaggcagccccauucugccug

SEQ ID NO: 2326123 - RNA, 20 nt, Human
gaggcagccccauucugccu

SEQ ID NO: 2326124 - RNA, 9 nt, Human
gaggcaggg

SEQ ID NO: 2326125 - RNA, 19 nt, Human
gaggcagccccauucugcc

SEQ ID NO: 2326126 - RNA, 18 nt, Human
gaggcagccccauucugc

SEQ ID NO: 2326127 - RNA, 19 nt, Human
gaggcagagguugcaguga

SEQ ID NO: 2326128 - RNA, 22 nt, Human
gaggcagagagcggucucaggc

SEQ ID NO: 2326129 - RNA, 11 nt, Human
gaggcagagga

SEQ ID NO: 2326130 - RNA, 13 nt, Human
gaggcagaggaca

SEQ ID NO: 2326131 - RNA, 14 nt, Human
gaggcagaggacag

SEQ ID NO: 2326132 - RNA, 11 nt, Human
gaggcagagag

SEQ ID NO: 2326133 - RNA, 21 nt, Human
gaggcagagaaagaagagaca

SEQ ID NO: 2326134 - RNA, 12 nt, Human
gaggcagagagc

SEQ ID NO: 2326135 - RNA, 13 nt, Human
gaggcagagagcg

SEQ ID NO: 2326136 - RNA, 15 nt, Human
gaggcagagagcggu

SEQ ID NO: 2326137 - RNA, 13 nt, Human
gaggcaagcccug

SEQ ID NO: 2326138 - RNA, 19 nt, Human
gaggcaaugucaggaacag

SEQ ID NO: 2326139 - RNA, 22 nt, Human
gaggcaaugggagcugaggcca

SEQ ID NO: 2326140 - RNA, 17 nt, Human
gaggauuucaagccugc

SEQ ID NO: 2326141 - RNA, 15 nt, Human
gaggauuucaagccu

SEQ ID NO: 2326142 - RNA, 13 nt, Human
gaggauuuugagu

SEQ ID NO: 2326143 - RNA, 17 nt, Human
gaggauuuuuuucugag

SEQ ID NO: 2326144 - RNA, 13 nt, Human
gaggcaagagaau

SEQ ID NO: 2326145 - RNA, 22 nt, Human
gaggcagacagcagcucaggca

SEQ ID NO: 2326146 - RNA, 21 nt, Human
gaggcagacagcagcucaggc

SEQ ID NO: 2326147 - RNA, 20 nt, Human
gaggcagacagcagcucagg

SEQ ID NO: 2326148 - RNA, 19 nt, Human
gaggcagacagcagcucag

SEQ ID NO: 2326149 - RNA, 22 nt, Human
gaggcagacuucccugaaugua

SEQ ID NO: 2326150 - RNA, 16 nt, Human
gaggcagagaaagaag

SEQ ID NO: 2326151 - RNA, 17 nt, Human
gaggcagagaaagaaga

SEQ ID NO: 2326152 - RNA, 19 nt, Human
gaggcagagaaagaagaga

SEQ ID NO: 2326153 - RNA, 15 nt, Human
gaggauggagagagg

SEQ ID NO: 2326154 - RNA, 14 nt, Human
gaggauggccagug

SEQ ID NO: 2326155 - RNA, 14 nt, Human
gaggauggagagag

SEQ ID NO: 2326156 - RNA, 13 nt, Human
gaggauggagaga

SEQ ID NO: 2326157 - RNA, 12 nt, Human
gaggauggagag

SEQ ID NO: 2326158 - RNA, 13 nt, Human
gaggaugagcugg

SEQ ID NO: 2326159 - RNA, 21 nt, Human
gaggaugcagagucagcagaa

SEQ ID NO: 2326160 - RNA, 22 nt, Human
gaggaugagcucuacccagggc

SEQ ID NO: 2326161 - RNA, 18 nt, Human
gaggaugagagcccagag

SEQ ID NO: 2326162 - RNA, 20 nt, Human
gaggaugagagcccagaggu

SEQ ID NO: 2326163 - RNA, 14 nt, Human
gaggaugagagccc

SEQ ID NO: 2326164 - RNA, 15 nt, Human
gaggaugagagccca

SEQ ID NO: 2326165 - RNA, 16 nt, Human
gaggaugagagcccag

SEQ ID NO: 2326166 - RNA, 17 nt, Human
gaggaugagagcccaga

SEQ ID NO: 2326167 - RNA, 20 nt, Human
gaggauugcuugagcucagg

SEQ ID NO: 2326168 - RNA, 22 nt, Human
gaggauuuaagggauggaaaag

SEQ ID NO: 2326169 - RNA, 20 nt, Human
gaggauuuaagggauggaaa

SEQ ID NO: 2326170 - RNA, 15 nt, Human
gaggauggccagugu

SEQ ID NO: 2326171 - RNA, 16 nt, Human
gaggauggccaguguc

SEQ ID NO: 2326172 - RNA, 19 nt, Human
gaggauggccagugucugu

SEQ ID NO: 2326173 - RNA, 19 nt, Human
gaggaucucuugagccugg

SEQ ID NO: 2326174 - RNA, 16 nt, Human
gaggaucucuugagcc

SEQ ID NO: 2326175 - RNA, 17 nt, Human
gaggaucccucucugga

SEQ ID NO: 2326176 - RNA, 13 nt, Human
gaggaucuggaga

SEQ ID NO: 2326177 - RNA, 21 nt, Human
gaggaugaauguaugugcacu

SEQ ID NO: 2326178 - RNA, 20 nt, Human
gaggaucacuggagcccagg

SEQ ID NO: 2326179 - RNA, 22 nt, Human
gaggaucucuugagccugggag

SEQ ID NO: 2326180 - RNA, 13 nt, Human
gaggaucucuuga

SEQ ID NO: 2326181 - RNA, 19 nt, Human
gagcccuuaucugugcuca

SEQ ID NO: 2326182 - RNA, 22 nt, Human
gagcccuguccugccuaaggcu

SEQ ID NO: 2326183 - RNA, 18 nt, Human
gagcccuuaucugugcuc

SEQ ID NO: 2326184 - RNA, 22 nt, Human
gagcccuguggaugagcccuca

SEQ ID NO: 2326185 - RNA, 21 nt, Human
gagcccuguggaugagcccuc

SEQ ID NO: 2326186 - RNA, 18 nt, Human
gagcccuguggaugagcc

SEQ ID NO: 2326187 - RNA, 15 nt, Human
gagggucaggaagga

SEQ ID NO: 2326188 - RNA, 13 nt, Human
gagggucaggaag

SEQ ID NO: 2326189 - RNA, 15 nt, Human
gagggucagagagga

SEQ ID NO: 2326190 - RNA, 13 nt, Human
gagggucagagag

SEQ ID NO: 2326191 - RNA, 16 nt, Human
gagggucaggaaggau

SEQ ID NO: 2326192 - RNA, 18 nt, Human
gagggucccaagcugggc

SEQ ID NO: 2326193 - RNA, 19 nt, Human
gagggucaggacugugacu

SEQ ID NO: 2326194 - RNA, 19 nt, Human
gagggucccaagcugggcc

SEQ ID NO: 2326195 - RNA, 20 nt, Human
gagggucccaagcugggccc

SEQ ID NO: 2326196 - RNA, 23 nt, Human
gagggucccaagcugggccccag

SEQ ID NO: 2326197 - RNA, 19 nt, Human
gaggguccccaccugggac

SEQ ID NO: 2326198 - RNA, 15 nt, Human
gaggguccuggcucc

SEQ ID NO: 2326199 - RNA, 21 nt, Human
gaggguccuggcuccugaggg

SEQ ID NO: 2326200 - RNA, 15 nt, Human
gagggucuggagaag

SEQ ID NO: 2326201 - RNA, 17 nt, Human
gaggguccuggcuccug

SEQ ID NO: 2326202 - RNA, 24 nt, Human
gagggucuggagaagcagugagcc

SEQ ID NO: 2326203 - RNA, 23 nt, Human
gagggucuugguuccagccugcc

SEQ ID NO: 2326204 - RNA, 13 nt, Human
gagggucugagga

SEQ ID NO: 2326205 - RNA, 14 nt, Human
gagggucugaggaa

SEQ ID NO: 2326206 - RNA, 15 nt, Human
gagggugagugcaag

SEQ ID NO: 2326207 - RNA, 21 nt, Human
gagggugaagugaagacaaug

SEQ ID NO: 2326208 - RNA, 19 nt, Human
gagggugggagagcccagc

SEQ ID NO: 2326209 - RNA, 18 nt, Human
gagggugggagagcccag

SEQ ID NO: 2326210 - RNA, 13 nt, Human
gaggguggcaggu

SEQ ID NO: 2326211 - RNA, 13 nt, Human
gaggguggagacu

SEQ ID NO: 2326212 - RNA, 20 nt, Human
gaggguggagacuaagcccu

SEQ ID NO: 2326213 - RNA, 12 nt, Human
gaggguggaaua

SEQ ID NO: 2326214 - RNA, 14 nt, Human
gaggguggugaccu

SEQ ID NO: 2326215 - RNA, 15 nt, Human
gagggugggaguggg

SEQ ID NO: 2326216 - RNA, 21 nt, Human
gaggguggugaccucugccug

SEQ ID NO: 2326217 - RNA, 22 nt, Human
gagggugucccaaaaagaaagg

SEQ ID NO: 2326218 - RNA, 22 nt, Human
gagguauucaauauccuuugcc

SEQ ID NO: 2326219 - RNA, 19 nt, Human
gagguauuuaucuuuacuu

SEQ ID NO: 2326220 - RNA, 22 nt, Human
gaggucaacagagaaggcagga

SEQ ID NO: 2326221 - RNA, 16 nt, Human
gaggucaacagagaag

SEQ ID NO: 2326222 - RNA, 15 nt, Human
gaggucaacagagaa

SEQ ID NO: 2326223 - RNA, 17 nt, Human
gaggucaaggcugcagu

SEQ ID NO: 2326224 - RNA, 17 nt, Human
gagguagaaaagauugg

SEQ ID NO: 2326225 - RNA, 18 nt, Human
gagguagaguuugaagga

SEQ ID NO: 2326226 - RNA, 19 nt, Human
gagguagaguuugaaggag

SEQ ID NO: 2326227 - RNA, 23 nt, Human
gagguagaguuugaaggagguga

SEQ ID NO: 2326228 - RNA, 13 nt, Human
gagguaugagguc

SEQ ID NO: 2326229 - RNA, 21 nt, Human
gagguagguggaucaccugag

SEQ ID NO: 2326230 - RNA, 21 nt, Human
gagguagcuuugagguggaag

SEQ ID NO: 2326231 - RNA, 16 nt, Human
gaggucaaguaagaag

SEQ ID NO: 2326232 - RNA, 16 nt, Human
gaggucacauucagga

SEQ ID NO: 2326233 - RNA, 19 nt, Human
gaggucacauucaggaaga

SEQ ID NO: 2326234 - RNA, 21 nt, Human
gaggucacauucaggaagaug

SEQ ID NO: 2326235 - RNA, 22 nt, Human
gaggucacauucaggaagauga

SEQ ID NO: 2326236 - RNA, 15 nt, Human
gaggucacuggaaag

SEQ ID NO: 2326237 - RNA, 16 nt, Human
gaggucacuggaaagg

SEQ ID NO: 2326238 - RNA, 17 nt, Human
gaggucacuggaaaggg

SEQ ID NO: 2326239 - RNA, 24 nt, Human
gaggucaagcccaggaggacugcc

SEQ ID NO: 2326240 - RNA, 19 nt, Human
gaggucaaggcugcaguga

SEQ ID NO: 2326241 - RNA, 20 nt, Human
gaggucaagcccaggaggac

SEQ ID NO: 2326242 - RNA, 19 nt, Human
gaggucaagcccaggagga

SEQ ID NO: 2326243 - RNA, 17 nt, Human
gaggucaagcccaggag

SEQ ID NO: 2326244 - RNA, 16 nt, Human
gaggucaagcccagga

SEQ ID NO: 2326245 - RNA, 15 nt, Human
gaggucaagcccagg

SEQ ID NO: 2326246 - RNA, 23 nt, Human
gaggucaacagagaaggcaggaa

SEQ ID NO: 2326247 - RNA, 12 nt, Human
gaggucagagcc

SEQ ID NO: 2326248 - RNA, 13 nt, Human
gaggucagagccu

SEQ ID NO: 2326249 - RNA, 15 nt, Human
gaggguuagggaggg

SEQ ID NO: 2326250 - RNA, 14 nt, Human
gaggguugggcugg

SEQ ID NO: 2326251 - RNA, 15 nt, Human
gaggguugggcuggu

SEQ ID NO: 2326252 - RNA, 18 nt, Human
gaggguuguucuccuaga

SEQ ID NO: 2326253 - RNA, 17 nt, Human
gaggguuguucuccuag

SEQ ID NO: 2326254 - RNA, 20 nt, Human
gaggguuggguucaucugag

SEQ ID NO: 2326255 - RNA, 12 nt, Human
gaggguuccugu

SEQ ID NO: 2326256 - RNA, 24 nt, Human
gagguaaggaauaccugucccccu

SEQ ID NO: 2326257 - RNA, 17 nt, Human
gagguaacagaacagcu

SEQ ID NO: 2326258 - RNA, 18 nt, Human
gagguaacagaacagcuu

SEQ ID NO: 2326259 - RNA, 21 nt, Human
gagguaacagaacagcuucag

SEQ ID NO: 2326260 - RNA, 22 nt, Human
gagguaaaagugugagcaguga

SEQ ID NO: 2326261 - RNA, 21 nt, Human
gaggguuuccaugggguagga

SEQ ID NO: 2326262 - RNA, 13 nt, Human
gagguaacagaac

SEQ ID NO: 2326263 - RNA, 14 nt, Human
gagguaacagaaca

SEQ ID NO: 2326264 - RNA, 15 nt, Human
gagguaacagaacag

SEQ ID NO: 2326265 - RNA, 16 nt, Human
gagguaacagaacagc

SEQ ID NO: 2326266 - RNA, 21 nt, Human
gagguaaggaauaccuguccc

SEQ ID NO: 2326267 - RNA, 15 nt, Human
gagggagcuuagcca

SEQ ID NO: 2326268 - RNA, 24 nt, Human
gagggagcauagaaggcaggugag

SEQ ID NO: 2326269 - RNA, 13 nt, Human
gagggaggaaucg

SEQ ID NO: 2326270 - RNA, 12 nt, Human
gagggaggaggc

SEQ ID NO: 2326271 - RNA, 13 nt, Human
gagggaggaggcc

SEQ ID NO: 2326272 - RNA, 19 nt, Human
gagggagggcuccagacac

SEQ ID NO: 2326273 - RNA, 22 nt, Human
gagggagcaaguccuucccuuu

SEQ ID NO: 2326274 - RNA, 12 nt, Human
gagggagaugga

SEQ ID NO: 2326275 - RNA, 12 nt, Human
gagggagcagac

SEQ ID NO: 2326276 - RNA, 20 nt, Human
gagggagcagacaggaggaa

SEQ ID NO: 2326277 - RNA, 20 nt, Human
gagggagcauagaaggcagg

SEQ ID NO: 2326278 - RNA, 14 nt, Human
gagggagaagcaug

SEQ ID NO: 2326279 - RNA, 13 nt, Human
gagggagagagag

SEQ ID NO: 2326280 - RNA, 15 nt, Human
gagggagagagagag

SEQ ID NO: 2326281 - RNA, 16 nt, Human
gagggagagagagaga

SEQ ID NO: 2326282 - RNA, 22 nt, Human
gagggagagagagagagagagg

SEQ ID NO: 2326283 - RNA, 13 nt, Human
gagggagagggag

SEQ ID NO: 2326284 - RNA, 14 nt, Human
gagggagaggugga

SEQ ID NO: 2326285 - RNA, 23 nt, Human
gagggagagguggagcaaaguga

SEQ ID NO: 2326286 - RNA, 13 nt, Human
gagggagaaggga

SEQ ID NO: 2326287 - RNA, 21 nt, Human
gagggagacacuggccccuca

SEQ ID NO: 2326288 - RNA, 22 nt, Human
gaggcugucuucucaggcucug

SEQ ID NO: 2326289 - RNA, 23 nt, Human
gaggcuguggucacagcggaggu

SEQ ID NO: 2326290 - RNA, 21 nt, Human
gaggcugucuucucaggcucu

SEQ ID NO: 2326291 - RNA, 20 nt, Human
gaggcugucuucucaggcuc

SEQ ID NO: 2326292 - RNA, 14 nt, Human
gaggcuguccugua

SEQ ID NO: 2326293 - RNA, 12 nt, Human
gaggcuguccug

SEQ ID NO: 2326294 - RNA, 12 nt, Human
gaggcuguagga

SEQ ID NO: 2326295 - RNA, 23 nt, Human
gaggcuguaggacucgcagucag

SEQ ID NO: 2326296 - RNA, 20 nt, Human
gaggcugggcucccuuccca

SEQ ID NO: 2326297 - RNA, 20 nt, Human
gaggcuggugcuguggccag

SEQ ID NO: 2326298 - RNA, 22 nt, Human
gaggcuggugcuguggccaggg

SEQ ID NO: 2326299 - RNA, 17 nt, Human
gagggaugcugccugag

SEQ ID NO: 2326300 - RNA, 15 nt, Human
gagggaugcugccug

SEQ ID NO: 2326301 - RNA, 18 nt, Human
gagggaugaggugcuggg

SEQ ID NO: 2326302 - RNA, 23 nt, Human
gagggaucacagggccccagaag

SEQ ID NO: 2326303 - RNA, 17 nt, Human
gagggaugaugccacac

SEQ ID NO: 2326304 - RNA, 15 nt, Human
gagggaucacagggc

SEQ ID NO: 2326305 - RNA, 14 nt, Human
gagggaucacaggg

SEQ ID NO: 2326306 - RNA, 13 nt, Human
gagggagggggcu

SEQ ID NO: 2326307 - RNA, 12 nt, Human
gagggaggggcc

SEQ ID NO: 2326308 - RNA, 21 nt, Human
gagggagugacagaggcagcc

SEQ ID NO: 2326309 - RNA, 22 nt, Human
gagggagugacagaggcagccc

SEQ ID NO: 2326310 - RNA, 18 nt, Human
gagggagugacagaggca

SEQ ID NO: 2326311 - RNA, 16 nt, Human
gagggagugacagagg

SEQ ID NO: 2326312 - RNA, 20 nt, Human
gagggagggggaaggcaggg

SEQ ID NO: 2326313 - RNA, 17 nt, Human
gagggaggaggccaccu

SEQ ID NO: 2326314 - RNA, 20 nt, Human
gagggagggcuccagacaca

SEQ ID NO: 2326315 - RNA, 19 nt, Human
gagggcagcagggcuaccc

SEQ ID NO: 2326316 - RNA, 16 nt, Human
gagggcagcagggcua

SEQ ID NO: 2326317 - RNA, 16 nt, Human
gagggcaguguuuccu

SEQ ID NO: 2326318 - RNA, 11 nt, Human
gagggcaggga

SEQ ID NO: 2326319 - RNA, 17 nt, Human
gaggggcuuucuggaga

SEQ ID NO: 2326320 - RNA, 18 nt, Human
gagggccaagacuuggca

SEQ ID NO: 2326321 - RNA, 16 nt, Human
gagggccacgggucug

SEQ ID NO: 2326322 - RNA, 22 nt, Human
gagggcaugcgcacaaggcuga

SEQ ID NO: 2326323 - RNA, 18 nt, Human
gagggcaugcgcacaagg

SEQ ID NO: 2326324 - RNA, 16 nt, Human
gagggccacaugggag

SEQ ID NO: 2326325 - RNA, 17 nt, Human
gaggggcugugggcgug

SEQ ID NO: 2326326 - RNA, 18 nt, Human
gagggauggcgggugggg

SEQ ID NO: 2326327 - RNA, 19 nt, Human
gagggauggcggguggggg

SEQ ID NO: 2326328 - RNA, 22 nt, Human
gagggaugaggugcugggaggg

SEQ ID NO: 2326329 - RNA, 14 nt, Human
gagggauggacuga

SEQ ID NO: 2326330 - RNA, 20 nt, Human
gagggaugcugccugaguca

SEQ ID NO: 2326331 - RNA, 18 nt, Human
gagggauucugguuccag

SEQ ID NO: 2326332 - RNA, 21 nt, Human
gagggauucugguuccagggu

SEQ ID NO: 2326333 - RNA, 19 nt, Human
gagggauuggccgcuuggc

SEQ ID NO: 2326334 - RNA, 18 nt, Human
gagggcaagggccaugcu

SEQ ID NO: 2326335 - RNA, 22 nt, Human
gagggcaagggccaugcugaag

SEQ ID NO: 2326336 - RNA, 12 nt, Human
gagggcacacac

SEQ ID NO: 2326337 - RNA, 15 nt, Human
gagggcagcagggcu

SEQ ID NO: 2326338 - RNA, 14 nt, Human
gagggcagcagggc

SEQ ID NO: 2326339 - RNA, 12 nt, Human
gagggcagcagg

SEQ ID NO: 2326340 - RNA, 15 nt, Human
gagggcacacacugu

SEQ ID NO: 2326341 - RNA, 18 nt, Human
gaggggucuccaggagga

SEQ ID NO: 2326342 - RNA, 14 nt, Human
gagggguguggcag

SEQ ID NO: 2326343 - RNA, 21 nt, Human
gagggguguggcuccuuccca

SEQ ID NO: 2326344 - RNA, 17 nt, Human
gagggguguggcagugg

SEQ ID NO: 2326345 - RNA, 18 nt, Human
gagggguguggcaguggu

SEQ ID NO: 2326346 - RNA, 13 nt, Human
gaggguaaggcug

SEQ ID NO: 2326347 - RNA, 17 nt, Human
gagggguugccacaggc

SEQ ID NO: 2326348 - RNA, 18 nt, Human
gagggguugccacaggcc

SEQ ID NO: 2326349 - RNA, 22 nt, Human
gagggguugccacaggccuccc

SEQ ID NO: 2326350 - RNA, 23 nt, Human
gagggguugccacaggccucccu

SEQ ID NO: 2326351 - RNA, 16 nt, Human
gaggguaauaaacuua

SEQ ID NO: 2326352 - RNA, 22 nt, Human
gagggggccaccuccccaggcc

SEQ ID NO: 2326353 - RNA, 21 nt, Human
gagggggcuauagcuacagga

SEQ ID NO: 2326354 - RNA, 17 nt, Human
gagggggcuugaagcca

SEQ ID NO: 2326355 - RNA, 18 nt, Human
gagggggccaccucccca

SEQ ID NO: 2326356 - RNA, 20 nt, Human
gagggggccaccuccccagg

SEQ ID NO: 2326357 - RNA, 16 nt, Human
gagggguaaaagcuga

SEQ ID NO: 2326358 - RNA, 21 nt, Human
gagggggcuugaagccaaaga

SEQ ID NO: 2326359 - RNA, 18 nt, Human
gagggguaggcagagccu

SEQ ID NO: 2326360 - RNA, 18 nt, Human
gagggggcuugaagccaa

SEQ ID NO: 2326361 - RNA, 14 nt, Human
gagggguaggcaga

SEQ ID NO: 2326362 - RNA, 17 nt, Human
gaggggguggccuccca

SEQ ID NO: 2326363 - RNA, 23 nt, Human
gauagcuucaccccaaucccagc

SEQ ID NO: 2326364 - RNA, 20 nt, Human
gauagcuuuauuuuuuaagu

SEQ ID NO: 2326365 - RNA, 22 nt, Human
gauagcuaacauuuuaaauaaa

SEQ ID NO: 2326366 - RNA, 16 nt, Human
gauagcuaacauuuua

SEQ ID NO: 2326367 - RNA, 20 nt, Human
gauagccuuccguaacccaa

SEQ ID NO: 2326368 - RNA, 18 nt, Human
gauagcuaacauuuuaaa

SEQ ID NO: 2326369 - RNA, 20 nt, Human
gauagcuaacauuuuaaaua

SEQ ID NO: 2326370 - RNA, 14 nt, Human
gauauaagugcugu

SEQ ID NO: 2326371 - RNA, 16 nt, Human
gauauaagugcuguau

SEQ ID NO: 2326372 - RNA, 15 nt, Human
gauauaaauggcugg

SEQ ID NO: 2326373 - RNA, 19 nt, Human
gauauaacuauugcccagg

SEQ ID NO: 2326374 - RNA, 13 nt, Human
gauauaaauauau

SEQ ID NO: 2326375 - RNA, 15 nt, Human
gauauaaauauauau

SEQ ID NO: 2326376 - RNA, 16 nt, Human
gauauaaauauauaua

SEQ ID NO: 2326377 - RNA, 17 nt, Human
gauauaaauauauauaa

SEQ ID NO: 2326378 - RNA, 22 nt, Human
gauauaaauauauauaaauaua

SEQ ID NO: 2326379 - RNA, 21 nt, Human
gauauaaaugcaauauuaaug

SEQ ID NO: 2326380 - RNA, 16 nt, Human
gauauaaauggcuggu

SEQ ID NO: 2326381 - RNA, 20 nt, Human
gauagcaagugaauuuuucu

SEQ ID NO: 2326382 - RNA, 23 nt, Human
gauagcaaagcgacguuagucgu

SEQ ID NO: 2326383 - RNA, 16 nt, Human
gauagcacagacccug

SEQ ID NO: 2326384 - RNA, 15 nt, Human
gauagcacagacccu

SEQ ID NO: 2326385 - RNA, 14 nt, Human
gauagccaaggcca

SEQ ID NO: 2326386 - RNA, 22 nt, Human
gauagccaaggccaaaggaagc

SEQ ID NO: 2326387 - RNA, 22 nt, Human
gauaagaaugcugguuuuccua

SEQ ID NO: 2326388 - RNA, 17 nt, Human
gauaagaccaccaccuc

SEQ ID NO: 2326389 - RNA, 22 nt, Human
gauagauguguggacacauugg

SEQ ID NO: 2326390 - RNA, 14 nt, Human
gauagaugugugga

SEQ ID NO: 2326391 - RNA, 20 nt, Human
gauaagagggcacacacugu

SEQ ID NO: 2326392 - RNA, 21 nt, Human
gauacaggaaaagcugcugac

SEQ ID NO: 2326393 - RNA, 23 nt, Human
gauacaggaaaagcugcugacag

SEQ ID NO: 2326394 - RNA, 11 nt, Human
gauaacucucc

SEQ ID NO: 2326395 - RNA, 20 nt, Human
gauaacuagauggugcugag

SEQ ID NO: 2326396 - RNA, 17 nt, Human
gauaacuguuauuuaua

SEQ ID NO: 2326397 - RNA, 18 nt, Human
gauaacugcaauuuuaau

SEQ ID NO: 2326398 - RNA, 22 nt, Human
gauaagaaccuuuugagugccu

SEQ ID NO: 2326399 - RNA, 20 nt, Human
gauacaggaaaagcugcuga

SEQ ID NO: 2326400 - RNA, 17 nt, Human
gauaagaaugcugguuu

SEQ ID NO: 2326401 - RNA, 18 nt, Human
gauaacuguuauuuauaa

SEQ ID NO: 2326402 - RNA, 21 nt, Human
gauaacugcaauuuuaauuga

SEQ ID NO: 2326403 - RNA, 21 nt, Human
gauaacuuagguggcaagcug

SEQ ID NO: 2326404 - RNA, 21 nt, Human
gauaugaguuguuuucagacu

SEQ ID NO: 2326405 - RNA, 14 nt, Human
gauaugauuuaaaa

SEQ ID NO: 2326406 - RNA, 13 nt, Human
gaucacaaaaaca

SEQ ID NO: 2326407 - RNA, 15 nt, Human
gaucacaacgugcau

SEQ ID NO: 2326408 - RNA, 16 nt, Human
gaucacaacgugcauu

SEQ ID NO: 2326409 - RNA, 17 nt, Human
gaucacaacgugcauug

SEQ ID NO: 2326410 - RNA, 18 nt, Human
gaucacaacgugcauugu

SEQ ID NO: 2326411 - RNA, 15 nt, Human
gauaugaaaaauaug

SEQ ID NO: 2326412 - RNA, 17 nt, Human
gauaucuugaaaugaaa

SEQ ID NO: 2326413 - RNA, 14 nt, Human
gauaugaaaaauau

SEQ ID NO: 2326414 - RNA, 15 nt, Human
gauaucuugaaauga

SEQ ID NO: 2326415 - RNA, 23 nt, Human
gauauaagugcuguauaaaauca

SEQ ID NO: 2326416 - RNA, 15 nt, Human
gauauaagugugugu

SEQ ID NO: 2326417 - RNA, 18 nt, Human
gauauaagugcuguauaa

SEQ ID NO: 2326418 - RNA, 19 nt, Human
gauauaagugcuguauaaa

SEQ ID NO: 2326419 - RNA, 21 nt, Human
gauauaagugcuguauaaaau

SEQ ID NO: 2326420 - RNA, 22 nt, Human
gauauaagugcuguauaaaauc

SEQ ID NO: 2326421 - RNA, 18 nt, Human
gaucacggcucacugcag

SEQ ID NO: 2326422 - RNA, 17 nt, Human
gaucacuuguuguuuua

SEQ ID NO: 2326423 - RNA, 14 nt, Human
gaucagaaauacag

SEQ ID NO: 2326424 - RNA, 15 nt, Human
gaucagaaauacaga

SEQ ID NO: 2326425 - RNA, 18 nt, Human
gaucacuggagcccagga

SEQ ID NO: 2326426 - RNA, 15 nt, Human
gaucacuuguuguuu

SEQ ID NO: 2326427 - RNA, 22 nt, Human
gaucacuuucucaguuuucaua

SEQ ID NO: 2326428 - RNA, 13 nt, Human
gaucacagaggcu

SEQ ID NO: 2326429 - RNA, 16 nt, Human
gaucacagcagcuucu

SEQ ID NO: 2326430 - RNA, 17 nt, Human
gaucacagagacauucc

SEQ ID NO: 2326431 - RNA, 19 nt, Human
gaucacagagacauuccuc

SEQ ID NO: 2326432 - RNA, 20 nt, Human
gaucacaacgugcauugugc

SEQ ID NO: 2326433 - RNA, 21 nt, Human
gaucacaacgugcauugugcu

SEQ ID NO: 2326434 - RNA, 22 nt, Human
gaucacaacgugcauugugcuu

SEQ ID NO: 2326435 - RNA, 23 nt, Human
gaucacaacgugcauugugcuuc

SEQ ID NO: 2326436 - RNA, 15 nt, Human
gaucacggcucacug

SEQ ID NO: 2326437 - RNA, 16 nt, Human
gaucacggcucacugc

SEQ ID NO: 2326438 - RNA, 23 nt, Human
gaguugacuugacagaacacugu

SEQ ID NO: 2326439 - RNA, 20 nt, Human
gaguuacagcgagaggcaga

SEQ ID NO: 2326440 - RNA, 21 nt, Human
gaguugaagacagagcuacac

SEQ ID NO: 2326441 - RNA, 15 nt, Human
gaguugaagacagag

SEQ ID NO: 2326442 - RNA, 17 nt, Human
gaguugaagacagagcu

SEQ ID NO: 2326443 - RNA, 18 nt, Human
gauaaaucagugguuauu

SEQ ID NO: 2326444 - RNA, 19 nt, Human
gauaacuagauggugcuga

SEQ ID NO: 2326445 - RNA, 22 nt, Human
gauaaauggcuuccuggcaaua

SEQ ID NO: 2326446 - RNA, 20 nt, Human
gaguucauacccuguuacca

SEQ ID NO: 2326447 - RNA, 14 nt, Human
gaguucaucuugaa

SEQ ID NO: 2326448 - RNA, 19 nt, Human
gaguucaucuugaauugua

SEQ ID NO: 2326449 - RNA, 20 nt, Human
gaguucaucuugaauuguaa

SEQ ID NO: 2326450 - RNA, 13 nt, Human
gaguuacagacaa

SEQ ID NO: 2326451 - RNA, 15 nt, Human
gaguuacagacaaag

SEQ ID NO: 2326452 - RNA, 18 nt, Human
gaguuacagcgagaggca

SEQ ID NO: 2326453 - RNA, 19 nt, Human
gaguuacagcgagaggcag

SEQ ID NO: 2326454 - RNA, 21 nt, Human
gaguuaagaccuggcagcucu

SEQ ID NO: 2326455 - RNA, 17 nt, Human
gaguuaagaccuggcag

SEQ ID NO: 2326456 - RNA, 11 nt, Human
gaguguagaag

SEQ ID NO: 2326457 - RNA, 13 nt, Human
gaguguacaagua

SEQ ID NO: 2326458 - RNA, 13 nt, Human
gaguguagaagca

SEQ ID NO: 2326459 - RNA, 14 nt, Human
gaguguagaagcau

SEQ ID NO: 2326460 - RNA, 15 nt, Human
gaguguagaagcauu

SEQ ID NO: 2326461 - RNA, 16 nt, Human
gaguguagaagcauuc

SEQ ID NO: 2326462 - RNA, 23 nt, Human
gaguguccuaggaguauccucau

SEQ ID NO: 2326463 - RNA, 21 nt, Human
gaguguauguagggcauaaug

SEQ ID NO: 2326464 - RNA, 11 nt, Human
gaguguaguga

SEQ ID NO: 2326465 - RNA, 20 nt, Human
gaguguagaagcauuccuuc

SEQ ID NO: 2326466 - RNA, 14 nt, Human
gaguguaaguguga

SEQ ID NO: 2326467 - RNA, 14 nt, Human
gaguggucuuucug

SEQ ID NO: 2326468 - RNA, 19 nt, Human
gagugguggcucaugccug

SEQ ID NO: 2326469 - RNA, 21 nt, Human
gaguggucuuucuggagaggu

SEQ ID NO: 2326470 - RNA, 16 nt, Human
gaguggucagaacaga

SEQ ID NO: 2326471 - RNA, 20 nt, Human
gaguguaagugugaguaaga

SEQ ID NO: 2326472 - RNA, 17 nt, Human
gaguguaagugugagua

SEQ ID NO: 2326473 - RNA, 18 nt, Human
gaguguacuuaacuauuc

SEQ ID NO: 2326474 - RNA, 15 nt, Human
gaguggguugauuuc

SEQ ID NO: 2326475 - RNA, 13 nt, Human
gagugggugaaua

SEQ ID NO: 2326476 - RNA, 17 nt, Human
gagugacagaggcagcc

SEQ ID NO: 2326477 - RNA, 21 nt, Human
gagugaagaggggcagcccuu

SEQ ID NO: 2326478 - RNA, 21 nt, Human
gagugggguuaucucuguguu

SEQ ID NO: 2326479 - RNA, 17 nt, Human
gaguguggcuccccucu

SEQ ID NO: 2326480 - RNA, 16 nt, Human
gaguguggcugaggag

SEQ ID NO: 2326481 - RNA, 16 nt, Human
gaguguggcuccccuc

SEQ ID NO: 2326482 - RNA, 14 nt, Human
gagugugcuggagg

SEQ ID NO: 2326483 - RNA, 15 nt, Human
gagugugcuggagga

SEQ ID NO: 2326484 - RNA, 18 nt, Human
gagugugcuggaggacug

SEQ ID NO: 2326485 - RNA, 17 nt, Human
gaguguggaagccggag

SEQ ID NO: 2326486 - RNA, 18 nt, Human
gagugugggaagggagag

SEQ ID NO: 2326487 - RNA, 12 nt, Human
gagugugggaag

SEQ ID NO: 2326488 - RNA, 13 nt, Human
gaguguguaauuu

SEQ ID NO: 2326489 - RNA, 20 nt, Human
gagugugccugaagucccag

SEQ ID NO: 2326490 - RNA, 19 nt, Human
gagugucuuaauuaaaaga

SEQ ID NO: 2326491 - RNA, 17 nt, Human
gaguuaaaaagggcagg

SEQ ID NO: 2326492 - RNA, 22 nt, Human
gaguuaaauagaguauaugcac

SEQ ID NO: 2326493 - RNA, 18 nt, Human
gaguuaacgggugaauaa

SEQ ID NO: 2326494 - RNA, 13 nt, Human
gaguuaagaagcu

SEQ ID NO: 2326495 - RNA, 14 nt, Human
gaguuaagaagcug

SEQ ID NO: 2326496 - RNA, 12 nt, Human
gaguuacagaca

SEQ ID NO: 2326497 - RNA, 14 nt, Human
gaguuaagaccugg

SEQ ID NO: 2326498 - RNA, 13 nt, Human
gaguuaagaccug

SEQ ID NO: 2326499 - RNA, 12 nt, Human
gaguuaagaccu

SEQ ID NO: 2326500 - RNA, 16 nt, Human
gaguuaagaagcuguu

SEQ ID NO: 2326501 - RNA, 21 nt, Human
gaguuaagaagcuguuguaca

SEQ ID NO: 2326502 - RNA, 14 nt, Human
gaguauuggucucc

SEQ ID NO: 2326503 - RNA, 17 nt, Human
gaguccucacucccagu

SEQ ID NO: 2326504 - RNA, 16 nt, Human
gaguccucacucccag

SEQ ID NO: 2326505 - RNA, 19 nt, Human
gaguccgaaagggacuugg

SEQ ID NO: 2326506 - RNA, 13 nt, Human
gaguccucugaau

SEQ ID NO: 2326507 - RNA, 12 nt, Human
gaguccucugga

SEQ ID NO: 2326508 - RNA, 14 nt, Human
gagucgaggacagg

SEQ ID NO: 2326509 - RNA, 18 nt, Human
gaguccuuaaacagggca

SEQ ID NO: 2326510 - RNA, 22 nt, Human
gagucguggggugugcugggag

SEQ ID NO: 2326511 - RNA, 20 nt, Human
gagucuagaaguuguuuguc

SEQ ID NO: 2326512 - RNA, 15 nt, Human
gagucgaggacaggg

SEQ ID NO: 2326513 - RNA, 16 nt, Human
gagucgaggacaggga

SEQ ID NO: 2326514 - RNA, 11 nt, Human
gaguauauguc

SEQ ID NO: 2326515 - RNA, 16 nt, Human
gaguaucugggaacug

SEQ ID NO: 2326516 - RNA, 23 nt, Human
gaguaucucggaccuuucagcug

SEQ ID NO: 2326517 - RNA, 19 nt, Human
gaguauguguuugugugug

SEQ ID NO: 2326518 - RNA, 22 nt, Human
gaguauguuaagcucuuuauga

SEQ ID NO: 2326519 - RNA, 23 nt, Human
gaguaucuccucgcaagcugggu

SEQ ID NO: 2326520 - RNA, 17 nt, Human
gaguaucaggucuccca

SEQ ID NO: 2326521 - RNA, 20 nt, Human
gaguaguugauguugcauuu

SEQ ID NO: 2326522 - RNA, 16 nt, Human
gaguauaggccggucu

SEQ ID NO: 2326523 - RNA, 12 nt, Human
gaguauaugcac

SEQ ID NO: 2326524 - RNA, 14 nt, Human
gaguauaugcacuu

SEQ ID NO: 2326525 - RNA, 21 nt, Human
gaguaguugauguugcauuuu

SEQ ID NO: 2326526 - RNA, 18 nt, Human
gaguagccgagagccugc

SEQ ID NO: 2326527 - RNA, 21 nt, Human
gaguagccaggguguggcccu

SEQ ID NO: 2326528 - RNA, 18 nt, Human
gaguaggaagacuuugga

SEQ ID NO: 2326529 - RNA, 19 nt, Human
gaguaggaagacuuuggaa

SEQ ID NO: 2326530 - RNA, 20 nt, Human
gagucuuggcggcagcagcc

SEQ ID NO: 2326531 - RNA, 22 nt, Human
gagucuugcuaccucagucagu

SEQ ID NO: 2326532 - RNA, 12 nt, Human
gagucugucuca

SEQ ID NO: 2326533 - RNA, 12 nt, Human
gagucugucucu

SEQ ID NO: 2326534 - RNA, 15 nt, Human
gagucugucucuguc

SEQ ID NO: 2326535 - RNA, 18 nt, Human
gagucugucucugucaug

SEQ ID NO: 2326536 - RNA, 23 nt, Human
gagucugaagcagaugcaaagag

SEQ ID NO: 2326537 - RNA, 23 nt, Human
gagucuggugaagcucacuucug

SEQ ID NO: 2326538 - RNA, 15 nt, Human
gagucugaaggcugg

SEQ ID NO: 2326539 - RNA, 14 nt, Human
gagucugaaggcug

SEQ ID NO: 2326540 - RNA, 12 nt, Human
gagucugaaggc

SEQ ID NO: 2326541 - RNA, 13 nt, Human
gagucugaaggcu

SEQ ID NO: 2326542 - RNA, 15 nt, Human
gagucuaucaaucaa

SEQ ID NO: 2326543 - RNA, 15 nt, Human
gagucugaagcagau

SEQ ID NO: 2326544 - RNA, 20 nt, Human
gagucuugcuaccucaguca

SEQ ID NO: 2326545 - RNA, 21 nt, Human
gagucuuggcggcagcagcca

SEQ ID NO: 2326546 - RNA, 20 nt, Human
gagugaaaccuuuagggcag

SEQ ID NO: 2326547 - RNA, 21 nt, Human
gagugaaaccuuuagggcagc

SEQ ID NO: 2326548 - RNA, 15 nt, Human
gagugaaccaucauu

SEQ ID NO: 2326549 - RNA, 22 nt, Human
gagugaaaccuuuagggcagcu

SEQ ID NO: 2326550 - RNA, 23 nt, Human
gagugaaaccuuuagggcagcuu

SEQ ID NO: 2326551 - RNA, 14 nt, Human
gagugaagaggggc

SEQ ID NO: 2326552 - RNA, 16 nt, Human
gagugaaccuaccuuc

SEQ ID NO: 2326553 - RNA, 15 nt, Human
gagugaagaggggca

SEQ ID NO: 2326554 - RNA, 16 nt, Human
gagugaagaggggcag

SEQ ID NO: 2326555 - RNA, 17 nt, Human
gagugaagcugggagaa

SEQ ID NO: 2326556 - RNA, 14 nt, Human
gagugacagaggca

SEQ ID NO: 2326557 - RNA, 14 nt, Human
gagugaauaaaugu

SEQ ID NO: 2326558 - RNA, 15 nt, Human
gagugaauaaauguc

SEQ ID NO: 2326559 - RNA, 17 nt, Human
gagugaagaggggcagc

SEQ ID NO: 2326560 - RNA, 18 nt, Human
gagugaagaggggcagcc

SEQ ID NO: 2326561 - RNA, 19 nt, Human
gagugaagaggggcagccc

SEQ ID NO: 2326562 - RNA, 20 nt, Human
gagugaagaggggcagcccu

SEQ ID NO: 2326563 - RNA, 15 nt, Human
gagugacagaggcag

SEQ ID NO: 2326564 - RNA, 16 nt, Human
gagugacagaggcagc

SEQ ID NO: 2326565 - RNA, 22 nt, Human
gaguagaaagacagagcuggga

SEQ ID NO: 2326566 - RNA, 15 nt, Human
gaguagaaaggccuu

SEQ ID NO: 2326567 - RNA, 17 nt, Human
gaguagaaaggccuuua

SEQ ID NO: 2326568 - RNA, 23 nt, Human
gaguagaaaggccuuuaaaauuu

SEQ ID NO: 2326569 - RNA, 14 nt, Human
gaguagaauugcau

SEQ ID NO: 2326570 - RNA, 17 nt, Human
gaguagaauugcauuga

SEQ ID NO: 2326571 - RNA, 19 nt, Human
gaguagcugggacuacagg

SEQ ID NO: 2326572 - RNA, 17 nt, Human
gaguagccgagagccug

SEQ ID NO: 2326573 - RNA, 18 nt, Human
gaguagauggugaaauuu

SEQ ID NO: 2326574 - RNA, 22 nt, Human
gaguagcaaguucuagagaaga

SEQ ID NO: 2326575 - RNA, 22 nt, Human
gaguagcugggacuacaggcac

SEQ ID NO: 2326576 - RNA, 12 nt, Human
gaguaggaagac

SEQ ID NO: 2326577 - RNA, 13 nt, Human
gaguaggaagacu

SEQ ID NO: 2326578 - RNA, 17 nt, Human
gaguaggaagacuuugg

SEQ ID NO: 2326579 - RNA, 17 nt, Human
gaguagaaagacagagc

SEQ ID NO: 2326580 - RNA, 20 nt, Human
gaguagaaagacagagcugg

SEQ ID NO: 2326581 - RNA, 19 nt, Human
gaguagaaacugcagggaa

SEQ ID NO: 2326582 - RNA, 16 nt, Human
gaguaauuuauuguuu

SEQ ID NO: 2326583 - RNA, 14 nt, Human
gaguaauuuauugu

SEQ ID NO: 2326584 - RNA, 21 nt, Human
gaguacuacaguccucccauc

SEQ ID NO: 2326585 - RNA, 23 nt, Human
gaguacuacaguccucccaucuc

SEQ ID NO: 2326586 - RNA, 13 nt, Human
gaguaaucugugu

SEQ ID NO: 2326587 - RNA, 12 nt, Human
gaguaagagcug

SEQ ID NO: 2326588 - RNA, 22 nt, Human
gaguaauccaagcaaaugugaa

SEQ ID NO: 2326589 - RNA, 22 nt, Human
gaguaaucuguguacaaagaaa

SEQ ID NO: 2326590 - RNA, 22 nt, Human
gaguaauggguuucauauuucu

SEQ ID NO: 2326591 - RNA, 20 nt, Human
gaguacuacaguccucccau

SEQ ID NO: 2326592 - RNA, 13 nt, Human
gagguuucaguga

SEQ ID NO: 2326593 - RNA, 19 nt, Human
gagguuuaggucaagaaga

SEQ ID NO: 2326594 - RNA, 17 nt, Human
gagguugggguguacua

SEQ ID NO: 2326595 - RNA, 19 nt, Human
gagguugcagugagcugag

SEQ ID NO: 2326596 - RNA, 14 nt, Human
gagguugggugggc

SEQ ID NO: 2326597 - RNA, 16 nt, Human
gagguuucaaaccucc

SEQ ID NO: 2326598 - RNA, 13 nt, Human
gagguugcaggga

SEQ ID NO: 2326599 - RNA, 18 nt, Human
gagguugauaacuuugcu

SEQ ID NO: 2326600 - RNA, 19 nt, Human
gagguugauaacuuugcuu

SEQ ID NO: 2326601 - RNA, 13 nt, Human
gagguugaagcca

SEQ ID NO: 2326602 - RNA, 15 nt, Human
gagguugaagccaag

SEQ ID NO: 2326603 - RNA, 15 nt, Human
gagguugauaacuuu

SEQ ID NO: 2326604 - RNA, 15 nt, Human
gagguugcagugagc

SEQ ID NO: 2326605 - RNA, 19 nt, Human
gagguugcagggagccgag

SEQ ID NO: 2326606 - RNA, 13 nt, Human
gagguugcagugu

SEQ ID NO: 2326607 - RNA, 19 nt, Human
gagguugcagugagccaag

SEQ ID NO: 2326608 - RNA, 20 nt, Human
gagguugaucagaucugaca

SEQ ID NO: 2326609 - RNA, 15 nt, Human
gagguugggaggcca

SEQ ID NO: 2326610 - RNA, 17 nt, Human
gagguugggaggccauu

SEQ ID NO: 2326611 - RNA, 20 nt, Human
gagguggucugaauguucug

SEQ ID NO: 2326612 - RNA, 17 nt, Human
gagguggucugaauguu

SEQ ID NO: 2326613 - RNA, 16 nt, Human
gagguggucugaaugu

SEQ ID NO: 2326614 - RNA, 13 nt, Human
gagguggucugaa

SEQ ID NO: 2326615 - RNA, 15 nt, Human
gaggugggguuggga

SEQ ID NO: 2326616 - RNA, 19 nt, Human
gagguggucugaauguucu

SEQ ID NO: 2326617 - RNA, 20 nt, Human
gagguguauggagagaaaac

SEQ ID NO: 2326618 - RNA, 14 nt, Human
gaggugucaggcug

SEQ ID NO: 2326619 - RNA, 15 nt, Human
gaggugucaggcugc

SEQ ID NO: 2326620 - RNA, 18 nt, Human
gaggugucaggcugcugg

SEQ ID NO: 2326621 - RNA, 22 nt, Human
gaggugucaggcugcuggcgcc

SEQ ID NO: 2326622 - RNA, 18 nt, Human
gagguuccucugccugcc

SEQ ID NO: 2326623 - RNA, 19 nt, Human
gagguuccucugccugccc

SEQ ID NO: 2326624 - RNA, 15 nt, Human
gaggugugggggcug

SEQ ID NO: 2326625 - RNA, 16 nt, Human
gagguuccucugccug

SEQ ID NO: 2326626 - RNA, 17 nt, Human
gagguuccucugccugc

SEQ ID NO: 2326627 - RNA, 16 nt, Human
gagguguggagccgag

SEQ ID NO: 2326628 - RNA, 12 nt, Human
gaggugggccca

SEQ ID NO: 2326629 - RNA, 14 nt, Human
gaggugggcccagg

SEQ ID NO: 2326630 - RNA, 15 nt, Human
gaggugggcccagga

SEQ ID NO: 2326631 - RNA, 22 nt, Human
gaggugggcccaggaccagcug

SEQ ID NO: 2326632 - RNA, 23 nt, Human
gaggugggcccaggaccagcugg

SEQ ID NO: 2326633 - RNA, 23 nt, Human
gaggucagcaugucuauucagcu

SEQ ID NO: 2326634 - RNA, 21 nt, Human
gaggugggccagucuguggau

SEQ ID NO: 2326635 - RNA, 21 nt, Human
gaggucacuggaaaggggaga

SEQ ID NO: 2326636 - RNA, 18 nt, Human
gaggucacuggaaagggg

SEQ ID NO: 2326637 - RNA, 20 nt, Human
gaggucacuggaaaggggag

SEQ ID NO: 2326638 - RNA, 17 nt, Human
gaggucagagccugcag

SEQ ID NO: 2326639 - RNA, 20 nt, Human
gaggucagagccugcaguua

SEQ ID NO: 2326640 - RNA, 14 nt, Human
gcagaaggccaaga

SEQ ID NO: 2326641 - RNA, 15 nt, Human
gcagaaggccaagaa

SEQ ID NO: 2326642 - RNA, 22 nt, Human
gcagaaggaagggcauccuucu

SEQ ID NO: 2326643 - RNA, 14 nt, Human
gcagaagggggugg

SEQ ID NO: 2326644 - RNA, 13 nt, Human
gcagaagggagaa

SEQ ID NO: 2326645 - RNA, 15 nt, Human
gcagaagggagaagg

SEQ ID NO: 2326646 - RNA, 11 nt, Human
gcagaauaaag

SEQ ID NO: 2326647 - RNA, 15 nt, Human
gcagaaggggguggu

SEQ ID NO: 2326648 - RNA, 22 nt, Human
gcagaaggggguggugucucca

SEQ ID NO: 2326649 - RNA, 19 nt, Human
gcacugucucaguuucacu

SEQ ID NO: 2326650 - RNA, 22 nt, Human
gcacuguccugcuccacagugu

SEQ ID NO: 2326651 - RNA, 21 nt, Human
gcacuggguugcaggggauug

SEQ ID NO: 2326652 - RNA, 20 nt, Human
gcacugucucaguuucacuu

SEQ ID NO: 2326653 - RNA, 11 nt, Human
gcacugugaag

SEQ ID NO: 2326654 - RNA, 18 nt, Human
gcacugugaaggacccuu

SEQ ID NO: 2326655 - RNA, 17 nt, Human
gcacugugaaggacccu

SEQ ID NO: 2326656 - RNA, 16 nt, Human
gcacugugaaggaccc

SEQ ID NO: 2326657 - RNA, 14 nt, Human
gcacugugaaggac

SEQ ID NO: 2326658 - RNA, 19 nt, Human
gcacugugacccccagcuc

SEQ ID NO: 2326659 - RNA, 11 nt, Human
gcacugugcua

SEQ ID NO: 2326660 - RNA, 14 nt, Human
gcacugugcuaaua

SEQ ID NO: 2326661 - RNA, 13 nt, Human
gcacugugcucag

SEQ ID NO: 2326662 - RNA, 14 nt, Human
gcacugugcucagg

SEQ ID NO: 2326663 - RNA, 16 nt, Human
gcacugugcucagggc

SEQ ID NO: 2326664 - RNA, 18 nt, Human
gcacugugcucagggcua

SEQ ID NO: 2326665 - RNA, 19 nt, Human
gcacuguggguagacacac

SEQ ID NO: 2326666 - RNA, 21 nt, Human
gcagacagcagcucaggcaca

SEQ ID NO: 2326667 - RNA, 14 nt, Human
gcagacaggaggaa

SEQ ID NO: 2326668 - RNA, 12 nt, Human
gcagacaggcaa

SEQ ID NO: 2326669 - RNA, 13 nt, Human
gcagacaggcaag

SEQ ID NO: 2326670 - RNA, 14 nt, Human
gcagacaggcaagc

SEQ ID NO: 2326671 - RNA, 20 nt, Human
gcagacagcagcucaggcac

SEQ ID NO: 2326672 - RNA, 19 nt, Human
gcagacagcagcucaggca

SEQ ID NO: 2326673 - RNA, 18 nt, Human
gcagacagcagcucaggc

SEQ ID NO: 2326674 - RNA, 17 nt, Human
gcagacagcagcucagg

SEQ ID NO: 2326675 - RNA, 16 nt, Human
gcagacagcagcucag

SEQ ID NO: 2326676 - RNA, 14 nt, Human
gcagacagcagcuc

SEQ ID NO: 2326677 - RNA, 13 nt, Human
gcagacagcagcu

SEQ ID NO: 2326678 - RNA, 14 nt, Human
gcagaauaaagcaa

SEQ ID NO: 2326679 - RNA, 23 nt, Human
gcagacacagggacuugaaguug

SEQ ID NO: 2326680 - RNA, 12 nt, Human
gcagaauaaagc

SEQ ID NO: 2326681 - RNA, 13 nt, Human
gcagaauaaagca

SEQ ID NO: 2326682 - RNA, 15 nt, Human
gcagacaccuuggac

SEQ ID NO: 2326683 - RNA, 23 nt, Human
gcagacacggaucugagaaucuu

SEQ ID NO: 2326684 - RNA, 16 nt, Human
gcagacacggaucuga

SEQ ID NO: 2326685 - RNA, 18 nt, Human
gcacuggaguccagucuc

SEQ ID NO: 2326686 - RNA, 17 nt, Human
gcacuggaguccagucu

SEQ ID NO: 2326687 - RNA, 14 nt, Human
gcacuggaguccag

SEQ ID NO: 2326688 - RNA, 11 nt, Human
gcacugcugug

SEQ ID NO: 2326689 - RNA, 14 nt, Human
gcacuggagugcag

SEQ ID NO: 2326690 - RNA, 15 nt, Human
gcacuggagugcagg

SEQ ID NO: 2326691 - RNA, 16 nt, Human
gcacuggagugcaggg

SEQ ID NO: 2326692 - RNA, 17 nt, Human
gcacugcuugaggaaaa

SEQ ID NO: 2326693 - RNA, 16 nt, Human
gcacugcuugaggaaa

SEQ ID NO: 2326694 - RNA, 15 nt, Human
gcacugcugugcugu

SEQ ID NO: 2326695 - RNA, 23 nt, Human
gcacugcuuccagugaggcucug

SEQ ID NO: 2326696 - RNA, 13 nt, Human
gcacugcugggug

SEQ ID NO: 2326697 - RNA, 14 nt, Human
gcacugcugggugg

SEQ ID NO: 2326698 - RNA, 15 nt, Human
gcacugcuggguggc

SEQ ID NO: 2326699 - RNA, 17 nt, Human
gcacugcuggguggccc

SEQ ID NO: 2326700 - RNA, 18 nt, Human
gcacugcuggguggccca

SEQ ID NO: 2326701 - RNA, 19 nt, Human
gcacugcuggguggcccau

SEQ ID NO: 2326702 - RNA, 21 nt, Human
gcacugcuggguggcccaucc

SEQ ID NO: 2326703 - RNA, 22 nt, Human
gcacugcuggguggcccauccc

SEQ ID NO: 2326704 - RNA, 18 nt, Human
gcacuggguugacuuuca

SEQ ID NO: 2326705 - RNA, 16 nt, Human
gcacugggggcagcgg

SEQ ID NO: 2326706 - RNA, 18 nt, Human
gcacuggguugcagggga

SEQ ID NO: 2326707 - RNA, 14 nt, Human
gcacugguggcccg

SEQ ID NO: 2326708 - RNA, 21 nt, Human
gcacuguccugcuccacagug

SEQ ID NO: 2326709 - RNA, 19 nt, Human
gcacuggcauugucccugu

SEQ ID NO: 2326710 - RNA, 20 nt, Human
gcacuggcauugucccugug

SEQ ID NO: 2326711 - RNA, 21 nt, Human
gcacugagauauuuauuguuu

SEQ ID NO: 2326712 - RNA, 13 nt, Human
gcacugagcagag

SEQ ID NO: 2326713 - RNA, 11 nt, Human
gcacugagccc

SEQ ID NO: 2326714 - RNA, 12 nt, Human
gcacugagcccc

SEQ ID NO: 2326715 - RNA, 15 nt, Human
gcacugagauauuua

SEQ ID NO: 2326716 - RNA, 21 nt, Human
gcacugagauaccagcgagga

SEQ ID NO: 2326717 - RNA, 11 nt, Human
gcacugaggaa

SEQ ID NO: 2326718 - RNA, 13 nt, Human
gcacugagccccc

SEQ ID NO: 2326719 - RNA, 14 nt, Human
gcacugagcccccc

SEQ ID NO: 2326720 - RNA, 13 nt, Human
gcacugaggaaga

SEQ ID NO: 2326721 - RNA, 12 nt, Human
gcacugcugccc

SEQ ID NO: 2326722 - RNA, 14 nt, Human
gcacugcugcccag

SEQ ID NO: 2326723 - RNA, 15 nt, Human
gcacugcugcccagc

SEQ ID NO: 2326724 - RNA, 18 nt, Human
gcacugcugcccagccuc

SEQ ID NO: 2326725 - RNA, 20 nt, Human
gcacugcugcccagccucca

SEQ ID NO: 2326726 - RNA, 16 nt, Human
gcacgcacacacacaa

SEQ ID NO: 2326727 - RNA, 14 nt, Human
gcacgcacacacac

SEQ ID NO: 2326728 - RNA, 15 nt, Human
gcacgcacacacaca

SEQ ID NO: 2326729 - RNA, 10 nt, Human
gcacgcacac

SEQ ID NO: 2326730 - RNA, 11 nt, Human
gcacgcacaca

SEQ ID NO: 2326731 - RNA, 12 nt, Human
gcacgcacacac

SEQ ID NO: 2326732 - RNA, 13 nt, Human
gcacgcacacaca

SEQ ID NO: 2326733 - RNA, 18 nt, Human
gcacugacuucuaaguaa

SEQ ID NO: 2326734 - RNA, 16 nt, Human
gcacgauuucuguuua

SEQ ID NO: 2326735 - RNA, 15 nt, Human
gcacugacuucuaag

SEQ ID NO: 2326736 - RNA, 22 nt, Human
gcacagauggauuugccugugc

SEQ ID NO: 2326737 - RNA, 20 nt, Human
gcacaggugggcuucccagu

SEQ ID NO: 2326738 - RNA, 19 nt, Human
gcacagauggauuugccug

SEQ ID NO: 2326739 - RNA, 18 nt, Human
gcacagauggauuugccu

SEQ ID NO: 2326740 - RNA, 24 nt, Human
gcacagauggauuugccugugcca

SEQ ID NO: 2326741 - RNA, 21 nt, Human
gcacaggugggcuucccagug

SEQ ID NO: 2326742 - RNA, 16 nt, Human
gcacagugaagugcug

SEQ ID NO: 2326743 - RNA, 15 nt, Human
gcacagauggauuug

SEQ ID NO: 2326744 - RNA, 13 nt, Human
gcacagauggauu

SEQ ID NO: 2326745 - RNA, 23 nt, Human
gcacagagcucuccagcuccaag

SEQ ID NO: 2326746 - RNA, 22 nt, Human
gcacagaguuguuacauuuuua

SEQ ID NO: 2326747 - RNA, 21 nt, Human
gcacagaguuguuacauuuuu

SEQ ID NO: 2326748 - RNA, 19 nt, Human
gcacagaguuguuacauuu

SEQ ID NO: 2326749 - RNA, 18 nt, Human
gcacagaguuguuacauu

SEQ ID NO: 2326750 - RNA, 16 nt, Human
gcacagaguuguuaca

SEQ ID NO: 2326751 - RNA, 15 nt, Human
gcacagugcaucuca

SEQ ID NO: 2326752 - RNA, 18 nt, Human
gcacagugcaucucagcc

SEQ ID NO: 2326753 - RNA, 13 nt, Human
gcacagugcaucu

SEQ ID NO: 2326754 - RNA, 12 nt, Human
gcacagugauuu

SEQ ID NO: 2326755 - RNA, 12 nt, Human
gcacauguuucc

SEQ ID NO: 2326756 - RNA, 12 nt, Human
gcacaugugugc

SEQ ID NO: 2326757 - RNA, 17 nt, Human
gcacauucuuagaguua

SEQ ID NO: 2326758 - RNA, 23 nt, Human
gcaccaggcacgaacccaccugc

SEQ ID NO: 2326759 - RNA, 21 nt, Human
gcaccaggcacgaacccaccu

SEQ ID NO: 2326760 - RNA, 16 nt, Human
gcaccagggguuucuc

SEQ ID NO: 2326761 - RNA, 18 nt, Human
gcaccagggguuucucgc

SEQ ID NO: 2326762 - RNA, 20 nt, Human
gcaccagggacuaugaaugg

SEQ ID NO: 2326763 - RNA, 23 nt, Human
gcaccaggguugaccccagagga

SEQ ID NO: 2326764 - RNA, 19 nt, Human
gcaccagggguuucucgca

SEQ ID NO: 2326765 - RNA, 16 nt, Human
gcacauuuccccagac

SEQ ID NO: 2326766 - RNA, 23 nt, Human
gcacauuuaagagacagucaccc

SEQ ID NO: 2326767 - RNA, 17 nt, Human
gcacauuuaagagacag

SEQ ID NO: 2326768 - RNA, 21 nt, Human
gcacauuuaagagacagucac

SEQ ID NO: 2326769 - RNA, 22 nt, Human
gcacauuuccccagaccugagc

SEQ ID NO: 2326770 - RNA, 19 nt, Human
gcacauuuccccagaccug

SEQ ID NO: 2326771 - RNA, 20 nt, Human
gcaccaggcacgaacccacc

SEQ ID NO: 2326772 - RNA, 18 nt, Human
gcaccaaaauaagaaaag

SEQ ID NO: 2326773 - RNA, 17 nt, Human
gcaccaaaauaagaaaa

SEQ ID NO: 2326774 - RNA, 21 nt, Human
gcaccccccugggcugagaga

SEQ ID NO: 2326775 - RNA, 14 nt, Human
gcaccccccugggc

SEQ ID NO: 2326776 - RNA, 13 nt, Human
gcaccccccuggg

SEQ ID NO: 2326777 - RNA, 14 nt, Human
gcaccccccaagcu

SEQ ID NO: 2326778 - RNA, 21 nt, Human
gcaccuguacucaggaggcug

SEQ ID NO: 2326779 - RNA, 19 nt, Human
gcaccuguacucaggaggc

SEQ ID NO: 2326780 - RNA, 15 nt, Human
gcaccuggggagugg

SEQ ID NO: 2326781 - RNA, 17 nt, Human
gcaccuggggaguggga

SEQ ID NO: 2326782 - RNA, 21 nt, Human
gcaccuguaaucccagcuacu

SEQ ID NO: 2326783 - RNA, 12 nt, Human
gcaccauaacuu

SEQ ID NO: 2326784 - RNA, 22 nt, Human
gcaccccagcuggggccaggcu

SEQ ID NO: 2326785 - RNA, 18 nt, Human
gcacccccacccuuuggg

SEQ ID NO: 2326786 - RNA, 15 nt, Human
gcacccccacccuuu

SEQ ID NO: 2326787 - RNA, 14 nt, Human
gcacccccacccuu

SEQ ID NO: 2326788 - RNA, 13 nt, Human
gcacccccacccu

SEQ ID NO: 2326789 - RNA, 17 nt, Human
gcaccccaugcuguuga

SEQ ID NO: 2326790 - RNA, 14 nt, Human
gcaccaucccuuuu

SEQ ID NO: 2326791 - RNA, 15 nt, Human
gcaccccaugcuguu

SEQ ID NO: 2326792 - RNA, 18 nt, Human
gcaccuuaccaacuuucu

SEQ ID NO: 2326793 - RNA, 22 nt, Human
gcaccugucccagaaaaagcau

SEQ ID NO: 2326794 - RNA, 19 nt, Human
gcaccugucccagaaaaag

SEQ ID NO: 2326795 - RNA, 15 nt, Human
gcaccugucccagaa

SEQ ID NO: 2326796 - RNA, 20 nt, Human
gcaccuuagacagucccugc

SEQ ID NO: 2326797 - RNA, 21 nt, Human
gcaccuuagacagucccugcc

SEQ ID NO: 2326798 - RNA, 16 nt, Human
gcaccuuccucacuuc

SEQ ID NO: 2326799 - RNA, 14 nt, Human
gcaccuugugucug

SEQ ID NO: 2326800 - RNA, 15 nt, Human
gcaccuuccucacuu

SEQ ID NO: 2326801 - RNA, 19 nt, Human
gcaccuuaccaacuuucug

SEQ ID NO: 2326802 - RNA, 13 nt, Human
gcaccuuaguggc

SEQ ID NO: 2326803 - RNA, 16 nt, Human
gcaccuuaguggcuuu

SEQ ID NO: 2326804 - RNA, 14 nt, Human
gcaccuucagacuu

SEQ ID NO: 2326805 - RNA, 15 nt, Human
gcacgauuucuguuu

SEQ ID NO: 2326806 - RNA, 13 nt, Human
gcacgauuucugu

SEQ ID NO: 2326807 - RNA, 22 nt, Human
gcacaaaauucgaccugauuua

SEQ ID NO: 2326808 - RNA, 13 nt, Human
gcacaaauauuua

SEQ ID NO: 2326809 - RNA, 23 nt, Human
gcacaaaaugauggacccaaugc

SEQ ID NO: 2326810 - RNA, 23 nt, Human
gcacaaaauucgaccugauuuac

SEQ ID NO: 2326811 - RNA, 18 nt, Human
gcacaaacucaccaucug

SEQ ID NO: 2326812 - RNA, 15 nt, Human
gcacaaacagaggcc

SEQ ID NO: 2326813 - RNA, 16 nt, Human
gcacaaacagaggccg

SEQ ID NO: 2326814 - RNA, 18 nt, Human
gcaauuuugcauuugaau

SEQ ID NO: 2326815 - RNA, 17 nt, Human
gcaauuuuccuugaagc

SEQ ID NO: 2326816 - RNA, 19 nt, Human
gcaauuuuccuugaagccg

SEQ ID NO: 2326817 - RNA, 14 nt, Human
gcaauuuuguaacg

SEQ ID NO: 2326818 - RNA, 20 nt, Human
gcaauuuuccuugaagccga

SEQ ID NO: 2326819 - RNA, 19 nt, Human
gcaauuuuaauugauuauu

SEQ ID NO: 2326820 - RNA, 10 nt, Human
gcaauuuucc

SEQ ID NO: 2326821 - RNA, 11 nt, Human
gcaauuuuccu

SEQ ID NO: 2326822 - RNA, 13 nt, Human
gcaauuuuccuug

SEQ ID NO: 2326823 - RNA, 14 nt, Human
gcaauuuuccuuga

SEQ ID NO: 2326824 - RNA, 15 nt, Human
gcaauuuuccuugaa

SEQ ID NO: 2326825 - RNA, 14 nt, Human
gcacaaacagaggc

SEQ ID NO: 2326826 - RNA, 23 nt, Human
gcaauuuuuccaugaaguuugaa

SEQ ID NO: 2326827 - RNA, 23 nt, Human
gcacaaaacccagaccuguuagc

SEQ ID NO: 2326828 - RNA, 13 nt, Human
gcacaaaacccag

SEQ ID NO: 2326829 - RNA, 17 nt, Human
gcaauuuauuaaaauga

SEQ ID NO: 2326830 - RNA, 14 nt, Human
gcaauuucauaugc

SEQ ID NO: 2326831 - RNA, 14 nt, Human
gcaaagggcugaaa

SEQ ID NO: 2326832 - RNA, 18 nt, Human
gcaauuuccuuuuuuguu

SEQ ID NO: 2326833 - RNA, 18 nt, Human
gcaauuuguuugugcuuc

SEQ ID NO: 2326834 - RNA, 20 nt, Human
gcaauuuguuugugcuucua

SEQ ID NO: 2326835 - RNA, 15 nt, Human
gcaauugcuuaggau

SEQ ID NO: 2326836 - RNA, 14 nt, Human
gcaauugggauggc

SEQ ID NO: 2326837 - RNA, 16 nt, Human
gcaauuuauacaauau

SEQ ID NO: 2326838 - RNA, 19 nt, Human
gcaauuuauacaauaucau

SEQ ID NO: 2326839 - RNA, 23 nt, Human
gcaauuuaauauuuugcacaguu

SEQ ID NO: 2326840 - RNA, 17 nt, Human
gcaauuccgcauuuaau

SEQ ID NO: 2326841 - RNA, 18 nt, Human
gcaauugaauuaaauuag

SEQ ID NO: 2326842 - RNA, 20 nt, Human
gcaauucuccugccucagcc

SEQ ID NO: 2326843 - RNA, 19 nt, Human
gcaauucuccugccucagc

SEQ ID NO: 2326844 - RNA, 18 nt, Human
gcaauucuccugccucag

SEQ ID NO: 2326845 - RNA, 17 nt, Human
gcaauucuccugccuca

SEQ ID NO: 2326846 - RNA, 16 nt, Human
gcaauucuccugccuc

SEQ ID NO: 2326847 - RNA, 15 nt, Human
gcaauucuccugccu

SEQ ID NO: 2326848 - RNA, 14 nt, Human
gcaauucuccugcc

SEQ ID NO: 2326849 - RNA, 14 nt, Human
gcaauguuuuccuu

SEQ ID NO: 2326850 - RNA, 21 nt, Human
gcaauuaaagugauacugaaa

SEQ ID NO: 2326851 - RNA, 15 nt, Human
gcaauuccgcauuua

SEQ ID NO: 2326852 - RNA, 21 nt, Human
gcaauuccccucugcugcugu

SEQ ID NO: 2326853 - RNA, 14 nt, Human
gcaauuccccucug

SEQ ID NO: 2326854 - RNA, 18 nt, Human
gcaauuccccucugcugc

SEQ ID NO: 2326855 - RNA, 14 nt, Human
gcaaugugcuacug

SEQ ID NO: 2326856 - RNA, 14 nt, Human
gcaaugucugugcu

SEQ ID NO: 2326857 - RNA, 15 nt, Human
gcaaugucugugcua

SEQ ID NO: 2326858 - RNA, 22 nt, Human
gcaaugucaggaacagaaggau

SEQ ID NO: 2326859 - RNA, 19 nt, Human
gcaaugucugagugaaccu

SEQ ID NO: 2326860 - RNA, 15 nt, Human
gcaaugugggcagag

SEQ ID NO: 2326861 - RNA, 20 nt, Human
gcaaugucaggaacagaagg

SEQ ID NO: 2326862 - RNA, 22 nt, Human
gcaauguagaggggaaaagaga

SEQ ID NO: 2326863 - RNA, 14 nt, Human
gcaaugugauaaaa

SEQ ID NO: 2326864 - RNA, 14 nt, Human
gcaacucaucuuag

SEQ ID NO: 2326865 - RNA, 22 nt, Human
gcaacucaaggacuuugcagcc

SEQ ID NO: 2326866 - RNA, 18 nt, Human
gcaacggggaggccaagu

SEQ ID NO: 2326867 - RNA, 13 nt, Human
gcaacacacagac

SEQ ID NO: 2326868 - RNA, 15 nt, Human
gcaauggcagccuug

SEQ ID NO: 2326869 - RNA, 20 nt, Human
gcaaugguguugcccugagu

SEQ ID NO: 2326870 - RNA, 23 nt, Human
gcaaugguguugcccugagugga

SEQ ID NO: 2326871 - RNA, 14 nt, Human
gcaaugggcacugg

SEQ ID NO: 2326872 - RNA, 16 nt, Human
gcaaugggcacuggga

SEQ ID NO: 2326873 - RNA, 20 nt, Human
gcaaugggagcugaggccac

SEQ ID NO: 2326874 - RNA, 19 nt, Human
gcaaugggagcugaggcca

SEQ ID NO: 2326875 - RNA, 16 nt, Human
gcacaaauauuuauuu

SEQ ID NO: 2326876 - RNA, 15 nt, Human
gcacaaauauuuauu

SEQ ID NO: 2326877 - RNA, 14 nt, Human
gcacaaauauuuau

SEQ ID NO: 2326878 - RNA, 23 nt, Human
gcacaaauucugucucuggauua

SEQ ID NO: 2326879 - RNA, 19 nt, Human
gcacaacuuuaagaggaca

SEQ ID NO: 2326880 - RNA, 11 nt, Human
gcacaagaagc

SEQ ID NO: 2326881 - RNA, 24 nt, Human
gcacaagaagcgugagacgccacc

SEQ ID NO: 2326882 - RNA, 17 nt, Human
gcacaagaagcgugaga

SEQ ID NO: 2326883 - RNA, 23 nt, Human
gcacaagcaaaagggugucugag

SEQ ID NO: 2326884 - RNA, 21 nt, Human
gcacaagcuccaagcucccag

SEQ ID NO: 2326885 - RNA, 18 nt, Human
gcacaagcuccaagcucc

SEQ ID NO: 2326886 - RNA, 15 nt, Human
gcacaagcuccaagc

SEQ ID NO: 2326887 - RNA, 17 nt, Human
gcacaagcuccaagcuc

SEQ ID NO: 2326888 - RNA, 14 nt, Human
gcacacgccuccca

SEQ ID NO: 2326889 - RNA, 17 nt, Human
gcacacgccucccacug

SEQ ID NO: 2326890 - RNA, 19 nt, Human
gcacacgccucccacuggg

SEQ ID NO: 2326891 - RNA, 20 nt, Human
gcacaccgggcacucagaag

SEQ ID NO: 2326892 - RNA, 20 nt, Human
gcacacucauccccucacuu

SEQ ID NO: 2326893 - RNA, 15 nt, Human
gcacacuccccugca

SEQ ID NO: 2326894 - RNA, 21 nt, Human
gcacacuccccugcacuggag

SEQ ID NO: 2326895 - RNA, 17 nt, Human
gcacacgucauguuucu

SEQ ID NO: 2326896 - RNA, 23 nt, Human
gcacacggggugcgucuccccgg

SEQ ID NO: 2326897 - RNA, 12 nt, Human
gcacacuguagc

SEQ ID NO: 2326898 - RNA, 20 nt, Human
gcacacuccccugcacugga

SEQ ID NO: 2326899 - RNA, 14 nt, Human
gcacacuuugccau

SEQ ID NO: 2326900 - RNA, 13 nt, Human
gcacacuuugcca

SEQ ID NO: 2326901 - RNA, 20 nt, Human
gcacacuuugcacugauaua

SEQ ID NO: 2326902 - RNA, 14 nt, Human
gcacacuuggccca

SEQ ID NO: 2326903 - RNA, 20 nt, Human
gcacacuuggcccaaguggc

SEQ ID NO: 2326904 - RNA, 22 nt, Human
gcacacuuugccauauuuucac

SEQ ID NO: 2326905 - RNA, 20 nt, Human
gcacagaaaauggaagacag

SEQ ID NO: 2326906 - RNA, 19 nt, Human
gcacagagagggggccacc

SEQ ID NO: 2326907 - RNA, 23 nt, Human
gcacagagagggggccaccuccc

SEQ ID NO: 2326908 - RNA, 17 nt, Human
gcacagagcucuccagc

SEQ ID NO: 2326909 - RNA, 18 nt, Human
gcacagagcucuccagcu

SEQ ID NO: 2326910 - RNA, 19 nt, Human
gcacagagcucuccagcuc

SEQ ID NO: 2326911 - RNA, 15 nt, Human
gcacagaguuguuac

SEQ ID NO: 2326912 - RNA, 18 nt, Human
gcacagacgucccuccac

SEQ ID NO: 2326913 - RNA, 16 nt, Human
gcacagagaagacaaa

SEQ ID NO: 2326914 - RNA, 15 nt, Human
gcacagagagggggc

SEQ ID NO: 2326915 - RNA, 17 nt, Human
gcacagagagggggcca

SEQ ID NO: 2326916 - RNA, 22 nt, Human
gcacagacccugcccugugggc

SEQ ID NO: 2326917 - RNA, 18 nt, Human
gcacagacccugcccugu

SEQ ID NO: 2326918 - RNA, 19 nt, Human
gcacagacccugcccugug

SEQ ID NO: 2326919 - RNA, 20 nt, Human
gcacagacccugcccugugg

SEQ ID NO: 2326920 - RNA, 21 nt, Human
gcacagacccugcccuguggg

SEQ ID NO: 2326921 - RNA, 12 nt, Human
gcacagaaggag

SEQ ID NO: 2326922 - RNA, 20 nt, Human
gcacagaaacacaauauuuu

SEQ ID NO: 2326923 - RNA, 21 nt, Human
gcacagaaaccucuacuaaaa

SEQ ID NO: 2326924 - RNA, 23 nt, Human
gcacagaaaauggaagacagcuc

SEQ ID NO: 2326925 - RNA, 21 nt, Human
gcacagaaaauggaagacagc

SEQ ID NO: 2326926 - RNA, 22 nt, Human
gcacagaaaauggaagacagcu

SEQ ID NO: 2326927 - RNA, 14 nt, Human
gcacagacccugcc

SEQ ID NO: 2326928 - RNA, 15 nt, Human
gcacagacccugccc

SEQ ID NO: 2326929 - RNA, 16 nt, Human
gcacagacccugcccu

SEQ ID NO: 2326930 - RNA, 17 nt, Human
gcacagacccugcccug

SEQ ID NO: 2326931 - RNA, 22 nt, Human
gaugggucugguuugcagagcu

SEQ ID NO: 2326932 - RNA, 21 nt, Human
gaugggucuggcugagcugaa

SEQ ID NO: 2326933 - RNA, 21 nt, Human
gaugggucaguuguaucagca

SEQ ID NO: 2326934 - RNA, 15 nt, Human
gaugggucaguugua

SEQ ID NO: 2326935 - RNA, 23 nt, Human
gaugggucugguuugcagagcuu

SEQ ID NO: 2326936 - RNA, 21 nt, Human
gauggguucuaauuuuggaug

SEQ ID NO: 2326937 - RNA, 22 nt, Human
gauggguucuaauuuuggaugg

SEQ ID NO: 2326938 - RNA, 18 nt, Human
gauggguuugacaagguu

SEQ ID NO: 2326939 - RNA, 19 nt, Human
gaugggugcuuggaggaag

SEQ ID NO: 2326940 - RNA, 22 nt, Human
gauggggugggguggagaacuc

SEQ ID NO: 2326941 - RNA, 16 nt, Human
gauggggucuguaaaa

SEQ ID NO: 2326942 - RNA, 19 nt, Human
gauggggcucccgcccgug

SEQ ID NO: 2326943 - RNA, 19 nt, Human
gauggggcugcaccggcug

SEQ ID NO: 2326944 - RNA, 15 nt, Human
gauggggcugcaccg

SEQ ID NO: 2326945 - RNA, 13 nt, Human
gauggggccucug

SEQ ID NO: 2326946 - RNA, 20 nt, Human
gaugggaugguggagggcca

SEQ ID NO: 2326947 - RNA, 19 nt, Human
gaugggaugguggagggcc

SEQ ID NO: 2326948 - RNA, 13 nt, Human
gauggggcugcac

SEQ ID NO: 2326949 - RNA, 18 nt, Human
gauggccggagaggaccg

SEQ ID NO: 2326950 - RNA, 15 nt, Human
gaugggagugagaca

SEQ ID NO: 2326951 - RNA, 20 nt, Human
gaugggagggaggcucaggu

SEQ ID NO: 2326952 - RNA, 20 nt, Human
gaugggcaacccccagccug

SEQ ID NO: 2326953 - RNA, 21 nt, Human
gaugggcaacccccagccugc

SEQ ID NO: 2326954 - RNA, 24 nt, Human
gauggggcccugccuccuuuguga

SEQ ID NO: 2326955 - RNA, 12 nt, Human
gauggccagugu

SEQ ID NO: 2326956 - RNA, 12 nt, Human
gauggccccagc

SEQ ID NO: 2326957 - RNA, 21 nt, Human
gaugcugaaacaggagagaaa

SEQ ID NO: 2326958 - RNA, 15 nt, Human
gaugcugacuaguga

SEQ ID NO: 2326959 - RNA, 22 nt, Human
gauggcaggauggccuggccag

SEQ ID NO: 2326960 - RNA, 15 nt, Human
gauggcauccuguga

SEQ ID NO: 2326961 - RNA, 21 nt, Human
gauggcauccugugaaguccu

SEQ ID NO: 2326962 - RNA, 15 nt, Human
gauggcccuucccac

SEQ ID NO: 2326963 - RNA, 22 nt, Human
gauggcccuucccacuggaggu

SEQ ID NO: 2326964 - RNA, 14 nt, Human
gauggccccagcac

SEQ ID NO: 2326965 - RNA, 15 nt, Human
gauggccccagcaca

SEQ ID NO: 2326966 - RNA, 22 nt, Human
gauggccgggcgcgguggcuca

SEQ ID NO: 2326967 - RNA, 17 nt, Human
gaugcccacugaggaau

SEQ ID NO: 2326968 - RNA, 18 nt, Human
gaugcccagagggcccag

SEQ ID NO: 2326969 - RNA, 20 nt, Human
gaugcccagagggcccaggc

SEQ ID NO: 2326970 - RNA, 19 nt, Human
gaugcccagagggcccagg

SEQ ID NO: 2326971 - RNA, 23 nt, Human
gaugcccagagggcccaggcagg

SEQ ID NO: 2326972 - RNA, 22 nt, Human
gaugcccagagggcccaggcag

SEQ ID NO: 2326973 - RNA, 22 nt, Human
gaugcccagggccacucugccu

SEQ ID NO: 2326974 - RNA, 21 nt, Human
gaugcccagggccacucugcc

SEQ ID NO: 2326975 - RNA, 20 nt, Human
gaugcccagggccacucugc

SEQ ID NO: 2326976 - RNA, 15 nt, Human
gaugcccacugagga

SEQ ID NO: 2326977 - RNA, 20 nt, Human
gaugcccaaagaugcagccg

SEQ ID NO: 2326978 - RNA, 18 nt, Human
gaugccaucugugggcac

SEQ ID NO: 2326979 - RNA, 22 nt, Human
gaugccagguucuauuuggaau

SEQ ID NO: 2326980 - RNA, 21 nt, Human
gaugccaguaggcucaacuag

SEQ ID NO: 2326981 - RNA, 11 nt, Human
gaugccaggac

SEQ ID NO: 2326982 - RNA, 14 nt, Human
gaugccagguucua

SEQ ID NO: 2326983 - RNA, 19 nt, Human
gaugcccaaagaugcagcc

SEQ ID NO: 2326984 - RNA, 15 nt, Human
gaucagaacagcaga

SEQ ID NO: 2326985 - RNA, 16 nt, Human
gaucagaccauaaugu

SEQ ID NO: 2326986 - RNA, 14 nt, Human
gaucagagcagcag

SEQ ID NO: 2326987 - RNA, 14 nt, Human
gaucagaucugaca

SEQ ID NO: 2326988 - RNA, 22 nt, Human
gaucagaccuuggaucagauga

SEQ ID NO: 2326989 - RNA, 23 nt, Human
gaucagagccgugguccuuuggg

SEQ ID NO: 2326990 - RNA, 16 nt, Human
gaucagagccgugguc

SEQ ID NO: 2326991 - RNA, 16 nt, Human
gaugccccagagcugu

SEQ ID NO: 2326992 - RNA, 12 nt, Human
gaugccccagag

SEQ ID NO: 2326993 - RNA, 16 nt, Human
gaugccccgucccccu

SEQ ID NO: 2326994 - RNA, 18 nt, Human
gaugcuagaacucccuuu

SEQ ID NO: 2326995 - RNA, 22 nt, Human
gaugcuagaacucccuuucaac

SEQ ID NO: 2326996 - RNA, 20 nt, Human
gaugcuagaacucccuuuca

SEQ ID NO: 2326997 - RNA, 20 nt, Human
gaugcugaaacaggagagaa

SEQ ID NO: 2326998 - RNA, 21 nt, Human
gaugcugacauucaccugccc

SEQ ID NO: 2326999 - RNA, 20 nt, Human
gaugcugacauucaccugcc

SEQ ID NO: 2327000 - RNA, 17 nt, Human
gaugcugacuguacucc

SEQ ID NO: 2327001 - RNA, 20 nt, Human
gaugcugacuguacuccucc

SEQ ID NO: 2327002 - RNA, 15 nt, Human
gaugcucuucugugg

SEQ ID NO: 2327003 - RNA, 21 nt, Human
gaugcuccuugggcccuuuga

SEQ ID NO: 2327004 - RNA, 16 nt, Human
gaugcuccuugggccc

SEQ ID NO: 2327005 - RNA, 14 nt, Human
gaugcuccuugggc

SEQ ID NO: 2327006 - RNA, 21 nt, Human
gaugccccgucccccucuggc

SEQ ID NO: 2327007 - RNA, 13 nt, Human
gaugcuccuuggg

SEQ ID NO: 2327008 - RNA, 17 nt, Human
gaugugggucaaggaau

SEQ ID NO: 2327009 - RNA, 20 nt, Human
gaugugggggaagaccuggc

SEQ ID NO: 2327010 - RNA, 20 nt, Human
gauguggcccuggccugcug

SEQ ID NO: 2327011 - RNA, 16 nt, Human
gauguggcugcagcag

SEQ ID NO: 2327012 - RNA, 18 nt, Human
gauguggcugcagcagcg

SEQ ID NO: 2327013 - RNA, 22 nt, Human
gaugugggagggagcagacagg

SEQ ID NO: 2327014 - RNA, 16 nt, Human
gaugugggggaagacc

SEQ ID NO: 2327015 - RNA, 23 nt, Human
gaugugggagggagcagacagga

SEQ ID NO: 2327016 - RNA, 14 nt, Human
gauguuaaccagaa

SEQ ID NO: 2327017 - RNA, 21 nt, Human
gauguuaacacauuuuguaua

SEQ ID NO: 2327018 - RNA, 22 nt, Human
gauguuaacacauuuuguauaa

SEQ ID NO: 2327019 - RNA, 20 nt, Human
gauguuacaucacaguguuu

SEQ ID NO: 2327020 - RNA, 23 nt, Human
gauguuacaucacaguguuugca

SEQ ID NO: 2327021 - RNA, 15 nt, Human
gauguggugaggcag

SEQ ID NO: 2327022 - RNA, 22 nt, Human
gauguggugaggcaggcuuugu

SEQ ID NO: 2327023 - RNA, 15 nt, Human
gauguggugccugag

SEQ ID NO: 2327024 - RNA, 20 nt, Human
gauguggugccugaggucug

SEQ ID NO: 2327025 - RNA, 22 nt, Human
gauguggugccugaggucugua

SEQ ID NO: 2327026 - RNA, 18 nt, Human
gauguuaacacauuuugu

SEQ ID NO: 2327027 - RNA, 19 nt, Human
gauguuaacacauuuugua

SEQ ID NO: 2327028 - RNA, 21 nt, Human
gauguggcccuggccugcugg

SEQ ID NO: 2327029 - RNA, 14 nt, Human
gauguggcccuggc

SEQ ID NO: 2327030 - RNA, 13 nt, Human
gauguggcccugg

SEQ ID NO: 2327031 - RNA, 12 nt, Human
gauguggcccug

SEQ ID NO: 2327032 - RNA, 17 nt, Human
gauguggaguggggcag

SEQ ID NO: 2327033 - RNA, 17 nt, Human
gaugguguuuuggggau

SEQ ID NO: 2327034 - RNA, 23 nt, Human
gaugguuauuuucuuuucuuuca

SEQ ID NO: 2327035 - RNA, 17 nt, Human
gaugguuauuuucuuuu

SEQ ID NO: 2327036 - RNA, 13 nt, Human
gaugguuccccug

SEQ ID NO: 2327037 - RNA, 18 nt, Human
gaugguuccccuguucac

SEQ ID NO: 2327038 - RNA, 21 nt, Human
gaugguuccccuguucacucu

SEQ ID NO: 2327039 - RNA, 23 nt, Human
gauggguucuaauuuuggaugga

SEQ ID NO: 2327040 - RNA, 14 nt, Human
gauggucagcuccc

SEQ ID NO: 2327041 - RNA, 24 nt, Human
gaugguccuggggcucugugcagg

SEQ ID NO: 2327042 - RNA, 21 nt, Human
gaugguccuggggcucugugc

SEQ ID NO: 2327043 - RNA, 15 nt, Human
gaugguccuggggcu

SEQ ID NO: 2327044 - RNA, 13 nt, Human
gaugguccugggg

SEQ ID NO: 2327045 - RNA, 12 nt, Human
gauggugcaaug

SEQ ID NO: 2327046 - RNA, 14 nt, Human
gauggugcaaugac

SEQ ID NO: 2327047 - RNA, 17 nt, Human
gauggugcaaugaccuu

SEQ ID NO: 2327048 - RNA, 24 nt, Human
gaugguguucaaaaaacuuguaaa

SEQ ID NO: 2327049 - RNA, 15 nt, Human
gauggucagcucccu

SEQ ID NO: 2327050 - RNA, 15 nt, Human
gauggugcaaugacc

SEQ ID NO: 2327051 - RNA, 16 nt, Human
gauggugcaaugaccu

SEQ ID NO: 2327052 - RNA, 18 nt, Human
gauuacaggcaugugcca

SEQ ID NO: 2327053 - RNA, 17 nt, Human
gauuacaggcuccugcc

SEQ ID NO: 2327054 - RNA, 20 nt, Human
gauuacaggcgugagccacc

SEQ ID NO: 2327055 - RNA, 23 nt, Human
gauuacaagcgugagccacugca

SEQ ID NO: 2327056 - RNA, 13 nt, Human
gauuacagaggaa

SEQ ID NO: 2327057 - RNA, 22 nt, Human
gauuacaagcgugagccacugc

SEQ ID NO: 2327058 - RNA, 16 nt, Human
gauuaaacgugcagac

SEQ ID NO: 2327059 - RNA, 16 nt, Human
gauguuuuucaugaaa

SEQ ID NO: 2327060 - RNA, 22 nt, Human
gauguuuuuaaaaguuucaaug

SEQ ID NO: 2327061 - RNA, 20 nt, Human
gauguuuuuaaaaguuucaa

SEQ ID NO: 2327062 - RNA, 21 nt, Human
gauguuuuuaaaaguuucaau

SEQ ID NO: 2327063 - RNA, 15 nt, Human
gauuaaacuuaaucu

SEQ ID NO: 2327064 - RNA, 23 nt, Human
gauguuuacagguggacacacaa

SEQ ID NO: 2327065 - RNA, 18 nt, Human
gauguuuaacuuaaucaa

SEQ ID NO: 2327066 - RNA, 18 nt, Human
gauguuuuuaaaaguuuc

SEQ ID NO: 2327067 - RNA, 16 nt, Human
gauguuuaguaaucau

SEQ ID NO: 2327068 - RNA, 15 nt, Human
gauguuggcugggaa

SEQ ID NO: 2327069 - RNA, 14 nt, Human
gauguuggcuggga

SEQ ID NO: 2327070 - RNA, 19 nt, Human
gauguucagauugcuuuga

SEQ ID NO: 2327071 - RNA, 20 nt, Human
gauguucagauugcuuugau

SEQ ID NO: 2327072 - RNA, 17 nt, Human
gauguucagcacugucc

SEQ ID NO: 2327073 - RNA, 19 nt, Human
gauguucagcacugucccu

SEQ ID NO: 2327074 - RNA, 20 nt, Human
gauguucagcacugucccuu

SEQ ID NO: 2327075 - RNA, 20 nt, Human
gauguuauguaaaaggccaa

SEQ ID NO: 2327076 - RNA, 23 nt, Human
gauguugaaugcccacaggcaaa

SEQ ID NO: 2327077 - RNA, 22 nt, Human
gauguucagcacugucccuugc

SEQ ID NO: 2327078 - RNA, 13 nt, Human
gauguucagugua

SEQ ID NO: 2327079 - RNA, 14 nt, Human
gauguucaguguaa

SEQ ID NO: 2327080 - RNA, 15 nt, Human
gauguucaguguaau

SEQ ID NO: 2327081 - RNA, 20 nt, Human
gauguucaguguaauuucuu

SEQ ID NO: 2327082 - RNA, 23 nt, Human
gauguucaguguaauuucuuugc

SEQ ID NO: 2327083 - RNA, 14 nt, Human
gauguucauuuaga

SEQ ID NO: 2327084 - RNA, 22 nt, Human
gcaaaccacacuggacuccggc

SEQ ID NO: 2327085 - RNA, 16 nt, Human
gcaaagauaucucauc

SEQ ID NO: 2327086 - RNA, 18 nt, Human
gcaaagaggcaagaggcu

SEQ ID NO: 2327087 - RNA, 12 nt, Human
gcaaagaucaaa

SEQ ID NO: 2327088 - RNA, 14 nt, Human
gcaaagaucaaaau

SEQ ID NO: 2327089 - RNA, 15 nt, Human
gcaaagaucaaaaua

SEQ ID NO: 2327090 - RNA, 15 nt, Human
gcaaaccaucauuga

SEQ ID NO: 2327091 - RNA, 22 nt, Human
gcaaagaucuguccucagccuu

SEQ ID NO: 2327092 - RNA, 21 nt, Human
gcaaagaucuguccucagccu

SEQ ID NO: 2327093 - RNA, 20 nt, Human
gcaaagaucuguccucagcc

SEQ ID NO: 2327094 - RNA, 19 nt, Human
gcaaagaucuguccucagc

SEQ ID NO: 2327095 - RNA, 16 nt, Human
gcaaagaucaaaauaa

SEQ ID NO: 2327096 - RNA, 18 nt, Human
gcaaagaucaaaauaaaa

SEQ ID NO: 2327097 - RNA, 17 nt, Human
gcaaaggaguagaaaga

SEQ ID NO: 2327098 - RNA, 23 nt, Human
gcaaaggacuguuuuuuccugag

SEQ ID NO: 2327099 - RNA, 13 nt, Human
gcaaaggcuggga

SEQ ID NO: 2327100 - RNA, 20 nt, Human
gcaaaggacuguuuuuuccu

SEQ ID NO: 2327101 - RNA, 20 nt, Human
gcaaaggaagguggauggcc

SEQ ID NO: 2327102 - RNA, 14 nt, Human
gcaaaggaaauacc

SEQ ID NO: 2327103 - RNA, 15 nt, Human
gcaaaggaaggugga

SEQ ID NO: 2327104 - RNA, 14 nt, Human
gcaaagcgacguua

SEQ ID NO: 2327105 - RNA, 21 nt, Human
gcaaagcugaugacaacuucc

SEQ ID NO: 2327106 - RNA, 22 nt, Human
gcaaagcaccagcuucuccagg

SEQ ID NO: 2327107 - RNA, 23 nt, Human
gcaaagcaccagcuucuccaggc

SEQ ID NO: 2327108 - RNA, 13 nt, Human
gcaaagcaccagc

SEQ ID NO: 2327109 - RNA, 21 nt, Human
gcaaagcaccagcuucuccag

SEQ ID NO: 2327110 - RNA, 12 nt, Human
gcaacacacaga

SEQ ID NO: 2327111 - RNA, 23 nt, Human
gcaacacaagcuggaagcacaug

SEQ ID NO: 2327112 - RNA, 17 nt, Human
gcaacacaagcuggaag

SEQ ID NO: 2327113 - RNA, 19 nt, Human
gcaacacaagcuggaagca

SEQ ID NO: 2327114 - RNA, 16 nt, Human
gcaacacaagcuggaa

SEQ ID NO: 2327115 - RNA, 14 nt, Human
gcaacaauuuauga

SEQ ID NO: 2327116 - RNA, 20 nt, Human
gcaacaagguccucugucag

SEQ ID NO: 2327117 - RNA, 22 nt, Human
gcaacaauacaugcugcuaauu

SEQ ID NO: 2327118 - RNA, 21 nt, Human
gcaaauuaauuggcagcagau

SEQ ID NO: 2327119 - RNA, 22 nt, Human
gcaacaagaccaccacuucgaa

SEQ ID NO: 2327120 - RNA, 12 nt, Human
gcaaauguguac

SEQ ID NO: 2327121 - RNA, 16 nt, Human
gcaaauugucacagga

SEQ ID NO: 2327122 - RNA, 20 nt, Human
gcaaagggagcacuggguug

SEQ ID NO: 2327123 - RNA, 18 nt, Human
gcaaagggagcacugggu

SEQ ID NO: 2327124 - RNA, 23 nt, Human
gcaaaugugaaucauuuuaccuu

SEQ ID NO: 2327125 - RNA, 16 nt, Human
gcaaaugugaccugug

SEQ ID NO: 2327126 - RNA, 17 nt, Human
gcaaagggagcagaacu

SEQ ID NO: 2327127 - RNA, 18 nt, Human
gcaaagggagcagaacug

SEQ ID NO: 2327128 - RNA, 15 nt, Human
gcaaauguggcuccu

SEQ ID NO: 2327129 - RNA, 15 nt, Human
gcaaaccacacugga

SEQ ID NO: 2327130 - RNA, 17 nt, Human
gcaaaccacacuggacu

SEQ ID NO: 2327131 - RNA, 18 nt, Human
gcaaaccacacuggacuc

SEQ ID NO: 2327132 - RNA, 20 nt, Human
gcaaaccacacuggacuccg

SEQ ID NO: 2327133 - RNA, 12 nt, Human
gcaaaccaucau

SEQ ID NO: 2327134 - RNA, 21 nt, Human
gcaaacaugggguuggcuggg

SEQ ID NO: 2327135 - RNA, 14 nt, Human
gauuuuuacacaug

SEQ ID NO: 2327136 - RNA, 15 nt, Human
gauuuuguuuugcuu

SEQ ID NO: 2327137 - RNA, 22 nt, Human
gauuuuguuuugcuuuuucuga

SEQ ID NO: 2327138 - RNA, 16 nt, Human
gauuuugcuguagaag

SEQ ID NO: 2327139 - RNA, 18 nt, Human
gauuuugcuguauauuug

SEQ ID NO: 2327140 - RNA, 15 nt, Human
gauuuugcuguauau

SEQ ID NO: 2327141 - RNA, 13 nt, Human
gauuuugccugug

SEQ ID NO: 2327142 - RNA, 18 nt, Human
gauuuugauagcaaagcg

SEQ ID NO: 2327143 - RNA, 14 nt, Human
gauuuugaguaucu

SEQ ID NO: 2327144 - RNA, 13 nt, Human
gauuuuguuuugc

SEQ ID NO: 2327145 - RNA, 14 nt, Human
gauuuuguuuugcu

SEQ ID NO: 2327146 - RNA, 13 nt, Human
gauuuuguaaccc

SEQ ID NO: 2327147 - RNA, 23 nt, Human
gauuuuguaucugcaggcagaca

SEQ ID NO: 2327148 - RNA, 16 nt, Human
gauuuuguaacccaga

SEQ ID NO: 2327149 - RNA, 19 nt, Human
gauuuugguuuuguucccc

SEQ ID NO: 2327150 - RNA, 22 nt, Human
gauuuugguuuuguuccccucc

SEQ ID NO: 2327151 - RNA, 21 nt, Human
gauuuugggguuguguuguca

SEQ ID NO: 2327152 - RNA, 19 nt, Human
gauuuuggccucauuacuu

SEQ ID NO: 2327153 - RNA, 21 nt, Human
gauuuugguauuacacuguau

SEQ ID NO: 2327154 - RNA, 13 nt, Human
gauuuuaauuuug

SEQ ID NO: 2327155 - RNA, 18 nt, Human
gauuuuaaucaaguugaa

SEQ ID NO: 2327156 - RNA, 15 nt, Human
gauuugcauugaaca

SEQ ID NO: 2327157 - RNA, 14 nt, Human
gauuugcaaaaaaa

SEQ ID NO: 2327158 - RNA, 16 nt, Human
gauuuuaacucugucu

SEQ ID NO: 2327159 - RNA, 14 nt, Human
gauuuuaacucugu

SEQ ID NO: 2327160 - RNA, 18 nt, Human
gauuuuacauguggccca

SEQ ID NO: 2327161 - RNA, 18 nt, Human
gauuuuacaauugaaaug

SEQ ID NO: 2327162 - RNA, 15 nt, Human
gauuuuaauuuugaa

SEQ ID NO: 2327163 - RNA, 19 nt, Human
gauuuuacaauugaaauga

SEQ ID NO: 2327164 - RNA, 17 nt, Human
gauuuuaaucaaguuga

SEQ ID NO: 2327165 - RNA, 21 nt, Human
gauuuugaaauuuuuauuaaa

SEQ ID NO: 2327166 - RNA, 19 nt, Human
gauuuugauccaagcuggu

SEQ ID NO: 2327167 - RNA, 24 nt, Human
gauuuucuuuaaaagaaugggcag

SEQ ID NO: 2327168 - RNA, 21 nt, Human
gauuuugaaaccaugaagaga

SEQ ID NO: 2327169 - RNA, 21 nt, Human
gauuuugaaaucaugaagaua

SEQ ID NO: 2327170 - RNA, 13 nt, Human
gauuuuaugcuuu

SEQ ID NO: 2327171 - RNA, 20 nt, Human
gauuuuaucugugaauucag

SEQ ID NO: 2327172 - RNA, 22 nt, Human
gauuuuaucuuucgcacagcag

SEQ ID NO: 2327173 - RNA, 22 nt, Human
gauugcguggaauugugcugag

SEQ ID NO: 2327174 - RNA, 13 nt, Human
gauugcuaaaugu

SEQ ID NO: 2327175 - RNA, 14 nt, Human
gauugcuaaaugua

SEQ ID NO: 2327176 - RNA, 16 nt, Human
gauugcuaaauguaac

SEQ ID NO: 2327177 - RNA, 20 nt, Human
gauuggggaagacuguggcu

SEQ ID NO: 2327178 - RNA, 17 nt, Human
gauugggccccugccag

SEQ ID NO: 2327179 - RNA, 13 nt, Human
gauuguaaaaaaa

SEQ ID NO: 2327180 - RNA, 20 nt, Human
gauugggugggcaggaaaag

SEQ ID NO: 2327181 - RNA, 19 nt, Human
gauugggugggcaggaaaa

SEQ ID NO: 2327182 - RNA, 18 nt, Human
gauuggguuaugaauauu

SEQ ID NO: 2327183 - RNA, 14 nt, Human
gauugggggcuggu

SEQ ID NO: 2327184 - RNA, 17 nt, Human
gauugggggcuggugcc

SEQ ID NO: 2327185 - RNA, 18 nt, Human
gauugggggcuggugcca

SEQ ID NO: 2327186 - RNA, 12 nt, Human
gauugggucuag

SEQ ID NO: 2327187 - RNA, 12 nt, Human
gauuuaaaucag

SEQ ID NO: 2327188 - RNA, 18 nt, Human
gauuguaaaaaaaaaugc

SEQ ID NO: 2327189 - RNA, 22 nt, Human
gauuguaaaaaaaaaugccuuu

SEQ ID NO: 2327190 - RNA, 12 nt, Human
gauuguaaaaua

SEQ ID NO: 2327191 - RNA, 20 nt, Human
gauuguaaaauagcuuguau

SEQ ID NO: 2327192 - RNA, 23 nt, Human
gauuguaaaauagcuuguauagu

SEQ ID NO: 2327193 - RNA, 18 nt, Human
gauuguaacguugcugug

SEQ ID NO: 2327194 - RNA, 14 nt, Human
gauuuaacagaaau

SEQ ID NO: 2327195 - RNA, 13 nt, Human
gauuuaacagaaa

SEQ ID NO: 2327196 - RNA, 16 nt, Human
gauuugaagcaaagca

SEQ ID NO: 2327197 - RNA, 12 nt, Human
gauuugacuguu

SEQ ID NO: 2327198 - RNA, 13 nt, Human
gauuugacuguuu

SEQ ID NO: 2327199 - RNA, 16 nt, Human
gauuugagcucagccc

SEQ ID NO: 2327200 - RNA, 14 nt, Human
gauuugacuguuuu

SEQ ID NO: 2327201 - RNA, 18 nt, Human
gauuugacuguuuuuacc

SEQ ID NO: 2327202 - RNA, 21 nt, Human
gauuugacuguuuuuacccau

SEQ ID NO: 2327203 - RNA, 22 nt, Human
gauuugaggagcagcuucaguu

SEQ ID NO: 2327204 - RNA, 23 nt, Human
gauuugaggagcagcuucaguug

SEQ ID NO: 2327205 - RNA, 15 nt, Human
gauuugaugcuggag

SEQ ID NO: 2327206 - RNA, 21 nt, Human
gauuugaugcuggagagguua

SEQ ID NO: 2327207 - RNA, 18 nt, Human
gauuugaugcuguuugac

SEQ ID NO: 2327208 - RNA, 18 nt, Human
gauuugaagaacauguga

SEQ ID NO: 2327209 - RNA, 20 nt, Human
gauuucgugggucuguuuuc

SEQ ID NO: 2327210 - RNA, 19 nt, Human
gauuucgugggucuguuuu

SEQ ID NO: 2327211 - RNA, 23 nt, Human
gauuucuagaaagccuguucccc

SEQ ID NO: 2327212 - RNA, 13 nt, Human
gauuugacauugc

SEQ ID NO: 2327213 - RNA, 20 nt, Human
gauuugaagaacaugugaga

SEQ ID NO: 2327214 - RNA, 19 nt, Human
gauuugaagaacaugugag

SEQ ID NO: 2327215 - RNA, 22 nt, Human
gauuuccguuaaaauaccagcc

SEQ ID NO: 2327216 - RNA, 15 nt, Human
gauuuaacagaaaug

SEQ ID NO: 2327217 - RNA, 13 nt, Human
gauuuccuugaau

SEQ ID NO: 2327218 - RNA, 22 nt, Human
gauuuccuugaauguggcuuga

SEQ ID NO: 2327219 - RNA, 17 nt, Human
gauuuccuugaaugugg

SEQ ID NO: 2327220 - RNA, 19 nt, Human
gauuguaacguugcugugg

SEQ ID NO: 2327221 - RNA, 22 nt, Human
gauuuccugcuuugggaagccg

SEQ ID NO: 2327222 - RNA, 18 nt, Human
gauuacagggaugagcca

SEQ ID NO: 2327223 - RNA, 20 nt, Human
gauuacagggaugagccacc

SEQ ID NO: 2327224 - RNA, 21 nt, Human
gauuacaggcuccugccacca

SEQ ID NO: 2327225 - RNA, 18 nt, Human
gauuacaggcuccugcca

SEQ ID NO: 2327226 - RNA, 20 nt, Human
gauucaaucuguaaacugug

SEQ ID NO: 2327227 - RNA, 22 nt, Human
gauucaaucuguaaacugugua

SEQ ID NO: 2327228 - RNA, 21 nt, Human
gauucaaucuguaaacugugu

SEQ ID NO: 2327229 - RNA, 11 nt, Human
gauucucagau

SEQ ID NO: 2327230 - RNA, 12 nt, Human
gauucucagggu

SEQ ID NO: 2327231 - RNA, 17 nt, Human
gauucucagggucucug

SEQ ID NO: 2327232 - RNA, 19 nt, Human
gauucucagggucucugcu

SEQ ID NO: 2327233 - RNA, 23 nt, Human
gauucucagggucucugcugccg

SEQ ID NO: 2327234 - RNA, 21 nt, Human
gauucucagggucucugcugc

SEQ ID NO: 2327235 - RNA, 22 nt, Human
gauucucagggucucugcugcc

SEQ ID NO: 2327236 - RNA, 21 nt, Human
gauucuauuuauauguacaug

SEQ ID NO: 2327237 - RNA, 20 nt, Human
gauucuauuuauauguacau

SEQ ID NO: 2327238 - RNA, 15 nt, Human
gauucuauuuauaug

SEQ ID NO: 2327239 - RNA, 18 nt, Human
gauucacaaugaaaugcu

SEQ ID NO: 2327240 - RNA, 22 nt, Human
gauucacaaugaaaugcucucc

SEQ ID NO: 2327241 - RNA, 22 nt, Human
gauugcauuagaaauagacagu

SEQ ID NO: 2327242 - RNA, 17 nt, Human
gauugcaugugacucug

SEQ ID NO: 2327243 - RNA, 19 nt, Human
gauugcagguggaacucag

SEQ ID NO: 2327244 - RNA, 23 nt, Human
gauugcaggagucccugccauca

SEQ ID NO: 2327245 - RNA, 14 nt, Human
gauucuccugccuc

SEQ ID NO: 2327246 - RNA, 16 nt, Human
gauucucaugccucag

SEQ ID NO: 2327247 - RNA, 13 nt, Human
gauugagaaggag

SEQ ID NO: 2327248 - RNA, 16 nt, Human
gauugagaaggagaga

SEQ ID NO: 2327249 - RNA, 17 nt, Human
gauugagaaggagagaa

SEQ ID NO: 2327250 - RNA, 18 nt, Human
gauugagaaggagagaaa

SEQ ID NO: 2327251 - RNA, 13 nt, Human
gauugaggccugc

SEQ ID NO: 2327252 - RNA, 16 nt, Human
gauugagucugugcca

SEQ ID NO: 2327253 - RNA, 19 nt, Human
gauugagaaggagagaaag

SEQ ID NO: 2327254 - RNA, 22 nt, Human
gauugaggccugcccucaggga

SEQ ID NO: 2327255 - RNA, 17 nt, Human
gauugauuugaagaaca

SEQ ID NO: 2327256 - RNA, 15 nt, Human
gauugauuugaagaa

SEQ ID NO: 2327257 - RNA, 19 nt, Human
gauugauagaguguuauca

SEQ ID NO: 2327258 - RNA, 22 nt, Human
gauugaucggagccuccucucu

SEQ ID NO: 2327259 - RNA, 15 nt, Human
gauugauaauugcau

SEQ ID NO: 2327260 - RNA, 14 nt, Human
gaauugcagaguac

SEQ ID NO: 2327261 - RNA, 13 nt, Human
gaauugcauugac

SEQ ID NO: 2327262 - RNA, 12 nt, Human
gaauugcauuga

SEQ ID NO: 2327263 - RNA, 18 nt, Human
gaauugauuugcauugaa

SEQ ID NO: 2327264 - RNA, 22 nt, Human
gaauugauuugcauugaacaca

SEQ ID NO: 2327265 - RNA, 16 nt, Human
gaauugccugcagaga

SEQ ID NO: 2327266 - RNA, 20 nt, Human
gaauugccugcagagagaag

SEQ ID NO: 2327267 - RNA, 16 nt, Human
gaauuggagcucgugg

SEQ ID NO: 2327268 - RNA, 22 nt, Human
gaauucuuacauguuuucuuug

SEQ ID NO: 2327269 - RNA, 19 nt, Human
gaauucuuacauguuuucu

SEQ ID NO: 2327270 - RNA, 18 nt, Human
gaauucuugaaggaaaau

SEQ ID NO: 2327271 - RNA, 21 nt, Human
gaauucuuaugcuuauaauau

SEQ ID NO: 2327272 - RNA, 21 nt, Human
gaauugacccacaagaaauga

SEQ ID NO: 2327273 - RNA, 16 nt, Human
gaauugacccacaaga

SEQ ID NO: 2327274 - RNA, 18 nt, Human
gaauucuuacauguuuuc

SEQ ID NO: 2327275 - RNA, 16 nt, Human
gaauguuuauagcaaa

SEQ ID NO: 2327276 - RNA, 20 nt, Human
gaauguuuacacucuuugua

SEQ ID NO: 2327277 - RNA, 14 nt, Human
gaauguugggacug

SEQ ID NO: 2327278 - RNA, 21 nt, Human
gaauguuuacacucuuuguaa

SEQ ID NO: 2327279 - RNA, 14 nt, Human
gaauguuuauuccu

SEQ ID NO: 2327280 - RNA, 20 nt, Human
gaauguuacauuguuugucu

SEQ ID NO: 2327281 - RNA, 17 nt, Human
gaauguuacauuguuug

SEQ ID NO: 2327282 - RNA, 21 nt, Human
gaauguuaaauaaauuguaua

SEQ ID NO: 2327283 - RNA, 16 nt, Human
gaauguuaaauaaauu

SEQ ID NO: 2327284 - RNA, 18 nt, Human
gaauguuaaauaaauugu

SEQ ID NO: 2327285 - RNA, 15 nt, Human
gaauguuaagcagau

SEQ ID NO: 2327286 - RNA, 20 nt, Human
gaauguucugacauuaacag

SEQ ID NO: 2327287 - RNA, 23 nt, Human
gaauguugggacugcuaaauaaa

SEQ ID NO: 2327288 - RNA, 19 nt, Human
gaauguucugacauuaaca

SEQ ID NO: 2327289 - RNA, 17 nt, Human
gaauguucugacauuaa

SEQ ID NO: 2327290 - RNA, 16 nt, Human
gaauguucugacauua

SEQ ID NO: 2327291 - RNA, 15 nt, Human
gaauguucugacauu

SEQ ID NO: 2327292 - RNA, 11 nt, Human
gaauguucuga

SEQ ID NO: 2327293 - RNA, 16 nt, Human
gaauguuaaagucagu

SEQ ID NO: 2327294 - RNA, 13 nt, Human
gaauguuaaauaa

SEQ ID NO: 2327295 - RNA, 14 nt, Human
gaauguuaaauaaa

SEQ ID NO: 2327296 - RNA, 14 nt, Human
gaauguuaagcaga

SEQ ID NO: 2327297 - RNA, 18 nt, Human
gaauguggcuugagaaau

SEQ ID NO: 2327298 - RNA, 22 nt, Human
gaauguggccccugaacaagaa

SEQ ID NO: 2327299 - RNA, 21 nt, Human
gaaugugcagguuuguuacau

SEQ ID NO: 2327300 - RNA, 18 nt, Human
gaauguguacaaagugua

SEQ ID NO: 2327301 - RNA, 22 nt, Human
gaaugucuuuguuggaaaagaa

SEQ ID NO: 2327302 - RNA, 16 nt, Human
gaaugucuuuugaaua

SEQ ID NO: 2327303 - RNA, 14 nt, Human
gaaugugaaagcac

SEQ ID NO: 2327304 - RNA, 17 nt, Human
gaaugugauuuuaaaga

SEQ ID NO: 2327305 - RNA, 19 nt, Human
gaaugugauuuuaaagagu

SEQ ID NO: 2327306 - RNA, 15 nt, Human
gaaugugcagguuug

SEQ ID NO: 2327307 - RNA, 14 nt, Human
gaaugugauuuuaa

SEQ ID NO: 2327308 - RNA, 16 nt, Human
gaauguaucaggaaau

SEQ ID NO: 2327309 - RNA, 19 nt, Human
gaaugucaguauguggaag

SEQ ID NO: 2327310 - RNA, 13 nt, Human
gaaugucagugug

SEQ ID NO: 2327311 - RNA, 17 nt, Human
gaauguaucaggaaaua

SEQ ID NO: 2327312 - RNA, 15 nt, Human
gaauguaucaggaaa

SEQ ID NO: 2327313 - RNA, 21 nt, Human
gaauguauauguuuuguggga

SEQ ID NO: 2327314 - RNA, 13 nt, Human
gaaugucaguaug

SEQ ID NO: 2327315 - RNA, 18 nt, Human
gaaugucaguauguggaa

SEQ ID NO: 2327316 - RNA, 16 nt, Human
gaaugucaguaugugg

SEQ ID NO: 2327317 - RNA, 15 nt, Human
gaauguagcugguuu

SEQ ID NO: 2327318 - RNA, 20 nt, Human
gaauguagcugguuuccuca

SEQ ID NO: 2327319 - RNA, 14 nt, Human
gaauguacucuguu

SEQ ID NO: 2327320 - RNA, 21 nt, Human
gaauggccugccuugaagcca

SEQ ID NO: 2327321 - RNA, 17 nt, Human
gaauggccugccuugaa

SEQ ID NO: 2327322 - RNA, 18 nt, Human
gaauggccuccucccuua

SEQ ID NO: 2327323 - RNA, 11 nt, Human
gaauguaauca

SEQ ID NO: 2327324 - RNA, 13 nt, Human
gaauguaaucaau

SEQ ID NO: 2327325 - RNA, 16 nt, Human
gaauguaaucaauguu

SEQ ID NO: 2327326 - RNA, 18 nt, Human
gaauguaaucaauguuuc

SEQ ID NO: 2327327 - RNA, 19 nt, Human
gaauguaaucaauguuucu

SEQ ID NO: 2327328 - RNA, 13 nt, Human
gaaucuauauuua

SEQ ID NO: 2327329 - RNA, 17 nt, Human
gaaucuacccaaaggau

SEQ ID NO: 2327330 - RNA, 15 nt, Human
gaaucuacuaauucc

SEQ ID NO: 2327331 - RNA, 19 nt, Human
gaaucgaggaaccagagcc

SEQ ID NO: 2327332 - RNA, 18 nt, Human
gaaucgaggaaccagagc

SEQ ID NO: 2327333 - RNA, 16 nt, Human
gaaucgaggaaccaga

SEQ ID NO: 2327334 - RNA, 14 nt, Human
gaaucgaggaacca

SEQ ID NO: 2327335 - RNA, 12 nt, Human
gaaucuaccaac

SEQ ID NO: 2327336 - RNA, 16 nt, Human
gaaucuacccaaagga

SEQ ID NO: 2327337 - RNA, 14 nt, Human
gaaucgcuucucuu

SEQ ID NO: 2327338 - RNA, 22 nt, Human
gaaucuacccccagauccaagc

SEQ ID NO: 2327339 - RNA, 18 nt, Human
gaaucuacccccagaucc

SEQ ID NO: 2327340 - RNA, 15 nt, Human
gaaucccaagaccca

SEQ ID NO: 2327341 - RNA, 18 nt, Human
gaaucccacccacaugug

SEQ ID NO: 2327342 - RNA, 22 nt, Human
gaaucccacccacaugugacac

SEQ ID NO: 2327343 - RNA, 14 nt, Human
gaauccaugcuugg

SEQ ID NO: 2327344 - RNA, 13 nt, Human
gaauccaugcuug

SEQ ID NO: 2327345 - RNA, 16 nt, Human
gaaucccaaauuugau

SEQ ID NO: 2327346 - RNA, 19 nt, Human
gaaucccaaauuugauuga

SEQ ID NO: 2327347 - RNA, 17 nt, Human
gaaucccaaauuugauu

SEQ ID NO: 2327348 - RNA, 18 nt, Human
gaauccagacccggcugc

SEQ ID NO: 2327349 - RNA, 20 nt, Human
gaauccagacccggcugcgu

SEQ ID NO: 2327350 - RNA, 19 nt, Human
gaaucauacuuagcaaagu

SEQ ID NO: 2327351 - RNA, 11 nt, Human
gaaucauguag

SEQ ID NO: 2327352 - RNA, 21 nt, Human
gaaucaguauaaacaaaguua

SEQ ID NO: 2327353 - RNA, 19 nt, Human
gaaucaguauaaacaaagu

SEQ ID NO: 2327354 - RNA, 20 nt, Human
gaaucaguauugggagccgg

SEQ ID NO: 2327355 - RNA, 21 nt, Human
gaaucaggaauauuuuccaaa

SEQ ID NO: 2327356 - RNA, 23 nt, Human
gaaucaggaauauuuuccaaaga

SEQ ID NO: 2327357 - RNA, 15 nt, Human
gaaucagugcaaaga

SEQ ID NO: 2327358 - RNA, 19 nt, Human
gaaucauaugauucugcuu

SEQ ID NO: 2327359 - RNA, 13 nt, Human
gaaucauguagua

SEQ ID NO: 2327360 - RNA, 14 nt, Human
gaaucauguaguau

SEQ ID NO: 2327361 - RNA, 17 nt, Human
gaaucaugucaggccug

SEQ ID NO: 2327362 - RNA, 20 nt, Human
gaaucaugucaggccugugu

SEQ ID NO: 2327363 - RNA, 21 nt, Human
gaaucaugucaggccugugug

SEQ ID NO: 2327364 - RNA, 19 nt, Human
gaaucaugugaacccggga

SEQ ID NO: 2327365 - RNA, 17 nt, Human
gaaucauucucgauuua

SEQ ID NO: 2327366 - RNA, 16 nt, Human
gaaaggccagcuggca

SEQ ID NO: 2327367 - RNA, 14 nt, Human
gaaaggccagcugg

SEQ ID NO: 2327368 - RNA, 12 nt, Human
gaaaggccagcu

SEQ ID NO: 2327369 - RNA, 17 nt, Human
gaaaggcauucucugaa

SEQ ID NO: 2327370 - RNA, 22 nt, Human
gaaaggccagcuggcagcagag

SEQ ID NO: 2327371 - RNA, 21 nt, Human
gaaaggccagcuggcagcaga

SEQ ID NO: 2327372 - RNA, 19 nt, Human
gaaaggccagcuggcagca

SEQ ID NO: 2327373 - RNA, 14 nt, Human
gaaaggccuuuaaa

SEQ ID NO: 2327374 - RNA, 15 nt, Human
gaaaggccuuuaaaa

SEQ ID NO: 2327375 - RNA, 19 nt, Human
gaaaggcucagucucagga

SEQ ID NO: 2327376 - RNA, 18 nt, Human
gaaaggcucagucucagg

SEQ ID NO: 2327377 - RNA, 14 nt, Human
gaaaggcucagucu

SEQ ID NO: 2327378 - RNA, 18 nt, Human
gaaaggccuuuaaaauuu

SEQ ID NO: 2327379 - RNA, 22 nt, Human
gaaaggcucagucucaggagca

SEQ ID NO: 2327380 - RNA, 21 nt, Human
gaaaggcucagucucaggagc

SEQ ID NO: 2327381 - RNA, 12 nt, Human
gaaaggcuccag

SEQ ID NO: 2327382 - RNA, 18 nt, Human
gaaucucugaauuugaga

SEQ ID NO: 2327383 - RNA, 17 nt, Human
gaaucuauauuuaacaa

SEQ ID NO: 2327384 - RNA, 18 nt, Human
gaaucucuuuuugcuuuc

SEQ ID NO: 2327385 - RNA, 15 nt, Human
gaaucucugugccuu

SEQ ID NO: 2327386 - RNA, 13 nt, Human
gaaucucugugcc

SEQ ID NO: 2327387 - RNA, 14 nt, Human
gaaucucugugccu

SEQ ID NO: 2327388 - RNA, 21 nt, Human
gaaugaaagggcccagagagg

SEQ ID NO: 2327389 - RNA, 21 nt, Human
gaaucuggaccccaucuguga

SEQ ID NO: 2327390 - RNA, 13 nt, Human
gaaugaacaaauu

SEQ ID NO: 2327391 - RNA, 20 nt, Human
gaaugaacacucuuuugcuu

SEQ ID NO: 2327392 - RNA, 16 nt, Human
gaaugaaauugcugaa

SEQ ID NO: 2327393 - RNA, 20 nt, Human
gaaugcacaaacagaggccg

SEQ ID NO: 2327394 - RNA, 12 nt, Human
gaaucuggagac

SEQ ID NO: 2327395 - RNA, 23 nt, Human
gaaucuggaccccaucugugaau

SEQ ID NO: 2327396 - RNA, 22 nt, Human
gaaucuggaccccaucugugaa

SEQ ID NO: 2327397 - RNA, 18 nt, Human
gaaugaaauacuguuuga

SEQ ID NO: 2327398 - RNA, 15 nt, Human
gaaugaaauacuguu

SEQ ID NO: 2327399 - RNA, 19 nt, Human
gaaugaaauacuguuugag

SEQ ID NO: 2327400 - RNA, 23 nt, Human
gaaugaaauccugcuucagugua

SEQ ID NO: 2327401 - RNA, 15 nt, Human
gaaugcuguauaugu

SEQ ID NO: 2327402 - RNA, 13 nt, Human
gaaugcuguguua

SEQ ID NO: 2327403 - RNA, 22 nt, Human
gaaugcacacuagccucuccag

SEQ ID NO: 2327404 - RNA, 20 nt, Human
gaaugcacacuagccucucc

SEQ ID NO: 2327405 - RNA, 21 nt, Human
gaaugcacaaacagaggccgc

SEQ ID NO: 2327406 - RNA, 16 nt, Human
gaauggcagcugccac

SEQ ID NO: 2327407 - RNA, 20 nt, Human
gaaugcuugaaaaaugugca

SEQ ID NO: 2327408 - RNA, 13 nt, Human
gaauggcagcugc

SEQ ID NO: 2327409 - RNA, 22 nt, Human
gaauggcacagcccaaagaagg

SEQ ID NO: 2327410 - RNA, 17 nt, Human
gaauggcacagcccaaa

SEQ ID NO: 2327411 - RNA, 15 nt, Human
gaaugcuucuucuca

SEQ ID NO: 2327412 - RNA, 13 nt, Human
gaaugcuugaaaa

SEQ ID NO: 2327413 - RNA, 16 nt, Human
gaaugcuugaaaaaug

SEQ ID NO: 2327414 - RNA, 17 nt, Human
gaaugcuugaaaaaugu

SEQ ID NO: 2327415 - RNA, 21 nt, Human
gaaugcuucugacuucauaga

SEQ ID NO: 2327416 - RNA, 18 nt, Human
gaaugcuucugacuucau

SEQ ID NO: 2327417 - RNA, 22 nt, Human
gaaugcuuauagguggccucuc

SEQ ID NO: 2327418 - RNA, 16 nt, Human
gaaugcuuccuagaag

SEQ ID NO: 2327419 - RNA, 18 nt, Human
gaaugcuuauagguggcc

SEQ ID NO: 2327420 - RNA, 14 nt, Human
gaaugcuguguuaa

SEQ ID NO: 2327421 - RNA, 19 nt, Human
gacaaggagaagagcaagg

SEQ ID NO: 2327422 - RNA, 17 nt, Human
gacaaggaaaggcaaau

SEQ ID NO: 2327423 - RNA, 19 nt, Human
gacaaggaaaggcaaaugc

SEQ ID NO: 2327424 - RNA, 16 nt, Human
gacaagaaaucccugu

SEQ ID NO: 2327425 - RNA, 15 nt, Human
gacaagaaaucccug

SEQ ID NO: 2327426 - RNA, 16 nt, Human
gacaaggaaaaaauaa

SEQ ID NO: 2327427 - RNA, 18 nt, Human
gacaaggauugcuacugu

SEQ ID NO: 2327428 - RNA, 21 nt, Human
gacaaggaugaucuaggaaga

SEQ ID NO: 2327429 - RNA, 19 nt, Human
gacaaggauugcuacuguc

SEQ ID NO: 2327430 - RNA, 21 nt, Human
gacaaggauugcuacuguccu

SEQ ID NO: 2327431 - RNA, 14 nt, Human
gacaaugucugaac

SEQ ID NO: 2327432 - RNA, 22 nt, Human
gacaaugcaaaccaucauugaa

SEQ ID NO: 2327433 - RNA, 18 nt, Human
gacaaugugaaaagaaaa

SEQ ID NO: 2327434 - RNA, 12 nt, Human
gacaaugugaaa

SEQ ID NO: 2327435 - RNA, 20 nt, Human
gacaaugugaaaagaaaaau

SEQ ID NO: 2327436 - RNA, 19 nt, Human
gacaaugugaaaagaaaaa

SEQ ID NO: 2327437 - RNA, 13 nt, Human
gacaauucuuuau

SEQ ID NO: 2327438 - RNA, 15 nt, Human
gacaauucuuuauac

SEQ ID NO: 2327439 - RNA, 22 nt, Human
gacaauucuuuauacaacagug

SEQ ID NO: 2327440 - RNA, 16 nt, Human
gacacaaaaaguagau

SEQ ID NO: 2327441 - RNA, 16 nt, Human
gacaauucaugaacuu

SEQ ID NO: 2327442 - RNA, 13 nt, Human
gacaauucaugaa

SEQ ID NO: 2327443 - RNA, 20 nt, Human
gacaccagccuuucucccag

SEQ ID NO: 2327444 - RNA, 23 nt, Human
gacaccagccaggcucugugcug

SEQ ID NO: 2327445 - RNA, 17 nt, Human
gacaccagccaggcucu

SEQ ID NO: 2327446 - RNA, 19 nt, Human
gacaccagccaggcucugu

SEQ ID NO: 2327447 - RNA, 19 nt, Human
gacaccagagcagaugcag

SEQ ID NO: 2327448 - RNA, 22 nt, Human
gacaccagagcagaugcagaga

SEQ ID NO: 2327449 - RNA, 14 nt, Human
gacaccagccaggc

SEQ ID NO: 2327450 - RNA, 15 nt, Human
gacaccagccaggcu

SEQ ID NO: 2327451 - RNA, 19 nt, Human
gacaccacacccagccuca

SEQ ID NO: 2327452 - RNA, 20 nt, Human
gacaccacacccagccucag

SEQ ID NO: 2327453 - RNA, 21 nt, Human
gacaccacacccagccucagu

SEQ ID NO: 2327454 - RNA, 12 nt, Human
gacaccagagca

SEQ ID NO: 2327455 - RNA, 13 nt, Human
gacaccagagcag

SEQ ID NO: 2327456 - RNA, 14 nt, Human
gacaccagagcaga

SEQ ID NO: 2327457 - RNA, 15 nt, Human
gacaccagagcagau

SEQ ID NO: 2327458 - RNA, 18 nt, Human
gacaccagagcagaugca

SEQ ID NO: 2327459 - RNA, 20 nt, Human
gacacauucaacccuggaga

SEQ ID NO: 2327460 - RNA, 21 nt, Human
gacacauucaacccuggagag

SEQ ID NO: 2327461 - RNA, 14 nt, Human
gacaccacacccag

SEQ ID NO: 2327462 - RNA, 15 nt, Human
gacaccacacccagc

SEQ ID NO: 2327463 - RNA, 16 nt, Human
gacaccacacccagcc

SEQ ID NO: 2327464 - RNA, 17 nt, Human
gacaccacacccagccu

SEQ ID NO: 2327465 - RNA, 18 nt, Human
gacaccacacccagccuc

SEQ ID NO: 2327466 - RNA, 19 nt, Human
gacacaugcaaggucauuu

SEQ ID NO: 2327467 - RNA, 15 nt, Human
gacacauguccaaga

SEQ ID NO: 2327468 - RNA, 20 nt, Human
gacacauguccaagaagccc

SEQ ID NO: 2327469 - RNA, 23 nt, Human
gacacauguccaagaagcccagg

SEQ ID NO: 2327470 - RNA, 14 nt, Human
gacacaacaacucc

SEQ ID NO: 2327471 - RNA, 13 nt, Human
gacacaggcccuc

SEQ ID NO: 2327472 - RNA, 14 nt, Human
gacacaugcaaggu

SEQ ID NO: 2327473 - RNA, 20 nt, Human
gacacaggcccggcuccagg

SEQ ID NO: 2327474 - RNA, 21 nt, Human
gacacaggcccggcuccaggc

SEQ ID NO: 2327475 - RNA, 19 nt, Human
gacacaggcccggcuccag

SEQ ID NO: 2327476 - RNA, 13 nt, Human
gacacaacuauuu

SEQ ID NO: 2327477 - RNA, 18 nt, Human
gacacaaaccugccuggg

SEQ ID NO: 2327478 - RNA, 20 nt, Human
gacacaaaccugccuggguu

SEQ ID NO: 2327479 - RNA, 17 nt, Human
gacacaaaccugccugg

SEQ ID NO: 2327480 - RNA, 14 nt, Human
gacacaaaccugcc

SEQ ID NO: 2327481 - RNA, 16 nt, Human
gacacaagccuucggc

SEQ ID NO: 2327482 - RNA, 16 nt, Human
gacaacgaggaagccc

SEQ ID NO: 2327483 - RNA, 15 nt, Human
gacaacgaggaagcc

SEQ ID NO: 2327484 - RNA, 17 nt, Human
gacaacguuucagcgac

SEQ ID NO: 2327485 - RNA, 21 nt, Human
gacaaccgaugcuccagccaa

SEQ ID NO: 2327486 - RNA, 14 nt, Human
gacaacgaggaagc

SEQ ID NO: 2327487 - RNA, 18 nt, Human
gacaacuuugccagcuuu

SEQ ID NO: 2327488 - RNA, 15 nt, Human
gacaagacuucagua

SEQ ID NO: 2327489 - RNA, 20 nt, Human
gacaaccgaugcuccagcca

SEQ ID NO: 2327490 - RNA, 19 nt, Human
gacaaccgaugcuccagcc

SEQ ID NO: 2327491 - RNA, 18 nt, Human
gacaaccgaugcuccagc

SEQ ID NO: 2327492 - RNA, 20 nt, Human
gacaacccugcaaaggacug

SEQ ID NO: 2327493 - RNA, 13 nt, Human
gacaacccugcaa

SEQ ID NO: 2327494 - RNA, 23 nt, Human
gacaaccaccgcuccccagccca

SEQ ID NO: 2327495 - RNA, 19 nt, Human
gacaaccacuggucuguag

SEQ ID NO: 2327496 - RNA, 12 nt, Human
gacaaccaugac

SEQ ID NO: 2327497 - RNA, 15 nt, Human
gacaaccacuggucu

SEQ ID NO: 2327498 - RNA, 17 nt, Human
gacaaccacuggucugu

SEQ ID NO: 2327499 - RNA, 12 nt, Human
gacaacauuaaa

SEQ ID NO: 2327500 - RNA, 17 nt, Human
gacaaccaccgcucccc

SEQ ID NO: 2327501 - RNA, 22 nt, Human
gacaaccaccgcuccccagccc

SEQ ID NO: 2327502 - RNA, 19 nt, Human
gacaaccaccgcuccccag

SEQ ID NO: 2327503 - RNA, 18 nt, Human
gacaaccaccgcucccca

SEQ ID NO: 2327504 - RNA, 16 nt, Human
gacaacagacuucuga

SEQ ID NO: 2327505 - RNA, 12 nt, Human
gacaacagaagc

SEQ ID NO: 2327506 - RNA, 11 nt, Human
gacaacaucug

SEQ ID NO: 2327507 - RNA, 19 nt, Human
gacaacacugggaaacaga

SEQ ID NO: 2327508 - RNA, 21 nt, Human
gacaacaaauuagguuuugua

SEQ ID NO: 2327509 - RNA, 23 nt, Human
gacaacaaauuagguuuuguaca

SEQ ID NO: 2327510 - RNA, 22 nt, Human
gacaacagaagucaugaagccc

SEQ ID NO: 2327511 - RNA, 17 nt, Human
gacaacagaagucauga

SEQ ID NO: 2327512 - RNA, 14 nt, Human
gacaacagaaguca

SEQ ID NO: 2327513 - RNA, 12 nt, Human
gacaacagaagu

SEQ ID NO: 2327514 - RNA, 22 nt, Human
gacaacacucauugaccugagg

SEQ ID NO: 2327515 - RNA, 23 nt, Human
gacaacacucauugaccugaggc

SEQ ID NO: 2327516 - RNA, 17 nt, Human
gacaaaucaagcuucag

SEQ ID NO: 2327517 - RNA, 22 nt, Human
gacaaaugcugcgcccuucccc

SEQ ID NO: 2327518 - RNA, 21 nt, Human
gacaaaugcugcgcccuuccc

SEQ ID NO: 2327519 - RNA, 15 nt, Human
gacaaauucuguuuc

SEQ ID NO: 2327520 - RNA, 14 nt, Human
gacaaauucuguuu

SEQ ID NO: 2327521 - RNA, 12 nt, Human
gacaaauucugu

SEQ ID NO: 2327522 - RNA, 22 nt, Human
gacaaauguguaucggaugcuu

SEQ ID NO: 2327523 - RNA, 17 nt, Human
gacaaauucuguuucuu

SEQ ID NO: 2327524 - RNA, 16 nt, Human
gacaaauucuguuucu

SEQ ID NO: 2327525 - RNA, 20 nt, Human
gacaaauucuguuucuugag

SEQ ID NO: 2327526 - RNA, 21 nt, Human
gaauuucuugguaagaagccg

SEQ ID NO: 2327527 - RNA, 20 nt, Human
gaauuucuucacuguugaaa

SEQ ID NO: 2327528 - RNA, 12 nt, Human
gaauuucuuggu

SEQ ID NO: 2327529 - RNA, 19 nt, Human
gaauuucuucacuguugaa

SEQ ID NO: 2327530 - RNA, 17 nt, Human
gaauuugaaugaaaaau

SEQ ID NO: 2327531 - RNA, 16 nt, Human
gaauuugaaugaaaaa

SEQ ID NO: 2327532 - RNA, 14 nt, Human
gaauuugaaugaaa

SEQ ID NO: 2327533 - RNA, 21 nt, Human
gaauuucuucaacucccugcc

SEQ ID NO: 2327534 - RNA, 22 nt, Human
gaauuucuuuugccguuauuaa

SEQ ID NO: 2327535 - RNA, 19 nt, Human
gaauuuggccugcacuaau

SEQ ID NO: 2327536 - RNA, 19 nt, Human
gaauuuggagacucugugg

SEQ ID NO: 2327537 - RNA, 13 nt, Human
gaauuugcugggg

SEQ ID NO: 2327538 - RNA, 23 nt, Human
gaauuugaucguuccaguuccca

SEQ ID NO: 2327539 - RNA, 19 nt, Human
gaauuugaaugaaaaauuu

SEQ ID NO: 2327540 - RNA, 17 nt, Human
gaauuugagugcucuga

SEQ ID NO: 2327541 - RNA, 19 nt, Human
gaauuugcaagucauggcu

SEQ ID NO: 2327542 - RNA, 14 nt, Human
gaauuuguaaguuu

SEQ ID NO: 2327543 - RNA, 22 nt, Human
gaauuuguaaguuuaugucuaa

SEQ ID NO: 2327544 - RNA, 16 nt, Human
gaauuuguaaccucag

SEQ ID NO: 2327545 - RNA, 17 nt, Human
gaauuuguaaccucagc

SEQ ID NO: 2327546 - RNA, 18 nt, Human
gaauuuguaaccucagcu

SEQ ID NO: 2327547 - RNA, 19 nt, Human
gaauuuguaaccucagcuc

SEQ ID NO: 2327548 - RNA, 21 nt, Human
gaauuuguaaccucagcucug

SEQ ID NO: 2327549 - RNA, 21 nt, Human
gaauuuccucuauugauguac

SEQ ID NO: 2327550 - RNA, 17 nt, Human
gaauuucuaaaaaacag

SEQ ID NO: 2327551 - RNA, 16 nt, Human
gaauuguaacuguucu

SEQ ID NO: 2327552 - RNA, 12 nt, Human
gaauuucuaaaa

SEQ ID NO: 2327553 - RNA, 13 nt, Human
gaauuuccucuau

SEQ ID NO: 2327554 - RNA, 17 nt, Human
gaauugcuugaaccugg

SEQ ID NO: 2327555 - RNA, 21 nt, Human
gaauugccugcagagagaagc

SEQ ID NO: 2327556 - RNA, 22 nt, Human
gaauugccugcagagagaagcc

SEQ ID NO: 2327557 - RNA, 22 nt, Human
gaauuggaccauccuauuuaac

SEQ ID NO: 2327558 - RNA, 16 nt, Human
gaauugggagcuuggg

SEQ ID NO: 2327559 - RNA, 20 nt, Human
gaauuggguggggggcuuca

SEQ ID NO: 2327560 - RNA, 17 nt, Human
gaauugggagcuuggga

SEQ ID NO: 2327561 - RNA, 15 nt, Human
gaauuguaaggaaug

SEQ ID NO: 2327562 - RNA, 23 nt, Human
gaauuggguggggggcuucauac

SEQ ID NO: 2327563 - RNA, 22 nt, Human
gaauuggguggggggcuucaua

SEQ ID NO: 2327564 - RNA, 15 nt, Human
gacagugggaaauau

SEQ ID NO: 2327565 - RNA, 13 nt, Human
gacagugggaaau

SEQ ID NO: 2327566 - RNA, 14 nt, Human
gacaguuaagagaa

SEQ ID NO: 2327567 - RNA, 19 nt, Human
gacagugcuucagccugag

SEQ ID NO: 2327568 - RNA, 18 nt, Human
gacagugcuucagccuga

SEQ ID NO: 2327569 - RNA, 20 nt, Human
gacagugcuucagccugagg

SEQ ID NO: 2327570 - RNA, 20 nt, Human
gacaguggauugcauuucuu

SEQ ID NO: 2327571 - RNA, 24 nt, Human
gacagggcacaccgggcacucaga

SEQ ID NO: 2327572 - RNA, 19 nt, Human
gacagggacccacuucaca

SEQ ID NO: 2327573 - RNA, 13 nt, Human
gacagggacccac

SEQ ID NO: 2327574 - RNA, 17 nt, Human
gacagggaagcuacagg

SEQ ID NO: 2327575 - RNA, 14 nt, Human
gacagggaugagca

SEQ ID NO: 2327576 - RNA, 21 nt, Human
gacagggaugagcauggagcu

SEQ ID NO: 2327577 - RNA, 23 nt, Human
gacagggaugagcauggagcugg

SEQ ID NO: 2327578 - RNA, 23 nt, Human
gacagggcacaccgggcacucag

SEQ ID NO: 2327579 - RNA, 16 nt, Human
gacagggaggugaccc

SEQ ID NO: 2327580 - RNA, 18 nt, Human
gacagggaggacgcucuc

SEQ ID NO: 2327581 - RNA, 13 nt, Human
gacaggaccugac

SEQ ID NO: 2327582 - RNA, 14 nt, Human
gacaggaccuagga

SEQ ID NO: 2327583 - RNA, 14 nt, Human
gacagggaagcuac

SEQ ID NO: 2327584 - RNA, 17 nt, Human
gacagggaggacgcucu

SEQ ID NO: 2327585 - RNA, 23 nt, Human
gacaggacagugcuucagccuga

SEQ ID NO: 2327586 - RNA, 22 nt, Human
gacaggacagugcuucagccug

SEQ ID NO: 2327587 - RNA, 14 nt, Human
gacaggacagugcu

SEQ ID NO: 2327588 - RNA, 17 nt, Human
gacaggaaagggaaggc

SEQ ID NO: 2327589 - RNA, 12 nt, Human
gacaggaaaggg

SEQ ID NO: 2327590 - RNA, 19 nt, Human
gacaggaaaauccucuggc

SEQ ID NO: 2327591 - RNA, 14 nt, Human
gacaggaccaggga

SEQ ID NO: 2327592 - RNA, 15 nt, Human
gacaggaccagggau

SEQ ID NO: 2327593 - RNA, 23 nt, Human
gacaggaccagggauuuccauga

SEQ ID NO: 2327594 - RNA, 23 nt, Human
gacauccccccgccaaaagcugc

SEQ ID NO: 2327595 - RNA, 16 nt, Human
gacauccguugugcuu

SEQ ID NO: 2327596 - RNA, 15 nt, Human
gacauccuccuccca

SEQ ID NO: 2327597 - RNA, 22 nt, Human
gacauccauguuuguaaaacua

SEQ ID NO: 2327598 - RNA, 20 nt, Human
gacauagagagggagaagaa

SEQ ID NO: 2327599 - RNA, 23 nt, Human
gacauccauguuuguaaaacuac

SEQ ID NO: 2327600 - RNA, 23 nt, Human
gacauacuugaagggccagagcc

SEQ ID NO: 2327601 - RNA, 22 nt, Human
gacauacuugaagggccagagc

SEQ ID NO: 2327602 - RNA, 13 nt, Human
gacaucucagggg

SEQ ID NO: 2327603 - RNA, 15 nt, Human
gacaucucaggggcc

SEQ ID NO: 2327604 - RNA, 16 nt, Human
gacaucucaggggcca

SEQ ID NO: 2327605 - RNA, 17 nt, Human
gacaucucaggggccag

SEQ ID NO: 2327606 - RNA, 18 nt, Human
gacaucucaggggccaga

SEQ ID NO: 2327607 - RNA, 23 nt, Human
gacauccucuucugcuuaggaga

SEQ ID NO: 2327608 - RNA, 18 nt, Human
gacauccuccucccaccc

SEQ ID NO: 2327609 - RNA, 13 nt, Human
gacauccucuucu

SEQ ID NO: 2327610 - RNA, 16 nt, Human
gacauccucuucugcu

SEQ ID NO: 2327611 - RNA, 22 nt, Human
gacauacuccuuccaucaaaua

SEQ ID NO: 2327612 - RNA, 23 nt, Human
gacaguguugaaaauguucagaa

SEQ ID NO: 2327613 - RNA, 15 nt, Human
gacauacuugaaggg

SEQ ID NO: 2327614 - RNA, 14 nt, Human
gacauacuugaagg

SEQ ID NO: 2327615 - RNA, 22 nt, Human
gacaguuaagagaaaugagcuu

SEQ ID NO: 2327616 - RNA, 20 nt, Human
gacauagaauuaacacauga

SEQ ID NO: 2327617 - RNA, 20 nt, Human
gacauacuugaagggccaga

SEQ ID NO: 2327618 - RNA, 19 nt, Human
gacauacuugaagggccag

SEQ ID NO: 2327619 - RNA, 18 nt, Human
gacauacuugaagggcca

SEQ ID NO: 2327620 - RNA, 17 nt, Human
gacauacuugaagggcc

SEQ ID NO: 2327621 - RNA, 14 nt, Human
gacaugcacucagc

SEQ ID NO: 2327622 - RNA, 24 nt, Human
gacaugauuuccuugaauguggcu

SEQ ID NO: 2327623 - RNA, 22 nt, Human
gacaugauuuccuugaaugugg

SEQ ID NO: 2327624 - RNA, 14 nt, Human
gacaugcgggcugg

SEQ ID NO: 2327625 - RNA, 15 nt, Human
gacaugcgggcuggg

SEQ ID NO: 2327626 - RNA, 22 nt, Human
gacaugauuccuuccuguucug

SEQ ID NO: 2327627 - RNA, 18 nt, Human
gacaugcgggcugggcag

SEQ ID NO: 2327628 - RNA, 20 nt, Human
gacaugcgggcugggcagcu

SEQ ID NO: 2327629 - RNA, 21 nt, Human
gacaugcgggcugggcagcug

SEQ ID NO: 2327630 - RNA, 22 nt, Human
gacaugcgggcugggcagcugu

SEQ ID NO: 2327631 - RNA, 14 nt, Human
gacaugggaaaggg

SEQ ID NO: 2327632 - RNA, 21 nt, Human
gacaugauggagcgcaccugc

SEQ ID NO: 2327633 - RNA, 16 nt, Human
gacaugauuccuuccu

SEQ ID NO: 2327634 - RNA, 14 nt, Human
gacaugauuccuuc

SEQ ID NO: 2327635 - RNA, 14 nt, Human
gacaugauuuccuu

SEQ ID NO: 2327636 - RNA, 20 nt, Human
gacaugauuuccuugaaugu

SEQ ID NO: 2327637 - RNA, 19 nt, Human
gacaugauuuccuugaaug

SEQ ID NO: 2327638 - RNA, 17 nt, Human
gacaugauuuccuugaa

SEQ ID NO: 2327639 - RNA, 16 nt, Human
gacaugauuuccuuga

SEQ ID NO: 2327640 - RNA, 14 nt, Human
gacaugaucuucuu

SEQ ID NO: 2327641 - RNA, 15 nt, Human
gacaucucugcaccc

SEQ ID NO: 2327642 - RNA, 16 nt, Human
gacaugaaugcacacu

SEQ ID NO: 2327643 - RNA, 19 nt, Human
gacaugagugcgugcucag

SEQ ID NO: 2327644 - RNA, 22 nt, Human
gacaucucaggggccagaggaa

SEQ ID NO: 2327645 - RNA, 20 nt, Human
gacaucucaggggccagagg

SEQ ID NO: 2327646 - RNA, 13 nt, Human
gacaucucugcac

SEQ ID NO: 2327647 - RNA, 18 nt, Human
gacagagaggacgugggc

SEQ ID NO: 2327648 - RNA, 19 nt, Human
gacagagaggacgugggcg

SEQ ID NO: 2327649 - RNA, 15 nt, Human
gacagagaggacugu

SEQ ID NO: 2327650 - RNA, 16 nt, Human
gacagagaggacugua

SEQ ID NO: 2327651 - RNA, 21 nt, Human
gacagagcaagugagacccug

SEQ ID NO: 2327652 - RNA, 20 nt, Human
gacaccaggagucccuggua

SEQ ID NO: 2327653 - RNA, 19 nt, Human
gacaccaggagucccuggu

SEQ ID NO: 2327654 - RNA, 22 nt, Human
gacaccagccuuucucccaggc

SEQ ID NO: 2327655 - RNA, 22 nt, Human
gacaccaucuuuugugagaugu

SEQ ID NO: 2327656 - RNA, 14 nt, Human
gacacccaaagggu

SEQ ID NO: 2327657 - RNA, 19 nt, Human
gacacccauguuucucugg

SEQ ID NO: 2327658 - RNA, 15 nt, Human
gacacccauuuucac

SEQ ID NO: 2327659 - RNA, 14 nt, Human
gacacccaggacuu

SEQ ID NO: 2327660 - RNA, 13 nt, Human
gacacccaggacu

SEQ ID NO: 2327661 - RNA, 14 nt, Human
gacagaggcagccc

SEQ ID NO: 2327662 - RNA, 16 nt, Human
gacagaggcagcccca

SEQ ID NO: 2327663 - RNA, 19 nt, Human
gacagagaggacuguaggg

SEQ ID NO: 2327664 - RNA, 13 nt, Human
gacagagccaugc

SEQ ID NO: 2327665 - RNA, 19 nt, Human
gacagagccaugcugggaa

SEQ ID NO: 2327666 - RNA, 17 nt, Human
gacagaggcagccccau

SEQ ID NO: 2327667 - RNA, 15 nt, Human
gacagaggggguggc

SEQ ID NO: 2327668 - RNA, 18 nt, Human
gacagaggggguggccuc

SEQ ID NO: 2327669 - RNA, 19 nt, Human
gacagaggggguggccucc

SEQ ID NO: 2327670 - RNA, 14 nt, Human
gacagagucucacu

SEQ ID NO: 2327671 - RNA, 23 nt, Human
gacagaggggguggccucccaac

SEQ ID NO: 2327672 - RNA, 21 nt, Human
gacagaggggguggccuccca

SEQ ID NO: 2327673 - RNA, 22 nt, Human
gacagaggggguggccucccaa

SEQ ID NO: 2327674 - RNA, 18 nt, Human
gacaggaaaauccucugg

SEQ ID NO: 2327675 - RNA, 15 nt, Human
gacagcuuugcugcu

SEQ ID NO: 2327676 - RNA, 16 nt, Human
gacagcuuugcugcug

SEQ ID NO: 2327677 - RNA, 12 nt, Human
gacagcuuugcu

SEQ ID NO: 2327678 - RNA, 19 nt, Human
gacagaucaagcugugaga

SEQ ID NO: 2327679 - RNA, 16 nt, Human
gacagaucaagcugug

SEQ ID NO: 2327680 - RNA, 17 nt, Human
gacagaucaagcuguga

SEQ ID NO: 2327681 - RNA, 18 nt, Human
gacagcugccugggaucc

SEQ ID NO: 2327682 - RNA, 21 nt, Human
gacagcugccugggaucccuc

SEQ ID NO: 2327683 - RNA, 20 nt, Human
gacagccacggccaggccag

SEQ ID NO: 2327684 - RNA, 21 nt, Human
gacagccacggccaggccaga

SEQ ID NO: 2327685 - RNA, 16 nt, Human
gacagcugccugggau

SEQ ID NO: 2327686 - RNA, 17 nt, Human
gacagcugccugggauc

SEQ ID NO: 2327687 - RNA, 21 nt, Human
gacagaguucacuauaaaugg

SEQ ID NO: 2327688 - RNA, 14 nt, Human
gacagaucaagcug

SEQ ID NO: 2327689 - RNA, 16 nt, Human
gacagaguaugaacac

SEQ ID NO: 2327690 - RNA, 20 nt, Human
gacagaucaagcugugagac

SEQ ID NO: 2327691 - RNA, 13 nt, Human
gacagauaacucu

SEQ ID NO: 2327692 - RNA, 13 nt, Human
gacagagggggug

SEQ ID NO: 2327693 - RNA, 20 nt, Human
gacagagugagacucugucu

SEQ ID NO: 2327694 - RNA, 22 nt, Human
gacagagugagacucugucuca

SEQ ID NO: 2327695 - RNA, 14 nt, Human
gacagccacggcca

SEQ ID NO: 2327696 - RNA, 17 nt, Human
gacagccacggccaggc

SEQ ID NO: 2327697 - RNA, 18 nt, Human
gacagccacggccaggcc

SEQ ID NO: 2327698 - RNA, 19 nt, Human
gacagccacggccaggcca

SEQ ID NO: 2327699 - RNA, 22 nt, Human
gaccagccucccugucggccug

SEQ ID NO: 2327700 - RNA, 13 nt, Human
gaccagccuggcc

SEQ ID NO: 2327701 - RNA, 12 nt, Human
gaccagccuggc

SEQ ID NO: 2327702 - RNA, 11 nt, Human
gaccagccugg

SEQ ID NO: 2327703 - RNA, 14 nt, Human
gaccagccucccug

SEQ ID NO: 2327704 - RNA, 19 nt, Human
gaccauucuccaccugcca

SEQ ID NO: 2327705 - RNA, 20 nt, Human
gaccauucuccaccugccag

SEQ ID NO: 2327706 - RNA, 15 nt, Human
gaccauuucaggggu

SEQ ID NO: 2327707 - RNA, 17 nt, Human
gaccauucuccaccugc

SEQ ID NO: 2327708 - RNA, 21 nt, Human
gaccauucuccaccugccagg

SEQ ID NO: 2327709 - RNA, 22 nt, Human
gaccauucuccaccugccaggg

SEQ ID NO: 2327710 - RNA, 21 nt, Human
gaccagccuccaugcugccuc

SEQ ID NO: 2327711 - RNA, 22 nt, Human
gaccagccuccaugcugccucc

SEQ ID NO: 2327712 - RNA, 20 nt, Human
gaccagccuccaugcugccu

SEQ ID NO: 2327713 - RNA, 21 nt, Human
gaccagagccccacacggagg

SEQ ID NO: 2327714 - RNA, 11 nt, Human
gaccagacuaa

SEQ ID NO: 2327715 - RNA, 18 nt, Human
gaccagagcugccaccug

SEQ ID NO: 2327716 - RNA, 19 nt, Human
gaccagagcugccaccugc

SEQ ID NO: 2327717 - RNA, 13 nt, Human
gaccagagcugcc

SEQ ID NO: 2327718 - RNA, 14 nt, Human
gaccagagcugcca

SEQ ID NO: 2327719 - RNA, 15 nt, Human
gaccagagcugccac

SEQ ID NO: 2327720 - RNA, 17 nt, Human
gaccagagcugccaccu

SEQ ID NO: 2327721 - RNA, 13 nt, Human
gaccaccugccca

SEQ ID NO: 2327722 - RNA, 14 nt, Human
gaccaccugcccaa

SEQ ID NO: 2327723 - RNA, 17 nt, Human
gaccacgcccguccugc

SEQ ID NO: 2327724 - RNA, 19 nt, Human
gaccacgcccguccugccu

SEQ ID NO: 2327725 - RNA, 21 nt, Human
gaccacgcccguccugccugu

SEQ ID NO: 2327726 - RNA, 22 nt, Human
gaccaccccugccuccacccuc

SEQ ID NO: 2327727 - RNA, 14 nt, Human
gaccacccuccccu

SEQ ID NO: 2327728 - RNA, 14 nt, Human
gaccaccccugccu

SEQ ID NO: 2327729 - RNA, 17 nt, Human
gaccaccccugccucca

SEQ ID NO: 2327730 - RNA, 19 nt, Human
gaccaccccugccuccacc

SEQ ID NO: 2327731 - RNA, 20 nt, Human
gaccaccccugccuccaccc

SEQ ID NO: 2327732 - RNA, 19 nt, Human
gaccacccuccccucucuu

SEQ ID NO: 2327733 - RNA, 15 nt, Human
gaccacccuccccuc

SEQ ID NO: 2327734 - RNA, 16 nt, Human
gaccacccuccccucu

SEQ ID NO: 2327735 - RNA, 17 nt, Human
gaccacccuccccucuc

SEQ ID NO: 2327736 - RNA, 18 nt, Human
gaccacccuccccucucu

SEQ ID NO: 2327737 - RNA, 18 nt, Human
gacaugggaaaggggaag

SEQ ID NO: 2327738 - RNA, 16 nt, Human
gacaugggacauuugc

SEQ ID NO: 2327739 - RNA, 17 nt, Human
gacaugcgguagccagc

SEQ ID NO: 2327740 - RNA, 16 nt, Human
gacaugcgguagccag

SEQ ID NO: 2327741 - RNA, 18 nt, Human
gaccaccccgccugcccu

SEQ ID NO: 2327742 - RNA, 21 nt, Human
gacauggcuugccacagcucu

SEQ ID NO: 2327743 - RNA, 19 nt, Human
gaccaccccgccugcccuc

SEQ ID NO: 2327744 - RNA, 20 nt, Human
gaccaccccgccugcccuca

SEQ ID NO: 2327745 - RNA, 14 nt, Human
gaccacgcuuucua

SEQ ID NO: 2327746 - RNA, 22 nt, Human
gaccacgcccguccugccugug

SEQ ID NO: 2327747 - RNA, 21 nt, Human
gaccacgcuuucuagcuguug

SEQ ID NO: 2327748 - RNA, 20 nt, Human
gaccacggacguuuccauca

SEQ ID NO: 2327749 - RNA, 14 nt, Human
gaccacguuucuaa

SEQ ID NO: 2327750 - RNA, 21 nt, Human
gaccacugcagaagacaguau

SEQ ID NO: 2327751 - RNA, 13 nt, Human
gaccacggcucga

SEQ ID NO: 2327752 - RNA, 21 nt, Human
gaccacggacguuuccaucag

SEQ ID NO: 2327753 - RNA, 22 nt, Human
gaccacggacguuuccaucagg

SEQ ID NO: 2327754 - RNA, 16 nt, Human
gaccagaagccaaaga

SEQ ID NO: 2327755 - RNA, 21 nt, Human
gaccacugcaugagcuuuuau

SEQ ID NO: 2327756 - RNA, 17 nt, Human
gaccacgggaagcaucu

SEQ ID NO: 2327757 - RNA, 17 nt, Human
gaccacgugcuaccccc

SEQ ID NO: 2327758 - RNA, 12 nt, Human
gaccacugcaug

SEQ ID NO: 2327759 - RNA, 14 nt, Human
gaccacuguuauca

SEQ ID NO: 2327760 - RNA, 11 nt, Human
gaccagagcug

SEQ ID NO: 2327761 - RNA, 17 nt, Human
gacccuguauauagccc

SEQ ID NO: 2327762 - RNA, 19 nt, Human
gacccuguauauagcccag

SEQ ID NO: 2327763 - RNA, 11 nt, Human
gacccuguaua

SEQ ID NO: 2327764 - RNA, 21 nt, Human
gacccugggugggcucugugc

SEQ ID NO: 2327765 - RNA, 12 nt, Human
gacccugucuca

SEQ ID NO: 2327766 - RNA, 22 nt, Human
gacccugcgaaggggcccuggu

SEQ ID NO: 2327767 - RNA, 17 nt, Human
gacccugggcagggacu

SEQ ID NO: 2327768 - RNA, 17 nt, Human
gacccugggugggcucu

SEQ ID NO: 2327769 - RNA, 18 nt, Human
gacccugggugggcucug

SEQ ID NO: 2327770 - RNA, 19 nt, Human
gacccugggugggcucugu

SEQ ID NO: 2327771 - RNA, 22 nt, Human
gacccugggugggcucugugca

SEQ ID NO: 2327772 - RNA, 21 nt, Human
gacccuuuccuuccuucccug

SEQ ID NO: 2327773 - RNA, 20 nt, Human
gacccuuuccuuccuucccu

SEQ ID NO: 2327774 - RNA, 14 nt, Human
gacccuuuccuucc

SEQ ID NO: 2327775 - RNA, 23 nt, Human
gacccuuuagccaaacccuuguc

SEQ ID NO: 2327776 - RNA, 21 nt, Human
gacccuuguggucccacccca

SEQ ID NO: 2327777 - RNA, 19 nt, Human
gacccuuguggucccaccc

SEQ ID NO: 2327778 - RNA, 20 nt, Human
gacccuuguggucccacccc

SEQ ID NO: 2327779 - RNA, 19 nt, Human
gaccuaccucagguugcug

SEQ ID NO: 2327780 - RNA, 19 nt, Human
gaccgugaggccagagaca

SEQ ID NO: 2327781 - RNA, 16 nt, Human
gaccuaccucagguug

SEQ ID NO: 2327782 - RNA, 18 nt, Human
gaccgugaggccagagac

SEQ ID NO: 2327783 - RNA, 16 nt, Human
gaccgugaggccagag

SEQ ID NO: 2327784 - RNA, 17 nt, Human
gaccgugaggccagaga

SEQ ID NO: 2327785 - RNA, 16 nt, Human
gaccgccagauggggc

SEQ ID NO: 2327786 - RNA, 20 nt, Human
gaccgccagauggggccucu

SEQ ID NO: 2327787 - RNA, 22 nt, Human
gaccgccagauggggccucugu

SEQ ID NO: 2327788 - RNA, 12 nt, Human
gaccgcccccuc

SEQ ID NO: 2327789 - RNA, 14 nt, Human
gaccgcccccuccu

SEQ ID NO: 2327790 - RNA, 23 nt, Human
gacccuuuccuuccuucccuggc

SEQ ID NO: 2327791 - RNA, 22 nt, Human
gacccuuuccuuccuucccugg

SEQ ID NO: 2327792 - RNA, 17 nt, Human
gaccgaggcuggagcug

SEQ ID NO: 2327793 - RNA, 19 nt, Human
gaccgaacuguuguauaaa

SEQ ID NO: 2327794 - RNA, 15 nt, Human
gaccgcccccuccuc

SEQ ID NO: 2327795 - RNA, 16 nt, Human
gaccgcccccuccucu

SEQ ID NO: 2327796 - RNA, 17 nt, Human
gaccggacuuuucugca

SEQ ID NO: 2327797 - RNA, 19 nt, Human
gaccccuccccuaaugccu

SEQ ID NO: 2327798 - RNA, 20 nt, Human
gacccccagcaacccuccua

SEQ ID NO: 2327799 - RNA, 23 nt, Human
gacccugaggcccagagggccug

SEQ ID NO: 2327800 - RNA, 14 nt, Human
gaccccuccaugug

SEQ ID NO: 2327801 - RNA, 18 nt, Human
gaccccuccaugugggcu

SEQ ID NO: 2327802 - RNA, 21 nt, Human
gaccccuccaugugggcuagu

SEQ ID NO: 2327803 - RNA, 22 nt, Human
gacccugaggcccagagggccu

SEQ ID NO: 2327804 - RNA, 23 nt, Human
gacccccacucucauuccccagg

SEQ ID NO: 2327805 - RNA, 19 nt, Human
gacccccacucucauuccc

SEQ ID NO: 2327806 - RNA, 18 nt, Human
gacccccacucucauucc

SEQ ID NO: 2327807 - RNA, 22 nt, Human
gacccccaccccuuccccacug

SEQ ID NO: 2327808 - RNA, 21 nt, Human
gacccccaccccuuccccacu

SEQ ID NO: 2327809 - RNA, 19 nt, Human
gacccccaccccuucccca

SEQ ID NO: 2327810 - RNA, 18 nt, Human
gacccccaccccuucccc

SEQ ID NO: 2327811 - RNA, 17 nt, Human
gacccccaccccuuccc

SEQ ID NO: 2327812 - RNA, 16 nt, Human
gacccccaccccuucc

SEQ ID NO: 2327813 - RNA, 15 nt, Human
gacccccaccccuuc

SEQ ID NO: 2327814 - RNA, 14 nt, Human
gacccccaccccuu

SEQ ID NO: 2327815 - RNA, 13 nt, Human
gacccccaccccu

SEQ ID NO: 2327816 - RNA, 12 nt, Human
gacccccacccc

SEQ ID NO: 2327817 - RNA, 14 nt, Human
gacccaaggaggaa

SEQ ID NO: 2327818 - RNA, 15 nt, Human
gacccccacaccuca

SEQ ID NO: 2327819 - RNA, 13 nt, Human
gacccccacaccu

SEQ ID NO: 2327820 - RNA, 19 nt, Human
gacccaauguaggagcugc

SEQ ID NO: 2327821 - RNA, 21 nt, Human
gacccccaaccaaguggcucc

SEQ ID NO: 2327822 - RNA, 13 nt, Human
gacccaaggagga

SEQ ID NO: 2327823 - RNA, 12 nt, Human
gacccaaagacc

SEQ ID NO: 2327824 - RNA, 18 nt, Human
gacccaauguaggagcug

SEQ ID NO: 2327825 - RNA, 12 nt, Human
gacccccaacca

SEQ ID NO: 2327826 - RNA, 22 nt, Human
gacccacaagaaaugaaagcag

SEQ ID NO: 2327827 - RNA, 15 nt, Human
gacccacaagaaaug

SEQ ID NO: 2327828 - RNA, 16 nt, Human
gacccaaaaggcagaa

SEQ ID NO: 2327829 - RNA, 11 nt, Human
gacccaaagac

SEQ ID NO: 2327830 - RNA, 13 nt, Human
gacccaaagacca

SEQ ID NO: 2327831 - RNA, 15 nt, Human
gacuccggcccuccu

SEQ ID NO: 2327832 - RNA, 17 nt, Human
gacucagcuccccagag

SEQ ID NO: 2327833 - RNA, 18 nt, Human
gacucagcuccccagagu

SEQ ID NO: 2327834 - RNA, 18 nt, Human
gacuccaaagaaauguaa

SEQ ID NO: 2327835 - RNA, 16 nt, Human
gacuccaaagaaaugu

SEQ ID NO: 2327836 - RNA, 22 nt, Human
gacuccggcccuccuacccugc

SEQ ID NO: 2327837 - RNA, 23 nt, Human
gacuccggguuugagauggacac

SEQ ID NO: 2327838 - RNA, 17 nt, Human
gacuccguuggccacuc

SEQ ID NO: 2327839 - RNA, 16 nt, Human
gacuccguuggccacu

SEQ ID NO: 2327840 - RNA, 20 nt, Human
gacucagcuccccagagucc

SEQ ID NO: 2327841 - RNA, 17 nt, Human
gacuccuaggcaggaca

SEQ ID NO: 2327842 - RNA, 19 nt, Human
gacuccuaggcaggacaug

SEQ ID NO: 2327843 - RNA, 15 nt, Human
gacuccaaagaaaug

SEQ ID NO: 2327844 - RNA, 12 nt, Human
gacuccaaagaa

SEQ ID NO: 2327845 - RNA, 11 nt, Human
gacuccaaaga

SEQ ID NO: 2327846 - RNA, 21 nt, Human
gacucauuuuaaaaaauggaa

SEQ ID NO: 2327847 - RNA, 22 nt, Human
gacuccuugagagaccaggcaa

SEQ ID NO: 2327848 - RNA, 16 nt, Human
gacuccugugcaacuu

SEQ ID NO: 2327849 - RNA, 13 nt, Human
gacuccugcccug

SEQ ID NO: 2327850 - RNA, 14 nt, Human
gacuccugcccugu

SEQ ID NO: 2327851 - RNA, 11 nt, Human
gacuccugggu

SEQ ID NO: 2327852 - RNA, 17 nt, Human
gacuccuggguugagcu

SEQ ID NO: 2327853 - RNA, 13 nt, Human
gacucgcgacaau

SEQ ID NO: 2327854 - RNA, 23 nt, Human
gacuccugcacacgcuccuuccu

SEQ ID NO: 2327855 - RNA, 13 nt, Human
gacuccugcaggc

SEQ ID NO: 2327856 - RNA, 14 nt, Human
gacuccucugucca

SEQ ID NO: 2327857 - RNA, 18 nt, Human
gacuccugaggacagcug

SEQ ID NO: 2327858 - RNA, 19 nt, Human
gacuccugaggacagcugu

SEQ ID NO: 2327859 - RNA, 20 nt, Human
gacuccugaggacagcuguc

SEQ ID NO: 2327860 - RNA, 21 nt, Human
gacuccugaggacagcugucc

SEQ ID NO: 2327861 - RNA, 12 nt, Human
gacuccugcagg

SEQ ID NO: 2327862 - RNA, 11 nt, Human
gacuccucugu

SEQ ID NO: 2327863 - RNA, 17 nt, Human
gacuccucggccuggcu

SEQ ID NO: 2327864 - RNA, 18 nt, Human
gacuccucggccuggcuc

SEQ ID NO: 2327865 - RNA, 20 nt, Human
gacuccucggccuggcuccu

SEQ ID NO: 2327866 - RNA, 23 nt, Human
gacuccuaggcaggacaugcuga

SEQ ID NO: 2327867 - RNA, 15 nt, Human
gacuccucggccugg

SEQ ID NO: 2327868 - RNA, 15 nt, Human
gacuccuaugaucuc

SEQ ID NO: 2327869 - RNA, 23 nt, Human
gaccuagggauguucuggcccuc

SEQ ID NO: 2327870 - RNA, 15 nt, Human
gaccuaucacuucca

SEQ ID NO: 2327871 - RNA, 22 nt, Human
gaccuagggauguucuggcccu

SEQ ID NO: 2327872 - RNA, 21 nt, Human
gaccuagggauguucuggccc

SEQ ID NO: 2327873 - RNA, 20 nt, Human
gaccuagggauguucuggcc

SEQ ID NO: 2327874 - RNA, 21 nt, Human
gaccuagggaggaccuuaucu

SEQ ID NO: 2327875 - RNA, 17 nt, Human
gaccuagggaggaccuu

SEQ ID NO: 2327876 - RNA, 20 nt, Human
gaccuaggauaucuucucca

SEQ ID NO: 2327877 - RNA, 18 nt, Human
gaccuaggauaucuucuc

SEQ ID NO: 2327878 - RNA, 13 nt, Human
gaccuacucucau

SEQ ID NO: 2327879 - RNA, 13 nt, Human
gacuacaggugug

SEQ ID NO: 2327880 - RNA, 16 nt, Human
gaccuauuccuccugg

SEQ ID NO: 2327881 - RNA, 17 nt, Human
gaccuauuccuccuggg

SEQ ID NO: 2327882 - RNA, 21 nt, Human
gaccuauguccuaaggacaca

SEQ ID NO: 2327883 - RNA, 22 nt, Human
gaccuauguccuaaggacacac

SEQ ID NO: 2327884 - RNA, 23 nt, Human
gaccuauguccuaaggacacacu

SEQ ID NO: 2327885 - RNA, 15 nt, Human
gacuagaggcaggga

SEQ ID NO: 2327886 - RNA, 22 nt, Human
gacuagaggcagggaggggacu

SEQ ID NO: 2327887 - RNA, 20 nt, Human
gacuagaggcagggagggga

SEQ ID NO: 2327888 - RNA, 17 nt, Human
gacuagaggcagggagg

SEQ ID NO: 2327889 - RNA, 16 nt, Human
gacuagaggcagggag

SEQ ID NO: 2327890 - RNA, 13 nt, Human
gaccucaaccugu

SEQ ID NO: 2327891 - RNA, 18 nt, Human
gacuacagucaggaaagg

SEQ ID NO: 2327892 - RNA, 14 nt, Human
gacuacauuuagag

SEQ ID NO: 2327893 - RNA, 22 nt, Human
gacuacccacguucucacaccc

SEQ ID NO: 2327894 - RNA, 18 nt, Human
gacuacaggugugaguca

SEQ ID NO: 2327895 - RNA, 21 nt, Human
gacuacaggugugagucacca

SEQ ID NO: 2327896 - RNA, 23 nt, Human
gacuagagggaccucucccaggg

SEQ ID NO: 2327897 - RNA, 20 nt, Human
gacuagagggaccucuccca

SEQ ID NO: 2327898 - RNA, 19 nt, Human
gacuagagggaccucuccc

SEQ ID NO: 2327899 - RNA, 17 nt, Human
gacuagagggaccucuc

SEQ ID NO: 2327900 - RNA, 16 nt, Human
gacuagaggcuugcau

SEQ ID NO: 2327901 - RNA, 21 nt, Human
gacuagaugauggaugccaau

SEQ ID NO: 2327902 - RNA, 16 nt, Human
gacuagaugauggaug

SEQ ID NO: 2327903 - RNA, 14 nt, Human
gacuagaugaugga

SEQ ID NO: 2327904 - RNA, 23 nt, Human
gacucagacaggaaagggaaggc

SEQ ID NO: 2327905 - RNA, 17 nt, Human
gacucagacaggaaagg

SEQ ID NO: 2327906 - RNA, 19 nt, Human
gacucagaagccucugggu

SEQ ID NO: 2327907 - RNA, 13 nt, Human
gacucagcccuga

SEQ ID NO: 2327908 - RNA, 11 nt, Human
gacucagcccu

SEQ ID NO: 2327909 - RNA, 16 nt, Human
gacucagacuccauuu

SEQ ID NO: 2327910 - RNA, 18 nt, Human
gacucagacauuggcacc

SEQ ID NO: 2327911 - RNA, 14 nt, Human
gacucagcucccca

SEQ ID NO: 2327912 - RNA, 20 nt, Human
gacucagccuucagacagag

SEQ ID NO: 2327913 - RNA, 15 nt, Human
gacucagccuucaga

SEQ ID NO: 2327914 - RNA, 19 nt, Human
gacucagccuucagacaga

SEQ ID NO: 2327915 - RNA, 16 nt, Human
gacucagcccugaggu

SEQ ID NO: 2327916 - RNA, 15 nt, Human
gacucagcccugagg

SEQ ID NO: 2327917 - RNA, 12 nt, Human
gacucagccuuc

SEQ ID NO: 2327918 - RNA, 14 nt, Human
gacucagccuucag

SEQ ID NO: 2327919 - RNA, 14 nt, Human
gacucauucuucug

SEQ ID NO: 2327920 - RNA, 15 nt, Human
gacucauucuucugu

SEQ ID NO: 2327921 - RNA, 14 nt, Human
gacuggaagcacag

SEQ ID NO: 2327922 - RNA, 15 nt, Human
gacuggaaccaggga

SEQ ID NO: 2327923 - RNA, 21 nt, Human
gacugcuuuggaccuaaaugg

SEQ ID NO: 2327924 - RNA, 15 nt, Human
gacuggaagcacagc

SEQ ID NO: 2327925 - RNA, 16 nt, Human
gacuggaagcacagcu

SEQ ID NO: 2327926 - RNA, 14 nt, Human
gacugcugggacug

SEQ ID NO: 2327927 - RNA, 12 nt, Human
gacugcugggac

SEQ ID NO: 2327928 - RNA, 23 nt, Human
gacugccgaccgaggcuggagcu

SEQ ID NO: 2327929 - RNA, 19 nt, Human
gacugcugggacuggccag

SEQ ID NO: 2327930 - RNA, 13 nt, Human
gacugcuucccau

SEQ ID NO: 2327931 - RNA, 15 nt, Human
gacugcuucccaucc

SEQ ID NO: 2327932 - RNA, 16 nt, Human
gacugcuucccauccu

SEQ ID NO: 2327933 - RNA, 12 nt, Human
gacugcuuccca

SEQ ID NO: 2327934 - RNA, 22 nt, Human
gacugcuucccauccuacccuc

SEQ ID NO: 2327935 - RNA, 17 nt, Human
gacugcuucccauccua

SEQ ID NO: 2327936 - RNA, 20 nt, Human
gacugcuucccauccuaccc

SEQ ID NO: 2327937 - RNA, 14 nt, Human
gacuggagcaucug

SEQ ID NO: 2327938 - RNA, 15 nt, Human
gacuggauacugccc

SEQ ID NO: 2327939 - RNA, 22 nt, Human
gacuggauacugcccggggcag

SEQ ID NO: 2327940 - RNA, 17 nt, Human
gacuggaaccagggaga

SEQ ID NO: 2327941 - RNA, 20 nt, Human
gacuggaagcuaauuugcau

SEQ ID NO: 2327942 - RNA, 21 nt, Human
gacuggaagcuaauuugcauu

SEQ ID NO: 2327943 - RNA, 18 nt, Human
gacuggaagcacagcuuc

SEQ ID NO: 2327944 - RNA, 15 nt, Human
gacugggagggccca

SEQ ID NO: 2327945 - RNA, 13 nt, Human
gacugggagguag

SEQ ID NO: 2327946 - RNA, 14 nt, Human
gacugggcccugcc

SEQ ID NO: 2327947 - RNA, 18 nt, Human
gacugggagccgcagcag

SEQ ID NO: 2327948 - RNA, 23 nt, Human
gacugggagccgcagcagcuccc

SEQ ID NO: 2327949 - RNA, 21 nt, Human
gacugggcugagggagccugg

SEQ ID NO: 2327950 - RNA, 16 nt, Human
gacugggcugagggag

SEQ ID NO: 2327951 - RNA, 15 nt, Human
gacugggcugaggga

SEQ ID NO: 2327952 - RNA, 14 nt, Human
gacugggcugaggg

SEQ ID NO: 2327953 - RNA, 21 nt, Human
gacuguuuuuuccugagcuug

SEQ ID NO: 2327954 - RNA, 14 nt, Human
gacuggggggcuug

SEQ ID NO: 2327955 - RNA, 20 nt, Human
gacuggggaugugggaggga

SEQ ID NO: 2327956 - RNA, 23 nt, Human
gacuggggaugugggagggagca

SEQ ID NO: 2327957 - RNA, 17 nt, Human
gacugggcccugccucu

SEQ ID NO: 2327958 - RNA, 16 nt, Human
gacuggggauguggga

SEQ ID NO: 2327959 - RNA, 17 nt, Human
gacuggggaugugggag

SEQ ID NO: 2327960 - RNA, 18 nt, Human
gacuggggaugugggagg

SEQ ID NO: 2327961 - RNA, 16 nt, Human
gacucgagaacuuuca

SEQ ID NO: 2327962 - RNA, 19 nt, Human
gacucgagaacuuucauuu

SEQ ID NO: 2327963 - RNA, 14 nt, Human
gacucuaccagacu

SEQ ID NO: 2327964 - RNA, 17 nt, Human
gacucgcgacaaugcaa

SEQ ID NO: 2327965 - RNA, 23 nt, Human
gacucuaccucauaucaguuugc

SEQ ID NO: 2327966 - RNA, 19 nt, Human
gacucuaccucauaucagu

SEQ ID NO: 2327967 - RNA, 20 nt, Human
gacucuaccagacuguguau

SEQ ID NO: 2327968 - RNA, 19 nt, Human
gacucuaggugcccuugga

SEQ ID NO: 2327969 - RNA, 17 nt, Human
gacucuaggugcccuug

SEQ ID NO: 2327970 - RNA, 14 nt, Human
gacucucaaaucuu

SEQ ID NO: 2327971 - RNA, 13 nt, Human
gacucucugugac

SEQ ID NO: 2327972 - RNA, 12 nt, Human
gacucucuguga

SEQ ID NO: 2327973 - RNA, 20 nt, Human
gacucucagucucugagcag

SEQ ID NO: 2327974 - RNA, 14 nt, Human
gacucucagucucu

SEQ ID NO: 2327975 - RNA, 18 nt, Human
gacucucagucucugagc

SEQ ID NO: 2327976 - RNA, 16 nt, Human
gacucucagucucuga

SEQ ID NO: 2327977 - RNA, 22 nt, Human
gacugaguacguugugcauuug

SEQ ID NO: 2327978 - RNA, 21 nt, Human
gacugaguacguugugcauuu

SEQ ID NO: 2327979 - RNA, 20 nt, Human
gacugccgaccgaggcugga

SEQ ID NO: 2327980 - RNA, 19 nt, Human
gacugccgaccgaggcugg

SEQ ID NO: 2327981 - RNA, 16 nt, Human
gacugccgaccgaggc

SEQ ID NO: 2327982 - RNA, 23 nt, Human
gacugccccgugcagacuggagg

SEQ ID NO: 2327983 - RNA, 21 nt, Human
gacugccccgugcagacugga

SEQ ID NO: 2327984 - RNA, 20 nt, Human
gacugccccgugcagacugg

SEQ ID NO: 2327985 - RNA, 19 nt, Human
gacugccccgugcagacug

SEQ ID NO: 2327986 - RNA, 17 nt, Human
gacugccccgugcagac

SEQ ID NO: 2327987 - RNA, 15 nt, Human
gacugcccggcaggg

SEQ ID NO: 2327988 - RNA, 21 nt, Human
gacugcauguaccauuugcau

SEQ ID NO: 2327989 - RNA, 23 nt, Human
gacugcauguaccauuugcaugg

SEQ ID NO: 2327990 - RNA, 13 nt, Human
gacugcccggcag

SEQ ID NO: 2327991 - RNA, 22 nt, Human
gacugaguccucguagccaucu

SEQ ID NO: 2327992 - RNA, 23 nt, Human
gacugaguacguugugcauuugg

SEQ ID NO: 2327993 - RNA, 14 nt, Human
gacugcauuauauu

SEQ ID NO: 2327994 - RNA, 16 nt, Human
gacugcauuauauuua

SEQ ID NO: 2327995 - RNA, 16 nt, Human
gacuugacagaacacu

SEQ ID NO: 2327996 - RNA, 18 nt, Human
gacuugacagaacacugu

SEQ ID NO: 2327997 - RNA, 15 nt, Human
gacuugaaguuguua

SEQ ID NO: 2327998 - RNA, 19 nt, Human
gacuugaauuuucccacug

SEQ ID NO: 2327999 - RNA, 20 nt, Human
gacuugaauuuucccacugc

SEQ ID NO: 2328000 - RNA, 21 nt, Human
gacuugaauuuucccacugca

SEQ ID NO: 2328001 - RNA, 21 nt, Human
gacuugaaagcauccaugugu

SEQ ID NO: 2328002 - RNA, 19 nt, Human
gacuugaaagcauccaugu

SEQ ID NO: 2328003 - RNA, 17 nt, Human
gacuugaaagcauccau

SEQ ID NO: 2328004 - RNA, 11 nt, Human
gacuugaaguu

SEQ ID NO: 2328005 - RNA, 12 nt, Human
gacuugaaguug

SEQ ID NO: 2328006 - RNA, 13 nt, Human
gacuugaaguugu

SEQ ID NO: 2328007 - RNA, 16 nt, Human
gacuugaaagcaucca

SEQ ID NO: 2328008 - RNA, 14 nt, Human
gacuugaaagcauc

SEQ ID NO: 2328009 - RNA, 13 nt, Human
gacuugaaagcau

SEQ ID NO: 2328010 - RNA, 22 nt, Human
gacuucuuuucacauucuuaua

SEQ ID NO: 2328011 - RNA, 19 nt, Human
gacuucuuuucacauucuu

SEQ ID NO: 2328012 - RNA, 21 nt, Human
gacuucuuuucacauucuuau

SEQ ID NO: 2328013 - RNA, 12 nt, Human
gacuucuuuuca

SEQ ID NO: 2328014 - RNA, 15 nt, Human
gacuucuuuucacau

SEQ ID NO: 2328015 - RNA, 16 nt, Human
gacuucuuuucacauu

SEQ ID NO: 2328016 - RNA, 18 nt, Human
gacuucuuuucacauucu

SEQ ID NO: 2328017 - RNA, 22 nt, Human
gacuucuuucaaauugagagaa

SEQ ID NO: 2328018 - RNA, 21 nt, Human
gacuucuuucaaauugagaga

SEQ ID NO: 2328019 - RNA, 17 nt, Human
gacuucugcuuuccaca

SEQ ID NO: 2328020 - RNA, 13 nt, Human
gacuuggaagcuc

SEQ ID NO: 2328021 - RNA, 21 nt, Human
gacuuggaggguugguccucu

SEQ ID NO: 2328022 - RNA, 19 nt, Human
gacuugcuguuuuguucug

SEQ ID NO: 2328023 - RNA, 20 nt, Human
gacuugcuguuuuguucugu

SEQ ID NO: 2328024 - RNA, 22 nt, Human
gacuugcuguuuuguucugugg

SEQ ID NO: 2328025 - RNA, 17 nt, Human
gacuuggcaacagaagc

SEQ ID NO: 2328026 - RNA, 19 nt, Human
gacuuggcaacagaagcag

SEQ ID NO: 2328027 - RNA, 23 nt, Human
gacuugagaaacaaauaauuugu

SEQ ID NO: 2328028 - RNA, 19 nt, Human
gacuugagaaacaaauaau

SEQ ID NO: 2328029 - RNA, 19 nt, Human
gacuugacuuuagucugca

SEQ ID NO: 2328030 - RNA, 19 nt, Human
gacuugaggauuuugagua

SEQ ID NO: 2328031 - RNA, 23 nt, Human
gacuugaggauuuugaguaucuc

SEQ ID NO: 2328032 - RNA, 15 nt, Human
gacuugcauuuuugc

SEQ ID NO: 2328033 - RNA, 13 nt, Human
gacuugcauuuuu

SEQ ID NO: 2328034 - RNA, 18 nt, Human
gacuugcaauuucuaccu

SEQ ID NO: 2328035 - RNA, 15 nt, Human
gacuugcaucgugga

SEQ ID NO: 2328036 - RNA, 23 nt, Human
gacuugguguccuuucccuccac

SEQ ID NO: 2328037 - RNA, 14 nt, Human
gacuuggucugauu

SEQ ID NO: 2328038 - RNA, 19 nt, Human
gacuuguagggaugccuuu

SEQ ID NO: 2328039 - RNA, 16 nt, Human
gacuuguauauuugua

SEQ ID NO: 2328040 - RNA, 21 nt, Human
gagaaaacgucuugcuuggga

SEQ ID NO: 2328041 - RNA, 18 nt, Human
gacuuguauauuuguaca

SEQ ID NO: 2328042 - RNA, 9 nt, Human
gagaaaaga

SEQ ID NO: 2328043 - RNA, 16 nt, Human
gagaaaacuuauuuga

SEQ ID NO: 2328044 - RNA, 18 nt, Human
gagaaaacuuauuugagu

SEQ ID NO: 2328045 - RNA, 20 nt, Human
gacuuggggagauggaguuc

SEQ ID NO: 2328046 - RNA, 20 nt, Human
gacuugggucucauuuagaa

SEQ ID NO: 2328047 - RNA, 16 nt, Human
gacuuggucaccagcu

SEQ ID NO: 2328048 - RNA, 19 nt, Human
gacuuggucaccagcuccu

SEQ ID NO: 2328049 - RNA, 20 nt, Human
gacuuaacugcauuuuuaga

SEQ ID NO: 2328050 - RNA, 16 nt, Human
gacuuaacuccuucca

SEQ ID NO: 2328051 - RNA, 19 nt, Human
gacuuaacggcuccaggau

SEQ ID NO: 2328052 - RNA, 14 nt, Human
gacuuaacggcucc

SEQ ID NO: 2328053 - RNA, 16 nt, Human
gacuuaacggcuccag

SEQ ID NO: 2328054 - RNA, 19 nt, Human
gacuuaaaauauuccugca

SEQ ID NO: 2328055 - RNA, 13 nt, Human
gacuuaaagcaga

SEQ ID NO: 2328056 - RNA, 14 nt, Human
gacugggggccaga

SEQ ID NO: 2328057 - RNA, 19 nt, Human
gacuuaagcacacuugaca

SEQ ID NO: 2328058 - RNA, 15 nt, Human
gacuuccuugagaca

SEQ ID NO: 2328059 - RNA, 19 nt, Human
gacuuaagugugcaaaaua

SEQ ID NO: 2328060 - RNA, 20 nt, Human
gacuuccuugagacacggag

SEQ ID NO: 2328061 - RNA, 16 nt, Human
gacuuccuugagacac

SEQ ID NO: 2328062 - RNA, 16 nt, Human
gacuuaauagaaacau

SEQ ID NO: 2328063 - RNA, 14 nt, Human
gacuuccuugcucu

SEQ ID NO: 2328064 - RNA, 16 nt, Human
gacuuccuugcucucc

SEQ ID NO: 2328065 - RNA, 17 nt, Human
gacuuccuugcucuccc

SEQ ID NO: 2328066 - RNA, 16 nt, Human
gacuucuaaguaaaac

SEQ ID NO: 2328067 - RNA, 18 nt, Human
gacuucuaaguaaaacca

SEQ ID NO: 2328068 - RNA, 17 nt, Human
gacuucuaaguaaaacc

SEQ ID NO: 2328069 - RNA, 18 nt, Human
gacuucgacugugaccug

SEQ ID NO: 2328070 - RNA, 18 nt, Human
gacuuccuugcucucccu

SEQ ID NO: 2328071 - RNA, 15 nt, Human
gacuucgacucagga

SEQ ID NO: 2328072 - RNA, 16 nt, Human
gacuucgacucaggau

SEQ ID NO: 2328073 - RNA, 14 nt, Human
gacuucuccagguc

SEQ ID NO: 2328074 - RNA, 24 nt, Human
gacuucuaaguaaaaccacagcag

SEQ ID NO: 2328075 - RNA, 23 nt, Human
gacuucuaaguaaaaccacagca

SEQ ID NO: 2328076 - RNA, 19 nt, Human
gacuucuaaguaaaaccac

SEQ ID NO: 2328077 - RNA, 17 nt, Human
gacuucugccuggagac

SEQ ID NO: 2328078 - RNA, 15 nt, Human
gacuucugccuggag

SEQ ID NO: 2328079 - RNA, 16 nt, Human
gacuucugccuggaga

SEQ ID NO: 2328080 - RNA, 22 nt, Human
gacuucuccaggucucacgggc

SEQ ID NO: 2328081 - RNA, 13 nt, Human
gacuucugccugg

SEQ ID NO: 2328082 - RNA, 14 nt, Human
gacuucugccugga

SEQ ID NO: 2328083 - RNA, 23 nt, Human
gacuucugucuucacaacagauu

SEQ ID NO: 2328084 - RNA, 20 nt, Human
gacuucugucuucacaacag

SEQ ID NO: 2328085 - RNA, 20 nt, Human
gagaaagccaggcagguagc

SEQ ID NO: 2328086 - RNA, 15 nt, Human
gagaaagccaggcag

SEQ ID NO: 2328087 - RNA, 16 nt, Human
gagaaagccaggcagg

SEQ ID NO: 2328088 - RNA, 17 nt, Human
gagaaaauaaaaaguua

SEQ ID NO: 2328089 - RNA, 22 nt, Human
gagaaaacuuauuugagugauu

SEQ ID NO: 2328090 - RNA, 22 nt, Human
gagaaaguacuucuccacccug

SEQ ID NO: 2328091 - RNA, 18 nt, Human
gagaaaggggagcccacu

SEQ ID NO: 2328092 - RNA, 17 nt, Human
gagaaaggggagcccac

SEQ ID NO: 2328093 - RNA, 16 nt, Human
gagaaagguugaagca

SEQ ID NO: 2328094 - RNA, 13 nt, Human
gagaaaagacaug

SEQ ID NO: 2328095 - RNA, 12 nt, Human
gagaaaauaaaa

SEQ ID NO: 2328096 - RNA, 11 nt, Human
gagaaaauaaa

SEQ ID NO: 2328097 - RNA, 16 nt, Human
gagaaaauaaaaaguu

SEQ ID NO: 2328098 - RNA, 15 nt, Human
gagaaaauaaaaagu

SEQ ID NO: 2328099 - RNA, 14 nt, Human
gagaaaauaaaaag

SEQ ID NO: 2328100 - RNA, 13 nt, Human
gagaaaauaaaaa

SEQ ID NO: 2328101 - RNA, 20 nt, Human
gagaaaagaaaaaaaaagaa

SEQ ID NO: 2328102 - RNA, 19 nt, Human
gagaaaagaaaaaaaaaga

SEQ ID NO: 2328103 - RNA, 15 nt, Human
gagaaaagaaaaaaa

SEQ ID NO: 2328104 - RNA, 14 nt, Human
gagaaaagaaaaaa

SEQ ID NO: 2328105 - RNA, 13 nt, Human
gagaaaagaaaaa

SEQ ID NO: 2328106 - RNA, 12 nt, Human
gagaaaagaaaa

SEQ ID NO: 2328107 - RNA, 11 nt, Human
gagaaaagaaa

SEQ ID NO: 2328108 - RNA, 10 nt, Human
gagaaaagaa

SEQ ID NO: 2328109 - RNA, 14 nt, Human
gagaaccucaggcu

SEQ ID NO: 2328110 - RNA, 22 nt, Human
gagaaccucacgcaccucccau

SEQ ID NO: 2328111 - RNA, 14 nt, Human
gagaaauugacaga

SEQ ID NO: 2328112 - RNA, 18 nt, Human
gagaaccuaaguuucagu

SEQ ID NO: 2328113 - RNA, 13 nt, Human
gagaacgcagccc

SEQ ID NO: 2328114 - RNA, 19 nt, Human
gagaaccuggaguuccuga

SEQ ID NO: 2328115 - RNA, 21 nt, Human
gagaaccuagggugauauuaa

SEQ ID NO: 2328116 - RNA, 22 nt, Human
gagaaccuagggugauauuaac

SEQ ID NO: 2328117 - RNA, 21 nt, Human
gagaaaugaaaaaauauauau

SEQ ID NO: 2328118 - RNA, 14 nt, Human
gagaaaugagcuug

SEQ ID NO: 2328119 - RNA, 12 nt, Human
gagaaaugaaaa

SEQ ID NO: 2328120 - RNA, 13 nt, Human
gagaaaugggacu

SEQ ID NO: 2328121 - RNA, 11 nt, Human
gagaaauuauu

SEQ ID NO: 2328122 - RNA, 12 nt, Human
gagaaaugcaua

SEQ ID NO: 2328123 - RNA, 17 nt, Human
gagaacuuucauuuuuu

SEQ ID NO: 2328124 - RNA, 15 nt, Human
gagaacuuucauuuu

SEQ ID NO: 2328125 - RNA, 16 nt, Human
gagaacuuucauuuuu

SEQ ID NO: 2328126 - RNA, 23 nt, Human
gagaacugcauauguuucgcuga

SEQ ID NO: 2328127 - RNA, 19 nt, Human
gagaacugcauauguuucg

SEQ ID NO: 2328128 - RNA, 15 nt, Human
gagaacuguggccgu

SEQ ID NO: 2328129 - RNA, 20 nt, Human
gagaagaauuuucagacccc

SEQ ID NO: 2328130 - RNA, 14 nt, Human
gagaagagaaugca

SEQ ID NO: 2328131 - RNA, 18 nt, Human
gagaacugcauauguuuc

SEQ ID NO: 2328132 - RNA, 15 nt, Human
gagaacuccuagggu

SEQ ID NO: 2328133 - RNA, 23 nt, Human
gagaacucaucccuaaugcugca

SEQ ID NO: 2328134 - RNA, 14 nt, Human
gagaacgcagcccu

SEQ ID NO: 2328135 - RNA, 15 nt, Human
gagaacgcagcccua

SEQ ID NO: 2328136 - RNA, 16 nt, Human
gagaacgcagcccuag

SEQ ID NO: 2328137 - RNA, 24 nt, Human
gagaacgcagcccuagagccugcc

SEQ ID NO: 2328138 - RNA, 19 nt, Human
gacuuguauauuuguacaa

SEQ ID NO: 2328139 - RNA, 19 nt, Human
gagaacuagaaccuggagg

SEQ ID NO: 2328140 - RNA, 22 nt, Human
gagaacuuccagauccuggaaa

SEQ ID NO: 2328141 - RNA, 23 nt, Human
gagaacuuccagauccuggaaau

SEQ ID NO: 2328142 - RNA, 13 nt, Human
gagaagcaugaaa

SEQ ID NO: 2328143 - RNA, 20 nt, Human
gagaagccacaggccugaga

SEQ ID NO: 2328144 - RNA, 22 nt, Human
gagaagccacaggccugagauu

SEQ ID NO: 2328145 - RNA, 17 nt, Human
gagaaugagagacacac

SEQ ID NO: 2328146 - RNA, 18 nt, Human
gagaagccaaaagauugg

SEQ ID NO: 2328147 - RNA, 13 nt, Human
gagaagccacagg

SEQ ID NO: 2328148 - RNA, 17 nt, Human
gagaagccacaggccug

SEQ ID NO: 2328149 - RNA, 18 nt, Human
gagaagccacaggccuga

SEQ ID NO: 2328150 - RNA, 21 nt, Human
gagaagcaucggagggaauug

SEQ ID NO: 2328151 - RNA, 18 nt, Human
gagaagcagugagccgca

SEQ ID NO: 2328152 - RNA, 14 nt, Human
gagaagcagugagc

SEQ ID NO: 2328153 - RNA, 12 nt, Human
gagaagcacugu

SEQ ID NO: 2328154 - RNA, 16 nt, Human
gagaagcagaggaagg

SEQ ID NO: 2328155 - RNA, 15 nt, Human
gagaagagaggagag

SEQ ID NO: 2328156 - RNA, 16 nt, Human
gagaagagaggagagg

SEQ ID NO: 2328157 - RNA, 13 nt, Human
gagaagagcuguu

SEQ ID NO: 2328158 - RNA, 19 nt, Human
gagaagagagaaauagccu

SEQ ID NO: 2328159 - RNA, 15 nt, Human
gagaagacaaaauua

SEQ ID NO: 2328160 - RNA, 12 nt, Human
gagaagagagga

SEQ ID NO: 2328161 - RNA, 21 nt, Human
gagaagaauuuucagacccca

SEQ ID NO: 2328162 - RNA, 20 nt, Human
gagaagaaaggugaguuuga

SEQ ID NO: 2328163 - RNA, 16 nt, Human
gagaagagaaugcaca

SEQ ID NO: 2328164 - RNA, 22 nt, Human
gagacaggguuuugccauguug

SEQ ID NO: 2328165 - RNA, 17 nt, Human
gagacagugaucuccau

SEQ ID NO: 2328166 - RNA, 16 nt, Human
gagacagucaccccag

SEQ ID NO: 2328167 - RNA, 14 nt, Human
gagacagugggaaa

SEQ ID NO: 2328168 - RNA, 16 nt, Human
gagacaguucaagaaa

SEQ ID NO: 2328169 - RNA, 16 nt, Human
gagacagugggaaaua

SEQ ID NO: 2328170 - RNA, 12 nt, Human
gagacaggguuu

SEQ ID NO: 2328171 - RNA, 19 nt, Human
gagacaggguuucaccaug

SEQ ID NO: 2328172 - RNA, 13 nt, Human
gagacaggguuug

SEQ ID NO: 2328173 - RNA, 22 nt, Human
gagacaggguuuggcugugucu

SEQ ID NO: 2328174 - RNA, 17 nt, Human
gagacaguccagccugg

SEQ ID NO: 2328175 - RNA, 14 nt, Human
gagaccaucccuga

SEQ ID NO: 2328176 - RNA, 22 nt, Human
gagacaguugggugagaacaac

SEQ ID NO: 2328177 - RNA, 15 nt, Human
gagacagugggaaau

SEQ ID NO: 2328178 - RNA, 18 nt, Human
gagacaguucaagaaagc

SEQ ID NO: 2328179 - RNA, 18 nt, Human
gagaccaucccugaaggc

SEQ ID NO: 2328180 - RNA, 21 nt, Human
gagaccaucccugaaggcccc

SEQ ID NO: 2328181 - RNA, 19 nt, Human
gagacagcuugaucaaagg

SEQ ID NO: 2328182 - RNA, 17 nt, Human
gagaaugucaguaugug

SEQ ID NO: 2328183 - RNA, 16 nt, Human
gagacaggaccugacu

SEQ ID NO: 2328184 - RNA, 12 nt, Human
gagacaggaagg

SEQ ID NO: 2328185 - RNA, 15 nt, Human
gagacaggagggcaa

SEQ ID NO: 2328186 - RNA, 21 nt, Human
gagacaggaaaauccucuggc

SEQ ID NO: 2328187 - RNA, 20 nt, Human
gagacaggaaaauccucugg

SEQ ID NO: 2328188 - RNA, 19 nt, Human
gagacaggaaaauccucug

SEQ ID NO: 2328189 - RNA, 21 nt, Human
gagaauguagauauugugaag

SEQ ID NO: 2328190 - RNA, 20 nt, Human
gagaauggcgugaacccggg

SEQ ID NO: 2328191 - RNA, 15 nt, Human
gagaauguaagaacu

SEQ ID NO: 2328192 - RNA, 16 nt, Human
gagaauguaagaacua

SEQ ID NO: 2328193 - RNA, 20 nt, Human
gagacagcucugcauacuca

SEQ ID NO: 2328194 - RNA, 15 nt, Human
gagaauggaaaacag

SEQ ID NO: 2328195 - RNA, 23 nt, Human
gagaaugcacaaacagaggccgc

SEQ ID NO: 2328196 - RNA, 20 nt, Human
gagaaugagagacacacuga

SEQ ID NO: 2328197 - RNA, 21 nt, Human
gagaaugagagacacacugaa

SEQ ID NO: 2328198 - RNA, 13 nt, Human
gagacucugucuc

SEQ ID NO: 2328199 - RNA, 17 nt, Human
gagaccaugcagagcgc

SEQ ID NO: 2328200 - RNA, 20 nt, Human
gagacucgcgacaaugcaaa

SEQ ID NO: 2328201 - RNA, 21 nt, Human
gagacucgcgacaaugcaaac

SEQ ID NO: 2328202 - RNA, 19 nt, Human
gagacuccugcaggcagcc

SEQ ID NO: 2328203 - RNA, 23 nt, Human
gagacaguugggugagaacaacc

SEQ ID NO: 2328204 - RNA, 16 nt, Human
gagacaguuucuuagc

SEQ ID NO: 2328205 - RNA, 18 nt, Human
gagaccaugcagagcgcc

SEQ ID NO: 2328206 - RNA, 20 nt, Human
gagacuccugcaggcagcca

SEQ ID NO: 2328207 - RNA, 21 nt, Human
gagacuccugcaggcagccag

SEQ ID NO: 2328208 - RNA, 13 nt, Human
gagacugggaaga

SEQ ID NO: 2328209 - RNA, 20 nt, Human
gagacuggagcaucugacuc

SEQ ID NO: 2328210 - RNA, 19 nt, Human
gagacucucuuaggagcag

SEQ ID NO: 2328211 - RNA, 12 nt, Human
gagacucuggcc

SEQ ID NO: 2328212 - RNA, 13 nt, Human
gagacucuggccu

SEQ ID NO: 2328213 - RNA, 14 nt, Human
gagacucuggccuc

SEQ ID NO: 2328214 - RNA, 21 nt, Human
gagacugggaagauaggcucu

SEQ ID NO: 2328215 - RNA, 14 nt, Human
gagacugggcugag

SEQ ID NO: 2328216 - RNA, 13 nt, Human
gagacugggcuga

SEQ ID NO: 2328217 - RNA, 21 nt, Human
gagacugggcugagggagccu

SEQ ID NO: 2328218 - RNA, 20 nt, Human
gagacugggcugagggagcc

SEQ ID NO: 2328219 - RNA, 17 nt, Human
gagacugggcugaggga

SEQ ID NO: 2328220 - RNA, 15 nt, Human
gagacugggcugagg

SEQ ID NO: 2328221 - RNA, 16 nt, Human
gagacugguccugugu

SEQ ID NO: 2328222 - RNA, 23 nt, Human
gagacugguccugugugcaguga

SEQ ID NO: 2328223 - RNA, 14 nt, Human
gagacuggggggcu

SEQ ID NO: 2328224 - RNA, 16 nt, Human
gagacuggggggcuug

SEQ ID NO: 2328225 - RNA, 18 nt, Human
gagacuggggggcuugaa

SEQ ID NO: 2328226 - RNA, 19 nt, Human
gagacuggggggcuugaaa

SEQ ID NO: 2328227 - RNA, 22 nt, Human
gagagaaagugugagcaaacua

SEQ ID NO: 2328228 - RNA, 20 nt, Human
gagagaaagugggugagaug

SEQ ID NO: 2328229 - RNA, 22 nt, Human
gagagaaagugggugagaugcu

SEQ ID NO: 2328230 - RNA, 15 nt, Human
gagagaaagugggug

SEQ ID NO: 2328231 - RNA, 17 nt, Human
gagagaaagugggugag

SEQ ID NO: 2328232 - RNA, 18 nt, Human
gagagaaagugggugaga

SEQ ID NO: 2328233 - RNA, 11 nt, Human
gagagaaagaa

SEQ ID NO: 2328234 - RNA, 16 nt, Human
gagagaaagccaggca

SEQ ID NO: 2328235 - RNA, 21 nt, Human
gagagaaagccaggcagguag

SEQ ID NO: 2328236 - RNA, 18 nt, Human
gagagaaagccaggcagg

SEQ ID NO: 2328237 - RNA, 19 nt, Human
gagagaaagccaggcaggu

SEQ ID NO: 2328238 - RNA, 17 nt, Human
gagagaaaauaaaaagu

SEQ ID NO: 2328239 - RNA, 16 nt, Human
gagagaaaauaaaaag

SEQ ID NO: 2328240 - RNA, 21 nt, Human
gagagaaaauaaaaaguuaaa

SEQ ID NO: 2328241 - RNA, 20 nt, Human
gagagaaaauaaaaaguuaa

SEQ ID NO: 2328242 - RNA, 19 nt, Human
gagagaaaauaaaaaguua

SEQ ID NO: 2328243 - RNA, 18 nt, Human
gagagaaaauaaaaaguu

SEQ ID NO: 2328244 - RNA, 18 nt, Human
gagagccccucacacagc

SEQ ID NO: 2328245 - RNA, 15 nt, Human
gagagcccgggagcu

SEQ ID NO: 2328246 - RNA, 20 nt, Human
gagagcccggcgccccugcc

SEQ ID NO: 2328247 - RNA, 13 nt, Human
gagagcccagcca

SEQ ID NO: 2328248 - RNA, 13 nt, Human
gagagccccagcu

SEQ ID NO: 2328249 - RNA, 14 nt, Human
gagagccccagcug

SEQ ID NO: 2328250 - RNA, 15 nt, Human
gagagccccagcuga

SEQ ID NO: 2328251 - RNA, 21 nt, Human
gagagccugcucccccacccc

SEQ ID NO: 2328252 - RNA, 17 nt, Human
gagagccugcuccccca

SEQ ID NO: 2328253 - RNA, 14 nt, Human
gagagccugcuccc

SEQ ID NO: 2328254 - RNA, 16 nt, Human
gagagcccuucauuug

SEQ ID NO: 2328255 - RNA, 15 nt, Human
gagagcaacauuuua

SEQ ID NO: 2328256 - RNA, 13 nt, Human
gagagagcuggag

SEQ ID NO: 2328257 - RNA, 19 nt, Human
gagagagcagcuucugcca

SEQ ID NO: 2328258 - RNA, 18 nt, Human
gagagaugggagcuccuc

SEQ ID NO: 2328259 - RNA, 13 nt, Human
gagagcaacucug

SEQ ID NO: 2328260 - RNA, 17 nt, Human
gagagcaacucugagau

SEQ ID NO: 2328261 - RNA, 20 nt, Human
gagagcaacucugagaucua

SEQ ID NO: 2328262 - RNA, 16 nt, Human
gagagcagcuucugcc

SEQ ID NO: 2328263 - RNA, 18 nt, Human
gagagcagcuucugccac

SEQ ID NO: 2328264 - RNA, 19 nt, Human
gagagcagcuucugccacu

SEQ ID NO: 2328265 - RNA, 22 nt, Human
gagagcagcuucugccacuucc

SEQ ID NO: 2328266 - RNA, 21 nt, Human
gagagcagcuuuaaacucagg

SEQ ID NO: 2328267 - RNA, 23 nt, Human
gagagcagcuuuaaacucaggga

SEQ ID NO: 2328268 - RNA, 13 nt, Human
gagagcaggcugg

SEQ ID NO: 2328269 - RNA, 14 nt, Human
gagagcaggcuggc

SEQ ID NO: 2328270 - RNA, 17 nt, Human
gagagcaggcuggcagc

SEQ ID NO: 2328271 - RNA, 21 nt, Human
gagagcaggcuggcagcucuc

SEQ ID NO: 2328272 - RNA, 15 nt, Human
gagagagcagcuucu

SEQ ID NO: 2328273 - RNA, 19 nt, Human
gagagagcuucuguugcug

SEQ ID NO: 2328274 - RNA, 22 nt, Human
gagagagcuucuguugcugccu

SEQ ID NO: 2328275 - RNA, 13 nt, Human
gagagagagaggu

SEQ ID NO: 2328276 - RNA, 14 nt, Human
gagagagagaggac

SEQ ID NO: 2328277 - RNA, 12 nt, Human
gagagagaggac

SEQ ID NO: 2328278 - RNA, 13 nt, Human
gagagagaggaca

SEQ ID NO: 2328279 - RNA, 14 nt, Human
gagagagagagaga

SEQ ID NO: 2328280 - RNA, 14 nt, Human
gagagagagagagg

SEQ ID NO: 2328281 - RNA, 13 nt, Human
gagagagagagga

SEQ ID NO: 2328282 - RNA, 23 nt, Human
gagagagaagugccccugcugcc

SEQ ID NO: 2328283 - RNA, 12 nt, Human
gagagagaaagc

SEQ ID NO: 2328284 - RNA, 15 nt, Human
gagagagaaagccag

SEQ ID NO: 2328285 - RNA, 18 nt, Human
gagagagaaagccaggca

SEQ ID NO: 2328286 - RNA, 20 nt, Human
gagagacccaaggaggaaaa

SEQ ID NO: 2328287 - RNA, 19 nt, Human
gagagacccaaggaggaaa

SEQ ID NO: 2328288 - RNA, 15 nt, Human
gagagacccaaggag

SEQ ID NO: 2328289 - RNA, 14 nt, Human
gagagacccaagga

SEQ ID NO: 2328290 - RNA, 14 nt, Human
gagagaccaggcaa

SEQ ID NO: 2328291 - RNA, 16 nt, Human
gagagaccaggcaaag

SEQ ID NO: 2328292 - RNA, 19 nt, Human
gagagacguguacauagug

SEQ ID NO: 2328293 - RNA, 16 nt, Human
gagagacguguacaua

SEQ ID NO: 2328294 - RNA, 17 nt, Human
gagagacguguacauag

SEQ ID NO: 2328295 - RNA, 20 nt, Human
gagagacguguacauagugu

SEQ ID NO: 2328296 - RNA, 15 nt, Human
gagagaccucaucag

SEQ ID NO: 2328297 - RNA, 17 nt, Human
gagagaccucaucagga

SEQ ID NO: 2328298 - RNA, 18 nt, Human
gagagaccucaucaggau

SEQ ID NO: 2328299 - RNA, 18 nt, Human
gagagggggccaccuccc

SEQ ID NO: 2328300 - RNA, 18 nt, Human
gagagggucuggagaagc

SEQ ID NO: 2328301 - RNA, 13 nt, Human
gagagggugacaa

SEQ ID NO: 2328302 - RNA, 13 nt, Human
gagagggucugga

SEQ ID NO: 2328303 - RNA, 14 nt, Human
gagagggugggagu

SEQ ID NO: 2328304 - RNA, 19 nt, Human
gagaguacagugagccaag

SEQ ID NO: 2328305 - RNA, 16 nt, Human
gagaguacagugagcc

SEQ ID NO: 2328306 - RNA, 20 nt, Human
gagagggugggagugggccc

SEQ ID NO: 2328307 - RNA, 16 nt, Human
gagagggugggagugg

SEQ ID NO: 2328308 - RNA, 13 nt, Human
gagaggggcacag

SEQ ID NO: 2328309 - RNA, 21 nt, Human
gagaggggaauaauagaagaa

SEQ ID NO: 2328310 - RNA, 18 nt, Human
gagaggggaagggccagu

SEQ ID NO: 2328311 - RNA, 21 nt, Human
gagaggggacaaaacccaccu

SEQ ID NO: 2328312 - RNA, 22 nt, Human
gagaggggacaaaacccaccuu

SEQ ID NO: 2328313 - RNA, 22 nt, Human
gagagccugcucccccaccccc

SEQ ID NO: 2328314 - RNA, 18 nt, Human
gagaggggaagaguguac

SEQ ID NO: 2328315 - RNA, 20 nt, Human
gagaggggaagaguguacug

SEQ ID NO: 2328316 - RNA, 21 nt, Human
gagaggggaagaguguacugg

SEQ ID NO: 2328317 - RNA, 22 nt, Human
gagaggggaagaguguacuggg

SEQ ID NO: 2328318 - RNA, 16 nt, Human
gagaggggaagggcca

SEQ ID NO: 2328319 - RNA, 17 nt, Human
gagaggggaagggccag

SEQ ID NO: 2328320 - RNA, 19 nt, Human
gagaggggaacagacugga

SEQ ID NO: 2328321 - RNA, 16 nt, Human
gagaguggcuccuccc

SEQ ID NO: 2328322 - RNA, 21 nt, Human
gagaguggcuccucccggugc

SEQ ID NO: 2328323 - RNA, 20 nt, Human
gagagugugaaauagacauu

SEQ ID NO: 2328324 - RNA, 21 nt, Human
gagagugucuucacggcagga

SEQ ID NO: 2328325 - RNA, 20 nt, Human
gagaguucaauggcugcuga

SEQ ID NO: 2328326 - RNA, 15 nt, Human
gagauaccagcgagg

SEQ ID NO: 2328327 - RNA, 21 nt, Human
gagaguucaauggcugcugaa

SEQ ID NO: 2328328 - RNA, 22 nt, Human
gagaguucaauggcugcugaag

SEQ ID NO: 2328329 - RNA, 22 nt, Human
gagaguagccgagagccugcuc

SEQ ID NO: 2328330 - RNA, 21 nt, Human
gagaguagccgagagccugcu

SEQ ID NO: 2328331 - RNA, 20 nt, Human
gagaguagccgagagccugc

SEQ ID NO: 2328332 - RNA, 18 nt, Human
gagaguagccgagagccu

SEQ ID NO: 2328333 - RNA, 15 nt, Human
gagaguagaacagau

SEQ ID NO: 2328334 - RNA, 17 nt, Human
gagagucauauuuugau

SEQ ID NO: 2328335 - RNA, 15 nt, Human
gagaguauauuaugu

SEQ ID NO: 2328336 - RNA, 15 nt, Human
gagagucccacugcc

SEQ ID NO: 2328337 - RNA, 20 nt, Human
gagagucccacugccucagg

SEQ ID NO: 2328338 - RNA, 21 nt, Human
gagagucccacugccucaggu

SEQ ID NO: 2328339 - RNA, 13 nt, Human
gagaguggcuccu

SEQ ID NO: 2328340 - RNA, 19 nt, Human
gagagucccagagcaggag

SEQ ID NO: 2328341 - RNA, 15 nt, Human
gagaguccucuggau

SEQ ID NO: 2328342 - RNA, 22 nt, Human
gagagucccacugccucagguu

SEQ ID NO: 2328343 - RNA, 15 nt, Human
gagagucccagagca

SEQ ID NO: 2328344 - RNA, 17 nt, Human
gagagucccagagcagg

SEQ ID NO: 2328345 - RNA, 18 nt, Human
gagagucccagagcagga

SEQ ID NO: 2328346 - RNA, 20 nt, Human
gagcaaggguucccucaaga

SEQ ID NO: 2328347 - RNA, 13 nt, Human
gagcaagucugca

SEQ ID NO: 2328348 - RNA, 15 nt, Human
gagcaagucugcagg

SEQ ID NO: 2328349 - RNA, 16 nt, Human
gagcaagucugcaggu

SEQ ID NO: 2328350 - RNA, 21 nt, Human
gagcaagucugcaggugcacc

SEQ ID NO: 2328351 - RNA, 18 nt, Human
gagcaaguuccuucuggu

SEQ ID NO: 2328352 - RNA, 20 nt, Human
gagcaagcauuuauguuuau

SEQ ID NO: 2328353 - RNA, 14 nt, Human
gagcaagagcuggc

SEQ ID NO: 2328354 - RNA, 15 nt, Human
gagcaaugucugugc

SEQ ID NO: 2328355 - RNA, 16 nt, Human
gagcaaugucugugcu

SEQ ID NO: 2328356 - RNA, 17 nt, Human
gagcaaugucugugcua

SEQ ID NO: 2328357 - RNA, 20 nt, Human
gagcaccuuagacagucccu

SEQ ID NO: 2328358 - RNA, 13 nt, Human
gagcaacauuuua

SEQ ID NO: 2328359 - RNA, 20 nt, Human
gagcaacagagugagacccu

SEQ ID NO: 2328360 - RNA, 14 nt, Human
gagcaaauguuucu

SEQ ID NO: 2328361 - RNA, 15 nt, Human
gagcaaauguuucug

SEQ ID NO: 2328362 - RNA, 16 nt, Human
gagcaaauguuucugc

SEQ ID NO: 2328363 - RNA, 19 nt, Human
gagcaaauguuucugcagu

SEQ ID NO: 2328364 - RNA, 12 nt, Human
gagcaagacucu

SEQ ID NO: 2328365 - RNA, 14 nt, Human
gagcaagacucugu

SEQ ID NO: 2328366 - RNA, 12 nt, Human
gagcaagagcug

SEQ ID NO: 2328367 - RNA, 13 nt, Human
gagcaagagcugg

SEQ ID NO: 2328368 - RNA, 20 nt, Human
gagcacucccaagucuacag

SEQ ID NO: 2328369 - RNA, 20 nt, Human
gagcagacuggugagcagac

SEQ ID NO: 2328370 - RNA, 19 nt, Human
gagcagacuggugagcaga

SEQ ID NO: 2328371 - RNA, 18 nt, Human
gagcagacuggugagcag

SEQ ID NO: 2328372 - RNA, 21 nt, Human
gagcacuaaggugugcucuga

SEQ ID NO: 2328373 - RNA, 15 nt, Human
gagcacucccaaguc

SEQ ID NO: 2328374 - RNA, 17 nt, Human
gagcaccuuccucacuu

SEQ ID NO: 2328375 - RNA, 19 nt, Human
gagcaccuuccucacuucc

SEQ ID NO: 2328376 - RNA, 20 nt, Human
gagcaccuuccucacuucca

SEQ ID NO: 2328377 - RNA, 20 nt, Human
gagcacggccaacaaagcug

SEQ ID NO: 2328378 - RNA, 15 nt, Human
gagcacuaaggugug

SEQ ID NO: 2328379 - RNA, 16 nt, Human
gagcaccuuccucacu

SEQ ID NO: 2328380 - RNA, 21 nt, Human
gagcaccuuagacagucccug

SEQ ID NO: 2328381 - RNA, 22 nt, Human
gagcaccuuagacagucccugc

SEQ ID NO: 2328382 - RNA, 20 nt, Human
gagaugaagcaaacacauua

SEQ ID NO: 2328383 - RNA, 16 nt, Human
gagaugaauuaaauuu

SEQ ID NO: 2328384 - RNA, 16 nt, Human
gagaugacugaguccu

SEQ ID NO: 2328385 - RNA, 13 nt, Human
gagaugacugagu

SEQ ID NO: 2328386 - RNA, 18 nt, Human
gagaugaagcaaacacau

SEQ ID NO: 2328387 - RNA, 15 nt, Human
gagaugaagcaaaca

SEQ ID NO: 2328388 - RNA, 17 nt, Human
gagaucccgccucuucu

SEQ ID NO: 2328389 - RNA, 12 nt, Human
gagauccuccug

SEQ ID NO: 2328390 - RNA, 20 nt, Human
gagcaaagugaagacacugg

SEQ ID NO: 2328391 - RNA, 14 nt, Human
gagcaaagugaggg

SEQ ID NO: 2328392 - RNA, 16 nt, Human
gagcaaagucuaaagu

SEQ ID NO: 2328393 - RNA, 19 nt, Human
gagcaaagucuaaaguuua

SEQ ID NO: 2328394 - RNA, 22 nt, Human
gagcaaaggggucccauagagg

SEQ ID NO: 2328395 - RNA, 22 nt, Human
gagcaaaggcugagaacacugu

SEQ ID NO: 2328396 - RNA, 14 nt, Human
gagcaaagucuaaa

SEQ ID NO: 2328397 - RNA, 18 nt, Human
gagaugaugaaaauauuu

SEQ ID NO: 2328398 - RNA, 13 nt, Human
gagcaaaggcuga

SEQ ID NO: 2328399 - RNA, 16 nt, Human
gagcaaaggcugagaa

SEQ ID NO: 2328400 - RNA, 21 nt, Human
gagaugacugaguccucguag

SEQ ID NO: 2328401 - RNA, 17 nt, Human
gagaugaggccgccaug

SEQ ID NO: 2328402 - RNA, 22 nt, Human
gagaugauacauccaaagcaga

SEQ ID NO: 2328403 - RNA, 16 nt, Human
gagaucacgccacugc

SEQ ID NO: 2328404 - RNA, 18 nt, Human
gagaucacgccacugcac

SEQ ID NO: 2328405 - RNA, 18 nt, Human
gagaucaggcucugccuc

SEQ ID NO: 2328406 - RNA, 16 nt, Human
gagaucauccuuucca

SEQ ID NO: 2328407 - RNA, 20 nt, Human
gagaucauccuuuccagcau

SEQ ID NO: 2328408 - RNA, 22 nt, Human
gagauccaaaagaagcccccag

SEQ ID NO: 2328409 - RNA, 21 nt, Human
gagauccaaaagaagccccca

SEQ ID NO: 2328410 - RNA, 19 nt, Human
gagaucacgccacugcacu

SEQ ID NO: 2328411 - RNA, 16 nt, Human
gagauagaagaacugc

SEQ ID NO: 2328412 - RNA, 12 nt, Human
gagauagcauug

SEQ ID NO: 2328413 - RNA, 15 nt, Human
gagauagcauuguga

SEQ ID NO: 2328414 - RNA, 16 nt, Human
gagauagcauugugaa

SEQ ID NO: 2328415 - RNA, 20 nt, Human
gagauagcauugugaacuga

SEQ ID NO: 2328416 - RNA, 23 nt, Human
gagauagcauugugaacugacag

SEQ ID NO: 2328417 - RNA, 14 nt, Human
gagauagccaaggc

SEQ ID NO: 2328418 - RNA, 23 nt, Human
gagaucaaccccuucgcuccugu

SEQ ID NO: 2328419 - RNA, 16 nt, Human
gagauagccaaggcca

SEQ ID NO: 2328420 - RNA, 21 nt, Human
gagccagcagccuggcucucc

SEQ ID NO: 2328421 - RNA, 14 nt, Human
gagccagcccuccc

SEQ ID NO: 2328422 - RNA, 13 nt, Human
gagccagcccucc

SEQ ID NO: 2328423 - RNA, 12 nt, Human
gagccagcccuc

SEQ ID NO: 2328424 - RNA, 14 nt, Human
gagccagggucuca

SEQ ID NO: 2328425 - RNA, 23 nt, Human
gagccagauuucacucuccuugg

SEQ ID NO: 2328426 - RNA, 12 nt, Human
gagccagcagac

SEQ ID NO: 2328427 - RNA, 15 nt, Human
gagccagcagacauu

SEQ ID NO: 2328428 - RNA, 17 nt, Human
gagccagcagacauugu

SEQ ID NO: 2328429 - RNA, 20 nt, Human
gagccagcagacauugucag

SEQ ID NO: 2328430 - RNA, 22 nt, Human
gagccagcagacauugucagca

SEQ ID NO: 2328431 - RNA, 23 nt, Human
gagccagcagacauugucagcaa

SEQ ID NO: 2328432 - RNA, 19 nt, Human
gagccaguucaguaccugg

SEQ ID NO: 2328433 - RNA, 21 nt, Human
gagccaguucaguaccuggag

SEQ ID NO: 2328434 - RNA, 13 nt, Human
gagccagucccag

SEQ ID NO: 2328435 - RNA, 15 nt, Human
gagccagucccaggg

SEQ ID NO: 2328436 - RNA, 19 nt, Human
gagccauauaaguuugaag

SEQ ID NO: 2328437 - RNA, 22 nt, Human
gagccaguucaguaccuggagg

SEQ ID NO: 2328438 - RNA, 23 nt, Human
gagccaguucaguaccuggagga

SEQ ID NO: 2328439 - RNA, 23 nt, Human
gagcccacuguacuugcucuuga

SEQ ID NO: 2328440 - RNA, 24 nt, Human
gagcccacuguccugggccugcag

SEQ ID NO: 2328441 - RNA, 19 nt, Human
gagcccacuguccugggcc

SEQ ID NO: 2328442 - RNA, 16 nt, Human
gagccagcccucccug

SEQ ID NO: 2328443 - RNA, 15 nt, Human
gagccagcccucccu

SEQ ID NO: 2328444 - RNA, 18 nt, Human
gagccagguaaugaggga

SEQ ID NO: 2328445 - RNA, 19 nt, Human
gagccagguaaugagggac

SEQ ID NO: 2328446 - RNA, 22 nt, Human
gagccagguaaugagggacugg

SEQ ID NO: 2328447 - RNA, 18 nt, Human
gagccaguaaacagagga

SEQ ID NO: 2328448 - RNA, 19 nt, Human
gagccagggucucacuaug

SEQ ID NO: 2328449 - RNA, 18 nt, Human
gagcccagcccuccccau

SEQ ID NO: 2328450 - RNA, 13 nt, Human
gagcccagcucca

SEQ ID NO: 2328451 - RNA, 12 nt, Human
gagcccagcucc

SEQ ID NO: 2328452 - RNA, 14 nt, Human
gagcccagcuccaa

SEQ ID NO: 2328453 - RNA, 12 nt, Human
gagcccagcucu

SEQ ID NO: 2328454 - RNA, 21 nt, Human
gagcccagcucugaaaccagu

SEQ ID NO: 2328455 - RNA, 14 nt, Human
gagcccagcucuga

SEQ ID NO: 2328456 - RNA, 22 nt, Human
gagcccagccauuaccauggag

SEQ ID NO: 2328457 - RNA, 15 nt, Human
gagcccagcccuccc

SEQ ID NO: 2328458 - RNA, 23 nt, Human
gagcccagagguaacagaacagc

SEQ ID NO: 2328459 - RNA, 14 nt, Human
gagcccagaggagg

SEQ ID NO: 2328460 - RNA, 22 nt, Human
gagcccagaggagggcagcaga

SEQ ID NO: 2328461 - RNA, 21 nt, Human
gagcccagagguaacagaaca

SEQ ID NO: 2328462 - RNA, 22 nt, Human
gagcccagagguaacagaacag

SEQ ID NO: 2328463 - RNA, 12 nt, Human
gagcccaggagu

SEQ ID NO: 2328464 - RNA, 11 nt, Human
gagcccaggag

SEQ ID NO: 2328465 - RNA, 22 nt, Human
gagcccagcugggucaggcagg

SEQ ID NO: 2328466 - RNA, 21 nt, Human
gagcccagcugggucaggcag

SEQ ID NO: 2328467 - RNA, 19 nt, Human
gagcccagcugggucaggc

SEQ ID NO: 2328468 - RNA, 13 nt, Human
gagcccagcuggg

SEQ ID NO: 2328469 - RNA, 18 nt, Human
gagcccugguggcagugg

SEQ ID NO: 2328470 - RNA, 23 nt, Human
gagcccaggaguucgaggcugca

SEQ ID NO: 2328471 - RNA, 20 nt, Human
gagccaacagaagcuuccau

SEQ ID NO: 2328472 - RNA, 14 nt, Human
gagccaacugcugc

SEQ ID NO: 2328473 - RNA, 15 nt, Human
gagccaacugcugcu

SEQ ID NO: 2328474 - RNA, 21 nt, Human
gagccaagaucgcgccacugc

SEQ ID NO: 2328475 - RNA, 17 nt, Human
gagcauuuagggcaagg

SEQ ID NO: 2328476 - RNA, 19 nt, Human
gagcauuguggcugucagc

SEQ ID NO: 2328477 - RNA, 15 nt, Human
gagcauuggcugaga

SEQ ID NO: 2328478 - RNA, 23 nt, Human
gagcauuuccaacaccacagaca

SEQ ID NO: 2328479 - RNA, 17 nt, Human
gagcauugccauucccu

SEQ ID NO: 2328480 - RNA, 21 nt, Human
gagcauuacgugagccaggua

SEQ ID NO: 2328481 - RNA, 18 nt, Human
gagcauuacgugagccag

SEQ ID NO: 2328482 - RNA, 20 nt, Human
gagcauuacgugagccaggu

SEQ ID NO: 2328483 - RNA, 21 nt, Human
gagcauuagauuucucauuug

SEQ ID NO: 2328484 - RNA, 15 nt, Human
gagcauuagauuucu

SEQ ID NO: 2328485 - RNA, 14 nt, Human
gagccaaguccaga

SEQ ID NO: 2328486 - RNA, 23 nt, Human
gagccaaggguucagagacucag

SEQ ID NO: 2328487 - RNA, 20 nt, Human
gagccagauuucacucuccu

SEQ ID NO: 2328488 - RNA, 19 nt, Human
gagccaaggguucagagac

SEQ ID NO: 2328489 - RNA, 19 nt, Human
gagccaauuuaaagaaaac

SEQ ID NO: 2328490 - RNA, 24 nt, Human
gagcagagacaugacucagccugu

SEQ ID NO: 2328491 - RNA, 21 nt, Human
gagcagagacacuaacgacuu

SEQ ID NO: 2328492 - RNA, 13 nt, Human
gagcagagacacu

SEQ ID NO: 2328493 - RNA, 12 nt, Human
gagcagagacac

SEQ ID NO: 2328494 - RNA, 15 nt, Human
gagcagacugguggg

SEQ ID NO: 2328495 - RNA, 23 nt, Human
gagcagacuggugagcagacugg

SEQ ID NO: 2328496 - RNA, 16 nt, Human
gagcagagaauucucu

SEQ ID NO: 2328497 - RNA, 18 nt, Human
gagcagcgguuuggggag

SEQ ID NO: 2328498 - RNA, 12 nt, Human
gagcagagacca

SEQ ID NO: 2328499 - RNA, 17 nt, Human
gagcauuacgugagcca

SEQ ID NO: 2328500 - RNA, 22 nt, Human
gagcaggaccucugaaacccug

SEQ ID NO: 2328501 - RNA, 22 nt, Human
gagcaggaagcauucagagagc

SEQ ID NO: 2328502 - RNA, 15 nt, Human
gagcagcuucaguug

SEQ ID NO: 2328503 - RNA, 16 nt, Human
gagcagcuucugccac

SEQ ID NO: 2328504 - RNA, 17 nt, Human
gagcagcuucugccacu

SEQ ID NO: 2328505 - RNA, 20 nt, Human
gagcagcuucugccacuucc

SEQ ID NO: 2328506 - RNA, 21 nt, Human
gagcagcuucugccacuuccc

SEQ ID NO: 2328507 - RNA, 17 nt, Human
gagcagcuuuaaacuca

SEQ ID NO: 2328508 - RNA, 18 nt, Human
gagcagcuuuaaacucag

SEQ ID NO: 2328509 - RNA, 21 nt, Human
gagcagcuuuaaacucaggga

SEQ ID NO: 2328510 - RNA, 22 nt, Human
gagcagcuuuaaacucagggac

SEQ ID NO: 2328511 - RNA, 23 nt, Human
gagcagcuuuaaacucagggaca

SEQ ID NO: 2328512 - RNA, 16 nt, Human
gagcaggaagcauuca

SEQ ID NO: 2328513 - RNA, 23 nt, Human
gagcaggaagcauucagagagca

SEQ ID NO: 2328514 - RNA, 14 nt, Human
cugccuccccaacc

SEQ ID NO: 2328515 - RNA, 12 nt, Human
cugccuccccaa

SEQ ID NO: 2328516 - RNA, 18 nt, Human
cugccuccauucugacca

SEQ ID NO: 2328517 - RNA, 16 nt, Human
cugccucccauucuga

SEQ ID NO: 2328518 - RNA, 19 nt, Human
cugccuccccaacccugcc

SEQ ID NO: 2328519 - RNA, 18 nt, Human
cugccuccccaacccugc

SEQ ID NO: 2328520 - RNA, 16 nt, Human
cugccuccccaacccu

SEQ ID NO: 2328521 - RNA, 15 nt, Human
cugccuccccaaccc

SEQ ID NO: 2328522 - RNA, 20 nt, Human
cugccucucugcaggucccu

SEQ ID NO: 2328523 - RNA, 21 nt, Human
cugccucucugcaggucccua

SEQ ID NO: 2328524 - RNA, 15 nt, Human
cugccucugacacac

SEQ ID NO: 2328525 - RNA, 22 nt, Human
cugccucucugcaggucccuaa

SEQ ID NO: 2328526 - RNA, 22 nt, Human
cugccucugacacacagcucug

SEQ ID NO: 2328527 - RNA, 23 nt, Human
cugccucugacacacagcucugu

SEQ ID NO: 2328528 - RNA, 13 nt, Human
cugccuaagcccu

SEQ ID NO: 2328529 - RNA, 11 nt, Human
cugccucccau

SEQ ID NO: 2328530 - RNA, 14 nt, Human
cugccgugugcccu

SEQ ID NO: 2328531 - RNA, 12 nt, Human
cugccucccauc

SEQ ID NO: 2328532 - RNA, 14 nt, Human
cugccucccaucac

SEQ ID NO: 2328533 - RNA, 16 nt, Human
cugccucccaucaccc

SEQ ID NO: 2328534 - RNA, 19 nt, Human
cugccucccaucacccgcu

SEQ ID NO: 2328535 - RNA, 14 nt, Human
cugccuuggcucag

SEQ ID NO: 2328536 - RNA, 22 nt, Human
cugccuuggcucagacauguuu

SEQ ID NO: 2328537 - RNA, 18 nt, Human
cugccuuggcucagacau

SEQ ID NO: 2328538 - RNA, 17 nt, Human
cugccuuggcucagaca

SEQ ID NO: 2328539 - RNA, 15 nt, Human
cugccuuggcucaga

SEQ ID NO: 2328540 - RNA, 21 nt, Human
cugccugggaucccucauccu

SEQ ID NO: 2328541 - RNA, 20 nt, Human
cugccuggcccccagcugug

SEQ ID NO: 2328542 - RNA, 16 nt, Human
cugccuggcccccagc

SEQ ID NO: 2328543 - RNA, 14 nt, Human
cugccuggccccca

SEQ ID NO: 2328544 - RNA, 18 nt, Human
cugccuggcccccugucc

SEQ ID NO: 2328545 - RNA, 17 nt, Human
cugccuggccaggcaga

SEQ ID NO: 2328546 - RNA, 16 nt, Human
cugccuggccaggcag

SEQ ID NO: 2328547 - RNA, 21 nt, Human
cugccuggccaggcagaucug

SEQ ID NO: 2328548 - RNA, 15 nt, Human
cugccuggccaggca

SEQ ID NO: 2328549 - RNA, 13 nt, Human
cugccuggccagg

SEQ ID NO: 2328550 - RNA, 12 nt, Human
cugccuggccag

SEQ ID NO: 2328551 - RNA, 17 nt, Human
cugccugaaccuuccau

SEQ ID NO: 2328552 - RNA, 18 nt, Human
cugccucugccugcauuc

SEQ ID NO: 2328553 - RNA, 20 nt, Human
cugccugcccaggccccugc

SEQ ID NO: 2328554 - RNA, 15 nt, Human
cugccugaagucaca

SEQ ID NO: 2328555 - RNA, 22 nt, Human
cugccucuucugggagggcagc

SEQ ID NO: 2328556 - RNA, 16 nt, Human
cugccucuucuguggg

SEQ ID NO: 2328557 - RNA, 16 nt, Human
cugccugcccaggccc

SEQ ID NO: 2328558 - RNA, 17 nt, Human
cugccugcccaggcccc

SEQ ID NO: 2328559 - RNA, 15 nt, Human
cugccucuucucuac

SEQ ID NO: 2328560 - RNA, 17 nt, Human
cugccucuucugggagg

SEQ ID NO: 2328561 - RNA, 16 nt, Human
cugccucuucugggag

SEQ ID NO: 2328562 - RNA, 20 nt, Human
cugccucugccugcauucug

SEQ ID NO: 2328563 - RNA, 17 nt, Human
cugccucugccugcauu

SEQ ID NO: 2328564 - RNA, 14 nt, Human
cugccucugccugc

SEQ ID NO: 2328565 - RNA, 21 nt, Human
cugccucugagggaaagccca

SEQ ID NO: 2328566 - RNA, 22 nt, Human
cugccuccccaacccugccccu

SEQ ID NO: 2328567 - RNA, 14 nt, Human
cugccucugaggga

SEQ ID NO: 2328568 - RNA, 15 nt, Human
cugccucugagggaa

SEQ ID NO: 2328569 - RNA, 19 nt, Human
cugccucucugcagguccc

SEQ ID NO: 2328570 - RNA, 12 nt, Human
cugcccuaggcu

SEQ ID NO: 2328571 - RNA, 22 nt, Human
cugcccuagcuccacacccucu

SEQ ID NO: 2328572 - RNA, 16 nt, Human
cugcccuagcuccaca

SEQ ID NO: 2328573 - RNA, 15 nt, Human
cugcccuagcuccac

SEQ ID NO: 2328574 - RNA, 21 nt, Human
cugcccuagagcacacuguag

SEQ ID NO: 2328575 - RNA, 19 nt, Human
cugcccuagagcacacugu

SEQ ID NO: 2328576 - RNA, 13 nt, Human
cucccuggccugu

SEQ ID NO: 2328577 - RNA, 19 nt, Human
cucccuucaugcauggaaa

SEQ ID NO: 2328578 - RNA, 15 nt, Human
cugcccuagagcaca

SEQ ID NO: 2328579 - RNA, 18 nt, Human
cugcccuaggcuccguca

SEQ ID NO: 2328580 - RNA, 12 nt, Human
cugcccucaggg

SEQ ID NO: 2328581 - RNA, 19 nt, Human
cugcccucauggccccucu

SEQ ID NO: 2328582 - RNA, 12 nt, Human
cugcccuccaag

SEQ ID NO: 2328583 - RNA, 14 nt, Human
cucccuucccaccu

SEQ ID NO: 2328584 - RNA, 15 nt, Human
cucccuucccaccuc

SEQ ID NO: 2328585 - RNA, 16 nt, Human
cucccuucccaccucu

SEQ ID NO: 2328586 - RNA, 17 nt, Human
cucccuucccaccucuc

SEQ ID NO: 2328587 - RNA, 12 nt, Human
cugcccuuccuc

SEQ ID NO: 2328588 - RNA, 16 nt, Human
cugcccuggcugcugc

SEQ ID NO: 2328589 - RNA, 17 nt, Human
cugcccuggcugcugcc

SEQ ID NO: 2328590 - RNA, 14 nt, Human
cugcccuuccucag

SEQ ID NO: 2328591 - RNA, 15 nt, Human
cugcccuuccucagu

SEQ ID NO: 2328592 - RNA, 12 nt, Human
cugcccuggcug

SEQ ID NO: 2328593 - RNA, 23 nt, Human
cugcccuggcccugagguguggg

SEQ ID NO: 2328594 - RNA, 14 nt, Human
cugcccuggcugcu

SEQ ID NO: 2328595 - RNA, 16 nt, Human
cugcccuggcccugag

SEQ ID NO: 2328596 - RNA, 17 nt, Human
cugcccuggcccugagg

SEQ ID NO: 2328597 - RNA, 18 nt, Human
cugcccuggcccugaggu

SEQ ID NO: 2328598 - RNA, 22 nt, Human
cugcccuggcccugaggugugg

SEQ ID NO: 2328599 - RNA, 22 nt, Human
cugcccugcugccgccucccag

SEQ ID NO: 2328600 - RNA, 21 nt, Human
cugcccugcugccgccuccca

SEQ ID NO: 2328601 - RNA, 22 nt, Human
cugcccugcugagucccaggcu

SEQ ID NO: 2328602 - RNA, 16 nt, Human
cugcccugccugaggg

SEQ ID NO: 2328603 - RNA, 12 nt, Human
cugcccuggccc

SEQ ID NO: 2328604 - RNA, 13 nt, Human
cugcccuggcccu

SEQ ID NO: 2328605 - RNA, 14 nt, Human
cugcccuggcccug

SEQ ID NO: 2328606 - RNA, 15 nt, Human
cugcccuggcccuga

SEQ ID NO: 2328607 - RNA, 11 nt, Human
cugcccugcug

SEQ ID NO: 2328608 - RNA, 13 nt, Human
cugcccucaggga

SEQ ID NO: 2328609 - RNA, 20 nt, Human
cugcccugcgggucacagga

SEQ ID NO: 2328610 - RNA, 12 nt, Human
cugcccucaugg

SEQ ID NO: 2328611 - RNA, 21 nt, Human
cugccgguaaacacgccugca

SEQ ID NO: 2328612 - RNA, 18 nt, Human
cugccgguaaacacgccu

SEQ ID NO: 2328613 - RNA, 19 nt, Human
cugccggguucuagucucc

SEQ ID NO: 2328614 - RNA, 20 nt, Human
cugccggguucuagucuccu

SEQ ID NO: 2328615 - RNA, 21 nt, Human
cugccggguucuagucuccuu

SEQ ID NO: 2328616 - RNA, 23 nt, Human
cugccggguucuagucuccuuug

SEQ ID NO: 2328617 - RNA, 13 nt, Human
cugccguggggcc

SEQ ID NO: 2328618 - RNA, 20 nt, Human
cugccguggggccgccgccu

SEQ ID NO: 2328619 - RNA, 21 nt, Human
cugccguggggccgccgccuc

SEQ ID NO: 2328620 - RNA, 14 nt, Human
cugccggcucuuuc

SEQ ID NO: 2328621 - RNA, 20 nt, Human
cugccggcucuuuccuugcu

SEQ ID NO: 2328622 - RNA, 22 nt, Human
cugccggcucuuuccuugcuca

SEQ ID NO: 2328623 - RNA, 19 nt, Human
cugccgcaauacaggaacc

SEQ ID NO: 2328624 - RNA, 17 nt, Human
cugccgcaauacaggaa

SEQ ID NO: 2328625 - RNA, 18 nt, Human
cugccgcaauacaggaac

SEQ ID NO: 2328626 - RNA, 14 nt, Human
cugccggguucuag

SEQ ID NO: 2328627 - RNA, 17 nt, Human
cugccgcagcccugcag

SEQ ID NO: 2328628 - RNA, 18 nt, Human
cugccgcagcccugcaga

SEQ ID NO: 2328629 - RNA, 19 nt, Human
cugccgaccucguccuccc

SEQ ID NO: 2328630 - RNA, 17 nt, Human
cugccgaccucguccuc

SEQ ID NO: 2328631 - RNA, 15 nt, Human
cugccgaccucgucc

SEQ ID NO: 2328632 - RNA, 23 nt, Human
cugccgaccgaggcuggagcugg

SEQ ID NO: 2328633 - RNA, 19 nt, Human
cugccgacuccuggguuga

SEQ ID NO: 2328634 - RNA, 14 nt, Human
cugccgacuccugg

SEQ ID NO: 2328635 - RNA, 15 nt, Human
cugccgacuccuggg

SEQ ID NO: 2328636 - RNA, 14 nt, Human
cugccgcagcccug

SEQ ID NO: 2328637 - RNA, 17 nt, Human
cugccgcaacaguuuuu

SEQ ID NO: 2328638 - RNA, 15 nt, Human
cugccgcagcccugc

SEQ ID NO: 2328639 - RNA, 18 nt, Human
cugcccuugucccacuca

SEQ ID NO: 2328640 - RNA, 17 nt, Human
cugcccuugucccacuc

SEQ ID NO: 2328641 - RNA, 15 nt, Human
cugcccuugucccac

SEQ ID NO: 2328642 - RNA, 22 nt, Human
cugcccuuccucaguuuaaucc

SEQ ID NO: 2328643 - RNA, 23 nt, Human
cugcccuugucccacucaagcca

SEQ ID NO: 2328644 - RNA, 16 nt, Human
cugcccuugucugaga

SEQ ID NO: 2328645 - RNA, 21 nt, Human
cugcccuuucugggcaccggg

SEQ ID NO: 2328646 - RNA, 13 nt, Human
cugccgaccagag

SEQ ID NO: 2328647 - RNA, 22 nt, Human
cugccgaccgaggcuggagcug

SEQ ID NO: 2328648 - RNA, 21 nt, Human
cugccgaccgaggcuggagcu

SEQ ID NO: 2328649 - RNA, 16 nt, Human
cugccgaccgaggcug

SEQ ID NO: 2328650 - RNA, 16 nt, Human
cugccgaccagagccc

SEQ ID NO: 2328651 - RNA, 15 nt, Human
cugccgaccagagcc

SEQ ID NO: 2328652 - RNA, 20 nt, Human
cugcgacuuucugccuggag

SEQ ID NO: 2328653 - RNA, 18 nt, Human
cugcgacuuucugccugg

SEQ ID NO: 2328654 - RNA, 19 nt, Human
cugcgacuuucugccugga

SEQ ID NO: 2328655 - RNA, 19 nt, Human
cugcuccagcuguucagcu

SEQ ID NO: 2328656 - RNA, 20 nt, Human
cugcuccagcuguucagcug

SEQ ID NO: 2328657 - RNA, 14 nt, Human
cugcgaucuucaga

SEQ ID NO: 2328658 - RNA, 17 nt, Human
cugcgaucuucagagca

SEQ ID NO: 2328659 - RNA, 19 nt, Human
cugcgaucuucagagcagg

SEQ ID NO: 2328660 - RNA, 17 nt, Human
cugcgauuuugccugug

SEQ ID NO: 2328661 - RNA, 20 nt, Human
cugccuuuagucgcugagga

SEQ ID NO: 2328662 - RNA, 12 nt, Human
cugccuuuauug

SEQ ID NO: 2328663 - RNA, 14 nt, Human
cugccuuguguaca

SEQ ID NO: 2328664 - RNA, 19 nt, Human
cugcgaccacaagaaggau

SEQ ID NO: 2328665 - RNA, 14 nt, Human
cugcgacuuucugc

SEQ ID NO: 2328666 - RNA, 16 nt, Human
cugcgacuuucugccu

SEQ ID NO: 2328667 - RNA, 17 nt, Human
cugcgacuuucugccug

SEQ ID NO: 2328668 - RNA, 15 nt, Human
cugccuuuauugugu

SEQ ID NO: 2328669 - RNA, 17 nt, Human
cugccuuuauuguguuu

SEQ ID NO: 2328670 - RNA, 18 nt, Human
cugccuuuauuguguuug

SEQ ID NO: 2328671 - RNA, 24 nt, Human
cugcuccuccagggccacgugcca

SEQ ID NO: 2328672 - RNA, 22 nt, Human
cugcuccuccagggccacgugc

SEQ ID NO: 2328673 - RNA, 12 nt, Human
cugcuccucccu

SEQ ID NO: 2328674 - RNA, 13 nt, Human
cugcuccucccug

SEQ ID NO: 2328675 - RNA, 17 nt, Human
cugcuccuccagggcca

SEQ ID NO: 2328676 - RNA, 16 nt, Human
cugcuccuccagggcc

SEQ ID NO: 2328677 - RNA, 14 nt, Human
cugcuccuccaggg

SEQ ID NO: 2328678 - RNA, 13 nt, Human
cugcuccuccagg

SEQ ID NO: 2328679 - RNA, 14 nt, Human
cugcuccucauggu

SEQ ID NO: 2328680 - RNA, 13 nt, Human
cugcuccucaugg

SEQ ID NO: 2328681 - RNA, 11 nt, Human
cugcuccucca

SEQ ID NO: 2328682 - RNA, 12 nt, Human
cugcuccuccag

SEQ ID NO: 2328683 - RNA, 22 nt, Human
cugcuccuagagggaggggccu

SEQ ID NO: 2328684 - RNA, 21 nt, Human
cugcuccuagagggaggggcc

SEQ ID NO: 2328685 - RNA, 17 nt, Human
cugcuccuagagggagg

SEQ ID NO: 2328686 - RNA, 15 nt, Human
cugcuccuagaggga

SEQ ID NO: 2328687 - RNA, 14 nt, Human
cugcuccuagaggg

SEQ ID NO: 2328688 - RNA, 20 nt, Human
cugcgaucuucagagcaggg

SEQ ID NO: 2328689 - RNA, 19 nt, Human
cugcucuccgaccagacac

SEQ ID NO: 2328690 - RNA, 14 nt, Human
cugcuccucccugg

SEQ ID NO: 2328691 - RNA, 15 nt, Human
cugcuccucccuggc

SEQ ID NO: 2328692 - RNA, 16 nt, Human
cugcuccucccuggcu

SEQ ID NO: 2328693 - RNA, 17 nt, Human
cugcuccucccuggcug

SEQ ID NO: 2328694 - RNA, 18 nt, Human
cugcuccucccuggcugc

SEQ ID NO: 2328695 - RNA, 19 nt, Human
cugcuccucccuggcugcc

SEQ ID NO: 2328696 - RNA, 20 nt, Human
cugcuccucccuggcugccc

SEQ ID NO: 2328697 - RNA, 21 nt, Human
cugcuccucccuggcugcccu

SEQ ID NO: 2328698 - RNA, 14 nt, Human
cugcucuccucuug

SEQ ID NO: 2328699 - RNA, 20 nt, Human
cugcucuccucuugccacug

SEQ ID NO: 2328700 - RNA, 13 nt, Human
cugcuccucucca

SEQ ID NO: 2328701 - RNA, 22 nt, Human
cugcuccucccuggcugcccug

SEQ ID NO: 2328702 - RNA, 23 nt, Human
cugcuccucccuggcugcccugg

SEQ ID NO: 2328703 - RNA, 21 nt, Human
cugcucuccucuugccacugc

SEQ ID NO: 2328704 - RNA, 12 nt, Human
cugcucuccuuc

SEQ ID NO: 2328705 - RNA, 13 nt, Human
cugcucuccuucc

SEQ ID NO: 2328706 - RNA, 17 nt, Human
cugcugaaggaauaaau

SEQ ID NO: 2328707 - RNA, 18 nt, Human
cugcugaaggaauaaauu

SEQ ID NO: 2328708 - RNA, 15 nt, Human
cugcucuccuuccug

SEQ ID NO: 2328709 - RNA, 21 nt, Human
cugcugaagaugaaucaaugg

SEQ ID NO: 2328710 - RNA, 15 nt, Human
cugcugaagcugccu

SEQ ID NO: 2328711 - RNA, 16 nt, Human
cugcugaagcugccug

SEQ ID NO: 2328712 - RNA, 19 nt, Human
cugcugaagcugccugcuu

SEQ ID NO: 2328713 - RNA, 20 nt, Human
cugcugaagcugccugcuuu

SEQ ID NO: 2328714 - RNA, 16 nt, Human
cugcugcagaggggca

SEQ ID NO: 2328715 - RNA, 17 nt, Human
cugcugcagaggggcag

SEQ ID NO: 2328716 - RNA, 18 nt, Human
cugcugcagaggggcagg

SEQ ID NO: 2328717 - RNA, 21 nt, Human
cugcugcagaggggcaggccc

SEQ ID NO: 2328718 - RNA, 22 nt, Human
cugcugcagaggggcaggcccu

SEQ ID NO: 2328719 - RNA, 22 nt, Human
cugcugcaaggccuuucugugu

SEQ ID NO: 2328720 - RNA, 23 nt, Human
cugcugcaaggccuuucugugug

SEQ ID NO: 2328721 - RNA, 15 nt, Human
cugcugcaccaaccc

SEQ ID NO: 2328722 - RNA, 17 nt, Human
cugcugcaccaacccag

SEQ ID NO: 2328723 - RNA, 18 nt, Human
cugcugcaccaacccagc

SEQ ID NO: 2328724 - RNA, 19 nt, Human
cugcugcaccaacccagcc

SEQ ID NO: 2328725 - RNA, 20 nt, Human
cugcugcaccaacccagccg

SEQ ID NO: 2328726 - RNA, 23 nt, Human
cugcugcaccaacccagccgcug

SEQ ID NO: 2328727 - RNA, 11 nt, Human
cugcugaaggc

SEQ ID NO: 2328728 - RNA, 13 nt, Human
cugcugcaaggcc

SEQ ID NO: 2328729 - RNA, 15 nt, Human
cugcugcaaggccuu

SEQ ID NO: 2328730 - RNA, 16 nt, Human
cugcugcaaggccuuu

SEQ ID NO: 2328731 - RNA, 19 nt, Human
cugcugcaaggccuuucug

SEQ ID NO: 2328732 - RNA, 21 nt, Human
cugcugcaaggccuuucugug

SEQ ID NO: 2328733 - RNA, 12 nt, Human
cugcugcccagc

SEQ ID NO: 2328734 - RNA, 15 nt, Human
cugcugcccagccuc

SEQ ID NO: 2328735 - RNA, 14 nt, Human
cugcugcccccacc

SEQ ID NO: 2328736 - RNA, 22 nt, Human
cugcugcccagccuccaagcuc

SEQ ID NO: 2328737 - RNA, 14 nt, Human
cugcugcccuccau

SEQ ID NO: 2328738 - RNA, 13 nt, Human
cugcugcccucca

SEQ ID NO: 2328739 - RNA, 17 nt, Human
cugcugcccuccauccc

SEQ ID NO: 2328740 - RNA, 12 nt, Human
cugcugcccucc

SEQ ID NO: 2328741 - RNA, 15 nt, Human
cugcugcccccaccc

SEQ ID NO: 2328742 - RNA, 12 nt, Human
cugcugcccagg

SEQ ID NO: 2328743 - RNA, 22 nt, Human
cugcugcccccaccccggggac

SEQ ID NO: 2328744 - RNA, 21 nt, Human
cugcugcccccaccccgggga

SEQ ID NO: 2328745 - RNA, 16 nt, Human
cugcugcauggggugg

SEQ ID NO: 2328746 - RNA, 22 nt, Human
cugcugccauggcgugucccuc

SEQ ID NO: 2328747 - RNA, 19 nt, Human
cugcugcaggggcucugga

SEQ ID NO: 2328748 - RNA, 20 nt, Human
cugcugcaggggcucuggag

SEQ ID NO: 2328749 - RNA, 23 nt, Human
cugcugcagaggggcaggcccug

SEQ ID NO: 2328750 - RNA, 11 nt, Human
cugcugcaggg

SEQ ID NO: 2328751 - RNA, 12 nt, Human
cugcugcagggg

SEQ ID NO: 2328752 - RNA, 13 nt, Human
cugcugcaggggc

SEQ ID NO: 2328753 - RNA, 14 nt, Human
cugcugcaggggcu

SEQ ID NO: 2328754 - RNA, 16 nt, Human
cugcugcaggggcucu

SEQ ID NO: 2328755 - RNA, 17 nt, Human
cugcugcaggggcucug

SEQ ID NO: 2328756 - RNA, 18 nt, Human
cugcugcaggggcucugg

SEQ ID NO: 2328757 - RNA, 15 nt, Human
cugcuuccagugagg

SEQ ID NO: 2328758 - RNA, 16 nt, Human
cugcuuccagugaggc

SEQ ID NO: 2328759 - RNA, 18 nt, Human
cugcuuccagugaggcuc

SEQ ID NO: 2328760 - RNA, 19 nt, Human
cugcuuccagugaggcucu

SEQ ID NO: 2328761 - RNA, 20 nt, Human
cugcuuccagugaggcucug

SEQ ID NO: 2328762 - RNA, 21 nt, Human
cugcuuccagugaggcucugc

SEQ ID NO: 2328763 - RNA, 23 nt, Human
cugcuuccagugaggcucugccc

SEQ ID NO: 2328764 - RNA, 23 nt, Human
cugcugggcucuccaccucagcc

SEQ ID NO: 2328765 - RNA, 12 nt, Human
cugcugggcugg

SEQ ID NO: 2328766 - RNA, 22 nt, Human
cugcugggcucuccaccucagc

SEQ ID NO: 2328767 - RNA, 21 nt, Human
cugcugggcucuccaccucag

SEQ ID NO: 2328768 - RNA, 19 nt, Human
cugcugggcucuccaccuc

SEQ ID NO: 2328769 - RNA, 18 nt, Human
cugcugggcucuccaccu

SEQ ID NO: 2328770 - RNA, 17 nt, Human
cugcugggcucuccacc

SEQ ID NO: 2328771 - RNA, 16 nt, Human
cugcugggcucuccac

SEQ ID NO: 2328772 - RNA, 11 nt, Human
cugcugggcuu

SEQ ID NO: 2328773 - RNA, 13 nt, Human
cugcugggcuggg

SEQ ID NO: 2328774 - RNA, 14 nt, Human
cugcugggcugggg

SEQ ID NO: 2328775 - RNA, 15 nt, Human
cugcugggcuggggc

SEQ ID NO: 2328776 - RNA, 17 nt, Human
cugcugggcuggggccu

SEQ ID NO: 2328777 - RNA, 15 nt, Human
cugcugggcucucca

SEQ ID NO: 2328778 - RNA, 18 nt, Human
cugcuggcgccucugcaa

SEQ ID NO: 2328779 - RNA, 20 nt, Human
cugcuggcgccucugcaagg

SEQ ID NO: 2328780 - RNA, 12 nt, Human
cugcuggcucuu

SEQ ID NO: 2328781 - RNA, 19 nt, Human
cugcuggcucuucugccca

SEQ ID NO: 2328782 - RNA, 16 nt, Human
cugcuggccuggaucu

SEQ ID NO: 2328783 - RNA, 13 nt, Human
cugcuggccuggc

SEQ ID NO: 2328784 - RNA, 16 nt, Human
cugcuggccuggccgg

SEQ ID NO: 2328785 - RNA, 20 nt, Human
cugcuggccuggccggcaac

SEQ ID NO: 2328786 - RNA, 14 nt, Human
cugcuggcgccucu

SEQ ID NO: 2328787 - RNA, 15 nt, Human
cugcuggcgccucug

SEQ ID NO: 2328788 - RNA, 16 nt, Human
cugcuggcgccucugc

SEQ ID NO: 2328789 - RNA, 17 nt, Human
cugcuggcgccucugca

SEQ ID NO: 2328790 - RNA, 13 nt, Human
cugcugguucagg

SEQ ID NO: 2328791 - RNA, 21 nt, Human
cugcugggcuggggccugaug

SEQ ID NO: 2328792 - RNA, 18 nt, Human
cugcugggcuggggccug

SEQ ID NO: 2328793 - RNA, 19 nt, Human
cugcugggcuggggccuga

SEQ ID NO: 2328794 - RNA, 15 nt, Human
cugcugguucagggu

SEQ ID NO: 2328795 - RNA, 23 nt, Human
cugcugguucaggguuggccccu

SEQ ID NO: 2328796 - RNA, 15 nt, Human
cugcuggaaacagac

SEQ ID NO: 2328797 - RNA, 20 nt, Human
cugcugcuuuuugagguggc

SEQ ID NO: 2328798 - RNA, 22 nt, Human
cugcugcuuuuugagguggcac

SEQ ID NO: 2328799 - RNA, 22 nt, Human
cugcuggacaguaucacugucu

SEQ ID NO: 2328800 - RNA, 20 nt, Human
cugcuggacaguaucacugu

SEQ ID NO: 2328801 - RNA, 15 nt, Human
cugcuggacaguauc

SEQ ID NO: 2328802 - RNA, 13 nt, Human
cugcugcuucuua

SEQ ID NO: 2328803 - RNA, 13 nt, Human
cugcugcuguguu

SEQ ID NO: 2328804 - RNA, 11 nt, Human
cugcuggagga

SEQ ID NO: 2328805 - RNA, 20 nt, Human
cugcuggaguuucauguaca

SEQ ID NO: 2328806 - RNA, 21 nt, Human
cugcuggcacauuuccccaga

SEQ ID NO: 2328807 - RNA, 23 nt, Human
cugcuggaucacagcugcuuucu

SEQ ID NO: 2328808 - RNA, 14 nt, Human
cugcuggcacccac

SEQ ID NO: 2328809 - RNA, 21 nt, Human
cugcuggaguuucauguacaa

SEQ ID NO: 2328810 - RNA, 21 nt, Human
cugcuggaucacagcugcuuu

SEQ ID NO: 2328811 - RNA, 22 nt, Human
cugcuggcccagccaaacccug

SEQ ID NO: 2328812 - RNA, 16 nt, Human
cugcuggcccagccaa

SEQ ID NO: 2328813 - RNA, 15 nt, Human
cugcuggcccagcca

SEQ ID NO: 2328814 - RNA, 16 nt, Human
cugcuggcacccaccg

SEQ ID NO: 2328815 - RNA, 17 nt, Human
cugcuggcacccaccgu

SEQ ID NO: 2328816 - RNA, 23 nt, Human
cugcuggccccucaccugggcac

SEQ ID NO: 2328817 - RNA, 13 nt, Human
cugcuggccgccu

SEQ ID NO: 2328818 - RNA, 17 nt, Human
cugcuggccccucaccu

SEQ ID NO: 2328819 - RNA, 16 nt, Human
cugcuggccccucacc

SEQ ID NO: 2328820 - RNA, 15 nt, Human
cugcuggccccucac

SEQ ID NO: 2328821 - RNA, 14 nt, Human
cugcuggccccuca

SEQ ID NO: 2328822 - RNA, 11 nt, Human
cugcuggcccc

SEQ ID NO: 2328823 - RNA, 15 nt, Human
cugcuggccggagca

SEQ ID NO: 2328824 - RNA, 16 nt, Human
cugcuggccggagcaa

SEQ ID NO: 2328825 - RNA, 20 nt, Human
cugcuggccgccucaccccc

SEQ ID NO: 2328826 - RNA, 15 nt, Human
cugcuggccgccuca

SEQ ID NO: 2328827 - RNA, 18 nt, Human
cugcuggccgccucaccc

SEQ ID NO: 2328828 - RNA, 12 nt, Human
cugcuggccugg

SEQ ID NO: 2328829 - RNA, 13 nt, Human
cugcuggccugga

SEQ ID NO: 2328830 - RNA, 14 nt, Human
cugcuggccuggau

SEQ ID NO: 2328831 - RNA, 15 nt, Human
cugcuggccuggauc

SEQ ID NO: 2328832 - RNA, 20 nt, Human
cugcugccgccucccagccu

SEQ ID NO: 2328833 - RNA, 16 nt, Human
cugcugcgcccugggc

SEQ ID NO: 2328834 - RNA, 20 nt, Human
cugcugccgccccacccaga

SEQ ID NO: 2328835 - RNA, 17 nt, Human
cugcugcgcccugggcu

SEQ ID NO: 2328836 - RNA, 18 nt, Human
cugcugcgcccugggcuc

SEQ ID NO: 2328837 - RNA, 17 nt, Human
cugcugcgcccuuaccu

SEQ ID NO: 2328838 - RNA, 20 nt, Human
cugcugcgcccuuaccuucc

SEQ ID NO: 2328839 - RNA, 21 nt, Human
cugcugcgcccuuaccuuccc

SEQ ID NO: 2328840 - RNA, 19 nt, Human
cugcugccgccucccagcc

SEQ ID NO: 2328841 - RNA, 17 nt, Human
cugcugccgccucccag

SEQ ID NO: 2328842 - RNA, 14 nt, Human
cugcugccgccucc

SEQ ID NO: 2328843 - RNA, 19 nt, Human
cugcugccgccccacccag

SEQ ID NO: 2328844 - RNA, 21 nt, Human
cugcugcuaaucuucagggca

SEQ ID NO: 2328845 - RNA, 15 nt, Human
cugcugcuggcuggu

SEQ ID NO: 2328846 - RNA, 14 nt, Human
cugcugcugucccu

SEQ ID NO: 2328847 - RNA, 17 nt, Human
cuggacaccgggccagu

SEQ ID NO: 2328848 - RNA, 23 nt, Human
cuggacaagccaacuuguaaaua

SEQ ID NO: 2328849 - RNA, 22 nt, Human
cuggacaccgggccaguaucua

SEQ ID NO: 2328850 - RNA, 15 nt, Human
cuggacaagcagagg

SEQ ID NO: 2328851 - RNA, 18 nt, Human
cuggacaagcagaggugg

SEQ ID NO: 2328852 - RNA, 11 nt, Human
cuggacaagcc

SEQ ID NO: 2328853 - RNA, 15 nt, Human
cuggacaagccaacu

SEQ ID NO: 2328854 - RNA, 21 nt, Human
cuggacaagccaacuuguaaa

SEQ ID NO: 2328855 - RNA, 13 nt, Human
cuggaauuugaaa

SEQ ID NO: 2328856 - RNA, 15 nt, Human
cugcuuccuccugga

SEQ ID NO: 2328857 - RNA, 16 nt, Human
cugcuuccuccuggaa

SEQ ID NO: 2328858 - RNA, 18 nt, Human
cugcuuccuccuggaaau

SEQ ID NO: 2328859 - RNA, 21 nt, Human
cuggaauuugcaagucauggc

SEQ ID NO: 2328860 - RNA, 22 nt, Human
cuggaauuugcaagucauggcu

SEQ ID NO: 2328861 - RNA, 23 nt, Human
cuggaauuugcaagucauggcug

SEQ ID NO: 2328862 - RNA, 21 nt, Human
cugcuucccucugccuguccc

SEQ ID NO: 2328863 - RNA, 20 nt, Human
cugcuucccucugccugucc

SEQ ID NO: 2328864 - RNA, 18 nt, Human
cugcuucccucugccugu

SEQ ID NO: 2328865 - RNA, 14 nt, Human
cugcuucccucugc

SEQ ID NO: 2328866 - RNA, 15 nt, Human
cugcuucccauccua

SEQ ID NO: 2328867 - RNA, 18 nt, Human
cugcuucccauccuaccc

SEQ ID NO: 2328868 - RNA, 19 nt, Human
cugcuucccauccuacccu

SEQ ID NO: 2328869 - RNA, 24 nt, Human
cugcuucccauccuacccucgggc

SEQ ID NO: 2328870 - RNA, 11 nt, Human
cugcuucccau

SEQ ID NO: 2328871 - RNA, 12 nt, Human
cugcuucccauc

SEQ ID NO: 2328872 - RNA, 13 nt, Human
cugcuucccaucc

SEQ ID NO: 2328873 - RNA, 14 nt, Human
cugcuucccauccu

SEQ ID NO: 2328874 - RNA, 23 nt, Human
cugcuucccucugccugucccuc

SEQ ID NO: 2328875 - RNA, 22 nt, Human
cugcuucccucugccugucccu

SEQ ID NO: 2328876 - RNA, 12 nt, Human
cugcuuccuccu

SEQ ID NO: 2328877 - RNA, 13 nt, Human
cugcuuccuccug

SEQ ID NO: 2328878 - RNA, 14 nt, Human
cugcuuccuccugg

SEQ ID NO: 2328879 - RNA, 23 nt, Human
cuggacaggcauguucucugagg

SEQ ID NO: 2328880 - RNA, 17 nt, Human
cuggacacucagaccug

SEQ ID NO: 2328881 - RNA, 15 nt, Human
cuggacacucagacc

SEQ ID NO: 2328882 - RNA, 16 nt, Human
cuggacacucagaccu

SEQ ID NO: 2328883 - RNA, 14 nt, Human
cuggacaggcaugu

SEQ ID NO: 2328884 - RNA, 17 nt, Human
cuggacaggcauguucu

SEQ ID NO: 2328885 - RNA, 21 nt, Human
cuggaccaguggucucacaug

SEQ ID NO: 2328886 - RNA, 18 nt, Human
cuggaccccaucugugaa

SEQ ID NO: 2328887 - RNA, 17 nt, Human
cuggaccccaucuguga

SEQ ID NO: 2328888 - RNA, 13 nt, Human
cuggacuccggcc

SEQ ID NO: 2328889 - RNA, 15 nt, Human
cuggacuccggcccu

SEQ ID NO: 2328890 - RNA, 14 nt, Human
cuggacggcaggcu

SEQ ID NO: 2328891 - RNA, 20 nt, Human
cuggacggcaggcucacugc

SEQ ID NO: 2328892 - RNA, 21 nt, Human
cuggacggcaggcucacugcc

SEQ ID NO: 2328893 - RNA, 22 nt, Human
cuggacggcaggcucacugcca

SEQ ID NO: 2328894 - RNA, 14 nt, Human
cuggacuccucugu

SEQ ID NO: 2328895 - RNA, 17 nt, Human
cuggacuccucugucca

SEQ ID NO: 2328896 - RNA, 18 nt, Human
cuggacuccggcccuccu

SEQ ID NO: 2328897 - RNA, 18 nt, Human
cuggacuccucuguccag

SEQ ID NO: 2328898 - RNA, 19 nt, Human
cuggacuccucuguccagg

SEQ ID NO: 2328899 - RNA, 17 nt, Human
cuggaccuugaacuggg

SEQ ID NO: 2328900 - RNA, 20 nt, Human
cuggaccuugaacuggguac

SEQ ID NO: 2328901 - RNA, 21 nt, Human
cuggaccuugaacuggguacu

SEQ ID NO: 2328902 - RNA, 15 nt, Human
cuggaccugccuccu

SEQ ID NO: 2328903 - RNA, 17 nt, Human
cuggaccugccuccugc

SEQ ID NO: 2328904 - RNA, 21 nt, Human
cuggaccugccuccugccugc

SEQ ID NO: 2328905 - RNA, 20 nt, Human
cuggaccugccuccugccug

SEQ ID NO: 2328906 - RNA, 13 nt, Human
cuggacggcaggc

SEQ ID NO: 2328907 - RNA, 12 nt, Human
cuggaccugccu

SEQ ID NO: 2328908 - RNA, 16 nt, Human
cuggaccuugaacugg

SEQ ID NO: 2328909 - RNA, 15 nt, Human
cuggaccuauguccu

SEQ ID NO: 2328910 - RNA, 19 nt, Human
cuggaccuauguccuaagg

SEQ ID NO: 2328911 - RNA, 20 nt, Human
cuggaccuauguccuaagga

SEQ ID NO: 2328912 - RNA, 15 nt, Human
cuggacccuguugcu

SEQ ID NO: 2328913 - RNA, 16 nt, Human
cuggacccuguugcua

SEQ ID NO: 2328914 - RNA, 17 nt, Human
cuggacccuguugcuaa

SEQ ID NO: 2328915 - RNA, 18 nt, Human
cuggacccuguugcuaag

SEQ ID NO: 2328916 - RNA, 15 nt, Human
cuggacccuguggau

SEQ ID NO: 2328917 - RNA, 14 nt, Human
cuggacccuguugc

SEQ ID NO: 2328918 - RNA, 14 nt, Human
cuggacccccagcu

SEQ ID NO: 2328919 - RNA, 22 nt, Human
cuggaccccaucugugaauaag

SEQ ID NO: 2328920 - RNA, 20 nt, Human
cuggaccccaucugugaaua

SEQ ID NO: 2328921 - RNA, 19 nt, Human
cuggaccccaucugugaau

SEQ ID NO: 2328922 - RNA, 20 nt, Human
cuggagucaugccaagcauu

SEQ ID NO: 2328923 - RNA, 15 nt, Human
cuggaguccagucuc

SEQ ID NO: 2328924 - RNA, 15 nt, Human
cuggagucuccagug

SEQ ID NO: 2328925 - RNA, 15 nt, Human
cuggagugaggaaaa

SEQ ID NO: 2328926 - RNA, 14 nt, Human
cuggagucuccagu

SEQ ID NO: 2328927 - RNA, 16 nt, Human
cuggaguccagucucu

SEQ ID NO: 2328928 - RNA, 14 nt, Human
cuggagugaggggu

SEQ ID NO: 2328929 - RNA, 12 nt, Human
cuggagugcagg

SEQ ID NO: 2328930 - RNA, 16 nt, Human
cuggagugcagggagg

SEQ ID NO: 2328931 - RNA, 17 nt, Human
cuggagguuuguuuaga

SEQ ID NO: 2328932 - RNA, 12 nt, Human
cuggagguuugu

SEQ ID NO: 2328933 - RNA, 17 nt, Human
cuggagguugaagccaa

SEQ ID NO: 2328934 - RNA, 19 nt, Human
cuggagguugaagccaagu

SEQ ID NO: 2328935 - RNA, 15 nt, Human
cuggagguugauaac

SEQ ID NO: 2328936 - RNA, 17 nt, Human
cuggagguugauaacuu

SEQ ID NO: 2328937 - RNA, 18 nt, Human
cuggagguugauaacuuu

SEQ ID NO: 2328938 - RNA, 19 nt, Human
cuggagguugauaacuuug

SEQ ID NO: 2328939 - RNA, 21 nt, Human
cuggagguugauaacuuugcu

SEQ ID NO: 2328940 - RNA, 22 nt, Human
cuggagguugauaacuuugcuu

SEQ ID NO: 2328941 - RNA, 14 nt, Human
cuggagugcaguga

SEQ ID NO: 2328942 - RNA, 15 nt, Human
cuggagugcagugag

SEQ ID NO: 2328943 - RNA, 16 nt, Human
cuggagugcagugagc

SEQ ID NO: 2328944 - RNA, 17 nt, Human
cuggagugcagugagcc

SEQ ID NO: 2328945 - RNA, 23 nt, Human
cuggaggggcauggccagcagcu

SEQ ID NO: 2328946 - RNA, 22 nt, Human
cuggaggggcauggccagcagc

SEQ ID NO: 2328947 - RNA, 12 nt, Human
cuggaggggccc

SEQ ID NO: 2328948 - RNA, 14 nt, Human
cuggaggggccccu

SEQ ID NO: 2328949 - RNA, 14 nt, Human
cuggaggggcaugg

SEQ ID NO: 2328950 - RNA, 13 nt, Human
cuggaggggaggg

SEQ ID NO: 2328951 - RNA, 21 nt, Human
cuggaggggcuagaaccuaga

SEQ ID NO: 2328952 - RNA, 15 nt, Human
cuggaggggccccug

SEQ ID NO: 2328953 - RNA, 16 nt, Human
cuggaggggccccugc

SEQ ID NO: 2328954 - RNA, 17 nt, Human
cuggaggggccccugcu

SEQ ID NO: 2328955 - RNA, 23 nt, Human
cuggaggggccccugcuucucca

SEQ ID NO: 2328956 - RNA, 17 nt, Human
cuggagguacgaaaaga

SEQ ID NO: 2328957 - RNA, 16 nt, Human
cuggagggguguggcu

SEQ ID NO: 2328958 - RNA, 20 nt, Human
cuggagggguguggcuccuu

SEQ ID NO: 2328959 - RNA, 16 nt, Human
cuggagguaaggccuu

SEQ ID NO: 2328960 - RNA, 20 nt, Human
cuggagguaaggccuuugag

SEQ ID NO: 2328961 - RNA, 22 nt, Human
cuggagguacgaaaagagggga

SEQ ID NO: 2328962 - RNA, 13 nt, Human
cuggaggugccag

SEQ ID NO: 2328963 - RNA, 22 nt, Human
cuggaggucacauucaggaaga

SEQ ID NO: 2328964 - RNA, 19 nt, Human
cuggaggucacauucagga

SEQ ID NO: 2328965 - RNA, 21 nt, Human
cuggaggucacauucaggaag

SEQ ID NO: 2328966 - RNA, 16 nt, Human
cuggaggugccagcaa

SEQ ID NO: 2328967 - RNA, 19 nt, Human
cuggaggugccagcaaagc

SEQ ID NO: 2328968 - RNA, 22 nt, Human
cuggaggugccagcaaagcccc

SEQ ID NO: 2328969 - RNA, 23 nt, Human
cuggaggugccagcaaagcccca

SEQ ID NO: 2328970 - RNA, 20 nt, Human
cuggagguggcugagccccu

SEQ ID NO: 2328971 - RNA, 14 nt, Human
cuggaggugggagc

SEQ ID NO: 2328972 - RNA, 16 nt, Human
cuggaggugggagcag

SEQ ID NO: 2328973 - RNA, 17 nt, Human
cuggaggugggagcagg

SEQ ID NO: 2328974 - RNA, 18 nt, Human
cuggaggugggagcagga

SEQ ID NO: 2328975 - RNA, 19 nt, Human
cuggaggugggagcaggag

SEQ ID NO: 2328976 - RNA, 20 nt, Human
cuggaggugggagcaggaga

SEQ ID NO: 2328977 - RNA, 21 nt, Human
cuggaggugggagcaggagau

SEQ ID NO: 2328978 - RNA, 22 nt, Human
cuggaggugggagcaggagauu

SEQ ID NO: 2328979 - RNA, 18 nt, Human
cuggagguggggccugga

SEQ ID NO: 2328980 - RNA, 22 nt, Human
cuggagguggggccuggagcag

SEQ ID NO: 2328981 - RNA, 15 nt, Human
cuggaggugggguug

SEQ ID NO: 2328982 - RNA, 20 nt, Human
cuggaggugggguugggauu

SEQ ID NO: 2328983 - RNA, 22 nt, Human
cuggaggugggguugggauugg

SEQ ID NO: 2328984 - RNA, 16 nt, Human
cuggagguugaagcca

SEQ ID NO: 2328985 - RNA, 17 nt, Human
cuggagccccugggugg

SEQ ID NO: 2328986 - RNA, 18 nt, Human
cuggagccccuggguggg

SEQ ID NO: 2328987 - RNA, 12 nt, Human
cuggagccccug

SEQ ID NO: 2328988 - RNA, 14 nt, Human
cuggagccccuggg

SEQ ID NO: 2328989 - RNA, 15 nt, Human
cuggagccccugggu

SEQ ID NO: 2328990 - RNA, 16 nt, Human
cuggagccccugggug

SEQ ID NO: 2328991 - RNA, 15 nt, Human
cuggagcccuugggu

SEQ ID NO: 2328992 - RNA, 15 nt, Human
cuggagccuggugcc

SEQ ID NO: 2328993 - RNA, 16 nt, Human
cuggagccuggugccc

SEQ ID NO: 2328994 - RNA, 17 nt, Human
cuggagccuggugcccu

SEQ ID NO: 2328995 - RNA, 15 nt, Human
cuggagcccaggagu

SEQ ID NO: 2328996 - RNA, 13 nt, Human
cuggagcccaggg

SEQ ID NO: 2328997 - RNA, 14 nt, Human
cuggagcccaggga

SEQ ID NO: 2328998 - RNA, 13 nt, Human
cuggagccccauc

SEQ ID NO: 2328999 - RNA, 13 nt, Human
cuggagcccagga

SEQ ID NO: 2329000 - RNA, 12 nt, Human
cuggagcccagg

SEQ ID NO: 2329001 - RNA, 21 nt, Human
cuggagcccagaggagggcag

SEQ ID NO: 2329002 - RNA, 23 nt, Human
cuggagcccagaggagggcagca

SEQ ID NO: 2329003 - RNA, 18 nt, Human
cuggagauguuuuagagu

SEQ ID NO: 2329004 - RNA, 23 nt, Human
cuggagauccuccugcagaccac

SEQ ID NO: 2329005 - RNA, 18 nt, Human
cuggagauccuccugcag

SEQ ID NO: 2329006 - RNA, 20 nt, Human
cuggagauccuccugcagac

SEQ ID NO: 2329007 - RNA, 14 nt, Human
cuggagauccuccu

SEQ ID NO: 2329008 - RNA, 15 nt, Human
cuggagauccuccug

SEQ ID NO: 2329009 - RNA, 16 nt, Human
cuggagauccuccugc

SEQ ID NO: 2329010 - RNA, 17 nt, Human
cuggagauccuccugca

SEQ ID NO: 2329011 - RNA, 22 nt, Human
cuggaggcagggccuugcccag

SEQ ID NO: 2329012 - RNA, 20 nt, Human
cuggaggcagggccuugccc

SEQ ID NO: 2329013 - RNA, 19 nt, Human
cuggaggcagggccuugcc

SEQ ID NO: 2329014 - RNA, 16 nt, Human
cuggaggcagggccuu

SEQ ID NO: 2329015 - RNA, 23 nt, Human
cuggaggcagggccuugcccaga

SEQ ID NO: 2329016 - RNA, 12 nt, Human
cuggaggcccag

SEQ ID NO: 2329017 - RNA, 21 nt, Human
cuggaggggacgcugguagag

SEQ ID NO: 2329018 - RNA, 16 nt, Human
cuggaggggacgcugg

SEQ ID NO: 2329019 - RNA, 15 nt, Human
cuggaggggacgcug

SEQ ID NO: 2329020 - RNA, 22 nt, Human
cuggagggcuggaaucuggaga

SEQ ID NO: 2329021 - RNA, 21 nt, Human
cuggaggcccaguucacccug

SEQ ID NO: 2329022 - RNA, 20 nt, Human
cuggagggcuggaaucugga

SEQ ID NO: 2329023 - RNA, 15 nt, Human
cuggaggcccaguuc

SEQ ID NO: 2329024 - RNA, 14 nt, Human
cuggaggcccaguu

SEQ ID NO: 2329025 - RNA, 13 nt, Human
cuggaggcccagu

SEQ ID NO: 2329026 - RNA, 15 nt, Human
cuggaggcagggccu

SEQ ID NO: 2329027 - RNA, 14 nt, Human
cuggaggcagggcc

SEQ ID NO: 2329028 - RNA, 13 nt, Human
cuggaggcagggc

SEQ ID NO: 2329029 - RNA, 11 nt, Human
cuggagcuggc

SEQ ID NO: 2329030 - RNA, 11 nt, Human
cuggagccugu

SEQ ID NO: 2329031 - RNA, 12 nt, Human
cuggaggcaggg

SEQ ID NO: 2329032 - RNA, 16 nt, Human
cuggagcucugcccau

SEQ ID NO: 2329033 - RNA, 13 nt, Human
cuggagcucugcc

SEQ ID NO: 2329034 - RNA, 12 nt, Human
cuggagcucugc

SEQ ID NO: 2329035 - RNA, 12 nt, Human
cuggcgccucug

SEQ ID NO: 2329036 - RNA, 13 nt, Human
cuggcgccucugc

SEQ ID NO: 2329037 - RNA, 14 nt, Human
cuggcgccucugca

SEQ ID NO: 2329038 - RNA, 15 nt, Human
cuggcgccucugcaa

SEQ ID NO: 2329039 - RNA, 23 nt, Human
cuggcggcuacucagcagcccuc

SEQ ID NO: 2329040 - RNA, 22 nt, Human
cuggcggcuacucagcagcccu

SEQ ID NO: 2329041 - RNA, 20 nt, Human
cuggcggcuacucagcagcc

SEQ ID NO: 2329042 - RNA, 18 nt, Human
cuggcggcuacucagcag

SEQ ID NO: 2329043 - RNA, 17 nt, Human
cuggcggcuacucagca

SEQ ID NO: 2329044 - RNA, 16 nt, Human
cuggcggcuacucagc

SEQ ID NO: 2329045 - RNA, 20 nt, Human
cuggcgccucugcaagggca

SEQ ID NO: 2329046 - RNA, 19 nt, Human
cuggccuugaaaccaccuu

SEQ ID NO: 2329047 - RNA, 14 nt, Human
cuggccugugucua

SEQ ID NO: 2329048 - RNA, 23 nt, Human
cuggccuucggccuccauccuga

SEQ ID NO: 2329049 - RNA, 14 nt, Human
cuggcgucugucuu

SEQ ID NO: 2329050 - RNA, 13 nt, Human
cuggcgucugucu

SEQ ID NO: 2329051 - RNA, 18 nt, Human
cuggcgucaugcaaaguc

SEQ ID NO: 2329052 - RNA, 19 nt, Human
cuggcgucaugcaaaguca

SEQ ID NO: 2329053 - RNA, 21 nt, Human
cuggcguagaaguuuuuguac

SEQ ID NO: 2329054 - RNA, 22 nt, Human
cuggcguagaaguuuuuguacu

SEQ ID NO: 2329055 - RNA, 13 nt, Human
cuggcgggauggg

SEQ ID NO: 2329056 - RNA, 16 nt, Human
cuggcgggaugggcca

SEQ ID NO: 2329057 - RNA, 19 nt, Human
cuggcgggaugggccaccg

SEQ ID NO: 2329058 - RNA, 20 nt, Human
cuggcgggaugggccaccgc

SEQ ID NO: 2329059 - RNA, 14 nt, Human
cuggcgugcagugg

SEQ ID NO: 2329060 - RNA, 15 nt, Human
cuggcgugcaguggu

SEQ ID NO: 2329061 - RNA, 22 nt, Human
cuggcugaggauuucaagccug

SEQ ID NO: 2329062 - RNA, 21 nt, Human
cuggcugaggauuucaagccu

SEQ ID NO: 2329063 - RNA, 17 nt, Human
cuggcugagguuccucu

SEQ ID NO: 2329064 - RNA, 19 nt, Human
cuggcugagguuccucugc

SEQ ID NO: 2329065 - RNA, 23 nt, Human
cuggcugcagagcagugggccug

SEQ ID NO: 2329066 - RNA, 20 nt, Human
cuggcugagguuccucugcc

SEQ ID NO: 2329067 - RNA, 21 nt, Human
cuggcugagguuccucugccu

SEQ ID NO: 2329068 - RNA, 22 nt, Human
cuggcugagguuccucugccug

SEQ ID NO: 2329069 - RNA, 23 nt, Human
cuggcugagguuccucugccugc

SEQ ID NO: 2329070 - RNA, 17 nt, Human
cuggcuaacuggaagca

SEQ ID NO: 2329071 - RNA, 15 nt, Human
cuggcucuucugccc

SEQ ID NO: 2329072 - RNA, 23 nt, Human
cuggcuagaggccagccccaccc

SEQ ID NO: 2329073 - RNA, 16 nt, Human
cuggcucuucugccca

SEQ ID NO: 2329074 - RNA, 17 nt, Human
cuggcucuucugcccaa

SEQ ID NO: 2329075 - RNA, 18 nt, Human
cuggcugagccuggcugg

SEQ ID NO: 2329076 - RNA, 13 nt, Human
cuggcugagcuga

SEQ ID NO: 2329077 - RNA, 24 nt, Human
cuggcucuuccaggcugggagagc

SEQ ID NO: 2329078 - RNA, 22 nt, Human
cuggcuagaggccagccccacc

SEQ ID NO: 2329079 - RNA, 21 nt, Human
cuggcuagaggccagccccac

SEQ ID NO: 2329080 - RNA, 20 nt, Human
cuggcuagaggccagcccca

SEQ ID NO: 2329081 - RNA, 16 nt, Human
cuggcuaacuggaagc

SEQ ID NO: 2329082 - RNA, 23 nt, Human
cuggcgucugucuucaagggcuu

SEQ ID NO: 2329083 - RNA, 22 nt, Human
cuggcgucugucuucaagggcu

SEQ ID NO: 2329084 - RNA, 15 nt, Human
cuggcgucugucuuc

SEQ ID NO: 2329085 - RNA, 13 nt, Human
cuggcgugugggu

SEQ ID NO: 2329086 - RNA, 21 nt, Human
cuggcucuuccaggcugggag

SEQ ID NO: 2329087 - RNA, 22 nt, Human
cuggcucuuccaggcugggaga

SEQ ID NO: 2329088 - RNA, 19 nt, Human
cuggccuggccccucaggg

SEQ ID NO: 2329089 - RNA, 18 nt, Human
cuggccuggcacacauca

SEQ ID NO: 2329090 - RNA, 22 nt, Human
cuggccuggcacacaucaggag

SEQ ID NO: 2329091 - RNA, 13 nt, Human
cuggccuggcaca

SEQ ID NO: 2329092 - RNA, 14 nt, Human
cuggccuggcacac

SEQ ID NO: 2329093 - RNA, 16 nt, Human
cuggccuggcacacau

SEQ ID NO: 2329094 - RNA, 17 nt, Human
cuggccuggcacacauc

SEQ ID NO: 2329095 - RNA, 22 nt, Human
cuggccuggacuguuuucucuc

SEQ ID NO: 2329096 - RNA, 12 nt, Human
cuggccuggauc

SEQ ID NO: 2329097 - RNA, 14 nt, Human
cuggccuggaucuc

SEQ ID NO: 2329098 - RNA, 15 nt, Human
cuggccuggaucucc

SEQ ID NO: 2329099 - RNA, 21 nt, Human
cuggccuggaucuccccacuc

SEQ ID NO: 2329100 - RNA, 22 nt, Human
cuggccuggaucuccccacucu

SEQ ID NO: 2329101 - RNA, 24 nt, Human
cuggccuggccccucagggucccu

SEQ ID NO: 2329102 - RNA, 15 nt, Human
cuggccuggccggca

SEQ ID NO: 2329103 - RNA, 14 nt, Human
cuggccuggccggc

SEQ ID NO: 2329104 - RNA, 13 nt, Human
cuggccuggcuuc

SEQ ID NO: 2329105 - RNA, 14 nt, Human
cuggccuggcuucu

SEQ ID NO: 2329106 - RNA, 17 nt, Human
cuggccuggcuucuccu

SEQ ID NO: 2329107 - RNA, 22 nt, Human
cuggccuucggccuccauccug

SEQ ID NO: 2329108 - RNA, 16 nt, Human
cuggccucugcacucc

SEQ ID NO: 2329109 - RNA, 14 nt, Human
cuggccuggacugu

SEQ ID NO: 2329110 - RNA, 18 nt, Human
cuggccuggacuguuuuc

SEQ ID NO: 2329111 - RNA, 21 nt, Human
cuggccucugcacuccccugc

SEQ ID NO: 2329112 - RNA, 18 nt, Human
cuggccucugcacucccc

SEQ ID NO: 2329113 - RNA, 20 nt, Human
cuggccucugcacuccccug

SEQ ID NO: 2329114 - RNA, 19 nt, Human
cuggcccagccggccucuc

SEQ ID NO: 2329115 - RNA, 16 nt, Human
cuggcccaucagugua

SEQ ID NO: 2329116 - RNA, 13 nt, Human
cuggccccaggac

SEQ ID NO: 2329117 - RNA, 23 nt, Human
cuggcccagggcccagagcccag

SEQ ID NO: 2329118 - RNA, 22 nt, Human
cuggcccagggcccagagccca

SEQ ID NO: 2329119 - RNA, 21 nt, Human
cuggcccagggcccagagccc

SEQ ID NO: 2329120 - RNA, 20 nt, Human
cuggcccagggcccagagcc

SEQ ID NO: 2329121 - RNA, 19 nt, Human
cuggcccagggcccagagc

SEQ ID NO: 2329122 - RNA, 18 nt, Human
cuggcccagggcccagag

SEQ ID NO: 2329123 - RNA, 17 nt, Human
cuggcccagggcccaga

SEQ ID NO: 2329124 - RNA, 23 nt, Human
cuggccaucccucguggucccca

SEQ ID NO: 2329125 - RNA, 16 nt, Human
cuggccaucuccaccc

SEQ ID NO: 2329126 - RNA, 18 nt, Human
cuggccaucccacaagug

SEQ ID NO: 2329127 - RNA, 17 nt, Human
cuggccaucccucgugg

SEQ ID NO: 2329128 - RNA, 15 nt, Human
cuggcccacugcauc

SEQ ID NO: 2329129 - RNA, 21 nt, Human
cuggccaguggcuggaucugu

SEQ ID NO: 2329130 - RNA, 22 nt, Human
cuggccaguccaggcugccgug

SEQ ID NO: 2329131 - RNA, 23 nt, Human
cuggccaguccaggcugccgugg

SEQ ID NO: 2329132 - RNA, 23 nt, Human
cuggcccagccaaacccugucug

SEQ ID NO: 2329133 - RNA, 10 nt, Human
cuggcccagc

SEQ ID NO: 2329134 - RNA, 13 nt, Human
cuggcccagcccu

SEQ ID NO: 2329135 - RNA, 20 nt, Human
cuggcccagccaaacccugu

SEQ ID NO: 2329136 - RNA, 17 nt, Human
cuggcccagccaaaccc

SEQ ID NO: 2329137 - RNA, 13 nt, Human
cuggcccagccaa

SEQ ID NO: 2329138 - RNA, 11 nt, Human
cuggcccagcc

SEQ ID NO: 2329139 - RNA, 16 nt, Human
cuggcccagggcccag

SEQ ID NO: 2329140 - RNA, 16 nt, Human
cuggcccagccggccu

SEQ ID NO: 2329141 - RNA, 18 nt, Human
cuggcccagccggccucu

SEQ ID NO: 2329142 - RNA, 12 nt, Human
cuggcccagccg

SEQ ID NO: 2329143 - RNA, 13 nt, Human
cuggcccagccgg

SEQ ID NO: 2329144 - RNA, 14 nt, Human
cuggcccagccggc

SEQ ID NO: 2329145 - RNA, 15 nt, Human
cuggcccagccggcc

SEQ ID NO: 2329146 - RNA, 14 nt, Human
cuggcccagcccug

SEQ ID NO: 2329147 - RNA, 15 nt, Human
cuggcccagcccugc

SEQ ID NO: 2329148 - RNA, 16 nt, Human
cuggcccagcccugcu

SEQ ID NO: 2329149 - RNA, 17 nt, Human
cuggcccagcccugcug

SEQ ID NO: 2329150 - RNA, 18 nt, Human
cuggcccagcccugcugg

SEQ ID NO: 2329151 - RNA, 19 nt, Human
cuggcccagcccugcuggc

SEQ ID NO: 2329152 - RNA, 20 nt, Human
cuggcccagcccugcuggcc

SEQ ID NO: 2329153 - RNA, 22 nt, Human
cuggcccagcccugcuggccgc

SEQ ID NO: 2329154 - RNA, 19 nt, Human
cuggcaguggaacuaagaa

SEQ ID NO: 2329155 - RNA, 22 nt, Human
cuggcaguccuggaagccagcu

SEQ ID NO: 2329156 - RNA, 13 nt, Human
cuggcagaaggga

SEQ ID NO: 2329157 - RNA, 15 nt, Human
cuggcaguuuuccau

SEQ ID NO: 2329158 - RNA, 15 nt, Human
cuggcaguuuaaaaa

SEQ ID NO: 2329159 - RNA, 19 nt, Human
cuggcaguuuaaaaaaauu

SEQ ID NO: 2329160 - RNA, 15 nt, Human
cuggccacugcacag

SEQ ID NO: 2329161 - RNA, 23 nt, Human
cuggcaucgcaccauucugacuc

SEQ ID NO: 2329162 - RNA, 12 nt, Human
cuggccacugca

SEQ ID NO: 2329163 - RNA, 20 nt, Human
cuggcaucgcaccauucuga

SEQ ID NO: 2329164 - RNA, 22 nt, Human
cuggcaucgcaccauucugacu

SEQ ID NO: 2329165 - RNA, 17 nt, Human
cuggcaucgcaccauuc

SEQ ID NO: 2329166 - RNA, 18 nt, Human
cuggcaucgcaccauucu

SEQ ID NO: 2329167 - RNA, 19 nt, Human
cuggcaucgcaccauucug

SEQ ID NO: 2329168 - RNA, 13 nt, Human
cuggccagaggcu

SEQ ID NO: 2329169 - RNA, 22 nt, Human
cuggccacugcacagagcucuc

SEQ ID NO: 2329170 - RNA, 21 nt, Human
cuggccagacacaggcccucc

SEQ ID NO: 2329171 - RNA, 19 nt, Human
cuggccaguccaggcugcc

SEQ ID NO: 2329172 - RNA, 21 nt, Human
cuggccaguccaggcugccgu

SEQ ID NO: 2329173 - RNA, 14 nt, Human
cuggccagaugcac

SEQ ID NO: 2329174 - RNA, 19 nt, Human
cuggccagacacaggcccu

SEQ ID NO: 2329175 - RNA, 18 nt, Human
cuggccagacacaggccc

SEQ ID NO: 2329176 - RNA, 17 nt, Human
cuggccagacacaggcc

SEQ ID NO: 2329177 - RNA, 15 nt, Human
cuggccagacacagg

SEQ ID NO: 2329178 - RNA, 13 nt, Human
cuggccagaaugc

SEQ ID NO: 2329179 - RNA, 13 nt, Human
cuggccagacaca

SEQ ID NO: 2329180 - RNA, 18 nt, Human
cuggccacugcacagagc

SEQ ID NO: 2329181 - RNA, 19 nt, Human
cuggccacugcacagagcu

SEQ ID NO: 2329182 - RNA, 20 nt, Human
cuggccacugcacagagcuc

SEQ ID NO: 2329183 - RNA, 21 nt, Human
cuggccacugcacagagcucu

SEQ ID NO: 2329184 - RNA, 20 nt, Human
cuggcacccggccccugcug

SEQ ID NO: 2329185 - RNA, 21 nt, Human
cuggcacccggccccugcugg

SEQ ID NO: 2329186 - RNA, 19 nt, Human
cuggcacccggccccugcu

SEQ ID NO: 2329187 - RNA, 14 nt, Human
cuggagugcagugg

SEQ ID NO: 2329188 - RNA, 13 nt, Human
cuggagugcaguu

SEQ ID NO: 2329189 - RNA, 14 nt, Human
cuggcacaucagaa

SEQ ID NO: 2329190 - RNA, 19 nt, Human
cuggcacaucagaaaggaa

SEQ ID NO: 2329191 - RNA, 20 nt, Human
cuggagugcagugagccgag

SEQ ID NO: 2329192 - RNA, 20 nt, Human
cuggcacaguuuucugagaa

SEQ ID NO: 2329193 - RNA, 22 nt, Human
cuggcacaguuuucugagaaag

SEQ ID NO: 2329194 - RNA, 21 nt, Human
cuggcacaguuuucugagaaa

SEQ ID NO: 2329195 - RNA, 23 nt, Human
cuggcacauuuccccagaccuga

SEQ ID NO: 2329196 - RNA, 22 nt, Human
cuggcacauuuccccagaccug

SEQ ID NO: 2329197 - RNA, 19 nt, Human
cuggcacauuuccccagac

SEQ ID NO: 2329198 - RNA, 17 nt, Human
cuggcacauuuccccag

SEQ ID NO: 2329199 - RNA, 19 nt, Human
cuggcacugcuuccaguga

SEQ ID NO: 2329200 - RNA, 20 nt, Human
cuggcacugcuuccagugag

SEQ ID NO: 2329201 - RNA, 23 nt, Human
cuggcacugcuuccagugaggcu

SEQ ID NO: 2329202 - RNA, 21 nt, Human
cuggcacuggaugcagaaaca

SEQ ID NO: 2329203 - RNA, 14 nt, Human
cuggcacuuggaga

SEQ ID NO: 2329204 - RNA, 19 nt, Human
cuggcacccaccguggagg

SEQ ID NO: 2329205 - RNA, 18 nt, Human
cuggcacugcuuccagug

SEQ ID NO: 2329206 - RNA, 21 nt, Human
cuggcagaacugagcuccucu

SEQ ID NO: 2329207 - RNA, 20 nt, Human
cuggcagaacugagcuccuc

SEQ ID NO: 2329208 - RNA, 19 nt, Human
cuggcagaacugagcuccu

SEQ ID NO: 2329209 - RNA, 18 nt, Human
cuggcagaacugagcucc

SEQ ID NO: 2329210 - RNA, 17 nt, Human
cuggcagaacugagcuc

SEQ ID NO: 2329211 - RNA, 16 nt, Human
cuggcagaacugagcu

SEQ ID NO: 2329212 - RNA, 13 nt, Human
cuggcagaacuga

SEQ ID NO: 2329213 - RNA, 21 nt, Human
cuggcagaaagcaaaugugac

SEQ ID NO: 2329214 - RNA, 23 nt, Human
cuggcagaaagcaaaugugaccu

SEQ ID NO: 2329215 - RNA, 21 nt, Human
cuggcacuuggagacuuguau

SEQ ID NO: 2329216 - RNA, 14 nt, Human
cugguacucaagcc

SEQ ID NO: 2329217 - RNA, 16 nt, Human
cugguacccuccuggc

SEQ ID NO: 2329218 - RNA, 23 nt, Human
cugguacccagccaucugcccag

SEQ ID NO: 2329219 - RNA, 14 nt, Human
cugguacccuccug

SEQ ID NO: 2329220 - RNA, 15 nt, Human
cugguacccuccugg

SEQ ID NO: 2329221 - RNA, 18 nt, Human
cugguacccagccaucug

SEQ ID NO: 2329222 - RNA, 19 nt, Human
cugguacccagccaucugc

SEQ ID NO: 2329223 - RNA, 21 nt, Human
cugguacccagccaucugccc

SEQ ID NO: 2329224 - RNA, 22 nt, Human
cugguacccagccaucugccca

SEQ ID NO: 2329225 - RNA, 13 nt, Human
cugguacccagcc

SEQ ID NO: 2329226 - RNA, 14 nt, Human
cugguacccagcca

SEQ ID NO: 2329227 - RNA, 16 nt, Human
cugguacccagccauc

SEQ ID NO: 2329228 - RNA, 17 nt, Human
cugguacccagccaucu

SEQ ID NO: 2329229 - RNA, 22 nt, Human
cugguaauuuguaucugaagga

SEQ ID NO: 2329230 - RNA, 21 nt, Human
cugguaauuuguaucugaagg

SEQ ID NO: 2329231 - RNA, 18 nt, Human
cugguaauuuguaucuga

SEQ ID NO: 2329232 - RNA, 14 nt, Human
cuggguucuaccca

SEQ ID NO: 2329233 - RNA, 15 nt, Human
cuggguucuacccag

SEQ ID NO: 2329234 - RNA, 16 nt, Human
cuggguucuacccagg

SEQ ID NO: 2329235 - RNA, 17 nt, Human
cuggguucuacccaggu

SEQ ID NO: 2329236 - RNA, 15 nt, Human
cugggguccagggag

SEQ ID NO: 2329237 - RNA, 16 nt, Human
cugggguccagggagc

SEQ ID NO: 2329238 - RNA, 20 nt, Human
cugggguauaaaacuuuccu

SEQ ID NO: 2329239 - RNA, 18 nt, Human
cugggguccuggggccuc

SEQ ID NO: 2329240 - RNA, 15 nt, Human
cugggguccuggggc

SEQ ID NO: 2329241 - RNA, 19 nt, Human
cugggguccuggggccucg

SEQ ID NO: 2329242 - RNA, 13 nt, Human
cuggggucuggag

SEQ ID NO: 2329243 - RNA, 15 nt, Human
cuggggugccgccug

SEQ ID NO: 2329244 - RNA, 22 nt, Human
cuggggucuggaguugaucugg

SEQ ID NO: 2329245 - RNA, 13 nt, Human
cugggguccccca

SEQ ID NO: 2329246 - RNA, 16 nt, Human
cuggggugccgccugc

SEQ ID NO: 2329247 - RNA, 23 nt, Human
cuggguacuucuugaaggugcug

SEQ ID NO: 2329248 - RNA, 20 nt, Human
cuggguacuucuugaaggug

SEQ ID NO: 2329249 - RNA, 17 nt, Human
cuggguacuucuugaag

SEQ ID NO: 2329250 - RNA, 15 nt, Human
cuggguacuucuuga

SEQ ID NO: 2329251 - RNA, 20 nt, Human
cuggguaacuagggaagaua

SEQ ID NO: 2329252 - RNA, 22 nt, Human
cuggguaacuagggaagauaau

SEQ ID NO: 2329253 - RNA, 18 nt, Human
cuggcugcccagaccccu

SEQ ID NO: 2329254 - RNA, 13 nt, Human
cuggcugcccaga

SEQ ID NO: 2329255 - RNA, 16 nt, Human
cuggcugccccaaccu

SEQ ID NO: 2329256 - RNA, 18 nt, Human
cuggcugccccaaccugc

SEQ ID NO: 2329257 - RNA, 12 nt, Human
cuggcugcccag

SEQ ID NO: 2329258 - RNA, 16 nt, Human
cuggcugccagcuauu

SEQ ID NO: 2329259 - RNA, 13 nt, Human
cuggcugcaguga

SEQ ID NO: 2329260 - RNA, 24 nt, Human
cugggcuucaguggcagcugcuuu

SEQ ID NO: 2329261 - RNA, 19 nt, Human
cugggcuucaucuggcaac

SEQ ID NO: 2329262 - RNA, 15 nt, Human
cugggcuucaucugg

SEQ ID NO: 2329263 - RNA, 19 nt, Human
cuggcugccccaaccugcu

SEQ ID NO: 2329264 - RNA, 20 nt, Human
cuggcugccccaaccugcug

SEQ ID NO: 2329265 - RNA, 21 nt, Human
cuggcugccccaaccugcuga

SEQ ID NO: 2329266 - RNA, 13 nt, Human
cugggcuuggccu

SEQ ID NO: 2329267 - RNA, 13 nt, Human
cugggggaagaag

SEQ ID NO: 2329268 - RNA, 18 nt, Human
cuggggcuggccucccaa

SEQ ID NO: 2329269 - RNA, 15 nt, Human
cuggggcuggccucc

SEQ ID NO: 2329270 - RNA, 15 nt, Human
cuggggcuucuccug

SEQ ID NO: 2329271 - RNA, 15 nt, Human
cuggggcuggcacaa

SEQ ID NO: 2329272 - RNA, 14 nt, Human
cuggggcuggccuc

SEQ ID NO: 2329273 - RNA, 20 nt, Human
cugggcuuggccugcuguga

SEQ ID NO: 2329274 - RNA, 14 nt, Human
cuggggcugcuggc

SEQ ID NO: 2329275 - RNA, 15 nt, Human
cuggggcugcuggcc

SEQ ID NO: 2329276 - RNA, 16 nt, Human
cuggggcugcuggccu

SEQ ID NO: 2329277 - RNA, 14 nt, Human
cugggcuuggccug

SEQ ID NO: 2329278 - RNA, 15 nt, Human
cugggcuuggccugc

SEQ ID NO: 2329279 - RNA, 16 nt, Human
cugggcuuggccugcu

SEQ ID NO: 2329280 - RNA, 12 nt, Human
cuggggcugcug

SEQ ID NO: 2329281 - RNA, 17 nt, Human
cugggcuuggccugcug

SEQ ID NO: 2329282 - RNA, 18 nt, Human
cugggcuuggccugcugu

SEQ ID NO: 2329283 - RNA, 18 nt, Human
cugggggccaugagcucc

SEQ ID NO: 2329284 - RNA, 17 nt, Human
cugggggccaugagcuc

SEQ ID NO: 2329285 - RNA, 16 nt, Human
cugggggccaugagcu

SEQ ID NO: 2329286 - RNA, 14 nt, Human
cugggggccaugag

SEQ ID NO: 2329287 - RNA, 19 nt, Human
cugggggcugggcagagga

SEQ ID NO: 2329288 - RNA, 22 nt, Human
cugggggggauuguaaaauggu

SEQ ID NO: 2329289 - RNA, 16 nt, Human
cuggggggcaguggug

SEQ ID NO: 2329290 - RNA, 13 nt, Human
cuggggggcagug

SEQ ID NO: 2329291 - RNA, 14 nt, Human
cugggggaagcccu

SEQ ID NO: 2329292 - RNA, 20 nt, Human
cuggggcuucuccugaccca

SEQ ID NO: 2329293 - RNA, 16 nt, Human
cuggggcuucuccuga

SEQ ID NO: 2329294 - RNA, 19 nt, Human
cuggggcuucuccugaccc

SEQ ID NO: 2329295 - RNA, 17 nt, Human
cugggggaagcccugga

SEQ ID NO: 2329296 - RNA, 20 nt, Human
cugggggacccaauguagga

SEQ ID NO: 2329297 - RNA, 15 nt, Human
cugggggaagaagcu

SEQ ID NO: 2329298 - RNA, 19 nt, Human
cugggggcaggagggcccu

SEQ ID NO: 2329299 - RNA, 14 nt, Human
cugggggcaggagg

SEQ ID NO: 2329300 - RNA, 12 nt, Human
cugggggcagga

SEQ ID NO: 2329301 - RNA, 16 nt, Human
cugggggaagcccugg

SEQ ID NO: 2329302 - RNA, 13 nt, Human
cugggggagugga

SEQ ID NO: 2329303 - RNA, 14 nt, Human
cugggggaguggaa

SEQ ID NO: 2329304 - RNA, 17 nt, Human
cuggucaaacaaacucu

SEQ ID NO: 2329305 - RNA, 14 nt, Human
cugguauuuuaucu

SEQ ID NO: 2329306 - RNA, 13 nt, Human
cugguacucuccu

SEQ ID NO: 2329307 - RNA, 16 nt, Human
cugguacucuccuaga

SEQ ID NO: 2329308 - RNA, 23 nt, Human
cuggucaaacaaacucucugaac

SEQ ID NO: 2329309 - RNA, 18 nt, Human
cuggucaaacaaacucuc

SEQ ID NO: 2329310 - RNA, 15 nt, Human
cuggucaaccuccug

SEQ ID NO: 2329311 - RNA, 16 nt, Human
cuggucaaccuccugg

SEQ ID NO: 2329312 - RNA, 17 nt, Human
cuggucaaccuccugga

SEQ ID NO: 2329313 - RNA, 19 nt, Human
cuggucaaccuccuggaca

SEQ ID NO: 2329314 - RNA, 15 nt, Human
cuggucacagccucc

SEQ ID NO: 2329315 - RNA, 16 nt, Human
cuggucacagccuccu

SEQ ID NO: 2329316 - RNA, 17 nt, Human
cuggucacagccuccuc

SEQ ID NO: 2329317 - RNA, 18 nt, Human
cuggucacagccuccucu

SEQ ID NO: 2329318 - RNA, 15 nt, Human
cuggucccugggagg

SEQ ID NO: 2329319 - RNA, 18 nt, Human
cuggucacaggacucugc

SEQ ID NO: 2329320 - RNA, 21 nt, Human
cuggucccuugcagcuaguuu

SEQ ID NO: 2329321 - RNA, 17 nt, Human
cuggucccuugcagcua

SEQ ID NO: 2329322 - RNA, 19 nt, Human
cuggucacagccuccucug

SEQ ID NO: 2329323 - RNA, 16 nt, Human
cugguccggacacucc

SEQ ID NO: 2329324 - RNA, 20 nt, Human
cugguccggacacuccuaga

SEQ ID NO: 2329325 - RNA, 21 nt, Human
cugguccggacacuccuagag

SEQ ID NO: 2329326 - RNA, 22 nt, Human
cugguccggacacuccuagaga

SEQ ID NO: 2329327 - RNA, 15 nt, Human
cugguccgugggacg

SEQ ID NO: 2329328 - RNA, 16 nt, Human
cugguccgugggacgg

SEQ ID NO: 2329329 - RNA, 17 nt, Human
cugguccuacccauccc

SEQ ID NO: 2329330 - RNA, 16 nt, Human
cugguccugagggucc

SEQ ID NO: 2329331 - RNA, 19 nt, Human
cugguccugagggucccca

SEQ ID NO: 2329332 - RNA, 14 nt, Human
cuggugcucucugc

SEQ ID NO: 2329333 - RNA, 16 nt, Human
cuggugcucucugcca

SEQ ID NO: 2329334 - RNA, 18 nt, Human
cuggugcucucugccacu

SEQ ID NO: 2329335 - RNA, 22 nt, Human
cugguccuacccauccccgcag

SEQ ID NO: 2329336 - RNA, 16 nt, Human
cugguccuacccaucc

SEQ ID NO: 2329337 - RNA, 13 nt, Human
cugguccuaccca

SEQ ID NO: 2329338 - RNA, 19 nt, Human
cugguccgugggacggugc

SEQ ID NO: 2329339 - RNA, 21 nt, Human
cugguccgugggacggugccc

SEQ ID NO: 2329340 - RNA, 12 nt, Human
cuggugcugcca

SEQ ID NO: 2329341 - RNA, 13 nt, Human
cuggugcugccac

SEQ ID NO: 2329342 - RNA, 20 nt, Human
cuggugcugccacacuucag

SEQ ID NO: 2329343 - RNA, 22 nt, Human
cuggugcugccacacuucaggc

SEQ ID NO: 2329344 - RNA, 21 nt, Human
cugguggcagcucaccucucc

SEQ ID NO: 2329345 - RNA, 19 nt, Human
cuggugcugccucuaccug

SEQ ID NO: 2329346 - RNA, 14 nt, Human
cuggugcugccucu

SEQ ID NO: 2329347 - RNA, 23 nt, Human
cugguggcagcucaccucucccu

SEQ ID NO: 2329348 - RNA, 13 nt, Human
cugguggcagcug

SEQ ID NO: 2329349 - RNA, 14 nt, Human
cugguggcagcugc

SEQ ID NO: 2329350 - RNA, 20 nt, Human
cugguggcccgacagccugg

SEQ ID NO: 2329351 - RNA, 21 nt, Human
cugguggcccgacagccuggc

SEQ ID NO: 2329352 - RNA, 22 nt, Human
cugguggcccgacagccuggca

SEQ ID NO: 2329353 - RNA, 23 nt, Human
cugguggcccgacagccuggcac

SEQ ID NO: 2329354 - RNA, 18 nt, Human
cugguuccggaauccugu

SEQ ID NO: 2329355 - RNA, 12 nt, Human
cugguuccuccc

SEQ ID NO: 2329356 - RNA, 17 nt, Human
cugguuccggaauccug

SEQ ID NO: 2329357 - RNA, 21 nt, Human
cugguucccguuucuccaccu

SEQ ID NO: 2329358 - RNA, 23 nt, Human
cuggugggaucugugcccagaga

SEQ ID NO: 2329359 - RNA, 23 nt, Human
cuggugggaggggcgcccaccuc

SEQ ID NO: 2329360 - RNA, 18 nt, Human
cugguucccguuucucca

SEQ ID NO: 2329361 - RNA, 15 nt, Human
cugguggccucugcc

SEQ ID NO: 2329362 - RNA, 15 nt, Human
cugguggcucccgga

SEQ ID NO: 2329363 - RNA, 23 nt, Human
cugguggcucccggagggcccug

SEQ ID NO: 2329364 - RNA, 22 nt, Human
cuggugggaggggcgcccaccu

SEQ ID NO: 2329365 - RNA, 16 nt, Human
cugguuccauggccuc

SEQ ID NO: 2329366 - RNA, 14 nt, Human
cugguggccucugc

SEQ ID NO: 2329367 - RNA, 12 nt, Human
cuggugcugcug

SEQ ID NO: 2329368 - RNA, 16 nt, Human
cugguucuauuuaaug

SEQ ID NO: 2329369 - RNA, 20 nt, Human
cuguaauaaagaugauugug

SEQ ID NO: 2329370 - RNA, 17 nt, Human
cugguucuauuuaaugg

SEQ ID NO: 2329371 - RNA, 18 nt, Human
cugguucuauuuaaugga

SEQ ID NO: 2329372 - RNA, 13 nt, Human
cugguuccucccc

SEQ ID NO: 2329373 - RNA, 21 nt, Human
cugguucggauuuggggugga

SEQ ID NO: 2329374 - RNA, 23 nt, Human
cugguucggauuugggguggauu

SEQ ID NO: 2329375 - RNA, 23 nt, Human
cuguaaucacagcuacuugggag

SEQ ID NO: 2329376 - RNA, 12 nt, Human
cuguaauaaaua

SEQ ID NO: 2329377 - RNA, 13 nt, Human
cuguaauaaauau

SEQ ID NO: 2329378 - RNA, 14 nt, Human
cuguaauaaauaug

SEQ ID NO: 2329379 - RNA, 15 nt, Human
cuguaauaaauauga

SEQ ID NO: 2329380 - RNA, 16 nt, Human
cuguaauaaauaugag

SEQ ID NO: 2329381 - RNA, 17 nt, Human
cuguaauaaauaugagu

SEQ ID NO: 2329382 - RNA, 20 nt, Human
cuguaauuuuuuucuuauau

SEQ ID NO: 2329383 - RNA, 15 nt, Human
cuguacaaauauaag

SEQ ID NO: 2329384 - RNA, 16 nt, Human
cuguacaaauauaaga

SEQ ID NO: 2329385 - RNA, 13 nt, Human
cuguaauuuuaua

SEQ ID NO: 2329386 - RNA, 15 nt, Human
cuguacaaaguagaa

SEQ ID NO: 2329387 - RNA, 13 nt, Human
cuguacaaaguag

SEQ ID NO: 2329388 - RNA, 20 nt, Human
cuguaauccuagcacuuugg

SEQ ID NO: 2329389 - RNA, 19 nt, Human
cuguaaucauauaauaaau

SEQ ID NO: 2329390 - RNA, 21 nt, Human
cuguaaugaaucuaagcagca

SEQ ID NO: 2329391 - RNA, 21 nt, Human
cuguaaugaaacaccuucucu

SEQ ID NO: 2329392 - RNA, 20 nt, Human
cuguaaugaaccgcugaaua

SEQ ID NO: 2329393 - RNA, 21 nt, Human
cuguaaugaaccgcugaauau

SEQ ID NO: 2329394 - RNA, 15 nt, Human
cuguaaugaaucuaa

SEQ ID NO: 2329395 - RNA, 19 nt, Human
cuguaaucucguuucaaaa

SEQ ID NO: 2329396 - RNA, 20 nt, Human
cuguaaucucguuucaaaaa

SEQ ID NO: 2329397 - RNA, 22 nt, Human
cuguaaucucguuucaaaaaca

SEQ ID NO: 2329398 - RNA, 20 nt, Human
cuguaaucgcccuacuauuc

SEQ ID NO: 2329399 - RNA, 14 nt, Human
cuguaaucuaugaa

SEQ ID NO: 2329400 - RNA, 16 nt, Human
cuguauauagcccagc

SEQ ID NO: 2329401 - RNA, 15 nt, Human
cuguauauacuuuuu

SEQ ID NO: 2329402 - RNA, 14 nt, Human
cuguauauacuuuu

SEQ ID NO: 2329403 - RNA, 23 nt, Human
cuguaucaggacccagaggaagg

SEQ ID NO: 2329404 - RNA, 22 nt, Human
cuguaucaggacccagaggaag

SEQ ID NO: 2329405 - RNA, 16 nt, Human
cuguaucaggacccag

SEQ ID NO: 2329406 - RNA, 23 nt, Human
cuguauauuugugauagcacuuu

SEQ ID NO: 2329407 - RNA, 22 nt, Human
cuguauauuugugauagcacuu

SEQ ID NO: 2329408 - RNA, 18 nt, Human
cuguaguuaggaaauaaa

SEQ ID NO: 2329409 - RNA, 17 nt, Human
cuguaguuaggaaauaa

SEQ ID NO: 2329410 - RNA, 21 nt, Human
cuguauaaauaggagaggaug

SEQ ID NO: 2329411 - RNA, 12 nt, Human
cuguauaaguaa

SEQ ID NO: 2329412 - RNA, 13 nt, Human
cuguauaaguaag

SEQ ID NO: 2329413 - RNA, 14 nt, Human
cuguauaaguaaga

SEQ ID NO: 2329414 - RNA, 15 nt, Human
cuguauaaguaagaa

SEQ ID NO: 2329415 - RNA, 16 nt, Human
cuguauaaguaagaaa

SEQ ID NO: 2329416 - RNA, 17 nt, Human
cuguauaaguaagaaaa

SEQ ID NO: 2329417 - RNA, 21 nt, Human
cuguauaaguggaggcacuuu

SEQ ID NO: 2329418 - RNA, 21 nt, Human
cuguauaaguaagaaaauauu

SEQ ID NO: 2329419 - RNA, 18 nt, Human
cuguauaaguaagaaaau

SEQ ID NO: 2329420 - RNA, 19 nt, Human
cuguauaaguaagaaaaua

SEQ ID NO: 2329421 - RNA, 22 nt, Human
cuguauaaguggaggcacuuua

SEQ ID NO: 2329422 - RNA, 19 nt, Human
cuguauacaacccuggcau

SEQ ID NO: 2329423 - RNA, 22 nt, Human
cuguaguccuagccacucagga

SEQ ID NO: 2329424 - RNA, 20 nt, Human
cuguaguccuagccacucag

SEQ ID NO: 2329425 - RNA, 22 nt, Human
cuguagucccagcuacucggga

SEQ ID NO: 2329426 - RNA, 23 nt, Human
cuguagucccagcuacucaggag

SEQ ID NO: 2329427 - RNA, 22 nt, Human
cuguagucccagcuacucagga

SEQ ID NO: 2329428 - RNA, 18 nt, Human
cuguagucccagcuacuc

SEQ ID NO: 2329429 - RNA, 15 nt, Human
cuguagucccagcua

SEQ ID NO: 2329430 - RNA, 14 nt, Human
cuguagucccagcu

SEQ ID NO: 2329431 - RNA, 15 nt, Human
cuguacacugcacga

SEQ ID NO: 2329432 - RNA, 13 nt, Human
cuguacacugcac

SEQ ID NO: 2329433 - RNA, 20 nt, Human
cuguagucucaggaccuagg

SEQ ID NO: 2329434 - RNA, 18 nt, Human
cuguagugagauagcauu

SEQ ID NO: 2329435 - RNA, 20 nt, Human
cuguagugagauagcauugu

SEQ ID NO: 2329436 - RNA, 22 nt, Human
cuguagugagauagcauuguga

SEQ ID NO: 2329437 - RNA, 15 nt, Human
cuguagucucaggac

SEQ ID NO: 2329438 - RNA, 14 nt, Human
cuguagucucagga

SEQ ID NO: 2329439 - RNA, 23 nt, Human
cuguaguccuagccacucaggag

SEQ ID NO: 2329440 - RNA, 15 nt, Human
cuguaguuaggaaau

SEQ ID NO: 2329441 - RNA, 14 nt, Human
cuguaguuaggaaa

SEQ ID NO: 2329442 - RNA, 13 nt, Human
cuguaguuaggaa

SEQ ID NO: 2329443 - RNA, 19 nt, Human
cuguacacugaauauuuau

SEQ ID NO: 2329444 - RNA, 18 nt, Human
cuguacacguguccugua

SEQ ID NO: 2329445 - RNA, 16 nt, Human
cuguacacguguccug

SEQ ID NO: 2329446 - RNA, 17 nt, Human
cuguacacguguccugu

SEQ ID NO: 2329447 - RNA, 13 nt, Human
cuguacagagccc

SEQ ID NO: 2329448 - RNA, 18 nt, Human
cuguacaauauuuaaaau

SEQ ID NO: 2329449 - RNA, 17 nt, Human
cuguacaauauuuaaaa

SEQ ID NO: 2329450 - RNA, 16 nt, Human
cuguacaauauuuaaa

SEQ ID NO: 2329451 - RNA, 15 nt, Human
cuguacaauauuuaa

SEQ ID NO: 2329452 - RNA, 14 nt, Human
cuguacaauauuua

SEQ ID NO: 2329453 - RNA, 20 nt, Human
cuguacaaauauaagaauaa

SEQ ID NO: 2329454 - RNA, 17 nt, Human
cuguacaaauauaagaa

SEQ ID NO: 2329455 - RNA, 19 nt, Human
cuguacaaauauaagaaua

SEQ ID NO: 2329456 - RNA, 21 nt, Human
cuguacaauauuuaaaauuua

SEQ ID NO: 2329457 - RNA, 15 nt, Human
cuguacaaugacuuu

SEQ ID NO: 2329458 - RNA, 17 nt, Human
cuguaucggagacagug

SEQ ID NO: 2329459 - RNA, 23 nt, Human
cuguaucccaugagccucagcau

SEQ ID NO: 2329460 - RNA, 18 nt, Human
cuguaucuuguuuuucca

SEQ ID NO: 2329461 - RNA, 23 nt, Human
cuguaucuguagugagauagcau

SEQ ID NO: 2329462 - RNA, 18 nt, Human
cuguaucggagacaguga

SEQ ID NO: 2329463 - RNA, 17 nt, Human
cuguaucuguagugaga

SEQ ID NO: 2329464 - RNA, 22 nt, Human
cuguaucuugggggacagggcu

SEQ ID NO: 2329465 - RNA, 22 nt, Human
cugucaaacaaagccagaagcu

SEQ ID NO: 2329466 - RNA, 19 nt, Human
cugucaaacaaagccagaa

SEQ ID NO: 2329467 - RNA, 18 nt, Human
cugucaaacaaagccaga

SEQ ID NO: 2329468 - RNA, 23 nt, Human
cuguauuuuauuuagacaagaga

SEQ ID NO: 2329469 - RNA, 21 nt, Human
cuguauuuuauuuagacaaga

SEQ ID NO: 2329470 - RNA, 22 nt, Human
cuguauuuuauuuagacaagag

SEQ ID NO: 2329471 - RNA, 22 nt, Human
cuguauuuuaaaagaaugauua

SEQ ID NO: 2329472 - RNA, 20 nt, Human
cuguauuuuaaaagaaugau

SEQ ID NO: 2329473 - RNA, 19 nt, Human
cuguauuuuaaaagaauga

SEQ ID NO: 2329474 - RNA, 21 nt, Human
cugucaagugggaucugucac

SEQ ID NO: 2329475 - RNA, 19 nt, Human
cugucaaguuccuuugggu

SEQ ID NO: 2329476 - RNA, 17 nt, Human
cugucaaggcugcuuag

SEQ ID NO: 2329477 - RNA, 20 nt, Human
cugucaaggcugcuuagaau

SEQ ID NO: 2329478 - RNA, 19 nt, Human
cugucaaggcugcuuagaa

SEQ ID NO: 2329479 - RNA, 17 nt, Human
cuguccagacagccugu

SEQ ID NO: 2329480 - RNA, 21 nt, Human
cuguccagacagccuguaucu

SEQ ID NO: 2329481 - RNA, 11 nt, Human
cuguccagaga

SEQ ID NO: 2329482 - RNA, 12 nt, Human
cugucaagaaga

SEQ ID NO: 2329483 - RNA, 14 nt, Human
cugucaagaagaug

SEQ ID NO: 2329484 - RNA, 17 nt, Human
cuguccagccugggcag

SEQ ID NO: 2329485 - RNA, 15 nt, Human
cuguccagccugggc

SEQ ID NO: 2329486 - RNA, 13 nt, Human
cuguccagccugg

SEQ ID NO: 2329487 - RNA, 18 nt, Human
cuguccagagagagaagu

SEQ ID NO: 2329488 - RNA, 18 nt, Human
cuguccagccugggcagc

SEQ ID NO: 2329489 - RNA, 12 nt, Human
cuguccagcucc

SEQ ID NO: 2329490 - RNA, 14 nt, Human
cuguccagcuccaa

SEQ ID NO: 2329491 - RNA, 13 nt, Human
cuguccagcucca

SEQ ID NO: 2329492 - RNA, 23 nt, Human
cuguccaggcacugcugcccagc

SEQ ID NO: 2329493 - RNA, 18 nt, Human
cuguccagcuccaaccug

SEQ ID NO: 2329494 - RNA, 17 nt, Human
cuguccagcuccaaccu

SEQ ID NO: 2329495 - RNA, 21 nt, Human
cuguccagcuccaaccugcaa

SEQ ID NO: 2329496 - RNA, 16 nt, Human
cuguccaggcacugag

SEQ ID NO: 2329497 - RNA, 19 nt, Human
cuguccaggcacugagaua

SEQ ID NO: 2329498 - RNA, 18 nt, Human
cuguccagggcccugagc

SEQ ID NO: 2329499 - RNA, 23 nt, Human
cuguccagggcccugagcucggu

SEQ ID NO: 2329500 - RNA, 22 nt, Human
cuguccagggcccugagcucgg

SEQ ID NO: 2329501 - RNA, 20 nt, Human
cuguccagggcccugagcuc

SEQ ID NO: 2329502 - RNA, 19 nt, Human
cuguccagggcccugagcu

SEQ ID NO: 2329503 - RNA, 17 nt, Human
cuguccccgcacugggc

SEQ ID NO: 2329504 - RNA, 13 nt, Human
cuguccagugccc

SEQ ID NO: 2329505 - RNA, 14 nt, Human
cuguccagugccca

SEQ ID NO: 2329506 - RNA, 15 nt, Human
cuguccagugcccau

SEQ ID NO: 2329507 - RNA, 18 nt, Human
cuguccagugcccauucc

SEQ ID NO: 2329508 - RNA, 14 nt, Human
cuguccagugggua

SEQ ID NO: 2329509 - RNA, 14 nt, Human
cuguccaguuccca

SEQ ID NO: 2329510 - RNA, 15 nt, Human
cuguccaguucccag

SEQ ID NO: 2329511 - RNA, 16 nt, Human
cuguccaguucccaga

SEQ ID NO: 2329512 - RNA, 18 nt, Human
cuguccccgcacugggcu

SEQ ID NO: 2329513 - RNA, 19 nt, Human
cuguccccgcacugggcuu

SEQ ID NO: 2329514 - RNA, 22 nt, Human
cuguccccgcacugggcuuggg

SEQ ID NO: 2329515 - RNA, 21 nt, Human
cuguccaguucccagaaggca

SEQ ID NO: 2329516 - RNA, 18 nt, Human
cuguccaguucccagaag

SEQ ID NO: 2329517 - RNA, 19 nt, Human
cuguccaguucccagaagg

SEQ ID NO: 2329518 - RNA, 20 nt, Human
cuguccaguucccagaaggc

SEQ ID NO: 2329519 - RNA, 14 nt, Human
cuguccgagcuuug

SEQ ID NO: 2329520 - RNA, 20 nt, Human
cugucccuuacgugaguccu

SEQ ID NO: 2329521 - RNA, 15 nt, Human
cugucccucucaggc

SEQ ID NO: 2329522 - RNA, 21 nt, Human
cugucccgggguccuguggca

SEQ ID NO: 2329523 - RNA, 17 nt, Human
cugucccuccgggaccu

SEQ ID NO: 2329524 - RNA, 21 nt, Human
cugucccuccgggaccuggug

SEQ ID NO: 2329525 - RNA, 12 nt, Human
cugucccuguca

SEQ ID NO: 2329526 - RNA, 16 nt, Human
cugucccucucaggca

SEQ ID NO: 2329527 - RNA, 14 nt, Human
cugucccugccuca

SEQ ID NO: 2329528 - RNA, 14 nt, Human
cuguccccuucucu

SEQ ID NO: 2329529 - RNA, 16 nt, Human
cuguccccuucucuca

SEQ ID NO: 2329530 - RNA, 19 nt, Human
cuguccccuucucucaucu

SEQ ID NO: 2329531 - RNA, 20 nt, Human
cuguccccuucucucaucuc

SEQ ID NO: 2329532 - RNA, 21 nt, Human
cuguccccuucucucaucucu

SEQ ID NO: 2329533 - RNA, 22 nt, Human
cuguccccuucucucaucucuu

SEQ ID NO: 2329534 - RNA, 23 nt, Human
cuguccccuucucucaucucuua

SEQ ID NO: 2329535 - RNA, 17 nt, Human
cugucccgggguccugu

SEQ ID NO: 2329536 - RNA, 18 nt, Human
cugucccgggguccugug

SEQ ID NO: 2329537 - RNA, 19 nt, Human
cuguccccucuugccccaa

SEQ ID NO: 2329538 - RNA, 20 nt, Human
cuguccccucuugccccaac

SEQ ID NO: 2329539 - RNA, 15 nt, Human
cuguccccucuugcc

SEQ ID NO: 2329540 - RNA, 16 nt, Human
cuguccccucuugccc

SEQ ID NO: 2329541 - RNA, 17 nt, Human
cuguccccucuugcccc

SEQ ID NO: 2329542 - RNA, 18 nt, Human
cuguccccucuugcccca

SEQ ID NO: 2329543 - RNA, 14 nt, Human
cuguccccucagcu

SEQ ID NO: 2329544 - RNA, 15 nt, Human
cuguccccucagcuc

SEQ ID NO: 2329545 - RNA, 16 nt, Human
cuguccccucagcucc

SEQ ID NO: 2329546 - RNA, 17 nt, Human
cuguccccucagcucca

SEQ ID NO: 2329547 - RNA, 20 nt, Human
cuguccccucagcuccagac

SEQ ID NO: 2329548 - RNA, 12 nt, Human
cuguccccucuu

SEQ ID NO: 2329549 - RNA, 12 nt, Human
cuguccuccaag

SEQ ID NO: 2329550 - RNA, 23 nt, Human
cuguccuccaacaccaagcacag

SEQ ID NO: 2329551 - RNA, 15 nt, Human
cuguccuccaacacc

SEQ ID NO: 2329552 - RNA, 13 nt, Human
cugucuagagagg

SEQ ID NO: 2329553 - RNA, 17 nt, Human
cugucuagagagggagg

SEQ ID NO: 2329554 - RNA, 16 nt, Human
cugucuagagagggag

SEQ ID NO: 2329555 - RNA, 14 nt, Human
cugucuagagaggg

SEQ ID NO: 2329556 - RNA, 13 nt, Human
cugucuauucuag

SEQ ID NO: 2329557 - RNA, 14 nt, Human
cugucuauuucugc

SEQ ID NO: 2329558 - RNA, 15 nt, Human
cugucuauuucugcu

SEQ ID NO: 2329559 - RNA, 18 nt, Human
cugucuagagagggaggc

SEQ ID NO: 2329560 - RNA, 12 nt, Human
cugucuagagua

SEQ ID NO: 2329561 - RNA, 18 nt, Human
cugucucaaaaaaagaaa

SEQ ID NO: 2329562 - RNA, 22 nt, Human
cugucucaagagggcacuggug

SEQ ID NO: 2329563 - RNA, 16 nt, Human
cugucuauuucugcug

SEQ ID NO: 2329564 - RNA, 17 nt, Human
cugucuauuucugcuga

SEQ ID NO: 2329565 - RNA, 18 nt, Human
cugucuauuucugcugaa

SEQ ID NO: 2329566 - RNA, 19 nt, Human
cugucuauuucugcugaau

SEQ ID NO: 2329567 - RNA, 16 nt, Human
cugucucaaaaaaaga

SEQ ID NO: 2329568 - RNA, 23 nt, Human
cugucucaaaaaaacacaaaagu

SEQ ID NO: 2329569 - RNA, 15 nt, Human
cuguccucagguggc

SEQ ID NO: 2329570 - RNA, 16 nt, Human
cuguccucagguggcc

SEQ ID NO: 2329571 - RNA, 17 nt, Human
cuguccucagguggcca

SEQ ID NO: 2329572 - RNA, 18 nt, Human
cuguccucagguggccau

SEQ ID NO: 2329573 - RNA, 20 nt, Human
cugucuacacuaagagagaa

SEQ ID NO: 2329574 - RNA, 12 nt, Human
cuguccucaggu

SEQ ID NO: 2329575 - RNA, 17 nt, Human
cuguccucagcuucuua

SEQ ID NO: 2329576 - RNA, 15 nt, Human
cuguccucagcuucu

SEQ ID NO: 2329577 - RNA, 22 nt, Human
cuguccucagccuugccagaga

SEQ ID NO: 2329578 - RNA, 21 nt, Human
cuguccucagccuugccagag

SEQ ID NO: 2329579 - RNA, 20 nt, Human
cuguccucagccuugccaga

SEQ ID NO: 2329580 - RNA, 18 nt, Human
cuguccucagccuugcca

SEQ ID NO: 2329581 - RNA, 14 nt, Human
cuguccucagccuu

SEQ ID NO: 2329582 - RNA, 18 nt, Human
cuguccguuuacuccaag

SEQ ID NO: 2329583 - RNA, 17 nt, Human
cugucccugucaccaag

SEQ ID NO: 2329584 - RNA, 13 nt, Human
cuguccucagccu

SEQ ID NO: 2329585 - RNA, 14 nt, Human
cuguccuacccacc

SEQ ID NO: 2329586 - RNA, 15 nt, Human
cuguccgagcuuuga

SEQ ID NO: 2329587 - RNA, 15 nt, Human
cugucccugucacca

SEQ ID NO: 2329588 - RNA, 22 nt, Human
cugucccuuacgugaguccugg

SEQ ID NO: 2329589 - RNA, 23 nt, Human
cugugggcugcacucugugccca

SEQ ID NO: 2329590 - RNA, 15 nt, Human
cugugggcuggcagu

SEQ ID NO: 2329591 - RNA, 18 nt, Human
cugugggcugcacucugu

SEQ ID NO: 2329592 - RNA, 20 nt, Human
cugugggcugcacucugugc

SEQ ID NO: 2329593 - RNA, 21 nt, Human
cugugggcugcacucugugcc

SEQ ID NO: 2329594 - RNA, 22 nt, Human
cugugggcugcacucugugccc

SEQ ID NO: 2329595 - RNA, 19 nt, Human
cugugggccucaaggacuu

SEQ ID NO: 2329596 - RNA, 15 nt, Human
cugugggcugcacuc

SEQ ID NO: 2329597 - RNA, 14 nt, Human
cugugggcugcacu

SEQ ID NO: 2329598 - RNA, 23 nt, Human
cugugggcgugagaccugccccu

SEQ ID NO: 2329599 - RNA, 19 nt, Human
cuguggggauuucucccag

SEQ ID NO: 2329600 - RNA, 18 nt, Human
cuguggggauuucuccca

SEQ ID NO: 2329601 - RNA, 17 nt, Human
cuguggggauuucuccc

SEQ ID NO: 2329602 - RNA, 21 nt, Human
cuguggggaucucaggggcug

SEQ ID NO: 2329603 - RNA, 16 nt, Human
cuguggggaucucagg

SEQ ID NO: 2329604 - RNA, 17 nt, Human
cuguggggaucucaggg

SEQ ID NO: 2329605 - RNA, 20 nt, Human
cuguggggaucucaggggcu

SEQ ID NO: 2329606 - RNA, 21 nt, Human
cuguggggauuucucccagcu

SEQ ID NO: 2329607 - RNA, 20 nt, Human
cuguggggauuucucccagc

SEQ ID NO: 2329608 - RNA, 19 nt, Human
cuguggggccuugguuccc

SEQ ID NO: 2329609 - RNA, 14 nt, Human
cuguggggcuggua

SEQ ID NO: 2329610 - RNA, 17 nt, Human
cuguggggcugguagcu

SEQ ID NO: 2329611 - RNA, 21 nt, Human
cuguggggcugguagcucagg

SEQ ID NO: 2329612 - RNA, 22 nt, Human
cuguggggcugguagcucaggu

SEQ ID NO: 2329613 - RNA, 21 nt, Human
cugugucuugcaauggcagcc

SEQ ID NO: 2329614 - RNA, 20 nt, Human
cugugucuugcaauggcagc

SEQ ID NO: 2329615 - RNA, 19 nt, Human
cugugggggaagagcacag

SEQ ID NO: 2329616 - RNA, 20 nt, Human
cugugggggaagagcacagc

SEQ ID NO: 2329617 - RNA, 21 nt, Human
cugugggggaagagcacagcc

SEQ ID NO: 2329618 - RNA, 22 nt, Human
cugugggggaagagcacagccc

SEQ ID NO: 2329619 - RNA, 22 nt, Human
cugugucuugcaauggcagccu

SEQ ID NO: 2329620 - RNA, 23 nt, Human
cugugucuugcaauggcagccuu

SEQ ID NO: 2329621 - RNA, 16 nt, Human
cuguguggacugugau

SEQ ID NO: 2329622 - RNA, 18 nt, Human
cuguguggacugugaugc

SEQ ID NO: 2329623 - RNA, 15 nt, Human
cuguguggcagucug

SEQ ID NO: 2329624 - RNA, 23 nt, Human
cugugggggaagagcacagcccu

SEQ ID NO: 2329625 - RNA, 18 nt, Human
cugugugcuccuccuugg

SEQ ID NO: 2329626 - RNA, 23 nt, Human
cugugugcuccuccuuggugccu

SEQ ID NO: 2329627 - RNA, 23 nt, Human
cugugugcucaggagcccuggga

SEQ ID NO: 2329628 - RNA, 19 nt, Human
cugugugcucaggagcccu

SEQ ID NO: 2329629 - RNA, 16 nt, Human
cugugugcucaggagc

SEQ ID NO: 2329630 - RNA, 20 nt, Human
cugugugcucaggagcccug

SEQ ID NO: 2329631 - RNA, 21 nt, Human
cugugugcucaggagcccugg

SEQ ID NO: 2329632 - RNA, 21 nt, Human
cugugugguuugguguguucc

SEQ ID NO: 2329633 - RNA, 12 nt, Human
cuguguguguga

SEQ ID NO: 2329634 - RNA, 16 nt, Human
cugugugugugaauga

SEQ ID NO: 2329635 - RNA, 14 nt, Human
cugugugugugaau

SEQ ID NO: 2329636 - RNA, 23 nt, Human
cugugugugugaaugaacacucu

SEQ ID NO: 2329637 - RNA, 18 nt, Human
cugugugugugaaugaac

SEQ ID NO: 2329638 - RNA, 17 nt, Human
cugugugugugaaugaa

SEQ ID NO: 2329639 - RNA, 18 nt, Human
cugugugugcgccuacag

SEQ ID NO: 2329640 - RNA, 12 nt, Human
cugugugguuug

SEQ ID NO: 2329641 - RNA, 22 nt, Human
cuguguggugucgcgccuucuc

SEQ ID NO: 2329642 - RNA, 20 nt, Human
cugugugugcgccuacagga

SEQ ID NO: 2329643 - RNA, 17 nt, Human
cuguguguuuaugugug

SEQ ID NO: 2329644 - RNA, 16 nt, Human
cuguguguuuaugugu

SEQ ID NO: 2329645 - RNA, 22 nt, Human
cuguguguugccacaggacaca

SEQ ID NO: 2329646 - RNA, 21 nt, Human
cuguguguugccacaggacac

SEQ ID NO: 2329647 - RNA, 22 nt, Human
cuguguugucucuagagcaggg

SEQ ID NO: 2329648 - RNA, 20 nt, Human
cuguguguugccacaggaca

SEQ ID NO: 2329649 - RNA, 19 nt, Human
cuguguguugccacaggac

SEQ ID NO: 2329650 - RNA, 13 nt, Human
cuguguguugcca

SEQ ID NO: 2329651 - RNA, 19 nt, Human
cuguguguuaguucccaac

SEQ ID NO: 2329652 - RNA, 16 nt, Human
cuguguguuaguuccc

SEQ ID NO: 2329653 - RNA, 18 nt, Human
cuguguguuaguucccaa

SEQ ID NO: 2329654 - RNA, 21 nt, Human
cuguguguuaguucccaacau

SEQ ID NO: 2329655 - RNA, 21 nt, Human
cugugugugugaaugaacacu

SEQ ID NO: 2329656 - RNA, 12 nt, Human
cuguguguuagu

SEQ ID NO: 2329657 - RNA, 20 nt, Human
cuguguuugagcucugcagc

SEQ ID NO: 2329658 - RNA, 19 nt, Human
cuguguuucuuuugguucc

SEQ ID NO: 2329659 - RNA, 19 nt, Human
cuguguuucaaguggggcu

SEQ ID NO: 2329660 - RNA, 22 nt, Human
cuguguuugagcucugcagccc

SEQ ID NO: 2329661 - RNA, 20 nt, Human
cuguuaaaagaugaaaauau

SEQ ID NO: 2329662 - RNA, 13 nt, Human
cuguguuuuaaua

SEQ ID NO: 2329663 - RNA, 15 nt, Human
cuguguuuguuccua

SEQ ID NO: 2329664 - RNA, 14 nt, Human
cuguguuuguuccu

SEQ ID NO: 2329665 - RNA, 23 nt, Human
cuguuaaaagaugaaaauauuug

SEQ ID NO: 2329666 - RNA, 21 nt, Human
cuguuaaaagaugaaaauauu

SEQ ID NO: 2329667 - RNA, 17 nt, Human
cuguucccaccugcugg

SEQ ID NO: 2329668 - RNA, 18 nt, Human
cuguucccaaauuuucua

SEQ ID NO: 2329669 - RNA, 14 nt, Human
cuguuccagccugc

SEQ ID NO: 2329670 - RNA, 17 nt, Human
cuguuccagccugcccu

SEQ ID NO: 2329671 - RNA, 23 nt, Human
cuguuccagccugcccucuucau

SEQ ID NO: 2329672 - RNA, 18 nt, Human
cuguucccauucuugcau

SEQ ID NO: 2329673 - RNA, 20 nt, Human
cuguucccauguagcccccu

SEQ ID NO: 2329674 - RNA, 13 nt, Human
cuguuccccagag

SEQ ID NO: 2329675 - RNA, 16 nt, Human
cuguuccccagagaaa

SEQ ID NO: 2329676 - RNA, 12 nt, Human
cuguucccccgc

SEQ ID NO: 2329677 - RNA, 23 nt, Human
cuguucccccgccgcuuuucucc

SEQ ID NO: 2329678 - RNA, 15 nt, Human
cuguuccccagagaa

SEQ ID NO: 2329679 - RNA, 14 nt, Human
cuguuccccagaga

SEQ ID NO: 2329680 - RNA, 17 nt, Human
cuguucauuuccucaaa

SEQ ID NO: 2329681 - RNA, 14 nt, Human
cuguucauuuccuc

SEQ ID NO: 2329682 - RNA, 17 nt, Human
cuguucaguuacagaaa

SEQ ID NO: 2329683 - RNA, 18 nt, Human
cuguucaguuacagaaag

SEQ ID NO: 2329684 - RNA, 19 nt, Human
cuguucaguuacagaaagu

SEQ ID NO: 2329685 - RNA, 21 nt, Human
cuguucaguuacagaaagugg

SEQ ID NO: 2329686 - RNA, 21 nt, Human
cuguucagcugguugagguuu

SEQ ID NO: 2329687 - RNA, 19 nt, Human
cuguucagcugguugaggu

SEQ ID NO: 2329688 - RNA, 18 nt, Human
cuguucagcugguugagg

SEQ ID NO: 2329689 - RNA, 16 nt, Human
cuguucagugucccgg

SEQ ID NO: 2329690 - RNA, 20 nt, Human
cuguucagugucccgggccc

SEQ ID NO: 2329691 - RNA, 12 nt, Human
cuguucaguuac

SEQ ID NO: 2329692 - RNA, 13 nt, Human
cuguucaguuaca

SEQ ID NO: 2329693 - RNA, 14 nt, Human
cuguucaguuacag

SEQ ID NO: 2329694 - RNA, 15 nt, Human
cuguucaguuacaga

SEQ ID NO: 2329695 - RNA, 13 nt, Human
cuguuacugucuu

SEQ ID NO: 2329696 - RNA, 20 nt, Human
cuguuaccugaucaaugaca

SEQ ID NO: 2329697 - RNA, 21 nt, Human
cuguuaccugaucaaugacag

SEQ ID NO: 2329698 - RNA, 18 nt, Human
cuguuacccagagaauau

SEQ ID NO: 2329699 - RNA, 20 nt, Human
cuguuaccaugucacugugg

SEQ ID NO: 2329700 - RNA, 16 nt, Human
cuguuacacuggagga

SEQ ID NO: 2329701 - RNA, 15 nt, Human
cuguuaccaugucac

SEQ ID NO: 2329702 - RNA, 16 nt, Human
cuguuaccaugucacu

SEQ ID NO: 2329703 - RNA, 18 nt, Human
cuguuaccaugucacugu

SEQ ID NO: 2329704 - RNA, 19 nt, Human
cuguuaccaugucacugug

SEQ ID NO: 2329705 - RNA, 13 nt, Human
cuguuacacugga

SEQ ID NO: 2329706 - RNA, 21 nt, Human
cuguuccuucacauccugugu

SEQ ID NO: 2329707 - RNA, 18 nt, Human
cuguuccuucacauccug

SEQ ID NO: 2329708 - RNA, 15 nt, Human
cuguuccuucacauc

SEQ ID NO: 2329709 - RNA, 15 nt, Human
cuguuccuuagaccu

SEQ ID NO: 2329710 - RNA, 16 nt, Human
cuguuccuuagaccuu

SEQ ID NO: 2329711 - RNA, 13 nt, Human
cuguucucugccc

SEQ ID NO: 2329712 - RNA, 20 nt, Human
cuguucuacauagaugcuua

SEQ ID NO: 2329713 - RNA, 23 nt, Human
cuguucccccuucacaaagccca

SEQ ID NO: 2329714 - RNA, 22 nt, Human
cuguuccccuaguaagugccuu

SEQ ID NO: 2329715 - RNA, 23 nt, Human
cuguuccccuaguaagugccuuc

SEQ ID NO: 2329716 - RNA, 12 nt, Human
cuguuccccuca

SEQ ID NO: 2329717 - RNA, 17 nt, Human
cuguucccccuucacaa

SEQ ID NO: 2329718 - RNA, 16 nt, Human
cuguucccccuucaca

SEQ ID NO: 2329719 - RNA, 15 nt, Human
cuguucccccuucac

SEQ ID NO: 2329720 - RNA, 14 nt, Human
cuguucccccuuca

SEQ ID NO: 2329721 - RNA, 17 nt, Human
cuguucccccugugcag

SEQ ID NO: 2329722 - RNA, 16 nt, Human
cuguucccccugugca

SEQ ID NO: 2329723 - RNA, 15 nt, Human
cuguucccccugugc

SEQ ID NO: 2329724 - RNA, 12 nt, Human
cuguucccccug

SEQ ID NO: 2329725 - RNA, 20 nt, Human
cuguucccucugcuccugga

SEQ ID NO: 2329726 - RNA, 17 nt, Human
cuguucccucugcuccu

SEQ ID NO: 2329727 - RNA, 19 nt, Human
cuguucccucugcuccugg

SEQ ID NO: 2329728 - RNA, 22 nt, Human
cuguuccccucacuggaugaaa

SEQ ID NO: 2329729 - RNA, 14 nt, Human
cuguuccccucacu

SEQ ID NO: 2329730 - RNA, 15 nt, Human
cuguuccccucacug

SEQ ID NO: 2329731 - RNA, 17 nt, Human
cuguuccccucacugga

SEQ ID NO: 2329732 - RNA, 14 nt, Human
cuguucccucugcu

SEQ ID NO: 2329733 - RNA, 20 nt, Human
cuguucucugcccuccaaga

SEQ ID NO: 2329734 - RNA, 15 nt, Human
cuguucucuugggaa

SEQ ID NO: 2329735 - RNA, 19 nt, Human
cuguucuacauagaugcuu

SEQ ID NO: 2329736 - RNA, 18 nt, Human
cuguucucugcccuccaa

SEQ ID NO: 2329737 - RNA, 19 nt, Human
cuguucucugcccuccaag

SEQ ID NO: 2329738 - RNA, 14 nt, Human
cuguucucugcccu

SEQ ID NO: 2329739 - RNA, 15 nt, Human
cuguucucugcccuc

SEQ ID NO: 2329740 - RNA, 16 nt, Human
cuguucucugcccucc

SEQ ID NO: 2329741 - RNA, 17 nt, Human
cuguucucugcccucca

SEQ ID NO: 2329742 - RNA, 13 nt, Human
cugugccuccuca

SEQ ID NO: 2329743 - RNA, 14 nt, Human
cugugccucccaaa

SEQ ID NO: 2329744 - RNA, 16 nt, Human
cugugccuccucaccc

SEQ ID NO: 2329745 - RNA, 15 nt, Human
cugugccuccucacc

SEQ ID NO: 2329746 - RNA, 14 nt, Human
cugugccauuuugu

SEQ ID NO: 2329747 - RNA, 20 nt, Human
cugugccacccugggcucug

SEQ ID NO: 2329748 - RNA, 22 nt, Human
cugugccacccugggcucugug

SEQ ID NO: 2329749 - RNA, 18 nt, Human
cugugccacccaccaggg

SEQ ID NO: 2329750 - RNA, 13 nt, Human
cugugccacccug

SEQ ID NO: 2329751 - RNA, 13 nt, Human
cugugccacccac

SEQ ID NO: 2329752 - RNA, 17 nt, Human
cugugcaugguggcacc

SEQ ID NO: 2329753 - RNA, 15 nt, Human
cugugccacccuggg

SEQ ID NO: 2329754 - RNA, 16 nt, Human
cugugccacccugggc

SEQ ID NO: 2329755 - RNA, 17 nt, Human
cugugccacccugggcu

SEQ ID NO: 2329756 - RNA, 18 nt, Human
cugugccacccugggcuc

SEQ ID NO: 2329757 - RNA, 17 nt, Human
cugugcauguaugucuu

SEQ ID NO: 2329758 - RNA, 11 nt, Human
cugugccaccc

SEQ ID NO: 2329759 - RNA, 16 nt, Human
cugugccaugugccag

SEQ ID NO: 2329760 - RNA, 18 nt, Human
cugugccaugugccaggu

SEQ ID NO: 2329761 - RNA, 22 nt, Human
cugugcacaaaacccagaccug

SEQ ID NO: 2329762 - RNA, 19 nt, Human
cugugcacaucugugucuu

SEQ ID NO: 2329763 - RNA, 18 nt, Human
cugugcacaucugugucu

SEQ ID NO: 2329764 - RNA, 23 nt, Human
cugugcaguggcccccacagaaa

SEQ ID NO: 2329765 - RNA, 20 nt, Human
cugugcacaucugugucuug

SEQ ID NO: 2329766 - RNA, 22 nt, Human
cugugcaugggugaagggagag

SEQ ID NO: 2329767 - RNA, 20 nt, Human
cugugcaugggugaagggag

SEQ ID NO: 2329768 - RNA, 17 nt, Human
cugugcaugggugaagg

SEQ ID NO: 2329769 - RNA, 14 nt, Human
cugugcauggguga

SEQ ID NO: 2329770 - RNA, 15 nt, Human
cugugcauguauguc

SEQ ID NO: 2329771 - RNA, 16 nt, Human
cugugcauguaugucu

SEQ ID NO: 2329772 - RNA, 19 nt, Human
cugugauggggcccugccu

SEQ ID NO: 2329773 - RNA, 20 nt, Human
cugugauggggcccugccuc

SEQ ID NO: 2329774 - RNA, 21 nt, Human
cugugcaaccucuuggccuga

SEQ ID NO: 2329775 - RNA, 20 nt, Human
cugugcacaaaacccagacc

SEQ ID NO: 2329776 - RNA, 19 nt, Human
cugugcacaaaacccagac

SEQ ID NO: 2329777 - RNA, 13 nt, Human
cugucucagggug

SEQ ID NO: 2329778 - RNA, 13 nt, Human
cugucuccagacc

SEQ ID NO: 2329779 - RNA, 18 nt, Human
cugucuccagacccccac

SEQ ID NO: 2329780 - RNA, 16 nt, Human
cugucuccagaccccc

SEQ ID NO: 2329781 - RNA, 15 nt, Human
cugucuccagacccc

SEQ ID NO: 2329782 - RNA, 13 nt, Human
cugucucagccuc

SEQ ID NO: 2329783 - RNA, 17 nt, Human
cugucucagccucccag

SEQ ID NO: 2329784 - RNA, 16 nt, Human
cugucucagccuccca

SEQ ID NO: 2329785 - RNA, 15 nt, Human
cugucucagccuccc

SEQ ID NO: 2329786 - RNA, 14 nt, Human
cugucucagccucc

SEQ ID NO: 2329787 - RNA, 12 nt, Human
cugucucagccu

SEQ ID NO: 2329788 - RNA, 13 nt, Human
cugucucagacuc

SEQ ID NO: 2329789 - RNA, 23 nt, Human
cugucucaagagggcacuggugg

SEQ ID NO: 2329790 - RNA, 13 nt, Human
cugucuccuagga

SEQ ID NO: 2329791 - RNA, 23 nt, Human
cugugaggugcagagugcccaga

SEQ ID NO: 2329792 - RNA, 19 nt, Human
cugugaggggcucucucau

SEQ ID NO: 2329793 - RNA, 22 nt, Human
cugucuccagacccccaccccu

SEQ ID NO: 2329794 - RNA, 19 nt, Human
cugucuccagacccccacc

SEQ ID NO: 2329795 - RNA, 20 nt, Human
cugucuccauggcccugcaa

SEQ ID NO: 2329796 - RNA, 18 nt, Human
cugucuccauguuugaug

SEQ ID NO: 2329797 - RNA, 14 nt, Human
cugugaguguaagu

SEQ ID NO: 2329798 - RNA, 22 nt, Human
cugugaggugcagagugcccag

SEQ ID NO: 2329799 - RNA, 23 nt, Human
cugugaguacuacaguccuccca

SEQ ID NO: 2329800 - RNA, 20 nt, Human
cugugaguacuacaguccuc

SEQ ID NO: 2329801 - RNA, 21 nt, Human
cugugaguacuacaguccucc

SEQ ID NO: 2329802 - RNA, 20 nt, Human
cugugaguguaagugugagu

SEQ ID NO: 2329803 - RNA, 19 nt, Human
cugugaguguaagugugag

SEQ ID NO: 2329804 - RNA, 21 nt, Human
cugugaguguaagugugagua

SEQ ID NO: 2329805 - RNA, 17 nt, Human
cugugaguuuaaagcaa

SEQ ID NO: 2329806 - RNA, 18 nt, Human
cugugauggggcccugcc

SEQ ID NO: 2329807 - RNA, 17 nt, Human
cugugauggggcccugc

SEQ ID NO: 2329808 - RNA, 19 nt, Human
cuguggaaaagaaacacgc

SEQ ID NO: 2329809 - RNA, 18 nt, Human
cuguggaaaaauauuuaa

SEQ ID NO: 2329810 - RNA, 14 nt, Human
cuguggaaaaauau

SEQ ID NO: 2329811 - RNA, 17 nt, Human
cugugcuuuuaaaugca

SEQ ID NO: 2329812 - RNA, 19 nt, Human
cugugcuuugacucaccug

SEQ ID NO: 2329813 - RNA, 21 nt, Human
cugugcuuugacucaccuguu

SEQ ID NO: 2329814 - RNA, 12 nt, Human
cugugcuuucua

SEQ ID NO: 2329815 - RNA, 13 nt, Human
cugugcuuucuau

SEQ ID NO: 2329816 - RNA, 15 nt, Human
cugugcuuucuauug

SEQ ID NO: 2329817 - RNA, 16 nt, Human
cugugcuuucuauugu

SEQ ID NO: 2329818 - RNA, 20 nt, Human
cugugcuuucuauuguacag

SEQ ID NO: 2329819 - RNA, 22 nt, Human
cugugcuuucuauuguacagaa

SEQ ID NO: 2329820 - RNA, 16 nt, Human
cugugcuuugacucac

SEQ ID NO: 2329821 - RNA, 18 nt, Human
cugugcuuugacucaccu

SEQ ID NO: 2329822 - RNA, 15 nt, Human
cugugcuuuccagcu

SEQ ID NO: 2329823 - RNA, 21 nt, Human
cugugcuucgggcccuuccca

SEQ ID NO: 2329824 - RNA, 20 nt, Human
cugugcuucgggcccuuccc

SEQ ID NO: 2329825 - RNA, 16 nt, Human
cugugcuuuccagcuc

SEQ ID NO: 2329826 - RNA, 17 nt, Human
cugugcuuuccagcuca

SEQ ID NO: 2329827 - RNA, 20 nt, Human
cugugcuuuccagcucaccc

SEQ ID NO: 2329828 - RNA, 21 nt, Human
cugugcuuuccagcucacccc

SEQ ID NO: 2329829 - RNA, 22 nt, Human
cugugcuuuccagcucaccccc

SEQ ID NO: 2329830 - RNA, 14 nt, Human
cugugcuuucccug

SEQ ID NO: 2329831 - RNA, 19 nt, Human
cugugcuuucccugaacug

SEQ ID NO: 2329832 - RNA, 12 nt, Human
cugugcuggugu

SEQ ID NO: 2329833 - RNA, 17 nt, Human
cugugcugguguccuga

SEQ ID NO: 2329834 - RNA, 18 nt, Human
cugugcugguguccugac

SEQ ID NO: 2329835 - RNA, 19 nt, Human
cugugcugguguccugacc

SEQ ID NO: 2329836 - RNA, 20 nt, Human
cugugcugguguccugacca

SEQ ID NO: 2329837 - RNA, 21 nt, Human
cugugcugguguccugaccac

SEQ ID NO: 2329838 - RNA, 11 nt, Human
cugugcugugu

SEQ ID NO: 2329839 - RNA, 13 nt, Human
cugugcugugugu

SEQ ID NO: 2329840 - RNA, 23 nt, Human
cugugcugguguccugaccaccc

SEQ ID NO: 2329841 - RNA, 18 nt, Human
cugugcugugcccaaguu

SEQ ID NO: 2329842 - RNA, 12 nt, Human
cugugcugugga

SEQ ID NO: 2329843 - RNA, 15 nt, Human
cugugcuguggaagc

SEQ ID NO: 2329844 - RNA, 19 nt, Human
cugugcuucgggcccuucc

SEQ ID NO: 2329845 - RNA, 17 nt, Human
cugugcuucgggcccuu

SEQ ID NO: 2329846 - RNA, 18 nt, Human
cugugcuucaauuaauaa

SEQ ID NO: 2329847 - RNA, 21 nt, Human
cugugcuguggaagcaacagg

SEQ ID NO: 2329848 - RNA, 18 nt, Human
cugugcugugugugacgu

SEQ ID NO: 2329849 - RNA, 17 nt, Human
cugugcuucaauuaaua

SEQ ID NO: 2329850 - RNA, 18 nt, Human
cugugccucugggacugg

SEQ ID NO: 2329851 - RNA, 17 nt, Human
cugugccucugggacug

SEQ ID NO: 2329852 - RNA, 22 nt, Human
cugugcugcccugcccaccugg

SEQ ID NO: 2329853 - RNA, 16 nt, Human
cugugcuggagccacu

SEQ ID NO: 2329854 - RNA, 21 nt, Human
cugugcuggagccacuaacua

SEQ ID NO: 2329855 - RNA, 13 nt, Human
cugugcuggagcc

SEQ ID NO: 2329856 - RNA, 14 nt, Human
cugugcuggagcca

SEQ ID NO: 2329857 - RNA, 15 nt, Human
cugugcuggagccac

SEQ ID NO: 2329858 - RNA, 16 nt, Human
cugugccucugggacu

SEQ ID NO: 2329859 - RNA, 14 nt, Human
cugugccucuggga

SEQ ID NO: 2329860 - RNA, 11 nt, Human
cugugccucug

SEQ ID NO: 2329861 - RNA, 23 nt, Human
cugugccucggcuuuucucagcu

SEQ ID NO: 2329862 - RNA, 22 nt, Human
cugugccucggcuuuucucagc

SEQ ID NO: 2329863 - RNA, 13 nt, Human
cugugccucggcu

SEQ ID NO: 2329864 - RNA, 22 nt, Human
cuguggaaaagaaacacgcacu

SEQ ID NO: 2329865 - RNA, 19 nt, Human
cuguggaaaaauauuuaag

SEQ ID NO: 2329866 - RNA, 13 nt, Human
cuguggaaagugu

SEQ ID NO: 2329867 - RNA, 14 nt, Human
cuguggaaagugua

SEQ ID NO: 2329868 - RNA, 15 nt, Human
cuguggaaaguguaa

SEQ ID NO: 2329869 - RNA, 16 nt, Human
cuguggaaaguguaaa

SEQ ID NO: 2329870 - RNA, 17 nt, Human
cuguggaaaguguaaag

SEQ ID NO: 2329871 - RNA, 17 nt, Human
cuguggaugauaaaaca

SEQ ID NO: 2329872 - RNA, 20 nt, Human
cuguggaugagcccucagaa

SEQ ID NO: 2329873 - RNA, 18 nt, Human
cuguggaaaguguaaagc

SEQ ID NO: 2329874 - RNA, 20 nt, Human
cuguggaaaguguaaagcau

SEQ ID NO: 2329875 - RNA, 21 nt, Human
cuguggaaaguguaaagcauu

SEQ ID NO: 2329876 - RNA, 19 nt, Human
cuguggaugagcccucaga

SEQ ID NO: 2329877 - RNA, 16 nt, Human
cuguggccaaguucuu

SEQ ID NO: 2329878 - RNA, 17 nt, Human
cuguggcaucuuugccu

SEQ ID NO: 2329879 - RNA, 23 nt, Human
cuguggcaggcagcgccaagcaa

SEQ ID NO: 2329880 - RNA, 14 nt, Human
cuguggcaggcagc

SEQ ID NO: 2329881 - RNA, 17 nt, Human
cuguggcaggcagcgcc

SEQ ID NO: 2329882 - RNA, 18 nt, Human
cuguggcaggcagcgcca

SEQ ID NO: 2329883 - RNA, 21 nt, Human
cuguggcaggcagcgccaagc

SEQ ID NO: 2329884 - RNA, 13 nt, Human
cuguggcaggcag

SEQ ID NO: 2329885 - RNA, 18 nt, Human
cuguggccaaguucuuag

SEQ ID NO: 2329886 - RNA, 22 nt, Human
cuguggccagcuuguuauuuau

SEQ ID NO: 2329887 - RNA, 14 nt, Human
cuguggccugggca

SEQ ID NO: 2329888 - RNA, 13 nt, Human
cuguggccugggc

SEQ ID NO: 2329889 - RNA, 13 nt, Human
cuguggccaaagg

SEQ ID NO: 2329890 - RNA, 23 nt, Human
cuguggccagcuuguuauuuaua

SEQ ID NO: 2329891 - RNA, 20 nt, Human
cuguggccugugucccauga

SEQ ID NO: 2329892 - RNA, 22 nt, Human
cuguggccugugucccaugacc

SEQ ID NO: 2329893 - RNA, 16 nt, Human
cuguggccugggcaag

SEQ ID NO: 2329894 - RNA, 14 nt, Human
cuguggccuguguc

SEQ ID NO: 2329895 - RNA, 17 nt, Human
cuguggccuguguccca

SEQ ID NO: 2329896 - RNA, 17 nt, Human
cuguggcgccgucucca

SEQ ID NO: 2329897 - RNA, 23 nt, Human
cuguggccugugucccaugaccc

SEQ ID NO: 2329898 - RNA, 19 nt, Human
cuguggcgccgucuccagg

SEQ ID NO: 2329899 - RNA, 20 nt, Human
cuguggcgccgucuccaggg

SEQ ID NO: 2329900 - RNA, 18 nt, Human
cuguggcggugccugggu

SEQ ID NO: 2329901 - RNA, 21 nt, Human
cuguggcgccgucuccagggg

SEQ ID NO: 2329902 - RNA, 24 nt, Human
cuguggcgccgucuccaggggcug

SEQ ID NO: 2329903 - RNA, 14 nt, Human
cugugggcccccaa

SEQ ID NO: 2329904 - RNA, 20 nt, Human
cugugggccucaaggacuug

SEQ ID NO: 2329905 - RNA, 14 nt, Human
cugugggccucaag

SEQ ID NO: 2329906 - RNA, 17 nt, Human
cuguggcugcuagcacu

SEQ ID NO: 2329907 - RNA, 15 nt, Human
cuguggcggugccug

SEQ ID NO: 2329908 - RNA, 14 nt, Human
cuguggcggugccu

SEQ ID NO: 2329909 - RNA, 22 nt, Human
cugugggcgugagaccugcccc

SEQ ID NO: 2329910 - RNA, 21 nt, Human
cugugggcgugagaccugccc

SEQ ID NO: 2329911 - RNA, 18 nt, Human
cuucaccccaaucccagc

SEQ ID NO: 2329912 - RNA, 24 nt, Human
cuucacccagcuaaucuguagggc

SEQ ID NO: 2329913 - RNA, 21 nt, Human
cuucaccauuuggcaaugcca

SEQ ID NO: 2329914 - RNA, 19 nt, Human
cuucaccagagcauuucca

SEQ ID NO: 2329915 - RNA, 22 nt, Human
cuucacccagcuaaucuguagg

SEQ ID NO: 2329916 - RNA, 15 nt, Human
cuucaccccccacuc

SEQ ID NO: 2329917 - RNA, 14 nt, Human
cuucaccccagugg

SEQ ID NO: 2329918 - RNA, 19 nt, Human
cuucaccccaguggccacu

SEQ ID NO: 2329919 - RNA, 23 nt, Human
cuucaccccaguggccacucagc

SEQ ID NO: 2329920 - RNA, 21 nt, Human
cuucacccugaaugguuccau

SEQ ID NO: 2329921 - RNA, 15 nt, Human
cuucacccuggagcc

SEQ ID NO: 2329922 - RNA, 19 nt, Human
cuucaggcucuucuccuuu

SEQ ID NO: 2329923 - RNA, 22 nt, Human
cuucaggcucuucuccuuucac

SEQ ID NO: 2329924 - RNA, 23 nt, Human
cuucaguaagccgugauuuucau

SEQ ID NO: 2329925 - RNA, 16 nt, Human
cuucaguaagccguga

SEQ ID NO: 2329926 - RNA, 19 nt, Human
cuucagggcacugcugcug

SEQ ID NO: 2329927 - RNA, 15 nt, Human
cuucagggagugagg

SEQ ID NO: 2329928 - RNA, 20 nt, Human
cuucagggcagggcucugau

SEQ ID NO: 2329929 - RNA, 17 nt, Human
cuucagggcagggcucu

SEQ ID NO: 2329930 - RNA, 16 nt, Human
cuucagggcagggcuc

SEQ ID NO: 2329931 - RNA, 19 nt, Human
cuucagggcagggcucuga

SEQ ID NO: 2329932 - RNA, 18 nt, Human
cuucagggcagggcucug

SEQ ID NO: 2329933 - RNA, 19 nt, Human
cuucaguacccucucagcu

SEQ ID NO: 2329934 - RNA, 22 nt, Human
cuucaguacccucucagcucca

SEQ ID NO: 2329935 - RNA, 23 nt, Human
cuucaguacccucucagcuccag

SEQ ID NO: 2329936 - RNA, 14 nt, Human
cuucaguauguugu

SEQ ID NO: 2329937 - RNA, 15 nt, Human
cuucaguauguuguc

SEQ ID NO: 2329938 - RNA, 18 nt, Human
cuucaguauguugucaaa

SEQ ID NO: 2329939 - RNA, 19 nt, Human
cuucaguauguugucaaag

SEQ ID NO: 2329940 - RNA, 18 nt, Human
cuucagugccuuauggaa

SEQ ID NO: 2329941 - RNA, 22 nt, Human
cuucagugccuuauggaacacu

SEQ ID NO: 2329942 - RNA, 13 nt, Human
cuucaguggcagc

SEQ ID NO: 2329943 - RNA, 14 nt, Human
cuucaguggcagcu

SEQ ID NO: 2329944 - RNA, 15 nt, Human
cuucaguggcagcug

SEQ ID NO: 2329945 - RNA, 16 nt, Human
cuucaguggcagcugc

SEQ ID NO: 2329946 - RNA, 14 nt, Human
cuuccacugagggc

SEQ ID NO: 2329947 - RNA, 22 nt, Human
cuuccaggaaacuccacaucug

SEQ ID NO: 2329948 - RNA, 23 nt, Human
cuuccaggaaacuccacaucugc

SEQ ID NO: 2329949 - RNA, 17 nt, Human
cuuccaggaaacuccac

SEQ ID NO: 2329950 - RNA, 18 nt, Human
cuuccaggaaacuccaca

SEQ ID NO: 2329951 - RNA, 19 nt, Human
cuuccaggaaacuccacau

SEQ ID NO: 2329952 - RNA, 21 nt, Human
cuuccaggaaacuccacaucu

SEQ ID NO: 2329953 - RNA, 12 nt, Human
cuuccaggcugg

SEQ ID NO: 2329954 - RNA, 14 nt, Human
cuuccaggcuggga

SEQ ID NO: 2329955 - RNA, 17 nt, Human
cuuccaccagccugcac

SEQ ID NO: 2329956 - RNA, 21 nt, Human
cuuccaccagccugcacuacu

SEQ ID NO: 2329957 - RNA, 16 nt, Human
cuuccacaagagccca

SEQ ID NO: 2329958 - RNA, 14 nt, Human
cuuccaccucaccc

SEQ ID NO: 2329959 - RNA, 16 nt, Human
cuuccaccucacccca

SEQ ID NO: 2329960 - RNA, 17 nt, Human
cuuccaccucaccccac

SEQ ID NO: 2329961 - RNA, 18 nt, Human
cuuccaccucaccccacu

SEQ ID NO: 2329962 - RNA, 22 nt, Human
cuuccacgcugucuccagaccc

SEQ ID NO: 2329963 - RNA, 21 nt, Human
cuuccacgcugucuccagacc

SEQ ID NO: 2329964 - RNA, 20 nt, Human
cuuccacgcugucuccagac

SEQ ID NO: 2329965 - RNA, 18 nt, Human
cuuccacgcugucuccag

SEQ ID NO: 2329966 - RNA, 16 nt, Human
cuuccacgcugucucc

SEQ ID NO: 2329967 - RNA, 17 nt, Human
cuuccacgcugucucca

SEQ ID NO: 2329968 - RNA, 20 nt, Human
cuuccaccucaccccacuua

SEQ ID NO: 2329969 - RNA, 13 nt, Human
cuuccaccucccu

SEQ ID NO: 2329970 - RNA, 14 nt, Human
cuuccaccucccuc

SEQ ID NO: 2329971 - RNA, 15 nt, Human
cuuccaccucccucc

SEQ ID NO: 2329972 - RNA, 19 nt, Human
cuucauugccuuaacugga

SEQ ID NO: 2329973 - RNA, 14 nt, Human
cuucauuucauugu

SEQ ID NO: 2329974 - RNA, 23 nt, Human
cuucauugagaguuuugucuuga

SEQ ID NO: 2329975 - RNA, 17 nt, Human
cuuccacaagagcccag

SEQ ID NO: 2329976 - RNA, 19 nt, Human
cuuccacaagagcccaggc

SEQ ID NO: 2329977 - RNA, 21 nt, Human
cuuccacaagagcccaggccu

SEQ ID NO: 2329978 - RNA, 22 nt, Human
cuucauucaagucuaugaugcu

SEQ ID NO: 2329979 - RNA, 20 nt, Human
cuucauucuugaaagcugug

SEQ ID NO: 2329980 - RNA, 21 nt, Human
cuucauucuugaaagcugugg

SEQ ID NO: 2329981 - RNA, 14 nt, Human
cuucauugagaguu

SEQ ID NO: 2329982 - RNA, 17 nt, Human
cuucaguggagaauuau

SEQ ID NO: 2329983 - RNA, 21 nt, Human
cuucauugagaguuuugucuu

SEQ ID NO: 2329984 - RNA, 20 nt, Human
cuucauucaacccaccugcg

SEQ ID NO: 2329985 - RNA, 17 nt, Human
cuucaguggcagcugcu

SEQ ID NO: 2329986 - RNA, 21 nt, Human
cuuccaggggugggacacccu

SEQ ID NO: 2329987 - RNA, 17 nt, Human
cuuccaggggugggaca

SEQ ID NO: 2329988 - RNA, 14 nt, Human
cuuccagggguggg

SEQ ID NO: 2329989 - RNA, 15 nt, Human
cuuccagggguggga

SEQ ID NO: 2329990 - RNA, 19 nt, Human
cuuccaggcccccaccacu

SEQ ID NO: 2329991 - RNA, 16 nt, Human
cuuccaggcccccacc

SEQ ID NO: 2329992 - RNA, 19 nt, Human
cuuccaggcugggagagcc

SEQ ID NO: 2329993 - RNA, 15 nt, Human
cuuccaggcugggag

SEQ ID NO: 2329994 - RNA, 16 nt, Human
cuuccaggcugggaga

SEQ ID NO: 2329995 - RNA, 18 nt, Human
cuucccaucacuggagca

SEQ ID NO: 2329996 - RNA, 17 nt, Human
cuucccaucacuggagc

SEQ ID NO: 2329997 - RNA, 16 nt, Human
cuucccaucacuggag

SEQ ID NO: 2329998 - RNA, 11 nt, Human
cuucccaucac

SEQ ID NO: 2329999 - RNA, 23 nt, Human
cuucccaguucaggagucccaag

SEQ ID NO: 2330000 - RNA, 20 nt, Human
cuucccaguggcugcugccc

SEQ ID NO: 2330001 - RNA, 20 nt, Human
cuucccauaccacccaaugc

SEQ ID NO: 2330002 - RNA, 22 nt, Human
cuucccaguucaggagucccaa

SEQ ID NO: 2330003 - RNA, 18 nt, Human
cuucccaguggcugcugc

SEQ ID NO: 2330004 - RNA, 19 nt, Human
cuucccaguggcugcugcc

SEQ ID NO: 2330005 - RNA, 17 nt, Human
cuucccaguggcugcug

SEQ ID NO: 2330006 - RNA, 11 nt, Human
cuucccauccu

SEQ ID NO: 2330007 - RNA, 12 nt, Human
cuucccauccua

SEQ ID NO: 2330008 - RNA, 15 nt, Human
cuucccauccuaccc

SEQ ID NO: 2330009 - RNA, 16 nt, Human
cuucccauccuacccu

SEQ ID NO: 2330010 - RNA, 19 nt, Human
cuucccauccuacccucgg

SEQ ID NO: 2330011 - RNA, 15 nt, Human
cuucccaucgcuguc

SEQ ID NO: 2330012 - RNA, 15 nt, Human
cuucccaugacccag

SEQ ID NO: 2330013 - RNA, 17 nt, Human
cuucccaugacccaggc

SEQ ID NO: 2330014 - RNA, 19 nt, Human
cuucccaugacccaggcug

SEQ ID NO: 2330015 - RNA, 20 nt, Human
cuucccaugacccaggcugg

SEQ ID NO: 2330016 - RNA, 21 nt, Human
cuucccaugacccaggcuggg

SEQ ID NO: 2330017 - RNA, 22 nt, Human
cuucccaugacccaggcugggc

SEQ ID NO: 2330018 - RNA, 20 nt, Human
cuuccccucucuccuccugc

SEQ ID NO: 2330019 - RNA, 20 nt, Human
cuuccccucccuggcuccca

SEQ ID NO: 2330020 - RNA, 18 nt, Human
cuuccccucccuggcucc

SEQ ID NO: 2330021 - RNA, 15 nt, Human
cuuccccugggcccu

SEQ ID NO: 2330022 - RNA, 13 nt, Human
cuuccccuccuac

SEQ ID NO: 2330023 - RNA, 22 nt, Human
cuuccccuccuaccccucccag

SEQ ID NO: 2330024 - RNA, 23 nt, Human
cuuccccuccuaccccucccagc

SEQ ID NO: 2330025 - RNA, 14 nt, Human
cuuccccugggccc

SEQ ID NO: 2330026 - RNA, 16 nt, Human
cuuccccucccuggcu

SEQ ID NO: 2330027 - RNA, 14 nt, Human
cuuccccucccugg

SEQ ID NO: 2330028 - RNA, 12 nt, Human
cuuccccucacu

SEQ ID NO: 2330029 - RNA, 23 nt, Human
cuuccccgagggaugaugccaca

SEQ ID NO: 2330030 - RNA, 18 nt, Human
cuucccccugcuuccacc

SEQ ID NO: 2330031 - RNA, 22 nt, Human
cuuccccgagggaugaugccac

SEQ ID NO: 2330032 - RNA, 17 nt, Human
cuucccuacaguugaaa

SEQ ID NO: 2330033 - RNA, 15 nt, Human
cuucccgucccauau

SEQ ID NO: 2330034 - RNA, 19 nt, Human
cuucccgucccauauccug

SEQ ID NO: 2330035 - RNA, 20 nt, Human
cuucccgucccauauccugc

SEQ ID NO: 2330036 - RNA, 21 nt, Human
cuucccgucccauauccugcc

SEQ ID NO: 2330037 - RNA, 22 nt, Human
cuucccgucccauauccugccu

SEQ ID NO: 2330038 - RNA, 23 nt, Human
cuucccgucccauauccugccuc

SEQ ID NO: 2330039 - RNA, 16 nt, Human
cuucccuaaaaucagg

SEQ ID NO: 2330040 - RNA, 23 nt, Human
cuucccgcucagcccucccugcc

SEQ ID NO: 2330041 - RNA, 18 nt, Human
cuucccgcucagcccucc

SEQ ID NO: 2330042 - RNA, 14 nt, Human
cuucccgucccaua

SEQ ID NO: 2330043 - RNA, 19 nt, Human
cuucccgcucagcccuccc

SEQ ID NO: 2330044 - RNA, 16 nt, Human
cuuccccuugcccagg

SEQ ID NO: 2330045 - RNA, 13 nt, Human
cuuccccuugccc

SEQ ID NO: 2330046 - RNA, 12 nt, Human
cuuccccuugcc

SEQ ID NO: 2330047 - RNA, 16 nt, Human
cuucccuugagcccuc

SEQ ID NO: 2330048 - RNA, 16 nt, Human
cuucccuucuccaucu

SEQ ID NO: 2330049 - RNA, 13 nt, Human
cuucccuuucugc

SEQ ID NO: 2330050 - RNA, 15 nt, Human
cuucccugucccucu

SEQ ID NO: 2330051 - RNA, 16 nt, Human
cuucccugucccucua

SEQ ID NO: 2330052 - RNA, 22 nt, Human
cuucccuguaugauuccuugau

SEQ ID NO: 2330053 - RNA, 12 nt, Human
cuucccuaaucu

SEQ ID NO: 2330054 - RNA, 22 nt, Human
cuucccuguauuuucuuucucu

SEQ ID NO: 2330055 - RNA, 12 nt, Human
cuucccuguccc

SEQ ID NO: 2330056 - RNA, 13 nt, Human
cuucccugucccu

SEQ ID NO: 2330057 - RNA, 14 nt, Human
cuucccugucccuc

SEQ ID NO: 2330058 - RNA, 13 nt, Human
cuuccucccucau

SEQ ID NO: 2330059 - RNA, 12 nt, Human
cuuccucccaag

SEQ ID NO: 2330060 - RNA, 20 nt, Human
cuuccucccaaguggugccu

SEQ ID NO: 2330061 - RNA, 21 nt, Human
cuuccucccaaguggugccua

SEQ ID NO: 2330062 - RNA, 23 nt, Human
cuuccucccaaguggugccuaaa

SEQ ID NO: 2330063 - RNA, 15 nt, Human
cuuccuccacauccu

SEQ ID NO: 2330064 - RNA, 21 nt, Human
cuuccuccacauccuuucuaa

SEQ ID NO: 2330065 - RNA, 23 nt, Human
cuuccucauccaccccaucccuc

SEQ ID NO: 2330066 - RNA, 18 nt, Human
cuuccucauccaccccau

SEQ ID NO: 2330067 - RNA, 22 nt, Human
cuuccucauccaccccaucccu

SEQ ID NO: 2330068 - RNA, 17 nt, Human
cuuccucaguuacacaa

SEQ ID NO: 2330069 - RNA, 18 nt, Human
cuuccucaguuuaauccu

SEQ ID NO: 2330070 - RNA, 20 nt, Human
cuuccucaguuuaauccuuc

SEQ ID NO: 2330071 - RNA, 15 nt, Human
cuucccuugagcccu

SEQ ID NO: 2330072 - RNA, 17 nt, Human
cuuccguaacccaacuc

SEQ ID NO: 2330073 - RNA, 23 nt, Human
cuuccguaacccaacucuccugg

SEQ ID NO: 2330074 - RNA, 19 nt, Human
cuuccuaauuccacagcug

SEQ ID NO: 2330075 - RNA, 18 nt, Human
cuuccuaauuccacagcu

SEQ ID NO: 2330076 - RNA, 17 nt, Human
cuuccuaauuccacagc

SEQ ID NO: 2330077 - RNA, 13 nt, Human
cuuccuaauucca

SEQ ID NO: 2330078 - RNA, 10 nt, Human
cuucaaggau

SEQ ID NO: 2330079 - RNA, 15 nt, Human
cuucaacauuuacau

SEQ ID NO: 2330080 - RNA, 17 nt, Human
cuucaaccuugagacag

SEQ ID NO: 2330081 - RNA, 20 nt, Human
cuucaaccauuccccauggg

SEQ ID NO: 2330082 - RNA, 22 nt, Human
cuucaacaucaauguucauugu

SEQ ID NO: 2330083 - RNA, 16 nt, Human
cuucaaccauucccca

SEQ ID NO: 2330084 - RNA, 18 nt, Human
cuucaaguuaaagugaau

SEQ ID NO: 2330085 - RNA, 22 nt, Human
cuucaagugcaugcucucugca

SEQ ID NO: 2330086 - RNA, 16 nt, Human
cuucaaggauccugag

SEQ ID NO: 2330087 - RNA, 13 nt, Human
cuucaaggauccu

SEQ ID NO: 2330088 - RNA, 15 nt, Human
cuucaaggauccuga

SEQ ID NO: 2330089 - RNA, 16 nt, Human
cuucacagcucugugu

SEQ ID NO: 2330090 - RNA, 23 nt, Human
cuucacagagugugcuggaggac

SEQ ID NO: 2330091 - RNA, 13 nt, Human
cuucacagagugu

SEQ ID NO: 2330092 - RNA, 17 nt, Human
cuucacagagugugcug

SEQ ID NO: 2330093 - RNA, 20 nt, Human
cuucacagagugugcuggag

SEQ ID NO: 2330094 - RNA, 22 nt, Human
cuucacagagugugcuggagga

SEQ ID NO: 2330095 - RNA, 17 nt, Human
cuucaccauuuggcaau

SEQ ID NO: 2330096 - RNA, 22 nt, Human
cuucaccagaggaaucacucuu

SEQ ID NO: 2330097 - RNA, 21 nt, Human
cuucacacugcaagagccuug

SEQ ID NO: 2330098 - RNA, 11 nt, Human
cuucacagagu

SEQ ID NO: 2330099 - RNA, 20 nt, Human
cuucacacugcaagagccuu

SEQ ID NO: 2330100 - RNA, 18 nt, Human
cuucacacugcaagagcc

SEQ ID NO: 2330101 - RNA, 15 nt, Human
cuucacacugcaaga

SEQ ID NO: 2330102 - RNA, 13 nt, Human
cuucacacugcaa

SEQ ID NO: 2330103 - RNA, 12 nt, Human
cuucacacugca

SEQ ID NO: 2330104 - RNA, 23 nt, Human
cuucacagaugggugcuuggagg

SEQ ID NO: 2330105 - RNA, 22 nt, Human
cuucacacacaggcaacugagg

SEQ ID NO: 2330106 - RNA, 15 nt, Human
cuucaauuaauaaaa

SEQ ID NO: 2330107 - RNA, 21 nt, Human
cuucacacacaggcaacugag

SEQ ID NO: 2330108 - RNA, 16 nt, Human
cuucaauuccugggcc

SEQ ID NO: 2330109 - RNA, 15 nt, Human
cuucaauuccugggc

SEQ ID NO: 2330110 - RNA, 19 nt, Human
cuucaaguuagcucaggag

SEQ ID NO: 2330111 - RNA, 18 nt, Human
cuucaaguuagcucagga

SEQ ID NO: 2330112 - RNA, 17 nt, Human
cuucaaguuagcucagg

SEQ ID NO: 2330113 - RNA, 16 nt, Human
cuucaaguuagcucag

SEQ ID NO: 2330114 - RNA, 14 nt, Human
cuucaauaaaguau

SEQ ID NO: 2330115 - RNA, 20 nt, Human
cuucaaguuagcucaggagg

SEQ ID NO: 2330116 - RNA, 12 nt, Human
cuucaauaaagu

SEQ ID NO: 2330117 - RNA, 21 nt, Human
cuucaauaaaugguauagcaa

SEQ ID NO: 2330118 - RNA, 22 nt, Human
cuucaauacccaaauccucucc

SEQ ID NO: 2330119 - RNA, 23 nt, Human
cuucaaacuagggccaagcccag

SEQ ID NO: 2330120 - RNA, 17 nt, Human
cuucaaagcaaaugucu

SEQ ID NO: 2330121 - RNA, 22 nt, Human
cuucaaacagaacugcagucag

SEQ ID NO: 2330122 - RNA, 18 nt, Human
cuucaaagcuugaagauc

SEQ ID NO: 2330123 - RNA, 16 nt, Human
cuucaaagcuugaaga

SEQ ID NO: 2330124 - RNA, 20 nt, Human
cuucaacaucaauguucauu

SEQ ID NO: 2330125 - RNA, 19 nt, Human
cuucaacaucaauguucau

SEQ ID NO: 2330126 - RNA, 18 nt, Human
cuucaacaucaauguuca

SEQ ID NO: 2330127 - RNA, 16 nt, Human
cuucaacaucaauguu

SEQ ID NO: 2330128 - RNA, 24 nt, Human
cuucaacagacccccucuagaaau

SEQ ID NO: 2330129 - RNA, 16 nt, Human
cuucaacagcucccca

SEQ ID NO: 2330130 - RNA, 17 nt, Human
cuucaacagcuccccau

SEQ ID NO: 2330131 - RNA, 11 nt, Human
cuuauuugagu

SEQ ID NO: 2330132 - RNA, 17 nt, Human
cuuauuucaugaaaauu

SEQ ID NO: 2330133 - RNA, 15 nt, Human
cuuauuucauuucuu

SEQ ID NO: 2330134 - RNA, 23 nt, Human
cuuauuuuaaaauuuuaucucuu

SEQ ID NO: 2330135 - RNA, 12 nt, Human
cuuauuugagug

SEQ ID NO: 2330136 - RNA, 13 nt, Human
cuuauuugaguga

SEQ ID NO: 2330137 - RNA, 23 nt, Human
cuuauuugcugccacaccugagc

SEQ ID NO: 2330138 - RNA, 15 nt, Human
cuucaaaaguauuuu

SEQ ID NO: 2330139 - RNA, 16 nt, Human
cuucaaaaguauuuuc

SEQ ID NO: 2330140 - RNA, 17 nt, Human
cuucaaaaguauuuucc

SEQ ID NO: 2330141 - RNA, 21 nt, Human
cuucaaaaguauuuuccugua

SEQ ID NO: 2330142 - RNA, 18 nt, Human
cuuauuuaaugaaagacu

SEQ ID NO: 2330143 - RNA, 13 nt, Human
cuuauuuauuauu

SEQ ID NO: 2330144 - RNA, 19 nt, Human
cuuaucucagucaugcaua

SEQ ID NO: 2330145 - RNA, 20 nt, Human
cuuaucucagucaugcauaa

SEQ ID NO: 2330146 - RNA, 21 nt, Human
cuuaucucagucaugcauaaa

SEQ ID NO: 2330147 - RNA, 21 nt, Human
cuuauuuauucauauuuucuu

SEQ ID NO: 2330148 - RNA, 14 nt, Human
cuuauuucauuucu

SEQ ID NO: 2330149 - RNA, 18 nt, Human
cuuauccucugaucucca

SEQ ID NO: 2330150 - RNA, 15 nt, Human
cuuauccucugaucu

SEQ ID NO: 2330151 - RNA, 16 nt, Human
cuuauccucugaucuc

SEQ ID NO: 2330152 - RNA, 22 nt, Human
cuuauccucugaucuccauggc

SEQ ID NO: 2330153 - RNA, 13 nt, Human
cuuauccucugau

SEQ ID NO: 2330154 - RNA, 14 nt, Human
cuuauccucugauc

SEQ ID NO: 2330155 - RNA, 17 nt, Human
cuuauuuaaugaaagac

SEQ ID NO: 2330156 - RNA, 22 nt, Human
cuuaucaccacaguaaguuccu

SEQ ID NO: 2330157 - RNA, 23 nt, Human
cuuaucaccacaguaaguuccua

SEQ ID NO: 2330158 - RNA, 13 nt, Human
cuuaucaccagcu

SEQ ID NO: 2330159 - RNA, 19 nt, Human
cuuaucaagugucuuccau

SEQ ID NO: 2330160 - RNA, 13 nt, Human
cuuauauuaugga

SEQ ID NO: 2330161 - RNA, 19 nt, Human
cuuauauaguuuacuauuu

SEQ ID NO: 2330162 - RNA, 14 nt, Human
cuuauauaugugaa

SEQ ID NO: 2330163 - RNA, 17 nt, Human
cuuauauaugugaacau

SEQ ID NO: 2330164 - RNA, 21 nt, Human
cuuauaucaucagcauaccuu

SEQ ID NO: 2330165 - RNA, 21 nt, Human
cuuauauuaauauuccucagu

SEQ ID NO: 2330166 - RNA, 18 nt, Human
cuuauauguguauugcua

SEQ ID NO: 2330167 - RNA, 15 nt, Human
cuuauccaggacucu

SEQ ID NO: 2330168 - RNA, 21 nt, Human
cuuauccuaaaacaaauaguu

SEQ ID NO: 2330169 - RNA, 15 nt, Human
cuuauccagcuggug

SEQ ID NO: 2330170 - RNA, 12 nt, Human
cuuauccaggac

SEQ ID NO: 2330171 - RNA, 13 nt, Human
cuuauccaggacu

SEQ ID NO: 2330172 - RNA, 19 nt, Human
cuuauccaggacucuguca

SEQ ID NO: 2330173 - RNA, 12 nt, Human
cuuaucccucuc

SEQ ID NO: 2330174 - RNA, 18 nt, Human
cuuaucacugacacaaaa

SEQ ID NO: 2330175 - RNA, 16 nt, Human
cuuaucaccagcugcc

SEQ ID NO: 2330176 - RNA, 17 nt, Human
cuuaucaccagcugccu

SEQ ID NO: 2330177 - RNA, 19 nt, Human
cuuaucaccagcugccucu

SEQ ID NO: 2330178 - RNA, 22 nt, Human
cuuaucaccagcugccucuucu

SEQ ID NO: 2330179 - RNA, 20 nt, Human
cuuaucaugcugucuuuaca

SEQ ID NO: 2330180 - RNA, 21 nt, Human
cuuaucauccacauuguuuua

SEQ ID NO: 2330181 - RNA, 15 nt, Human
cuuaucauccacauu

SEQ ID NO: 2330182 - RNA, 19 nt, Human
cuuaucauccacauuguuu

SEQ ID NO: 2330183 - RNA, 15 nt, Human
cuuaucauucauucu

SEQ ID NO: 2330184 - RNA, 15 nt, Human
cuuaucauggucuca

SEQ ID NO: 2330185 - RNA, 14 nt, Human
cuuaucauggucuc

SEQ ID NO: 2330186 - RNA, 18 nt, Human
cuuauauaguuuacuauu

SEQ ID NO: 2330187 - RNA, 20 nt, Human
cuuauauaguuuacuauuuu

SEQ ID NO: 2330188 - RNA, 20 nt, Human
cuuauagaauauuuauuacc

SEQ ID NO: 2330189 - RNA, 13 nt, Human
cuuauagaauauu

SEQ ID NO: 2330190 - RNA, 14 nt, Human
cuuauagaauauuu

SEQ ID NO: 2330191 - RNA, 15 nt, Human
cuuauagaauauuua

SEQ ID NO: 2330192 - RNA, 16 nt, Human
cuuauagaauauuuau

SEQ ID NO: 2330193 - RNA, 14 nt, Human
cuuauagacaacau

SEQ ID NO: 2330194 - RNA, 14 nt, Human
cuuaguucucacug

SEQ ID NO: 2330195 - RNA, 19 nt, Human
cuuaguguuucugugcaug

SEQ ID NO: 2330196 - RNA, 16 nt, Human
cuuaguuaucagcuuu

SEQ ID NO: 2330197 - RNA, 13 nt, Human
cuuaguguuucug

SEQ ID NO: 2330198 - RNA, 16 nt, Human
cuuaguguuucugugc

SEQ ID NO: 2330199 - RNA, 17 nt, Human
cuuaguguuucugugca

SEQ ID NO: 2330200 - RNA, 18 nt, Human
cuuaguguuucugugcau

SEQ ID NO: 2330201 - RNA, 17 nt, Human
cuuaguuuguguguugu

SEQ ID NO: 2330202 - RNA, 22 nt, Human
cuuaguuuguguguugucucuu

SEQ ID NO: 2330203 - RNA, 15 nt, Human
cuuaguucucacugu

SEQ ID NO: 2330204 - RNA, 16 nt, Human
cuuaguucucacuguu

SEQ ID NO: 2330205 - RNA, 22 nt, Human
cuuaguuuggauucuuauguag

SEQ ID NO: 2330206 - RNA, 14 nt, Human
cuuauacccaugaa

SEQ ID NO: 2330207 - RNA, 19 nt, Human
cuuaguuuggauucuuaug

SEQ ID NO: 2330208 - RNA, 23 nt, Human
cuuaguuuguguguugucucuug

SEQ ID NO: 2330209 - RNA, 20 nt, Human
cuuagucuucucauagcauu

SEQ ID NO: 2330210 - RNA, 16 nt, Human
cuuagucuucucauag

SEQ ID NO: 2330211 - RNA, 15 nt, Human
cuuagucuucucaua

SEQ ID NO: 2330212 - RNA, 20 nt, Human
cuuagucucaguuugugugu

SEQ ID NO: 2330213 - RNA, 23 nt, Human
cuuagucucaguuugugugucuu

SEQ ID NO: 2330214 - RNA, 17 nt, Human
cuuagugaaauuacuuc

SEQ ID NO: 2330215 - RNA, 19 nt, Human
cuuagugcggacaaguuuu

SEQ ID NO: 2330216 - RNA, 20 nt, Human
cuuagugcggacaaguuuua

SEQ ID NO: 2330217 - RNA, 21 nt, Human
cuuagucuucucauagcauua

SEQ ID NO: 2330218 - RNA, 22 nt, Human
cuuagugcggacaaguuuuaau

SEQ ID NO: 2330219 - RNA, 22 nt, Human
cuuaguggcuuuuuuccuccug

SEQ ID NO: 2330220 - RNA, 17 nt, Human
cuuagugguuccccacc

SEQ ID NO: 2330221 - RNA, 13 nt, Human
cuuaguggcuuuu

SEQ ID NO: 2330222 - RNA, 18 nt, Human
cuuagucacugagacagc

SEQ ID NO: 2330223 - RNA, 19 nt, Human
cuuagucacugagacagcc

SEQ ID NO: 2330224 - RNA, 14 nt, Human
cuuagucacugaga

SEQ ID NO: 2330225 - RNA, 16 nt, Human
cuuagauggauucucc

SEQ ID NO: 2330226 - RNA, 14 nt, Human
cuguucuguggaaa

SEQ ID NO: 2330227 - RNA, 12 nt, Human
cuuagucucagu

SEQ ID NO: 2330228 - RNA, 13 nt, Human
cuuagucucaguu

SEQ ID NO: 2330229 - RNA, 18 nt, Human
cuuagucucaguuugugu

SEQ ID NO: 2330230 - RNA, 19 nt, Human
cuuagucucaguuugugug

SEQ ID NO: 2330231 - RNA, 13 nt, Human
cuuagauguauau

SEQ ID NO: 2330232 - RNA, 22 nt, Human
cuuagaugcaguucugaagaag

SEQ ID NO: 2330233 - RNA, 22 nt, Human
cuguucugguuuuuaaccauug

SEQ ID NO: 2330234 - RNA, 19 nt, Human
cuguucugucccuuggagc

SEQ ID NO: 2330235 - RNA, 11 nt, Human
cuguucugugg

SEQ ID NO: 2330236 - RNA, 16 nt, Human
cuuagucacugagaca

SEQ ID NO: 2330237 - RNA, 11 nt, Human
cuguucuggaa

SEQ ID NO: 2330238 - RNA, 20 nt, Human
cuuagaugcaguucugaaga

SEQ ID NO: 2330239 - RNA, 16 nt, Human
cuguucugcacacagc

SEQ ID NO: 2330240 - RNA, 21 nt, Human
cuguucucuugggaacugaac

SEQ ID NO: 2330241 - RNA, 16 nt, Human
cuguucuggcagaguu

SEQ ID NO: 2330242 - RNA, 21 nt, Human
cuugaggaaacaacagcuuua

SEQ ID NO: 2330243 - RNA, 21 nt, Human
cuugaggguugggcugguguc

SEQ ID NO: 2330244 - RNA, 19 nt, Human
cuugaggguugggcuggug

SEQ ID NO: 2330245 - RNA, 20 nt, Human
cuugaggguugggcuggugu

SEQ ID NO: 2330246 - RNA, 20 nt, Human
cuugaggaaacaacagcuuu

SEQ ID NO: 2330247 - RNA, 18 nt, Human
cuugaggaaacaacagcu

SEQ ID NO: 2330248 - RNA, 13 nt, Human
cuugaggaaacaa

SEQ ID NO: 2330249 - RNA, 21 nt, Human
cuugagcuuggcagcugaacu

SEQ ID NO: 2330250 - RNA, 20 nt, Human
cuugagcuuggcagcugaac

SEQ ID NO: 2330251 - RNA, 12 nt, Human
cuugagcuuggc

SEQ ID NO: 2330252 - RNA, 13 nt, Human
cuugagcugagau

SEQ ID NO: 2330253 - RNA, 16 nt, Human
cuugagcugagaugga

SEQ ID NO: 2330254 - RNA, 10 nt, Human
cuugagcuga

SEQ ID NO: 2330255 - RNA, 14 nt, Human
cuugagcuccccaa

SEQ ID NO: 2330256 - RNA, 20 nt, Human
cuugacuaaaaaaaaaagaa

SEQ ID NO: 2330257 - RNA, 13 nt, Human
cuugacuccuugu

SEQ ID NO: 2330258 - RNA, 22 nt, Human
cuugacuugcaauuucuaccua

SEQ ID NO: 2330259 - RNA, 20 nt, Human
cuugacuuuagucugcaaaa

SEQ ID NO: 2330260 - RNA, 15 nt, Human
cuugagccuugaacu

SEQ ID NO: 2330261 - RNA, 18 nt, Human
cuugagccuugaacuuug

SEQ ID NO: 2330262 - RNA, 17 nt, Human
cuugagccuugaacuuu

SEQ ID NO: 2330263 - RNA, 16 nt, Human
cuugagccugggaggu

SEQ ID NO: 2330264 - RNA, 12 nt, Human
cuugaccuccua

SEQ ID NO: 2330265 - RNA, 14 nt, Human
cuugaccugaggcu

SEQ ID NO: 2330266 - RNA, 23 nt, Human
cuugaccugaggcuguggucaca

SEQ ID NO: 2330267 - RNA, 17 nt, Human
cuugaccugaggcugug

SEQ ID NO: 2330268 - RNA, 20 nt, Human
cuugaccugaggcugugguc

SEQ ID NO: 2330269 - RNA, 13 nt, Human
cuugaccucaggu

SEQ ID NO: 2330270 - RNA, 21 nt, Human
cuugaccgugaggccagagac

SEQ ID NO: 2330271 - RNA, 18 nt, Human
cuugaccgugaggccaga

SEQ ID NO: 2330272 - RNA, 20 nt, Human
cuugaccgugaggccagaga

SEQ ID NO: 2330273 - RNA, 16 nt, Human
cuugaagacuuuucuu

SEQ ID NO: 2330274 - RNA, 16 nt, Human
cuugacccaucucccc

SEQ ID NO: 2330275 - RNA, 13 nt, Human
cuugacccaucuc

SEQ ID NO: 2330276 - RNA, 17 nt, Human
cuugaccgugaggccag

SEQ ID NO: 2330277 - RNA, 22 nt, Human
cuugaccauucuccaccugcca

SEQ ID NO: 2330278 - RNA, 23 nt, Human
cuugaccauucuccaccugccag

SEQ ID NO: 2330279 - RNA, 15 nt, Human
cuugaacccaggaga

SEQ ID NO: 2330280 - RNA, 14 nt, Human
cuugaaccacuucc

SEQ ID NO: 2330281 - RNA, 15 nt, Human
cuugaaccacuuccc

SEQ ID NO: 2330282 - RNA, 13 nt, Human
cuugaacuccugg

SEQ ID NO: 2330283 - RNA, 16 nt, Human
cuugaacuccugaccu

SEQ ID NO: 2330284 - RNA, 13 nt, Human
cuugaacuccuga

SEQ ID NO: 2330285 - RNA, 18 nt, Human
cuugaacuccugaccuca

SEQ ID NO: 2330286 - RNA, 12 nt, Human
cuugaagaacug

SEQ ID NO: 2330287 - RNA, 17 nt, Human
cuugaagaacugcaggc

SEQ ID NO: 2330288 - RNA, 18 nt, Human
cuugaagaacugcaggcc

SEQ ID NO: 2330289 - RNA, 20 nt, Human
cuugaagaacugcaggcccu

SEQ ID NO: 2330290 - RNA, 22 nt, Human
cuugaagaacugcaggcccugg

SEQ ID NO: 2330291 - RNA, 21 nt, Human
cuugaacuuugaccucugcag

SEQ ID NO: 2330292 - RNA, 17 nt, Human
cuugaacuuugaccucu

SEQ ID NO: 2330293 - RNA, 16 nt, Human
cuugaacacuggggga

SEQ ID NO: 2330294 - RNA, 18 nt, Human
cuugaacauguuuuguau

SEQ ID NO: 2330295 - RNA, 15 nt, Human
cuugaacacuggggg

SEQ ID NO: 2330296 - RNA, 13 nt, Human
cuugaacacuggg

SEQ ID NO: 2330297 - RNA, 19 nt, Human
cuugaacacucaugcugaa

SEQ ID NO: 2330298 - RNA, 20 nt, Human
cuugaacacucaugcugaaa

SEQ ID NO: 2330299 - RNA, 23 nt, Human
cuugaacacucaugcugaaagcc

SEQ ID NO: 2330300 - RNA, 17 nt, Human
cuugaaauuuuaaccua

SEQ ID NO: 2330301 - RNA, 20 nt, Human
cuugaaagcauccaugugug

SEQ ID NO: 2330302 - RNA, 22 nt, Human
cuugaaauaccagugaaccaaa

SEQ ID NO: 2330303 - RNA, 17 nt, Human
cuugaaauaccagugaa

SEQ ID NO: 2330304 - RNA, 16 nt, Human
cuugaaauuuuaaccu

SEQ ID NO: 2330305 - RNA, 15 nt, Human
cuugaaauuuuaacc

SEQ ID NO: 2330306 - RNA, 16 nt, Human
cuugaaagcauccaug

SEQ ID NO: 2330307 - RNA, 18 nt, Human
cuugaaagcauccaugug

SEQ ID NO: 2330308 - RNA, 17 nt, Human
cuugaaagcauccaugu

SEQ ID NO: 2330309 - RNA, 13 nt, Human
cuugaaagcugug

SEQ ID NO: 2330310 - RNA, 13 nt, Human
cuugaaagaaaau

SEQ ID NO: 2330311 - RNA, 23 nt, Human
cuugaaaauauuuuuuauauaua

SEQ ID NO: 2330312 - RNA, 22 nt, Human
cuugaaaauaagaauagaaaua

SEQ ID NO: 2330313 - RNA, 20 nt, Human
cuugaaaauuuuauuaaaaa

SEQ ID NO: 2330314 - RNA, 18 nt, Human
cuugaaaauuaacaugaa

SEQ ID NO: 2330315 - RNA, 12 nt, Human
cuugaaaauuaa

SEQ ID NO: 2330316 - RNA, 13 nt, Human
cuugaaaauuaac

SEQ ID NO: 2330317 - RNA, 16 nt, Human
cuucuuuuuuuucauu

SEQ ID NO: 2330318 - RNA, 17 nt, Human
cuucuuuaauugaucua

SEQ ID NO: 2330319 - RNA, 17 nt, Human
cuucuuuuuuugugaug

SEQ ID NO: 2330320 - RNA, 12 nt, Human
cuugaaaaaugc

SEQ ID NO: 2330321 - RNA, 18 nt, Human
cuugaaaaaugcauguug

SEQ ID NO: 2330322 - RNA, 14 nt, Human
cuugaaaacacugu

SEQ ID NO: 2330323 - RNA, 12 nt, Human
cuugaaaaaugu

SEQ ID NO: 2330324 - RNA, 13 nt, Human
cuugaaaaaugug

SEQ ID NO: 2330325 - RNA, 18 nt, Human
cuugaaaaaugugcaaaa

SEQ ID NO: 2330326 - RNA, 23 nt, Human
cuugaaaacacuguucucugccc

SEQ ID NO: 2330327 - RNA, 21 nt, Human
cuugaaaaaugugcaaaacag

SEQ ID NO: 2330328 - RNA, 22 nt, Human
cuugaaaaaugugcaaaacagc

SEQ ID NO: 2330329 - RNA, 15 nt, Human
cuugaaaaggguguu

SEQ ID NO: 2330330 - RNA, 16 nt, Human
cuugaaaauaagaaua

SEQ ID NO: 2330331 - RNA, 15 nt, Human
cuucuguggcucaca

SEQ ID NO: 2330332 - RNA, 22 nt, Human
cuucuguggcucacagaacccu

SEQ ID NO: 2330333 - RNA, 13 nt, Human
cuucuguggguuu

SEQ ID NO: 2330334 - RNA, 14 nt, Human
cuucuguggguuuc

SEQ ID NO: 2330335 - RNA, 21 nt, Human
cuucuguggguuucuaaagcu

SEQ ID NO: 2330336 - RNA, 13 nt, Human
cuucuguggcuca

SEQ ID NO: 2330337 - RNA, 21 nt, Human
cuucugugagacccccacacc

SEQ ID NO: 2330338 - RNA, 20 nt, Human
cuucugugagacccccacac

SEQ ID NO: 2330339 - RNA, 22 nt, Human
cuucugugagacccccacaccu

SEQ ID NO: 2330340 - RNA, 19 nt, Human
cuucugugagacccccaca

SEQ ID NO: 2330341 - RNA, 17 nt, Human
cuucuguccugguguca

SEQ ID NO: 2330342 - RNA, 14 nt, Human
cuucugugaaagua

SEQ ID NO: 2330343 - RNA, 16 nt, Human
cuucuuggucuuauuu

SEQ ID NO: 2330344 - RNA, 23 nt, Human
cuucuuggugcuuacacaucuca

SEQ ID NO: 2330345 - RNA, 20 nt, Human
cuucuuggucuuauuuauua

SEQ ID NO: 2330346 - RNA, 13 nt, Human
cuucuuguucccc

SEQ ID NO: 2330347 - RNA, 16 nt, Human
cuucuugccucugugc

SEQ ID NO: 2330348 - RNA, 17 nt, Human
cuucuugccucugugcu

SEQ ID NO: 2330349 - RNA, 18 nt, Human
cuucuugccucugugcug

SEQ ID NO: 2330350 - RNA, 14 nt, Human
cuucuguucugccu

SEQ ID NO: 2330351 - RNA, 21 nt, Human
cuucugugggugacccagguc

SEQ ID NO: 2330352 - RNA, 15 nt, Human
cuucuguugcugccu

SEQ ID NO: 2330353 - RNA, 13 nt, Human
cuucuugccucug

SEQ ID NO: 2330354 - RNA, 15 nt, Human
cuucuugccucugug

SEQ ID NO: 2330355 - RNA, 19 nt, Human
cuucuccugacccaguccc

SEQ ID NO: 2330356 - RNA, 18 nt, Human
cuucucucucuaaaauga

SEQ ID NO: 2330357 - RNA, 13 nt, Human
cuucucuccuccc

SEQ ID NO: 2330358 - RNA, 15 nt, Human
cuucucuccucccca

SEQ ID NO: 2330359 - RNA, 13 nt, Human
cuucucucucacc

SEQ ID NO: 2330360 - RNA, 15 nt, Human
cuucucucucaccag

SEQ ID NO: 2330361 - RNA, 16 nt, Human
cuucucucugugggau

SEQ ID NO: 2330362 - RNA, 13 nt, Human
cuucucugaagga

SEQ ID NO: 2330363 - RNA, 13 nt, Human
cuucucucugugg

SEQ ID NO: 2330364 - RNA, 11 nt, Human
cuucucugaag

SEQ ID NO: 2330365 - RNA, 12 nt, Human
cuucucugaagg

SEQ ID NO: 2330366 - RNA, 13 nt, Human
cuucucugaaggg

SEQ ID NO: 2330367 - RNA, 16 nt, Human
cuucucugaagggagg

SEQ ID NO: 2330368 - RNA, 12 nt, Human
cuucucugacuu

SEQ ID NO: 2330369 - RNA, 14 nt, Human
cuucucugacuucu

SEQ ID NO: 2330370 - RNA, 15 nt, Human
cuucucugacuucug

SEQ ID NO: 2330371 - RNA, 16 nt, Human
cuucucugacuucugc

SEQ ID NO: 2330372 - RNA, 17 nt, Human
cuucucugacuucugcc

SEQ ID NO: 2330373 - RNA, 20 nt, Human
cuucucugacuucugccugg

SEQ ID NO: 2330374 - RNA, 14 nt, Human
cuucuccucuugua

SEQ ID NO: 2330375 - RNA, 22 nt, Human
cuucuccuauguguaaggugaa

SEQ ID NO: 2330376 - RNA, 18 nt, Human
cuucuccuccccacccgc

SEQ ID NO: 2330377 - RNA, 14 nt, Human
cuucuccuaugugu

SEQ ID NO: 2330378 - RNA, 15 nt, Human
cuucuccuaugugua

SEQ ID NO: 2330379 - RNA, 16 nt, Human
cuucuccuauguguaa

SEQ ID NO: 2330380 - RNA, 15 nt, Human
cuucuccucuuguaa

SEQ ID NO: 2330381 - RNA, 17 nt, Human
cuucuccucuuguaaau

SEQ ID NO: 2330382 - RNA, 18 nt, Human
cuucuccucuuguaaaua

SEQ ID NO: 2330383 - RNA, 23 nt, Human
cuucuccucuuguaaauaaagcc

SEQ ID NO: 2330384 - RNA, 19 nt, Human
cuucuccuucaccuuuguc

SEQ ID NO: 2330385 - RNA, 12 nt, Human
cuucucuccagc

SEQ ID NO: 2330386 - RNA, 13 nt, Human
cuucucuccagcc

SEQ ID NO: 2330387 - RNA, 15 nt, Human
cuucucuccagcccc

SEQ ID NO: 2330388 - RNA, 17 nt, Human
cuucucuccagccccug

SEQ ID NO: 2330389 - RNA, 19 nt, Human
cuucucuccagccccugga

SEQ ID NO: 2330390 - RNA, 19 nt, Human
cuuccuguccagagagaga

SEQ ID NO: 2330391 - RNA, 17 nt, Human
cuuccuguccagagaga

SEQ ID NO: 2330392 - RNA, 16 nt, Human
cuuccuguccagcucc

SEQ ID NO: 2330393 - RNA, 13 nt, Human
cuucuccacugga

SEQ ID NO: 2330394 - RNA, 14 nt, Human
cuucuccacuggau

SEQ ID NO: 2330395 - RNA, 15 nt, Human
cuucuccacuggaug

SEQ ID NO: 2330396 - RNA, 11 nt, Human
cuucuccacuu

SEQ ID NO: 2330397 - RNA, 20 nt, Human
cuucuccacuuucuagccag

SEQ ID NO: 2330398 - RNA, 16 nt, Human
cuuccuggagcccaga

SEQ ID NO: 2330399 - RNA, 17 nt, Human
cuuccuggagcccagag

SEQ ID NO: 2330400 - RNA, 22 nt, Human
cuuccuggagcccagaggaggg

SEQ ID NO: 2330401 - RNA, 16 nt, Human
cuuccuguccagagag

SEQ ID NO: 2330402 - RNA, 15 nt, Human
cuuccuguccagaga

SEQ ID NO: 2330403 - RNA, 23 nt, Human
cuuccuguaacacaagccacaga

SEQ ID NO: 2330404 - RNA, 22 nt, Human
cuuccuguaacacaagccacag

SEQ ID NO: 2330405 - RNA, 23 nt, Human
cuuccuggggcaucuggcgaauc

SEQ ID NO: 2330406 - RNA, 20 nt, Human
cuuccuggggcaucuggcga

SEQ ID NO: 2330407 - RNA, 12 nt, Human
cuucuccaggcu

SEQ ID NO: 2330408 - RNA, 17 nt, Human
cuucuccagacaaacca

SEQ ID NO: 2330409 - RNA, 12 nt, Human
cuucuccagccu

SEQ ID NO: 2330410 - RNA, 23 nt, Human
cuucuccagacaaaccagaagca

SEQ ID NO: 2330411 - RNA, 17 nt, Human
cuucuccacuggaugga

SEQ ID NO: 2330412 - RNA, 13 nt, Human
cuucuccaggcug

SEQ ID NO: 2330413 - RNA, 15 nt, Human
cuucuccagccuaga

SEQ ID NO: 2330414 - RNA, 18 nt, Human
cuucucccccccggggcu

SEQ ID NO: 2330415 - RNA, 20 nt, Human
cuucucccccccggggcugg

SEQ ID NO: 2330416 - RNA, 22 nt, Human
cuucucccccccggggcugggu

SEQ ID NO: 2330417 - RNA, 22 nt, Human
cuucucccucauuucaggagca

SEQ ID NO: 2330418 - RNA, 12 nt, Human
cuucuccgccag

SEQ ID NO: 2330419 - RNA, 13 nt, Human
cuucuccgccagc

SEQ ID NO: 2330420 - RNA, 14 nt, Human
cuucuccgccagcc

SEQ ID NO: 2330421 - RNA, 15 nt, Human
cuucuccgccagccu

SEQ ID NO: 2330422 - RNA, 16 nt, Human
cuucuccgccagccuc

SEQ ID NO: 2330423 - RNA, 17 nt, Human
cuucuccgccagccucc

SEQ ID NO: 2330424 - RNA, 18 nt, Human
cuucuccgccagccuccu

SEQ ID NO: 2330425 - RNA, 19 nt, Human
cuucuccgccagccuccuc

SEQ ID NO: 2330426 - RNA, 21 nt, Human
cuucuccgccagccuccucug

SEQ ID NO: 2330427 - RNA, 23 nt, Human
cuucuccgccagccuccucugga

SEQ ID NO: 2330428 - RNA, 24 nt, Human
cuucuccgccagccuccucuggac

SEQ ID NO: 2330429 - RNA, 18 nt, Human
cuucuguauacuguggag

SEQ ID NO: 2330430 - RNA, 14 nt, Human
cuucuguaguuuua

SEQ ID NO: 2330431 - RNA, 17 nt, Human
cuucuguaguuuuauca

SEQ ID NO: 2330432 - RNA, 21 nt, Human
cuucuguaguuuuaucacaug

SEQ ID NO: 2330433 - RNA, 15 nt, Human
cuucuguauucacuu

SEQ ID NO: 2330434 - RNA, 22 nt, Human
cuucuguauuuuuuuuucuaag

SEQ ID NO: 2330435 - RNA, 19 nt, Human
cuucuguauucacuuauau

SEQ ID NO: 2330436 - RNA, 20 nt, Human
cuucuguauuuuuuuuucua

SEQ ID NO: 2330437 - RNA, 15 nt, Human
cuucugucccucaca

SEQ ID NO: 2330438 - RNA, 14 nt, Human
cuucugucccucac

SEQ ID NO: 2330439 - RNA, 11 nt, Human
cuucuguaguu

SEQ ID NO: 2330440 - RNA, 18 nt, Human
cuucuguaggaauucuuu

SEQ ID NO: 2330441 - RNA, 19 nt, Human
cuucugguacucuccuaga

SEQ ID NO: 2330442 - RNA, 20 nt, Human
cuucugguacucuccuagag

SEQ ID NO: 2330443 - RNA, 21 nt, Human
cuucuguacgucugacaggca

SEQ ID NO: 2330444 - RNA, 14 nt, Human
cuucuguacgucug

SEQ ID NO: 2330445 - RNA, 15 nt, Human
cuucuguacgucuga

SEQ ID NO: 2330446 - RNA, 18 nt, Human
cuucuguacgucugacag

SEQ ID NO: 2330447 - RNA, 20 nt, Human
cuucuguacgucugacaggc

SEQ ID NO: 2330448 - RNA, 16 nt, Human
cuucuguccuacucug

SEQ ID NO: 2330449 - RNA, 17 nt, Human
cuucuguccuacucugu

SEQ ID NO: 2330450 - RNA, 18 nt, Human
cuucuguccuacucugug

SEQ ID NO: 2330451 - RNA, 19 nt, Human
cuucuguccuacucugugu

SEQ ID NO: 2330452 - RNA, 21 nt, Human
cuucuguccuacucuguguca

SEQ ID NO: 2330453 - RNA, 18 nt, Human
cuucugucuucacaacag

SEQ ID NO: 2330454 - RNA, 22 nt, Human
cuucugucuucacaacagauua

SEQ ID NO: 2330455 - RNA, 21 nt, Human
cuucugucuucacaacagauu

SEQ ID NO: 2330456 - RNA, 19 nt, Human
cuucugcuggauaaaauga

SEQ ID NO: 2330457 - RNA, 17 nt, Human
cuucugcuggauaaaau

SEQ ID NO: 2330458 - RNA, 11 nt, Human
cuucugcuggg

SEQ ID NO: 2330459 - RNA, 13 nt, Human
cuucugcugggcu

SEQ ID NO: 2330460 - RNA, 14 nt, Human
cuucugcugggcug

SEQ ID NO: 2330461 - RNA, 15 nt, Human
cuucugcugggcugg

SEQ ID NO: 2330462 - RNA, 16 nt, Human
cuucugcugggcuggg

SEQ ID NO: 2330463 - RNA, 17 nt, Human
cuucugcugggcugggg

SEQ ID NO: 2330464 - RNA, 15 nt, Human
cuucugcuggauaaa

SEQ ID NO: 2330465 - RNA, 14 nt, Human
cuucugccuguuau

SEQ ID NO: 2330466 - RNA, 23 nt, Human
cuucugcuccacccuuggccugu

SEQ ID NO: 2330467 - RNA, 21 nt, Human
cuucugcuccacccuuggccu

SEQ ID NO: 2330468 - RNA, 19 nt, Human
cuucugcuccacccuuggc

SEQ ID NO: 2330469 - RNA, 13 nt, Human
cuucugcuucagc

SEQ ID NO: 2330470 - RNA, 19 nt, Human
cuucugcugggcuggggcc

SEQ ID NO: 2330471 - RNA, 15 nt, Human
cuucugcuuaggaga

SEQ ID NO: 2330472 - RNA, 16 nt, Human
cuucugcuuaggagag

SEQ ID NO: 2330473 - RNA, 21 nt, Human
cuucucugacuucugccugga

SEQ ID NO: 2330474 - RNA, 17 nt, Human
cuucucugaagggaggu

SEQ ID NO: 2330475 - RNA, 23 nt, Human
cuucugcccaauuggaggaaagc

SEQ ID NO: 2330476 - RNA, 19 nt, Human
cuucugccggcccuggggc

SEQ ID NO: 2330477 - RNA, 18 nt, Human
cuucugccggcccugggg

SEQ ID NO: 2330478 - RNA, 17 nt, Human
cuucugccggcccuggg

SEQ ID NO: 2330479 - RNA, 15 nt, Human
cuucugcccuugcca

SEQ ID NO: 2330480 - RNA, 12 nt, Human
cuucugccugca

SEQ ID NO: 2330481 - RNA, 14 nt, Human
cuucugccugagcu

SEQ ID NO: 2330482 - RNA, 15 nt, Human
cuucugccugagcuu

SEQ ID NO: 2330483 - RNA, 17 nt, Human
cuucugcuccacccuug

SEQ ID NO: 2330484 - RNA, 15 nt, Human
cuucugcuccacccu

SEQ ID NO: 2330485 - RNA, 18 nt, Human
cuucugccuguggaacug

SEQ ID NO: 2330486 - RNA, 18 nt, Human
cuucugccuuagucucag

SEQ ID NO: 2330487 - RNA, 13 nt, Human
cuucugccuggag

SEQ ID NO: 2330488 - RNA, 14 nt, Human
cuucugccuggaga

SEQ ID NO: 2330489 - RNA, 15 nt, Human
cuucugccuggagac

SEQ ID NO: 2330490 - RNA, 16 nt, Human
cuucugccuggagacu

SEQ ID NO: 2330491 - RNA, 23 nt, Human
cuucuggguuccuuccucugagc

SEQ ID NO: 2330492 - RNA, 15 nt, Human
cuucugguacucucc

SEQ ID NO: 2330493 - RNA, 16 nt, Human
cuucugguacucuccu

SEQ ID NO: 2330494 - RNA, 17 nt, Human
cuucugguacucuccua

SEQ ID NO: 2330495 - RNA, 18 nt, Human
cuucugguacucuccuag

SEQ ID NO: 2330496 - RNA, 17 nt, Human
cuucuggguuccuuccu

SEQ ID NO: 2330497 - RNA, 16 nt, Human
cuucuggguuccuucc

SEQ ID NO: 2330498 - RNA, 14 nt, Human
cuucugguugaugc

SEQ ID NO: 2330499 - RNA, 21 nt, Human
cuucuggugaccuuccaagag

SEQ ID NO: 2330500 - RNA, 20 nt, Human
cuucuggugaccuuccaaga

SEQ ID NO: 2330501 - RNA, 18 nt, Human
cuucuggugaccuuccaa

SEQ ID NO: 2330502 - RNA, 15 nt, Human
cuucuggguggggca

SEQ ID NO: 2330503 - RNA, 23 nt, Human
cuucugggagggcagcagggcua

SEQ ID NO: 2330504 - RNA, 19 nt, Human
cuucugggcaucuguucug

SEQ ID NO: 2330505 - RNA, 20 nt, Human
cuucugggcaucuguucugg

SEQ ID NO: 2330506 - RNA, 19 nt, Human
cuucugggagggcagcagg

SEQ ID NO: 2330507 - RNA, 18 nt, Human
cuucugcuuaggagagac

SEQ ID NO: 2330508 - RNA, 22 nt, Human
cuucugggagggcagcagggcu

SEQ ID NO: 2330509 - RNA, 22 nt, Human
cuucugggcuucaucuggcaac

SEQ ID NO: 2330510 - RNA, 21 nt, Human
cuucugggcuucaucuggcaa

SEQ ID NO: 2330511 - RNA, 21 nt, Human
cuucugggcaucuguucuggu

SEQ ID NO: 2330512 - RNA, 18 nt, Human
cuuuacggacacccccuc

SEQ ID NO: 2330513 - RNA, 21 nt, Human
cuuuaaacauugguucuugua

SEQ ID NO: 2330514 - RNA, 13 nt, Human
cuuuacuauggcc

SEQ ID NO: 2330515 - RNA, 18 nt, Human
cuuuaaaauuuuuuuaga

SEQ ID NO: 2330516 - RNA, 21 nt, Human
cuuuaaaauuuuuuuagaaag

SEQ ID NO: 2330517 - RNA, 23 nt, Human
cuuuaaaauuuuuuuagaaagca

SEQ ID NO: 2330518 - RNA, 22 nt, Human
cuuuaccuuuuuuauacauaaa

SEQ ID NO: 2330519 - RNA, 12 nt, Human
cuuuacuguuug

SEQ ID NO: 2330520 - RNA, 19 nt, Human
cuuuacugucaaaauaauu

SEQ ID NO: 2330521 - RNA, 22 nt, Human
cuuuacuaagaugacauugcua

SEQ ID NO: 2330522 - RNA, 15 nt, Human
cuuuacugucaaaau

SEQ ID NO: 2330523 - RNA, 18 nt, Human
cuuuacuaagaugacauu

SEQ ID NO: 2330524 - RNA, 16 nt, Human
cuuuaccuuuuuucuu

SEQ ID NO: 2330525 - RNA, 15 nt, Human
cuuuagccaaacccu

SEQ ID NO: 2330526 - RNA, 17 nt, Human
cuuuagaugcugaugau

SEQ ID NO: 2330527 - RNA, 16 nt, Human
cuuuagccaaacccuu

SEQ ID NO: 2330528 - RNA, 12 nt, Human
cuuuagaugcug

SEQ ID NO: 2330529 - RNA, 13 nt, Human
cuuuagaugcuga

SEQ ID NO: 2330530 - RNA, 14 nt, Human
cuuuagaugcugau

SEQ ID NO: 2330531 - RNA, 22 nt, Human
cuuguucuacucauauauaucu

SEQ ID NO: 2330532 - RNA, 13 nt, Human
cuuguucuacuca

SEQ ID NO: 2330533 - RNA, 21 nt, Human
cuuguucucuaaguuccacug

SEQ ID NO: 2330534 - RNA, 21 nt, Human
cuuguuccccacugacagccu

SEQ ID NO: 2330535 - RNA, 16 nt, Human
cuuguuccagcucuuu

SEQ ID NO: 2330536 - RNA, 14 nt, Human
cuuguucccucucc

SEQ ID NO: 2330537 - RNA, 12 nt, Human
cuuguuccuaga

SEQ ID NO: 2330538 - RNA, 21 nt, Human
cuuguucgugggucaucggga

SEQ ID NO: 2330539 - RNA, 13 nt, Human
cuuguuccagcuc

SEQ ID NO: 2330540 - RNA, 16 nt, Human
cuuguucacacucuca

SEQ ID NO: 2330541 - RNA, 13 nt, Human
cuuguuauuuaua

SEQ ID NO: 2330542 - RNA, 15 nt, Human
cuuguuauuuauaac

SEQ ID NO: 2330543 - RNA, 20 nt, Human
cuuguucaaaauauguucuu

SEQ ID NO: 2330544 - RNA, 22 nt, Human
cuugugucccuccugggaucug

SEQ ID NO: 2330545 - RNA, 15 nt, Human
cuugugucuacagag

SEQ ID NO: 2330546 - RNA, 16 nt, Human
cuugugucaaacagua

SEQ ID NO: 2330547 - RNA, 14 nt, Human
cuugugucccauga

SEQ ID NO: 2330548 - RNA, 15 nt, Human
cuuguguauccauua

SEQ ID NO: 2330549 - RNA, 16 nt, Human
cuuguguauccauuau

SEQ ID NO: 2330550 - RNA, 22 nt, Human
cuuguguauccauuaucaugug

SEQ ID NO: 2330551 - RNA, 23 nt, Human
cuuguguauccauuaucaugugu

SEQ ID NO: 2330552 - RNA, 18 nt, Human
cuuuauacguguagcuau

SEQ ID NO: 2330553 - RNA, 20 nt, Human
cuuuauacaacagugcuaaa

SEQ ID NO: 2330554 - RNA, 23 nt, Human
cuuuauacaacagugcuaaaaau

SEQ ID NO: 2330555 - RNA, 13 nt, Human
cuuuauacaacag

SEQ ID NO: 2330556 - RNA, 15 nt, Human
cuuuauacaacagug

SEQ ID NO: 2330557 - RNA, 17 nt, Human
cuuuauacaacagugcu

SEQ ID NO: 2330558 - RNA, 18 nt, Human
cuuuauacaacagugcua

SEQ ID NO: 2330559 - RNA, 19 nt, Human
cuuuauacguguagcuaua

SEQ ID NO: 2330560 - RNA, 13 nt, Human
cuuuauaugaaga

SEQ ID NO: 2330561 - RNA, 20 nt, Human
cuuuauauggccucaagauc

SEQ ID NO: 2330562 - RNA, 22 nt, Human
cuuuauaugaagaaaaucacuu

SEQ ID NO: 2330563 - RNA, 19 nt, Human
cuuuauaauucuacuuuga

SEQ ID NO: 2330564 - RNA, 13 nt, Human
cuuuauaauucua

SEQ ID NO: 2330565 - RNA, 14 nt, Human
cuuuagcgcccagu

SEQ ID NO: 2330566 - RNA, 15 nt, Human
cuuuagcgcccaguu

SEQ ID NO: 2330567 - RNA, 19 nt, Human
cuuuaugccggaugugcuu

SEQ ID NO: 2330568 - RNA, 20 nt, Human
cuuuaugccggaugugcuuu

SEQ ID NO: 2330569 - RNA, 22 nt, Human
cuuuaugccggaugugcuuuuc

SEQ ID NO: 2330570 - RNA, 14 nt, Human
cuuuaucuugacau

SEQ ID NO: 2330571 - RNA, 23 nt, Human
cuuuaugacuguuuuuguagugg

SEQ ID NO: 2330572 - RNA, 15 nt, Human
cuuuaugcacaaaau

SEQ ID NO: 2330573 - RNA, 22 nt, Human
cuuuaugaaugaaaaaacaguc

SEQ ID NO: 2330574 - RNA, 13 nt, Human
cuuuaucuguucu

SEQ ID NO: 2330575 - RNA, 18 nt, Human
cuuuaucuguucuugcua

SEQ ID NO: 2330576 - RNA, 23 nt, Human
cuuuaucuugaauaauguaagac

SEQ ID NO: 2330577 - RNA, 19 nt, Human
cuuuaucacauuauuugca

SEQ ID NO: 2330578 - RNA, 13 nt, Human
cuuuauauuuagu

SEQ ID NO: 2330579 - RNA, 12 nt, Human
cuuuauauuuag

SEQ ID NO: 2330580 - RNA, 21 nt, Human
cuuuaucuaauaccucugugu

SEQ ID NO: 2330581 - RNA, 22 nt, Human
cuuuaucuaauaccucugugug

SEQ ID NO: 2330582 - RNA, 14 nt, Human
cuuuauccucuuua

SEQ ID NO: 2330583 - RNA, 16 nt, Human
cuuuauccucuuuaga

SEQ ID NO: 2330584 - RNA, 18 nt, Human
cuuuaucuugaauaaugu

SEQ ID NO: 2330585 - RNA, 21 nt, Human
cuuuaucuugaauaauguaag

SEQ ID NO: 2330586 - RNA, 22 nt, Human
cuuguauagguuuuaaagaccu

SEQ ID NO: 2330587 - RNA, 15 nt, Human
cuuguauaguguaaa

SEQ ID NO: 2330588 - RNA, 16 nt, Human
cuuguauaguguaaaa

SEQ ID NO: 2330589 - RNA, 17 nt, Human
cuuguauaguguaaaau

SEQ ID NO: 2330590 - RNA, 20 nt, Human
cuuguauauacgcaucuaua

SEQ ID NO: 2330591 - RNA, 17 nt, Human
cuuguauaucuuguuuu

SEQ ID NO: 2330592 - RNA, 11 nt, Human
cuuguauauuu

SEQ ID NO: 2330593 - RNA, 12 nt, Human
cuuguauauuug

SEQ ID NO: 2330594 - RNA, 14 nt, Human
cuuguauauuugua

SEQ ID NO: 2330595 - RNA, 16 nt, Human
cuuguauauuuguaca

SEQ ID NO: 2330596 - RNA, 23 nt, Human
cuugucaauaaaauccauacauu

SEQ ID NO: 2330597 - RNA, 17 nt, Human
cuuguauauuuuaagaa

SEQ ID NO: 2330598 - RNA, 17 nt, Human
cuuguauauuuguacaa

SEQ ID NO: 2330599 - RNA, 18 nt, Human
cuuguauauuuguacaaa

SEQ ID NO: 2330600 - RNA, 19 nt, Human
cuuguauauuuguacaaaa

SEQ ID NO: 2330601 - RNA, 15 nt, Human
cuugucaaagaaggu

SEQ ID NO: 2330602 - RNA, 21 nt, Human
cuuguaguuuaccucuuuaaa

SEQ ID NO: 2330603 - RNA, 17 nt, Human
cuuguagggaugccuuu

SEQ ID NO: 2330604 - RNA, 23 nt, Human
cuuguacauguguagccugugca

SEQ ID NO: 2330605 - RNA, 14 nt, Human
cuuguacaugugua

SEQ ID NO: 2330606 - RNA, 19 nt, Human
cuuguacauguguagccug

SEQ ID NO: 2330607 - RNA, 20 nt, Human
cuuguacauguguagccugu

SEQ ID NO: 2330608 - RNA, 22 nt, Human
cuuguacauguguagccugugc

SEQ ID NO: 2330609 - RNA, 21 nt, Human
cuugucccacucaagccaagc

SEQ ID NO: 2330610 - RNA, 15 nt, Human
cuugucccagaggcu

SEQ ID NO: 2330611 - RNA, 14 nt, Human
cuuguccccaaauc

SEQ ID NO: 2330612 - RNA, 19 nt, Human
cuugucccagaggcugccc

SEQ ID NO: 2330613 - RNA, 19 nt, Human
cuugucccacucaagccaa

SEQ ID NO: 2330614 - RNA, 18 nt, Human
cuugucccacucaagcca

SEQ ID NO: 2330615 - RNA, 16 nt, Human
cuugucccacucaagc

SEQ ID NO: 2330616 - RNA, 18 nt, Human
cuugucccacuaucuggg

SEQ ID NO: 2330617 - RNA, 13 nt, Human
cuuguccagcuga

SEQ ID NO: 2330618 - RNA, 12 nt, Human
cuuguccagcug

SEQ ID NO: 2330619 - RNA, 12 nt, Human
cuuguccccaca

SEQ ID NO: 2330620 - RNA, 14 nt, Human
cuugugguuuaugu

SEQ ID NO: 2330621 - RNA, 14 nt, Human
cuuguguauccauu

SEQ ID NO: 2330622 - RNA, 15 nt, Human
cuugucaauauuuaa

SEQ ID NO: 2330623 - RNA, 19 nt, Human
cuugucaauauuuaaacau

SEQ ID NO: 2330624 - RNA, 18 nt, Human
cuuguccagcgccuagug

SEQ ID NO: 2330625 - RNA, 14 nt, Human
cuuguccagcgccu

SEQ ID NO: 2330626 - RNA, 15 nt, Human
cuuguccacccaccu

SEQ ID NO: 2330627 - RNA, 20 nt, Human
cuuguccaacccgaggcccg

SEQ ID NO: 2330628 - RNA, 22 nt, Human
cuugucaauauuuaaacauggu

SEQ ID NO: 2330629 - RNA, 16 nt, Human
cuuguaaauagcucag

SEQ ID NO: 2330630 - RNA, 22 nt, Human
cuugggggguuuuuacuccagu

SEQ ID NO: 2330631 - RNA, 23 nt, Human
cuugggggguuuuuacuccagug

SEQ ID NO: 2330632 - RNA, 13 nt, Human
cuugaguuugucg

SEQ ID NO: 2330633 - RNA, 14 nt, Human
cuuggggggguggc

SEQ ID NO: 2330634 - RNA, 16 nt, Human
cuuggggggguggccg

SEQ ID NO: 2330635 - RNA, 18 nt, Human
cuuggggggguggccgcu

SEQ ID NO: 2330636 - RNA, 19 nt, Human
cuuggggggguggccgcug

SEQ ID NO: 2330637 - RNA, 22 nt, Human
cuuggggggguggccgcugagu

SEQ ID NO: 2330638 - RNA, 23 nt, Human
cuuggggggcugaggugggagga

SEQ ID NO: 2330639 - RNA, 12 nt, Human
cuugaguuuguc

SEQ ID NO: 2330640 - RNA, 19 nt, Human
cuugaguuuaaauuguaau

SEQ ID NO: 2330641 - RNA, 17 nt, Human
cuuguaaauagcucagg

SEQ ID NO: 2330642 - RNA, 18 nt, Human
cuuguaaauagcucaggu

SEQ ID NO: 2330643 - RNA, 12 nt, Human
cuuguacauaau

SEQ ID NO: 2330644 - RNA, 15 nt, Human
cuuguacauaaugcg

SEQ ID NO: 2330645 - RNA, 13 nt, Human
cuuguacaugugu

SEQ ID NO: 2330646 - RNA, 22 nt, Human
cuuguacauaaugcgugcauac

SEQ ID NO: 2330647 - RNA, 21 nt, Human
cuuguacauaaugcgugcaua

SEQ ID NO: 2330648 - RNA, 19 nt, Human
cuuguacauaaugcgugca

SEQ ID NO: 2330649 - RNA, 16 nt, Human
cuuuauguaauaaugu

SEQ ID NO: 2330650 - RNA, 13 nt, Human
cuuuaugguuucu

SEQ ID NO: 2330651 - RNA, 15 nt, Human
cuuuaugcugaaaca

SEQ ID NO: 2330652 - RNA, 12 nt, Human
cuuuaugcugaa

SEQ ID NO: 2330653 - RNA, 16 nt, Human
cuuuaugguaaagaug

SEQ ID NO: 2330654 - RNA, 15 nt, Human
cuuuccaucuacccu

SEQ ID NO: 2330655 - RNA, 15 nt, Human
cuuuccaggaaggcu

SEQ ID NO: 2330656 - RNA, 15 nt, Human
cuuuccccugugggg

SEQ ID NO: 2330657 - RNA, 17 nt, Human
cuuuccccuguggggau

SEQ ID NO: 2330658 - RNA, 18 nt, Human
cuuucccggacugcaagc

SEQ ID NO: 2330659 - RNA, 18 nt, Human
cuuuccauuggaucucau

SEQ ID NO: 2330660 - RNA, 14 nt, Human
cuuuccauguugcu

SEQ ID NO: 2330661 - RNA, 17 nt, Human
cuuuccauguugcugcc

SEQ ID NO: 2330662 - RNA, 18 nt, Human
cuuuccauguugcugcca

SEQ ID NO: 2330663 - RNA, 19 nt, Human
cuuucccugcuuaaugaaa

SEQ ID NO: 2330664 - RNA, 15 nt, Human
cuuucccuuaucaaa

SEQ ID NO: 2330665 - RNA, 20 nt, Human
cuuucccugaacugggaccu

SEQ ID NO: 2330666 - RNA, 17 nt, Human
cuuucccuucaguaccc

SEQ ID NO: 2330667 - RNA, 13 nt, Human
cuuucccuccacu

SEQ ID NO: 2330668 - RNA, 13 nt, Human
cuuucccugaacu

SEQ ID NO: 2330669 - RNA, 13 nt, Human
cuuucccugccuc

SEQ ID NO: 2330670 - RNA, 12 nt, Human
cuuuccugaggc

SEQ ID NO: 2330671 - RNA, 16 nt, Human
cuuucccucccuuccu

SEQ ID NO: 2330672 - RNA, 14 nt, Human
cuuucccucccuuc

SEQ ID NO: 2330673 - RNA, 13 nt, Human
cuuucccucccuu

SEQ ID NO: 2330674 - RNA, 11 nt, Human
cuuucccuccc

SEQ ID NO: 2330675 - RNA, 19 nt, Human
cuuucugcucagcuucucc

SEQ ID NO: 2330676 - RNA, 16 nt, Human
cuuucugcuuguguua

SEQ ID NO: 2330677 - RNA, 17 nt, Human
cuuucucuucucuguuc

SEQ ID NO: 2330678 - RNA, 15 nt, Human
cuuucucuucucugu

SEQ ID NO: 2330679 - RNA, 16 nt, Human
cuuucucugccaguga

SEQ ID NO: 2330680 - RNA, 18 nt, Human
cuuucucugccagugaca

SEQ ID NO: 2330681 - RNA, 13 nt, Human
cuuucucugccag

SEQ ID NO: 2330682 - RNA, 14 nt, Human
cuuucucugccagu

SEQ ID NO: 2330683 - RNA, 15 nt, Human
cuuucucuccuuucu

SEQ ID NO: 2330684 - RNA, 17 nt, Human
cuuucucuccuuucuuu

SEQ ID NO: 2330685 - RNA, 16 nt, Human
cuuucucuccuuucuu

SEQ ID NO: 2330686 - RNA, 22 nt, Human
cuuuccugaauccaaacuaauc

SEQ ID NO: 2330687 - RNA, 15 nt, Human
cuuuccugaauccaa

SEQ ID NO: 2330688 - RNA, 16 nt, Human
cuuucucuacuuugag

SEQ ID NO: 2330689 - RNA, 13 nt, Human
cuuuccugaggcu

SEQ ID NO: 2330690 - RNA, 15 nt, Human
cuuuccugaggcugg

SEQ ID NO: 2330691 - RNA, 13 nt, Human
cuuucuguaaacu

SEQ ID NO: 2330692 - RNA, 13 nt, Human
cuuucuguauaua

SEQ ID NO: 2330693 - RNA, 11 nt, Human
cuuucuuccuc

SEQ ID NO: 2330694 - RNA, 14 nt, Human
cuuucugggccaag

SEQ ID NO: 2330695 - RNA, 20 nt, Human
cuuucugggcaccggggccu

SEQ ID NO: 2330696 - RNA, 16 nt, Human
cuuucuguaaccauaa

SEQ ID NO: 2330697 - RNA, 13 nt, Human
cuuucuggcucuc

SEQ ID NO: 2330698 - RNA, 20 nt, Human
cuuucuggcuaugcauuuga

SEQ ID NO: 2330699 - RNA, 19 nt, Human
cuuucuggcuaugcauuug

SEQ ID NO: 2330700 - RNA, 18 nt, Human
cuuucuggcuaugcauuu

SEQ ID NO: 2330701 - RNA, 17 nt, Human
cuuucuggcuaugcauu

SEQ ID NO: 2330702 - RNA, 12 nt, Human
cuuucuuccucu

SEQ ID NO: 2330703 - RNA, 13 nt, Human
cuuucuuccucug

SEQ ID NO: 2330704 - RNA, 14 nt, Human
cuuucuuccucugc

SEQ ID NO: 2330705 - RNA, 15 nt, Human
cuuucuuccucugcu

SEQ ID NO: 2330706 - RNA, 15 nt, Human
cuuugaccucugcag

SEQ ID NO: 2330707 - RNA, 14 nt, Human
cuuugaccucugca

SEQ ID NO: 2330708 - RNA, 24 nt, Human
cuuugaccucugcagcaauaaagc

SEQ ID NO: 2330709 - RNA, 20 nt, Human
cuuugaccucugcagcaaua

SEQ ID NO: 2330710 - RNA, 18 nt, Human
cuuugaccucugcagcaa

SEQ ID NO: 2330711 - RNA, 17 nt, Human
cuuugaccucugcagca

SEQ ID NO: 2330712 - RNA, 22 nt, Human
cuuugccuugggcugcuccuca

SEQ ID NO: 2330713 - RNA, 19 nt, Human
cuuugccuugggcugcucc

SEQ ID NO: 2330714 - RNA, 18 nt, Human
cuuugccuugggcugcuc

SEQ ID NO: 2330715 - RNA, 16 nt, Human
cuuugccuugggcugc

SEQ ID NO: 2330716 - RNA, 13 nt, Human
cuuugccuugggc

SEQ ID NO: 2330717 - RNA, 23 nt, Human
cuuugccuuccacgcugucucca

SEQ ID NO: 2330718 - RNA, 22 nt, Human
cuuugccuuccacgcugucucc

SEQ ID NO: 2330719 - RNA, 22 nt, Human
cuuugccuguucaguuacagaa

SEQ ID NO: 2330720 - RNA, 15 nt, Human
cuuugccuguucagu

SEQ ID NO: 2330721 - RNA, 16 nt, Human
cuuugccuguucaguu

SEQ ID NO: 2330722 - RNA, 13 nt, Human
cuuugccuccccg

SEQ ID NO: 2330723 - RNA, 11 nt, Human
cuuugccuggu

SEQ ID NO: 2330724 - RNA, 14 nt, Human
cuuugccuguucag

SEQ ID NO: 2330725 - RNA, 17 nt, Human
cuuugcagguugcuuug

SEQ ID NO: 2330726 - RNA, 18 nt, Human
cuuugaccugccucccuu

SEQ ID NO: 2330727 - RNA, 12 nt, Human
cuuugcaggcau

SEQ ID NO: 2330728 - RNA, 15 nt, Human
cuuugcagguugcuu

SEQ ID NO: 2330729 - RNA, 16 nt, Human
cuuugcagacaggcaa

SEQ ID NO: 2330730 - RNA, 13 nt, Human
cuuugaccucugc

SEQ ID NO: 2330731 - RNA, 15 nt, Human
cuuugaccugccucc

SEQ ID NO: 2330732 - RNA, 14 nt, Human
cuuugaccugccuc

SEQ ID NO: 2330733 - RNA, 13 nt, Human
cuuugcaggcuca

SEQ ID NO: 2330734 - RNA, 22 nt, Human
cuuugcagccggcacagggucu

SEQ ID NO: 2330735 - RNA, 20 nt, Human
cuuugcagacaggcaagcac

SEQ ID NO: 2330736 - RNA, 14 nt, Human
cuuugucccauuuc

SEQ ID NO: 2330737 - RNA, 15 nt, Human
cuuuguccccaccgc

SEQ ID NO: 2330738 - RNA, 19 nt, Human
cuuugugagagugagcugu

SEQ ID NO: 2330739 - RNA, 23 nt, Human
cuuugugacuguauauaaaggaa

SEQ ID NO: 2330740 - RNA, 15 nt, Human
cuuugugacuguaua

SEQ ID NO: 2330741 - RNA, 22 nt, Human
cuuugugaauagaacucugaaa

SEQ ID NO: 2330742 - RNA, 15 nt, Human
cuuugucugaaaaau

SEQ ID NO: 2330743 - RNA, 13 nt, Human
cuuugugcugugg

SEQ ID NO: 2330744 - RNA, 15 nt, Human
cuuugugaggaagcc

SEQ ID NO: 2330745 - RNA, 16 nt, Human
cuuugucaaaaggaag

SEQ ID NO: 2330746 - RNA, 18 nt, Human
cuuugucaucuuucuucu

SEQ ID NO: 2330747 - RNA, 20 nt, Human
cuuuguauuuuuacuuuuaa

SEQ ID NO: 2330748 - RNA, 23 nt, Human
cuuuguauuuuuacuuuuaaaug

SEQ ID NO: 2330749 - RNA, 14 nt, Human
cuuuguccccaccg

SEQ ID NO: 2330750 - RNA, 13 nt, Human
cuuuggcucugga

SEQ ID NO: 2330751 - RNA, 14 nt, Human
cuuuggcucuggag

SEQ ID NO: 2330752 - RNA, 15 nt, Human
cuuuggcucuggaga

SEQ ID NO: 2330753 - RNA, 13 nt, Human
cuuuggcuccccu

SEQ ID NO: 2330754 - RNA, 15 nt, Human
cuuuggcuccccugu

SEQ ID NO: 2330755 - RNA, 14 nt, Human
cuuuggcugcaugc

SEQ ID NO: 2330756 - RNA, 14 nt, Human
cuuugccuuuugca

SEQ ID NO: 2330757 - RNA, 23 nt, Human
cuuugccuugggcugcuccucau

SEQ ID NO: 2330758 - RNA, 19 nt, Human
cuuuggcuauuagagauca

SEQ ID NO: 2330759 - RNA, 19 nt, Human
cuuuggcuaugagggccuu

SEQ ID NO: 2330760 - RNA, 21 nt, Human
gaaaccauuaugaagaagaga

SEQ ID NO: 2330761 - RNA, 19 nt, Human
gaaaccaguguagccuugc

SEQ ID NO: 2330762 - RNA, 23 nt, Human
gaaacccagcucugguccauaga

SEQ ID NO: 2330763 - RNA, 17 nt, Human
gaaaccccaucucuacu

SEQ ID NO: 2330764 - RNA, 21 nt, Human
gaaacccagacugaacuuacc

SEQ ID NO: 2330765 - RNA, 15 nt, Human
gaaacccccacacac

SEQ ID NO: 2330766 - RNA, 17 nt, Human
gaaacccccacacacac

SEQ ID NO: 2330767 - RNA, 16 nt, Human
gaaacccccacacaca

SEQ ID NO: 2330768 - RNA, 16 nt, Human
gaaacccgacagaggg

SEQ ID NO: 2330769 - RNA, 15 nt, Human
gaaacccuauuuccc

SEQ ID NO: 2330770 - RNA, 23 nt, Human
gaaacccccacacacacacacau

SEQ ID NO: 2330771 - RNA, 20 nt, Human
gaaaccucuacuaaaaagaa

SEQ ID NO: 2330772 - RNA, 16 nt, Human
gaaaccugggauucag

SEQ ID NO: 2330773 - RNA, 13 nt, Human
gaaaccugaaaaa

SEQ ID NO: 2330774 - RNA, 18 nt, Human
gaaaccugaaaaaaaguu

SEQ ID NO: 2330775 - RNA, 12 nt, Human
gaaaccugcccu

SEQ ID NO: 2330776 - RNA, 13 nt, Human
gaaaccugcccug

SEQ ID NO: 2330777 - RNA, 17 nt, Human
gaaacccuugaaaagac

SEQ ID NO: 2330778 - RNA, 21 nt, Human
gaaacccuggaccaguggucu

SEQ ID NO: 2330779 - RNA, 14 nt, Human
gaaacccuggacca

SEQ ID NO: 2330780 - RNA, 14 nt, Human
gaaacccugucucu

SEQ ID NO: 2330781 - RNA, 15 nt, Human
gaaacuaacagauaa

SEQ ID NO: 2330782 - RNA, 16 nt, Human
gaaacgucuucuaaac

SEQ ID NO: 2330783 - RNA, 20 nt, Human
gaaaccuuauuguaccucuc

SEQ ID NO: 2330784 - RNA, 13 nt, Human
gaaaccuuaauau

SEQ ID NO: 2330785 - RNA, 13 nt, Human
gaaaccuuauuuu

SEQ ID NO: 2330786 - RNA, 17 nt, Human
gaaaccuuauuguaccu

SEQ ID NO: 2330787 - RNA, 19 nt, Human
gaaaccuuauuguaccucu

SEQ ID NO: 2330788 - RNA, 18 nt, Human
gaaaccugcccugccuga

SEQ ID NO: 2330789 - RNA, 14 nt, Human
gaaaccugcccugc

SEQ ID NO: 2330790 - RNA, 17 nt, Human
gaaaccugcccugccug

SEQ ID NO: 2330791 - RNA, 12 nt, Human
gaaacuaacaga

SEQ ID NO: 2330792 - RNA, 22 nt, Human
gaaaccuuauuuuuucccaaag

SEQ ID NO: 2330793 - RNA, 13 nt, Human
gaaacuaggucug

SEQ ID NO: 2330794 - RNA, 19 nt, Human
gaaacuccacaucugccuu

SEQ ID NO: 2330795 - RNA, 18 nt, Human
gaaacuaggucugauauu

SEQ ID NO: 2330796 - RNA, 20 nt, Human
gaaacuccacaucugccuua

SEQ ID NO: 2330797 - RNA, 20 nt, Human
gaaacuccaccuugcgggga

SEQ ID NO: 2330798 - RNA, 23 nt, Human
gaaacucguuaauuuguaguguu

SEQ ID NO: 2330799 - RNA, 18 nt, Human
gaaaaugcaacaacaugu

SEQ ID NO: 2330800 - RNA, 20 nt, Human
gaaaaugcaacaacauguau

SEQ ID NO: 2330801 - RNA, 23 nt, Human
gaaaaugauguguacccaaacgu

SEQ ID NO: 2330802 - RNA, 22 nt, Human
gaaaaugaucugagucccagga

SEQ ID NO: 2330803 - RNA, 14 nt, Human
gaaaaugaucugag

SEQ ID NO: 2330804 - RNA, 16 nt, Human
gaaaaugaucugaguc

SEQ ID NO: 2330805 - RNA, 22 nt, Human
gaaacaauacucauaaugugaa

SEQ ID NO: 2330806 - RNA, 15 nt, Human
gaaacaauaaagaga

SEQ ID NO: 2330807 - RNA, 21 nt, Human
gaaacaauacucauaauguga

SEQ ID NO: 2330808 - RNA, 14 nt, Human
gaaaaugcagcagg

SEQ ID NO: 2330809 - RNA, 22 nt, Human
gaaaaugcagcagggaugcccu

SEQ ID NO: 2330810 - RNA, 16 nt, Human
gaaaaugaaucccucu

SEQ ID NO: 2330811 - RNA, 23 nt, Human
gaaaaugaguuuuuauggggcug

SEQ ID NO: 2330812 - RNA, 12 nt, Human
gaaaaugaauaa

SEQ ID NO: 2330813 - RNA, 20 nt, Human
gaaaaugauacgcaacauaa

SEQ ID NO: 2330814 - RNA, 20 nt, Human
gaaacacacugaggcaggga

SEQ ID NO: 2330815 - RNA, 19 nt, Human
gaaacacacugaggcaggg

SEQ ID NO: 2330816 - RNA, 16 nt, Human
gaaacacacugaggca

SEQ ID NO: 2330817 - RNA, 23 nt, Human
gaaacacaccaggcugugggccu

SEQ ID NO: 2330818 - RNA, 17 nt, Human
gaaacacaccaggcugu

SEQ ID NO: 2330819 - RNA, 16 nt, Human
gaaacacaccaggcug

SEQ ID NO: 2330820 - RNA, 15 nt, Human
gaaacacaauauuuu

SEQ ID NO: 2330821 - RNA, 14 nt, Human
gaaacacaauauuu

SEQ ID NO: 2330822 - RNA, 16 nt, Human
gaaacacaacuauauu

SEQ ID NO: 2330823 - RNA, 23 nt, Human
gaaacacacugaggcagggaagu

SEQ ID NO: 2330824 - RNA, 21 nt, Human
gaaacacacugaggcagggaa

SEQ ID NO: 2330825 - RNA, 13 nt, Human
gaaacacagaaac

SEQ ID NO: 2330826 - RNA, 16 nt, Human
gaaaccaaagaagaaa

SEQ ID NO: 2330827 - RNA, 22 nt, Human
gaaaccaaagauauauacacag

SEQ ID NO: 2330828 - RNA, 15 nt, Human
gaaaccaaagaagaa

SEQ ID NO: 2330829 - RNA, 13 nt, Human
gaaacauuuucau

SEQ ID NO: 2330830 - RNA, 11 nt, Human
gaaacauuugg

SEQ ID NO: 2330831 - RNA, 14 nt, Human
gaaaccacagcugc

SEQ ID NO: 2330832 - RNA, 15 nt, Human
gaaaccacagcugcu

SEQ ID NO: 2330833 - RNA, 20 nt, Human
gaaaccacagcugcuggaga

SEQ ID NO: 2330834 - RNA, 17 nt, Human
gaaaccacagcugcugg

SEQ ID NO: 2330835 - RNA, 18 nt, Human
gaaaccacagcugcugga

SEQ ID NO: 2330836 - RNA, 14 nt, Human
gaaaccagggccug

SEQ ID NO: 2330837 - RNA, 20 nt, Human
gaaaccagggccugagccaa

SEQ ID NO: 2330838 - RNA, 18 nt, Human
gaaaccagugcaacagca

SEQ ID NO: 2330839 - RNA, 13 nt, Human
gaaacccagcucu

SEQ ID NO: 2330840 - RNA, 14 nt, Human
gaaacccagcucug

SEQ ID NO: 2330841 - RNA, 15 nt, Human
gaaacccagcucugg

SEQ ID NO: 2330842 - RNA, 16 nt, Human
gaaacccagcucuggu

SEQ ID NO: 2330843 - RNA, 18 nt, Human
gaaacccagcucuggucc

SEQ ID NO: 2330844 - RNA, 19 nt, Human
gaaacccagcucuggucca

SEQ ID NO: 2330845 - RNA, 13 nt, Human
gaaagcuagagau

SEQ ID NO: 2330846 - RNA, 24 nt, Human
gaaagccuguuccccucacuggau

SEQ ID NO: 2330847 - RNA, 16 nt, Human
gaaagccucugcugcc

SEQ ID NO: 2330848 - RNA, 18 nt, Human
gaaagccuguuccccuca

SEQ ID NO: 2330849 - RNA, 20 nt, Human
gaaagccuguuccccucacu

SEQ ID NO: 2330850 - RNA, 21 nt, Human
gaaagccuguuccccucacug

SEQ ID NO: 2330851 - RNA, 15 nt, Human
gaaagccucugcugc

SEQ ID NO: 2330852 - RNA, 16 nt, Human
gaaagccuaucaaaga

SEQ ID NO: 2330853 - RNA, 16 nt, Human
gaaagcuagagauaug

SEQ ID NO: 2330854 - RNA, 18 nt, Human
gaaagcuccuagcagaga

SEQ ID NO: 2330855 - RNA, 20 nt, Human
gaaagcuccuagcagagaga

SEQ ID NO: 2330856 - RNA, 22 nt, Human
gaaagcuccucgagggcaggga

SEQ ID NO: 2330857 - RNA, 17 nt, Human
gaaagcugccugguaua

SEQ ID NO: 2330858 - RNA, 21 nt, Human
gaaagcugguaaacuauuugu

SEQ ID NO: 2330859 - RNA, 17 nt, Human
gaaagcuucaaacugca

SEQ ID NO: 2330860 - RNA, 18 nt, Human
gaaagccccagcacuaac

SEQ ID NO: 2330861 - RNA, 14 nt, Human
gaaagccccagcac

SEQ ID NO: 2330862 - RNA, 17 nt, Human
gaaagcccugagcuuuc

SEQ ID NO: 2330863 - RNA, 22 nt, Human
gaaagcccugagcuuucugcua

SEQ ID NO: 2330864 - RNA, 21 nt, Human
gaaagcccugagcuuucugcu

SEQ ID NO: 2330865 - RNA, 17 nt, Human
gaaagcauccaugugug

SEQ ID NO: 2330866 - RNA, 15 nt, Human
gaaagcauccaugug

SEQ ID NO: 2330867 - RNA, 20 nt, Human
gaaagcccagaaaaggacag

SEQ ID NO: 2330868 - RNA, 21 nt, Human
gaaagcccagaaaaggacaga

SEQ ID NO: 2330869 - RNA, 19 nt, Human
gaaagcaucaccucaggcc

SEQ ID NO: 2330870 - RNA, 18 nt, Human
gaaagcaucaccucaggc

SEQ ID NO: 2330871 - RNA, 17 nt, Human
gaaagcaucaccucagg

SEQ ID NO: 2330872 - RNA, 16 nt, Human
gaaagcaucaccucag

SEQ ID NO: 2330873 - RNA, 20 nt, Human
gaaagcagcucaaaggcaca

SEQ ID NO: 2330874 - RNA, 14 nt, Human
gaaagcagcugaac

SEQ ID NO: 2330875 - RNA, 12 nt, Human
gaaagcaggggc

SEQ ID NO: 2330876 - RNA, 13 nt, Human
gaaagcaggggcu

SEQ ID NO: 2330877 - RNA, 14 nt, Human
gaaagcaggggcua

SEQ ID NO: 2330878 - RNA, 19 nt, Human
gaaagcaggggcuacaaga

SEQ ID NO: 2330879 - RNA, 23 nt, Human
gaaagcaggggcuacaagaggga

SEQ ID NO: 2330880 - RNA, 14 nt, Human
gaaagcagggacuu

SEQ ID NO: 2330881 - RNA, 19 nt, Human
gaaagcagcucaaaggcac

SEQ ID NO: 2330882 - RNA, 22 nt, Human
gaaagcagauaccucacccugc

SEQ ID NO: 2330883 - RNA, 20 nt, Human
gaaagcagauaccucacccu

SEQ ID NO: 2330884 - RNA, 15 nt, Human
gaaagaguaaaggaa

SEQ ID NO: 2330885 - RNA, 22 nt, Human
gaaagcagaacagugauuacca

SEQ ID NO: 2330886 - RNA, 17 nt, Human
gaaagcagaacagugau

SEQ ID NO: 2330887 - RNA, 20 nt, Human
gaaagaggcugaggccugga

SEQ ID NO: 2330888 - RNA, 21 nt, Human
gaaagaggcugaggccuggac

SEQ ID NO: 2330889 - RNA, 22 nt, Human
gaaagaggcugaggccuggacu

SEQ ID NO: 2330890 - RNA, 21 nt, Human
gaaagaguacucuuguuuccu

SEQ ID NO: 2330891 - RNA, 15 nt, Human
gaaagaguaggaaga

SEQ ID NO: 2330892 - RNA, 16 nt, Human
gaaagaguaggaagac

SEQ ID NO: 2330893 - RNA, 17 nt, Human
gaaagacuguacaaagu

SEQ ID NO: 2330894 - RNA, 23 nt, Human
gaaacucuuaucucagucaugca

SEQ ID NO: 2330895 - RNA, 18 nt, Human
gaaacuccgucuuagaag

SEQ ID NO: 2330896 - RNA, 21 nt, Human
gaaacuccaccuugcggggau

SEQ ID NO: 2330897 - RNA, 22 nt, Human
gaaacuccgucuuagaagugga

SEQ ID NO: 2330898 - RNA, 14 nt, Human
gaaacucuuaucuc

SEQ ID NO: 2330899 - RNA, 15 nt, Human
gaaacucuuaucuca

SEQ ID NO: 2330900 - RNA, 16 nt, Human
gaaacucuuaucucag

SEQ ID NO: 2330901 - RNA, 20 nt, Human
gaaacucuuaucucagucau

SEQ ID NO: 2330902 - RNA, 19 nt, Human
gaaagacuuuuccaacccu

SEQ ID NO: 2330903 - RNA, 17 nt, Human
gaaagagaacuuccaga

SEQ ID NO: 2330904 - RNA, 17 nt, Human
gaaagaggagugcuugu

SEQ ID NO: 2330905 - RNA, 20 nt, Human
gaaagaggcagcuugaaacu

SEQ ID NO: 2330906 - RNA, 14 nt, Human
gaaagagaaggugg

SEQ ID NO: 2330907 - RNA, 15 nt, Human
gaaagagaagguggg

SEQ ID NO: 2330908 - RNA, 21 nt, Human
gaaacucuuaucucagucaug

SEQ ID NO: 2330909 - RNA, 21 nt, Human
gaaagaggaaugaaguacuca

SEQ ID NO: 2330910 - RNA, 18 nt, Human
cuuuuucuuuauaaacuu

SEQ ID NO: 2330911 - RNA, 18 nt, Human
cuuuuugaaaucagcaua

SEQ ID NO: 2330912 - RNA, 17 nt, Human
cuuuuugguuugcagau

SEQ ID NO: 2330913 - RNA, 15 nt, Human
cuuuuugaaaucagc

SEQ ID NO: 2330914 - RNA, 21 nt, Human
cuuuuuggaggugcuuaagca

SEQ ID NO: 2330915 - RNA, 17 nt, Human
cuuuuuuggcugcugaa

SEQ ID NO: 2330916 - RNA, 14 nt, Human
cuuuuuguaccugg

SEQ ID NO: 2330917 - RNA, 16 nt, Human
cuuuuuguaccuggug

SEQ ID NO: 2330918 - RNA, 11 nt, Human
cuuuuuguagg

SEQ ID NO: 2330919 - RNA, 20 nt, Human
cuuuuuuggcugcugaaggc

SEQ ID NO: 2330920 - RNA, 22 nt, Human
cuuuuuuggcugcugaaggcuc

SEQ ID NO: 2330921 - RNA, 15 nt, Human
gaaaaaggaggaaga

SEQ ID NO: 2330922 - RNA, 12 nt, Human
gaaaaaggagga

SEQ ID NO: 2330923 - RNA, 16 nt, Human
cuuuuuuggcugcuga

SEQ ID NO: 2330924 - RNA, 13 nt, Human
gaaaaagcaugua

SEQ ID NO: 2330925 - RNA, 18 nt, Human
gaaaaagcauguacagug

SEQ ID NO: 2330926 - RNA, 20 nt, Human
gaaaaagcauguacaguguu

SEQ ID NO: 2330927 - RNA, 14 nt, Human
gaaaaagcauguac

SEQ ID NO: 2330928 - RNA, 15 nt, Human
gaaaaagcauguaca

SEQ ID NO: 2330929 - RNA, 16 nt, Human
gaaaaagcauguacag

SEQ ID NO: 2330930 - RNA, 17 nt, Human
gaaaaagcauguacagu

SEQ ID NO: 2330931 - RNA, 22 nt, Human
gaaaaagcauguacaguguucu

SEQ ID NO: 2330932 - RNA, 21 nt, Human
gaaaaagcuccuguccuccca

SEQ ID NO: 2330933 - RNA, 14 nt, Human
gaaaacacauuuuu

SEQ ID NO: 2330934 - RNA, 18 nt, Human
gaaaacacauuuuucuua

SEQ ID NO: 2330935 - RNA, 18 nt, Human
gaaaacacuguucucugc

SEQ ID NO: 2330936 - RNA, 21 nt, Human
gaaaacacugugcacaucugu

SEQ ID NO: 2330937 - RNA, 14 nt, Human
gaaaacacugugca

SEQ ID NO: 2330938 - RNA, 19 nt, Human
gaaaacacauuuuucuuag

SEQ ID NO: 2330939 - RNA, 15 nt, Human
cuuuuuauugaaucu

SEQ ID NO: 2330940 - RNA, 17 nt, Human
cuuuuuauugaaucuau

SEQ ID NO: 2330941 - RNA, 22 nt, Human
cuuuuuauguugccaguuuaau

SEQ ID NO: 2330942 - RNA, 13 nt, Human
cuuuuuauugaau

SEQ ID NO: 2330943 - RNA, 14 nt, Human
cuuuuuauugaauc

SEQ ID NO: 2330944 - RNA, 13 nt, Human
cuuuuguucgcau

SEQ ID NO: 2330945 - RNA, 20 nt, Human
cuuuuguucuugguuuguaa

SEQ ID NO: 2330946 - RNA, 17 nt, Human
cuuuuuauggccuguga

SEQ ID NO: 2330947 - RNA, 19 nt, Human
cuuuuuauugaaucuauuu

SEQ ID NO: 2330948 - RNA, 11 nt, Human
cuuuuucugac

SEQ ID NO: 2330949 - RNA, 17 nt, Human
cuuuuucugacuccagu

SEQ ID NO: 2330950 - RNA, 22 nt, Human
cuuuuucuggacugaagccugc

SEQ ID NO: 2330951 - RNA, 16 nt, Human
cuuuuucuuuauaaac

SEQ ID NO: 2330952 - RNA, 12 nt, Human
cuuuuucuuuau

SEQ ID NO: 2330953 - RNA, 15 nt, Human
cuuuuucuucuuccc

SEQ ID NO: 2330954 - RNA, 19 nt, Human
cuuuuucuucuucccuccc

SEQ ID NO: 2330955 - RNA, 15 nt, Human
cuuugugugauugaa

SEQ ID NO: 2330956 - RNA, 17 nt, Human
cuuugugcuguggggcu

SEQ ID NO: 2330957 - RNA, 16 nt, Human
cuuuguggaugucuuc

SEQ ID NO: 2330958 - RNA, 17 nt, Human
cuuuguggaugucuucc

SEQ ID NO: 2330959 - RNA, 20 nt, Human
cuuuguggaugucuuccuug

SEQ ID NO: 2330960 - RNA, 14 nt, Human
cuuuguguuucuau

SEQ ID NO: 2330961 - RNA, 23 nt, Human
cuuuguguuucuauugacuucaa

SEQ ID NO: 2330962 - RNA, 18 nt, Human
cuuuguuaguuucuccaa

SEQ ID NO: 2330963 - RNA, 15 nt, Human
cuuuguuacaggcac

SEQ ID NO: 2330964 - RNA, 22 nt, Human
cuuuuguucagggcugugaucg

SEQ ID NO: 2330965 - RNA, 20 nt, Human
cuuuguuauuuuuguuucuu

SEQ ID NO: 2330966 - RNA, 22 nt, Human
cuuuguuauuuuuguuucuucc

SEQ ID NO: 2330967 - RNA, 12 nt, Human
cuuuuguucuug

SEQ ID NO: 2330968 - RNA, 11 nt, Human
cuuuuguucuu

SEQ ID NO: 2330969 - RNA, 11 nt, Human
gaaaaggcagg

SEQ ID NO: 2330970 - RNA, 20 nt, Human
gaaaacguuuuauuguguuu

SEQ ID NO: 2330971 - RNA, 19 nt, Human
gaaaacguuuuauuguguu

SEQ ID NO: 2330972 - RNA, 15 nt, Human
gaaaaggaagacuag

SEQ ID NO: 2330973 - RNA, 13 nt, Human
gaaaaggaagacu

SEQ ID NO: 2330974 - RNA, 20 nt, Human
gaaaaggaagacuagaggcu

SEQ ID NO: 2330975 - RNA, 16 nt, Human
gaaaagugaaugcuca

SEQ ID NO: 2330976 - RNA, 17 nt, Human
gaaaacagacucagguu

SEQ ID NO: 2330977 - RNA, 21 nt, Human
gaaaacagaccuaaugcuccu

SEQ ID NO: 2330978 - RNA, 13 nt, Human
gaaaacagaccua

SEQ ID NO: 2330979 - RNA, 21 nt, Human
gaaaacagaacaucauuagaa

SEQ ID NO: 2330980 - RNA, 22 nt, Human
gaaaacacuguucucugcccuc

SEQ ID NO: 2330981 - RNA, 24 nt, Human
gaaaacacuguucucugcccucca

SEQ ID NO: 2330982 - RNA, 19 nt, Human
gaaaagcugcugacagugu

SEQ ID NO: 2330983 - RNA, 18 nt, Human
gaaaacguuuuauugugu

SEQ ID NO: 2330984 - RNA, 16 nt, Human
gaaaacguuuuauugu

SEQ ID NO: 2330985 - RNA, 14 nt, Human
gaaaacguuuuauu

SEQ ID NO: 2330986 - RNA, 19 nt, Human
gaaaacguggcugcuucaa

SEQ ID NO: 2330987 - RNA, 20 nt, Human
gaaaacguggcugcuucaag

SEQ ID NO: 2330988 - RNA, 22 nt, Human
gaaaacguggcugcuucaagga

SEQ ID NO: 2330989 - RNA, 17 nt, Human
gaaaauauuuugucuaa

SEQ ID NO: 2330990 - RNA, 18 nt, Human
gaaaauauuuugucuaaa

SEQ ID NO: 2330991 - RNA, 19 nt, Human
gaaaauauuuugucuaaaa

SEQ ID NO: 2330992 - RNA, 20 nt, Human
gaaaauauuuugucuaaaau

SEQ ID NO: 2330993 - RNA, 21 nt, Human
gaaaauauuuugucuaaaaug

SEQ ID NO: 2330994 - RNA, 13 nt, Human
gaaaauauuuaaa

SEQ ID NO: 2330995 - RNA, 18 nt, Human
gaaaauauuuguaucaca

SEQ ID NO: 2330996 - RNA, 21 nt, Human
gaaaauauuauguguuuccau

SEQ ID NO: 2330997 - RNA, 14 nt, Human
gaaaauaaaaaguu

SEQ ID NO: 2330998 - RNA, 16 nt, Human
gaaaauaaaaaaaaga

SEQ ID NO: 2330999 - RNA, 11 nt, Human
gaaaauaaaaa

SEQ ID NO: 2331000 - RNA, 12 nt, Human
gaaaaguucaua

SEQ ID NO: 2331001 - RNA, 21 nt, Human
gaaaauaaaaaaaagaaaaaa

SEQ ID NO: 2331002 - RNA, 19 nt, Human
gaaaauaaaaaaaagaaaa

SEQ ID NO: 2331003 - RNA, 18 nt, Human
gaaaauaaaaaaaagaaa

SEQ ID NO: 2331004 - RNA, 17 nt, Human
gaaaauaaaaaaaagaa

SEQ ID NO: 2331005 - RNA, 22 nt, Human
gaaaauaaaaaaaagaaaaaag

SEQ ID NO: 2331006 - RNA, 13 nt, Human
gaaaauaaaaagu

SEQ ID NO: 2331007 - RNA, 12 nt, Human
gaaaauaaaaag

SEQ ID NO: 2331008 - RNA, 22 nt, Human
gaaaaucagccugcuccagcug

SEQ ID NO: 2331009 - RNA, 20 nt, Human
gaaaaucagccugcuccagc

SEQ ID NO: 2331010 - RNA, 14 nt, Human
gaaaaucauauugc

SEQ ID NO: 2331011 - RNA, 18 nt, Human
gaaaauauuuuuuauaua

SEQ ID NO: 2331012 - RNA, 13 nt, Human
gaaaauccucugg

SEQ ID NO: 2331013 - RNA, 22 nt, Human
gaaaaucuacacuccagugaga

SEQ ID NO: 2331014 - RNA, 15 nt, Human
gaaaauccucuggcu

SEQ ID NO: 2331015 - RNA, 14 nt, Human
gaaaauccucuggc

SEQ ID NO: 2331016 - RNA, 14 nt, Human
gaaaaucuaauauu

SEQ ID NO: 2331017 - RNA, 20 nt, Human
gaaaaucuaauauuaaaaau

SEQ ID NO: 2331018 - RNA, 21 nt, Human
gaaaaucuaauauuaaaaaua

SEQ ID NO: 2331019 - RNA, 23 nt, Human
gaaaaucuaauauuaaaaauaug

SEQ ID NO: 2331020 - RNA, 13 nt, Human
gaaaaugaauaau

SEQ ID NO: 2331021 - RNA, 18 nt, Human
gaaaaucuuauaauuuaa

SEQ ID NO: 2331022 - RNA, 15 nt, Human
ccuuggacuugagga

SEQ ID NO: 2331023 - RNA, 18 nt, Human
ccuugaggaaacaacagc

SEQ ID NO: 2331024 - RNA, 14 nt, Human
ccuugagcugagau

SEQ ID NO: 2331025 - RNA, 12 nt, Human
ccuugagcugag

SEQ ID NO: 2331026 - RNA, 15 nt, Human
ccuuggacucauuuu

SEQ ID NO: 2331027 - RNA, 23 nt, Human
ccuuggauaaugcuguugccuca

SEQ ID NO: 2331028 - RNA, 22 nt, Human
ccuuggauaaugcuguugccuc

SEQ ID NO: 2331029 - RNA, 18 nt, Human
ccuuggauaaugcuguug

SEQ ID NO: 2331030 - RNA, 23 nt, Human
ccuuggagggucccaagcugggc

SEQ ID NO: 2331031 - RNA, 18 nt, Human
ccuuggaggcugucuucu

SEQ ID NO: 2331032 - RNA, 16 nt, Human
ccuuggaggccagcca

SEQ ID NO: 2331033 - RNA, 12 nt, Human
ccuuggaggcca

SEQ ID NO: 2331034 - RNA, 13 nt, Human
ccuuggacuugag

SEQ ID NO: 2331035 - RNA, 15 nt, Human
ccuuggauugucccc

SEQ ID NO: 2331036 - RNA, 13 nt, Human
ccuuggccucaga

SEQ ID NO: 2331037 - RNA, 11 nt, Human
ccuuggccuca

SEQ ID NO: 2331038 - RNA, 14 nt, Human
ccuuggccucagaa

SEQ ID NO: 2331039 - RNA, 19 nt, Human
ccuuggccugucucauccc

SEQ ID NO: 2331040 - RNA, 15 nt, Human
ccuuggccugucuca

SEQ ID NO: 2331041 - RNA, 22 nt, Human
ccuuggcucaaguccucuuuuc

SEQ ID NO: 2331042 - RNA, 14 nt, Human
ccuugagacagcuu

SEQ ID NO: 2331043 - RNA, 19 nt, Human
ccuugagaaaccuuauugu

SEQ ID NO: 2331044 - RNA, 23 nt, Human
ccuugaccagcagaucccagcuc

SEQ ID NO: 2331045 - RNA, 12 nt, Human
ccuugaccaggc

SEQ ID NO: 2331046 - RNA, 14 nt, Human
ccuugagaaaccuu

SEQ ID NO: 2331047 - RNA, 21 nt, Human
ccuugaccagcagaucccagc

SEQ ID NO: 2331048 - RNA, 20 nt, Human
ccuugaccagcagaucccag

SEQ ID NO: 2331049 - RNA, 12 nt, Human
ccuugaccagca

SEQ ID NO: 2331050 - RNA, 23 nt, Human
ccuugacauuguagagcuucugg

SEQ ID NO: 2331051 - RNA, 17 nt, Human
ccuugagcuccccaaaa

SEQ ID NO: 2331052 - RNA, 21 nt, Human
ccuugagagaccaggcaaagc

SEQ ID NO: 2331053 - RNA, 18 nt, Human
ccuugagagaccaggcaa

SEQ ID NO: 2331054 - RNA, 20 nt, Human
ccuugagagaccaggcaaag

SEQ ID NO: 2331055 - RNA, 21 nt, Human
ccuugagaguaucaggucucc

SEQ ID NO: 2331056 - RNA, 19 nt, Human
ccuugagaccucagccaug

SEQ ID NO: 2331057 - RNA, 16 nt, Human
ccuugagagaccaggc

SEQ ID NO: 2331058 - RNA, 18 nt, Human
ccuugagaccucagccau

SEQ ID NO: 2331059 - RNA, 17 nt, Human
ccuugagaccucagcca

SEQ ID NO: 2331060 - RNA, 16 nt, Human
ccuugagaccucagcc

SEQ ID NO: 2331061 - RNA, 14 nt, Human
ccuugagaccucag

SEQ ID NO: 2331062 - RNA, 16 nt, Human
ccuugagaccacaggg

SEQ ID NO: 2331063 - RNA, 11 nt, Human
ccuugagacca

SEQ ID NO: 2331064 - RNA, 18 nt, Human
ccuugacagggcacaccg

SEQ ID NO: 2331065 - RNA, 21 nt, Human
ccuugacagggcacaccgggc

SEQ ID NO: 2331066 - RNA, 17 nt, Human
ccuucucuccagccccu

SEQ ID NO: 2331067 - RNA, 18 nt, Human
ccuucucuccagccccug

SEQ ID NO: 2331068 - RNA, 17 nt, Human
ccuugggcugcuccuca

SEQ ID NO: 2331069 - RNA, 15 nt, Human
ccuugggcugcuccu

SEQ ID NO: 2331070 - RNA, 14 nt, Human
ccuugggcugcucc

SEQ ID NO: 2331071 - RNA, 14 nt, Human
ccuuggggagcagg

SEQ ID NO: 2331072 - RNA, 13 nt, Human
ccuugggcucccu

SEQ ID NO: 2331073 - RNA, 18 nt, Human
ccuugggcggcugagagc

SEQ ID NO: 2331074 - RNA, 18 nt, Human
ccuuggcuugcccacgug

SEQ ID NO: 2331075 - RNA, 12 nt, Human
ccuugggcuccc

SEQ ID NO: 2331076 - RNA, 14 nt, Human
ccuugggcggcuga

SEQ ID NO: 2331077 - RNA, 17 nt, Human
ccuugggcggcugagag

SEQ ID NO: 2331078 - RNA, 20 nt, Human
ccuuggcuucaggggagucc

SEQ ID NO: 2331079 - RNA, 13 nt, Human
ccuuggcuugccc

SEQ ID NO: 2331080 - RNA, 16 nt, Human
ccuuggcuugcccacg

SEQ ID NO: 2331081 - RNA, 15 nt, Human
ccuuggcuugcccac

SEQ ID NO: 2331082 - RNA, 12 nt, Human
ccuuggcuggug

SEQ ID NO: 2331083 - RNA, 13 nt, Human
ccuuggcuggugc

SEQ ID NO: 2331084 - RNA, 14 nt, Human
ccuuggcuggugca

SEQ ID NO: 2331085 - RNA, 21 nt, Human
ccuuggcugugaggccccugg

SEQ ID NO: 2331086 - RNA, 21 nt, Human
ccuuggcuguuggcagugagu

SEQ ID NO: 2331087 - RNA, 14 nt, Human
ccuuggcugcaggg

SEQ ID NO: 2331088 - RNA, 23 nt, Human
ccuuggccugucucauccccagg

SEQ ID NO: 2331089 - RNA, 22 nt, Human
ccuuggccugucucauccccag

SEQ ID NO: 2331090 - RNA, 16 nt, Human
ccuuggcugcagggag

SEQ ID NO: 2331091 - RNA, 21 nt, Human
ccuugguguccaccuggcccc

SEQ ID NO: 2331092 - RNA, 20 nt, Human
ccuugguguccaccuggccc

SEQ ID NO: 2331093 - RNA, 19 nt, Human
ccuugguguccaccuggcc

SEQ ID NO: 2331094 - RNA, 18 nt, Human
ccuugguguccaccuggc

SEQ ID NO: 2331095 - RNA, 17 nt, Human
ccuugguguccaccugg

SEQ ID NO: 2331096 - RNA, 16 nt, Human
ccuugguguccaccug

SEQ ID NO: 2331097 - RNA, 15 nt, Human
ccuugguguccaccu

SEQ ID NO: 2331098 - RNA, 18 nt, Human
ccuugguguaguugaacu

SEQ ID NO: 2331099 - RNA, 18 nt, Human
ccuugggcugcuccucau

SEQ ID NO: 2331100 - RNA, 17 nt, Human
ccuuggggaauuuccuc

SEQ ID NO: 2331101 - RNA, 22 nt, Human
ccuuggggaauuuccucuauug

SEQ ID NO: 2331102 - RNA, 23 nt, Human
ccuuggggaauuuccucuauuga

SEQ ID NO: 2331103 - RNA, 19 nt, Human
ccuuggugucgggcaugac

SEQ ID NO: 2331104 - RNA, 20 nt, Human
ccuuggugucgggcaugaca

SEQ ID NO: 2331105 - RNA, 17 nt, Human
ccuugguucccuugugu

SEQ ID NO: 2331106 - RNA, 16 nt, Human
ccuugguucccccacu

SEQ ID NO: 2331107 - RNA, 14 nt, Human
ccuuguauuuaaau

SEQ ID NO: 2331108 - RNA, 13 nt, Human
ccuuguauuuaaa

SEQ ID NO: 2331109 - RNA, 16 nt, Human
ccuuguaauucuaaau

SEQ ID NO: 2331110 - RNA, 19 nt, Human
ccuuguaauucuaaaugaa

SEQ ID NO: 2331111 - RNA, 19 nt, Human
ccuucucuccagccccugg

SEQ ID NO: 2331112 - RNA, 16 nt, Human
ccuuccagcacccugc

SEQ ID NO: 2331113 - RNA, 17 nt, Human
ccuuccagcacccugca

SEQ ID NO: 2331114 - RNA, 15 nt, Human
ccuucauuuccuccg

SEQ ID NO: 2331115 - RNA, 14 nt, Human
ccuucauuuccucc

SEQ ID NO: 2331116 - RNA, 23 nt, Human
ccuucauugccuuaacuggagcc

SEQ ID NO: 2331117 - RNA, 18 nt, Human
ccuucauuucaggaggga

SEQ ID NO: 2331118 - RNA, 19 nt, Human
ccuucauuucaggagggau

SEQ ID NO: 2331119 - RNA, 13 nt, Human
ccuucauuuccuc

SEQ ID NO: 2331120 - RNA, 12 nt, Human
ccuucauuuccu

SEQ ID NO: 2331121 - RNA, 20 nt, Human
ccuucauugccuuaacugga

SEQ ID NO: 2331122 - RNA, 15 nt, Human
ccuucaugcauggaa

SEQ ID NO: 2331123 - RNA, 21 nt, Human
ccuucauuaccuuuuuugaua

SEQ ID NO: 2331124 - RNA, 22 nt, Human
ccuguggggauuucucccagcu

SEQ ID NO: 2331125 - RNA, 20 nt, Human
ccugugggggaagagcacag

SEQ ID NO: 2331126 - RNA, 20 nt, Human
ccuguggggauuucucccag

SEQ ID NO: 2331127 - RNA, 19 nt, Human
ccuguggggauuucuccca

SEQ ID NO: 2331128 - RNA, 23 nt, Human
ccugugggggaagagcacagccc

SEQ ID NO: 2331129 - RNA, 21 nt, Human
ccugugggggaagagcacagc

SEQ ID NO: 2331130 - RNA, 22 nt, Human
ccugugggggaagagcacagcc

SEQ ID NO: 2331131 - RNA, 13 nt, Human
ccuguguaacagc

SEQ ID NO: 2331132 - RNA, 12 nt, Human
ccuguggugcaa

SEQ ID NO: 2331133 - RNA, 22 nt, Human
ccuguguaacagcuccuuggga

SEQ ID NO: 2331134 - RNA, 20 nt, Human
ccuguguaacagcuccuugg

SEQ ID NO: 2331135 - RNA, 21 nt, Human
ccuguguaacagcuccuuggg

SEQ ID NO: 2331136 - RNA, 15 nt, Human
ccuguguaacagcuc

SEQ ID NO: 2331137 - RNA, 16 nt, Human
ccuguguaacagcucc

SEQ ID NO: 2331138 - RNA, 17 nt, Human
ccuguguaacagcuccu

SEQ ID NO: 2331139 - RNA, 18 nt, Human
ccuguguaacagcuccuu

SEQ ID NO: 2331140 - RNA, 21 nt, Human
ccuucaugcauggaaauuccc

SEQ ID NO: 2331141 - RNA, 12 nt, Human
ccuucaugcaug

SEQ ID NO: 2331142 - RNA, 21 nt, Human
ccuguguaaucauuucuuggg

SEQ ID NO: 2331143 - RNA, 20 nt, Human
ccuguggcggugccugggug

SEQ ID NO: 2331144 - RNA, 11 nt, Human
ccuguggcucu

SEQ ID NO: 2331145 - RNA, 23 nt, Human
ccuguggcucuacaacugagucc

SEQ ID NO: 2331146 - RNA, 19 nt, Human
ccuguggcggugccugggu

SEQ ID NO: 2331147 - RNA, 18 nt, Human
ccuguggcggugccuggg

SEQ ID NO: 2331148 - RNA, 17 nt, Human
ccuguggcggugccugg

SEQ ID NO: 2331149 - RNA, 16 nt, Human
ccuguggcggugccug

SEQ ID NO: 2331150 - RNA, 15 nt, Human
ccuguggcggugccu

SEQ ID NO: 2331151 - RNA, 23 nt, Human
ccuguggccugugucccaugacc

SEQ ID NO: 2331152 - RNA, 22 nt, Human
ccuguggcgccgucuccagggg

SEQ ID NO: 2331153 - RNA, 20 nt, Human
ccugugggcccccaaaugga

SEQ ID NO: 2331154 - RNA, 14 nt, Human
ccugugggagccug

SEQ ID NO: 2331155 - RNA, 15 nt, Human
ccugugggagccugc

SEQ ID NO: 2331156 - RNA, 18 nt, Human
ccuguggggaucucaggg

SEQ ID NO: 2331157 - RNA, 20 nt, Human
ccuguggggaucucaggggc

SEQ ID NO: 2331158 - RNA, 22 nt, Human
ccuguggggaucucaggggcug

SEQ ID NO: 2331159 - RNA, 20 nt, Human
ccuguggaugauaaaacaca

SEQ ID NO: 2331160 - RNA, 18 nt, Human
ccuguggaucaaauccag

SEQ ID NO: 2331161 - RNA, 17 nt, Human
ccuguggagcccgcacc

SEQ ID NO: 2331162 - RNA, 20 nt, Human
ccuguggaugagcccucaga

SEQ ID NO: 2331163 - RNA, 21 nt, Human
ccuguggcgccgucuccaggg

SEQ ID NO: 2331164 - RNA, 19 nt, Human
ccuguggccugugucccau

SEQ ID NO: 2331165 - RNA, 21 nt, Human
ccuguggccugugucccauga

SEQ ID NO: 2331166 - RNA, 13 nt, Human
ccuguggccugug

SEQ ID NO: 2331167 - RNA, 14 nt, Human
ccuguggccugugu

SEQ ID NO: 2331168 - RNA, 15 nt, Human
ccuguggccuguguc

SEQ ID NO: 2331169 - RNA, 18 nt, Human
ccuguggccuguguccca

SEQ ID NO: 2331170 - RNA, 18 nt, Human
ccuguggagcccgcaccc

SEQ ID NO: 2331171 - RNA, 15 nt, Human
ccuguggagcccgca

SEQ ID NO: 2331172 - RNA, 14 nt, Human
ccuguggagacugg

SEQ ID NO: 2331173 - RNA, 21 nt, Human
ccugugcugcccgucuucagc

SEQ ID NO: 2331174 - RNA, 11 nt, Human
ccuguggagac

SEQ ID NO: 2331175 - RNA, 17 nt, Human
ccugugcuccgugccuc

SEQ ID NO: 2331176 - RNA, 18 nt, Human
ccugugcuccgugccucc

SEQ ID NO: 2331177 - RNA, 19 nt, Human
ccugugcuccgugccucca

SEQ ID NO: 2331178 - RNA, 20 nt, Human
ccugugcuccgugccuccac

SEQ ID NO: 2331179 - RNA, 21 nt, Human
ccugugcuccgugccuccacc

SEQ ID NO: 2331180 - RNA, 22 nt, Human
ccugugcuccgugccuccacca

SEQ ID NO: 2331181 - RNA, 18 nt, Human
ccugugcugacggaagcc

SEQ ID NO: 2331182 - RNA, 17 nt, Human
ccugugccuuuugccau

SEQ ID NO: 2331183 - RNA, 15 nt, Human
ccugugccugacccu

SEQ ID NO: 2331184 - RNA, 21 nt, Human
ccuguccucacugcucccuga

SEQ ID NO: 2331185 - RNA, 23 nt, Human
ccugugcuacuuugccuuuugca

SEQ ID NO: 2331186 - RNA, 16 nt, Human
ccuguccucacugcuc

SEQ ID NO: 2331187 - RNA, 15 nt, Human
ccugugcuacuuugc

SEQ ID NO: 2331188 - RNA, 17 nt, Human
ccugugcuacuuugccu

SEQ ID NO: 2331189 - RNA, 19 nt, Human
ccugugcuacuuugccuuu

SEQ ID NO: 2331190 - RNA, 16 nt, Human
ccugucccucucaggc

SEQ ID NO: 2331191 - RNA, 15 nt, Human
ccugucccucucagg

SEQ ID NO: 2331192 - RNA, 20 nt, Human
ccugucccucccaccucugu

SEQ ID NO: 2331193 - RNA, 21 nt, Human
ccugucccucccaccucugug

SEQ ID NO: 2331194 - RNA, 16 nt, Human
ccugucccucccaccu

SEQ ID NO: 2331195 - RNA, 17 nt, Human
ccugucccucccaccuc

SEQ ID NO: 2331196 - RNA, 18 nt, Human
ccugucccucccaccucu

SEQ ID NO: 2331197 - RNA, 19 nt, Human
ccugucccucccaccucug

SEQ ID NO: 2331198 - RNA, 23 nt, Human
ccugucccuucucuuaauuuaau

SEQ ID NO: 2331199 - RNA, 22 nt, Human
ccugucccucucaggcaugccu

SEQ ID NO: 2331200 - RNA, 20 nt, Human
ccugugccucugggacugga

SEQ ID NO: 2331201 - RNA, 13 nt, Human
ccuguccucacug

SEQ ID NO: 2331202 - RNA, 14 nt, Human
ccuguccucacugc

SEQ ID NO: 2331203 - RNA, 15 nt, Human
ccuguccucacugcu

SEQ ID NO: 2331204 - RNA, 12 nt, Human
ccuguccucacu

SEQ ID NO: 2331205 - RNA, 15 nt, Human
ccuucucucaucucu

SEQ ID NO: 2331206 - RNA, 16 nt, Human
ccuucucucaucucuu

SEQ ID NO: 2331207 - RNA, 17 nt, Human
ccuucucucaucucuua

SEQ ID NO: 2331208 - RNA, 21 nt, Human
ccuucucucaucucuuagcuc

SEQ ID NO: 2331209 - RNA, 15 nt, Human
ccuucuccucuugua

SEQ ID NO: 2331210 - RNA, 16 nt, Human
ccuucuccucuuguaa

SEQ ID NO: 2331211 - RNA, 21 nt, Human
ccuucuccuccccacccgccc

SEQ ID NO: 2331212 - RNA, 16 nt, Human
ccuucucccucauuuc

SEQ ID NO: 2331213 - RNA, 23 nt, Human
ccuucucccccccggggcugggu

SEQ ID NO: 2331214 - RNA, 14 nt, Human
ccuucucccccccg

SEQ ID NO: 2331215 - RNA, 16 nt, Human
ccuucucccccccggg

SEQ ID NO: 2331216 - RNA, 22 nt, Human
ccuucucccccccggggcuggg

SEQ ID NO: 2331217 - RNA, 12 nt, Human
ccuucucuccag

SEQ ID NO: 2331218 - RNA, 13 nt, Human
ccuucucuccagc

SEQ ID NO: 2331219 - RNA, 15 nt, Human
ccuucucuccagccc

SEQ ID NO: 2331220 - RNA, 16 nt, Human
ccuucucuccagcccc

SEQ ID NO: 2331221 - RNA, 16 nt, Human
ccuucucccacacugc

SEQ ID NO: 2331222 - RNA, 22 nt, Human
ccuucuccaucucucuggcccu

SEQ ID NO: 2331223 - RNA, 16 nt, Human
ccuucucccaccccug

SEQ ID NO: 2331224 - RNA, 14 nt, Human
ccuucucccaugag

SEQ ID NO: 2331225 - RNA, 14 nt, Human
ccuucucccacacu

SEQ ID NO: 2331226 - RNA, 21 nt, Human
ccuucucaucacuccccucca

SEQ ID NO: 2331227 - RNA, 14 nt, Human
ccuucuccaucucu

SEQ ID NO: 2331228 - RNA, 17 nt, Human
ccuucuccaucucucug

SEQ ID NO: 2331229 - RNA, 21 nt, Human
ccuucuccaucucucuggccc

SEQ ID NO: 2331230 - RNA, 22 nt, Human
ccuucuccauccacaugggagc

SEQ ID NO: 2331231 - RNA, 16 nt, Human
ccuucuccauccacau

SEQ ID NO: 2331232 - RNA, 13 nt, Human
ccuucuccaucca

SEQ ID NO: 2331233 - RNA, 11 nt, Human
ccuucuccauc

SEQ ID NO: 2331234 - RNA, 15 nt, Human
ccuucuccaaaugag

SEQ ID NO: 2331235 - RNA, 13 nt, Human
ccuucucaucacu

SEQ ID NO: 2331236 - RNA, 17 nt, Human
ccuucucaucacucccc

SEQ ID NO: 2331237 - RNA, 14 nt, Human
ccuucucagaaucu

SEQ ID NO: 2331238 - RNA, 22 nt, Human
ccuucuaaagguguugucccuu

SEQ ID NO: 2331239 - RNA, 19 nt, Human
ccuucguuuacuaugccug

SEQ ID NO: 2331240 - RNA, 17 nt, Human
ccuucguuuacuaugcc

SEQ ID NO: 2331241 - RNA, 14 nt, Human
ccuucuaaaggugu

SEQ ID NO: 2331242 - RNA, 13 nt, Human
ccuucuaaaggug

SEQ ID NO: 2331243 - RNA, 23 nt, Human
ccuucguuuacuaugccuguguc

SEQ ID NO: 2331244 - RNA, 22 nt, Human
ccuucguuuacuaugccugugu

SEQ ID NO: 2331245 - RNA, 20 nt, Human
ccuucguuuacuaugccugu

SEQ ID NO: 2331246 - RNA, 13 nt, Human
ccuuccaggcccc

SEQ ID NO: 2331247 - RNA, 17 nt, Human
ccuuccagcuccuguaa

SEQ ID NO: 2331248 - RNA, 23 nt, Human
ccuuccauagccuaaucccuggg

SEQ ID NO: 2331249 - RNA, 15 nt, Human
ccuuccaucccagag

SEQ ID NO: 2331250 - RNA, 15 nt, Human
ccuuccauaauuaug

SEQ ID NO: 2331251 - RNA, 12 nt, Human
ccuuccauaauu

SEQ ID NO: 2331252 - RNA, 11 nt, Human
ccuuccauaau

SEQ ID NO: 2331253 - RNA, 22 nt, Human
ccuuccaguguccuuagaacau

SEQ ID NO: 2331254 - RNA, 16 nt, Human
ccuuccagucaggaug

SEQ ID NO: 2331255 - RNA, 13 nt, Human
ccuuccaggggug

SEQ ID NO: 2331256 - RNA, 12 nt, Human
ccuuccagcucc

SEQ ID NO: 2331257 - RNA, 13 nt, Human
ccuuccagcuccu

SEQ ID NO: 2331258 - RNA, 15 nt, Human
ccuuccagcuccugu

SEQ ID NO: 2331259 - RNA, 16 nt, Human
ccuuccagcuccugua

SEQ ID NO: 2331260 - RNA, 19 nt, Human
ccuuccaucccuacccccu

SEQ ID NO: 2331261 - RNA, 12 nt, Human
ccuuccaucccu

SEQ ID NO: 2331262 - RNA, 17 nt, Human
ccuuccaucucgccacc

SEQ ID NO: 2331263 - RNA, 23 nt, Human
ccuuccauggugugaucgucuga

SEQ ID NO: 2331264 - RNA, 17 nt, Human
ccuuccauggacuuugu

SEQ ID NO: 2331265 - RNA, 18 nt, Human
ccuuccaugucgccucug

SEQ ID NO: 2331266 - RNA, 21 nt, Human
ccuuccuggagcccagaggag

SEQ ID NO: 2331267 - RNA, 20 nt, Human
ccuuccuggagacugcccag

SEQ ID NO: 2331268 - RNA, 17 nt, Human
ccuuccugucuuccugc

SEQ ID NO: 2331269 - RNA, 19 nt, Human
ccuuccugucuuccugcau

SEQ ID NO: 2331270 - RNA, 15 nt, Human
ccuuccuguucugaa

SEQ ID NO: 2331271 - RNA, 19 nt, Human
ccuuccuguuuuucacauu

SEQ ID NO: 2331272 - RNA, 17 nt, Human
ccuuccuguuuuucaca

SEQ ID NO: 2331273 - RNA, 19 nt, Human
ccuuccuggggcaucuggc

SEQ ID NO: 2331274 - RNA, 16 nt, Human
ccuuccugucccaccu

SEQ ID NO: 2331275 - RNA, 19 nt, Human
ccuuccugucccaccucuu

SEQ ID NO: 2331276 - RNA, 17 nt, Human
ccuucggccuccauccu

SEQ ID NO: 2331277 - RNA, 16 nt, Human
ccuucggccuccaucc

SEQ ID NO: 2331278 - RNA, 14 nt, Human
ccuuccuucccugg

SEQ ID NO: 2331279 - RNA, 16 nt, Human
ccuucgucuuucccau

SEQ ID NO: 2331280 - RNA, 17 nt, Human
ccuucgucuuucccaug

SEQ ID NO: 2331281 - RNA, 16 nt, Human
ccuucgggcugugccc

SEQ ID NO: 2331282 - RNA, 15 nt, Human
ccuucgggcugugcc

SEQ ID NO: 2331283 - RNA, 18 nt, Human
ccuucggccuccauccug

SEQ ID NO: 2331284 - RNA, 14 nt, Human
ccuucgggcugugc

SEQ ID NO: 2331285 - RNA, 17 nt, Human
ccuuccuguucugaacu

SEQ ID NO: 2331286 - RNA, 13 nt, Human
ccuuccuucccac

SEQ ID NO: 2331287 - RNA, 22 nt, Human
ccuuccuguuuuucacauuuuc

SEQ ID NO: 2331288 - RNA, 19 nt, Human
cgaauccccucccugucaa

SEQ ID NO: 2331289 - RNA, 22 nt, Human
cgaaucucuuuuugcuuucgaa

SEQ ID NO: 2331290 - RNA, 12 nt, Human
cgaaucucugug

SEQ ID NO: 2331291 - RNA, 16 nt, Human
cgaaucucugugccuu

SEQ ID NO: 2331292 - RNA, 15 nt, Human
cgaaugaucuuucuu

SEQ ID NO: 2331293 - RNA, 13 nt, Human
cgaaugugcaggu

SEQ ID NO: 2331294 - RNA, 21 nt, Human
cgaaugugcagguuuguuaca

SEQ ID NO: 2331295 - RNA, 18 nt, Human
cgagacuugguuucaaaa

SEQ ID NO: 2331296 - RNA, 16 nt, Human
cgaauuaauagcuuuu

SEQ ID NO: 2331297 - RNA, 22 nt, Human
cgaauuaauagcuuuuauugua

SEQ ID NO: 2331298 - RNA, 15 nt, Human
cgaauguguacaacu

SEQ ID NO: 2331299 - RNA, 23 nt, Human
cgaauguguacaacuuaaguugg

SEQ ID NO: 2331300 - RNA, 14 nt, Human
cgaauuaauagcuu

SEQ ID NO: 2331301 - RNA, 18 nt, Human
cgaaucagcuauuuacug

SEQ ID NO: 2331302 - RNA, 22 nt, Human
cgaaguggacuggccccugggu

SEQ ID NO: 2331303 - RNA, 21 nt, Human
cgaauauuaugcccaguuucu

SEQ ID NO: 2331304 - RNA, 19 nt, Human
cgaaguggacuggccccug

SEQ ID NO: 2331305 - RNA, 17 nt, Human
cgaaucauuuguucaaa

SEQ ID NO: 2331306 - RNA, 14 nt, Human
cgaaucauuuguuc

SEQ ID NO: 2331307 - RNA, 17 nt, Human
cgaaucuacuaauucca

SEQ ID NO: 2331308 - RNA, 18 nt, Human
cgaauccccucccuguca

SEQ ID NO: 2331309 - RNA, 15 nt, Human
cgaauauugcugaug

SEQ ID NO: 2331310 - RNA, 17 nt, Human
cgaauauugcugauggu

SEQ ID NO: 2331311 - RNA, 16 nt, Human
cgaauagcugggacua

SEQ ID NO: 2331312 - RNA, 11 nt, Human
cgaauauugcu

SEQ ID NO: 2331313 - RNA, 12 nt, Human
cgaauauugcug

SEQ ID NO: 2331314 - RNA, 14 nt, Human
cgaauauugcugau

SEQ ID NO: 2331315 - RNA, 17 nt, Human
cgaagcucagcccaccc

SEQ ID NO: 2331316 - RNA, 16 nt, Human
cgaagcucagcccacc

SEQ ID NO: 2331317 - RNA, 15 nt, Human
cgaagcucagcccac

SEQ ID NO: 2331318 - RNA, 23 nt, Human
cgaagcgcgccacucgcuucccc

SEQ ID NO: 2331319 - RNA, 13 nt, Human
cgaagcucagccc

SEQ ID NO: 2331320 - RNA, 18 nt, Human
cgaagcucagcccacccc

SEQ ID NO: 2331321 - RNA, 12 nt, Human
cgaagcucuggc

SEQ ID NO: 2331322 - RNA, 14 nt, Human
cgaagcucuggcug

SEQ ID NO: 2331323 - RNA, 15 nt, Human
cgaagcucuggcuga

SEQ ID NO: 2331324 - RNA, 23 nt, Human
cgaaggcagugcaagagacucug

SEQ ID NO: 2331325 - RNA, 20 nt, Human
cgaagcucuggcugaacccu

SEQ ID NO: 2331326 - RNA, 18 nt, Human
cgaagcuuugaaggccga

SEQ ID NO: 2331327 - RNA, 16 nt, Human
cgaaggugcuggaggu

SEQ ID NO: 2331328 - RNA, 13 nt, Human
cgaaggugcugga

SEQ ID NO: 2331329 - RNA, 13 nt, Human
cgaaggggcccug

SEQ ID NO: 2331330 - RNA, 15 nt, Human
cgaauagcugggacu

SEQ ID NO: 2331331 - RNA, 22 nt, Human
cgaacauggaacucauuccugc

SEQ ID NO: 2331332 - RNA, 20 nt, Human
cgaacauggaacucauuccu

SEQ ID NO: 2331333 - RNA, 16 nt, Human
cgaagcgcgccacucg

SEQ ID NO: 2331334 - RNA, 14 nt, Human
cgaagcccaggccc

SEQ ID NO: 2331335 - RNA, 11 nt, Human
cgaagcgcgcc

SEQ ID NO: 2331336 - RNA, 21 nt, Human
cgaacacccucgaagcgcgcc

SEQ ID NO: 2331337 - RNA, 18 nt, Human
cgaacacccucgaagcgc

SEQ ID NO: 2331338 - RNA, 22 nt, Human
cgaacacccucgaagcgcgcca

SEQ ID NO: 2331339 - RNA, 19 nt, Human
cgaacauccaaccuuccca

SEQ ID NO: 2331340 - RNA, 13 nt, Human
cgaaauguuauuu

SEQ ID NO: 2331341 - RNA, 14 nt, Human
cgaaauguuauuuu

SEQ ID NO: 2331342 - RNA, 22 nt, Human
cgaaauguuauuuuuuaauuau

SEQ ID NO: 2331343 - RNA, 23 nt, Human
cgaacauguuuuucuucucccuc

SEQ ID NO: 2331344 - RNA, 21 nt, Human
cgaacauguuuuucuucuccc

SEQ ID NO: 2331345 - RNA, 23 nt, Human
cgaaagggacuuggaagcuccgc

SEQ ID NO: 2331346 - RNA, 23 nt, Human
ccuuuuuugauaaaguuucucag

SEQ ID NO: 2331347 - RNA, 20 nt, Human
ccuuuuuuggcuuuagacac

SEQ ID NO: 2331348 - RNA, 11 nt, Human
cgaaauaacaa

SEQ ID NO: 2331349 - RNA, 16 nt, Human
cgaaauaacaauguua

SEQ ID NO: 2331350 - RNA, 17 nt, Human
cgaaauaacaauguuaa

SEQ ID NO: 2331351 - RNA, 20 nt, Human
cgaaauaacaauguuaagga

SEQ ID NO: 2331352 - RNA, 17 nt, Human
ccuuuuuuggcugcuga

SEQ ID NO: 2331353 - RNA, 18 nt, Human
ccuuuuuuggcugcugaa

SEQ ID NO: 2331354 - RNA, 20 nt, Human
ccuuuuuuggcugcugaagg

SEQ ID NO: 2331355 - RNA, 22 nt, Human
ccuuuuuuggcugcugaaggcu

SEQ ID NO: 2331356 - RNA, 21 nt, Human
ccuugucguugacuuuaggga

SEQ ID NO: 2331357 - RNA, 21 nt, Human
ccuuguauuuaaauauuaaau

SEQ ID NO: 2331358 - RNA, 16 nt, Human
ccuuguauuuaaauau

SEQ ID NO: 2331359 - RNA, 13 nt, Human
ccuugucugagau

SEQ ID NO: 2331360 - RNA, 18 nt, Human
ccuugugccuggcucaga

SEQ ID NO: 2331361 - RNA, 17 nt, Human
ccuugugccuggcucag

SEQ ID NO: 2331362 - RNA, 16 nt, Human
ccuuguggccugggcc

SEQ ID NO: 2331363 - RNA, 22 nt, Human
ccuuguggccugggccuccuca

SEQ ID NO: 2331364 - RNA, 23 nt, Human
ccuugugauguggcaauaaauuu

SEQ ID NO: 2331365 - RNA, 11 nt, Human
ccuugugccug

SEQ ID NO: 2331366 - RNA, 16 nt, Human
ccuugugccuggcuca

SEQ ID NO: 2331367 - RNA, 18 nt, Human
ccuuuggggggggcccgc

SEQ ID NO: 2331368 - RNA, 14 nt, Human
ccuuugguucuggc

SEQ ID NO: 2331369 - RNA, 21 nt, Human
ccuuuguaaauugucagaugc

SEQ ID NO: 2331370 - RNA, 20 nt, Human
ccuuugguucuggccagaau

SEQ ID NO: 2331371 - RNA, 15 nt, Human
ccuuugguucuggcc

SEQ ID NO: 2331372 - RNA, 19 nt, Human
ccuuugggaggcugaggcg

SEQ ID NO: 2331373 - RNA, 14 nt, Human
ccuuugggaagggg

SEQ ID NO: 2331374 - RNA, 14 nt, Human
ccuuugggcccagg

SEQ ID NO: 2331375 - RNA, 16 nt, Human
ccuuugggcccaggga

SEQ ID NO: 2331376 - RNA, 17 nt, Human
ccuuugggcccagggac

SEQ ID NO: 2331377 - RNA, 18 nt, Human
ccuuugucaucuuucuuc

SEQ ID NO: 2331378 - RNA, 19 nt, Human
ccuuugucaucauuguaua

SEQ ID NO: 2331379 - RNA, 23 nt, Human
ccuuugucaucauuguauauaug

SEQ ID NO: 2331380 - RNA, 14 nt, Human
ccuuugucccagaa

SEQ ID NO: 2331381 - RNA, 14 nt, Human
ccuuuguccccacc

SEQ ID NO: 2331382 - RNA, 16 nt, Human
ccuuuguccccaccgc

SEQ ID NO: 2331383 - RNA, 18 nt, Human
ccuuuguccccaccgcag

SEQ ID NO: 2331384 - RNA, 16 nt, Human
ccuuugguuuuuuucu

SEQ ID NO: 2331385 - RNA, 23 nt, Human
ccuuuguaaauugucagaugcug

SEQ ID NO: 2331386 - RNA, 24 nt, Human
ccuuuguauucucuccuguaccuc

SEQ ID NO: 2331387 - RNA, 23 nt, Human
ccuuuguauucucuccuguaccu

SEQ ID NO: 2331388 - RNA, 22 nt, Human
ccuuuguauucucuccuguacc

SEQ ID NO: 2331389 - RNA, 19 nt, Human
ccuuuguuuuuuuuuccug

SEQ ID NO: 2331390 - RNA, 19 nt, Human
ccuuuguuuuuaugaagaa

SEQ ID NO: 2331391 - RNA, 23 nt, Human
ccuuuguuuugauguuuguggcc

SEQ ID NO: 2331392 - RNA, 13 nt, Human
ccuuuguguuucu

SEQ ID NO: 2331393 - RNA, 12 nt, Human
ccuuugugcugu

SEQ ID NO: 2331394 - RNA, 13 nt, Human
ccuuugugcugug

SEQ ID NO: 2331395 - RNA, 18 nt, Human
ccuuuuaacaccugaugu

SEQ ID NO: 2331396 - RNA, 19 nt, Human
ccuuuuuuauacauaaaca

SEQ ID NO: 2331397 - RNA, 20 nt, Human
ccuuuguuuuuaugaagaaa

SEQ ID NO: 2331398 - RNA, 22 nt, Human
ccuuuuuuauuuuuuuaagcug

SEQ ID NO: 2331399 - RNA, 22 nt, Human
ccuuuuuucacggaaguuuuca

SEQ ID NO: 2331400 - RNA, 15 nt, Human
ccuuuuuuggcugcu

SEQ ID NO: 2331401 - RNA, 12 nt, Human
ccuuuuuugauc

SEQ ID NO: 2331402 - RNA, 13 nt, Human
ccuuuuuugauca

SEQ ID NO: 2331403 - RNA, 23 nt, Human
ccuuugucaucuuucuucuauuu

SEQ ID NO: 2331404 - RNA, 14 nt, Human
ccuuugucuuguca

SEQ ID NO: 2331405 - RNA, 14 nt, Human
ccuuugugaggaag

SEQ ID NO: 2331406 - RNA, 22 nt, Human
ccuuuguccccaccgcagacag

SEQ ID NO: 2331407 - RNA, 23 nt, Human
ccuuuguccccaccgcagacagg

SEQ ID NO: 2331408 - RNA, 15 nt, Human
ccuuugugaggaagc

SEQ ID NO: 2331409 - RNA, 16 nt, Human
ccuuugugaggaagcc

SEQ ID NO: 2331410 - RNA, 17 nt, Human
ccuuugugaggaagccg

SEQ ID NO: 2331411 - RNA, 23 nt, Human
ccuuugugaggaagccgcugggg

SEQ ID NO: 2331412 - RNA, 20 nt, Human
cggcccuccuacccugcgcc

SEQ ID NO: 2331413 - RNA, 23 nt, Human
cggcccuccuacccugcgcccag

SEQ ID NO: 2331414 - RNA, 22 nt, Human
cggcccuccuacccugcgccca

SEQ ID NO: 2331415 - RNA, 13 nt, Human
cggcccugggcuc

SEQ ID NO: 2331416 - RNA, 18 nt, Human
cggcccugggcucggagg

SEQ ID NO: 2331417 - RNA, 12 nt, Human
cggcccuggggc

SEQ ID NO: 2331418 - RNA, 11 nt, Human
cggcccugggg

SEQ ID NO: 2331419 - RNA, 22 nt, Human
cggcccugggcucggaggcugc

SEQ ID NO: 2331420 - RNA, 18 nt, Human
cggccgcauucccugagu

SEQ ID NO: 2331421 - RNA, 15 nt, Human
cggccgcauucccug

SEQ ID NO: 2331422 - RNA, 13 nt, Human
cggccgcauuccc

SEQ ID NO: 2331423 - RNA, 16 nt, Human
cggccgcauucccuga

SEQ ID NO: 2331424 - RNA, 12 nt, Human
cggccgcuccag

SEQ ID NO: 2331425 - RNA, 15 nt, Human
cggccucccaaagug

SEQ ID NO: 2331426 - RNA, 21 nt, Human
cggccuccguccaggagccug

SEQ ID NO: 2331427 - RNA, 22 nt, Human
cggccuccguccaggagccugg

SEQ ID NO: 2331428 - RNA, 16 nt, Human
cggccugaugcucccu

SEQ ID NO: 2331429 - RNA, 15 nt, Human
cggccugaugcuccc

SEQ ID NO: 2331430 - RNA, 21 nt, Human
cggccucucuggccucccacc

SEQ ID NO: 2331431 - RNA, 14 nt, Human
cggcuggcagccca

SEQ ID NO: 2331432 - RNA, 13 nt, Human
cggccucuaaccc

SEQ ID NO: 2331433 - RNA, 15 nt, Human
cggccucuaacccca

SEQ ID NO: 2331434 - RNA, 17 nt, Human
cggccucuaaccccagg

SEQ ID NO: 2331435 - RNA, 18 nt, Human
cggccucuaaccccaggc

SEQ ID NO: 2331436 - RNA, 19 nt, Human
cggccucuaaccccaggcc

SEQ ID NO: 2331437 - RNA, 20 nt, Human
cggccucuaaccccaggccc

SEQ ID NO: 2331438 - RNA, 21 nt, Human
cggccucuaaccccaggcccc

SEQ ID NO: 2331439 - RNA, 22 nt, Human
cggccucuaaccccaggccccg

SEQ ID NO: 2331440 - RNA, 13 nt, Human
cggccucucuggc

SEQ ID NO: 2331441 - RNA, 14 nt, Human
cggccucucuggcc

SEQ ID NO: 2331442 - RNA, 15 nt, Human
cggccucucuggccu

SEQ ID NO: 2331443 - RNA, 16 nt, Human
cggccucucuggccuc

SEQ ID NO: 2331444 - RNA, 18 nt, Human
cggccucucuggccuccc

SEQ ID NO: 2331445 - RNA, 19 nt, Human
cggccucucuggccuccca

SEQ ID NO: 2331446 - RNA, 23 nt, Human
cggaucaccgagaguagccgaga

SEQ ID NO: 2331447 - RNA, 18 nt, Human
cggaucaccgagaguagc

SEQ ID NO: 2331448 - RNA, 13 nt, Human
cggaguugggggu

SEQ ID NO: 2331449 - RNA, 19 nt, Human
cggagugagaagcuuugcc

SEQ ID NO: 2331450 - RNA, 23 nt, Human
cggagugaagaggggcagcccuu

SEQ ID NO: 2331451 - RNA, 18 nt, Human
cggagugaagaggggcag

SEQ ID NO: 2331452 - RNA, 19 nt, Human
cggagugaagaggggcagc

SEQ ID NO: 2331453 - RNA, 20 nt, Human
cggagugaagaggggcagcc

SEQ ID NO: 2331454 - RNA, 22 nt, Human
cggagugaagaggggcagcccu

SEQ ID NO: 2331455 - RNA, 11 nt, Human
cggccaggcca

SEQ ID NO: 2331456 - RNA, 22 nt, Human
cggccagccccuggccccagga

SEQ ID NO: 2331457 - RNA, 18 nt, Human
cggcccuaccagcgcccg

SEQ ID NO: 2331458 - RNA, 21 nt, Human
cggcccuaccagcgcccgcug

SEQ ID NO: 2331459 - RNA, 20 nt, Human
cggcccuaccagcgcccgcu

SEQ ID NO: 2331460 - RNA, 14 nt, Human
cggcccuaugcaug

SEQ ID NO: 2331461 - RNA, 12 nt, Human
cggccaggccag

SEQ ID NO: 2331462 - RNA, 20 nt, Human
cggccaggccagagggagug

SEQ ID NO: 2331463 - RNA, 12 nt, Human
cgggaagcggag

SEQ ID NO: 2331464 - RNA, 23 nt, Human
cgggaagagaggaguucaaugau

SEQ ID NO: 2331465 - RNA, 24 nt, Human
cgggaagagaggaguucaaugauc

SEQ ID NO: 2331466 - RNA, 18 nt, Human
cgggaagagaggaguuca

SEQ ID NO: 2331467 - RNA, 19 nt, Human
cgggaagagaggaguucaa

SEQ ID NO: 2331468 - RNA, 20 nt, Human
cgggaagagaggaguucaau

SEQ ID NO: 2331469 - RNA, 22 nt, Human
cgggaagagaggaguucaauga

SEQ ID NO: 2331470 - RNA, 16 nt, Human
cgggaagggggcuggg

SEQ ID NO: 2331471 - RNA, 19 nt, Human
cgggaagggggcugggaca

SEQ ID NO: 2331472 - RNA, 20 nt, Human
cgggaagggggcugggacau

SEQ ID NO: 2331473 - RNA, 23 nt, Human
cgggaaggaggguuagggagggg

SEQ ID NO: 2331474 - RNA, 23 nt, Human
cgggaagcaucuuccagaagugu

SEQ ID NO: 2331475 - RNA, 16 nt, Human
cgggaaggucaccagc

SEQ ID NO: 2331476 - RNA, 14 nt, Human
cgggaaggaggguu

SEQ ID NO: 2331477 - RNA, 12 nt, Human
cgggaaggaggg

SEQ ID NO: 2331478 - RNA, 18 nt, Human
cgggaauuuucaucuagg

SEQ ID NO: 2331479 - RNA, 17 nt, Human
cgggaaggucaccagca

SEQ ID NO: 2331480 - RNA, 15 nt, Human
cgggacaccugcccu

SEQ ID NO: 2331481 - RNA, 20 nt, Human
cgggaaggucaccagcacca

SEQ ID NO: 2331482 - RNA, 15 nt, Human
cgggaacagacaaca

SEQ ID NO: 2331483 - RNA, 14 nt, Human
cgggaaagaagagc

SEQ ID NO: 2331484 - RNA, 20 nt, Human
cgggaaagccagugacucca

SEQ ID NO: 2331485 - RNA, 22 nt, Human
cgggaaaagcagcccuuggcca

SEQ ID NO: 2331486 - RNA, 23 nt, Human
cgggaaaagcagcccuuggccag

SEQ ID NO: 2331487 - RNA, 16 nt, Human
cggcuuuucucagcug

SEQ ID NO: 2331488 - RNA, 19 nt, Human
cggcuucaugccagcuacu

SEQ ID NO: 2331489 - RNA, 22 nt, Human
cgggaacaguguuucccauaau

SEQ ID NO: 2331490 - RNA, 13 nt, Human
cgggaacaguguu

SEQ ID NO: 2331491 - RNA, 22 nt, Human
cgggaaagccagugacuccagg

SEQ ID NO: 2331492 - RNA, 20 nt, Human
cgggaacaguguuucccaua

SEQ ID NO: 2331493 - RNA, 14 nt, Human
cgggaaccucacuc

SEQ ID NO: 2331494 - RNA, 20 nt, Human
cgggaaccucacucuugcca

SEQ ID NO: 2331495 - RNA, 12 nt, Human
cgggaagagagg

SEQ ID NO: 2331496 - RNA, 14 nt, Human
cgggaagagaggag

SEQ ID NO: 2331497 - RNA, 23 nt, Human
cggcuggcagcccaccccucaac

SEQ ID NO: 2331498 - RNA, 13 nt, Human
cggcuggccuggc

SEQ ID NO: 2331499 - RNA, 17 nt, Human
cggccugaugcucccuc

SEQ ID NO: 2331500 - RNA, 20 nt, Human
cggccucucuggccucccac

SEQ ID NO: 2331501 - RNA, 14 nt, Human
cggcuggccuggcc

SEQ ID NO: 2331502 - RNA, 23 nt, Human
cggcuuagacuucgacucaggau

SEQ ID NO: 2331503 - RNA, 15 nt, Human
cggcuucaugccagc

SEQ ID NO: 2331504 - RNA, 16 nt, Human
cggcuucaugccagcu

SEQ ID NO: 2331505 - RNA, 20 nt, Human
cgggaauuuucaucuaggau

SEQ ID NO: 2331506 - RNA, 15 nt, Human
cgcggggacauuggg

SEQ ID NO: 2331507 - RNA, 22 nt, Human
cgcgaaaguaucaccagggugc

SEQ ID NO: 2331508 - RNA, 16 nt, Human
cgcguuguaaaauaua

SEQ ID NO: 2331509 - RNA, 17 nt, Human
cgcguuguaaaauauag

SEQ ID NO: 2331510 - RNA, 15 nt, Human
cgcuaaagagcccuu

SEQ ID NO: 2331511 - RNA, 19 nt, Human
cgcuaaagagcccuugccu

SEQ ID NO: 2331512 - RNA, 21 nt, Human
cgcuaaagagcccuugccucc

SEQ ID NO: 2331513 - RNA, 18 nt, Human
cgcuacccgggaaggggg

SEQ ID NO: 2331514 - RNA, 22 nt, Human
cgcuaaagagcccuugccuccc

SEQ ID NO: 2331515 - RNA, 17 nt, Human
cgcuacccgggaagggg

SEQ ID NO: 2331516 - RNA, 21 nt, Human
cgcuacccgggaagggggcug

SEQ ID NO: 2331517 - RNA, 24 nt, Human
cgcuacccgggaagggggcuggga

SEQ ID NO: 2331518 - RNA, 19 nt, Human
cgcgguggcucacgccugu

SEQ ID NO: 2331519 - RNA, 23 nt, Human
cgcgggagccaugcgcccccucc

SEQ ID NO: 2331520 - RNA, 15 nt, Human
cgcgacaaugcaaac

SEQ ID NO: 2331521 - RNA, 13 nt, Human
cgccuuucccagg

SEQ ID NO: 2331522 - RNA, 12 nt, Human
cgccuuguucuu

SEQ ID NO: 2331523 - RNA, 14 nt, Human
cgccuuucccaacu

SEQ ID NO: 2331524 - RNA, 19 nt, Human
cgccuucucccccccgggg

SEQ ID NO: 2331525 - RNA, 14 nt, Human
cgcgacaaugcaaa

SEQ ID NO: 2331526 - RNA, 12 nt, Human
cgcccguccugc

SEQ ID NO: 2331527 - RNA, 14 nt, Human
cgcccguccugccu

SEQ ID NO: 2331528 - RNA, 13 nt, Human
cgccuucuccccc

SEQ ID NO: 2331529 - RNA, 21 nt, Human
cgccuucucccccccggggcu

SEQ ID NO: 2331530 - RNA, 15 nt, Human
cgcccguccugccug

SEQ ID NO: 2331531 - RNA, 12 nt, Human
cgcccaaggccc

SEQ ID NO: 2331532 - RNA, 18 nt, Human
cgcccaacuaauuuuugu

SEQ ID NO: 2331533 - RNA, 17 nt, Human
cgcccaaagccagacag

SEQ ID NO: 2331534 - RNA, 14 nt, Human
cgcccaacccuucc

SEQ ID NO: 2331535 - RNA, 15 nt, Human
cgcccaacccuuccc

SEQ ID NO: 2331536 - RNA, 16 nt, Human
cgcccaacccuucccc

SEQ ID NO: 2331537 - RNA, 13 nt, Human
cgcccagucugga

SEQ ID NO: 2331538 - RNA, 19 nt, Human
cgcccagucuggaaugcag

SEQ ID NO: 2331539 - RNA, 21 nt, Human
cgcccagucuggaaugcagug

SEQ ID NO: 2331540 - RNA, 13 nt, Human
cgccccuuccccc

SEQ ID NO: 2331541 - RNA, 14 nt, Human
cgcccgcccacugu

SEQ ID NO: 2331542 - RNA, 16 nt, Human
cgcccgcccacugucc

SEQ ID NO: 2331543 - RNA, 18 nt, Human
cgcccgcccacuguccug

SEQ ID NO: 2331544 - RNA, 19 nt, Human
cgcccgcccacuguccugg

SEQ ID NO: 2331545 - RNA, 21 nt, Human
cgcccgcccacuguccugggc

SEQ ID NO: 2331546 - RNA, 13 nt, Human
cgcccgcgcccgc

SEQ ID NO: 2331547 - RNA, 12 nt, Human
cgcccgcgcccu

SEQ ID NO: 2331548 - RNA, 18 nt, Human
cgcccggcuaauuuuugu

SEQ ID NO: 2331549 - RNA, 13 nt, Human
cgcccgcugggcu

SEQ ID NO: 2331550 - RNA, 14 nt, Human
cgcccgcugggcug

SEQ ID NO: 2331551 - RNA, 16 nt, Human
cgcccgcugggcugag

SEQ ID NO: 2331552 - RNA, 23 nt, Human
cgcccgcugggcugagccccuac

SEQ ID NO: 2331553 - RNA, 12 nt, Human
cgcagccaaggc

SEQ ID NO: 2331554 - RNA, 13 nt, Human
cgcagccaaggcc

SEQ ID NO: 2331555 - RNA, 13 nt, Human
cgcagcccugcuu

SEQ ID NO: 2331556 - RNA, 15 nt, Human
cgcagcccugcuuug

SEQ ID NO: 2331557 - RNA, 24 nt, Human
cgcagcccugcuuugggcugcccu

SEQ ID NO: 2331558 - RNA, 18 nt, Human
cgcagcccugcagagggc

SEQ ID NO: 2331559 - RNA, 19 nt, Human
cgcagcccugcagagggca

SEQ ID NO: 2331560 - RNA, 12 nt, Human
cgcaggaagcug

SEQ ID NO: 2331561 - RNA, 18 nt, Human
cgccauucucaagcccug

SEQ ID NO: 2331562 - RNA, 14 nt, Human
cgccauugccacca

SEQ ID NO: 2331563 - RNA, 15 nt, Human
cgccauugcacucca

SEQ ID NO: 2331564 - RNA, 20 nt, Human
cgccauggcuuccaaggugg

SEQ ID NO: 2331565 - RNA, 17 nt, Human
cgccauugccaccagga

SEQ ID NO: 2331566 - RNA, 16 nt, Human
cgccauugccaccagg

SEQ ID NO: 2331567 - RNA, 18 nt, Human
cgccauugccaccaggag

SEQ ID NO: 2331568 - RNA, 19 nt, Human
cgccauugcacuccagccu

SEQ ID NO: 2331569 - RNA, 16 nt, Human
cgcagccucccucuga

SEQ ID NO: 2331570 - RNA, 20 nt, Human
cgagaggggaagaguguacu

SEQ ID NO: 2331571 - RNA, 21 nt, Human
cgcagccaaggccgaagcucu

SEQ ID NO: 2331572 - RNA, 13 nt, Human
cgcagcucuugcc

SEQ ID NO: 2331573 - RNA, 17 nt, Human
cgcagcucuugcccuuc

SEQ ID NO: 2331574 - RNA, 18 nt, Human
cgcagcucuugcccuucc

SEQ ID NO: 2331575 - RNA, 19 nt, Human
cgcagcucuugcccuuccc

SEQ ID NO: 2331576 - RNA, 23 nt, Human
cgcagcucuugcccuucccuguc

SEQ ID NO: 2331577 - RNA, 20 nt, Human
cgcagcucuugcccuucccu

SEQ ID NO: 2331578 - RNA, 15 nt, Human
cgcaggaacucccag

SEQ ID NO: 2331579 - RNA, 17 nt, Human
cgcaggaacucccagca

SEQ ID NO: 2331580 - RNA, 18 nt, Human
cgcaggaacucccagcaa

SEQ ID NO: 2331581 - RNA, 18 nt, Human
cggaauccuguccucagc

SEQ ID NO: 2331582 - RNA, 17 nt, Human
cggaauccuguccucag

SEQ ID NO: 2331583 - RNA, 16 nt, Human
cggacuuagcugggag

SEQ ID NO: 2331584 - RNA, 21 nt, Human
cggacagccacggccaggcca

SEQ ID NO: 2331585 - RNA, 22 nt, Human
cggacagccacggccaggccag

SEQ ID NO: 2331586 - RNA, 17 nt, Human
cggacuuagcugggaga

SEQ ID NO: 2331587 - RNA, 14 nt, Human
cggacuuuucugca

SEQ ID NO: 2331588 - RNA, 15 nt, Human
cggacuuuucugcaa

SEQ ID NO: 2331589 - RNA, 15 nt, Human
cggagaaaggaaggg

SEQ ID NO: 2331590 - RNA, 17 nt, Human
cggagaaaggaagggcu

SEQ ID NO: 2331591 - RNA, 16 nt, Human
cggacuuuucugcaaa

SEQ ID NO: 2331592 - RNA, 22 nt, Human
cggagucguggggugugcuggg

SEQ ID NO: 2331593 - RNA, 23 nt, Human
cggagucguggggugugcuggga

SEQ ID NO: 2331594 - RNA, 14 nt, Human
cggagugaagaggg

SEQ ID NO: 2331595 - RNA, 15 nt, Human
cggaauccuguccuc

SEQ ID NO: 2331596 - RNA, 13 nt, Human
cgcuuucuaugua

SEQ ID NO: 2331597 - RNA, 22 nt, Human
cgcuuucuggaaaagaggaguu

SEQ ID NO: 2331598 - RNA, 20 nt, Human
cggacagccacggccaggcc

SEQ ID NO: 2331599 - RNA, 21 nt, Human
cggaaucacucuguccuugga

SEQ ID NO: 2331600 - RNA, 16 nt, Human
cggaauaguuggcuag

SEQ ID NO: 2331601 - RNA, 17 nt, Human
cggaauaguuggcuagg

SEQ ID NO: 2331602 - RNA, 17 nt, Human
cgcuucugaaugcugcu

SEQ ID NO: 2331603 - RNA, 20 nt, Human
cgcuugugcagaaaacauug

SEQ ID NO: 2331604 - RNA, 14 nt, Human
cgcuuuccugaauc

SEQ ID NO: 2331605 - RNA, 16 nt, Human
cgcuuucuagcuguug

SEQ ID NO: 2331606 - RNA, 22 nt, Human
cgcuuucuagcuguugagcugu

SEQ ID NO: 2331607 - RNA, 16 nt, Human
cgcuuucuacccagcg

SEQ ID NO: 2331608 - RNA, 14 nt, Human
cgcuuucuacccag

SEQ ID NO: 2331609 - RNA, 16 nt, Human
cgcuucuugccucugu

SEQ ID NO: 2331610 - RNA, 17 nt, Human
cgcuucuugccucugug

SEQ ID NO: 2331611 - RNA, 22 nt, Human
cgcuugugcagaaaacauuguu

SEQ ID NO: 2331612 - RNA, 19 nt, Human
cgcuccccgccuguucccc

SEQ ID NO: 2331613 - RNA, 18 nt, Human
cgcuccugccgcagagcu

SEQ ID NO: 2331614 - RNA, 22 nt, Human
cgcuccucccucugaggcugua

SEQ ID NO: 2331615 - RNA, 19 nt, Human
cgcuccugccgcagagcug

SEQ ID NO: 2331616 - RNA, 20 nt, Human
cgcuccugccgcagagcugg

SEQ ID NO: 2331617 - RNA, 14 nt, Human
cgcucccagugucu

SEQ ID NO: 2331618 - RNA, 21 nt, Human
cgcucccagugucuuccugug

SEQ ID NO: 2331619 - RNA, 22 nt, Human
cgcucccagugucuuccugugg

SEQ ID NO: 2331620 - RNA, 14 nt, Human
cgcuccccgccugu

SEQ ID NO: 2331621 - RNA, 16 nt, Human
cgcuccccgccuguuc

SEQ ID NO: 2331622 - RNA, 17 nt, Human
cgcuccccgccuguucc

SEQ ID NO: 2331623 - RNA, 18 nt, Human
cgcuccccgccuguuccc

SEQ ID NO: 2331624 - RNA, 14 nt, Human
cgcuccugucugcc

SEQ ID NO: 2331625 - RNA, 16 nt, Human
cgcugucuccagaccc

SEQ ID NO: 2331626 - RNA, 11 nt, Human
cgcugugcugc

SEQ ID NO: 2331627 - RNA, 13 nt, Human
cgcugugcugccc

SEQ ID NO: 2331628 - RNA, 14 nt, Human
cgcugugcugcccu

SEQ ID NO: 2331629 - RNA, 22 nt, Human
cgcugucuccagacccccaccc

SEQ ID NO: 2331630 - RNA, 20 nt, Human
cgcugucuccagacccccac

SEQ ID NO: 2331631 - RNA, 16 nt, Human
cgcugugagccccugg

SEQ ID NO: 2331632 - RNA, 19 nt, Human
cgcugugagccccuggucc

SEQ ID NO: 2331633 - RNA, 19 nt, Human
cgcugugcugcccugccca

SEQ ID NO: 2331634 - RNA, 21 nt, Human
cgcugugcugcccugcccacc

SEQ ID NO: 2331635 - RNA, 23 nt, Human
cgcugugcugcccugcccaccug

SEQ ID NO: 2331636 - RNA, 12 nt, Human
cgcuucugacug

SEQ ID NO: 2331637 - RNA, 15 nt, Human
cgcuucuugccucug

SEQ ID NO: 2331638 - RNA, 14 nt, Human
cgcuucugccugca

SEQ ID NO: 2331639 - RNA, 20 nt, Human
cgcuucccccauagccaccc

SEQ ID NO: 2331640 - RNA, 18 nt, Human
cgcuucccccauagccac

SEQ ID NO: 2331641 - RNA, 17 nt, Human
cgcuuccggcuccugug

SEQ ID NO: 2331642 - RNA, 20 nt, Human
cgcuuccggcuccugugcuu

SEQ ID NO: 2331643 - RNA, 14 nt, Human
cgcugugggcaggu

SEQ ID NO: 2331644 - RNA, 20 nt, Human
cgcuguguguuaguucccaa

SEQ ID NO: 2331645 - RNA, 13 nt, Human
cgcuguugcugaa

SEQ ID NO: 2331646 - RNA, 14 nt, Human
cgcuguugcugaau

SEQ ID NO: 2331647 - RNA, 17 nt, Human
cgcuguugcugaauagg

SEQ ID NO: 2331648 - RNA, 16 nt, Human
cgcuucccccauagcc

SEQ ID NO: 2331649 - RNA, 13 nt, Human
cgcuucccccaua

SEQ ID NO: 2331650 - RNA, 14 nt, Human
cgcuguucacccac

SEQ ID NO: 2331651 - RNA, 17 nt, Human
cgcuuaaaggugucuuc

SEQ ID NO: 2331652 - RNA, 17 nt, Human
cgaggagguaaugaauu

SEQ ID NO: 2331653 - RNA, 20 nt, Human
cgaggaggcuccagagggca

SEQ ID NO: 2331654 - RNA, 19 nt, Human
cgaggaggcuccagagggc

SEQ ID NO: 2331655 - RNA, 19 nt, Human
cgaggacuguauuugugac

SEQ ID NO: 2331656 - RNA, 20 nt, Human
cgaggacuguauuugugacu

SEQ ID NO: 2331657 - RNA, 21 nt, Human
cgaggacuguauuugugacua

SEQ ID NO: 2331658 - RNA, 16 nt, Human
cgaggacagggaggug

SEQ ID NO: 2331659 - RNA, 18 nt, Human
cgaggacuguauuuguga

SEQ ID NO: 2331660 - RNA, 17 nt, Human
cgaggacccagacccag

SEQ ID NO: 2331661 - RNA, 20 nt, Human
cgaggacccagacccagugg

SEQ ID NO: 2331662 - RNA, 21 nt, Human
cgaggacaugaaacuccaccu

SEQ ID NO: 2331663 - RNA, 12 nt, Human
cgaggacccaga

SEQ ID NO: 2331664 - RNA, 13 nt, Human
cgaggacccagac

SEQ ID NO: 2331665 - RNA, 14 nt, Human
cgaggacccagacc

SEQ ID NO: 2331666 - RNA, 15 nt, Human
cgaugcaaugaacac

SEQ ID NO: 2331667 - RNA, 23 nt, Human
cgaugaauuuggagacucugugg

SEQ ID NO: 2331668 - RNA, 23 nt, Human
cgaggccuaccccgcagacaccu

SEQ ID NO: 2331669 - RNA, 13 nt, Human
cgaggcccgcaug

SEQ ID NO: 2331670 - RNA, 19 nt, Human
cgaggcccucgggcccagc

SEQ ID NO: 2331671 - RNA, 20 nt, Human
cgaggcccucgggcccagcc

SEQ ID NO: 2331672 - RNA, 17 nt, Human
cgaggccuaccccgcag

SEQ ID NO: 2331673 - RNA, 21 nt, Human
cgaggcccucgggcccagccc

SEQ ID NO: 2331674 - RNA, 22 nt, Human
cgaggcagggucaggagagggg

SEQ ID NO: 2331675 - RNA, 11 nt, Human
cgaggccagua

SEQ ID NO: 2331676 - RNA, 19 nt, Human
cgaggccaguaccuuucca

SEQ ID NO: 2331677 - RNA, 14 nt, Human
cgaggcagggucag

SEQ ID NO: 2331678 - RNA, 13 nt, Human
cgaggcagaggac

SEQ ID NO: 2331679 - RNA, 15 nt, Human
cgaggcagaggacag

SEQ ID NO: 2331680 - RNA, 12 nt, Human
cgaggcagagga

SEQ ID NO: 2331681 - RNA, 14 nt, Human
cgaggacagggagg

SEQ ID NO: 2331682 - RNA, 13 nt, Human
cgagccuggcucc

SEQ ID NO: 2331683 - RNA, 18 nt, Human
cgagcccugguggcagug

SEQ ID NO: 2331684 - RNA, 16 nt, Human
cgagagggagagagag

SEQ ID NO: 2331685 - RNA, 23 nt, Human
cgagcccuguggaugagcccuca

SEQ ID NO: 2331686 - RNA, 14 nt, Human
cgagccgggccugg

SEQ ID NO: 2331687 - RNA, 15 nt, Human
cgagccgggccuggg

SEQ ID NO: 2331688 - RNA, 17 nt, Human
cgagccgggccuggggc

SEQ ID NO: 2331689 - RNA, 18 nt, Human
cgagccggggaguuucuu

SEQ ID NO: 2331690 - RNA, 22 nt, Human
cgagccggggaguuucuuuccu

SEQ ID NO: 2331691 - RNA, 19 nt, Human
cgagccucugucacugcag

SEQ ID NO: 2331692 - RNA, 20 nt, Human
cgagccucugucacugcagg

SEQ ID NO: 2331693 - RNA, 23 nt, Human
cgagccucugucacugcaggcac

SEQ ID NO: 2331694 - RNA, 20 nt, Human
cgagagccugcucccccacc

SEQ ID NO: 2331695 - RNA, 19 nt, Human
cgagagccugcucccccac

SEQ ID NO: 2331696 - RNA, 15 nt, Human
cgagagccugcuccc

SEQ ID NO: 2331697 - RNA, 14 nt, Human
cgagagccugcucc

SEQ ID NO: 2331698 - RNA, 13 nt, Human
cgagagccugcuc

SEQ ID NO: 2331699 - RNA, 21 nt, Human
cgagagacuuguggccuggga

SEQ ID NO: 2331700 - RNA, 21 nt, Human
cgagagagcaccccucucugc

SEQ ID NO: 2331701 - RNA, 19 nt, Human
cgagcccugguggcagugg

SEQ ID NO: 2331702 - RNA, 21 nt, Human
cgagagccugcucccccaccc

SEQ ID NO: 2331703 - RNA, 14 nt, Human
cgagaggaggggcc

SEQ ID NO: 2331704 - RNA, 15 nt, Human
cgagaggaggggccc

SEQ ID NO: 2331705 - RNA, 14 nt, Human
cgagaggcagagaa

SEQ ID NO: 2331706 - RNA, 15 nt, Human
cgagaggcagagaaa

SEQ ID NO: 2331707 - RNA, 13 nt, Human
cgagagggagaga

SEQ ID NO: 2331708 - RNA, 14 nt, Human
cgagagggagagag

SEQ ID NO: 2331709 - RNA, 17 nt, Human
cgcacugugacccccag

SEQ ID NO: 2331710 - RNA, 23 nt, Human
cgcacuucgggaggucgaggcag

SEQ ID NO: 2331711 - RNA, 17 nt, Human
cgcacugggcuugggga

SEQ ID NO: 2331712 - RNA, 14 nt, Human
cgcagaugauccau

SEQ ID NO: 2331713 - RNA, 22 nt, Human
cgcacugugacccccagcuccg

SEQ ID NO: 2331714 - RNA, 14 nt, Human
cgcagagcuggccg

SEQ ID NO: 2331715 - RNA, 16 nt, Human
cgcagcaggaggccag

SEQ ID NO: 2331716 - RNA, 18 nt, Human
cgcagcaggaggccaggc

SEQ ID NO: 2331717 - RNA, 17 nt, Human
cgcagcaggaggccagg

SEQ ID NO: 2331718 - RNA, 19 nt, Human
cgcagcauauucaggaagc

SEQ ID NO: 2331719 - RNA, 20 nt, Human
cgcagcauauucaggaagcu

SEQ ID NO: 2331720 - RNA, 15 nt, Human
cgcagcccugcagag

SEQ ID NO: 2331721 - RNA, 17 nt, Human
cgcagcccugcagaggg

SEQ ID NO: 2331722 - RNA, 21 nt, Human
cgaugggcccaauucuuacaa

SEQ ID NO: 2331723 - RNA, 18 nt, Human
cgauggcuuugccagcuu

SEQ ID NO: 2331724 - RNA, 18 nt, Human
cgauggauauauguuuuu

SEQ ID NO: 2331725 - RNA, 22 nt, Human
cgaugcugcuuuccccuguggg

SEQ ID NO: 2331726 - RNA, 16 nt, Human
cgcaccuaccaucagg

SEQ ID NO: 2331727 - RNA, 16 nt, Human
cgcaccucccauccua

SEQ ID NO: 2331728 - RNA, 12 nt, Human
cgcaccucccau

SEQ ID NO: 2331729 - RNA, 19 nt, Human
cgcaccuaccaucagggac

SEQ ID NO: 2331730 - RNA, 23 nt, Human
cgaugcuccagccaaccccugug

SEQ ID NO: 2331731 - RNA, 22 nt, Human
cgaugcuccagccaaccccugu

SEQ ID NO: 2331732 - RNA, 20 nt, Human
cgaugcuccagccaaccccu

SEQ ID NO: 2331733 - RNA, 18 nt, Human
cgaugcuccagccaaccc

SEQ ID NO: 2331734 - RNA, 12 nt, Human
cgaugcugcuuu

SEQ ID NO: 2331735 - RNA, 18 nt, Human
cgaugcugcuuuccccug

SEQ ID NO: 2331736 - RNA, 20 nt, Human
cgaugcugcuuuccccugug

SEQ ID NO: 2331737 - RNA, 21 nt, Human
cgaugcugcuuuccccugugg

SEQ ID NO: 2331738 - RNA, 14 nt, Human
cgaugcuccagcca

SEQ ID NO: 2331739 - RNA, 18 nt, Human
cgcacgugggucuucagg

SEQ ID NO: 2331740 - RNA, 22 nt, Human
cgcacuacaugugguuuauaga

SEQ ID NO: 2331741 - RNA, 18 nt, Human
cgcacucacccaugugcc

SEQ ID NO: 2331742 - RNA, 16 nt, Human
cgcacuccaugagcac

SEQ ID NO: 2331743 - RNA, 17 nt, Human
cgcacuccaugagcacc

SEQ ID NO: 2331744 - RNA, 13 nt, Human
cgcacugggcuug

SEQ ID NO: 2331745 - RNA, 17 nt, Human
cgcaccugcccccuggu

SEQ ID NO: 2331746 - RNA, 16 nt, Human
cgcaccugcccccugg

SEQ ID NO: 2331747 - RNA, 15 nt, Human
cgcaccugccucagg

SEQ ID NO: 2331748 - RNA, 14 nt, Human
cgcaccugccucag

SEQ ID NO: 2331749 - RNA, 18 nt, Human
cgcaccucccauccuaau

SEQ ID NO: 2331750 - RNA, 11 nt, Human
cgcacgcacac

SEQ ID NO: 2331751 - RNA, 16 nt, Human
cgcaccugccucagga

SEQ ID NO: 2331752 - RNA, 13 nt, Human
cgcacgcacacac

SEQ ID NO: 2331753 - RNA, 14 nt, Human
cgcacgcacacaca

SEQ ID NO: 2331754 - RNA, 15 nt, Human
cgcacgcacacacac

SEQ ID NO: 2331755 - RNA, 16 nt, Human
cgcacgcacacacaca

SEQ ID NO: 2331756 - RNA, 18 nt, Human
cgcccacaggaagccugc

SEQ ID NO: 2331757 - RNA, 21 nt, Human
ccugggguggggauagggagc

SEQ ID NO: 2331758 - RNA, 20 nt, Human
ccuggggugugggaggcccg

SEQ ID NO: 2331759 - RNA, 15 nt, Human
ccuggggugggguca

SEQ ID NO: 2331760 - RNA, 20 nt, Human
ccuggguaaaugcagcguga

SEQ ID NO: 2331761 - RNA, 22 nt, Human
ccuggguaaaugcagcgugaag

SEQ ID NO: 2331762 - RNA, 14 nt, Human
ccugggucagucug

SEQ ID NO: 2331763 - RNA, 15 nt, Human
ccugggucagucugg

SEQ ID NO: 2331764 - RNA, 19 nt, Human
ccugggucagucugguggg

SEQ ID NO: 2331765 - RNA, 21 nt, Human
ccugggucagucuggugggag

SEQ ID NO: 2331766 - RNA, 22 nt, Human
ccugggucagucuggugggagg

SEQ ID NO: 2331767 - RNA, 23 nt, Human
ccugggcagccaggcugccaagg

SEQ ID NO: 2331768 - RNA, 12 nt, Human
ccuggggggcag

SEQ ID NO: 2331769 - RNA, 18 nt, Human
ccugggggcugggcagag

SEQ ID NO: 2331770 - RNA, 23 nt, Human
ccugggaguuuuguauucaucuu

SEQ ID NO: 2331771 - RNA, 22 nt, Human
ccugggguauaaaacuuuccuc

SEQ ID NO: 2331772 - RNA, 14 nt, Human
ccuggggucuggag

SEQ ID NO: 2331773 - RNA, 20 nt, Human
ccugggggcugggcagagga

SEQ ID NO: 2331774 - RNA, 21 nt, Human
ccugggggcugggcagaggaa

SEQ ID NO: 2331775 - RNA, 19 nt, Human
ccugggggcugggcagagg

SEQ ID NO: 2331776 - RNA, 17 nt, Human
ccugggacugcugcuuc

SEQ ID NO: 2331777 - RNA, 20 nt, Human
ccugggaccuccccugaggc

SEQ ID NO: 2331778 - RNA, 17 nt, Human
ccugggagaaccucagg

SEQ ID NO: 2331779 - RNA, 17 nt, Human
ccugggaccuccccuga

SEQ ID NO: 2331780 - RNA, 19 nt, Human
ccugggaccuccccugagg

SEQ ID NO: 2331781 - RNA, 19 nt, Human
ccugggagaaccucaggcu

SEQ ID NO: 2331782 - RNA, 18 nt, Human
ccugggagaaccucaggc

SEQ ID NO: 2331783 - RNA, 19 nt, Human
ccugggaggaaauuugaau

SEQ ID NO: 2331784 - RNA, 22 nt, Human
ccugggaggucaaggcugcagu

SEQ ID NO: 2331785 - RNA, 16 nt, Human
ccugggagugagcugg

SEQ ID NO: 2331786 - RNA, 19 nt, Human
ccugggcagccaggcugcc

SEQ ID NO: 2331787 - RNA, 18 nt, Human
ccugggcagccaggcugc

SEQ ID NO: 2331788 - RNA, 17 nt, Human
ccugggcagccaggcug

SEQ ID NO: 2331789 - RNA, 23 nt, Human
ccugggagguggagguugcagug

SEQ ID NO: 2331790 - RNA, 16 nt, Human
ccugggcagaaggaag

SEQ ID NO: 2331791 - RNA, 18 nt, Human
ccugggagugagcugguu

SEQ ID NO: 2331792 - RNA, 15 nt, Human
ccugggcagaaggaa

SEQ ID NO: 2331793 - RNA, 16 nt, Human
ccuggcccacugcauc

SEQ ID NO: 2331794 - RNA, 15 nt, Human
ccuggcccagcggcc

SEQ ID NO: 2331795 - RNA, 20 nt, Human
ccuggcccagcggccccucc

SEQ ID NO: 2331796 - RNA, 21 nt, Human
ccuggcccagcggccccuccc

SEQ ID NO: 2331797 - RNA, 12 nt, Human
ccuggcccagcu

SEQ ID NO: 2331798 - RNA, 13 nt, Human
ccuggcccagcuc

SEQ ID NO: 2331799 - RNA, 14 nt, Human
ccuggcccagcucc

SEQ ID NO: 2331800 - RNA, 15 nt, Human
ccuggcccagcuccc

SEQ ID NO: 2331801 - RNA, 20 nt, Human
ccuggcccagcucccccggg

SEQ ID NO: 2331802 - RNA, 16 nt, Human
ccuggcccagcucccc

SEQ ID NO: 2331803 - RNA, 12 nt, Human
ccuggccccaug

SEQ ID NO: 2331804 - RNA, 13 nt, Human
ccuggccccagga

SEQ ID NO: 2331805 - RNA, 12 nt, Human
ccuggccccagg

SEQ ID NO: 2331806 - RNA, 17 nt, Human
ccuggcccaucagugua

SEQ ID NO: 2331807 - RNA, 18 nt, Human
ccuggcccaucaguguac

SEQ ID NO: 2331808 - RNA, 20 nt, Human
ccuggcccaucaguguaccc

SEQ ID NO: 2331809 - RNA, 22 nt, Human
ccuggcucccaugaccauacug

SEQ ID NO: 2331810 - RNA, 15 nt, Human
ccuggcucccaugac

SEQ ID NO: 2331811 - RNA, 14 nt, Human
ccuggcucccauga

SEQ ID NO: 2331812 - RNA, 21 nt, Human
ccuggcucccaugaccauacu

SEQ ID NO: 2331813 - RNA, 23 nt, Human
ccuggcuccugaggggcaucugc

SEQ ID NO: 2331814 - RNA, 15 nt, Human
ccuggcuccugaggg

SEQ ID NO: 2331815 - RNA, 18 nt, Human
ccuggcuccuacccaccg

SEQ ID NO: 2331816 - RNA, 21 nt, Human
ccuggcuccguccaggagccu

SEQ ID NO: 2331817 - RNA, 23 nt, Human
ccuggcuucuggagcccuugggu

SEQ ID NO: 2331818 - RNA, 22 nt, Human
ccuggcuucuggagcccuuggg

SEQ ID NO: 2331819 - RNA, 21 nt, Human
ccuggcuucuggagcccuugg

SEQ ID NO: 2331820 - RNA, 20 nt, Human
ccuggcuucuggagcccuug

SEQ ID NO: 2331821 - RNA, 22 nt, Human
ccuggcuuguaacuccaccaac

SEQ ID NO: 2331822 - RNA, 20 nt, Human
ccuggcuuguaacuccacca

SEQ ID NO: 2331823 - RNA, 18 nt, Human
ccuggcuuguaacuccac

SEQ ID NO: 2331824 - RNA, 17 nt, Human
ccuggcuuuucacugcu

SEQ ID NO: 2331825 - RNA, 16 nt, Human
ccuggcuuuucacugc

SEQ ID NO: 2331826 - RNA, 12 nt, Human
ccugggaagggg

SEQ ID NO: 2331827 - RNA, 18 nt, Human
ccugggaaauauucccua

SEQ ID NO: 2331828 - RNA, 17 nt, Human
ccugggaaauauucccu

SEQ ID NO: 2331829 - RNA, 14 nt, Human
ccugggaauguauu

SEQ ID NO: 2331830 - RNA, 21 nt, Human
ccugcuaauuccccagauugc

SEQ ID NO: 2331831 - RNA, 20 nt, Human
ccugccuguugggccaggag

SEQ ID NO: 2331832 - RNA, 18 nt, Human
ccugccuguugggccagg

SEQ ID NO: 2331833 - RNA, 19 nt, Human
ccugccuguugggccagga

SEQ ID NO: 2331834 - RNA, 18 nt, Human
ccugcuagacacauuuuu

SEQ ID NO: 2331835 - RNA, 13 nt, Human
ccuggacuuuccu

SEQ ID NO: 2331836 - RNA, 14 nt, Human
ccuggacuuuccug

SEQ ID NO: 2331837 - RNA, 13 nt, Human
ccugcuacucugu

SEQ ID NO: 2331838 - RNA, 16 nt, Human
ccugcuacucuguucc

SEQ ID NO: 2331839 - RNA, 23 nt, Human
ccugccuguggcgccgucuccag

SEQ ID NO: 2331840 - RNA, 19 nt, Human
ccugcuacaacuucagcag

SEQ ID NO: 2331841 - RNA, 20 nt, Human
ccugcuacaacuucagcagu

SEQ ID NO: 2331842 - RNA, 17 nt, Human
ccugcuaauuccccaga

SEQ ID NO: 2331843 - RNA, 19 nt, Human
ccuggcacccggccccugc

SEQ ID NO: 2331844 - RNA, 16 nt, Human
ccuggagaacuagaga

SEQ ID NO: 2331845 - RNA, 23 nt, Human
ccuggagaacuagaaccuggagg

SEQ ID NO: 2331846 - RNA, 17 nt, Human
ccuggagaagcugaugc

SEQ ID NO: 2331847 - RNA, 12 nt, Human
ccuggagaacua

SEQ ID NO: 2331848 - RNA, 13 nt, Human
ccuggagaacuag

SEQ ID NO: 2331849 - RNA, 15 nt, Human
ccuggacuuuccugc

SEQ ID NO: 2331850 - RNA, 16 nt, Human
ccuggacuuuccugca

SEQ ID NO: 2331851 - RNA, 17 nt, Human
ccuggacuuuccugcaa

SEQ ID NO: 2331852 - RNA, 19 nt, Human
ccuggacuuuccugcaacu

SEQ ID NO: 2331853 - RNA, 20 nt, Human
ccuggcacccggccccugcu

SEQ ID NO: 2331854 - RNA, 21 nt, Human
ccuggcacccggccccugcug

SEQ ID NO: 2331855 - RNA, 12 nt, Human
ccuggcacugcu

SEQ ID NO: 2331856 - RNA, 22 nt, Human
ccuggcacuauaauguaagcuc

SEQ ID NO: 2331857 - RNA, 15 nt, Human
ccuggccaccacccc

SEQ ID NO: 2331858 - RNA, 17 nt, Human
ccuggccaccacccccc

SEQ ID NO: 2331859 - RNA, 21 nt, Human
ccuggccaccaccccccacuc

SEQ ID NO: 2331860 - RNA, 13 nt, Human
ccuggccaccucu

SEQ ID NO: 2331861 - RNA, 14 nt, Human
ccuggccaccucuc

SEQ ID NO: 2331862 - RNA, 15 nt, Human
ccuggccaccucucu

SEQ ID NO: 2331863 - RNA, 23 nt, Human
ccuggcaugggaaugaaugucag

SEQ ID NO: 2331864 - RNA, 19 nt, Human
ccuggcauuauguccacug

SEQ ID NO: 2331865 - RNA, 13 nt, Human
ccuggcaugggaa

SEQ ID NO: 2331866 - RNA, 21 nt, Human
ccuggcagguuagaaccuaga

SEQ ID NO: 2331867 - RNA, 19 nt, Human
ccuggcagguuagaaccua

SEQ ID NO: 2331868 - RNA, 20 nt, Human
ccuggcagguuagaaccuag

SEQ ID NO: 2331869 - RNA, 21 nt, Human
ccuggcaucgcaccauucuga

SEQ ID NO: 2331870 - RNA, 23 nt, Human
ccuggcaucgcaccauucugacu

SEQ ID NO: 2331871 - RNA, 21 nt, Human
ccuggcaggcugucuggccag

SEQ ID NO: 2331872 - RNA, 22 nt, Human
ccuggcaggaugacccugcgaa

SEQ ID NO: 2331873 - RNA, 11 nt, Human
ccuggagaagc

SEQ ID NO: 2331874 - RNA, 15 nt, Human
ccuggcacugcugug

SEQ ID NO: 2331875 - RNA, 17 nt, Human
ccuggcacugcugugcu

SEQ ID NO: 2331876 - RNA, 13 nt, Human
ccuggcacugcuu

SEQ ID NO: 2331877 - RNA, 16 nt, Human
ccuggcacugcuucca

SEQ ID NO: 2331878 - RNA, 21 nt, Human
ccuggccagaugcaccagccc

SEQ ID NO: 2331879 - RNA, 23 nt, Human
ccuggccagaugcaccagcccuu

SEQ ID NO: 2331880 - RNA, 20 nt, Human
ccuggccagaugcaccagcc

SEQ ID NO: 2331881 - RNA, 17 nt, Human
ccuggccaccugaggug

SEQ ID NO: 2331882 - RNA, 18 nt, Human
ccuggccaccugaggugg

SEQ ID NO: 2331883 - RNA, 18 nt, Human
ccuggccaccucucuccu

SEQ ID NO: 2331884 - RNA, 12 nt, Human
ccuggccaccug

SEQ ID NO: 2331885 - RNA, 13 nt, Human
ccuggccaccuga

SEQ ID NO: 2331886 - RNA, 16 nt, Human
ccuggccaccugaggu

SEQ ID NO: 2331887 - RNA, 14 nt, Human
ccuggcccacugca

SEQ ID NO: 2331888 - RNA, 13 nt, Human
ccuggcccacugc

SEQ ID NO: 2331889 - RNA, 13 nt, Human
ccuggccaggagc

SEQ ID NO: 2331890 - RNA, 15 nt, Human
ccuggccagccuaca

SEQ ID NO: 2331891 - RNA, 21 nt, Human
ccuggcccacagcaggugcug

SEQ ID NO: 2331892 - RNA, 19 nt, Human
ccuggccaucccacaagug

SEQ ID NO: 2331893 - RNA, 17 nt, Human
ccuggccaucccacaag

SEQ ID NO: 2331894 - RNA, 13 nt, Human
ccuggccacgccc

SEQ ID NO: 2331895 - RNA, 14 nt, Human
ccuggcaugggaau

SEQ ID NO: 2331896 - RNA, 23 nt, Human
ccuguauauagcccagccaggcc

SEQ ID NO: 2331897 - RNA, 14 nt, Human
ccugucaccaagcu

SEQ ID NO: 2331898 - RNA, 19 nt, Human
ccuguaugcaacaggcacu

SEQ ID NO: 2331899 - RNA, 13 nt, Human
ccuguauauagcc

SEQ ID NO: 2331900 - RNA, 12 nt, Human
ccuguauaguua

SEQ ID NO: 2331901 - RNA, 22 nt, Human
ccuguauaguuaggauagcauu

SEQ ID NO: 2331902 - RNA, 16 nt, Human
ccuguauauagcccag

SEQ ID NO: 2331903 - RNA, 21 nt, Human
ccuguauauagcccagccagg

SEQ ID NO: 2331904 - RNA, 23 nt, Human
ccuguauaaguggaggcacuuua

SEQ ID NO: 2331905 - RNA, 22 nt, Human
ccuguauaaguggaggcacuuu

SEQ ID NO: 2331906 - RNA, 19 nt, Human
ccugucagugcagcccgug

SEQ ID NO: 2331907 - RNA, 12 nt, Human
ccugucagugcc

SEQ ID NO: 2331908 - RNA, 13 nt, Human
ccugucagugccg

SEQ ID NO: 2331909 - RNA, 14 nt, Human
ccugucagugccgc

SEQ ID NO: 2331910 - RNA, 15 nt, Human
ccugucagugccgcc

SEQ ID NO: 2331911 - RNA, 19 nt, Human
ccugucagugccgccgccu

SEQ ID NO: 2331912 - RNA, 16 nt, Human
ccugucagugcagccc

SEQ ID NO: 2331913 - RNA, 14 nt, Human
ccugucagugcagc

SEQ ID NO: 2331914 - RNA, 21 nt, Human
ccugucaugccccccucaaac

SEQ ID NO: 2331915 - RNA, 22 nt, Human
ccugucauucccaccacccuga

SEQ ID NO: 2331916 - RNA, 11 nt, Human
ccugucccacc

SEQ ID NO: 2331917 - RNA, 13 nt, Human
ccugucccacccc

SEQ ID NO: 2331918 - RNA, 12 nt, Human
ccugucaugccc

SEQ ID NO: 2331919 - RNA, 14 nt, Human
ccugucaugccccc

SEQ ID NO: 2331920 - RNA, 15 nt, Human
ccugucaugcccccc

SEQ ID NO: 2331921 - RNA, 16 nt, Human
ccugucaugccccccu

SEQ ID NO: 2331922 - RNA, 18 nt, Human
ccugucaugccccccuca

SEQ ID NO: 2331923 - RNA, 19 nt, Human
ccugucaugccccccucaa

SEQ ID NO: 2331924 - RNA, 14 nt, Human
ccugucccaccucu

SEQ ID NO: 2331925 - RNA, 16 nt, Human
ccugucccauggacac

SEQ ID NO: 2331926 - RNA, 19 nt, Human
ccugucccauggacacucc

SEQ ID NO: 2331927 - RNA, 23 nt, Human
ccugucccauggacacuccagug

SEQ ID NO: 2331928 - RNA, 13 nt, Human
ccugucccaccuc

SEQ ID NO: 2331929 - RNA, 16 nt, Human
ccugucccaccucuuc

SEQ ID NO: 2331930 - RNA, 15 nt, Human
ccugucccaccccca

SEQ ID NO: 2331931 - RNA, 17 nt, Human
ccugucccacccccacc

SEQ ID NO: 2331932 - RNA, 18 nt, Human
ccugucccacccccaccc

SEQ ID NO: 2331933 - RNA, 12 nt, Human
ccugucccccug

SEQ ID NO: 2331934 - RNA, 13 nt, Human
ccugucccccagc

SEQ ID NO: 2331935 - RNA, 14 nt, Human
ccugucccccagcu

SEQ ID NO: 2331936 - RNA, 15 nt, Human
ccugucccccagcuc

SEQ ID NO: 2331937 - RNA, 16 nt, Human
ccugucccccagcucu

SEQ ID NO: 2331938 - RNA, 13 nt, Human
ccugucccccuga

SEQ ID NO: 2331939 - RNA, 14 nt, Human
ccugucccccugac

SEQ ID NO: 2331940 - RNA, 15 nt, Human
ccugucccccugaca

SEQ ID NO: 2331941 - RNA, 17 nt, Human
ccugucccccagcucug

SEQ ID NO: 2331942 - RNA, 19 nt, Human
ccugucccccagcucuggu

SEQ ID NO: 2331943 - RNA, 14 nt, Human
ccugucccucccac

SEQ ID NO: 2331944 - RNA, 15 nt, Human
ccugucccucccacc

SEQ ID NO: 2331945 - RNA, 18 nt, Human
ccuguagaccuagggagg

SEQ ID NO: 2331946 - RNA, 13 nt, Human
ccuguagaccuag

SEQ ID NO: 2331947 - RNA, 12 nt, Human
ccuguacuuuuu

SEQ ID NO: 2331948 - RNA, 20 nt, Human
ccuguacuguucugugucuu

SEQ ID NO: 2331949 - RNA, 12 nt, Human
ccuguaccucuu

SEQ ID NO: 2331950 - RNA, 17 nt, Human
ccuguaccccagcacuu

SEQ ID NO: 2331951 - RNA, 14 nt, Human
ccuguaccccagca

SEQ ID NO: 2331952 - RNA, 10 nt, Human
ccuguaccuc

SEQ ID NO: 2331953 - RNA, 22 nt, Human
ccuguacaguagauuuuccaaa

SEQ ID NO: 2331954 - RNA, 16 nt, Human
ccuguacauuguggga

SEQ ID NO: 2331955 - RNA, 16 nt, Human
ccuggucuugagaugu

SEQ ID NO: 2331956 - RNA, 16 nt, Human
ccuggucuuuccucug

SEQ ID NO: 2331957 - RNA, 14 nt, Human
ccuggucuguagaa

SEQ ID NO: 2331958 - RNA, 15 nt, Human
ccugguggcaguggg

SEQ ID NO: 2331959 - RNA, 14 nt, Human
ccuguacaguagau

SEQ ID NO: 2331960 - RNA, 20 nt, Human
ccuguacaguagauuuucca

SEQ ID NO: 2331961 - RNA, 21 nt, Human
ccuguacaguagauuuuccaa

SEQ ID NO: 2331962 - RNA, 13 nt, Human
ccugguggcagug

SEQ ID NO: 2331963 - RNA, 14 nt, Human
ccugguggcagugg

SEQ ID NO: 2331964 - RNA, 23 nt, Human
ccuguagaccuagggaggaccuu

SEQ ID NO: 2331965 - RNA, 22 nt, Human
ccuguagaccuagggaggaccu

SEQ ID NO: 2331966 - RNA, 17 nt, Human
ccuguagcacuuacugg

SEQ ID NO: 2331967 - RNA, 14 nt, Human
ccuguagagcuaga

SEQ ID NO: 2331968 - RNA, 13 nt, Human
ccuguagcaguga

SEQ ID NO: 2331969 - RNA, 16 nt, Human
ccuguagcccacucug

SEQ ID NO: 2331970 - RNA, 12 nt, Human
ccuguagcccac

SEQ ID NO: 2331971 - RNA, 21 nt, Human
ccuguagcagugagaaaaagc

SEQ ID NO: 2331972 - RNA, 13 nt, Human
ccuguagcaucuu

SEQ ID NO: 2331973 - RNA, 15 nt, Human
ccuguagcaucuucu

SEQ ID NO: 2331974 - RNA, 18 nt, Human
ccuguagcaucuucugga

SEQ ID NO: 2331975 - RNA, 16 nt, Human
ccuguagagugggagc

SEQ ID NO: 2331976 - RNA, 15 nt, Human
ccuguagagugggag

SEQ ID NO: 2331977 - RNA, 13 nt, Human
ccuguagcccuaa

SEQ ID NO: 2331978 - RNA, 24 nt, Human
ccuguagcccacucugcucgccuu

SEQ ID NO: 2331979 - RNA, 23 nt, Human
ccuguagcccacucugcucgccu

SEQ ID NO: 2331980 - RNA, 22 nt, Human
ccuguagcccacucugcucgcc

SEQ ID NO: 2331981 - RNA, 19 nt, Human
ccuguagcccacucugcuc

SEQ ID NO: 2331982 - RNA, 23 nt, Human
ccuguaguugcguggacucugca

SEQ ID NO: 2331983 - RNA, 18 nt, Human
ccuguauaaguggaggca

SEQ ID NO: 2331984 - RNA, 16 nt, Human
ccuguauaaguggagg

SEQ ID NO: 2331985 - RNA, 21 nt, Human
ccuguaguugcguggacucug

SEQ ID NO: 2331986 - RNA, 19 nt, Human
ccuguagccuucuguagga

SEQ ID NO: 2331987 - RNA, 20 nt, Human
ccuguaguugcguggacucu

SEQ ID NO: 2331988 - RNA, 16 nt, Human
ccuguagccuucugua

SEQ ID NO: 2331989 - RNA, 21 nt, Human
ccuguagcaucuucuggaguc

SEQ ID NO: 2331990 - RNA, 15 nt, Human
ccuggguccaaauaa

SEQ ID NO: 2331991 - RNA, 17 nt, Human
ccuggguccaaauaaaa

SEQ ID NO: 2331992 - RNA, 20 nt, Human
ccuggguggggcugcuccuc

SEQ ID NO: 2331993 - RNA, 19 nt, Human
ccuggguggggcugcuccu

SEQ ID NO: 2331994 - RNA, 20 nt, Human
ccuggguccaaauaaaaacu

SEQ ID NO: 2331995 - RNA, 23 nt, Human
ccuggguggggcugcuccuccag

SEQ ID NO: 2331996 - RNA, 13 nt, Human
ccugggugggugg

SEQ ID NO: 2331997 - RNA, 22 nt, Human
ccuggguggggcugcuccucca

SEQ ID NO: 2331998 - RNA, 21 nt, Human
ccuggguggggcugcuccucc

SEQ ID NO: 2331999 - RNA, 17 nt, Human
ccugggugggugguggg

SEQ ID NO: 2332000 - RNA, 19 nt, Human
ccuggguggguggugggga

SEQ ID NO: 2332001 - RNA, 20 nt, Human
ccugggugggugguggggag

SEQ ID NO: 2332002 - RNA, 21 nt, Human
ccugggugggugguggggagg

SEQ ID NO: 2332003 - RNA, 22 nt, Human
ccuggguggucugcaggcaggg

SEQ ID NO: 2332004 - RNA, 20 nt, Human
ccuggguggucugcaggcag

SEQ ID NO: 2332005 - RNA, 19 nt, Human
ccuggguggucugcaggca

SEQ ID NO: 2332006 - RNA, 18 nt, Human
ccuggguggucugcaggc

SEQ ID NO: 2332007 - RNA, 14 nt, Human
ccuggguggucugc

SEQ ID NO: 2332008 - RNA, 22 nt, Human
ccugggugggugguggggaggg

SEQ ID NO: 2332009 - RNA, 23 nt, Human
ccugggugggugguggggagggg

SEQ ID NO: 2332010 - RNA, 21 nt, Human
ccuggguggucugcaggcagg

SEQ ID NO: 2332011 - RNA, 19 nt, Human
ccuggguucagaaaugcug

SEQ ID NO: 2332012 - RNA, 18 nt, Human
ccugguccuuccaggccc

SEQ ID NO: 2332013 - RNA, 15 nt, Human
ccugguccuuccagg

SEQ ID NO: 2332014 - RNA, 16 nt, Human
ccuggucccugggagg

SEQ ID NO: 2332015 - RNA, 14 nt, Human
ccuggucccuggga

SEQ ID NO: 2332016 - RNA, 14 nt, Human
ccugguccugaggg

SEQ ID NO: 2332017 - RNA, 22 nt, Human
ccuggguucagaaaugcugccu

SEQ ID NO: 2332018 - RNA, 23 nt, Human
ccuggguucagaaaugcugccug

SEQ ID NO: 2332019 - RNA, 20 nt, Human
ccugguccucacacucaccc

SEQ ID NO: 2332020 - RNA, 13 nt, Human
ccuggucucuggu

SEQ ID NO: 2332021 - RNA, 23 nt, Human
ccuggucucagcagcgaccaccc

SEQ ID NO: 2332022 - RNA, 14 nt, Human
ccuggucucugguc

SEQ ID NO: 2332023 - RNA, 19 nt, Human
ccugguccuuccaggcccc

SEQ ID NO: 2332024 - RNA, 23 nt, Human
ccugguccugaggguccccaccu

SEQ ID NO: 2332025 - RNA, 14 nt, Human
ccugguggcagcug

SEQ ID NO: 2332026 - RNA, 22 nt, Human
ccugguggcagcucaccucucc

SEQ ID NO: 2332027 - RNA, 19 nt, Human
ccugguggcagcucaccuc

SEQ ID NO: 2332028 - RNA, 21 nt, Human
ccugguggcagcucaccucuc

SEQ ID NO: 2332029 - RNA, 15 nt, Human
ccugguggcagcugc

SEQ ID NO: 2332030 - RNA, 16 nt, Human
ccugguggcagcugcg

SEQ ID NO: 2332031 - RNA, 17 nt, Human
ccugguggcagcugcgg

SEQ ID NO: 2332032 - RNA, 18 nt, Human
ccugguggcagcugcggu

SEQ ID NO: 2332033 - RNA, 13 nt, Human
ccuggguucccuu

SEQ ID NO: 2332034 - RNA, 18 nt, Human
ccuguggauguaaaguga

SEQ ID NO: 2332035 - RNA, 13 nt, Human
ccugccaccuccc

SEQ ID NO: 2332036 - RNA, 14 nt, Human
ccugccaccucccu

SEQ ID NO: 2332037 - RNA, 16 nt, Human
ccugccaccucccuga

SEQ ID NO: 2332038 - RNA, 16 nt, Human
ccugccaccugcugcu

SEQ ID NO: 2332039 - RNA, 16 nt, Human
ccugccacccugggga

SEQ ID NO: 2332040 - RNA, 22 nt, Human
ccugccacccuggggagaaagu

SEQ ID NO: 2332041 - RNA, 19 nt, Human
ccugccaccagucacuguc

SEQ ID NO: 2332042 - RNA, 14 nt, Human
ccugccacccuggg

SEQ ID NO: 2332043 - RNA, 12 nt, Human
ccugccacccug

SEQ ID NO: 2332044 - RNA, 13 nt, Human
ccugccacccugg

SEQ ID NO: 2332045 - RNA, 23 nt, Human
ccugcauuugugaaaugauggug

SEQ ID NO: 2332046 - RNA, 14 nt, Human
ccugcauuucugag

SEQ ID NO: 2332047 - RNA, 18 nt, Human
ccugcauucuuucuguau

SEQ ID NO: 2332048 - RNA, 13 nt, Human
ccugcacuguccu

SEQ ID NO: 2332049 - RNA, 12 nt, Human
ccugcacugucc

SEQ ID NO: 2332050 - RNA, 14 nt, Human
ccugcacuguccug

SEQ ID NO: 2332051 - RNA, 15 nt, Human
ccugcacuguccugc

SEQ ID NO: 2332052 - RNA, 16 nt, Human
ccugcacuguccugcu

SEQ ID NO: 2332053 - RNA, 17 nt, Human
ccugcacuguccugcuc

SEQ ID NO: 2332054 - RNA, 14 nt, Human
ccugcacuuacuug

SEQ ID NO: 2332055 - RNA, 17 nt, Human
ccugcacuuacuugcuu

SEQ ID NO: 2332056 - RNA, 19 nt, Human
ccugcacuguccugcucca

SEQ ID NO: 2332057 - RNA, 20 nt, Human
ccugcacuguccugcuccac

SEQ ID NO: 2332058 - RNA, 21 nt, Human
ccugcacuguccugcuccaca

SEQ ID NO: 2332059 - RNA, 23 nt, Human
ccugcacuguccugcuccacagu

SEQ ID NO: 2332060 - RNA, 19 nt, Human
ccugccaccacgcccggcu

SEQ ID NO: 2332061 - RNA, 15 nt, Human
ccugccaccacgccc

SEQ ID NO: 2332062 - RNA, 19 nt, Human
ccugccaauggacuaacuu

SEQ ID NO: 2332063 - RNA, 12 nt, Human
ccugccacagcc

SEQ ID NO: 2332064 - RNA, 12 nt, Human
ccugccaccagg

SEQ ID NO: 2332065 - RNA, 13 nt, Human
ccugccaccaggc

SEQ ID NO: 2332066 - RNA, 14 nt, Human
ccugccaccaggcc

SEQ ID NO: 2332067 - RNA, 15 nt, Human
ccugccaccaggcca

SEQ ID NO: 2332068 - RNA, 18 nt, Human
ccugccaccaggccaccu

SEQ ID NO: 2332069 - RNA, 19 nt, Human
ccugccaccaggccaccuc

SEQ ID NO: 2332070 - RNA, 16 nt, Human
ccugcauuucugaguu

SEQ ID NO: 2332071 - RNA, 14 nt, Human
ccugccaccaguca

SEQ ID NO: 2332072 - RNA, 15 nt, Human
ccugauccagccucu

SEQ ID NO: 2332073 - RNA, 13 nt, Human
ccugaucagagcc

SEQ ID NO: 2332074 - RNA, 19 nt, Human
ccugaucagaccacggcuc

SEQ ID NO: 2332075 - RNA, 18 nt, Human
ccugaucagaccacggcu

SEQ ID NO: 2332076 - RNA, 14 nt, Human
ccugaucagaccac

SEQ ID NO: 2332077 - RNA, 15 nt, Human
ccugaucaaugacag

SEQ ID NO: 2332078 - RNA, 17 nt, Human
ccugaucaaugacagag

SEQ ID NO: 2332079 - RNA, 13 nt, Human
ccugauccuggag

SEQ ID NO: 2332080 - RNA, 18 nt, Human
ccugauccuggaggccca

SEQ ID NO: 2332081 - RNA, 15 nt, Human
ccugauccuggaggc

SEQ ID NO: 2332082 - RNA, 15 nt, Human
ccugauccugugaag

SEQ ID NO: 2332083 - RNA, 22 nt, Human
ccugcaaacucacugcucaaga

SEQ ID NO: 2332084 - RNA, 20 nt, Human
ccugauccuggaggcccagu

SEQ ID NO: 2332085 - RNA, 19 nt, Human
ccugauccuggaggcccag

SEQ ID NO: 2332086 - RNA, 22 nt, Human
ccugcacaaagcccuuccaugu

SEQ ID NO: 2332087 - RNA, 20 nt, Human
ccugcacaaagcccuuccau

SEQ ID NO: 2332088 - RNA, 18 nt, Human
ccugcaaagcccagcuug

SEQ ID NO: 2332089 - RNA, 17 nt, Human
ccugcaaagcccagcuu

SEQ ID NO: 2332090 - RNA, 14 nt, Human
ccugcaaagcccag

SEQ ID NO: 2332091 - RNA, 16 nt, Human
ccugcaaagcccagcu

SEQ ID NO: 2332092 - RNA, 15 nt, Human
ccugcaaagcccagc

SEQ ID NO: 2332093 - RNA, 23 nt, Human
ccugcacaaagcccuuccauguc

SEQ ID NO: 2332094 - RNA, 21 nt, Human
ccugcacacgcuccuuccucu

SEQ ID NO: 2332095 - RNA, 20 nt, Human
ccugcacaauaaaaauguuu

SEQ ID NO: 2332096 - RNA, 19 nt, Human
ccugcacaauaaaaauguu

SEQ ID NO: 2332097 - RNA, 23 nt, Human
ccugcacuggaguccagucucuu

SEQ ID NO: 2332098 - RNA, 20 nt, Human
ccugcacuggaguccagucu

SEQ ID NO: 2332099 - RNA, 17 nt, Human
ccugcacuggaguccag

SEQ ID NO: 2332100 - RNA, 15 nt, Human
ccugcacuggagucc

SEQ ID NO: 2332101 - RNA, 20 nt, Human
ccugcaccuccccccacugc

SEQ ID NO: 2332102 - RNA, 14 nt, Human
ccugcacuggggag

SEQ ID NO: 2332103 - RNA, 21 nt, Human
ccugcacuggggagcccgucu

SEQ ID NO: 2332104 - RNA, 19 nt, Human
ccugcaccuccccccacug

SEQ ID NO: 2332105 - RNA, 18 nt, Human
ccugcaccuccccccacu

SEQ ID NO: 2332106 - RNA, 17 nt, Human
ccugcaccuccccccac

SEQ ID NO: 2332107 - RNA, 14 nt, Human
ccugcaccuccccc

SEQ ID NO: 2332108 - RNA, 15 nt, Human
ccugaggcucaggga

SEQ ID NO: 2332109 - RNA, 21 nt, Human
ccugaggcugagacugcggga

SEQ ID NO: 2332110 - RNA, 17 nt, Human
ccugagcugccauccag

SEQ ID NO: 2332111 - RNA, 18 nt, Human
ccugagcugaggcagcag

SEQ ID NO: 2332112 - RNA, 17 nt, Human
ccugaggcuccacuugg

SEQ ID NO: 2332113 - RNA, 14 nt, Human
ccugaggcuccacu

SEQ ID NO: 2332114 - RNA, 13 nt, Human
ccugaggcuccac

SEQ ID NO: 2332115 - RNA, 20 nt, Human
ccugaucaagucaccggagc

SEQ ID NO: 2332116 - RNA, 14 nt, Human
ccugaucaaugaca

SEQ ID NO: 2332117 - RNA, 17 nt, Human
ccugaggcucagggaaa

SEQ ID NO: 2332118 - RNA, 16 nt, Human
ccugaggcugggcucc

SEQ ID NO: 2332119 - RNA, 15 nt, Human
ccugaggcugggcuc

SEQ ID NO: 2332120 - RNA, 13 nt, Human
ccugaggcugggc

SEQ ID NO: 2332121 - RNA, 14 nt, Human
ccugaggcugggcu

SEQ ID NO: 2332122 - RNA, 22 nt, Human
ccugagcucgguggacccaggg

SEQ ID NO: 2332123 - RNA, 21 nt, Human
ccugagcucgguggacccagg

SEQ ID NO: 2332124 - RNA, 20 nt, Human
ccugagcucgguggacccag

SEQ ID NO: 2332125 - RNA, 19 nt, Human
ccugagcucgguggaccca

SEQ ID NO: 2332126 - RNA, 18 nt, Human
ccugagcucgguggaccc

SEQ ID NO: 2332127 - RNA, 16 nt, Human
ccugagcucgguggac

SEQ ID NO: 2332128 - RNA, 15 nt, Human
ccugagcucggugga

SEQ ID NO: 2332129 - RNA, 12 nt, Human
ccugagcucccc

SEQ ID NO: 2332130 - RNA, 15 nt, Human
ccugagcuccccacc

SEQ ID NO: 2332131 - RNA, 14 nt, Human
ccugagcucugaua

SEQ ID NO: 2332132 - RNA, 16 nt, Human
ccugagcugaggcagc

SEQ ID NO: 2332133 - RNA, 15 nt, Human
ccugagcugaggcag

SEQ ID NO: 2332134 - RNA, 12 nt, Human
ccugagcuggga

SEQ ID NO: 2332135 - RNA, 15 nt, Human
ccugaggcccagagg

SEQ ID NO: 2332136 - RNA, 16 nt, Human
ccugaggcccagaggg

SEQ ID NO: 2332137 - RNA, 17 nt, Human
ccugaggcccagagggc

SEQ ID NO: 2332138 - RNA, 18 nt, Human
ccugaggcccagagggcc

SEQ ID NO: 2332139 - RNA, 12 nt, Human
ccugagcgcucc

SEQ ID NO: 2332140 - RNA, 16 nt, Human
ccugagcgcuccugcc

SEQ ID NO: 2332141 - RNA, 21 nt, Human
ccugagcgcuccugccgcaga

SEQ ID NO: 2332142 - RNA, 23 nt, Human
ccugagcgcuccugccgcagagc

SEQ ID NO: 2332143 - RNA, 11 nt, Human
ccugagcuaga

SEQ ID NO: 2332144 - RNA, 18 nt, Human
ccugagcuagaagcugga

SEQ ID NO: 2332145 - RNA, 21 nt, Human
ccugagcuagaagcuggagga

SEQ ID NO: 2332146 - RNA, 13 nt, Human
ccugagcucacuc

SEQ ID NO: 2332147 - RNA, 16 nt, Human
ccugagccuggccagc

SEQ ID NO: 2332148 - RNA, 15 nt, Human
ccugagccuggccag

SEQ ID NO: 2332149 - RNA, 14 nt, Human
ccugagccuggcca

SEQ ID NO: 2332150 - RNA, 13 nt, Human
ccugagccuggcc

SEQ ID NO: 2332151 - RNA, 12 nt, Human
ccugagccuggc

SEQ ID NO: 2332152 - RNA, 12 nt, Human
ccugagccccuu

SEQ ID NO: 2332153 - RNA, 13 nt, Human
ccugagccccuuc

SEQ ID NO: 2332154 - RNA, 14 nt, Human
ccugagccccuucc

SEQ ID NO: 2332155 - RNA, 15 nt, Human
ccugagccccuuccu

SEQ ID NO: 2332156 - RNA, 16 nt, Human
ccugagccccuuccuu

SEQ ID NO: 2332157 - RNA, 23 nt, Human
ccugagccccuuccuugcucugc

SEQ ID NO: 2332158 - RNA, 20 nt, Human
ccugagccccuuccuugcuc

SEQ ID NO: 2332159 - RNA, 19 nt, Human
ccugaaguaagcaaagacu

SEQ ID NO: 2332160 - RNA, 17 nt, Human
ccugaaguucaccauua

SEQ ID NO: 2332161 - RNA, 22 nt, Human
ccugaagucuuuguacagacaa

SEQ ID NO: 2332162 - RNA, 20 nt, Human
ccugaagucacacagugagu

SEQ ID NO: 2332163 - RNA, 19 nt, Human
ccugaagucacacagugag

SEQ ID NO: 2332164 - RNA, 15 nt, Human
ccugagccagauuuc

SEQ ID NO: 2332165 - RNA, 12 nt, Human
ccugaaucauuc

SEQ ID NO: 2332166 - RNA, 16 nt, Human
ccugagccagauuuca

SEQ ID NO: 2332167 - RNA, 18 nt, Human
ccugagccagauuucacu

SEQ ID NO: 2332168 - RNA, 21 nt, Human
ccugaagaguccucugaauga

SEQ ID NO: 2332169 - RNA, 22 nt, Human
ccugaagaggcgggccagccag

SEQ ID NO: 2332170 - RNA, 23 nt, Human
ccugaagaggcgggccagccagg

SEQ ID NO: 2332171 - RNA, 18 nt, Human
ccugaagaggcgggccag

SEQ ID NO: 2332172 - RNA, 19 nt, Human
ccugaagaggcgggccagc

SEQ ID NO: 2332173 - RNA, 20 nt, Human
ccugaagaggcgggccagcc

SEQ ID NO: 2332174 - RNA, 21 nt, Human
ccugaagaggcgggccagcca

SEQ ID NO: 2332175 - RNA, 17 nt, Human
ccugaagaggcgggcca

SEQ ID NO: 2332176 - RNA, 19 nt, Human
ccugaagagaagggcaggg

SEQ ID NO: 2332177 - RNA, 18 nt, Human
ccugaaagcccugagcuu

SEQ ID NO: 2332178 - RNA, 14 nt, Human
ccugaaagcccuga

SEQ ID NO: 2332179 - RNA, 13 nt, Human
ccugaaagcccug

SEQ ID NO: 2332180 - RNA, 18 nt, Human
ccugaaacuuacacacaa

SEQ ID NO: 2332181 - RNA, 15 nt, Human
ccugaaacuuauuuu

SEQ ID NO: 2332182 - RNA, 16 nt, Human
ccugaaacuuauuuuu

SEQ ID NO: 2332183 - RNA, 22 nt, Human
ccugaaacuuauuuuuuucuga

SEQ ID NO: 2332184 - RNA, 13 nt, Human
ccugaaagaggaa

SEQ ID NO: 2332185 - RNA, 14 nt, Human
ccugaaggccccgc

SEQ ID NO: 2332186 - RNA, 21 nt, Human
ccugaagccaggccauggcua

SEQ ID NO: 2332187 - RNA, 17 nt, Human
ccugaagccagccuucu

SEQ ID NO: 2332188 - RNA, 18 nt, Human
ccugaagccagccuucuu

SEQ ID NO: 2332189 - RNA, 12 nt, Human
ccugaagccagc

SEQ ID NO: 2332190 - RNA, 14 nt, Human
ccugaagccagccu

SEQ ID NO: 2332191 - RNA, 15 nt, Human
ccugaagccagccuu

SEQ ID NO: 2332192 - RNA, 16 nt, Human
ccugaagccagccuuc

SEQ ID NO: 2332193 - RNA, 18 nt, Human
ccugaaggccccgcccag

SEQ ID NO: 2332194 - RNA, 19 nt, Human
ccugaaggccccgcccagg

SEQ ID NO: 2332195 - RNA, 22 nt, Human
ccugaaggccccgcccaggcuu

SEQ ID NO: 2332196 - RNA, 22 nt, Human
ccugaaggggcgucuguucccc

SEQ ID NO: 2332197 - RNA, 16 nt, Human
ccugaaggggcgucug

SEQ ID NO: 2332198 - RNA, 14 nt, Human
ccugaaggggcguc

SEQ ID NO: 2332199 - RNA, 20 nt, Human
ccugaaggggccaugauggc

SEQ ID NO: 2332200 - RNA, 20 nt, Human
ccugaaggccccgcccaggc

SEQ ID NO: 2332201 - RNA, 21 nt, Human
ccugaaggccccgcccaggcu

SEQ ID NO: 2332202 - RNA, 11 nt, Human
ccucuuccuga

SEQ ID NO: 2332203 - RNA, 16 nt, Human
ccucuuccuugcugug

SEQ ID NO: 2332204 - RNA, 22 nt, Human
ccucuuccucugaggcuggauc

SEQ ID NO: 2332205 - RNA, 22 nt, Human
ccucuuccccagaaaggagacu

SEQ ID NO: 2332206 - RNA, 14 nt, Human
ccucuuccccagaa

SEQ ID NO: 2332207 - RNA, 13 nt, Human
ccucuuccccaga

SEQ ID NO: 2332208 - RNA, 18 nt, Human
ccucuuccaucauguccc

SEQ ID NO: 2332209 - RNA, 15 nt, Human
ccucuucccccugcu

SEQ ID NO: 2332210 - RNA, 15 nt, Human
ccucuuccccuugcc

SEQ ID NO: 2332211 - RNA, 17 nt, Human
ccucuuccccuugcccu

SEQ ID NO: 2332212 - RNA, 14 nt, Human
ccucuuccucugag

SEQ ID NO: 2332213 - RNA, 15 nt, Human
ccucuuccucugagg

SEQ ID NO: 2332214 - RNA, 22 nt, Human
ccugaaaauguuuuucugccag

SEQ ID NO: 2332215 - RNA, 21 nt, Human
ccugaaaauguuuuucugcca

SEQ ID NO: 2332216 - RNA, 23 nt, Human
ccugaaaauguuuuucugccagg

SEQ ID NO: 2332217 - RNA, 15 nt, Human
ccugaaacaacuugg

SEQ ID NO: 2332218 - RNA, 17 nt, Human
ccugaaaacccagagag

SEQ ID NO: 2332219 - RNA, 16 nt, Human
ccugaaaacccagaga

SEQ ID NO: 2332220 - RNA, 13 nt, Human
ccugaaaacccag

SEQ ID NO: 2332221 - RNA, 19 nt, Human
ccucuucucaagugccuua

SEQ ID NO: 2332222 - RNA, 22 nt, Human
ccugaaaaguaacuuggcuuuc

SEQ ID NO: 2332223 - RNA, 15 nt, Human
ccucuuccuuuagga

SEQ ID NO: 2332224 - RNA, 18 nt, Human
ccucuucuauuuuguaaa

SEQ ID NO: 2332225 - RNA, 17 nt, Human
ccucuucuauuuuguaa

SEQ ID NO: 2332226 - RNA, 18 nt, Human
ccugaaaacacugugcac

SEQ ID NO: 2332227 - RNA, 17 nt, Human
ccucuucucaagugccu

SEQ ID NO: 2332228 - RNA, 18 nt, Human
ccucuucucaagugccuu

SEQ ID NO: 2332229 - RNA, 14 nt, Human
ccucuucucaagug

SEQ ID NO: 2332230 - RNA, 15 nt, Human
ccucuucucaagugc

SEQ ID NO: 2332231 - RNA, 16 nt, Human
ccucuucucaagugcc

SEQ ID NO: 2332232 - RNA, 15 nt, Human
ccuaugaucccagca

SEQ ID NO: 2332233 - RNA, 14 nt, Human
ccuaugaucccagc

SEQ ID NO: 2332234 - RNA, 13 nt, Human
ccuaugaucccag

SEQ ID NO: 2332235 - RNA, 17 nt, Human
ccuaugauauuuucugu

SEQ ID NO: 2332236 - RNA, 14 nt, Human
ccucuucagaggcc

SEQ ID NO: 2332237 - RNA, 13 nt, Human
ccucuucagaggc

SEQ ID NO: 2332238 - RNA, 12 nt, Human
ccucuuccccac

SEQ ID NO: 2332239 - RNA, 11 nt, Human
ccucuucccca

SEQ ID NO: 2332240 - RNA, 14 nt, Human
ccucuuccagucuu

SEQ ID NO: 2332241 - RNA, 12 nt, Human
ccucuuccaguc

SEQ ID NO: 2332242 - RNA, 15 nt, Human
ccucuuccaggcccc

SEQ ID NO: 2332243 - RNA, 18 nt, Human
ccucuucauggauggggg

SEQ ID NO: 2332244 - RNA, 16 nt, Human
ccucuucagaggcccu

SEQ ID NO: 2332245 - RNA, 15 nt, Human
ccuagucccuucccc

SEQ ID NO: 2332246 - RNA, 14 nt, Human
ccuagucccuuccc

SEQ ID NO: 2332247 - RNA, 14 nt, Human
ccuaguagucauuu

SEQ ID NO: 2332248 - RNA, 13 nt, Human
ccuagucccuucc

SEQ ID NO: 2332249 - RNA, 18 nt, Human
ccuagucccuuccacacc

SEQ ID NO: 2332250 - RNA, 19 nt, Human
ccuagucccuuccacaccc

SEQ ID NO: 2332251 - RNA, 19 nt, Human
ccuagucccuuccccuccc

SEQ ID NO: 2332252 - RNA, 16 nt, Human
ccuagucccuuccccu

SEQ ID NO: 2332253 - RNA, 21 nt, Human
ccuagucccuuccccucccug

SEQ ID NO: 2332254 - RNA, 12 nt, Human
ccuaucuuugcc

SEQ ID NO: 2332255 - RNA, 18 nt, Human
ccuaucuuuuaguuuuag

SEQ ID NO: 2332256 - RNA, 20 nt, Human
ccuaucuuugccacccucau

SEQ ID NO: 2332257 - RNA, 19 nt, Human
ccuaucuuugccacccuca

SEQ ID NO: 2332258 - RNA, 15 nt, Human
ccuaucuuugccacc

SEQ ID NO: 2332259 - RNA, 13 nt, Human
ccuaucuuugcca

SEQ ID NO: 2332260 - RNA, 15 nt, Human
ccugagcugggauga

SEQ ID NO: 2332261 - RNA, 15 nt, Human
ccugcccccugaaac

SEQ ID NO: 2332262 - RNA, 18 nt, Human
ccugcccccugaaacuua

SEQ ID NO: 2332263 - RNA, 12 nt, Human
ccugcccccugg

SEQ ID NO: 2332264 - RNA, 18 nt, Human
ccugccccccagccucug

SEQ ID NO: 2332265 - RNA, 22 nt, Human
ccugccccccagccucuggcau

SEQ ID NO: 2332266 - RNA, 22 nt, Human
ccugccagugccuuaccuccug

SEQ ID NO: 2332267 - RNA, 21 nt, Human
ccugccagugccuuaccuccu

SEQ ID NO: 2332268 - RNA, 20 nt, Human
ccugccagugccuuaccucc

SEQ ID NO: 2332269 - RNA, 18 nt, Human
ccugccagugccuuaccu

SEQ ID NO: 2332270 - RNA, 17 nt, Human
ccugccagugccuuacc

SEQ ID NO: 2332271 - RNA, 14 nt, Human
ccugccagugccuu

SEQ ID NO: 2332272 - RNA, 13 nt, Human
ccugccagugccu

SEQ ID NO: 2332273 - RNA, 22 nt, Human
ccugccaguccuagcugcacag

SEQ ID NO: 2332274 - RNA, 14 nt, Human
ccugccccccagcc

SEQ ID NO: 2332275 - RNA, 15 nt, Human
ccugccccccagccu

SEQ ID NO: 2332276 - RNA, 17 nt, Human
ccugccccccagccucu

SEQ ID NO: 2332277 - RNA, 15 nt, Human
ccugccaggcauggu

SEQ ID NO: 2332278 - RNA, 13 nt, Human
ccugccaggcagg

SEQ ID NO: 2332279 - RNA, 14 nt, Human
ccugccaggcaggg

SEQ ID NO: 2332280 - RNA, 22 nt, Human
ccugccagggacagagggggug

SEQ ID NO: 2332281 - RNA, 15 nt, Human
ccugccaggcagggg

SEQ ID NO: 2332282 - RNA, 19 nt, Human
ccugccaggcagggguggg

SEQ ID NO: 2332283 - RNA, 22 nt, Human
ccugccaggcaggggugggggu

SEQ ID NO: 2332284 - RNA, 16 nt, Human
ccugccagggagacag

SEQ ID NO: 2332285 - RNA, 19 nt, Human
ccugccagggcagggcccc

SEQ ID NO: 2332286 - RNA, 17 nt, Human
ccugccagggcagggcc

SEQ ID NO: 2332287 - RNA, 13 nt, Human
ccugccagggcag

SEQ ID NO: 2332288 - RNA, 17 nt, Human
ccugccagggagacaga

SEQ ID NO: 2332289 - RNA, 19 nt, Human
ccugccagggagacagagc

SEQ ID NO: 2332290 - RNA, 20 nt, Human
ccugccagggagacagagcu

SEQ ID NO: 2332291 - RNA, 12 nt, Human
ccugccaguccu

SEQ ID NO: 2332292 - RNA, 14 nt, Human
ccugccaguccuag

SEQ ID NO: 2332293 - RNA, 15 nt, Human
ccugccaguccuagc

SEQ ID NO: 2332294 - RNA, 16 nt, Human
ccugccaguccuagcu

SEQ ID NO: 2332295 - RNA, 19 nt, Human
ccugccaguccuagcugca

SEQ ID NO: 2332296 - RNA, 20 nt, Human
ccugccaguccuagcugcac

SEQ ID NO: 2332297 - RNA, 21 nt, Human
ccugccaguccuagcugcaca

SEQ ID NO: 2332298 - RNA, 13 nt, Human
ccugccaccuggg

SEQ ID NO: 2332299 - RNA, 16 nt, Human
ccugccaccuggggca

SEQ ID NO: 2332300 - RNA, 12 nt, Human
ccugccacucac

SEQ ID NO: 2332301 - RNA, 13 nt, Human
ccugccacucaca

SEQ ID NO: 2332302 - RNA, 14 nt, Human
ccugccacucacac

SEQ ID NO: 2332303 - RNA, 16 nt, Human
ccugccacucacacag

SEQ ID NO: 2332304 - RNA, 17 nt, Human
ccugccacucacacagc

SEQ ID NO: 2332305 - RNA, 20 nt, Human
ccugccacucacacagccag

SEQ ID NO: 2332306 - RNA, 21 nt, Human
ccugccacucacacagccagg

SEQ ID NO: 2332307 - RNA, 22 nt, Human
ccugccacucacacagccaggu

SEQ ID NO: 2332308 - RNA, 23 nt, Human
ccugccacucacacagccaggug

SEQ ID NO: 2332309 - RNA, 12 nt, Human
ccugccaggcau

SEQ ID NO: 2332310 - RNA, 21 nt, Human
ccugccacucacuaggccccc

SEQ ID NO: 2332311 - RNA, 22 nt, Human
ccugccacucacuaggccccca

SEQ ID NO: 2332312 - RNA, 13 nt, Human
ccugccacucacu

SEQ ID NO: 2332313 - RNA, 15 nt, Human
ccugccacucacuag

SEQ ID NO: 2332314 - RNA, 16 nt, Human
ccugccacucacuagg

SEQ ID NO: 2332315 - RNA, 18 nt, Human
ccugccacucacuaggcc

SEQ ID NO: 2332316 - RNA, 17 nt, Human
ccugccccugccccguc

SEQ ID NO: 2332317 - RNA, 11 nt, Human
ccugccccugc

SEQ ID NO: 2332318 - RNA, 15 nt, Human
ccugccccucucccg

SEQ ID NO: 2332319 - RNA, 16 nt, Human
ccugccccucucccgc

SEQ ID NO: 2332320 - RNA, 17 nt, Human
ccugccccugagcccau

SEQ ID NO: 2332321 - RNA, 22 nt, Human
ccugccccuccucucugcccua

SEQ ID NO: 2332322 - RNA, 21 nt, Human
ccugccccuccucucugcccu

SEQ ID NO: 2332323 - RNA, 20 nt, Human
ccugccccuccucucugccc

SEQ ID NO: 2332324 - RNA, 19 nt, Human
ccugccccuccucucugcc

SEQ ID NO: 2332325 - RNA, 15 nt, Human
ccugccccucccuuc

SEQ ID NO: 2332326 - RNA, 16 nt, Human
ccugccccucccuuca

SEQ ID NO: 2332327 - RNA, 18 nt, Human
ccugccccucccuucaac

SEQ ID NO: 2332328 - RNA, 18 nt, Human
ccugccccuccucucugc

SEQ ID NO: 2332329 - RNA, 16 nt, Human
ccugcccccuggugga

SEQ ID NO: 2332330 - RNA, 15 nt, Human
ccugcccccuggugg

SEQ ID NO: 2332331 - RNA, 14 nt, Human
ccugcccccuggug

SEQ ID NO: 2332332 - RNA, 13 nt, Human
ccugcccccuggu

SEQ ID NO: 2332333 - RNA, 16 nt, Human
ccugcccccuucuccc

SEQ ID NO: 2332334 - RNA, 13 nt, Human
ccugcccccuucu

SEQ ID NO: 2332335 - RNA, 12 nt, Human
ccugcccccuuc

SEQ ID NO: 2332336 - RNA, 14 nt, Human
ccugccccucccuu

SEQ ID NO: 2332337 - RNA, 16 nt, Human
ccugcccuagcuccac

SEQ ID NO: 2332338 - RNA, 24 nt, Human
ccugcccuagagcacacuguagca

SEQ ID NO: 2332339 - RNA, 22 nt, Human
ccugcccuagagcacacuguag

SEQ ID NO: 2332340 - RNA, 19 nt, Human
ccugcccuagagcacacug

SEQ ID NO: 2332341 - RNA, 14 nt, Human
ccugcccuagcucc

SEQ ID NO: 2332342 - RNA, 14 nt, Human
ccugcccucaggga

SEQ ID NO: 2332343 - RNA, 15 nt, Human
ccugcccucagggau

SEQ ID NO: 2332344 - RNA, 19 nt, Human
ccugcccucaucucucucc

SEQ ID NO: 2332345 - RNA, 21 nt, Human
ccugcccucauggccccucug

SEQ ID NO: 2332346 - RNA, 23 nt, Human
ccugcccucauggccccucugac

SEQ ID NO: 2332347 - RNA, 18 nt, Human
ccugcccuagagcacacu

SEQ ID NO: 2332348 - RNA, 20 nt, Human
ccugcccuacagaggucucu

SEQ ID NO: 2332349 - RNA, 23 nt, Human
ccugcccuacagaggucucugcc

SEQ ID NO: 2332350 - RNA, 23 nt, Human
ccugcccgucucucucccaugga

SEQ ID NO: 2332351 - RNA, 22 nt, Human
ccugcccgucucucucccaugg

SEQ ID NO: 2332352 - RNA, 23 nt, Human
ccugcccguaaacacgccugcaa

SEQ ID NO: 2332353 - RNA, 22 nt, Human
ccugcccgggcgcggccagccc

SEQ ID NO: 2332354 - RNA, 12 nt, Human
ccugcccgucuc

SEQ ID NO: 2332355 - RNA, 13 nt, Human
ccugcccgucucu

SEQ ID NO: 2332356 - RNA, 17 nt, Human
ccugcccgucucucucc

SEQ ID NO: 2332357 - RNA, 19 nt, Human
ccugcccgucucucuccca

SEQ ID NO: 2332358 - RNA, 20 nt, Human
ccugcccgucucucucccau

SEQ ID NO: 2332359 - RNA, 14 nt, Human
ccugcccggcugcg

SEQ ID NO: 2332360 - RNA, 16 nt, Human
ccugcccggcugcgga

SEQ ID NO: 2332361 - RNA, 10 nt, Human
ccugcccggg

SEQ ID NO: 2332362 - RNA, 14 nt, Human
ccugccccuguucu

SEQ ID NO: 2332363 - RNA, 22 nt, Human
ccugcccguaaacacgccugca

SEQ ID NO: 2332364 - RNA, 21 nt, Human
ccugcccguaaacacgccugc

SEQ ID NO: 2332365 - RNA, 20 nt, Human
ccugcccguaaacacgccug

SEQ ID NO: 2332366 - RNA, 15 nt, Human
ccugcccguaaacac

SEQ ID NO: 2332367 - RNA, 13 nt, Human
ccugcccuccccu

SEQ ID NO: 2332368 - RNA, 20 nt, Human
ccugcccuccccagagcacu

SEQ ID NO: 2332369 - RNA, 21 nt, Human
ccugcccuccccagagcacug

SEQ ID NO: 2332370 - RNA, 14 nt, Human
ccugcccuccccag

SEQ ID NO: 2332371 - RNA, 15 nt, Human
ccugcccuccccaga

SEQ ID NO: 2332372 - RNA, 16 nt, Human
ccugcccuccccagag

SEQ ID NO: 2332373 - RNA, 19 nt, Human
ccugcccuccccagagcac

SEQ ID NO: 2332374 - RNA, 22 nt, Human
ccugcccuccccagagcacugg

SEQ ID NO: 2332375 - RNA, 12 nt, Human
ccugcccucgug

SEQ ID NO: 2332376 - RNA, 13 nt, Human
ccugcccucgugg

SEQ ID NO: 2332377 - RNA, 14 nt, Human
ccugcccucguggc

SEQ ID NO: 2332378 - RNA, 15 nt, Human
ccugcccucguggcc

SEQ ID NO: 2332379 - RNA, 16 nt, Human
ccugcccucguggcca

SEQ ID NO: 2332380 - RNA, 17 nt, Human
ccugcccucguggccag

SEQ ID NO: 2332381 - RNA, 18 nt, Human
ccugcccucguggccagc

SEQ ID NO: 2332382 - RNA, 11 nt, Human
ccugcccugca

SEQ ID NO: 2332383 - RNA, 13 nt, Human
ccugcccugcacg

SEQ ID NO: 2332384 - RNA, 19 nt, Human
ccugcccucguggccagcc

SEQ ID NO: 2332385 - RNA, 20 nt, Human
ccugcccucguggccagccc

SEQ ID NO: 2332386 - RNA, 22 nt, Human
ccugcccucguggccagcccgg

SEQ ID NO: 2332387 - RNA, 23 nt, Human
ccugcccucguggccagcccggc

SEQ ID NO: 2332388 - RNA, 13 nt, Human
ccugcccugcugc

SEQ ID NO: 2332389 - RNA, 14 nt, Human
ccugcccugccuga

SEQ ID NO: 2332390 - RNA, 15 nt, Human
ccugcccugccugag

SEQ ID NO: 2332391 - RNA, 13 nt, Human
ccugcccugccug

SEQ ID NO: 2332392 - RNA, 15 nt, Human
ccugcccugccccca

SEQ ID NO: 2332393 - RNA, 15 nt, Human
ccugcccugggaggc

SEQ ID NO: 2332394 - RNA, 14 nt, Human
ccugcccugggagg

SEQ ID NO: 2332395 - RNA, 12 nt, Human
ccugcccuggga

SEQ ID NO: 2332396 - RNA, 10 nt, Human
ccugcccugg

SEQ ID NO: 2332397 - RNA, 15 nt, Human
ccugcccugguccag

SEQ ID NO: 2332398 - RNA, 23 nt, Human
ccugcccugguuuccugcccugg

SEQ ID NO: 2332399 - RNA, 11 nt, Human
ccugcccugug

SEQ ID NO: 2332400 - RNA, 12 nt, Human
ccugcccugugg

SEQ ID NO: 2332401 - RNA, 14 nt, Human
ccugcccugugggc

SEQ ID NO: 2332402 - RNA, 12 nt, Human
ccugcccugguc

SEQ ID NO: 2332403 - RNA, 20 nt, Human
ccugcccugcugccgccucc

SEQ ID NO: 2332404 - RNA, 14 nt, Human
ccugcccugguuuc

SEQ ID NO: 2332405 - RNA, 22 nt, Human
ccugcccugggaggcagugaug

SEQ ID NO: 2332406 - RNA, 20 nt, Human
ccugcccugggaggcaguga

SEQ ID NO: 2332407 - RNA, 22 nt, Human
ccugcccugguuuccugcccug

SEQ ID NO: 2332408 - RNA, 21 nt, Human
ccugcccugguuuccugcccu

SEQ ID NO: 2332409 - RNA, 20 nt, Human
ccugcccugguuuccugccc

SEQ ID NO: 2332410 - RNA, 19 nt, Human
ccugcccugguuuccugcc

SEQ ID NO: 2332411 - RNA, 21 nt, Human
ccugcccuguuguguauagau

SEQ ID NO: 2332412 - RNA, 19 nt, Human
ccugcccuugucccacuca

SEQ ID NO: 2332413 - RNA, 13 nt, Human
ccugcccuugucu

SEQ ID NO: 2332414 - RNA, 16 nt, Human
ccugcccuugucccac

SEQ ID NO: 2332415 - RNA, 15 nt, Human
ccugcccuuguccca

SEQ ID NO: 2332416 - RNA, 18 nt, Human
ccugccgaccucguccuc

SEQ ID NO: 2332417 - RNA, 16 nt, Human
ccugcccuugucugag

SEQ ID NO: 2332418 - RNA, 17 nt, Human
ccugcccuugucugaga

SEQ ID NO: 2332419 - RNA, 14 nt, Human
ccugccgacuccug

SEQ ID NO: 2332420 - RNA, 16 nt, Human
ccugccgacuccuggg

SEQ ID NO: 2332421 - RNA, 15 nt, Human
ccugcccugugggcc

SEQ ID NO: 2332422 - RNA, 19 nt, Human
ccugcccuuaccugccagg

SEQ ID NO: 2332423 - RNA, 21 nt, Human
ccugcccuuaccugccaggaa

SEQ ID NO: 2332424 - RNA, 22 nt, Human
ccugcccuuaccugccaggaag

SEQ ID NO: 2332425 - RNA, 13 nt, Human
ccugccucagccu

SEQ ID NO: 2332426 - RNA, 14 nt, Human
ccugccucagccuc

SEQ ID NO: 2332427 - RNA, 12 nt, Human
ccugccucagcc

SEQ ID NO: 2332428 - RNA, 13 nt, Human
ccugccgcagagc

SEQ ID NO: 2332429 - RNA, 14 nt, Human
ccugccgcagagcu

SEQ ID NO: 2332430 - RNA, 15 nt, Human
ccugccgcagagcug

SEQ ID NO: 2332431 - RNA, 16 nt, Human
ccugccgcagagcugg

SEQ ID NO: 2332432 - RNA, 15 nt, Human
ccugccugucuccuu

SEQ ID NO: 2332433 - RNA, 12 nt, Human
ccugccugucug

SEQ ID NO: 2332434 - RNA, 14 nt, Human
ccugccugucuccu

SEQ ID NO: 2332435 - RNA, 13 nt, Human
ccugccugucucc

SEQ ID NO: 2332436 - RNA, 13 nt, Human
ccugccugucugu

SEQ ID NO: 2332437 - RNA, 17 nt, Human
ccugccugucugucucu

SEQ ID NO: 2332438 - RNA, 18 nt, Human
ccugccugucugucucuc

SEQ ID NO: 2332439 - RNA, 14 nt, Human
ccugccgccucaau

SEQ ID NO: 2332440 - RNA, 17 nt, Human
ccugccgcagagcuggc

SEQ ID NO: 2332441 - RNA, 16 nt, Human
ccugccuguagcccac

SEQ ID NO: 2332442 - RNA, 22 nt, Human
ccugccugucugucucuccauc

SEQ ID NO: 2332443 - RNA, 22 nt, Human
ccugccuguucccauucuugca

SEQ ID NO: 2332444 - RNA, 14 nt, Human
ccugccuguugggc

SEQ ID NO: 2332445 - RNA, 22 nt, Human
ccugccuguugggccaggagcc

SEQ ID NO: 2332446 - RNA, 20 nt, Human
cuacagguuacaacagauuu

SEQ ID NO: 2332447 - RNA, 11 nt, Human
cuacagguuac

SEQ ID NO: 2332448 - RNA, 14 nt, Human
cuacagguuacaac

SEQ ID NO: 2332449 - RNA, 17 nt, Human
cuacagguuacaacaga

SEQ ID NO: 2332450 - RNA, 18 nt, Human
cuacagguuacaacagau

SEQ ID NO: 2332451 - RNA, 16 nt, Human
cuacaggugugaguca

SEQ ID NO: 2332452 - RNA, 14 nt, Human
cuacaggugugagu

SEQ ID NO: 2332453 - RNA, 20 nt, Human
cuacauggaguauaugucaa

SEQ ID NO: 2332454 - RNA, 18 nt, Human
cuacauggaguauauguc

SEQ ID NO: 2332455 - RNA, 13 nt, Human
cuacaguccuccc

SEQ ID NO: 2332456 - RNA, 21 nt, Human
cuacagucaggaaaggaauca

SEQ ID NO: 2332457 - RNA, 18 nt, Human
cuacagucaggaaaggaa

SEQ ID NO: 2332458 - RNA, 15 nt, Human
cuacagucaggaaag

SEQ ID NO: 2332459 - RNA, 14 nt, Human
cuacagucaggaaa

SEQ ID NO: 2332460 - RNA, 22 nt, Human
cuacaggggaagguggccucug

SEQ ID NO: 2332461 - RNA, 18 nt, Human
cuacaggggaagguggcc

SEQ ID NO: 2332462 - RNA, 21 nt, Human
cuacaggagagggaagagugc

SEQ ID NO: 2332463 - RNA, 22 nt, Human
cuacaggcacacgccaccucgc

SEQ ID NO: 2332464 - RNA, 15 nt, Human
cuacaggcacccacc

SEQ ID NO: 2332465 - RNA, 17 nt, Human
cuacaggcacccaccau

SEQ ID NO: 2332466 - RNA, 18 nt, Human
cuacaggagagggaagag

SEQ ID NO: 2332467 - RNA, 22 nt, Human
cuacagcuuugugacuguauau

SEQ ID NO: 2332468 - RNA, 22 nt, Human
cuacaggaagcaccccaugcca

SEQ ID NO: 2332469 - RNA, 20 nt, Human
cuacaggaagcaccccaugc

SEQ ID NO: 2332470 - RNA, 18 nt, Human
cuacaggaagcaccccau

SEQ ID NO: 2332471 - RNA, 14 nt, Human
cuacaggagugagc

SEQ ID NO: 2332472 - RNA, 15 nt, Human
cuacaggagugagca

SEQ ID NO: 2332473 - RNA, 16 nt, Human
cuacaggagugagcac

SEQ ID NO: 2332474 - RNA, 21 nt, Human
cuacagcuaaucagcauucuc

SEQ ID NO: 2332475 - RNA, 22 nt, Human
cuacagcuaaucagcauucuca

SEQ ID NO: 2332476 - RNA, 15 nt, Human
cuacagauagucaaa

SEQ ID NO: 2332477 - RNA, 23 nt, Human
cuacagaggucucugccggcucu

SEQ ID NO: 2332478 - RNA, 14 nt, Human
cuacagauagucaa

SEQ ID NO: 2332479 - RNA, 18 nt, Human
cuacagcuaaucagcauu

SEQ ID NO: 2332480 - RNA, 19 nt, Human
cuacagcuaaucagcauuc

SEQ ID NO: 2332481 - RNA, 23 nt, Human
cuacagcuugaccgugaggccag

SEQ ID NO: 2332482 - RNA, 19 nt, Human
cuacagcuuugaucccuga

SEQ ID NO: 2332483 - RNA, 18 nt, Human
cuacagcuuugugacugu

SEQ ID NO: 2332484 - RNA, 19 nt, Human
cuacagcuugaccgugagg

SEQ ID NO: 2332485 - RNA, 22 nt, Human
cuacagcuugaccgugaggcca

SEQ ID NO: 2332486 - RNA, 17 nt, Human
cuacagaggccaugggc

SEQ ID NO: 2332487 - RNA, 17 nt, Human
cuacacugugcugaguc

SEQ ID NO: 2332488 - RNA, 13 nt, Human
cuacacugugcug

SEQ ID NO: 2332489 - RNA, 14 nt, Human
cuacacugugcuga

SEQ ID NO: 2332490 - RNA, 16 nt, Human
cuacacuccagccuga

SEQ ID NO: 2332491 - RNA, 16 nt, Human
cuacacugacacuggu

SEQ ID NO: 2332492 - RNA, 20 nt, Human
cuacacugugaacuugggga

SEQ ID NO: 2332493 - RNA, 20 nt, Human
cuacagaggucucugccggc

SEQ ID NO: 2332494 - RNA, 22 nt, Human
cuacagaggccaugggccuccu

SEQ ID NO: 2332495 - RNA, 18 nt, Human
cuacagaggccaugggcc

SEQ ID NO: 2332496 - RNA, 20 nt, Human
cuacagaggccaugggccuc

SEQ ID NO: 2332497 - RNA, 19 nt, Human
cuacccuagccauuccugg

SEQ ID NO: 2332498 - RNA, 12 nt, Human
cuacccucccac

SEQ ID NO: 2332499 - RNA, 18 nt, Human
cuacccuagccauuccug

SEQ ID NO: 2332500 - RNA, 17 nt, Human
cuacccccuaagagcca

SEQ ID NO: 2332501 - RNA, 19 nt, Human
cuacccccaggguugaggg

SEQ ID NO: 2332502 - RNA, 15 nt, Human
cuacccccuccucuc

SEQ ID NO: 2332503 - RNA, 17 nt, Human
cuacccccuccucucug

SEQ ID NO: 2332504 - RNA, 19 nt, Human
cuacccccuccucucugcc

SEQ ID NO: 2332505 - RNA, 14 nt, Human
cuacccucccccag

SEQ ID NO: 2332506 - RNA, 13 nt, Human
cuacccucccugc

SEQ ID NO: 2332507 - RNA, 14 nt, Human
cuacccucccugcu

SEQ ID NO: 2332508 - RNA, 15 nt, Human
cuacccucccugcug

SEQ ID NO: 2332509 - RNA, 16 nt, Human
cuacccucccugcugu

SEQ ID NO: 2332510 - RNA, 18 nt, Human
cuacccucccugcugucc

SEQ ID NO: 2332511 - RNA, 20 nt, Human
cuacccucccugcugucccc

SEQ ID NO: 2332512 - RNA, 19 nt, Human
cuacccucccacccccuuc

SEQ ID NO: 2332513 - RNA, 16 nt, Human
cuacccucccaccccc

SEQ ID NO: 2332514 - RNA, 14 nt, Human
cuacccucccaccc

SEQ ID NO: 2332515 - RNA, 13 nt, Human
cuacccucccacc

SEQ ID NO: 2332516 - RNA, 17 nt, Human
cuacccucuuagaaaaa

SEQ ID NO: 2332517 - RNA, 23 nt, Human
cuacccucccugcuguccccucu

SEQ ID NO: 2332518 - RNA, 15 nt, Human
cuacccucgggccca

SEQ ID NO: 2332519 - RNA, 16 nt, Human
cuacccucgggcccac

SEQ ID NO: 2332520 - RNA, 17 nt, Human
cuacccucgggcccacc

SEQ ID NO: 2332521 - RNA, 19 nt, Human
cuacccucgggcccaccug

SEQ ID NO: 2332522 - RNA, 20 nt, Human
cuacccucgggcccaccugg

SEQ ID NO: 2332523 - RNA, 22 nt, Human
cuacccucgggcccaccuggcc

SEQ ID NO: 2332524 - RNA, 17 nt, Human
cuacccugagcugaggc

SEQ ID NO: 2332525 - RNA, 12 nt, Human
cuacccugagcu

SEQ ID NO: 2332526 - RNA, 23 nt, Human
cuacccucgggcccaccuggcca

SEQ ID NO: 2332527 - RNA, 18 nt, Human
cuacccugagcugaggca

SEQ ID NO: 2332528 - RNA, 16 nt, Human
cuacccuuuuucucca

SEQ ID NO: 2332529 - RNA, 14 nt, Human
cuaccccaccacga

SEQ ID NO: 2332530 - RNA, 13 nt, Human
cuaccccaccacg

SEQ ID NO: 2332531 - RNA, 17 nt, Human
cuaccccaauuccuugu

SEQ ID NO: 2332532 - RNA, 12 nt, Human
cuaccccacacc

SEQ ID NO: 2332533 - RNA, 17 nt, Human
cuaccccacaccaggcc

SEQ ID NO: 2332534 - RNA, 21 nt, Human
cuaccccacaccaggccgucc

SEQ ID NO: 2332535 - RNA, 13 nt, Human
cuacccauccccg

SEQ ID NO: 2332536 - RNA, 16 nt, Human
cuaccccaauuccuug

SEQ ID NO: 2332537 - RNA, 15 nt, Human
cuacccauccccgca

SEQ ID NO: 2332538 - RNA, 18 nt, Human
cuacccagcgagcccugg

SEQ ID NO: 2332539 - RNA, 13 nt, Human
cuacccaggugcu

SEQ ID NO: 2332540 - RNA, 13 nt, Human
cuacccacccucc

SEQ ID NO: 2332541 - RNA, 13 nt, Human
cuacccaaccacu

SEQ ID NO: 2332542 - RNA, 14 nt, Human
cuacccaaccacuc

SEQ ID NO: 2332543 - RNA, 15 nt, Human
cuacccaaccacuca

SEQ ID NO: 2332544 - RNA, 16 nt, Human
cuacccaaccacucaa

SEQ ID NO: 2332545 - RNA, 16 nt, Human
cuacccacaccucugc

SEQ ID NO: 2332546 - RNA, 18 nt, Human
cuacccacaccucugcca

SEQ ID NO: 2332547 - RNA, 19 nt, Human
cuacccacaccucugccag

SEQ ID NO: 2332548 - RNA, 20 nt, Human
cuacccacaccucugccaga

SEQ ID NO: 2332549 - RNA, 15 nt, Human
cuacccagcgagccc

SEQ ID NO: 2332550 - RNA, 17 nt, Human
cuacccagcgagcccug

SEQ ID NO: 2332551 - RNA, 16 nt, Human
cuacaugugggagcuu

SEQ ID NO: 2332552 - RNA, 22 nt, Human
cuacauguauugcacauuguaa

SEQ ID NO: 2332553 - RNA, 18 nt, Human
cuacauguauugcacauu

SEQ ID NO: 2332554 - RNA, 21 nt, Human
cuacauguauugcacauugua

SEQ ID NO: 2332555 - RNA, 17 nt, Human
cuacaugcuuugugaac

SEQ ID NO: 2332556 - RNA, 23 nt, Human
cuacaugguugaaaccccaucuc

SEQ ID NO: 2332557 - RNA, 13 nt, Human
cuacauguauugc

SEQ ID NO: 2332558 - RNA, 17 nt, Human
cuacaugugggagcuuu

SEQ ID NO: 2332559 - RNA, 22 nt, Human
cuacauuauaaaugucucuuua

SEQ ID NO: 2332560 - RNA, 12 nt, Human
cuacauucauuu

SEQ ID NO: 2332561 - RNA, 14 nt, Human
cuaccaaagcaccu

SEQ ID NO: 2332562 - RNA, 14 nt, Human
cuacauucuguuaa

SEQ ID NO: 2332563 - RNA, 13 nt, Human
cuacauucuguua

SEQ ID NO: 2332564 - RNA, 19 nt, Human
cuaccaugaacagaaaaca

SEQ ID NO: 2332565 - RNA, 13 nt, Human
cuaccauucagug

SEQ ID NO: 2332566 - RNA, 17 nt, Human
cuaccaccuccccagcc

SEQ ID NO: 2332567 - RNA, 16 nt, Human
cuaccaccuccccagc

SEQ ID NO: 2332568 - RNA, 12 nt, Human
cuacccaaagga

SEQ ID NO: 2332569 - RNA, 20 nt, Human
cuaccauuugcagaguccug

SEQ ID NO: 2332570 - RNA, 13 nt, Human
cuaccauuucaga

SEQ ID NO: 2332571 - RNA, 12 nt, Human
cuaccauuucag

SEQ ID NO: 2332572 - RNA, 15 nt, Human
cuaccaccuccccag

SEQ ID NO: 2332573 - RNA, 14 nt, Human
cuaccaccucccca

SEQ ID NO: 2332574 - RNA, 11 nt, Human
cuaccaccucc

SEQ ID NO: 2332575 - RNA, 22 nt, Human
cuaccaccccuuccugucccac

SEQ ID NO: 2332576 - RNA, 16 nt, Human
cuaccaccccuuccug

SEQ ID NO: 2332577 - RNA, 17 nt, Human
cuaccaccccuuccugu

SEQ ID NO: 2332578 - RNA, 18 nt, Human
cuaccaccccuuccuguc

SEQ ID NO: 2332579 - RNA, 18 nt, Human
cuaccauccccuguagag

SEQ ID NO: 2332580 - RNA, 15 nt, Human
cuaccacagugucug

SEQ ID NO: 2332581 - RNA, 18 nt, Human
cuaccacaugccaagcac

SEQ ID NO: 2332582 - RNA, 14 nt, Human
cuaccaccccuucc

SEQ ID NO: 2332583 - RNA, 14 nt, Human
cuaccacagugucu

SEQ ID NO: 2332584 - RNA, 13 nt, Human
cuaccacaguguc

SEQ ID NO: 2332585 - RNA, 14 nt, Human
cuaccaaugcaugc

SEQ ID NO: 2332586 - RNA, 15 nt, Human
cuaccaaugcaugca

SEQ ID NO: 2332587 - RNA, 13 nt, Human
cuaccaaugcaug

SEQ ID NO: 2332588 - RNA, 19 nt, Human
cuaccaagcuauccuggcu

SEQ ID NO: 2332589 - RNA, 15 nt, Human
cuaccaaagcaccuu

SEQ ID NO: 2332590 - RNA, 18 nt, Human
cuaccaauagauucccca

SEQ ID NO: 2332591 - RNA, 22 nt, Human
cuaggaaauauuuauuuuaaua

SEQ ID NO: 2332592 - RNA, 21 nt, Human
cuaaaaauagacuuaaaucuc

SEQ ID NO: 2332593 - RNA, 23 nt, Human
cuaaaagugggcuugauucugca

SEQ ID NO: 2332594 - RNA, 11 nt, Human
cuaaaaauaaa

SEQ ID NO: 2332595 - RNA, 20 nt, Human
cuaaaagugggcuugauucu

SEQ ID NO: 2332596 - RNA, 22 nt, Human
cuaaaauaagggcagagucaca

SEQ ID NO: 2332597 - RNA, 22 nt, Human
cuaaaaaacauaaauuucuuua

SEQ ID NO: 2332598 - RNA, 17 nt, Human
cuaaaaaacagaggcca

SEQ ID NO: 2332599 - RNA, 11 nt, Human
cuaaaaaagau

SEQ ID NO: 2332600 - RNA, 13 nt, Human
cuaaaaaagauau

SEQ ID NO: 2332601 - RNA, 15 nt, Human
cuaaaaaagauauau

SEQ ID NO: 2332602 - RNA, 19 nt, Human
cuaaaaaagauauauuaaa

SEQ ID NO: 2332603 - RNA, 22 nt, Human
cuaaaaaagauauauuaaaaau

SEQ ID NO: 2332604 - RNA, 21 nt, Human
cuaaaaagaaggaaaaugauc

SEQ ID NO: 2332605 - RNA, 11 nt, Human
cuaaaaaacag

SEQ ID NO: 2332606 - RNA, 18 nt, Human
cguuuuauuguguuuuua

SEQ ID NO: 2332607 - RNA, 14 nt, Human
cguuuuauuguguu

SEQ ID NO: 2332608 - RNA, 20 nt, Human
cuaaaaaaaaaaaaguauua

SEQ ID NO: 2332609 - RNA, 18 nt, Human
cuaaaaaaaaaaaaguau

SEQ ID NO: 2332610 - RNA, 12 nt, Human
cguuuuauugug

SEQ ID NO: 2332611 - RNA, 23 nt, Human
cgggaggauguucugggacacag

SEQ ID NO: 2332612 - RNA, 21 nt, Human
cgggaggauguucugggacac

SEQ ID NO: 2332613 - RNA, 22 nt, Human
cgggaggcagagguugcagugu

SEQ ID NO: 2332614 - RNA, 21 nt, Human
cgggacgagacccuacaggag

SEQ ID NO: 2332615 - RNA, 20 nt, Human
cguuuguuccccaagacauu

SEQ ID NO: 2332616 - RNA, 14 nt, Human
cguuuguaugugug

SEQ ID NO: 2332617 - RNA, 15 nt, Human
cguuuguaugugugu

SEQ ID NO: 2332618 - RNA, 20 nt, Human
cgggaggcagagguugcagu

SEQ ID NO: 2332619 - RNA, 23 nt, Human
cgggaccccgagccuggcuccaa

SEQ ID NO: 2332620 - RNA, 13 nt, Human
cgggaccuggugc

SEQ ID NO: 2332621 - RNA, 13 nt, Human
cgggaccuguggc

SEQ ID NO: 2332622 - RNA, 14 nt, Human
cgggaccuguggcu

SEQ ID NO: 2332623 - RNA, 18 nt, Human
cgggacaccugcccugcc

SEQ ID NO: 2332624 - RNA, 13 nt, Human
cuaaaauagccac

SEQ ID NO: 2332625 - RNA, 19 nt, Human
cuaaaauagccacuuaccu

SEQ ID NO: 2332626 - RNA, 14 nt, Human
cuaaaauauuuauu

SEQ ID NO: 2332627 - RNA, 23 nt, Human
cuaaaauauuuauuuuuuuuaag

SEQ ID NO: 2332628 - RNA, 15 nt, Human
cuaaaauauuuauuu

SEQ ID NO: 2332629 - RNA, 14 nt, Human
cuaaaaugauuuua

SEQ ID NO: 2332630 - RNA, 23 nt, Human
cuaaaaugauuuuaucugugaau

SEQ ID NO: 2332631 - RNA, 22 nt, Human
cuaaaaugccucaguguauuug

SEQ ID NO: 2332632 - RNA, 13 nt, Human
cuaaacugccccc

SEQ ID NO: 2332633 - RNA, 12 nt, Human
cuaaacugcccc

SEQ ID NO: 2332634 - RNA, 22 nt, Human
cuaaacucauuuauaaagcuaa

SEQ ID NO: 2332635 - RNA, 17 nt, Human
cuaaacucauuuauaaa

SEQ ID NO: 2332636 - RNA, 22 nt, Human
cuaaacucucuuugggaauguu

SEQ ID NO: 2332637 - RNA, 15 nt, Human
cuaaacucauuuaua

SEQ ID NO: 2332638 - RNA, 14 nt, Human
cuaaacucauuuau

SEQ ID NO: 2332639 - RNA, 14 nt, Human
cuaaacuaucuuuu

SEQ ID NO: 2332640 - RNA, 15 nt, Human
cuaaacuaucuuuuu

SEQ ID NO: 2332641 - RNA, 23 nt, Human
cuaaauagcauguauugugucuu

SEQ ID NO: 2332642 - RNA, 15 nt, Human
cuaaaucucuaauau

SEQ ID NO: 2332643 - RNA, 15 nt, Human
cuaaauagcauguau

SEQ ID NO: 2332644 - RNA, 17 nt, Human
cuaaauagcauguauug

SEQ ID NO: 2332645 - RNA, 20 nt, Human
cuaaauagcauguauugugu

SEQ ID NO: 2332646 - RNA, 22 nt, Human
cuaaauagcauguauugugucu

SEQ ID NO: 2332647 - RNA, 22 nt, Human
cuaaaugaaaaucgugacaaca

SEQ ID NO: 2332648 - RNA, 21 nt, Human
cuaaaucuccaaaauaaaacu

SEQ ID NO: 2332649 - RNA, 24 nt, Human
cuaaauaccugcccugacaugcac

SEQ ID NO: 2332650 - RNA, 14 nt, Human
cuaaauagcaugua

SEQ ID NO: 2332651 - RNA, 23 nt, Human
cuaaauaaagcuugcaacaaaau

SEQ ID NO: 2332652 - RNA, 15 nt, Human
cuaaauaaaauuugu

SEQ ID NO: 2332653 - RNA, 20 nt, Human
cuaaauaaaauuuguugcau

SEQ ID NO: 2332654 - RNA, 21 nt, Human
cuaaacugcccccucugcccu

SEQ ID NO: 2332655 - RNA, 11 nt, Human
cuaaacugcau

SEQ ID NO: 2332656 - RNA, 24 nt, Human
cuaaaguuuacaguaaauaaauug

SEQ ID NO: 2332657 - RNA, 18 nt, Human
cuaagaguguccuaggag

SEQ ID NO: 2332658 - RNA, 18 nt, Human
cuaagaguugagcucucg

SEQ ID NO: 2332659 - RNA, 21 nt, Human
cuaagaguugagcucucggaa

SEQ ID NO: 2332660 - RNA, 12 nt, Human
cuaagaugacau

SEQ ID NO: 2332661 - RNA, 12 nt, Human
cuaagagugucc

SEQ ID NO: 2332662 - RNA, 22 nt, Human
cuaagagugcugggcauuuuua

SEQ ID NO: 2332663 - RNA, 16 nt, Human
cuaagauaguaacaau

SEQ ID NO: 2332664 - RNA, 23 nt, Human
cuaagagggagggagggcuccag

SEQ ID NO: 2332665 - RNA, 20 nt, Human
cuaagagcuagcgcugccgc

SEQ ID NO: 2332666 - RNA, 19 nt, Human
cuaagagcuagcgcugccg

SEQ ID NO: 2332667 - RNA, 13 nt, Human
cuaagagcucccg

SEQ ID NO: 2332668 - RNA, 13 nt, Human
cuaagagggaggg

SEQ ID NO: 2332669 - RNA, 15 nt, Human
cuaagagggagggag

SEQ ID NO: 2332670 - RNA, 22 nt, Human
cuaagagggagggagggcucca

SEQ ID NO: 2332671 - RNA, 18 nt, Human
cuaagagcuagcgcugcc

SEQ ID NO: 2332672 - RNA, 16 nt, Human
cuaagagcuagcgcug

SEQ ID NO: 2332673 - RNA, 20 nt, Human
cuaagagccauuuaggggcc

SEQ ID NO: 2332674 - RNA, 11 nt, Human
cuaagagccau

SEQ ID NO: 2332675 - RNA, 11 nt, Human
cuaaccugacc

SEQ ID NO: 2332676 - RNA, 21 nt, Human
cuaaccugaccgugggcgggg

SEQ ID NO: 2332677 - RNA, 22 nt, Human
cuaagagaaguuauuuucuaca

SEQ ID NO: 2332678 - RNA, 14 nt, Human
cuaagagagagaga

SEQ ID NO: 2332679 - RNA, 14 nt, Human
cuaagagagaauga

SEQ ID NO: 2332680 - RNA, 15 nt, Human
cuaagagagaaugag

SEQ ID NO: 2332681 - RNA, 12 nt, Human
cuaaccucaucu

SEQ ID NO: 2332682 - RNA, 21 nt, Human
cuaacccucagaaacacuggg

SEQ ID NO: 2332683 - RNA, 20 nt, Human
cuaacccucccauggcaccu

SEQ ID NO: 2332684 - RNA, 19 nt, Human
cuaacccuuaucaccagcu

SEQ ID NO: 2332685 - RNA, 15 nt, Human
cuaaccucaucuucu

SEQ ID NO: 2332686 - RNA, 16 nt, Human
cuaaccccuuuccugc

SEQ ID NO: 2332687 - RNA, 14 nt, Human
cuaaccccuuuccu

SEQ ID NO: 2332688 - RNA, 13 nt, Human
cuaaccccuuucc

SEQ ID NO: 2332689 - RNA, 16 nt, Human
cuaaccccgggcgggu

SEQ ID NO: 2332690 - RNA, 16 nt, Human
cuaaccccaggccccg

SEQ ID NO: 2332691 - RNA, 13 nt, Human
cuaaccacaucaa

SEQ ID NO: 2332692 - RNA, 13 nt, Human
cuaaccccaggcc

SEQ ID NO: 2332693 - RNA, 15 nt, Human
cuaaccccaggcccc

SEQ ID NO: 2332694 - RNA, 12 nt, Human
cuaaccacgcug

SEQ ID NO: 2332695 - RNA, 14 nt, Human
cuaaccacgcugga

SEQ ID NO: 2332696 - RNA, 12 nt, Human
cuaacaucagaa

SEQ ID NO: 2332697 - RNA, 18 nt, Human
cuaacauuuuaaauaaaa

SEQ ID NO: 2332698 - RNA, 21 nt, Human
cuaacauuuuaaauaaaagaa

SEQ ID NO: 2332699 - RNA, 17 nt, Human
cuaacagauaagcaaga

SEQ ID NO: 2332700 - RNA, 16 nt, Human
cuaacacuggccccua

SEQ ID NO: 2332701 - RNA, 18 nt, Human
cuaacagauaagcaagag

SEQ ID NO: 2332702 - RNA, 17 nt, Human
cuaacacuggccccuag

SEQ ID NO: 2332703 - RNA, 22 nt, Human
cuaacaagucauagguuaauau

SEQ ID NO: 2332704 - RNA, 12 nt, Human
cuaacauauaau

SEQ ID NO: 2332705 - RNA, 22 nt, Human
cuaacauauaauguuguuauuu

SEQ ID NO: 2332706 - RNA, 23 nt, Human
cuaacauauaauguuguuauuua

SEQ ID NO: 2332707 - RNA, 17 nt, Human
cuaacagcucaggaucu

SEQ ID NO: 2332708 - RNA, 13 nt, Human
cuaaaugaagugc

SEQ ID NO: 2332709 - RNA, 12 nt, Human
cuaaaugaaugu

SEQ ID NO: 2332710 - RNA, 14 nt, Human
cuaaaugaauguuu

SEQ ID NO: 2332711 - RNA, 14 nt, Human
cuaaauuccacacu

SEQ ID NO: 2332712 - RNA, 16 nt, Human
cuaaauucaugcugcu

SEQ ID NO: 2332713 - RNA, 19 nt, Human
cuaaauugacacuuaaaaa

SEQ ID NO: 2332714 - RNA, 17 nt, Human
cuaaauugaaaccugga

SEQ ID NO: 2332715 - RNA, 12 nt, Human
cuaaauugaaua

SEQ ID NO: 2332716 - RNA, 13 nt, Human
cuaaauugaauaa

SEQ ID NO: 2332717 - RNA, 14 nt, Human
cuaaauugaauaau

SEQ ID NO: 2332718 - RNA, 13 nt, Human
cguuuucaaaauu

SEQ ID NO: 2332719 - RNA, 23 nt, Human
cuaauagcggguuacuuucacau

SEQ ID NO: 2332720 - RNA, 17 nt, Human
cuaauauacaggguagc

SEQ ID NO: 2332721 - RNA, 22 nt, Human
cuaauauaaguuucuuugcuuc

SEQ ID NO: 2332722 - RNA, 23 nt, Human
cuaauaguuuuauuaauaaacau

SEQ ID NO: 2332723 - RNA, 15 nt, Human
cuaauauauuuuuau

SEQ ID NO: 2332724 - RNA, 12 nt, Human
cuaauaucagca

SEQ ID NO: 2332725 - RNA, 12 nt, Human
cuaauauauuuu

SEQ ID NO: 2332726 - RNA, 21 nt, Human
cuaauauauuuuuauauuuag

SEQ ID NO: 2332727 - RNA, 11 nt, Human
cuaauauauuu

SEQ ID NO: 2332728 - RNA, 13 nt, Human
cuaauagaacuca

SEQ ID NO: 2332729 - RNA, 20 nt, Human
cuaauagaacucaguuuuaa

SEQ ID NO: 2332730 - RNA, 17 nt, Human
cuaauagacaauuuauu

SEQ ID NO: 2332731 - RNA, 23 nt, Human
cuaauagacaauuuauuauggca

SEQ ID NO: 2332732 - RNA, 19 nt, Human
cuaauagacaauuuauuau

SEQ ID NO: 2332733 - RNA, 12 nt, Human
cuaauacaccag

SEQ ID NO: 2332734 - RNA, 18 nt, Human
cuaauaaucauuggauuc

SEQ ID NO: 2332735 - RNA, 23 nt, Human
cuaauacagcaacaauuuaugaa

SEQ ID NO: 2332736 - RNA, 19 nt, Human
cuaauacagcaacaauuua

SEQ ID NO: 2332737 - RNA, 13 nt, Human
cuaauaccucugu

SEQ ID NO: 2332738 - RNA, 15 nt, Human
cuaauaccucugugu

SEQ ID NO: 2332739 - RNA, 16 nt, Human
cuaauaccucugugug

SEQ ID NO: 2332740 - RNA, 17 nt, Human
cuaauaccucugugugc

SEQ ID NO: 2332741 - RNA, 14 nt, Human
cuaauaaagcugug

SEQ ID NO: 2332742 - RNA, 19 nt, Human
cuaaguaaaaccacagcag

SEQ ID NO: 2332743 - RNA, 18 nt, Human
cuaaguaaaaccacagca

SEQ ID NO: 2332744 - RNA, 14 nt, Human
cuaaguaaaaccac

SEQ ID NO: 2332745 - RNA, 22 nt, Human
cuaagcucaaggcgugaggaug

SEQ ID NO: 2332746 - RNA, 19 nt, Human
cuaagcuuugccagcugcu

SEQ ID NO: 2332747 - RNA, 20 nt, Human
cuaagcuuugccagcugcug

SEQ ID NO: 2332748 - RNA, 22 nt, Human
cuaagcuuugccagcugcugcu

SEQ ID NO: 2332749 - RNA, 21 nt, Human
cuaagcuucacuguaaaauaa

SEQ ID NO: 2332750 - RNA, 22 nt, Human
cuaagcuauucaguaauaacuc

SEQ ID NO: 2332751 - RNA, 11 nt, Human
cuaagaugcuc

SEQ ID NO: 2332752 - RNA, 15 nt, Human
cuaagaugacauugc

SEQ ID NO: 2332753 - RNA, 18 nt, Human
cuaagaugacauugcuaa

SEQ ID NO: 2332754 - RNA, 19 nt, Human
cuaagaugacauugcuaag

SEQ ID NO: 2332755 - RNA, 20 nt, Human
cuaagaugacauugcuaaga

SEQ ID NO: 2332756 - RNA, 19 nt, Human
cuaaggccgaagaaggguc

SEQ ID NO: 2332757 - RNA, 16 nt, Human
cuaaggcguggagcug

SEQ ID NO: 2332758 - RNA, 21 nt, Human
cuaaggcguggagcugccuga

SEQ ID NO: 2332759 - RNA, 22 nt, Human
cuaaggcguggagcugccugau

SEQ ID NO: 2332760 - RNA, 17 nt, Human
cuaaggcguggagcugc

SEQ ID NO: 2332761 - RNA, 18 nt, Human
cuaaggcguggagcugcc

SEQ ID NO: 2332762 - RNA, 19 nt, Human
cuaaggcguggagcugccu

SEQ ID NO: 2332763 - RNA, 20 nt, Human
cuaaggcguggagcugccug

SEQ ID NO: 2332764 - RNA, 14 nt, Human
cuaagguucucaua

SEQ ID NO: 2332765 - RNA, 19 nt, Human
cuaaggacauuucccaggg

SEQ ID NO: 2332766 - RNA, 17 nt, Human
cuaaggacauuucccag

SEQ ID NO: 2332767 - RNA, 16 nt, Human
cuaaggacauuuccca

SEQ ID NO: 2332768 - RNA, 16 nt, Human
cuaaggacacacuaau

SEQ ID NO: 2332769 - RNA, 11 nt, Human
cuaaggacaca

SEQ ID NO: 2332770 - RNA, 12 nt, Human
cuaaggacacac

SEQ ID NO: 2332771 - RNA, 13 nt, Human
cuaaggacacacu

SEQ ID NO: 2332772 - RNA, 14 nt, Human
cuaaggacacacua

SEQ ID NO: 2332773 - RNA, 18 nt, Human
cuacaccuuucuccuuug

SEQ ID NO: 2332774 - RNA, 20 nt, Human
cuacaccuuucuccuuugua

SEQ ID NO: 2332775 - RNA, 14 nt, Human
cuacacuccagccu

SEQ ID NO: 2332776 - RNA, 13 nt, Human
cuacaccuugagg

SEQ ID NO: 2332777 - RNA, 14 nt, Human
cuacacuaagagag

SEQ ID NO: 2332778 - RNA, 23 nt, Human
cuacacgagauacagaauuuuau

SEQ ID NO: 2332779 - RNA, 15 nt, Human
cuacaccuuucuccu

SEQ ID NO: 2332780 - RNA, 13 nt, Human
cuacaccuggcug

SEQ ID NO: 2332781 - RNA, 15 nt, Human
cuacaccuggcugag

SEQ ID NO: 2332782 - RNA, 12 nt, Human
cuacaccuggcu

SEQ ID NO: 2332783 - RNA, 18 nt, Human
cuacacccuuuuccagcu

SEQ ID NO: 2332784 - RNA, 13 nt, Human
cuacaccuaacuc

SEQ ID NO: 2332785 - RNA, 14 nt, Human
cuacaccuaacuca

SEQ ID NO: 2332786 - RNA, 16 nt, Human
cuacacccuuuuccag

SEQ ID NO: 2332787 - RNA, 16 nt, Human
cuacacccuuggacuu

SEQ ID NO: 2332788 - RNA, 20 nt, Human
cuacacccuuggacuugagg

SEQ ID NO: 2332789 - RNA, 22 nt, Human
cuacaccccuccccugcccuag

SEQ ID NO: 2332790 - RNA, 21 nt, Human
cuacacacugcauguuuguga

SEQ ID NO: 2332791 - RNA, 15 nt, Human
cuaauuccuuucuau

SEQ ID NO: 2332792 - RNA, 21 nt, Human
cuacacaggggaaaagaggag

SEQ ID NO: 2332793 - RNA, 21 nt, Human
cuacacauauguauuccugau

SEQ ID NO: 2332794 - RNA, 14 nt, Human
cuacacagggaugu

SEQ ID NO: 2332795 - RNA, 21 nt, Human
cuacacagggauguacaaggc

SEQ ID NO: 2332796 - RNA, 23 nt, Human
cuacacagucugcaagauucuga

SEQ ID NO: 2332797 - RNA, 21 nt, Human
cuaauucccauuuugcaaaau

SEQ ID NO: 2332798 - RNA, 20 nt, Human
cuaauucccauuuugcaaaa

SEQ ID NO: 2332799 - RNA, 19 nt, Human
cuaauucccauuuugcaaa

SEQ ID NO: 2332800 - RNA, 18 nt, Human
cuaauucccauuuugcaa

SEQ ID NO: 2332801 - RNA, 17 nt, Human
cuaauucccauuuugca

SEQ ID NO: 2332802 - RNA, 16 nt, Human
cuaauucccagagugu

SEQ ID NO: 2332803 - RNA, 14 nt, Human
cuaauucccagagu

SEQ ID NO: 2332804 - RNA, 16 nt, Human
cuaauuccacagcugc

SEQ ID NO: 2332805 - RNA, 15 nt, Human
cuaauuccacagcug

SEQ ID NO: 2332806 - RNA, 14 nt, Human
cuaauuccacagcu

SEQ ID NO: 2332807 - RNA, 17 nt, Human
cuaauuccacaccuuuu

SEQ ID NO: 2332808 - RNA, 15 nt, Human
cuaauuccacaccuu

SEQ ID NO: 2332809 - RNA, 13 nt, Human
cuaauucauuuau

SEQ ID NO: 2332810 - RNA, 14 nt, Human
cuaauuagagcaga

SEQ ID NO: 2332811 - RNA, 22 nt, Human
cuaauuauacccccugcaaagc

SEQ ID NO: 2332812 - RNA, 19 nt, Human
cuaauggguauuuaaacaa

SEQ ID NO: 2332813 - RNA, 16 nt, Human
cuaauuauauaauauu

SEQ ID NO: 2332814 - RNA, 18 nt, Human
cuaauuauauaauauuuu

SEQ ID NO: 2332815 - RNA, 19 nt, Human
cuaaugcuccuuguuccua

SEQ ID NO: 2332816 - RNA, 23 nt, Human
cuaaugcugcagauuugggcugg

SEQ ID NO: 2332817 - RNA, 18 nt, Human
cuaaugcuccuuguuccu

SEQ ID NO: 2332818 - RNA, 12 nt, Human
cuaaugcuccuu

SEQ ID NO: 2332819 - RNA, 18 nt, Human
cuaaugccuuacucuucu

SEQ ID NO: 2332820 - RNA, 23 nt, Human
cuaaugcgcaggcuggcccugcc

SEQ ID NO: 2332821 - RNA, 22 nt, Human
cuaaugcgcaggcuggcccugc

SEQ ID NO: 2332822 - RNA, 12 nt, Human
cuaaugggacac

SEQ ID NO: 2332823 - RNA, 13 nt, Human
cuaaugggacacu

SEQ ID NO: 2332824 - RNA, 18 nt, Human
cuaauauguaacaagcca

SEQ ID NO: 2332825 - RNA, 13 nt, Human
cuaauauggcaaa

SEQ ID NO: 2332826 - RNA, 20 nt, Human
cuaaucagcauucucacucc

SEQ ID NO: 2332827 - RNA, 21 nt, Human
cuaaucagcauucucacuccu

SEQ ID NO: 2332828 - RNA, 20 nt, Human
cuaauauggccacaguaguc

SEQ ID NO: 2332829 - RNA, 19 nt, Human
cuaaucagggaggucauuu

SEQ ID NO: 2332830 - RNA, 20 nt, Human
cuaaucagggaggucauuuu

SEQ ID NO: 2332831 - RNA, 21 nt, Human
cuaaucagggaggucauuuug

SEQ ID NO: 2332832 - RNA, 15 nt, Human
cuaauccaacccaug

SEQ ID NO: 2332833 - RNA, 16 nt, Human
cuaaucauccaaugcu

SEQ ID NO: 2332834 - RNA, 21 nt, Human
cuaaucagugucucacacugg

SEQ ID NO: 2332835 - RNA, 13 nt, Human
cuaauccaaccca

SEQ ID NO: 2332836 - RNA, 20 nt, Human
cuaaucaggcugaggugucu

SEQ ID NO: 2332837 - RNA, 12 nt, Human
cuaaucaguguc

SEQ ID NO: 2332838 - RNA, 13 nt, Human
cuaaucagugucu

SEQ ID NO: 2332839 - RNA, 15 nt, Human
cuaaucagugucuca

SEQ ID NO: 2332840 - RNA, 16 nt, Human
cuaaucagugucucac

SEQ ID NO: 2332841 - RNA, 17 nt, Human
cuaaucagugucucaca

SEQ ID NO: 2332842 - RNA, 18 nt, Human
cuaaucagugucucacac

SEQ ID NO: 2332843 - RNA, 20 nt, Human
cuaaucagugucucacacug

SEQ ID NO: 2332844 - RNA, 20 nt, Human
cuaaugcgcaggcuggcccu

SEQ ID NO: 2332845 - RNA, 19 nt, Human
cuaaugcgcaggcuggccc

SEQ ID NO: 2332846 - RNA, 16 nt, Human
cuaaugcgcaggcugg

SEQ ID NO: 2332847 - RNA, 15 nt, Human
cuaaugcgcaggcug

SEQ ID NO: 2332848 - RNA, 22 nt, Human
cuacuuaauuccuuucucaucc

SEQ ID NO: 2332849 - RNA, 15 nt, Human
cuacuuaauuccuuu

SEQ ID NO: 2332850 - RNA, 19 nt, Human
cuacuuaauuccuuucuca

SEQ ID NO: 2332851 - RNA, 21 nt, Human
cuacuuaccuaccacaugcca

SEQ ID NO: 2332852 - RNA, 22 nt, Human
cuacuuacaugcauuacugcau

SEQ ID NO: 2332853 - RNA, 20 nt, Human
cuacuguccuacccacccuc

SEQ ID NO: 2332854 - RNA, 17 nt, Human
cuacuguaauuuuauau

SEQ ID NO: 2332855 - RNA, 20 nt, Human
cuacugucucacugaaacau

SEQ ID NO: 2332856 - RNA, 19 nt, Human
cuacuguaauuuuauauga

SEQ ID NO: 2332857 - RNA, 17 nt, Human
cuacuuagcaugucccu

SEQ ID NO: 2332858 - RNA, 19 nt, Human
cuacuuaccauaugugcuu

SEQ ID NO: 2332859 - RNA, 22 nt, Human
cuacuuagcaugucccuaccga

SEQ ID NO: 2332860 - RNA, 18 nt, Human
cuacuuugucuaaaaaua

SEQ ID NO: 2332861 - RNA, 17 nt, Human
cuacuuuugcaugaaaa

SEQ ID NO: 2332862 - RNA, 18 nt, Human
cuacuuuugcaugaaaau

SEQ ID NO: 2332863 - RNA, 16 nt, Human
cuagaaacagaucuug

SEQ ID NO: 2332864 - RNA, 22 nt, Human
cuagaaagccuguuccccucac

SEQ ID NO: 2332865 - RNA, 16 nt, Human
cuagaaacuuccaaau

SEQ ID NO: 2332866 - RNA, 14 nt, Human
cuagaaacuuccaa

SEQ ID NO: 2332867 - RNA, 13 nt, Human
cuagaaauaugau

SEQ ID NO: 2332868 - RNA, 15 nt, Human
cuagaaauaugauuu

SEQ ID NO: 2332869 - RNA, 17 nt, Human
cuagaaauaugauuuua

SEQ ID NO: 2332870 - RNA, 13 nt, Human
cuagacuuucugu

SEQ ID NO: 2332871 - RNA, 14 nt, Human
cuagacuuucuguu

SEQ ID NO: 2332872 - RNA, 15 nt, Human
cuagagaacgcagcc

SEQ ID NO: 2332873 - RNA, 16 nt, Human
cuagagaacgcagccc

SEQ ID NO: 2332874 - RNA, 17 nt, Human
cuagagaacgcagcccu

SEQ ID NO: 2332875 - RNA, 18 nt, Human
cuagagaacgcagcccua

SEQ ID NO: 2332876 - RNA, 12 nt, Human
cuagagaagagg

SEQ ID NO: 2332877 - RNA, 15 nt, Human
cuagagaagaggcug

SEQ ID NO: 2332878 - RNA, 12 nt, Human
cuagacuuucug

SEQ ID NO: 2332879 - RNA, 16 nt, Human
cuagagggaccucucc

SEQ ID NO: 2332880 - RNA, 15 nt, Human
cuagagggaccucuc

SEQ ID NO: 2332881 - RNA, 14 nt, Human
cuagagggaccucu

SEQ ID NO: 2332882 - RNA, 22 nt, Human
cuagaggcuugcauaauaagcu

SEQ ID NO: 2332883 - RNA, 17 nt, Human
cuagagguucaaagaua

SEQ ID NO: 2332884 - RNA, 21 nt, Human
cuagagguucaaagauauuuu

SEQ ID NO: 2332885 - RNA, 18 nt, Human
cuagagguucaaagauau

SEQ ID NO: 2332886 - RNA, 15 nt, Human
cuagagguucaaaga

SEQ ID NO: 2332887 - RNA, 18 nt, Human
cuagaguuuagcuggaaa

SEQ ID NO: 2332888 - RNA, 16 nt, Human
cuagagugagggccug

SEQ ID NO: 2332889 - RNA, 17 nt, Human
cuagagugagggccuga

SEQ ID NO: 2332890 - RNA, 18 nt, Human
cuagagugagggccugag

SEQ ID NO: 2332891 - RNA, 19 nt, Human
cuagaguuuagcuggaaaa

SEQ ID NO: 2332892 - RNA, 22 nt, Human
cuagaggccagccccacccagg

SEQ ID NO: 2332893 - RNA, 14 nt, Human
cuagagccugccug

SEQ ID NO: 2332894 - RNA, 23 nt, Human
cuagaggccagccccacccagga

SEQ ID NO: 2332895 - RNA, 12 nt, Human
cuagaggccuga

SEQ ID NO: 2332896 - RNA, 14 nt, Human
cuagagcagggauu

SEQ ID NO: 2332897 - RNA, 15 nt, Human
cuagagcagggauua

SEQ ID NO: 2332898 - RNA, 17 nt, Human
cuagagcagcccuggag

SEQ ID NO: 2332899 - RNA, 11 nt, Human
cuagagccugc

SEQ ID NO: 2332900 - RNA, 12 nt, Human
cuagagccugcc

SEQ ID NO: 2332901 - RNA, 13 nt, Human
cuagagccugccu

SEQ ID NO: 2332902 - RNA, 13 nt, Human
cuagaggccugag

SEQ ID NO: 2332903 - RNA, 15 nt, Human
cuagaggccugagga

SEQ ID NO: 2332904 - RNA, 16 nt, Human
cuagaggccugaggau

SEQ ID NO: 2332905 - RNA, 18 nt, Human
cuagaggccugaggauga

SEQ ID NO: 2332906 - RNA, 20 nt, Human
cuagaggccugaggaugagc

SEQ ID NO: 2332907 - RNA, 22 nt, Human
cuagaggccugaggaugagcug

SEQ ID NO: 2332908 - RNA, 23 nt, Human
cuagaggcuuccuucauuuccuc

SEQ ID NO: 2332909 - RNA, 21 nt, Human
cuagaggcuuccuucauuucc

SEQ ID NO: 2332910 - RNA, 19 nt, Human
cuagaggcuuccuucauuu

SEQ ID NO: 2332911 - RNA, 18 nt, Human
cuagaggcuuccuucauu

SEQ ID NO: 2332912 - RNA, 12 nt, Human
cuagagagggag

SEQ ID NO: 2332913 - RNA, 22 nt, Human
cuagagacagaagcaggcugga

SEQ ID NO: 2332914 - RNA, 23 nt, Human
cuagagacagaagcaggcuggag

SEQ ID NO: 2332915 - RNA, 19 nt, Human
cuagagaauguuagaggau

SEQ ID NO: 2332916 - RNA, 15 nt, Human
cuagagacagaagca

SEQ ID NO: 2332917 - RNA, 20 nt, Human
cuagagacagaagcaggcug

SEQ ID NO: 2332918 - RNA, 17 nt, Human
cuagagaagaggcuggu

SEQ ID NO: 2332919 - RNA, 19 nt, Human
cuagagaagaggcuggugc

SEQ ID NO: 2332920 - RNA, 17 nt, Human
cuagagauauggcagcg

SEQ ID NO: 2332921 - RNA, 17 nt, Human
cuagagaucugguuuug

SEQ ID NO: 2332922 - RNA, 23 nt, Human
cuagagagggaggcaagcccugu

SEQ ID NO: 2332923 - RNA, 22 nt, Human
cuagagagggaggcaagcccug

SEQ ID NO: 2332924 - RNA, 21 nt, Human
cuagagagggaggcaagcccu

SEQ ID NO: 2332925 - RNA, 13 nt, Human
cuagagagggagg

SEQ ID NO: 2332926 - RNA, 15 nt, Human
cuagagcagcccugg

SEQ ID NO: 2332927 - RNA, 21 nt, Human
cuagagaucugguuuugcuau

SEQ ID NO: 2332928 - RNA, 22 nt, Human
cuagagaucugguuuugcuauu

SEQ ID NO: 2332929 - RNA, 14 nt, Human
cuacugcagcuuua

SEQ ID NO: 2332930 - RNA, 17 nt, Human
cuacugauuguuucauu

SEQ ID NO: 2332931 - RNA, 17 nt, Human
cuacugauaaagaaaga

SEQ ID NO: 2332932 - RNA, 16 nt, Human
cuacugauuuccuuug

SEQ ID NO: 2332933 - RNA, 16 nt, Human
cuacugauuuuuguga

SEQ ID NO: 2332934 - RNA, 16 nt, Human
cuacugauuguuucau

SEQ ID NO: 2332935 - RNA, 12 nt, Human
cuacucuguguc

SEQ ID NO: 2332936 - RNA, 13 nt, Human
cuacucuguguca

SEQ ID NO: 2332937 - RNA, 22 nt, Human
cuacucucaggaucaagaaagu

SEQ ID NO: 2332938 - RNA, 18 nt, Human
cuacucucccauggcuua

SEQ ID NO: 2332939 - RNA, 22 nt, Human
cuacucuggagguuuguuuaga

SEQ ID NO: 2332940 - RNA, 13 nt, Human
cuacucuccucau

SEQ ID NO: 2332941 - RNA, 12 nt, Human
cuacucuccuca

SEQ ID NO: 2332942 - RNA, 17 nt, Human
cuacucuccucaucucu

SEQ ID NO: 2332943 - RNA, 17 nt, Human
cuacucuccucggcccc

SEQ ID NO: 2332944 - RNA, 14 nt, Human
cuacucugugccag

SEQ ID NO: 2332945 - RNA, 15 nt, Human
cuacugggagccuac

SEQ ID NO: 2332946 - RNA, 14 nt, Human
cuacugggagccua

SEQ ID NO: 2332947 - RNA, 17 nt, Human
cuacugcagcuuuacau

SEQ ID NO: 2332948 - RNA, 19 nt, Human
cuacuguccuacccacccu

SEQ ID NO: 2332949 - RNA, 16 nt, Human
cuacuguaauuuuaua

SEQ ID NO: 2332950 - RNA, 21 nt, Human
cuacuguaauuugugauacaa

SEQ ID NO: 2332951 - RNA, 18 nt, Human
cuacugggagccuaccca

SEQ ID NO: 2332952 - RNA, 21 nt, Human
cuacuccuaccucagccuaga

SEQ ID NO: 2332953 - RNA, 14 nt, Human
cuacuccucugcag

SEQ ID NO: 2332954 - RNA, 15 nt, Human
cuacuccucugcagu

SEQ ID NO: 2332955 - RNA, 18 nt, Human
cuacuccuaccucagccu

SEQ ID NO: 2332956 - RNA, 17 nt, Human
cuacuccuaccucagcc

SEQ ID NO: 2332957 - RNA, 16 nt, Human
cuacuccuaccucagc

SEQ ID NO: 2332958 - RNA, 15 nt, Human
cuacuccuaccucag

SEQ ID NO: 2332959 - RNA, 16 nt, Human
cuacuccggagacagg

SEQ ID NO: 2332960 - RNA, 15 nt, Human
cuaccucagucagua

SEQ ID NO: 2332961 - RNA, 15 nt, Human
cuaccuccucaggga

SEQ ID NO: 2332962 - RNA, 17 nt, Human
cuacucccagacaccca

SEQ ID NO: 2332963 - RNA, 15 nt, Human
cuacucccagacacc

SEQ ID NO: 2332964 - RNA, 14 nt, Human
cuaccuccucaggg

SEQ ID NO: 2332965 - RNA, 18 nt, Human
cuaccucagguugcuggu

SEQ ID NO: 2332966 - RNA, 19 nt, Human
cuaccucagguugcugguu

SEQ ID NO: 2332967 - RNA, 20 nt, Human
cuaccucagguugcugguug

SEQ ID NO: 2332968 - RNA, 22 nt, Human
cuaccucagguugcugguugcu

SEQ ID NO: 2332969 - RNA, 21 nt, Human
cuacuccucugcagugccuug

SEQ ID NO: 2332970 - RNA, 20 nt, Human
cuacuccucugcagugccuu

SEQ ID NO: 2332971 - RNA, 18 nt, Human
cuacuccuguaauuccua

SEQ ID NO: 2332972 - RNA, 15 nt, Human
cuacucgaguuacag

SEQ ID NO: 2332973 - RNA, 16 nt, Human
cuacucgaguuacaga

SEQ ID NO: 2332974 - RNA, 19 nt, Human
cuacucgaguuacagacaa

SEQ ID NO: 2332975 - RNA, 17 nt, Human
cuaccgagucucuucuc

SEQ ID NO: 2332976 - RNA, 19 nt, Human
cuaccgagucucuucucca

SEQ ID NO: 2332977 - RNA, 18 nt, Human
cuaccgaaaccuugccuu

SEQ ID NO: 2332978 - RNA, 18 nt, Human
cuacccuuuuucuccagc

SEQ ID NO: 2332979 - RNA, 19 nt, Human
cuacccuuuuucuccagcu

SEQ ID NO: 2332980 - RNA, 23 nt, Human
cuaccgagucucuucuccacugg

SEQ ID NO: 2332981 - RNA, 21 nt, Human
cuaccgagucucuucuccacu

SEQ ID NO: 2332982 - RNA, 22 nt, Human
cuaccgagucucuucuccacug

SEQ ID NO: 2332983 - RNA, 13 nt, Human
cuaccucaggcag

SEQ ID NO: 2332984 - RNA, 15 nt, Human
cuaccucagccuaga

SEQ ID NO: 2332985 - RNA, 14 nt, Human
cuaccucagccuag

SEQ ID NO: 2332986 - RNA, 12 nt, Human
cuaccucagccu

SEQ ID NO: 2332987 - RNA, 11 nt, Human
cuaccucagcc

SEQ ID NO: 2332988 - RNA, 17 nt, Human
cuaccucacuggggucc

SEQ ID NO: 2332989 - RNA, 22 nt, Human
cuaccucacuauucaaguauua

SEQ ID NO: 2332990 - RNA, 15 nt, Human
cuaccgcucuuggga

SEQ ID NO: 2332991 - RNA, 20 nt, Human
cuaccucaggcaggaagggc

SEQ ID NO: 2332992 - RNA, 14 nt, Human
cuaccucaggcagg

SEQ ID NO: 2332993 - RNA, 17 nt, Human
cuaccucaggcagcuca

SEQ ID NO: 2332994 - RNA, 18 nt, Human
cuaccucaggcagcucaa

SEQ ID NO: 2332995 - RNA, 23 nt, Human
cuaccucaggcaggaagggcagg

SEQ ID NO: 2332996 - RNA, 12 nt, Human
cuaccucagguu

SEQ ID NO: 2332997 - RNA, 13 nt, Human
cuaccucagguug

SEQ ID NO: 2332998 - RNA, 14 nt, Human
cuaccucagguugc

SEQ ID NO: 2332999 - RNA, 15 nt, Human
cuaccucagguugcu

SEQ ID NO: 2333000 - RNA, 17 nt, Human
cuaccucagguugcugg

SEQ ID NO: 2333001 - RNA, 15 nt, Human
cuagcuuagagccuc

SEQ ID NO: 2333002 - RNA, 19 nt, Human
cuagcuuagagccucccuc

SEQ ID NO: 2333003 - RNA, 20 nt, Human
cuagcuuagagccucccuca

SEQ ID NO: 2333004 - RNA, 18 nt, Human
cuagcuguugagcuguuu

SEQ ID NO: 2333005 - RNA, 22 nt, Human
cuagcuuagagccucccucaau

SEQ ID NO: 2333006 - RNA, 13 nt, Human
cuagcuucugcuu

SEQ ID NO: 2333007 - RNA, 14 nt, Human
cuagcuucugcuuu

SEQ ID NO: 2333008 - RNA, 15 nt, Human
cuagcuucugcuuuu

SEQ ID NO: 2333009 - RNA, 16 nt, Human
cuagcuucugcuuuuc

SEQ ID NO: 2333010 - RNA, 18 nt, Human
cuagcuucugcuuuucug

SEQ ID NO: 2333011 - RNA, 21 nt, Human
cuagcuucugcuuuucugccc

SEQ ID NO: 2333012 - RNA, 22 nt, Human
cuagcuucugcuuuucugcccu

SEQ ID NO: 2333013 - RNA, 20 nt, Human
cuagcuugggaggcuucccc

SEQ ID NO: 2333014 - RNA, 23 nt, Human
cuagcuucugcuuuucugcccug

SEQ ID NO: 2333015 - RNA, 15 nt, Human
cuagcuuuagacccu

SEQ ID NO: 2333016 - RNA, 19 nt, Human
cuagcuuuagacccugggu

SEQ ID NO: 2333017 - RNA, 18 nt, Human
cuagcuuuagacccuggg

SEQ ID NO: 2333018 - RNA, 12 nt, Human
cuaggaaaauac

SEQ ID NO: 2333019 - RNA, 14 nt, Human
cuaggaaauauuua

SEQ ID NO: 2333020 - RNA, 15 nt, Human
cuaggaaauauuuau

SEQ ID NO: 2333021 - RNA, 19 nt, Human
cuaggaaauauuuauuuua

SEQ ID NO: 2333022 - RNA, 20 nt, Human
cuaggaaauauuuauuuuaa

SEQ ID NO: 2333023 - RNA, 21 nt, Human
cuagcugcuacaaagaagaca

SEQ ID NO: 2333024 - RNA, 23 nt, Human
cuagcugcuacaaagaagacaug

SEQ ID NO: 2333025 - RNA, 17 nt, Human
cuagcugcacagggcag

SEQ ID NO: 2333026 - RNA, 20 nt, Human
cuagcugcacagggcagcug

SEQ ID NO: 2333027 - RNA, 21 nt, Human
cuagcugcacagggcagcugg

SEQ ID NO: 2333028 - RNA, 14 nt, Human
cuagcugcuacaaa

SEQ ID NO: 2333029 - RNA, 15 nt, Human
cuagcugcuacaaag

SEQ ID NO: 2333030 - RNA, 16 nt, Human
cuagcugcuacaaaga

SEQ ID NO: 2333031 - RNA, 18 nt, Human
cuagcugcuacaaagaag

SEQ ID NO: 2333032 - RNA, 12 nt, Human
cuagcugggggu

SEQ ID NO: 2333033 - RNA, 20 nt, Human
cuagcugggggugggccagg

SEQ ID NO: 2333034 - RNA, 19 nt, Human
cuagcugggggugggccag

SEQ ID NO: 2333035 - RNA, 18 nt, Human
cuagcugggggugggcca

SEQ ID NO: 2333036 - RNA, 22 nt, Human
cuagcugggggugggccaggcu

SEQ ID NO: 2333037 - RNA, 21 nt, Human
cuagcugggggugggccaggc

SEQ ID NO: 2333038 - RNA, 15 nt, Human
cuagcuggugguuuc

SEQ ID NO: 2333039 - RNA, 17 nt, Human
cuagcuggugguuucac

SEQ ID NO: 2333040 - RNA, 22 nt, Human
cuagcuggugguuucacggugc

SEQ ID NO: 2333041 - RNA, 14 nt, Human
cuagcugugggggu

SEQ ID NO: 2333042 - RNA, 22 nt, Human
cuagcuccacacccucucccag

SEQ ID NO: 2333043 - RNA, 10 nt, Human
cuagcucccc

SEQ ID NO: 2333044 - RNA, 13 nt, Human
cuagcuccccucc

SEQ ID NO: 2333045 - RNA, 14 nt, Human
cuagcuccccuccu

SEQ ID NO: 2333046 - RNA, 15 nt, Human
cuagcuccccuccuc

SEQ ID NO: 2333047 - RNA, 16 nt, Human
cuagcuccccuccucu

SEQ ID NO: 2333048 - RNA, 19 nt, Human
cuagcuccccuccucuccc

SEQ ID NO: 2333049 - RNA, 21 nt, Human
cuagcuccccuccucuccccu

SEQ ID NO: 2333050 - RNA, 23 nt, Human
cuagcuagaagugggccaggaca

SEQ ID NO: 2333051 - RNA, 19 nt, Human
cuagcuagaagugggccag

SEQ ID NO: 2333052 - RNA, 17 nt, Human
cuagcuagaaauaugau

SEQ ID NO: 2333053 - RNA, 21 nt, Human
cuagcuagaaauaugauuuua

SEQ ID NO: 2333054 - RNA, 20 nt, Human
cuagcucugagccaguucag

SEQ ID NO: 2333055 - RNA, 16 nt, Human
cuagcugcacagggca

SEQ ID NO: 2333056 - RNA, 23 nt, Human
cuagcucuauguuuacaaaugga

SEQ ID NO: 2333057 - RNA, 14 nt, Human
cuagcucugagcca

SEQ ID NO: 2333058 - RNA, 19 nt, Human
cuagcucugagccaguuca

SEQ ID NO: 2333059 - RNA, 20 nt, Human
cuagcucuauguuuacaaau

SEQ ID NO: 2333060 - RNA, 19 nt, Human
cuagcucuauguuuacaaa

SEQ ID NO: 2333061 - RNA, 23 nt, Human
cuagcuccccuccucuccccuac

SEQ ID NO: 2333062 - RNA, 14 nt, Human
cuagcucgugauug

SEQ ID NO: 2333063 - RNA, 14 nt, Human
cuagauaucgacuu

SEQ ID NO: 2333064 - RNA, 21 nt, Human
cuagauaucgacuuguuuuug

SEQ ID NO: 2333065 - RNA, 24 nt, Human
cuagauacuguaucaugacaaaga

SEQ ID NO: 2333066 - RNA, 16 nt, Human
cuagauacuguaucau

SEQ ID NO: 2333067 - RNA, 13 nt, Human
cuagauacuguau

SEQ ID NO: 2333068 - RNA, 19 nt, Human
cuagccugugccucuggga

SEQ ID NO: 2333069 - RNA, 21 nt, Human
cuagccugugccucugggacu

SEQ ID NO: 2333070 - RNA, 22 nt, Human
cuagccugugccucugggacug

SEQ ID NO: 2333071 - RNA, 21 nt, Human
cuagccuuagaagucacacag

SEQ ID NO: 2333072 - RNA, 19 nt, Human
cuagccuugaggaguguga

SEQ ID NO: 2333073 - RNA, 15 nt, Human
cuagccuuuggcucu

SEQ ID NO: 2333074 - RNA, 16 nt, Human
cuagccuuuggcucug

SEQ ID NO: 2333075 - RNA, 17 nt, Human
cuagccuuauccucuga

SEQ ID NO: 2333076 - RNA, 22 nt, Human
cuagccuuaaucagguccucag

SEQ ID NO: 2333077 - RNA, 18 nt, Human
cuagccuuauccucugau

SEQ ID NO: 2333078 - RNA, 19 nt, Human
cuagccuuauccucugauc

SEQ ID NO: 2333079 - RNA, 21 nt, Human
cuagccuuauccucugaucuc

SEQ ID NO: 2333080 - RNA, 22 nt, Human
cuagccuuauccucugaucucc

SEQ ID NO: 2333081 - RNA, 22 nt, Human
cuagccuuagaagucacacagu

SEQ ID NO: 2333082 - RNA, 23 nt, Human
cuagccuuagaagucacacagua

SEQ ID NO: 2333083 - RNA, 22 nt, Human
cuagcgcugccgcaccccagag

SEQ ID NO: 2333084 - RNA, 12 nt, Human
cuagcgcugccg

SEQ ID NO: 2333085 - RNA, 17 nt, Human
cuagccuuuggcucugg

SEQ ID NO: 2333086 - RNA, 18 nt, Human
cuagccuuuggcucugga

SEQ ID NO: 2333087 - RNA, 19 nt, Human
cuagccuuuggcucuggag

SEQ ID NO: 2333088 - RNA, 20 nt, Human
cuagccuuuggcucuggaga

SEQ ID NO: 2333089 - RNA, 21 nt, Human
cuagccuuuggcucuggagac

SEQ ID NO: 2333090 - RNA, 23 nt, Human
cuagccuuuggcucuggagacag

SEQ ID NO: 2333091 - RNA, 16 nt, Human
cuagcgcugccgcacc

SEQ ID NO: 2333092 - RNA, 22 nt, Human
cuagcuaauguaauaacuguga

SEQ ID NO: 2333093 - RNA, 14 nt, Human
cuagcuagaaauau

SEQ ID NO: 2333094 - RNA, 15 nt, Human
cuagcuagaaauaug

SEQ ID NO: 2333095 - RNA, 16 nt, Human
cuagcuagaaauauga

SEQ ID NO: 2333096 - RNA, 15 nt, Human
cuauaggugcuacaa

SEQ ID NO: 2333097 - RNA, 21 nt, Human
cuauugauauaaauaaaacau

SEQ ID NO: 2333098 - RNA, 17 nt, Human
cuauugacaagucauuu

SEQ ID NO: 2333099 - RNA, 14 nt, Human
cuauugacuucaau

SEQ ID NO: 2333100 - RNA, 16 nt, Human
cuauugacuucaauga

SEQ ID NO: 2333101 - RNA, 15 nt, Human
cuauugauguacagu

SEQ ID NO: 2333102 - RNA, 17 nt, Human
cuauugauguacagucu

SEQ ID NO: 2333103 - RNA, 19 nt, Human
cuauugauguacagucugu

SEQ ID NO: 2333104 - RNA, 20 nt, Human
cuauugauguacagucuguc

SEQ ID NO: 2333105 - RNA, 21 nt, Human
cuauugauguacagucuguca

SEQ ID NO: 2333106 - RNA, 23 nt, Human
cuauugauguacagucugucaug

SEQ ID NO: 2333107 - RNA, 16 nt, Human
cuauugacaagucauu

SEQ ID NO: 2333108 - RNA, 13 nt, Human
cuauugacuucaa

SEQ ID NO: 2333109 - RNA, 12 nt, Human
cuauucucucuu

SEQ ID NO: 2333110 - RNA, 21 nt, Human
cuauucucuccaaaaaugcac

SEQ ID NO: 2333111 - RNA, 14 nt, Human
cuauucucuccaaa

SEQ ID NO: 2333112 - RNA, 19 nt, Human
cuauucaguggcgagaaau

SEQ ID NO: 2333113 - RNA, 15 nt, Human
cuauucuccagcuga

SEQ ID NO: 2333114 - RNA, 23 nt, Human
cuauucagcuucguuuauuuuca

SEQ ID NO: 2333115 - RNA, 23 nt, Human
cuauucaguaauaacucuacccu

SEQ ID NO: 2333116 - RNA, 17 nt, Human
cuauuguaaauauguuu

SEQ ID NO: 2333117 - RNA, 17 nt, Human
cuauucaguaauaacuc

SEQ ID NO: 2333118 - RNA, 21 nt, Human
cuauucaggagaguagaacag

SEQ ID NO: 2333119 - RNA, 17 nt, Human
cuauucagacaagcaac

SEQ ID NO: 2333120 - RNA, 14 nt, Human
cuauucagacaagc

SEQ ID NO: 2333121 - RNA, 15 nt, Human
cuauucagacaagca

SEQ ID NO: 2333122 - RNA, 22 nt, Human
cuauuauuuucacuguagaaug

SEQ ID NO: 2333123 - RNA, 20 nt, Human
cuauuauuuucacuguagaa

SEQ ID NO: 2333124 - RNA, 21 nt, Human
cuauuauaauuuaaugcaugu

SEQ ID NO: 2333125 - RNA, 16 nt, Human
cuauuauacuguauua

SEQ ID NO: 2333126 - RNA, 14 nt, Human
cuauuauagccaca

SEQ ID NO: 2333127 - RNA, 17 nt, Human
cuauuauaauuuaaugc

SEQ ID NO: 2333128 - RNA, 16 nt, Human
cuauuauaauuuaaug

SEQ ID NO: 2333129 - RNA, 17 nt, Human
cuauuauccccauuucu

SEQ ID NO: 2333130 - RNA, 16 nt, Human
cuauuauccccauuuc

SEQ ID NO: 2333131 - RNA, 18 nt, Human
cuauuauagccacauccc

SEQ ID NO: 2333132 - RNA, 14 nt, Human
cuauuauauuaaaa

SEQ ID NO: 2333133 - RNA, 15 nt, Human
cuauuauaauuuaau

SEQ ID NO: 2333134 - RNA, 13 nt, Human
cuauguaucaaug

SEQ ID NO: 2333135 - RNA, 13 nt, Human
cuaugcguuuuua

SEQ ID NO: 2333136 - RNA, 21 nt, Human
cuauggggagaaaagacauga

SEQ ID NO: 2333137 - RNA, 17 nt, Human
cuauggggagaaaagac

SEQ ID NO: 2333138 - RNA, 19 nt, Human
cuaugggagccccaggguc

SEQ ID NO: 2333139 - RNA, 20 nt, Human
cuauggggauagaugugugg

SEQ ID NO: 2333140 - RNA, 19 nt, Human
cuauggggauagaugugug

SEQ ID NO: 2333141 - RNA, 21 nt, Human
cuauguaacugcauugagaac

SEQ ID NO: 2333142 - RNA, 22 nt, Human
cuauguaggaaagaccauuuuu

SEQ ID NO: 2333143 - RNA, 20 nt, Human
cuauguaguccgugcugaca

SEQ ID NO: 2333144 - RNA, 23 nt, Human
cuauguaggaaagaccauuuuuc

SEQ ID NO: 2333145 - RNA, 18 nt, Human
cuauggggaugguccacu

SEQ ID NO: 2333146 - RNA, 15 nt, Human
cuauggggauggucc

SEQ ID NO: 2333147 - RNA, 21 nt, Human
cuauggggauagaugugugga

SEQ ID NO: 2333148 - RNA, 15 nt, Human
cuauguaacugcauu

SEQ ID NO: 2333149 - RNA, 22 nt, Human
cuauguaacauguaggaaguag

SEQ ID NO: 2333150 - RNA, 18 nt, Human
cuauagccuggggugggg

SEQ ID NO: 2333151 - RNA, 14 nt, Human
cuauagccuggggu

SEQ ID NO: 2333152 - RNA, 13 nt, Human
cuauagccugggg

SEQ ID NO: 2333153 - RNA, 12 nt, Human
cuauagccuggg

SEQ ID NO: 2333154 - RNA, 21 nt, Human
cuauagccuggggugggguca

SEQ ID NO: 2333155 - RNA, 14 nt, Human
cuauagcucaggac

SEQ ID NO: 2333156 - RNA, 16 nt, Human
cuauagcucaggaccu

SEQ ID NO: 2333157 - RNA, 23 nt, Human
cuauagcucaggaccugggaccu

SEQ ID NO: 2333158 - RNA, 21 nt, Human
cuauaguccagcuuuguucuu

SEQ ID NO: 2333159 - RNA, 19 nt, Human
cuauaggucauacaaucca

SEQ ID NO: 2333160 - RNA, 18 nt, Human
cuauaggcuggagaagcu

SEQ ID NO: 2333161 - RNA, 22 nt, Human
cuauaggcuggagaagcucacc

SEQ ID NO: 2333162 - RNA, 15 nt, Human
cuauaggcuggagaa

SEQ ID NO: 2333163 - RNA, 16 nt, Human
cuauaggcuggagaag

SEQ ID NO: 2333164 - RNA, 17 nt, Human
cuauaggcuggagaagc

SEQ ID NO: 2333165 - RNA, 23 nt, Human
cuauauaggcaucacauuuuugu

SEQ ID NO: 2333166 - RNA, 14 nt, Human
cuauauagagaugu

SEQ ID NO: 2333167 - RNA, 19 nt, Human
cuaugaaauauuauguuaa

SEQ ID NO: 2333168 - RNA, 21 nt, Human
cuauauacucacuuucuagau

SEQ ID NO: 2333169 - RNA, 20 nt, Human
cuaugccagcucagucccau

SEQ ID NO: 2333170 - RNA, 19 nt, Human
cuaugccagcucaguccca

SEQ ID NO: 2333171 - RNA, 14 nt, Human
cuaugccugugucu

SEQ ID NO: 2333172 - RNA, 22 nt, Human
cuaugccaaagaucacuuguug

SEQ ID NO: 2333173 - RNA, 15 nt, Human
cuaugccaaagauca

SEQ ID NO: 2333174 - RNA, 22 nt, Human
cuaugcaauauaucuaaauuga

SEQ ID NO: 2333175 - RNA, 17 nt, Human
cuaugccaaagaucacu

SEQ ID NO: 2333176 - RNA, 18 nt, Human
cuaugccaaagaucacuu

SEQ ID NO: 2333177 - RNA, 19 nt, Human
cuaugauuuggaaaauaaa

SEQ ID NO: 2333178 - RNA, 20 nt, Human
cuaugcaauauaucuaaauu

SEQ ID NO: 2333179 - RNA, 12 nt, Human
cuaugcacauau

SEQ ID NO: 2333180 - RNA, 15 nt, Human
cuaugauuuggaaaa

SEQ ID NO: 2333181 - RNA, 13 nt, Human
cuaugaacuacaa

SEQ ID NO: 2333182 - RNA, 18 nt, Human
cuaugaaguauauaaugg

SEQ ID NO: 2333183 - RNA, 23 nt, Human
cuaugaaguauauaaugguuuca

SEQ ID NO: 2333184 - RNA, 20 nt, Human
cuaugaaucuauuauacugu

SEQ ID NO: 2333185 - RNA, 14 nt, Human
cuaugaaugggcaa

SEQ ID NO: 2333186 - RNA, 14 nt, Human
cuaugaucucaggu

SEQ ID NO: 2333187 - RNA, 17 nt, Human
cuaugaucucagguucu

SEQ ID NO: 2333188 - RNA, 16 nt, Human
cuaugaugcuguugcc

SEQ ID NO: 2333189 - RNA, 22 nt, Human
cuaugaaguuuuuuuuauacag

SEQ ID NO: 2333190 - RNA, 19 nt, Human
cuaugaacucuguuuucuu

SEQ ID NO: 2333191 - RNA, 15 nt, Human
cuauauagagauguu

SEQ ID NO: 2333192 - RNA, 13 nt, Human
cuaugaaggcugu

SEQ ID NO: 2333193 - RNA, 17 nt, Human
cuaugaacuucucucag

SEQ ID NO: 2333194 - RNA, 11 nt, Human
cuaggaagaau

SEQ ID NO: 2333195 - RNA, 14 nt, Human
cuaggaagaauuuu

SEQ ID NO: 2333196 - RNA, 15 nt, Human
cuaggaagaauuuua

SEQ ID NO: 2333197 - RNA, 19 nt, Human
cuaggaagaauuuuaaaaa

SEQ ID NO: 2333198 - RNA, 20 nt, Human
cuaggaagaauuuuaaaaau

SEQ ID NO: 2333199 - RNA, 20 nt, Human
cuaggaacacuccuucacag

SEQ ID NO: 2333200 - RNA, 15 nt, Human
cuaggaagacuuugg

SEQ ID NO: 2333201 - RNA, 17 nt, Human
cuaggaagacuuuggaa

SEQ ID NO: 2333202 - RNA, 20 nt, Human
cuauaauucccuaucuuuua

SEQ ID NO: 2333203 - RNA, 23 nt, Human
cuaggaagaauuuuaaaaaugaa

SEQ ID NO: 2333204 - RNA, 21 nt, Human
cuaggaagaauuuuaaaaaug

SEQ ID NO: 2333205 - RNA, 22 nt, Human
cuaggaagaauuuuaaaaauga

SEQ ID NO: 2333206 - RNA, 13 nt, Human
cuauaauuuaaau

SEQ ID NO: 2333207 - RNA, 12 nt, Human
cuauaauuuaaa

SEQ ID NO: 2333208 - RNA, 19 nt, Human
cuauagccuaggugacaga

SEQ ID NO: 2333209 - RNA, 18 nt, Human
cuauagccuaggugacag

SEQ ID NO: 2333210 - RNA, 20 nt, Human
cuauagccuaggugacagag

SEQ ID NO: 2333211 - RNA, 21 nt, Human
cuauagccuaggugacagagu

SEQ ID NO: 2333212 - RNA, 20 nt, Human
cuauaccugggcauacuaau

SEQ ID NO: 2333213 - RNA, 15 nt, Human
cuauaccugugccuc

SEQ ID NO: 2333214 - RNA, 14 nt, Human
cuauaccugugccu

SEQ ID NO: 2333215 - RNA, 22 nt, Human
cuauaauucccuaucuuuuagu

SEQ ID NO: 2333216 - RNA, 19 nt, Human
cuauaccugugccucggcu

SEQ ID NO: 2333217 - RNA, 21 nt, Human
cuauaccugggcauacuaaua

SEQ ID NO: 2333218 - RNA, 19 nt, Human
cuauacgcagcgugcuuua

SEQ ID NO: 2333219 - RNA, 17 nt, Human
cuauacugcauacuuuu

SEQ ID NO: 2333220 - RNA, 21 nt, Human
cuauacugcauacuuuuuaaa

SEQ ID NO: 2333221 - RNA, 19 nt, Human
cuauacugcauacuuuuua

SEQ ID NO: 2333222 - RNA, 13 nt, Human
cucaaauuucuaa

SEQ ID NO: 2333223 - RNA, 12 nt, Human
cucaaauuugga

SEQ ID NO: 2333224 - RNA, 20 nt, Human
cucaacauguuacugaccag

SEQ ID NO: 2333225 - RNA, 16 nt, Human
cucaacauguuacuga

SEQ ID NO: 2333226 - RNA, 20 nt, Human
cucaacaugagucaagagca

SEQ ID NO: 2333227 - RNA, 15 nt, Human
cucaacaugagucaa

SEQ ID NO: 2333228 - RNA, 18 nt, Human
cucaacaugagucaagag

SEQ ID NO: 2333229 - RNA, 17 nt, Human
cucaaauuucuaaaucu

SEQ ID NO: 2333230 - RNA, 15 nt, Human
cucaaauuucuaaau

SEQ ID NO: 2333231 - RNA, 16 nt, Human
cucaacccucccucag

SEQ ID NO: 2333232 - RNA, 19 nt, Human
cucaacccccauuucuauu

SEQ ID NO: 2333233 - RNA, 22 nt, Human
cucaacccccauuucuauuuau

SEQ ID NO: 2333234 - RNA, 18 nt, Human
cucaaccccaccacuucu

SEQ ID NO: 2333235 - RNA, 20 nt, Human
cucaaccauccccuccgugg

SEQ ID NO: 2333236 - RNA, 15 nt, Human
cucaaccauccccuc

SEQ ID NO: 2333237 - RNA, 18 nt, Human
cucaaccaccuuucagau

SEQ ID NO: 2333238 - RNA, 22 nt, Human
cucaacccucccucagccccuc

SEQ ID NO: 2333239 - RNA, 21 nt, Human
cucaacccucccucagccccu

SEQ ID NO: 2333240 - RNA, 19 nt, Human
cucaacccucccucagccc

SEQ ID NO: 2333241 - RNA, 18 nt, Human
cucaacccucccucagcc

SEQ ID NO: 2333242 - RNA, 13 nt, Human
cucaacccucuca

SEQ ID NO: 2333243 - RNA, 20 nt, Human
cucaaccuaccaccccuucc

SEQ ID NO: 2333244 - RNA, 14 nt, Human
cucaacucuccucc

SEQ ID NO: 2333245 - RNA, 14 nt, Human
cucaaauuucuaaa

SEQ ID NO: 2333246 - RNA, 13 nt, Human
cuauuucugagaa

SEQ ID NO: 2333247 - RNA, 16 nt, Human
cuauuucuccuccaug

SEQ ID NO: 2333248 - RNA, 15 nt, Human
cuauuucuccuccau

SEQ ID NO: 2333249 - RNA, 23 nt, Human
cuauuucugagaagguccuuaau

SEQ ID NO: 2333250 - RNA, 12 nt, Human
cuauuucugcug

SEQ ID NO: 2333251 - RNA, 13 nt, Human
cuauuucugcuga

SEQ ID NO: 2333252 - RNA, 20 nt, Human
cuauuucugcugaauuuuca

SEQ ID NO: 2333253 - RNA, 21 nt, Human
cuauuucugcugaauuuucac

SEQ ID NO: 2333254 - RNA, 14 nt, Human
cuauuuauuuacug

SEQ ID NO: 2333255 - RNA, 15 nt, Human
cuauuuauuuacuga

SEQ ID NO: 2333256 - RNA, 18 nt, Human
cuauuuauuuacugagcu

SEQ ID NO: 2333257 - RNA, 15 nt, Human
cuauuucuaugagaa

SEQ ID NO: 2333258 - RNA, 22 nt, Human
cucaagcagcgaccgcccccuc

SEQ ID NO: 2333259 - RNA, 17 nt, Human
cucaacucaccuaaugu

SEQ ID NO: 2333260 - RNA, 16 nt, Human
cucaacucuccuccag

SEQ ID NO: 2333261 - RNA, 18 nt, Human
cucaacucuccuccagag

SEQ ID NO: 2333262 - RNA, 17 nt, Human
cucaagcccgcggggac

SEQ ID NO: 2333263 - RNA, 18 nt, Human
cucaagccaauccccucc

SEQ ID NO: 2333264 - RNA, 20 nt, Human
cucaagccaauccccuccuu

SEQ ID NO: 2333265 - RNA, 22 nt, Human
cucaagccaagcagccaagcuc

SEQ ID NO: 2333266 - RNA, 21 nt, Human
cucaagccaagcagccaagcu

SEQ ID NO: 2333267 - RNA, 18 nt, Human
cucaagccaagcagccaa

SEQ ID NO: 2333268 - RNA, 16 nt, Human
cucaagccaagcagcc

SEQ ID NO: 2333269 - RNA, 23 nt, Human
cucaagcagucuacccaccucag

SEQ ID NO: 2333270 - RNA, 14 nt, Human
cucaagcagucuac

SEQ ID NO: 2333271 - RNA, 23 nt, Human
cucaagcagcgaccgcccccucc

SEQ ID NO: 2333272 - RNA, 16 nt, Human
cucaaggcgugaggau

SEQ ID NO: 2333273 - RNA, 15 nt, Human
cucaaggcgugagga

SEQ ID NO: 2333274 - RNA, 21 nt, Human
cucaagggcuagcaucccuga

SEQ ID NO: 2333275 - RNA, 20 nt, Human
cucaaggggccauccugucc

SEQ ID NO: 2333276 - RNA, 22 nt, Human
cucaaggggccauccuguccca

SEQ ID NO: 2333277 - RNA, 23 nt, Human
cucaaggggccauccugucccac

SEQ ID NO: 2333278 - RNA, 12 nt, Human
cucaagcccugc

SEQ ID NO: 2333279 - RNA, 13 nt, Human
cucaagcccugca

SEQ ID NO: 2333280 - RNA, 19 nt, Human
cucaaggccucccacagug

SEQ ID NO: 2333281 - RNA, 20 nt, Human
cucaaggccucccacaguga

SEQ ID NO: 2333282 - RNA, 19 nt, Human
cucaagucacucccaagcc

SEQ ID NO: 2333283 - RNA, 14 nt, Human
cucaaguccucuuu

SEQ ID NO: 2333284 - RNA, 19 nt, Human
cucaaggugggccuugcua

SEQ ID NO: 2333285 - RNA, 18 nt, Human
cucaagggggacugucuu

SEQ ID NO: 2333286 - RNA, 21 nt, Human
cucacaccgcgucuggugaca

SEQ ID NO: 2333287 - RNA, 20 nt, Human
cucaagucacucccaagccc

SEQ ID NO: 2333288 - RNA, 13 nt, Human
cucacacucaccc

SEQ ID NO: 2333289 - RNA, 23 nt, Human
cucacacggacacucaaaagcug

SEQ ID NO: 2333290 - RNA, 12 nt, Human
cucacacugaga

SEQ ID NO: 2333291 - RNA, 13 nt, Human
cucacacugagaa

SEQ ID NO: 2333292 - RNA, 14 nt, Human
cucacacugagaau

SEQ ID NO: 2333293 - RNA, 20 nt, Human
cucacacugagaauguaaga

SEQ ID NO: 2333294 - RNA, 13 nt, Human
cucacagaagaau

SEQ ID NO: 2333295 - RNA, 17 nt, Human
cucacagaacccuugga

SEQ ID NO: 2333296 - RNA, 13 nt, Human
cucacagaaauga

SEQ ID NO: 2333297 - RNA, 9 nt, Human
cuauuuaag

SEQ ID NO: 2333298 - RNA, 12 nt, Human
cuauuuaauauu

SEQ ID NO: 2333299 - RNA, 14 nt, Human
cuauuuaauauuua

SEQ ID NO: 2333300 - RNA, 22 nt, Human
cuauuuaugugauccuuuugga

SEQ ID NO: 2333301 - RNA, 15 nt, Human
cuauuuaauauuuau

SEQ ID NO: 2333302 - RNA, 22 nt, Human
cuauuuaacuggcuucagccuc

SEQ ID NO: 2333303 - RNA, 14 nt, Human
cuauuuaacuugag

SEQ ID NO: 2333304 - RNA, 15 nt, Human
cuauuuaacuugagg

SEQ ID NO: 2333305 - RNA, 15 nt, Human
cuauuuaaaaaagag

SEQ ID NO: 2333306 - RNA, 15 nt, Human
cuauuuaaagccucc

SEQ ID NO: 2333307 - RNA, 16 nt, Human
cuauuuaaaacuugua

SEQ ID NO: 2333308 - RNA, 17 nt, Human
cuauuuaaaacuuguaa

SEQ ID NO: 2333309 - RNA, 23 nt, Human
cuauuggguucauuauuggaauu

SEQ ID NO: 2333310 - RNA, 13 nt, Human
cuauuguaaauau

SEQ ID NO: 2333311 - RNA, 16 nt, Human
cuauuggguucauuau

SEQ ID NO: 2333312 - RNA, 15 nt, Human
cuauuggguucauua

SEQ ID NO: 2333313 - RNA, 11 nt, Human
cuauugguaaa

SEQ ID NO: 2333314 - RNA, 18 nt, Human
cuauuguuagucucuuga

SEQ ID NO: 2333315 - RNA, 14 nt, Human
cuauuguaaauaug

SEQ ID NO: 2333316 - RNA, 14 nt, Human
cuauuguuuauucu

SEQ ID NO: 2333317 - RNA, 22 nt, Human
cuauuguuuauucuuuuuaaag

SEQ ID NO: 2333318 - RNA, 21 nt, Human
cuauuguuucuuuaagaaagu

SEQ ID NO: 2333319 - RNA, 16 nt, Human
cuauugcugcuugagg

SEQ ID NO: 2333320 - RNA, 18 nt, Human
cuauugcaguuauagaaa

SEQ ID NO: 2333321 - RNA, 21 nt, Human
cuauugcaaagguuccaacug

SEQ ID NO: 2333322 - RNA, 22 nt, Human
cuauugcaaagguuccaacugu

SEQ ID NO: 2333323 - RNA, 12 nt, Human
cuauugcccagg

SEQ ID NO: 2333324 - RNA, 21 nt, Human
cucagcugcuucucccacuug

SEQ ID NO: 2333325 - RNA, 23 nt, Human
cucagcuggaugauggucuucag

SEQ ID NO: 2333326 - RNA, 20 nt, Human
cucagcucuuggcuccacug

SEQ ID NO: 2333327 - RNA, 12 nt, Human
cucagcugccuc

SEQ ID NO: 2333328 - RNA, 16 nt, Human
cucagcugccucacuu

SEQ ID NO: 2333329 - RNA, 14 nt, Human
cucagcugccucac

SEQ ID NO: 2333330 - RNA, 18 nt, Human
cucagcugccucacuucc

SEQ ID NO: 2333331 - RNA, 16 nt, Human
cucagcucuucugacu

SEQ ID NO: 2333332 - RNA, 12 nt, Human
cucagcugcuuc

SEQ ID NO: 2333333 - RNA, 13 nt, Human
cucagcugcuucu

SEQ ID NO: 2333334 - RNA, 15 nt, Human
cucagcugcuucucc

SEQ ID NO: 2333335 - RNA, 16 nt, Human
cucagcugcuucuccc

SEQ ID NO: 2333336 - RNA, 17 nt, Human
cucagcugcuucuccca

SEQ ID NO: 2333337 - RNA, 18 nt, Human
cucagcucuuggcuccac

SEQ ID NO: 2333338 - RNA, 17 nt, Human
cucagcucuuggcucca

SEQ ID NO: 2333339 - RNA, 23 nt, Human
cucagcucugggccauucuccac

SEQ ID NO: 2333340 - RNA, 14 nt, Human
cucagcucugggcc

SEQ ID NO: 2333341 - RNA, 13 nt, Human
cucagcucuggga

SEQ ID NO: 2333342 - RNA, 14 nt, Human
cucagcucugggag

SEQ ID NO: 2333343 - RNA, 15 nt, Human
cucagcucugggaga

SEQ ID NO: 2333344 - RNA, 16 nt, Human
cucagcucugggagag

SEQ ID NO: 2333345 - RNA, 18 nt, Human
cucagcucugggagagga

SEQ ID NO: 2333346 - RNA, 22 nt, Human
cucagcucugggagaggauuuu

SEQ ID NO: 2333347 - RNA, 12 nt, Human
cucagcucuggg

SEQ ID NO: 2333348 - RNA, 20 nt, Human
cucagcucccccuguccccu

SEQ ID NO: 2333349 - RNA, 18 nt, Human
cucagcucccccuguccc

SEQ ID NO: 2333350 - RNA, 19 nt, Human
cucagcucccccugucccc

SEQ ID NO: 2333351 - RNA, 12 nt, Human
cucaggaagaac

SEQ ID NO: 2333352 - RNA, 14 nt, Human
cucaggaagaacac

SEQ ID NO: 2333353 - RNA, 13 nt, Human
cucaggaagaaca

SEQ ID NO: 2333354 - RNA, 15 nt, Human
cucaggaagccccca

SEQ ID NO: 2333355 - RNA, 19 nt, Human
cucaggaagcccccaaguu

SEQ ID NO: 2333356 - RNA, 15 nt, Human
cucaggaaugggcug

SEQ ID NO: 2333357 - RNA, 16 nt, Human
cucaggaaugggcugu

SEQ ID NO: 2333358 - RNA, 21 nt, Human
cucagcuuuuugucuuuucug

SEQ ID NO: 2333359 - RNA, 17 nt, Human
cucagcuuuuugucuuu

SEQ ID NO: 2333360 - RNA, 16 nt, Human
cucagcuucuccugug

SEQ ID NO: 2333361 - RNA, 16 nt, Human
cucagcuuccuaccca

SEQ ID NO: 2333362 - RNA, 22 nt, Human
cucagcuuccuacccacaccuc

SEQ ID NO: 2333363 - RNA, 14 nt, Human
cucagcuuccuacc

SEQ ID NO: 2333364 - RNA, 17 nt, Human
cucaggaaaacgggacc

SEQ ID NO: 2333365 - RNA, 12 nt, Human
cucaggaaaacg

SEQ ID NO: 2333366 - RNA, 22 nt, Human
cucaggaaaucaaauaugcaaa

SEQ ID NO: 2333367 - RNA, 12 nt, Human
cucaggaccuag

SEQ ID NO: 2333368 - RNA, 12 nt, Human
cucaggaccagg

SEQ ID NO: 2333369 - RNA, 14 nt, Human
cucaggaccaggca

SEQ ID NO: 2333370 - RNA, 21 nt, Human
cucaggacucagaagccucug

SEQ ID NO: 2333371 - RNA, 16 nt, Human
cucaggacucagaagc

SEQ ID NO: 2333372 - RNA, 14 nt, Human
cucaggacucagaa

SEQ ID NO: 2333373 - RNA, 15 nt, Human
cucaggaccaggcaa

SEQ ID NO: 2333374 - RNA, 16 nt, Human
cucaggaccugggacc

SEQ ID NO: 2333375 - RNA, 18 nt, Human
cucaggacagaugccaca

SEQ ID NO: 2333376 - RNA, 16 nt, Human
cucaggacagaugcca

SEQ ID NO: 2333377 - RNA, 14 nt, Human
cucaggacagaugc

SEQ ID NO: 2333378 - RNA, 12 nt, Human
cucaggacagau

SEQ ID NO: 2333379 - RNA, 19 nt, Human
cucaggacagaugccacac

SEQ ID NO: 2333380 - RNA, 20 nt, Human
cucaggaccaaagcuuucau

SEQ ID NO: 2333381 - RNA, 22 nt, Human
cucaggaccaaagcuuucaugu

SEQ ID NO: 2333382 - RNA, 21 nt, Human
cucaggaccaaagcuuucaug

SEQ ID NO: 2333383 - RNA, 16 nt, Human
cucaggacuccucucc

SEQ ID NO: 2333384 - RNA, 22 nt, Human
cucaggaccugggaccuccccu

SEQ ID NO: 2333385 - RNA, 16 nt, Human
cucaggacugcaacag

SEQ ID NO: 2333386 - RNA, 15 nt, Human
cucaggacuccucuc

SEQ ID NO: 2333387 - RNA, 14 nt, Human
cucaggacugcgac

SEQ ID NO: 2333388 - RNA, 17 nt, Human
cucaggacugcaacagg

SEQ ID NO: 2333389 - RNA, 19 nt, Human
cucaggacugcaacaggcu

SEQ ID NO: 2333390 - RNA, 12 nt, Human
cucaggagcaca

SEQ ID NO: 2333391 - RNA, 12 nt, Human
cucaggagcccu

SEQ ID NO: 2333392 - RNA, 13 nt, Human
cucaggagcccug

SEQ ID NO: 2333393 - RNA, 14 nt, Human
cucaggagcccugg

SEQ ID NO: 2333394 - RNA, 15 nt, Human
cucaggagcccuggg

SEQ ID NO: 2333395 - RNA, 16 nt, Human
cucaggagcccuggga

SEQ ID NO: 2333396 - RNA, 17 nt, Human
cucaggagcccugggag

SEQ ID NO: 2333397 - RNA, 20 nt, Human
cucaggagcccugggaggcu

SEQ ID NO: 2333398 - RNA, 21 nt, Human
cucaggagcccugggaggcuc

SEQ ID NO: 2333399 - RNA, 22 nt, Human
cucaggagcccugggaggcucu

SEQ ID NO: 2333400 - RNA, 23 nt, Human
cucaggagcccugggaggcucug

SEQ ID NO: 2333401 - RNA, 12 nt, Human
cucagguggcca

SEQ ID NO: 2333402 - RNA, 20 nt, Human
cucagguggccagccuggau

SEQ ID NO: 2333403 - RNA, 13 nt, Human
cucagguggccau

SEQ ID NO: 2333404 - RNA, 21 nt, Human
cucagguggccagccuggauc

SEQ ID NO: 2333405 - RNA, 22 nt, Human
cucagguggccagccuggaucu

SEQ ID NO: 2333406 - RNA, 15 nt, Human
cucagguggccaugc

SEQ ID NO: 2333407 - RNA, 18 nt, Human
cucagguggccaugccuc

SEQ ID NO: 2333408 - RNA, 19 nt, Human
cucagguggccaugccuca

SEQ ID NO: 2333409 - RNA, 20 nt, Human
cucagguggccaugccucag

SEQ ID NO: 2333410 - RNA, 22 nt, Human
cucaggugauccacccaccuca

SEQ ID NO: 2333411 - RNA, 20 nt, Human
cucaggugauccaccugccu

SEQ ID NO: 2333412 - RNA, 20 nt, Human
cucaggugaucuaccugccu

SEQ ID NO: 2333413 - RNA, 23 nt, Human
cucaggugauccacccaccucag

SEQ ID NO: 2333414 - RNA, 21 nt, Human
cucagguggccaugccucagc

SEQ ID NO: 2333415 - RNA, 13 nt, Human
cucaggugggcgu

SEQ ID NO: 2333416 - RNA, 21 nt, Human
cucaguucccuuggccucaga

SEQ ID NO: 2333417 - RNA, 20 nt, Human
cucaguucccuuggccucag

SEQ ID NO: 2333418 - RNA, 21 nt, Human
cucagguggggucacucuggc

SEQ ID NO: 2333419 - RNA, 19 nt, Human
cucagguggggucacucug

SEQ ID NO: 2333420 - RNA, 20 nt, Human
cucagguggggucacucugg

SEQ ID NO: 2333421 - RNA, 14 nt, Human
cucagggccugguc

SEQ ID NO: 2333422 - RNA, 20 nt, Human
cucagggucccugguggcag

SEQ ID NO: 2333423 - RNA, 21 nt, Human
cucagggucccugguggcagc

SEQ ID NO: 2333424 - RNA, 22 nt, Human
cucagggucccugguggcagcu

SEQ ID NO: 2333425 - RNA, 24 nt, Human
cucagguaaucgaccugccucggc

SEQ ID NO: 2333426 - RNA, 22 nt, Human
cucagguaaucgaccugccucg

SEQ ID NO: 2333427 - RNA, 20 nt, Human
cucagguaaucgaccugccu

SEQ ID NO: 2333428 - RNA, 19 nt, Human
cucagggucucugcugccg

SEQ ID NO: 2333429 - RNA, 18 nt, Human
cucagggucucugcugcc

SEQ ID NO: 2333430 - RNA, 24 nt, Human
cucagggucccugguggcagcuca

SEQ ID NO: 2333431 - RNA, 13 nt, Human
cucagggucucug

SEQ ID NO: 2333432 - RNA, 14 nt, Human
cucagggucucugc

SEQ ID NO: 2333433 - RNA, 16 nt, Human
cucagggucucugcug

SEQ ID NO: 2333434 - RNA, 17 nt, Human
cucagggucucugcugc

SEQ ID NO: 2333435 - RNA, 13 nt, Human
cucagggccccag

SEQ ID NO: 2333436 - RNA, 12 nt, Human
cucagggcccca

SEQ ID NO: 2333437 - RNA, 19 nt, Human
cucagggccaugcugaggc

SEQ ID NO: 2333438 - RNA, 20 nt, Human
cucagggccaugcugaggcc

SEQ ID NO: 2333439 - RNA, 20 nt, Human
cucagggccaugccugcccc

SEQ ID NO: 2333440 - RNA, 15 nt, Human
cucagggccaugcug

SEQ ID NO: 2333441 - RNA, 17 nt, Human
cucagggccaugcugag

SEQ ID NO: 2333442 - RNA, 18 nt, Human
cucagggccaugcugagg

SEQ ID NO: 2333443 - RNA, 17 nt, Human
cucaggcaugccugugu

SEQ ID NO: 2333444 - RNA, 16 nt, Human
cucaggcaugccugug

SEQ ID NO: 2333445 - RNA, 15 nt, Human
cucaggcaugccugu

SEQ ID NO: 2333446 - RNA, 23 nt, Human
cucaggcauaggccugggugcug

SEQ ID NO: 2333447 - RNA, 22 nt, Human
cucaggcauaggccugggugcu

SEQ ID NO: 2333448 - RNA, 18 nt, Human
cucaggcaugccugugug

SEQ ID NO: 2333449 - RNA, 20 nt, Human
cucagggcagcgccaggcug

SEQ ID NO: 2333450 - RNA, 13 nt, Human
cucagggccaugc

SEQ ID NO: 2333451 - RNA, 16 nt, Human
cucagggccccagcac

SEQ ID NO: 2333452 - RNA, 14 nt, Human
cucagggccccagc

SEQ ID NO: 2333453 - RNA, 18 nt, Human
cucagggccccagcacua

SEQ ID NO: 2333454 - RNA, 18 nt, Human
cucagggccuggcucagg

SEQ ID NO: 2333455 - RNA, 19 nt, Human
cucagggccuggcucaggu

SEQ ID NO: 2333456 - RNA, 20 nt, Human
cucagggccuggcucaggug

SEQ ID NO: 2333457 - RNA, 21 nt, Human
cucaggcauaggccugggugc

SEQ ID NO: 2333458 - RNA, 20 nt, Human
cucaggcauaggccugggug

SEQ ID NO: 2333459 - RNA, 17 nt, Human
cucaggcauaggccugg

SEQ ID NO: 2333460 - RNA, 16 nt, Human
cucaggcauaggccug

SEQ ID NO: 2333461 - RNA, 19 nt, Human
cucaggaggcugaggcaga

SEQ ID NO: 2333462 - RNA, 13 nt, Human
cucaggaggcuga

SEQ ID NO: 2333463 - RNA, 18 nt, Human
cucaggaggcugaggcag

SEQ ID NO: 2333464 - RNA, 18 nt, Human
cucaggcaggugggaugg

SEQ ID NO: 2333465 - RNA, 17 nt, Human
cucaggaggcugaggca

SEQ ID NO: 2333466 - RNA, 15 nt, Human
cucaggaggcugagg

SEQ ID NO: 2333467 - RNA, 14 nt, Human
cucaggaggcugag

SEQ ID NO: 2333468 - RNA, 15 nt, Human
cucaggcagguggga

SEQ ID NO: 2333469 - RNA, 24 nt, Human
cucaggagcccugggaggcucugg

SEQ ID NO: 2333470 - RNA, 16 nt, Human
cucaggagccucugcu

SEQ ID NO: 2333471 - RNA, 14 nt, Human
cucaggagcacagg

SEQ ID NO: 2333472 - RNA, 15 nt, Human
cucaggagcacaggc

SEQ ID NO: 2333473 - RNA, 17 nt, Human
cucaggagcacaggcag

SEQ ID NO: 2333474 - RNA, 18 nt, Human
cucaggagcacaggcagc

SEQ ID NO: 2333475 - RNA, 18 nt, Human
cucaggaggcaggaccuu

SEQ ID NO: 2333476 - RNA, 17 nt, Human
cucaggaggcaggaccu

SEQ ID NO: 2333477 - RNA, 16 nt, Human
cucaggaggcaggacc

SEQ ID NO: 2333478 - RNA, 22 nt, Human
cucaggagcacaggcagcugga

SEQ ID NO: 2333479 - RNA, 17 nt, Human
cucagcccugacccugu

SEQ ID NO: 2333480 - RNA, 23 nt, Human
cucagcguuuuuuuguuuuuaau

SEQ ID NO: 2333481 - RNA, 23 nt, Human
cucagcggggacagcuccuucug

SEQ ID NO: 2333482 - RNA, 22 nt, Human
cucagcuccagacguaggggag

SEQ ID NO: 2333483 - RNA, 16 nt, Human
cucagcucagcgccag

SEQ ID NO: 2333484 - RNA, 17 nt, Human
cucagcucagcgccagc

SEQ ID NO: 2333485 - RNA, 15 nt, Human
cucagcucagcgcca

SEQ ID NO: 2333486 - RNA, 13 nt, Human
cucagcucagcgc

SEQ ID NO: 2333487 - RNA, 19 nt, Human
cucagcucccaaggcucug

SEQ ID NO: 2333488 - RNA, 10 nt, Human
cucagcuccc

SEQ ID NO: 2333489 - RNA, 15 nt, Human
cucagcucccaaggc

SEQ ID NO: 2333490 - RNA, 19 nt, Human
cucagcuccagguggcucu

SEQ ID NO: 2333491 - RNA, 20 nt, Human
cucagcuccagguggcucug

SEQ ID NO: 2333492 - RNA, 16 nt, Human
cucagcucccauuucu

SEQ ID NO: 2333493 - RNA, 17 nt, Human
cucagcucccauuucua

SEQ ID NO: 2333494 - RNA, 18 nt, Human
cucagcucccauuucuac

SEQ ID NO: 2333495 - RNA, 21 nt, Human
cucagcucccauuucuacucu

SEQ ID NO: 2333496 - RNA, 11 nt, Human
cucagcucccc

SEQ ID NO: 2333497 - RNA, 12 nt, Human
cucagcucccca

SEQ ID NO: 2333498 - RNA, 14 nt, Human
cucagcuccccaga

SEQ ID NO: 2333499 - RNA, 16 nt, Human
cucagcuccccagagu

SEQ ID NO: 2333500 - RNA, 19 nt, Human
cucagcuccccagaguccu

SEQ ID NO: 2333501 - RNA, 12 nt, Human
cucagcuccccc

SEQ ID NO: 2333502 - RNA, 14 nt, Human
cucagcucccccug

SEQ ID NO: 2333503 - RNA, 15 nt, Human
cucagcucccccugu

SEQ ID NO: 2333504 - RNA, 16 nt, Human
cucagcucccccuguc

SEQ ID NO: 2333505 - RNA, 17 nt, Human
cucagcucccccugucc

SEQ ID NO: 2333506 - RNA, 14 nt, Human
cucagcccugaccc

SEQ ID NO: 2333507 - RNA, 15 nt, Human
cucagcccugacccu

SEQ ID NO: 2333508 - RNA, 13 nt, Human
cucagcccugacc

SEQ ID NO: 2333509 - RNA, 11 nt, Human
cucagcccuga

SEQ ID NO: 2333510 - RNA, 14 nt, Human
cucagcggggacag

SEQ ID NO: 2333511 - RNA, 15 nt, Human
cucagcggggacagc

SEQ ID NO: 2333512 - RNA, 16 nt, Human
cucagcggggacagcu

SEQ ID NO: 2333513 - RNA, 18 nt, Human
cucagcggggacagcucc

SEQ ID NO: 2333514 - RNA, 19 nt, Human
cucagcggggacagcuccu

SEQ ID NO: 2333515 - RNA, 20 nt, Human
cucagcggggacagcuccuu

SEQ ID NO: 2333516 - RNA, 21 nt, Human
cucagcggggacagcuccuuc

SEQ ID NO: 2333517 - RNA, 19 nt, Human
cucagcccaccccccucau

SEQ ID NO: 2333518 - RNA, 17 nt, Human
cucagcccaccccccuc

SEQ ID NO: 2333519 - RNA, 16 nt, Human
cucagcccaccccccu

SEQ ID NO: 2333520 - RNA, 11 nt, Human
cucagcccacc

SEQ ID NO: 2333521 - RNA, 16 nt, Human
cucagccaagcacagu

SEQ ID NO: 2333522 - RNA, 17 nt, Human
cucagccaagcacagug

SEQ ID NO: 2333523 - RNA, 15 nt, Human
cucagcauccuggca

SEQ ID NO: 2333524 - RNA, 19 nt, Human
cucagcauauuuguauagu

SEQ ID NO: 2333525 - RNA, 23 nt, Human
cucagcauauuuguauaguugcu

SEQ ID NO: 2333526 - RNA, 13 nt, Human
cucagcaugcauc

SEQ ID NO: 2333527 - RNA, 16 nt, Human
cucagcaugcauccuu

SEQ ID NO: 2333528 - RNA, 13 nt, Human
cucagccaagcac

SEQ ID NO: 2333529 - RNA, 14 nt, Human
cucagccaagcaca

SEQ ID NO: 2333530 - RNA, 15 nt, Human
cucagccaagcacag

SEQ ID NO: 2333531 - RNA, 19 nt, Human
cucagccccucuugccccc

SEQ ID NO: 2333532 - RNA, 18 nt, Human
cucagccccucuugcccc

SEQ ID NO: 2333533 - RNA, 20 nt, Human
cucagccccugauccuguga

SEQ ID NO: 2333534 - RNA, 22 nt, Human
cucagccccugauccugugaag

SEQ ID NO: 2333535 - RNA, 23 nt, Human
cucagccccugauccugugaagu

SEQ ID NO: 2333536 - RNA, 16 nt, Human
cucagccccucuugcc

SEQ ID NO: 2333537 - RNA, 13 nt, Human
cucagccccucuu

SEQ ID NO: 2333538 - RNA, 11 nt, Human
cucagccccuc

SEQ ID NO: 2333539 - RNA, 17 nt, Human
cucagccccaccccagg

SEQ ID NO: 2333540 - RNA, 14 nt, Human
cucagcccucccug

SEQ ID NO: 2333541 - RNA, 19 nt, Human
cucagcccucccugccccu

SEQ ID NO: 2333542 - RNA, 20 nt, Human
cucagcccucccugccccuc

SEQ ID NO: 2333543 - RNA, 21 nt, Human
cucagcccucccugccccucc

SEQ ID NO: 2333544 - RNA, 21 nt, Human
cucagcaaaagaugcuucuca

SEQ ID NO: 2333545 - RNA, 16 nt, Human
cucagcaggggagggu

SEQ ID NO: 2333546 - RNA, 20 nt, Human
cucagcaaaagaugcuucuc

SEQ ID NO: 2333547 - RNA, 19 nt, Human
cucagcaaaagaugcuucu

SEQ ID NO: 2333548 - RNA, 20 nt, Human
cucagcagcugguaaucuug

SEQ ID NO: 2333549 - RNA, 12 nt, Human
cucagcauaccu

SEQ ID NO: 2333550 - RNA, 16 nt, Human
cucagcauaccugcug

SEQ ID NO: 2333551 - RNA, 14 nt, Human
cucagcauauuugu

SEQ ID NO: 2333552 - RNA, 16 nt, Human
cucagcauauuuguau

SEQ ID NO: 2333553 - RNA, 18 nt, Human
cucagcauauuuguauag

SEQ ID NO: 2333554 - RNA, 13 nt, Human
cucagcauccugg

SEQ ID NO: 2333555 - RNA, 21 nt, Human
cucagcauccuggcacccggc

SEQ ID NO: 2333556 - RNA, 22 nt, Human
cucagcauccuggcacccggcc

SEQ ID NO: 2333557 - RNA, 14 nt, Human
cucacuggccaucc

SEQ ID NO: 2333558 - RNA, 23 nt, Human
cucacugcucccugaagccagcc

SEQ ID NO: 2333559 - RNA, 19 nt, Human
cucacugcucccugaagcc

SEQ ID NO: 2333560 - RNA, 20 nt, Human
cucacugcucccugaagcca

SEQ ID NO: 2333561 - RNA, 12 nt, Human
cucacugcucaa

SEQ ID NO: 2333562 - RNA, 14 nt, Human
cucacugcucaaga

SEQ ID NO: 2333563 - RNA, 16 nt, Human
cucacugcucaagaag

SEQ ID NO: 2333564 - RNA, 19 nt, Human
cucacugcucaagaagaca

SEQ ID NO: 2333565 - RNA, 20 nt, Human
cucacugcucaagaagacau

SEQ ID NO: 2333566 - RNA, 21 nt, Human
cucacugcucaagaagacaug

SEQ ID NO: 2333567 - RNA, 15 nt, Human
cucacugcucccuga

SEQ ID NO: 2333568 - RNA, 17 nt, Human
cucacugcucccugaag

SEQ ID NO: 2333569 - RNA, 20 nt, Human
cucacugggguccuggggcc

SEQ ID NO: 2333570 - RNA, 17 nt, Human
cucacugggguccuggg

SEQ ID NO: 2333571 - RNA, 18 nt, Human
cucacuggggccuacagc

SEQ ID NO: 2333572 - RNA, 16 nt, Human
cucacuggggccuaca

SEQ ID NO: 2333573 - RNA, 13 nt, Human
cucacuggggccu

SEQ ID NO: 2333574 - RNA, 16 nt, Human
cucacuggccaucccu

SEQ ID NO: 2333575 - RNA, 21 nt, Human
cucacuggccaucccucgugg

SEQ ID NO: 2333576 - RNA, 14 nt, Human
cucacuguugccca

SEQ ID NO: 2333577 - RNA, 15 nt, Human
cucacuguugcccag

SEQ ID NO: 2333578 - RNA, 13 nt, Human
cucacuggguggg

SEQ ID NO: 2333579 - RNA, 12 nt, Human
cucacugggugg

SEQ ID NO: 2333580 - RNA, 22 nt, Human
cucacugggguccuggggccuc

SEQ ID NO: 2333581 - RNA, 13 nt, Human
cucacugucugag

SEQ ID NO: 2333582 - RNA, 12 nt, Human
cucacugucuga

SEQ ID NO: 2333583 - RNA, 23 nt, Human
cucacugugggaaggccagcugc

SEQ ID NO: 2333584 - RNA, 20 nt, Human
cucacuguggugucuguguu

SEQ ID NO: 2333585 - RNA, 24 nt, Human
cucacugugggaaggccagcugcc

SEQ ID NO: 2333586 - RNA, 12 nt, Human
cucacuguuccc

SEQ ID NO: 2333587 - RNA, 18 nt, Human
cucacuguucccucugcu

SEQ ID NO: 2333588 - RNA, 20 nt, Human
cucacuguucccucugcucc

SEQ ID NO: 2333589 - RNA, 13 nt, Human
cucacagcacaga

SEQ ID NO: 2333590 - RNA, 14 nt, Human
cucacagcacagag

SEQ ID NO: 2333591 - RNA, 14 nt, Human
cucacugcagccuc

SEQ ID NO: 2333592 - RNA, 22 nt, Human
cucacugcggagaaccuugugc

SEQ ID NO: 2333593 - RNA, 11 nt, Human
cucacugccag

SEQ ID NO: 2333594 - RNA, 12 nt, Human
cucacugccagg

SEQ ID NO: 2333595 - RNA, 20 nt, Human
cucacugcauccuccgccuc

SEQ ID NO: 2333596 - RNA, 23 nt, Human
cucacugcuaagaauauuugaau

SEQ ID NO: 2333597 - RNA, 22 nt, Human
cucacugcuaagaauauuugaa

SEQ ID NO: 2333598 - RNA, 21 nt, Human
cucacugcuaagaauauuuga

SEQ ID NO: 2333599 - RNA, 20 nt, Human
cucacugcuaagaauauuug

SEQ ID NO: 2333600 - RNA, 15 nt, Human
cucacugcagccuca

SEQ ID NO: 2333601 - RNA, 16 nt, Human
cucacugcagccucaa

SEQ ID NO: 2333602 - RNA, 15 nt, Human
cucacagcacagaga

SEQ ID NO: 2333603 - RNA, 14 nt, Human
cucacagaccugga

SEQ ID NO: 2333604 - RNA, 17 nt, Human
cucacagaccuggagcc

SEQ ID NO: 2333605 - RNA, 20 nt, Human
cucacagaccuggagccccu

SEQ ID NO: 2333606 - RNA, 22 nt, Human
cucacagaccuggagccccugg

SEQ ID NO: 2333607 - RNA, 23 nt, Human
cucacagaccuggagccccuggg

SEQ ID NO: 2333608 - RNA, 14 nt, Human
cucagaguccaggc

SEQ ID NO: 2333609 - RNA, 18 nt, Human
cucagaguauggagcuca

SEQ ID NO: 2333610 - RNA, 16 nt, Human
cucagaguauggagcu

SEQ ID NO: 2333611 - RNA, 17 nt, Human
cucagaguauggagcuc

SEQ ID NO: 2333612 - RNA, 19 nt, Human
cucagagguagggcugcca

SEQ ID NO: 2333613 - RNA, 21 nt, Human
cucagaggguuguucuccuag

SEQ ID NO: 2333614 - RNA, 18 nt, Human
cucagaggguuguucucc

SEQ ID NO: 2333615 - RNA, 19 nt, Human
cucagaggcgcacugugac

SEQ ID NO: 2333616 - RNA, 16 nt, Human
cucagaggcuguucuu

SEQ ID NO: 2333617 - RNA, 18 nt, Human
cucagagcuacuugggcc

SEQ ID NO: 2333618 - RNA, 15 nt, Human
cucagagccagucuu

SEQ ID NO: 2333619 - RNA, 22 nt, Human
cucagagaugugcacccauggg

SEQ ID NO: 2333620 - RNA, 12 nt, Human
cucagagccagu

SEQ ID NO: 2333621 - RNA, 19 nt, Human
cucagagcuacuugggcca

SEQ ID NO: 2333622 - RNA, 18 nt, Human
cucagaggcgcacuguga

SEQ ID NO: 2333623 - RNA, 17 nt, Human
cucagaggcgcacugug

SEQ ID NO: 2333624 - RNA, 22 nt, Human
cucagauggaaccgcaggaagc

SEQ ID NO: 2333625 - RNA, 21 nt, Human
cucagauggaaccgcaggaag

SEQ ID NO: 2333626 - RNA, 23 nt, Human
cucagauggaaccgcaggaagcu

SEQ ID NO: 2333627 - RNA, 20 nt, Human
cucagauggaaccgcaggaa

SEQ ID NO: 2333628 - RNA, 16 nt, Human
cucagauggaaccgca

SEQ ID NO: 2333629 - RNA, 16 nt, Human
cucagaucuucugugg

SEQ ID NO: 2333630 - RNA, 15 nt, Human
cucacuguugaauuu

SEQ ID NO: 2333631 - RNA, 21 nt, Human
cucacuguucccucugcuccu

SEQ ID NO: 2333632 - RNA, 21 nt, Human
cucacuguucuauucaucuca

SEQ ID NO: 2333633 - RNA, 18 nt, Human
cucagagagggugggagu

SEQ ID NO: 2333634 - RNA, 19 nt, Human
cucagagagggugggagug

SEQ ID NO: 2333635 - RNA, 21 nt, Human
cucacuguugaauuuucucua

SEQ ID NO: 2333636 - RNA, 20 nt, Human
cucagagaugugcacccaug

SEQ ID NO: 2333637 - RNA, 15 nt, Human
cucagagccaccccu

SEQ ID NO: 2333638 - RNA, 23 nt, Human
cucagagagggugggagugggcc

SEQ ID NO: 2333639 - RNA, 16 nt, Human
cucacuguugcccagg

SEQ ID NO: 2333640 - RNA, 17 nt, Human
cucacuguugcccaggc

SEQ ID NO: 2333641 - RNA, 18 nt, Human
cucacuguugcccaggcu

SEQ ID NO: 2333642 - RNA, 19 nt, Human
cucacuguugcccaggcug

SEQ ID NO: 2333643 - RNA, 13 nt, Human
cucccaggcucuc

SEQ ID NO: 2333644 - RNA, 12 nt, Human
cucccaggcucu

SEQ ID NO: 2333645 - RNA, 16 nt, Human
cucccagggccagggc

SEQ ID NO: 2333646 - RNA, 18 nt, Human
cucccacaggcagcuuua

SEQ ID NO: 2333647 - RNA, 20 nt, Human
cucccaggcgccccuucccc

SEQ ID NO: 2333648 - RNA, 22 nt, Human
cucccaggcgccccuucccccu

SEQ ID NO: 2333649 - RNA, 16 nt, Human
cucccaucacuucccu

SEQ ID NO: 2333650 - RNA, 19 nt, Human
cucccagggccagggcccu

SEQ ID NO: 2333651 - RNA, 14 nt, Human
cucccaucacccgc

SEQ ID NO: 2333652 - RNA, 14 nt, Human
cucccacacugcua

SEQ ID NO: 2333653 - RNA, 19 nt, Human
cucccaauuucagacuccc

SEQ ID NO: 2333654 - RNA, 21 nt, Human
cucccaauuucagacucccau

SEQ ID NO: 2333655 - RNA, 15 nt, Human
cucccacacugcuag

SEQ ID NO: 2333656 - RNA, 14 nt, Human
cucccacaggcagc

SEQ ID NO: 2333657 - RNA, 15 nt, Human
cucccacaggcagcu

SEQ ID NO: 2333658 - RNA, 16 nt, Human
cucccacaggcagcuu

SEQ ID NO: 2333659 - RNA, 17 nt, Human
cucccacaggcagcuuu

SEQ ID NO: 2333660 - RNA, 17 nt, Human
cucccaggcgccccuuc

SEQ ID NO: 2333661 - RNA, 19 nt, Human
cucccaggcgccccuuccc

SEQ ID NO: 2333662 - RNA, 23 nt, Human
cuccccaccuucaauuccugggc

SEQ ID NO: 2333663 - RNA, 21 nt, Human
cuccccaccuucaauuccugg

SEQ ID NO: 2333664 - RNA, 12 nt, Human
cuccccacgccc

SEQ ID NO: 2333665 - RNA, 20 nt, Human
cuccccaccaccccagcugc

SEQ ID NO: 2333666 - RNA, 14 nt, Human
cuccccacccgccc

SEQ ID NO: 2333667 - RNA, 19 nt, Human
cuccccaccaccccagcug

SEQ ID NO: 2333668 - RNA, 22 nt, Human
cucccauugucccucugcccca

SEQ ID NO: 2333669 - RNA, 14 nt, Human
cucccauuuccuga

SEQ ID NO: 2333670 - RNA, 19 nt, Human
cucccauugucccucugcc

SEQ ID NO: 2333671 - RNA, 17 nt, Human
cucccauugucccucug

SEQ ID NO: 2333672 - RNA, 19 nt, Human
cucccauuccugaagaacc

SEQ ID NO: 2333673 - RNA, 17 nt, Human
cucccauuccugaagaa

SEQ ID NO: 2333674 - RNA, 16 nt, Human
cucccauuccugaaga

SEQ ID NO: 2333675 - RNA, 15 nt, Human
cucccauuccugaag

SEQ ID NO: 2333676 - RNA, 14 nt, Human
cucccauuccugaa

SEQ ID NO: 2333677 - RNA, 19 nt, Human
cucccauucacucuuccag

SEQ ID NO: 2333678 - RNA, 19 nt, Human
cucccauuaggacaaucag

SEQ ID NO: 2333679 - RNA, 20 nt, Human
cucccauucacucuuccaga

SEQ ID NO: 2333680 - RNA, 22 nt, Human
cucccauccagggcccccaucu

SEQ ID NO: 2333681 - RNA, 15 nt, Human
cucccauccagggcc

SEQ ID NO: 2333682 - RNA, 14 nt, Human
cucccauccagggc

SEQ ID NO: 2333683 - RNA, 12 nt, Human
cucccauccccc

SEQ ID NO: 2333684 - RNA, 14 nt, Human
cucccaucccccug

SEQ ID NO: 2333685 - RNA, 16 nt, Human
cucccaucccccugcc

SEQ ID NO: 2333686 - RNA, 17 nt, Human
cucccaucccccugccc

SEQ ID NO: 2333687 - RNA, 18 nt, Human
cucccaucccccugcccu

SEQ ID NO: 2333688 - RNA, 19 nt, Human
cucccaucccccugcccuc

SEQ ID NO: 2333689 - RNA, 24 nt, Human
cucccaucccccugcccucguggc

SEQ ID NO: 2333690 - RNA, 13 nt, Human
cucccauccccug

SEQ ID NO: 2333691 - RNA, 15 nt, Human
cucccauccccugga

SEQ ID NO: 2333692 - RNA, 16 nt, Human
cucccauccccuggac

SEQ ID NO: 2333693 - RNA, 23 nt, Human
cucccauccccuggacugggagg

SEQ ID NO: 2333694 - RNA, 14 nt, Human
cucccauggagccc

SEQ ID NO: 2333695 - RNA, 15 nt, Human
cucccauggagcccc

SEQ ID NO: 2333696 - RNA, 16 nt, Human
cucccauggagcccca

SEQ ID NO: 2333697 - RNA, 17 nt, Human
cucccauggagccccag

SEQ ID NO: 2333698 - RNA, 18 nt, Human
cucccauggagccccagc

SEQ ID NO: 2333699 - RNA, 19 nt, Human
cucccauggagccccagcc

SEQ ID NO: 2333700 - RNA, 20 nt, Human
cucccauggagccccagccc

SEQ ID NO: 2333701 - RNA, 23 nt, Human
cucccauggagccccagcccccu

SEQ ID NO: 2333702 - RNA, 14 nt, Human
cucccauggcaccu

SEQ ID NO: 2333703 - RNA, 20 nt, Human
cucccauggcuuaaugcuuc

SEQ ID NO: 2333704 - RNA, 21 nt, Human
cucccauggcuuaaugcuucu

SEQ ID NO: 2333705 - RNA, 20 nt, Human
cuccagcugcucugucuucu

SEQ ID NO: 2333706 - RNA, 15 nt, Human
cuccagcucuuuccu

SEQ ID NO: 2333707 - RNA, 23 nt, Human
cuccagcuggccgggagccugau

SEQ ID NO: 2333708 - RNA, 22 nt, Human
cuccagcuggccgggagccuga

SEQ ID NO: 2333709 - RNA, 15 nt, Human
cuccagcugggcucu

SEQ ID NO: 2333710 - RNA, 19 nt, Human
cuccagcugggcucugcaa

SEQ ID NO: 2333711 - RNA, 20 nt, Human
cuccagcugggcucugcaau

SEQ ID NO: 2333712 - RNA, 13 nt, Human
cuccaugcugccu

SEQ ID NO: 2333713 - RNA, 14 nt, Human
cuccaugcugccuc

SEQ ID NO: 2333714 - RNA, 15 nt, Human
cuccaugcugccucc

SEQ ID NO: 2333715 - RNA, 16 nt, Human
cuccaugcugccucca

SEQ ID NO: 2333716 - RNA, 17 nt, Human
cuccaugcugccuccag

SEQ ID NO: 2333717 - RNA, 20 nt, Human
cuccaugcuuagucacugcc

SEQ ID NO: 2333718 - RNA, 21 nt, Human
cuccaugcuuagucacugccu

SEQ ID NO: 2333719 - RNA, 15 nt, Human
cucccacaaaggaga

SEQ ID NO: 2333720 - RNA, 15 nt, Human
cucccaaaugagcca

SEQ ID NO: 2333721 - RNA, 20 nt, Human
cucccaaguuuuaggacaaa

SEQ ID NO: 2333722 - RNA, 14 nt, Human
cucccaacucaccc

SEQ ID NO: 2333723 - RNA, 15 nt, Human
cucccaacucacccc

SEQ ID NO: 2333724 - RNA, 16 nt, Human
cucccaaagugcuggg

SEQ ID NO: 2333725 - RNA, 23 nt, Human
cucccaaagugcugggauuacag

SEQ ID NO: 2333726 - RNA, 15 nt, Human
cuccauuuaguucuu

SEQ ID NO: 2333727 - RNA, 15 nt, Human
cuccccugcacugga

SEQ ID NO: 2333728 - RNA, 22 nt, Human
cuccccugauuacaccagccuc

SEQ ID NO: 2333729 - RNA, 15 nt, Human
cuccccucucuugca

SEQ ID NO: 2333730 - RNA, 13 nt, Human
cuccccugaggcu

SEQ ID NO: 2333731 - RNA, 22 nt, Human
cuccccugaggcucagggaaag

SEQ ID NO: 2333732 - RNA, 21 nt, Human
cuccccugcacuggaguccag

SEQ ID NO: 2333733 - RNA, 17 nt, Human
cuccccucucuugcacc

SEQ ID NO: 2333734 - RNA, 21 nt, Human
cuccccucuauuuagcaugac

SEQ ID NO: 2333735 - RNA, 12 nt, Human
cuccccucucuu

SEQ ID NO: 2333736 - RNA, 10 nt, Human
cuccccucua

SEQ ID NO: 2333737 - RNA, 22 nt, Human
cuccccuccuugccuccugugu

SEQ ID NO: 2333738 - RNA, 16 nt, Human
cuccccugaccuguga

SEQ ID NO: 2333739 - RNA, 22 nt, Human
cuccccugaccugugagcccag

SEQ ID NO: 2333740 - RNA, 17 nt, Human
cuccccugaccugugag

SEQ ID NO: 2333741 - RNA, 14 nt, Human
cuccccugcugggu

SEQ ID NO: 2333742 - RNA, 16 nt, Human
cuccccugccagggca

SEQ ID NO: 2333743 - RNA, 15 nt, Human
cuccccugccagggc

SEQ ID NO: 2333744 - RNA, 12 nt, Human
cuccccugccac

SEQ ID NO: 2333745 - RNA, 13 nt, Human
cuccccugccacc

SEQ ID NO: 2333746 - RNA, 18 nt, Human
cuccccugccaccaggcc

SEQ ID NO: 2333747 - RNA, 23 nt, Human
cuccccugccaccaggccaccuc

SEQ ID NO: 2333748 - RNA, 21 nt, Human
cuccccugcuggguguggcgc

SEQ ID NO: 2333749 - RNA, 23 nt, Human
cuccccugcuggguguggcgcag

SEQ ID NO: 2333750 - RNA, 13 nt, Human
cuccccagcccag

SEQ ID NO: 2333751 - RNA, 21 nt, Human
cuccccagcauuccagccccu

SEQ ID NO: 2333752 - RNA, 22 nt, Human
cuccccagcauuccagccccuc

SEQ ID NO: 2333753 - RNA, 23 nt, Human
cuccccagcauuccagccccucu

SEQ ID NO: 2333754 - RNA, 15 nt, Human
cuccccacgcccucc

SEQ ID NO: 2333755 - RNA, 17 nt, Human
cuccccacggccgcucc

SEQ ID NO: 2333756 - RNA, 20 nt, Human
cuccccacggccgcuccagg

SEQ ID NO: 2333757 - RNA, 13 nt, Human
cuccccacucuag

SEQ ID NO: 2333758 - RNA, 21 nt, Human
cuccccacggccgcuccaggg

SEQ ID NO: 2333759 - RNA, 22 nt, Human
cuccccacggccgcuccagggg

SEQ ID NO: 2333760 - RNA, 23 nt, Human
cuccccacggggccucgggaccu

SEQ ID NO: 2333761 - RNA, 12 nt, Human
cuccccacucua

SEQ ID NO: 2333762 - RNA, 20 nt, Human
cuccccuccuugccuccugu

SEQ ID NO: 2333763 - RNA, 19 nt, Human
cuccccuccuugccuccug

SEQ ID NO: 2333764 - RNA, 22 nt, Human
cuccccagcccaggguuccccc

SEQ ID NO: 2333765 - RNA, 16 nt, Human
cuccccagcccagggu

SEQ ID NO: 2333766 - RNA, 16 nt, Human
cuccccucuccuuccu

SEQ ID NO: 2333767 - RNA, 14 nt, Human
cuccccucggagaa

SEQ ID NO: 2333768 - RNA, 15 nt, Human
cuccccagcccaggg

SEQ ID NO: 2333769 - RNA, 11 nt, Human
cuccccagccc

SEQ ID NO: 2333770 - RNA, 18 nt, Human
cuccccagcccagagaca

SEQ ID NO: 2333771 - RNA, 20 nt, Human
cuccccagccccaucccaaa

SEQ ID NO: 2333772 - RNA, 16 nt, Human
cuccccuccuugccuc

SEQ ID NO: 2333773 - RNA, 17 nt, Human
cuccccagcccagagac

SEQ ID NO: 2333774 - RNA, 16 nt, Human
cuccccagcccagaga

SEQ ID NO: 2333775 - RNA, 15 nt, Human
cuccccagcccagag

SEQ ID NO: 2333776 - RNA, 14 nt, Human
cuccccagcccaga

SEQ ID NO: 2333777 - RNA, 18 nt, Human
cucccucagccccucuug

SEQ ID NO: 2333778 - RNA, 16 nt, Human
cucccucagccccucu

SEQ ID NO: 2333779 - RNA, 15 nt, Human
cucccucagccccuc

SEQ ID NO: 2333780 - RNA, 14 nt, Human
cucccucagccccu

SEQ ID NO: 2333781 - RNA, 13 nt, Human
cucccucagcccc

SEQ ID NO: 2333782 - RNA, 12 nt, Human
cucccucagccc

SEQ ID NO: 2333783 - RNA, 18 nt, Human
cucccucagucuggcccu

SEQ ID NO: 2333784 - RNA, 12 nt, Human
cucccuggagcc

SEQ ID NO: 2333785 - RNA, 19 nt, Human
cucccugcuguccccucuu

SEQ ID NO: 2333786 - RNA, 20 nt, Human
cucccugcuguccccucuug

SEQ ID NO: 2333787 - RNA, 11 nt, Human
cucccugcugu

SEQ ID NO: 2333788 - RNA, 14 nt, Human
cucccugcuguccc

SEQ ID NO: 2333789 - RNA, 16 nt, Human
cucccugcuguccccu

SEQ ID NO: 2333790 - RNA, 18 nt, Human
cucccugcuguccccucu

SEQ ID NO: 2333791 - RNA, 18 nt, Human
cucccuggagccagacuc

SEQ ID NO: 2333792 - RNA, 19 nt, Human
cucccuggagccagacucu

SEQ ID NO: 2333793 - RNA, 21 nt, Human
cucccuggagccagacucugg

SEQ ID NO: 2333794 - RNA, 11 nt, Human
cucccuggagu

SEQ ID NO: 2333795 - RNA, 12 nt, Human
cucccuggagug

SEQ ID NO: 2333796 - RNA, 22 nt, Human
cucccuggagugcaguuuccaa

SEQ ID NO: 2333797 - RNA, 22 nt, Human
cucccuggaguguggcugagga

SEQ ID NO: 2333798 - RNA, 22 nt, Human
cucccuucaaccauuccccaug

SEQ ID NO: 2333799 - RNA, 23 nt, Human
cucccuucaaccauuccccaugg

SEQ ID NO: 2333800 - RNA, 15 nt, Human
cucccuucauccuuc

SEQ ID NO: 2333801 - RNA, 12 nt, Human
cucccuggcccu

SEQ ID NO: 2333802 - RNA, 13 nt, Human
cucccuggcccuc

SEQ ID NO: 2333803 - RNA, 14 nt, Human
cucccuggcccuca

SEQ ID NO: 2333804 - RNA, 15 nt, Human
cucccuggcccucaa

SEQ ID NO: 2333805 - RNA, 21 nt, Human
cucccuucaaccauuccccau

SEQ ID NO: 2333806 - RNA, 23 nt, Human
cucccuggaguguggcugaggag

SEQ ID NO: 2333807 - RNA, 20 nt, Human
cucccgaauagcugggacua

SEQ ID NO: 2333808 - RNA, 23 nt, Human
cucccgaauagcugggacuacag

SEQ ID NO: 2333809 - RNA, 19 nt, Human
cuccccugugcaguccugg

SEQ ID NO: 2333810 - RNA, 14 nt, Human
cuccccuguaccuu

SEQ ID NO: 2333811 - RNA, 23 nt, Human
cuccccuggggacagcaagggcu

SEQ ID NO: 2333812 - RNA, 21 nt, Human
cuccccugccagggcagggcc

SEQ ID NO: 2333813 - RNA, 22 nt, Human
cuccccuggaacugucucucau

SEQ ID NO: 2333814 - RNA, 14 nt, Human
cucccucaacccca

SEQ ID NO: 2333815 - RNA, 13 nt, Human
cucccucacccug

SEQ ID NO: 2333816 - RNA, 18 nt, Human
cucccucacccugagccc

SEQ ID NO: 2333817 - RNA, 17 nt, Human
cucccucaauucccccu

SEQ ID NO: 2333818 - RNA, 15 nt, Human
cucccucacccugag

SEQ ID NO: 2333819 - RNA, 15 nt, Human
cucccucaaagcaca

SEQ ID NO: 2333820 - RNA, 22 nt, Human
cucccuauuuuuuuucuguuau

SEQ ID NO: 2333821 - RNA, 21 nt, Human
cucccuauuuuuuuucuguua

SEQ ID NO: 2333822 - RNA, 12 nt, Human
cucauuccugua

SEQ ID NO: 2333823 - RNA, 14 nt, Human
cucauaaaaagcaa

SEQ ID NO: 2333824 - RNA, 17 nt, Human
cucauaaaaagcaaaac

SEQ ID NO: 2333825 - RNA, 20 nt, Human
cucauuccugccugucuccu

SEQ ID NO: 2333826 - RNA, 14 nt, Human
cucaguuuucauaa

SEQ ID NO: 2333827 - RNA, 21 nt, Human
cucauaaaaagccugcaauuu

SEQ ID NO: 2333828 - RNA, 12 nt, Human
cucaguuucccu

SEQ ID NO: 2333829 - RNA, 21 nt, Human
cucaguuuaauccuucuaguu

SEQ ID NO: 2333830 - RNA, 17 nt, Human
cucaguuuaauccuucu

SEQ ID NO: 2333831 - RNA, 18 nt, Human
cucaguuuaauccuucua

SEQ ID NO: 2333832 - RNA, 16 nt, Human
cucaguuucccuaucu

SEQ ID NO: 2333833 - RNA, 13 nt, Human
cucaguuucccua

SEQ ID NO: 2333834 - RNA, 13 nt, Human
cucaguuugucag

SEQ ID NO: 2333835 - RNA, 18 nt, Human
cucaguuuuaucauuuuc

SEQ ID NO: 2333836 - RNA, 13 nt, Human
cucaguuuucaua

SEQ ID NO: 2333837 - RNA, 17 nt, Human
cucaguuuuaucauuuu

SEQ ID NO: 2333838 - RNA, 22 nt, Human
cucaguuugugugucuuaauua

SEQ ID NO: 2333839 - RNA, 11 nt, Human
cucaguuguag

SEQ ID NO: 2333840 - RNA, 14 nt, Human
cucaguuguagaau

SEQ ID NO: 2333841 - RNA, 16 nt, Human
cucaguuguagaaugu

SEQ ID NO: 2333842 - RNA, 21 nt, Human
cucaguuguagaauguauugu

SEQ ID NO: 2333843 - RNA, 15 nt, Human
cucaguuuaauccuu

SEQ ID NO: 2333844 - RNA, 15 nt, Human
cucaguucuagucuc

SEQ ID NO: 2333845 - RNA, 19 nt, Human
cucaguucuagucucucug

SEQ ID NO: 2333846 - RNA, 20 nt, Human
cucaguucuagucucucugg

SEQ ID NO: 2333847 - RNA, 21 nt, Human
cucaguucuagucucucuggg

SEQ ID NO: 2333848 - RNA, 22 nt, Human
cucaguucccuuggccucagaa

SEQ ID NO: 2333849 - RNA, 20 nt, Human
cucaguuccgauuucccagg

SEQ ID NO: 2333850 - RNA, 22 nt, Human
cucaguuccgauuucccaggcu

SEQ ID NO: 2333851 - RNA, 17 nt, Human
cucaguucucuucacuc

SEQ ID NO: 2333852 - RNA, 16 nt, Human
cucaguucucuucacu

SEQ ID NO: 2333853 - RNA, 16 nt, Human
cucauugcugagccuc

SEQ ID NO: 2333854 - RNA, 15 nt, Human
cucauugcugagccu

SEQ ID NO: 2333855 - RNA, 14 nt, Human
cucauuucaccccu

SEQ ID NO: 2333856 - RNA, 17 nt, Human
cucauuucaccccuccc

SEQ ID NO: 2333857 - RNA, 19 nt, Human
cucauuucaccccucccuu

SEQ ID NO: 2333858 - RNA, 22 nt, Human
cucauuucaccccucccuuucu

SEQ ID NO: 2333859 - RNA, 19 nt, Human
cucauugaccugaggcccu

SEQ ID NO: 2333860 - RNA, 21 nt, Human
cucauugaccugaggcccuuc

SEQ ID NO: 2333861 - RNA, 12 nt, Human
cucauucuucug

SEQ ID NO: 2333862 - RNA, 19 nt, Human
cucauucugaaggagcccc

SEQ ID NO: 2333863 - RNA, 17 nt, Human
cucauucugaaggagcc

SEQ ID NO: 2333864 - RNA, 17 nt, Human
cucauugaccugaggcc

SEQ ID NO: 2333865 - RNA, 22 nt, Human
cucauucuccuuguguuacuaa

SEQ ID NO: 2333866 - RNA, 18 nt, Human
cucauucuccuuguguua

SEQ ID NO: 2333867 - RNA, 18 nt, Human
cuccaaacugaagcagcc

SEQ ID NO: 2333868 - RNA, 17 nt, Human
cuccaagcucccaggca

SEQ ID NO: 2333869 - RNA, 22 nt, Human
cuccaaaccuccuguuagcugu

SEQ ID NO: 2333870 - RNA, 21 nt, Human
cuccaaacccucgaggcggau

SEQ ID NO: 2333871 - RNA, 12 nt, Human
cuccaaggacca

SEQ ID NO: 2333872 - RNA, 14 nt, Human
cuccaaggaccagg

SEQ ID NO: 2333873 - RNA, 15 nt, Human
cuccaaggaccaggu

SEQ ID NO: 2333874 - RNA, 23 nt, Human
cuccaaacugaagcagccucucc

SEQ ID NO: 2333875 - RNA, 22 nt, Human
cuccaaacugaagcagccucuc

SEQ ID NO: 2333876 - RNA, 22 nt, Human
cuccaaggaggggcuguaaaau

SEQ ID NO: 2333877 - RNA, 21 nt, Human
cuccaaggaggggcuguaaaa

SEQ ID NO: 2333878 - RNA, 20 nt, Human
cuccaaggaggggcuguaaa

SEQ ID NO: 2333879 - RNA, 19 nt, Human
cuccaaggaggggcuguaa

SEQ ID NO: 2333880 - RNA, 18 nt, Human
cuccaaaauaaaacuuuu

SEQ ID NO: 2333881 - RNA, 18 nt, Human
cucauuuuuuuaauuuau

SEQ ID NO: 2333882 - RNA, 17 nt, Human
cuccaaacccucgaggc

SEQ ID NO: 2333883 - RNA, 15 nt, Human
cuccaaacccucgag

SEQ ID NO: 2333884 - RNA, 22 nt, Human
cuccaaaauguuggucauuuua

SEQ ID NO: 2333885 - RNA, 21 nt, Human
cucauuugucacacacuuugg

SEQ ID NO: 2333886 - RNA, 21 nt, Human
cucauuucaggagcagccuca

SEQ ID NO: 2333887 - RNA, 16 nt, Human
cucauuucaggagcag

SEQ ID NO: 2333888 - RNA, 17 nt, Human
cucauuuccaagcaagu

SEQ ID NO: 2333889 - RNA, 23 nt, Human
cucauuucaccccucccuuucuc

SEQ ID NO: 2333890 - RNA, 12 nt, Human
cucauuucagga

SEQ ID NO: 2333891 - RNA, 13 nt, Human
cucauuucaggau

SEQ ID NO: 2333892 - RNA, 12 nt, Human
cucauuuccaag

SEQ ID NO: 2333893 - RNA, 13 nt, Human
cucauuuccaagc

SEQ ID NO: 2333894 - RNA, 14 nt, Human
cucauuuccaagca

SEQ ID NO: 2333895 - RNA, 20 nt, Human
cuccagaguggggaugacau

SEQ ID NO: 2333896 - RNA, 21 nt, Human
cuccagauagcucauuucauu

SEQ ID NO: 2333897 - RNA, 16 nt, Human
cuccagaugcagggca

SEQ ID NO: 2333898 - RNA, 17 nt, Human
cuccagauguuuccaga

SEQ ID NO: 2333899 - RNA, 21 nt, Human
cuccagaugcagggcagucau

SEQ ID NO: 2333900 - RNA, 18 nt, Human
cuccagaugcagggcagu

SEQ ID NO: 2333901 - RNA, 17 nt, Human
cuccagaugcagggcag

SEQ ID NO: 2333902 - RNA, 16 nt, Human
cuccagagucagaagu

SEQ ID NO: 2333903 - RNA, 21 nt, Human
cuccagagggcacucugcuug

SEQ ID NO: 2333904 - RNA, 20 nt, Human
cuccagagggcacucugcuu

SEQ ID NO: 2333905 - RNA, 13 nt, Human
cuccagagggcac

SEQ ID NO: 2333906 - RNA, 14 nt, Human
cuccagacucucug

SEQ ID NO: 2333907 - RNA, 15 nt, Human
cuccagacucucugu

SEQ ID NO: 2333908 - RNA, 16 nt, Human
cuccagacucucugug

SEQ ID NO: 2333909 - RNA, 18 nt, Human
cuccagacucucugugaa

SEQ ID NO: 2333910 - RNA, 22 nt, Human
cuccacuccuuccugccaccug

SEQ ID NO: 2333911 - RNA, 19 nt, Human
cuccagacguaggggaggg

SEQ ID NO: 2333912 - RNA, 20 nt, Human
cuccagacguaggggagggg

SEQ ID NO: 2333913 - RNA, 13 nt, Human
cuccagacucucu

SEQ ID NO: 2333914 - RNA, 23 nt, Human
cuccagaccugauccuggaggcc

SEQ ID NO: 2333915 - RNA, 19 nt, Human
cuccagaccugauccugga

SEQ ID NO: 2333916 - RNA, 21 nt, Human
cuccagaccccuggcuuuuca

SEQ ID NO: 2333917 - RNA, 14 nt, Human
cuccacuggaugga

SEQ ID NO: 2333918 - RNA, 14 nt, Human
cuccagaccugauc

SEQ ID NO: 2333919 - RNA, 12 nt, Human
cuccagaccuga

SEQ ID NO: 2333920 - RNA, 11 nt, Human
cuccagaccug

SEQ ID NO: 2333921 - RNA, 16 nt, Human
cuccacucucccccac

SEQ ID NO: 2333922 - RNA, 19 nt, Human
cuccagauguuuccagacu

SEQ ID NO: 2333923 - RNA, 11 nt, Human
cuccagccccu

SEQ ID NO: 2333924 - RNA, 13 nt, Human
cuccagccccugg

SEQ ID NO: 2333925 - RNA, 14 nt, Human
cuccagccccugga

SEQ ID NO: 2333926 - RNA, 15 nt, Human
cuccagcucaccagc

SEQ ID NO: 2333927 - RNA, 16 nt, Human
cuccagcucaccagcc

SEQ ID NO: 2333928 - RNA, 18 nt, Human
cuccagcucaccagcccc

SEQ ID NO: 2333929 - RNA, 14 nt, Human
cuccacccauccua

SEQ ID NO: 2333930 - RNA, 21 nt, Human
cuccacccauccuaucagccu

SEQ ID NO: 2333931 - RNA, 23 nt, Human
cuccacccauccuaucagccugu

SEQ ID NO: 2333932 - RNA, 13 nt, Human
cuccacccccagc

SEQ ID NO: 2333933 - RNA, 14 nt, Human
cuccacccccagcu

SEQ ID NO: 2333934 - RNA, 15 nt, Human
cuccacccccagcug

SEQ ID NO: 2333935 - RNA, 17 nt, Human
cuccacccccagcugcu

SEQ ID NO: 2333936 - RNA, 16 nt, Human
cuccacccuuggccug

SEQ ID NO: 2333937 - RNA, 15 nt, Human
cuccacccuuggccu

SEQ ID NO: 2333938 - RNA, 14 nt, Human
cuccacccuuggcc

SEQ ID NO: 2333939 - RNA, 18 nt, Human
cuccacccccagcugcuu

SEQ ID NO: 2333940 - RNA, 19 nt, Human
cuccacccccagcugcuug

SEQ ID NO: 2333941 - RNA, 21 nt, Human
cuccacccuuggccugucuca

SEQ ID NO: 2333942 - RNA, 17 nt, Human
cuccacccuuggccugu

SEQ ID NO: 2333943 - RNA, 15 nt, Human
cuccaaggugggguc

SEQ ID NO: 2333944 - RNA, 20 nt, Human
cuccaaggggaaucagaacu

SEQ ID NO: 2333945 - RNA, 18 nt, Human
cuccaagggcuucugcac

SEQ ID NO: 2333946 - RNA, 19 nt, Human
cuccaagggcuucugcacc

SEQ ID NO: 2333947 - RNA, 20 nt, Human
cuccaagggcuucugcaccc

SEQ ID NO: 2333948 - RNA, 22 nt, Human
cuccaagggcuucugcacccuc

SEQ ID NO: 2333949 - RNA, 23 nt, Human
cuccaagggcuucugcacccucc

SEQ ID NO: 2333950 - RNA, 16 nt, Human
cuccaccacccaaaag

SEQ ID NO: 2333951 - RNA, 12 nt, Human
cuccaccaccca

SEQ ID NO: 2333952 - RNA, 23 nt, Human
cuccaccaccacuggccaccagg

SEQ ID NO: 2333953 - RNA, 19 nt, Human
cuccaccaccacuggccac

SEQ ID NO: 2333954 - RNA, 21 nt, Human
cuccaccaccacuggccacca

SEQ ID NO: 2333955 - RNA, 14 nt, Human
cuccaccacccaaa

SEQ ID NO: 2333956 - RNA, 13 nt, Human
cuccaccacccaa

SEQ ID NO: 2333957 - RNA, 15 nt, Human
cuccaccaggaaccu

SEQ ID NO: 2333958 - RNA, 14 nt, Human
cuccaccaggaacc

SEQ ID NO: 2333959 - RNA, 13 nt, Human
cuccaccaggaac

SEQ ID NO: 2333960 - RNA, 12 nt, Human
cuccaccucagc

SEQ ID NO: 2333961 - RNA, 23 nt, Human
cuccaccuaguggcuguccagug

SEQ ID NO: 2333962 - RNA, 21 nt, Human
cuccaccuaguggcuguccag

SEQ ID NO: 2333963 - RNA, 22 nt, Human
cuccaccuaguggcuguccagu

SEQ ID NO: 2333964 - RNA, 15 nt, Human
cuccaccuagacugu

SEQ ID NO: 2333965 - RNA, 15 nt, Human
cuccaccuaguggcu

SEQ ID NO: 2333966 - RNA, 20 nt, Human
cuccaccuaguggcugucca

SEQ ID NO: 2333967 - RNA, 19 nt, Human
cuccaccgcugccuaagug

SEQ ID NO: 2333968 - RNA, 16 nt, Human
cuccaccgcugccuaa

SEQ ID NO: 2333969 - RNA, 15 nt, Human
cuccaccgcugccua

SEQ ID NO: 2333970 - RNA, 14 nt, Human
cuccaccgcugccu

SEQ ID NO: 2333971 - RNA, 20 nt, Human
cuccaccgccauggcuucca

SEQ ID NO: 2333972 - RNA, 16 nt, Human
cuccaccgccauggcu

SEQ ID NO: 2333973 - RNA, 14 nt, Human
cuccaccucagccu

SEQ ID NO: 2333974 - RNA, 13 nt, Human
cuccaccucagcc

SEQ ID NO: 2333975 - RNA, 13 nt, Human
cuccacucccacu

SEQ ID NO: 2333976 - RNA, 14 nt, Human
cuccacucccacuu

SEQ ID NO: 2333977 - RNA, 20 nt, Human
cuccacguucugcucaucau

SEQ ID NO: 2333978 - RNA, 19 nt, Human
cuccacuccuuccugccac

SEQ ID NO: 2333979 - RNA, 15 nt, Human
cuccacuccuuccug

SEQ ID NO: 2333980 - RNA, 14 nt, Human
cuccacuccuuccu

SEQ ID NO: 2333981 - RNA, 12 nt, Human
cuccacuccuuc

SEQ ID NO: 2333982 - RNA, 13 nt, Human
cuccacucucccc

SEQ ID NO: 2333983 - RNA, 15 nt, Human
cuccacucuccccca

SEQ ID NO: 2333984 - RNA, 13 nt, Human
cuccacugccuuc

SEQ ID NO: 2333985 - RNA, 14 nt, Human
cuccacucuccucu

SEQ ID NO: 2333986 - RNA, 14 nt, Human
cuccacugccuucg

SEQ ID NO: 2333987 - RNA, 15 nt, Human
cuccacugccuucga

SEQ ID NO: 2333988 - RNA, 16 nt, Human
cuccacugccuucgau

SEQ ID NO: 2333989 - RNA, 13 nt, Human
cuccacuggaugg

SEQ ID NO: 2333990 - RNA, 15 nt, Human
cccgccaaaagcugc

SEQ ID NO: 2333991 - RNA, 23 nt, Human
cccgccaccuaucucgugggaga

SEQ ID NO: 2333992 - RNA, 12 nt, Human
cccgcccacugu

SEQ ID NO: 2333993 - RNA, 16 nt, Human
cccgcccacuguccug

SEQ ID NO: 2333994 - RNA, 13 nt, Human
cccgcccagcugc

SEQ ID NO: 2333995 - RNA, 12 nt, Human
cccgcccaggcu

SEQ ID NO: 2333996 - RNA, 14 nt, Human
cccgcccaggcugg

SEQ ID NO: 2333997 - RNA, 17 nt, Human
cccgcccacuguccugg

SEQ ID NO: 2333998 - RNA, 18 nt, Human
cccgcccacuguccuggg

SEQ ID NO: 2333999 - RNA, 19 nt, Human
cccgcccacuguccugggc

SEQ ID NO: 2334000 - RNA, 20 nt, Human
cccgcccacuguccugggcg

SEQ ID NO: 2334001 - RNA, 22 nt, Human
cccgcagugugcacuaaggggc

SEQ ID NO: 2334002 - RNA, 19 nt, Human
cccgcagugugcacuaagg

SEQ ID NO: 2334003 - RNA, 21 nt, Human
cccgcagaccuccccagcccc

SEQ ID NO: 2334004 - RNA, 20 nt, Human
cccgcccaggcuuagucacu

SEQ ID NO: 2334005 - RNA, 22 nt, Human
cccgcccaggcuuagucacuga

SEQ ID NO: 2334006 - RNA, 23 nt, Human
cccgcuaagagggagggagggcu

SEQ ID NO: 2334007 - RNA, 15 nt, Human
cccgcccaggcuggc

SEQ ID NO: 2334008 - RNA, 17 nt, Human
cccgcccaggcuggcca

SEQ ID NO: 2334009 - RNA, 18 nt, Human
cccgcccaggcuggccag

SEQ ID NO: 2334010 - RNA, 20 nt, Human
cccgcccaggcuggccagcc

SEQ ID NO: 2334011 - RNA, 22 nt, Human
cccgcccaggcuggccagcccc

SEQ ID NO: 2334012 - RNA, 22 nt, Human
cccgagcuggugcauuacagag

SEQ ID NO: 2334013 - RNA, 15 nt, Human
cccgaggacccagac

SEQ ID NO: 2334014 - RNA, 16 nt, Human
cccgaggacccagacc

SEQ ID NO: 2334015 - RNA, 15 nt, Human
cccgcagacaccuug

SEQ ID NO: 2334016 - RNA, 18 nt, Human
cccgaggacccagaccca

SEQ ID NO: 2334017 - RNA, 16 nt, Human
cccgcagacaccuugg

SEQ ID NO: 2334018 - RNA, 17 nt, Human
cccgaggacccagaccc

SEQ ID NO: 2334019 - RNA, 12 nt, Human
cccgcagaccuc

SEQ ID NO: 2334020 - RNA, 14 nt, Human
cccgcagaccuccc

SEQ ID NO: 2334021 - RNA, 18 nt, Human
cccgcagaccuccccagc

SEQ ID NO: 2334022 - RNA, 19 nt, Human
cccgcagaccuccccagcc

SEQ ID NO: 2334023 - RNA, 20 nt, Human
cccgcagaccuccccagccc

SEQ ID NO: 2334024 - RNA, 14 nt, Human
cccgagcuggugca

SEQ ID NO: 2334025 - RNA, 12 nt, Human
cccgagcuggug

SEQ ID NO: 2334026 - RNA, 23 nt, Human
cccgagcugggggccaugagcuc

SEQ ID NO: 2334027 - RNA, 22 nt, Human
cccgagcugggggccaugagcu

SEQ ID NO: 2334028 - RNA, 20 nt, Human
cccgagcugggggccaugag

SEQ ID NO: 2334029 - RNA, 11 nt, Human
cccgagcuggg

SEQ ID NO: 2334030 - RNA, 15 nt, Human
cccgagccuggcucc

SEQ ID NO: 2334031 - RNA, 13 nt, Human
cccgagccuggcu

SEQ ID NO: 2334032 - RNA, 23 nt, Human
cccgacauggacccggagcuaac

SEQ ID NO: 2334033 - RNA, 15 nt, Human
cccgacagagggaag

SEQ ID NO: 2334034 - RNA, 12 nt, Human
cccgacagaggg

SEQ ID NO: 2334035 - RNA, 20 nt, Human
cccgacauggacccggagcu

SEQ ID NO: 2334036 - RNA, 15 nt, Human
cccgacagccuggca

SEQ ID NO: 2334037 - RNA, 18 nt, Human
cccgacagccuggcacag

SEQ ID NO: 2334038 - RNA, 14 nt, Human
cccgacuccucaaa

SEQ ID NO: 2334039 - RNA, 12 nt, Human
cccgacuccuca

SEQ ID NO: 2334040 - RNA, 13 nt, Human
cccgacuugcugu

SEQ ID NO: 2334041 - RNA, 20 nt, Human
ccccugguggacaguccugg

SEQ ID NO: 2334042 - RNA, 19 nt, Human
ccccugguggacaguccug

SEQ ID NO: 2334043 - RNA, 15 nt, Human
ccccugguggacagu

SEQ ID NO: 2334044 - RNA, 15 nt, Human
ccccuggucucuggu

SEQ ID NO: 2334045 - RNA, 22 nt, Human
ccccugguggacaguccuggga

SEQ ID NO: 2334046 - RNA, 21 nt, Human
ccccugguggacaguccuggg

SEQ ID NO: 2334047 - RNA, 12 nt, Human
ccccuggugguu

SEQ ID NO: 2334048 - RNA, 23 nt, Human
ccccugguggacaguccugggag

SEQ ID NO: 2334049 - RNA, 11 nt, Human
ccccugugcag

SEQ ID NO: 2334050 - RNA, 18 nt, Human
ccccuggcuuuucacugc

SEQ ID NO: 2334051 - RNA, 23 nt, Human
ccccuggcugggacguggcucag

SEQ ID NO: 2334052 - RNA, 22 nt, Human
ccccuggcugggacguggcuca

SEQ ID NO: 2334053 - RNA, 20 nt, Human
ccccuggcuccaggccaggg

SEQ ID NO: 2334054 - RNA, 14 nt, Human
ccccuggccucugu

SEQ ID NO: 2334055 - RNA, 20 nt, Human
ccccuggcuuuucacugcug

SEQ ID NO: 2334056 - RNA, 20 nt, Human
ccccugggucagucuggugg

SEQ ID NO: 2334057 - RNA, 21 nt, Human
ccccugggucagucugguggg

SEQ ID NO: 2334058 - RNA, 20 nt, Human
ccccuggguggguggugggg

SEQ ID NO: 2334059 - RNA, 21 nt, Human
ccccuggguggguggugggga

SEQ ID NO: 2334060 - RNA, 23 nt, Human
ccccugggugggugguggggagg

SEQ ID NO: 2334061 - RNA, 22 nt, Human
cccgaauagcugggacuacagg

SEQ ID NO: 2334062 - RNA, 14 nt, Human
cccgacagccuggc

SEQ ID NO: 2334063 - RNA, 21 nt, Human
ccccuuccccacugccugccc

SEQ ID NO: 2334064 - RNA, 19 nt, Human
ccccuuccccacugccugc

SEQ ID NO: 2334065 - RNA, 15 nt, Human
ccccuuccccacugc

SEQ ID NO: 2334066 - RNA, 13 nt, Human
ccccuuccccacu

SEQ ID NO: 2334067 - RNA, 13 nt, Human
ccccuuccaugug

SEQ ID NO: 2334068 - RNA, 14 nt, Human
ccccuuccaugugg

SEQ ID NO: 2334069 - RNA, 13 nt, Human
ccccuuccaugga

SEQ ID NO: 2334070 - RNA, 20 nt, Human
ccccuuccauggacuuuguu

SEQ ID NO: 2334071 - RNA, 15 nt, Human
ccccuguucacucua

SEQ ID NO: 2334072 - RNA, 21 nt, Human
ccccuguggggaucucagggg

SEQ ID NO: 2334073 - RNA, 24 nt, Human
ccccuguggggaucucaggggcug

SEQ ID NO: 2334074 - RNA, 16 nt, Human
ccccuucauccucuga

SEQ ID NO: 2334075 - RNA, 14 nt, Human
ccccuuccacugag

SEQ ID NO: 2334076 - RNA, 16 nt, Human
ccccuuccaucccaga

SEQ ID NO: 2334077 - RNA, 20 nt, Human
ccccugugcagccgcugagc

SEQ ID NO: 2334078 - RNA, 19 nt, Human
ccccugugcagccgcugag

SEQ ID NO: 2334079 - RNA, 19 nt, Human
ccccugugcuccgugccuc

SEQ ID NO: 2334080 - RNA, 11 nt, Human
ccccugugcuc

SEQ ID NO: 2334081 - RNA, 12 nt, Human
ccccugugggga

SEQ ID NO: 2334082 - RNA, 18 nt, Human
ccccuguggggaucucag

SEQ ID NO: 2334083 - RNA, 20 nt, Human
ccccuguggggaucucaggg

SEQ ID NO: 2334084 - RNA, 23 nt, Human
ccccugcccuccccucucugcac

SEQ ID NO: 2334085 - RNA, 13 nt, Human
ccccugcccucgu

SEQ ID NO: 2334086 - RNA, 14 nt, Human
ccccugcccucgug

SEQ ID NO: 2334087 - RNA, 15 nt, Human
ccccugcccucgugg

SEQ ID NO: 2334088 - RNA, 19 nt, Human
ccccugcccucguggccag

SEQ ID NO: 2334089 - RNA, 13 nt, Human
ccccugcccugcu

SEQ ID NO: 2334090 - RNA, 13 nt, Human
ccccugcccugca

SEQ ID NO: 2334091 - RNA, 14 nt, Human
ccccugcccugcac

SEQ ID NO: 2334092 - RNA, 21 nt, Human
ccccugcccucguggccagcc

SEQ ID NO: 2334093 - RNA, 22 nt, Human
ccccugcccucguggccagccc

SEQ ID NO: 2334094 - RNA, 23 nt, Human
ccccugcccucguggccagcccg

SEQ ID NO: 2334095 - RNA, 12 nt, Human
ccccugcccugc

SEQ ID NO: 2334096 - RNA, 17 nt, Human
ccccugcccggcugcgg

SEQ ID NO: 2334097 - RNA, 19 nt, Human
ccccugcccggcugcggaa

SEQ ID NO: 2334098 - RNA, 22 nt, Human
ccccugccccgucaccaucuca

SEQ ID NO: 2334099 - RNA, 15 nt, Human
ccccugccccgucac

SEQ ID NO: 2334100 - RNA, 14 nt, Human
ccccugccccguca

SEQ ID NO: 2334101 - RNA, 22 nt, Human
ccccucugcccagcuugggccc

SEQ ID NO: 2334102 - RNA, 13 nt, Human
ccccucugcccug

SEQ ID NO: 2334103 - RNA, 12 nt, Human
ccccucugcccu

SEQ ID NO: 2334104 - RNA, 13 nt, Human
ccccucugcccag

SEQ ID NO: 2334105 - RNA, 15 nt, Human
ccccucugcccagcu

SEQ ID NO: 2334106 - RNA, 17 nt, Human
ccccucugcccagcuug

SEQ ID NO: 2334107 - RNA, 18 nt, Human
ccccucugcccagcuugg

SEQ ID NO: 2334108 - RNA, 15 nt, Human
ccccucugaccugca

SEQ ID NO: 2334109 - RNA, 19 nt, Human
ccccucucugcaucugacc

SEQ ID NO: 2334110 - RNA, 18 nt, Human
ccccucugaccugcacug

SEQ ID NO: 2334111 - RNA, 12 nt, Human
ccccucugccca

SEQ ID NO: 2334112 - RNA, 22 nt, Human
ccccugccuccacccucugagc

SEQ ID NO: 2334113 - RNA, 18 nt, Human
ccccugccuccacccucu

SEQ ID NO: 2334114 - RNA, 21 nt, Human
ccccugccuccacccucugag

SEQ ID NO: 2334115 - RNA, 19 nt, Human
ccccugccucucugcaggu

SEQ ID NO: 2334116 - RNA, 16 nt, Human
ccccugccucucugca

SEQ ID NO: 2334117 - RNA, 17 nt, Human
ccccugccucucugcag

SEQ ID NO: 2334118 - RNA, 17 nt, Human
ccccugcccugguccag

SEQ ID NO: 2334119 - RNA, 13 nt, Human
ccccugcccuggu

SEQ ID NO: 2334120 - RNA, 15 nt, Human
ccccugcccugcugc

SEQ ID NO: 2334121 - RNA, 14 nt, Human
ccccugcccugcug

SEQ ID NO: 2334122 - RNA, 13 nt, Human
ccccugcccuggg

SEQ ID NO: 2334123 - RNA, 17 nt, Human
ccccugccggccggggc

SEQ ID NO: 2334124 - RNA, 11 nt, Human
ccccugccucc

SEQ ID NO: 2334125 - RNA, 12 nt, Human
ccccugccucca

SEQ ID NO: 2334126 - RNA, 15 nt, Human
ccccugccuccaccc

SEQ ID NO: 2334127 - RNA, 14 nt, Human
ccccugccucucug

SEQ ID NO: 2334128 - RNA, 15 nt, Human
ccccugccucucugc

SEQ ID NO: 2334129 - RNA, 20 nt, Human
ccccugcugccuccccaacc

SEQ ID NO: 2334130 - RNA, 14 nt, Human
ccccugcuggcucu

SEQ ID NO: 2334131 - RNA, 21 nt, Human
ccccugcuggcucuucugccc

SEQ ID NO: 2334132 - RNA, 18 nt, Human
ccccugcugccuccccaa

SEQ ID NO: 2334133 - RNA, 14 nt, Human
ccccugcugccucc

SEQ ID NO: 2334134 - RNA, 13 nt, Human
ccccugcugccuc

SEQ ID NO: 2334135 - RNA, 12 nt, Human
ccccugcugccu

SEQ ID NO: 2334136 - RNA, 19 nt, Human
ccccugcugcaggggcucu

SEQ ID NO: 2334137 - RNA, 22 nt, Human
ccccugcugcaggggcucugga

SEQ ID NO: 2334138 - RNA, 23 nt, Human
ccccugcugcaggggcucuggag

SEQ ID NO: 2334139 - RNA, 14 nt, Human
ccccugcugggugu

SEQ ID NO: 2334140 - RNA, 17 nt, Human
ccccugcuggguguggc

SEQ ID NO: 2334141 - RNA, 11 nt, Human
ccccugcuggu

SEQ ID NO: 2334142 - RNA, 13 nt, Human
ccccugcugguuc

SEQ ID NO: 2334143 - RNA, 15 nt, Human
ccccugcugguucag

SEQ ID NO: 2334144 - RNA, 20 nt, Human
ccccugcugguucaggguug

SEQ ID NO: 2334145 - RNA, 22 nt, Human
ccccugcuggcucuucugccca

SEQ ID NO: 2334146 - RNA, 19 nt, Human
ccccugcuuccaccucacc

SEQ ID NO: 2334147 - RNA, 11 nt, Human
ccccugcuucu

SEQ ID NO: 2334148 - RNA, 13 nt, Human
ccccugcuucucc

SEQ ID NO: 2334149 - RNA, 15 nt, Human
ccccugcuucuccag

SEQ ID NO: 2334150 - RNA, 18 nt, Human
ccccugcuucuccagccu

SEQ ID NO: 2334151 - RNA, 19 nt, Human
ccccugcuucuccagccug

SEQ ID NO: 2334152 - RNA, 15 nt, Human
ccccuggaugcagcc

SEQ ID NO: 2334153 - RNA, 20 nt, Human
ccccuggaggcacugaagug

SEQ ID NO: 2334154 - RNA, 15 nt, Human
ccccuggacugggag

SEQ ID NO: 2334155 - RNA, 15 nt, Human
ccccuggagagaagu

SEQ ID NO: 2334156 - RNA, 12 nt, Human
ccccuggccucu

SEQ ID NO: 2334157 - RNA, 19 nt, Human
ccccuggccuccggcguca

SEQ ID NO: 2334158 - RNA, 13 nt, Human
ccccuggccuccg

SEQ ID NO: 2334159 - RNA, 18 nt, Human
ccccuggaugcagccuca

SEQ ID NO: 2334160 - RNA, 19 nt, Human
ccccuggaugcagccucac

SEQ ID NO: 2334161 - RNA, 21 nt, Human
ccccucgcuuggacggcuggg

SEQ ID NO: 2334162 - RNA, 14 nt, Human
ccccucgugccagu

SEQ ID NO: 2334163 - RNA, 15 nt, Human
ccccucgugccaguc

SEQ ID NO: 2334164 - RNA, 20 nt, Human
ccccucuccaggcgccggcg

SEQ ID NO: 2334165 - RNA, 17 nt, Human
ccccucgugccagucgc

SEQ ID NO: 2334166 - RNA, 12 nt, Human
ccccucucuccu

SEQ ID NO: 2334167 - RNA, 11 nt, Human
ccccucucugc

SEQ ID NO: 2334168 - RNA, 19 nt, Human
ccccucuccuuccugugug

SEQ ID NO: 2334169 - RNA, 14 nt, Human
ccccucuccuuccu

SEQ ID NO: 2334170 - RNA, 12 nt, Human
ccccuccuucuc

SEQ ID NO: 2334171 - RNA, 17 nt, Human
ccccuccuuccuugacc

SEQ ID NO: 2334172 - RNA, 14 nt, Human
ccccuccugcugca

SEQ ID NO: 2334173 - RNA, 15 nt, Human
ccccuccuuccuuga

SEQ ID NO: 2334174 - RNA, 14 nt, Human
ccccuccucugcca

SEQ ID NO: 2334175 - RNA, 12 nt, Human
ccccuccugcug

SEQ ID NO: 2334176 - RNA, 13 nt, Human
ccccuccugcugc

SEQ ID NO: 2334177 - RNA, 13 nt, Human
ccccuccuucaga

SEQ ID NO: 2334178 - RNA, 22 nt, Human
ccccuccugcugcagaggggca

SEQ ID NO: 2334179 - RNA, 20 nt, Human
ccccuccuugccuccugugu

SEQ ID NO: 2334180 - RNA, 18 nt, Human
ccccuccuugccuccugu

SEQ ID NO: 2334181 - RNA, 15 nt, Human
ccccuccuugccucc

SEQ ID NO: 2334182 - RNA, 20 nt, Human
ccccuccuuccuugaccagc

SEQ ID NO: 2334183 - RNA, 15 nt, Human
ccccuccuugggcac

SEQ ID NO: 2334184 - RNA, 14 nt, Human
ccccuccuugcucu

SEQ ID NO: 2334185 - RNA, 13 nt, Human
ccccuccuugggc

SEQ ID NO: 2334186 - RNA, 15 nt, Human
ccccucggagaagag

SEQ ID NO: 2334187 - RNA, 11 nt, Human
ccccuccucug

SEQ ID NO: 2334188 - RNA, 13 nt, Human
ccccuccucucug

SEQ ID NO: 2334189 - RNA, 13 nt, Human
ccccuccucugcc

SEQ ID NO: 2334190 - RNA, 17 nt, Human
ccccuccucucugcccu

SEQ ID NO: 2334191 - RNA, 15 nt, Human
ccccuccucucugcc

SEQ ID NO: 2334192 - RNA, 21 nt, Human
ccccuccucuagcuguggggg

SEQ ID NO: 2334193 - RNA, 22 nt, Human
ccccuccucccuuuuuccuugu

SEQ ID NO: 2334194 - RNA, 11 nt, Human
ccccuccucuc

SEQ ID NO: 2334195 - RNA, 13 nt, Human
ccccuccucuccc

SEQ ID NO: 2334196 - RNA, 15 nt, Human
ccccuccucucccau

SEQ ID NO: 2334197 - RNA, 18 nt, Human
ccccuccucucccauccc

SEQ ID NO: 2334198 - RNA, 23 nt, Human
ccccuccucuccccuaccacugu

SEQ ID NO: 2334199 - RNA, 22 nt, Human
ccccuccuccuggacuccugca

SEQ ID NO: 2334200 - RNA, 17 nt, Human
ccccuccucuagcugug

SEQ ID NO: 2334201 - RNA, 19 nt, Human
ccccuccucuagcuguggg

SEQ ID NO: 2334202 - RNA, 18 nt, Human
ccccuccuccuggacucc

SEQ ID NO: 2334203 - RNA, 18 nt, Human
ccccuccuccacucuccc

SEQ ID NO: 2334204 - RNA, 23 nt, Human
ccccuccucacuggccaucccuc

SEQ ID NO: 2334205 - RNA, 13 nt, Human
ccccuccucccuu

SEQ ID NO: 2334206 - RNA, 12 nt, Human
ccccuccuccac

SEQ ID NO: 2334207 - RNA, 15 nt, Human
ccccuccuccacucu

SEQ ID NO: 2334208 - RNA, 23 nt, Human
ccccuccuaccccucccagcuga

SEQ ID NO: 2334209 - RNA, 12 nt, Human
ccccuccucacu

SEQ ID NO: 2334210 - RNA, 13 nt, Human
ccccuccucacug

SEQ ID NO: 2334211 - RNA, 19 nt, Human
ccccuccuaccccucccag

SEQ ID NO: 2334212 - RNA, 19 nt, Human
ccccuccgcccugccacuc

SEQ ID NO: 2334213 - RNA, 17 nt, Human
ccccuccgcccugccac

SEQ ID NO: 2334214 - RNA, 18 nt, Human
ccccuccgcccugccacu

SEQ ID NO: 2334215 - RNA, 23 nt, Human
ccccuccaaucccaccaacccuc

SEQ ID NO: 2334216 - RNA, 20 nt, Human
ccccucaucucucugcccaa

SEQ ID NO: 2334217 - RNA, 20 nt, Human
ccccucauagcccucacccu

SEQ ID NO: 2334218 - RNA, 13 nt, Human
ccccuccaccugc

SEQ ID NO: 2334219 - RNA, 14 nt, Human
ccccuccaaccugg

SEQ ID NO: 2334220 - RNA, 15 nt, Human
ccccuccaauccugc

SEQ ID NO: 2334221 - RNA, 12 nt, Human
ccccuccacugu

SEQ ID NO: 2334222 - RNA, 16 nt, Human
ccccuccaauccugcc

SEQ ID NO: 2334223 - RNA, 17 nt, Human
ccccuccaauccugccc

SEQ ID NO: 2334224 - RNA, 15 nt, Human
ccccucaccuugcaa

SEQ ID NO: 2334225 - RNA, 14 nt, Human
ccccucaccuugca

SEQ ID NO: 2334226 - RNA, 12 nt, Human
ccccucacucug

SEQ ID NO: 2334227 - RNA, 14 nt, Human
ccccucacucuggc

SEQ ID NO: 2334228 - RNA, 13 nt, Human
ccccucaccuugc

SEQ ID NO: 2334229 - RNA, 15 nt, Human
ccccucaccugggca

SEQ ID NO: 2334230 - RNA, 14 nt, Human
ccccucaccuccuc

SEQ ID NO: 2334231 - RNA, 13 nt, Human
ccccucacccugc

SEQ ID NO: 2334232 - RNA, 16 nt, Human
ccccucacccugccuu

SEQ ID NO: 2334233 - RNA, 12 nt, Human
ccccucaccucc

SEQ ID NO: 2334234 - RNA, 13 nt, Human
ccccucaccuccu

SEQ ID NO: 2334235 - RNA, 15 nt, Human
ccccucaggacugca

SEQ ID NO: 2334236 - RNA, 12 nt, Human
ccccucagcucc

SEQ ID NO: 2334237 - RNA, 13 nt, Human
ccccucagcucca

SEQ ID NO: 2334238 - RNA, 17 nt, Human
ccccucagcuccagacg

SEQ ID NO: 2334239 - RNA, 16 nt, Human
ccccucagggucccug

SEQ ID NO: 2334240 - RNA, 22 nt, Human
ccccucccuggcucccaugacc

SEQ ID NO: 2334241 - RNA, 12 nt, Human
ccccucccuggg

SEQ ID NO: 2334242 - RNA, 13 nt, Human
ccccucccugggu

SEQ ID NO: 2334243 - RNA, 15 nt, Human
ccccucccuucaacc

SEQ ID NO: 2334244 - RNA, 15 nt, Human
ccccucccuuucucc

SEQ ID NO: 2334245 - RNA, 16 nt, Human
ccccuccgcccugcca

SEQ ID NO: 2334246 - RNA, 12 nt, Human
ccccucccuuuc

SEQ ID NO: 2334247 - RNA, 14 nt, Human
ccccucccuggguu

SEQ ID NO: 2334248 - RNA, 13 nt, Human
ccccucccuguca

SEQ ID NO: 2334249 - RNA, 15 nt, Human
ccccucccuggcucc

SEQ ID NO: 2334250 - RNA, 14 nt, Human
ccccucccuggcuc

SEQ ID NO: 2334251 - RNA, 13 nt, Human
ccccucccuggcu

SEQ ID NO: 2334252 - RNA, 17 nt, Human
ccccucccuggccuguu

SEQ ID NO: 2334253 - RNA, 16 nt, Human
ccccucccuggccugu

SEQ ID NO: 2334254 - RNA, 15 nt, Human
ccccucccuggccug

SEQ ID NO: 2334255 - RNA, 14 nt, Human
ccccucccugcuuc

SEQ ID NO: 2334256 - RNA, 12 nt, Human
ccccucccuggc

SEQ ID NO: 2334257 - RNA, 13 nt, Human
ccccucccagaac

SEQ ID NO: 2334258 - RNA, 12 nt, Human
ccccucccagaa

SEQ ID NO: 2334259 - RNA, 11 nt, Human
ccccucccaga

SEQ ID NO: 2334260 - RNA, 12 nt, Human
ccccucccacca

SEQ ID NO: 2334261 - RNA, 16 nt, Human
ccccucccaccacagc

SEQ ID NO: 2334262 - RNA, 16 nt, Human
ccccucccacccaccg

SEQ ID NO: 2334263 - RNA, 12 nt, Human
ccccucccaggg

SEQ ID NO: 2334264 - RNA, 14 nt, Human
ccccucccagcuga

SEQ ID NO: 2334265 - RNA, 22 nt, Human
ccccucccagcugacaguccuc

SEQ ID NO: 2334266 - RNA, 12 nt, Human
ccccucccagcu

SEQ ID NO: 2334267 - RNA, 13 nt, Human
ccccucccagcug

SEQ ID NO: 2334268 - RNA, 11 nt, Human
ccccucccacc

SEQ ID NO: 2334269 - RNA, 22 nt, Human
ccccuccagcuuguggagcccc

SEQ ID NO: 2334270 - RNA, 11 nt, Human
ccccuccagga

SEQ ID NO: 2334271 - RNA, 11 nt, Human
ccccuccagcu

SEQ ID NO: 2334272 - RNA, 13 nt, Human
ccccuccagcuug

SEQ ID NO: 2334273 - RNA, 15 nt, Human
ccccuccagcuugug

SEQ ID NO: 2334274 - RNA, 12 nt, Human
ccccuccaugug

SEQ ID NO: 2334275 - RNA, 23 nt, Human
ccccggguuuggcgggccaagga

SEQ ID NO: 2334276 - RNA, 19 nt, Human
ccccggguuuggcgggcca

SEQ ID NO: 2334277 - RNA, 18 nt, Human
ccccggguuuggcgggcc

SEQ ID NO: 2334278 - RNA, 16 nt, Human
ccccggggacccugug

SEQ ID NO: 2334279 - RNA, 21 nt, Human
ccccggggcguuucuuugccg

SEQ ID NO: 2334280 - RNA, 15 nt, Human
ccccggggcuggguu

SEQ ID NO: 2334281 - RNA, 22 nt, Human
ccccggggugaguccauucucc

SEQ ID NO: 2334282 - RNA, 18 nt, Human
ccccgggcucucugcugu

SEQ ID NO: 2334283 - RNA, 17 nt, Human
ccccggggacccuguga

SEQ ID NO: 2334284 - RNA, 17 nt, Human
ccccgggcucucugcug

SEQ ID NO: 2334285 - RNA, 16 nt, Human
ccccgggcucucugcu

SEQ ID NO: 2334286 - RNA, 15 nt, Human
ccccgggcucucugc

SEQ ID NO: 2334287 - RNA, 16 nt, Human
ccccgggaggggcccg

SEQ ID NO: 2334288 - RNA, 23 nt, Human
ccccgggaggggcccgcuugccu

SEQ ID NO: 2334289 - RNA, 21 nt, Human
ccccggcccugggcucggagg

SEQ ID NO: 2334290 - RNA, 14 nt, Human
ccccggccucagca

SEQ ID NO: 2334291 - RNA, 15 nt, Human
ccccggcggcgccgg

SEQ ID NO: 2334292 - RNA, 21 nt, Human
cccccugugcagccgcugagc

SEQ ID NO: 2334293 - RNA, 13 nt, Human
ccccggcccuggg

SEQ ID NO: 2334294 - RNA, 12 nt, Human
ccccggcccugg

SEQ ID NO: 2334295 - RNA, 20 nt, Human
cccccugguggacaguccug

SEQ ID NO: 2334296 - RNA, 19 nt, Human
cccccugguggacaguccu

SEQ ID NO: 2334297 - RNA, 23 nt, Human
cccccuggggcuucuccugaccc

SEQ ID NO: 2334298 - RNA, 15 nt, Human
cccccuggucucugg

SEQ ID NO: 2334299 - RNA, 16 nt, Human
cccccugccagugccu

SEQ ID NO: 2334300 - RNA, 19 nt, Human
cccccuggggcuucuccug

SEQ ID NO: 2334301 - RNA, 20 nt, Human
cccccuggggcuucuccuga

SEQ ID NO: 2334302 - RNA, 21 nt, Human
cccccuggggcuucuccugac

SEQ ID NO: 2334303 - RNA, 13 nt, Human
cccccugggcucu

SEQ ID NO: 2334304 - RNA, 21 nt, Human
cccccugccccccagccucug

SEQ ID NO: 2334305 - RNA, 11 nt, Human
cccccugggcu

SEQ ID NO: 2334306 - RNA, 23 nt, Human
cccccugguggacaguccuggga

SEQ ID NO: 2334307 - RNA, 21 nt, Human
cccccugguggacaguccugg

SEQ ID NO: 2334308 - RNA, 16 nt, Human
cccccuggucucuggu

SEQ ID NO: 2334309 - RNA, 12 nt, Human
cccccugucccc

SEQ ID NO: 2334310 - RNA, 12 nt, Human
cccccugugcag

SEQ ID NO: 2334311 - RNA, 21 nt, Human
cccccuguccccucagcucca

SEQ ID NO: 2334312 - RNA, 12 nt, Human
cccccuguccuc

SEQ ID NO: 2334313 - RNA, 15 nt, Human
cccccuguccccuca

SEQ ID NO: 2334314 - RNA, 18 nt, Human
cccccuguccccucagcu

SEQ ID NO: 2334315 - RNA, 19 nt, Human
cccccuguccccucagcuc

SEQ ID NO: 2334316 - RNA, 24 nt, Human
ccccggucccuugagaccucagcc

SEQ ID NO: 2334317 - RNA, 16 nt, Human
ccccggucccuugaga

SEQ ID NO: 2334318 - RNA, 15 nt, Human
ccccggucccuugag

SEQ ID NO: 2334319 - RNA, 18 nt, Human
ccccuagcccaggagaga

SEQ ID NO: 2334320 - RNA, 20 nt, Human
ccccuagcccaggagagaga

SEQ ID NO: 2334321 - RNA, 18 nt, Human
ccccuaguaagugccuuc

SEQ ID NO: 2334322 - RNA, 21 nt, Human
ccccuagcuuagagccucccu

SEQ ID NO: 2334323 - RNA, 20 nt, Human
ccccuauccacccagcccau

SEQ ID NO: 2334324 - RNA, 19 nt, Human
ccccuauccacccagccca

SEQ ID NO: 2334325 - RNA, 17 nt, Human
ccccuauccacccagcc

SEQ ID NO: 2334326 - RNA, 16 nt, Human
ccccuauccacccagc

SEQ ID NO: 2334327 - RNA, 14 nt, Human
ccccuauccaccca

SEQ ID NO: 2334328 - RNA, 19 nt, Human
ccccuaguaagugccuucc

SEQ ID NO: 2334329 - RNA, 20 nt, Human
ccccuaguaagugccuucca

SEQ ID NO: 2334330 - RNA, 15 nt, Human
ccccucaacaccucu

SEQ ID NO: 2334331 - RNA, 21 nt, Human
ccccuauccacccagcccauu

SEQ ID NO: 2334332 - RNA, 18 nt, Human
ccccucaaaucguccagc

SEQ ID NO: 2334333 - RNA, 13 nt, Human
ccccucacagccu

SEQ ID NO: 2334334 - RNA, 21 nt, Human
ccccucaaaccuccucuucug

SEQ ID NO: 2334335 - RNA, 16 nt, Human
ccccucaccaggggca

SEQ ID NO: 2334336 - RNA, 17 nt, Human
ccccucaccaggggcag

SEQ ID NO: 2334337 - RNA, 14 nt, Human
ccccucacagccuc

SEQ ID NO: 2334338 - RNA, 17 nt, Human
ccccucacagccucuga

SEQ ID NO: 2334339 - RNA, 18 nt, Human
ccccucacagccucugac

SEQ ID NO: 2334340 - RNA, 20 nt, Human
ccccucacagccucugaccc

SEQ ID NO: 2334341 - RNA, 16 nt, Human
ccccucaacaccucug

SEQ ID NO: 2334342 - RNA, 23 nt, Human
ccccucaacucuccuccagaguc

SEQ ID NO: 2334343 - RNA, 24 nt, Human
cccccggguuuggcgggccaagga

SEQ ID NO: 2334344 - RNA, 15 nt, Human
cccccggggcugggu

SEQ ID NO: 2334345 - RNA, 16 nt, Human
cccccggggcuggguu

SEQ ID NO: 2334346 - RNA, 20 nt, Human
cccccgggaggggcccgcuu

SEQ ID NO: 2334347 - RNA, 22 nt, Human
cccccgggaggggcccgcuugc

SEQ ID NO: 2334348 - RNA, 18 nt, Human
cccccgggccgacggagc

SEQ ID NO: 2334349 - RNA, 23 nt, Human
cccccgggccgacggagccggga

SEQ ID NO: 2334350 - RNA, 15 nt, Human
cccccagcuccggcc

SEQ ID NO: 2334351 - RNA, 12 nt, Human
cccccagcucug

SEQ ID NO: 2334352 - RNA, 14 nt, Human
cccccagcucuggu

SEQ ID NO: 2334353 - RNA, 11 nt, Human
cccccagcugg

SEQ ID NO: 2334354 - RNA, 12 nt, Human
cccccagcuggc

SEQ ID NO: 2334355 - RNA, 21 nt, Human
cccccucaucucauucaaacc

SEQ ID NO: 2334356 - RNA, 16 nt, Human
cccccucaaaccuccu

SEQ ID NO: 2334357 - RNA, 19 nt, Human
cccccucaaaccuccucuu

SEQ ID NO: 2334358 - RNA, 15 nt, Human
cccccuccaauccug

SEQ ID NO: 2334359 - RNA, 16 nt, Human
cccccuccaauccugc

SEQ ID NO: 2334360 - RNA, 18 nt, Human
cccccuccaauccugccc

SEQ ID NO: 2334361 - RNA, 13 nt, Human
cccccucccaggg

SEQ ID NO: 2334362 - RNA, 12 nt, Human
cccccucccacc

SEQ ID NO: 2334363 - RNA, 13 nt, Human
cccccuccccagg

SEQ ID NO: 2334364 - RNA, 16 nt, Human
cccccagcaacccucc

SEQ ID NO: 2334365 - RNA, 12 nt, Human
cccccagccugc

SEQ ID NO: 2334366 - RNA, 21 nt, Human
cccccagcuaagaaccuggaa

SEQ ID NO: 2334367 - RNA, 18 nt, Human
cccccagcuaagaaccug

SEQ ID NO: 2334368 - RNA, 13 nt, Human
cccccagcuaaga

SEQ ID NO: 2334369 - RNA, 15 nt, Human
cccccagccucuggc

SEQ ID NO: 2334370 - RNA, 14 nt, Human
cccccugccagugc

SEQ ID NO: 2334371 - RNA, 16 nt, Human
cccccugccccccagc

SEQ ID NO: 2334372 - RNA, 14 nt, Human
cccccuccucuccc

SEQ ID NO: 2334373 - RNA, 21 nt, Human
cccccugcaaagcccagcuug

SEQ ID NO: 2334374 - RNA, 19 nt, Human
cccccugcaaagcccagcu

SEQ ID NO: 2334375 - RNA, 18 nt, Human
cccccugcaaagcccagc

SEQ ID NO: 2334376 - RNA, 19 nt, Human
cccccugacaacacucauu

SEQ ID NO: 2334377 - RNA, 14 nt, Human
cccccucccuggcc

SEQ ID NO: 2334378 - RNA, 12 nt, Human
cccccuccucuc

SEQ ID NO: 2334379 - RNA, 19 nt, Human
cccccuccgcccugccacu

SEQ ID NO: 2334380 - RNA, 19 nt, Human
cccccucuggcuccagcug

SEQ ID NO: 2334381 - RNA, 12 nt, Human
cccccucuggcu

SEQ ID NO: 2334382 - RNA, 21 nt, Human
cccccucuggcuccagcuggc

SEQ ID NO: 2334383 - RNA, 12 nt, Human
cccccucugucc

SEQ ID NO: 2334384 - RNA, 16 nt, Human
cccccucugucuugug

SEQ ID NO: 2334385 - RNA, 17 nt, Human
cccccugacaacacuca

SEQ ID NO: 2334386 - RNA, 22 nt, Human
cccccaccucucccugacccug

SEQ ID NO: 2334387 - RNA, 14 nt, Human
cccccacuccagcu

SEQ ID NO: 2334388 - RNA, 17 nt, Human
cccccacugccuuugac

SEQ ID NO: 2334389 - RNA, 21 nt, Human
cccccacucucauuccccagg

SEQ ID NO: 2334390 - RNA, 14 nt, Human
cccccacugcaggc

SEQ ID NO: 2334391 - RNA, 12 nt, Human
cccccacccuuu

SEQ ID NO: 2334392 - RNA, 17 nt, Human
cccccaccccuucccca

SEQ ID NO: 2334393 - RNA, 15 nt, Human
cccccaccccuuccc

SEQ ID NO: 2334394 - RNA, 12 nt, Human
cccccacccccu

SEQ ID NO: 2334395 - RNA, 13 nt, Human
cccccacccacuu

SEQ ID NO: 2334396 - RNA, 20 nt, Human
cccccaccccggggacccug

SEQ ID NO: 2334397 - RNA, 15 nt, Human
cccccacccccagcu

SEQ ID NO: 2334398 - RNA, 17 nt, Human
cccccacccccagcuca

SEQ ID NO: 2334399 - RNA, 22 nt, Human
cccccagaaccuguccuugcac

SEQ ID NO: 2334400 - RNA, 22 nt, Human
cccccacuugccucuuccuuga

SEQ ID NO: 2334401 - RNA, 15 nt, Human
cccccagaaccuguc

SEQ ID NO: 2334402 - RNA, 15 nt, Human
cccccacuggugaca

SEQ ID NO: 2334403 - RNA, 11 nt, Human
cccccacuggu

SEQ ID NO: 2334404 - RNA, 13 nt, Human
cccccacugguga

SEQ ID NO: 2334405 - RNA, 17 nt, Human
cccccacaccucaguuc

SEQ ID NO: 2334406 - RNA, 19 nt, Human
ccccauccuccccuucccu

SEQ ID NO: 2334407 - RNA, 18 nt, Human
ccccauccuccccuuccc

SEQ ID NO: 2334408 - RNA, 13 nt, Human
cccccacccaagg

SEQ ID NO: 2334409 - RNA, 15 nt, Human
cccccaccacuagga

SEQ ID NO: 2334410 - RNA, 14 nt, Human
cccccacccccagc

SEQ ID NO: 2334411 - RNA, 16 nt, Human
cccccacagugcuguc

SEQ ID NO: 2334412 - RNA, 22 nt, Human
cccccaccacggccacuggcca

SEQ ID NO: 2334413 - RNA, 24 nt, Human
cccccacccaagggccuggccuga

SEQ ID NO: 2334414 - RNA, 17 nt, Human
ccccauccuccccuucc

SEQ ID NO: 2334415 - RNA, 13 nt, Human
ccccauccucccc

SEQ ID NO: 2334416 - RNA, 17 nt, Human
ccccauccuccagcuuc

SEQ ID NO: 2334417 - RNA, 18 nt, Human
ccccauccuccagcuucu

SEQ ID NO: 2334418 - RNA, 15 nt, Human
ccccauccuccagca

SEQ ID NO: 2334419 - RNA, 14 nt, Human
ccccauccuccagc

SEQ ID NO: 2334420 - RNA, 15 nt, Human
ccccauccuccagcu

SEQ ID NO: 2334421 - RNA, 16 nt, Human
ccccauccuccagcuu

SEQ ID NO: 2334422 - RNA, 14 nt, Human
ccccauccucugua

SEQ ID NO: 2334423 - RNA, 16 nt, Human
ccccaucccacacccu

SEQ ID NO: 2334424 - RNA, 12 nt, Human
ccccauccucca

SEQ ID NO: 2334425 - RNA, 19 nt, Human
ccccaucaggacucuugug

SEQ ID NO: 2334426 - RNA, 13 nt, Human
ccccaucauucau

SEQ ID NO: 2334427 - RNA, 17 nt, Human
ccccaucauugguaccc

SEQ ID NO: 2334428 - RNA, 19 nt, Human
ccccaggccccaggaagcc

SEQ ID NO: 2334429 - RNA, 12 nt, Human
ccccaggccccg

SEQ ID NO: 2334430 - RNA, 13 nt, Human
ccccaggccccga

SEQ ID NO: 2334431 - RNA, 20 nt, Human
ccccaggccccgaggaccca

SEQ ID NO: 2334432 - RNA, 18 nt, Human
ccccaggccccaggaagc

SEQ ID NO: 2334433 - RNA, 12 nt, Human
ccccaggcccca

SEQ ID NO: 2334434 - RNA, 11 nt, Human
ccccaggcccc

SEQ ID NO: 2334435 - RNA, 19 nt, Human
ccccagaccugagcucccc

SEQ ID NO: 2334436 - RNA, 18 nt, Human
ccccagacaccgccacau

SEQ ID NO: 2334437 - RNA, 15 nt, Human
ccccagaccugagcu

SEQ ID NO: 2334438 - RNA, 11 nt, Human
ccccagggcac

SEQ ID NO: 2334439 - RNA, 13 nt, Human
ccccaggcugaag

SEQ ID NO: 2334440 - RNA, 21 nt, Human
ccccaggccugaaagaggcug

SEQ ID NO: 2334441 - RNA, 15 nt, Human
ccccaggccucugug

SEQ ID NO: 2334442 - RNA, 17 nt, Human
ccccaggccucuguguc

SEQ ID NO: 2334443 - RNA, 23 nt, Human
ccccaggccugaaagaggcugag

SEQ ID NO: 2334444 - RNA, 18 nt, Human
ccccaguaagccacugcc

SEQ ID NO: 2334445 - RNA, 16 nt, Human
ccccaguaagccacug

SEQ ID NO: 2334446 - RNA, 17 nt, Human
ccccaguaaaauugcca

SEQ ID NO: 2334447 - RNA, 14 nt, Human
ccccagucagccuc

SEQ ID NO: 2334448 - RNA, 19 nt, Human
ccccaguccccaccccugc

SEQ ID NO: 2334449 - RNA, 23 nt, Human
ccccagucagccucucucccagu

SEQ ID NO: 2334450 - RNA, 18 nt, Human
ccccaguccccaccccug

SEQ ID NO: 2334451 - RNA, 15 nt, Human
ccccagucagccucu

SEQ ID NO: 2334452 - RNA, 16 nt, Human
ccccagucagccucuc

SEQ ID NO: 2334453 - RNA, 17 nt, Human
ccccagucagccucucu

SEQ ID NO: 2334454 - RNA, 21 nt, Human
ccccagucagccucucuccca

SEQ ID NO: 2334455 - RNA, 13 nt, Human
ccccaguaaaauu

SEQ ID NO: 2334456 - RNA, 14 nt, Human
ccccaguaaaauug

SEQ ID NO: 2334457 - RNA, 23 nt, Human
ccccagguguguuggggccuugg

SEQ ID NO: 2334458 - RNA, 14 nt, Human
ccccagugcccaca

SEQ ID NO: 2334459 - RNA, 15 nt, Human
ccccagugcccacag

SEQ ID NO: 2334460 - RNA, 16 nt, Human
ccccagugcccacagg

SEQ ID NO: 2334461 - RNA, 20 nt, Human
ccccagugcccacaggauca

SEQ ID NO: 2334462 - RNA, 23 nt, Human
ccccaguuugcagaaaagcaccu

SEQ ID NO: 2334463 - RNA, 21 nt, Human
ccccaguucugcuccucucca

SEQ ID NO: 2334464 - RNA, 23 nt, Human
ccccaguucugcuccucuccagg

SEQ ID NO: 2334465 - RNA, 17 nt, Human
ccccaguucugcuccuc

SEQ ID NO: 2334466 - RNA, 18 nt, Human
ccccaguucugcuccucu

SEQ ID NO: 2334467 - RNA, 19 nt, Human
ccccaguucugcuccucuc

SEQ ID NO: 2334468 - RNA, 20 nt, Human
ccccaguucugcuccucucc

SEQ ID NO: 2334469 - RNA, 16 nt, Human
ccccagugcacccacu

SEQ ID NO: 2334470 - RNA, 14 nt, Human
ccccaguucugcuc

SEQ ID NO: 2334471 - RNA, 15 nt, Human
ccccaguucugcucc

SEQ ID NO: 2334472 - RNA, 16 nt, Human
ccccaguucugcuccu

SEQ ID NO: 2334473 - RNA, 14 nt, Human
ccccauauggucau

SEQ ID NO: 2334474 - RNA, 13 nt, Human
ccccaucagugcu

SEQ ID NO: 2334475 - RNA, 20 nt, Human
ccccaucagugcucccucac

SEQ ID NO: 2334476 - RNA, 14 nt, Human
ccccaucagugcuc

SEQ ID NO: 2334477 - RNA, 14 nt, Human
ccccauagccaccc

SEQ ID NO: 2334478 - RNA, 12 nt, Human
ccccauagccac

SEQ ID NO: 2334479 - RNA, 22 nt, Human
ccccauaauuuuuuuuuuccuu

SEQ ID NO: 2334480 - RNA, 12 nt, Human
cccagagaagcc

SEQ ID NO: 2334481 - RNA, 22 nt, Human
cccagagaaaggggagcccacu

SEQ ID NO: 2334482 - RNA, 13 nt, Human
cccagagaagcca

SEQ ID NO: 2334483 - RNA, 14 nt, Human
cccagagaagcccc

SEQ ID NO: 2334484 - RNA, 15 nt, Human
cccagagaagccccu

SEQ ID NO: 2334485 - RNA, 17 nt, Human
cccagaaugaggcugcu

SEQ ID NO: 2334486 - RNA, 17 nt, Human
cccagagacaggaaaau

SEQ ID NO: 2334487 - RNA, 16 nt, Human
cccagagacaggaaaa

SEQ ID NO: 2334488 - RNA, 15 nt, Human
cccagagacaggaaa

SEQ ID NO: 2334489 - RNA, 14 nt, Human
cccagagacaggaa

SEQ ID NO: 2334490 - RNA, 13 nt, Human
cccagagacagga

SEQ ID NO: 2334491 - RNA, 22 nt, Human
cccagagaagccccuuccccau

SEQ ID NO: 2334492 - RNA, 16 nt, Human
cccagagaagccccuu

SEQ ID NO: 2334493 - RNA, 21 nt, Human
cccagagaagccccuucccca

SEQ ID NO: 2334494 - RNA, 23 nt, Human
cccagagacauacuugaagggcc

SEQ ID NO: 2334495 - RNA, 22 nt, Human
cccagagacauacuugaagggc

SEQ ID NO: 2334496 - RNA, 21 nt, Human
cccagagacauacuugaaggg

SEQ ID NO: 2334497 - RNA, 18 nt, Human
cccagagacauacuugaa

SEQ ID NO: 2334498 - RNA, 13 nt, Human
cccaguucugcuc

SEQ ID NO: 2334499 - RNA, 14 nt, Human
cccaguucugcucc

SEQ ID NO: 2334500 - RNA, 15 nt, Human
cccaguucugcuccu

SEQ ID NO: 2334501 - RNA, 23 nt, Human
cccaguucugcuccucuccaggc

SEQ ID NO: 2334502 - RNA, 15 nt, Human
cccaguugccaucug

SEQ ID NO: 2334503 - RNA, 16 nt, Human
cccaguucugcuccuc

SEQ ID NO: 2334504 - RNA, 20 nt, Human
cccaguucugcuccucucca

SEQ ID NO: 2334505 - RNA, 21 nt, Human
cccaguucugcuccucuccag

SEQ ID NO: 2334506 - RNA, 22 nt, Human
cccaguucugcuccucuccagg

SEQ ID NO: 2334507 - RNA, 17 nt, Human
cccaguugccaucugcg

SEQ ID NO: 2334508 - RNA, 14 nt, Human
cccaguugggugga

SEQ ID NO: 2334509 - RNA, 21 nt, Human
cccaucucaugccccuggcug

SEQ ID NO: 2334510 - RNA, 22 nt, Human
cccaucucaugccccuggcugg

SEQ ID NO: 2334511 - RNA, 19 nt, Human
cccaucucuacaaaaagca

SEQ ID NO: 2334512 - RNA, 13 nt, Human
cccaucucccccu

SEQ ID NO: 2334513 - RNA, 22 nt, Human
cccaucugcaccccccugggcu

SEQ ID NO: 2334514 - RNA, 21 nt, Human
cccaucugcaccccccugggc

SEQ ID NO: 2334515 - RNA, 17 nt, Human
cccaucugcagggcccc

SEQ ID NO: 2334516 - RNA, 19 nt, Human
cccaucugcaccccuucuc

SEQ ID NO: 2334517 - RNA, 12 nt, Human
cccaucugccca

SEQ ID NO: 2334518 - RNA, 13 nt, Human
cccaucugcccag

SEQ ID NO: 2334519 - RNA, 14 nt, Human
cccaucugcccagg

SEQ ID NO: 2334520 - RNA, 15 nt, Human
cccaucugcccagga

SEQ ID NO: 2334521 - RNA, 16 nt, Human
cccaucugcccaggac

SEQ ID NO: 2334522 - RNA, 16 nt, Human
cccaucugggaguccc

SEQ ID NO: 2334523 - RNA, 23 nt, Human
cccaucugggaguccccuuuucu

SEQ ID NO: 2334524 - RNA, 18 nt, Human
cccaucuggguccuugca

SEQ ID NO: 2334525 - RNA, 21 nt, Human
cccaucucucccuccccugcc

SEQ ID NO: 2334526 - RNA, 18 nt, Human
cccaucucucccuccccu

SEQ ID NO: 2334527 - RNA, 13 nt, Human
cccaucucucccu

SEQ ID NO: 2334528 - RNA, 23 nt, Human
cccaucucucccuccccugccau

SEQ ID NO: 2334529 - RNA, 18 nt, Human
cccaucucuuccuaccca

SEQ ID NO: 2334530 - RNA, 13 nt, Human
cccaucugcaccc

SEQ ID NO: 2334531 - RNA, 14 nt, Human
cccaucucuucugg

SEQ ID NO: 2334532 - RNA, 18 nt, Human
cccaugcccaccugccca

SEQ ID NO: 2334533 - RNA, 15 nt, Human
cccaugcccaccugc

SEQ ID NO: 2334534 - RNA, 14 nt, Human
cccaugcccaccug

SEQ ID NO: 2334535 - RNA, 21 nt, Human
cccaugccaaagcuagggugg

SEQ ID NO: 2334536 - RNA, 22 nt, Human
cccaugcacugugaaggacccu

SEQ ID NO: 2334537 - RNA, 20 nt, Human
cccaugcacugugaaggacc

SEQ ID NO: 2334538 - RNA, 19 nt, Human
cccaugcacugugaaggac

SEQ ID NO: 2334539 - RNA, 18 nt, Human
cccaugcacugugaagga

SEQ ID NO: 2334540 - RNA, 16 nt, Human
cccaugcacugugaag

SEQ ID NO: 2334541 - RNA, 14 nt, Human
cccaugcacuguga

SEQ ID NO: 2334542 - RNA, 12 nt, Human
cccaugcacugu

SEQ ID NO: 2334543 - RNA, 23 nt, Human
cccaugaguuggggucuggcagc

SEQ ID NO: 2334544 - RNA, 15 nt, Human
cccaugaucccugug

SEQ ID NO: 2334545 - RNA, 21 nt, Human
cccaugcuggagccuguguaa

SEQ ID NO: 2334546 - RNA, 19 nt, Human
cccaugcuggagccugugu

SEQ ID NO: 2334547 - RNA, 20 nt, Human
cccaugcuggagccugugua

SEQ ID NO: 2334548 - RNA, 14 nt, Human
cccaugcuguugau

SEQ ID NO: 2334549 - RNA, 19 nt, Human
cccaugcuguugauugcua

SEQ ID NO: 2334550 - RNA, 21 nt, Human
cccaugcuguugauugcuaaa

SEQ ID NO: 2334551 - RNA, 13 nt, Human
cccaugcuggagc

SEQ ID NO: 2334552 - RNA, 14 nt, Human
cccaugcuggagcc

SEQ ID NO: 2334553 - RNA, 15 nt, Human
cccaugcuggagccu

SEQ ID NO: 2334554 - RNA, 16 nt, Human
cccaugcuggagccug

SEQ ID NO: 2334555 - RNA, 17 nt, Human
cccaugcuggagccugu

SEQ ID NO: 2334556 - RNA, 18 nt, Human
cccaugcuggagccugug

SEQ ID NO: 2334557 - RNA, 22 nt, Human
cccauggacaggcuggcuccag

SEQ ID NO: 2334558 - RNA, 20 nt, Human
cccauggacaggcuggcucc

SEQ ID NO: 2334559 - RNA, 15 nt, Human
cccauggacaggcug

SEQ ID NO: 2334560 - RNA, 22 nt, Human
cccaugcuguugauugcuaaau

SEQ ID NO: 2334561 - RNA, 15 nt, Human
cccauggacacucca

SEQ ID NO: 2334562 - RNA, 16 nt, Human
cccauggacacuccag

SEQ ID NO: 2334563 - RNA, 20 nt, Human
cccauggacacuccagugcc

SEQ ID NO: 2334564 - RNA, 21 nt, Human
cccauggacacuccagugcca

SEQ ID NO: 2334565 - RNA, 22 nt, Human
cccaugagccucagcauccugg

SEQ ID NO: 2334566 - RNA, 22 nt, Human
cccaugacuuuauauggaugau

SEQ ID NO: 2334567 - RNA, 19 nt, Human
cccaugaccauacugaggg

SEQ ID NO: 2334568 - RNA, 13 nt, Human
cccaugacccacc

SEQ ID NO: 2334569 - RNA, 14 nt, Human
cccaugacccaccc

SEQ ID NO: 2334570 - RNA, 15 nt, Human
cccaugacccacccc

SEQ ID NO: 2334571 - RNA, 16 nt, Human
cccaugacccaccccu

SEQ ID NO: 2334572 - RNA, 17 nt, Human
cccaugacccaccccug

SEQ ID NO: 2334573 - RNA, 19 nt, Human
cccaugacccaccccugug

SEQ ID NO: 2334574 - RNA, 12 nt, Human
cccaucugugaa

SEQ ID NO: 2334575 - RNA, 22 nt, Human
cccaucuggguccuugcacccc

SEQ ID NO: 2334576 - RNA, 14 nt, Human
cccaugagccucag

SEQ ID NO: 2334577 - RNA, 19 nt, Human
cccaugacccaggcugggc

SEQ ID NO: 2334578 - RNA, 17 nt, Human
cccaugacccaggcugg

SEQ ID NO: 2334579 - RNA, 18 nt, Human
cccaugacccaggcuggg

SEQ ID NO: 2334580 - RNA, 20 nt, Human
cccaugacccaccccugugc

SEQ ID NO: 2334581 - RNA, 21 nt, Human
cccaugacccaccccugugcu

SEQ ID NO: 2334582 - RNA, 22 nt, Human
cccaugacccaccccugugcuc

SEQ ID NO: 2334583 - RNA, 23 nt, Human
cccaugacccaccccugugcucc

SEQ ID NO: 2334584 - RNA, 12 nt, Human
ccccaccucucc

SEQ ID NO: 2334585 - RNA, 12 nt, Human
ccccaccuccac

SEQ ID NO: 2334586 - RNA, 17 nt, Human
ccccaccucucccugac

SEQ ID NO: 2334587 - RNA, 12 nt, Human
ccccaccugcca

SEQ ID NO: 2334588 - RNA, 21 nt, Human
ccccaccuucaauuccugggc

SEQ ID NO: 2334589 - RNA, 11 nt, Human
ccccaccuggg

SEQ ID NO: 2334590 - RNA, 14 nt, Human
ccccacgcccuccc

SEQ ID NO: 2334591 - RNA, 17 nt, Human
ccccacgagggucagga

SEQ ID NO: 2334592 - RNA, 14 nt, Human
ccccacccuuuggg

SEQ ID NO: 2334593 - RNA, 19 nt, Human
ccccaccgcagacaggacc

SEQ ID NO: 2334594 - RNA, 15 nt, Human
ccccaccgcagacag

SEQ ID NO: 2334595 - RNA, 20 nt, Human
ccccacccuggugggccaac

SEQ ID NO: 2334596 - RNA, 20 nt, Human
ccccacccugggcucuggga

SEQ ID NO: 2334597 - RNA, 19 nt, Human
ccccacgugacagugccug

SEQ ID NO: 2334598 - RNA, 21 nt, Human
ccccacggggccucgggaccu

SEQ ID NO: 2334599 - RNA, 22 nt, Human
ccccacggggccucgggaccuc

SEQ ID NO: 2334600 - RNA, 18 nt, Human
ccccacggccgcuccagg

SEQ ID NO: 2334601 - RNA, 19 nt, Human
ccccacggccgcuccaggg

SEQ ID NO: 2334602 - RNA, 22 nt, Human
ccccacggccgcuccaggggug

SEQ ID NO: 2334603 - RNA, 18 nt, Human
ccccacucaccagugucc

SEQ ID NO: 2334604 - RNA, 14 nt, Human
ccccacuccccacc

SEQ ID NO: 2334605 - RNA, 13 nt, Human
ccccacuccagcu

SEQ ID NO: 2334606 - RNA, 23 nt, Human
ccccacucccuggcucucagaag

SEQ ID NO: 2334607 - RNA, 21 nt, Human
ccccacucuaggggucaggcu

SEQ ID NO: 2334608 - RNA, 18 nt, Human
ccccacucuccccacacu

SEQ ID NO: 2334609 - RNA, 18 nt, Human
ccccacuuaucccucucc

SEQ ID NO: 2334610 - RNA, 13 nt, Human
ccccacuugccuc

SEQ ID NO: 2334611 - RNA, 15 nt, Human
ccccacucuccccac

SEQ ID NO: 2334612 - RNA, 12 nt, Human
ccccacucuccc

SEQ ID NO: 2334613 - RNA, 20 nt, Human
ccccacucucauuccccagg

SEQ ID NO: 2334614 - RNA, 15 nt, Human
ccccacucucauucc

SEQ ID NO: 2334615 - RNA, 20 nt, Human
ccccagaaccuguccuugca

SEQ ID NO: 2334616 - RNA, 15 nt, Human
ccccagaaccugucc

SEQ ID NO: 2334617 - RNA, 21 nt, Human
ccccagaaccuguccuugcac

SEQ ID NO: 2334618 - RNA, 16 nt, Human
ccccagaaggcaggga

SEQ ID NO: 2334619 - RNA, 14 nt, Human
ccccacuugccucu

SEQ ID NO: 2334620 - RNA, 15 nt, Human
ccccacuugccucuu

SEQ ID NO: 2334621 - RNA, 16 nt, Human
ccccacuugccucuuc

SEQ ID NO: 2334622 - RNA, 21 nt, Human
ccccacuugccucuuccuuga

SEQ ID NO: 2334623 - RNA, 16 nt, Human
ccccaccccacacuug

SEQ ID NO: 2334624 - RNA, 13 nt, Human
ccccaccccagcc

SEQ ID NO: 2334625 - RNA, 13 nt, Human
ccccacccccagc

SEQ ID NO: 2334626 - RNA, 16 nt, Human
ccccacccccagcuca

SEQ ID NO: 2334627 - RNA, 17 nt, Human
ccccacccccagcucaa

SEQ ID NO: 2334628 - RNA, 20 nt, Human
ccccacccccagcucaaugg

SEQ ID NO: 2334629 - RNA, 13 nt, Human
ccccacccaggag

SEQ ID NO: 2334630 - RNA, 12 nt, Human
ccccacccagga

SEQ ID NO: 2334631 - RNA, 14 nt, Human
ccccaccccacacu

SEQ ID NO: 2334632 - RNA, 21 nt, Human
ccccacccaagggccuggccu

SEQ ID NO: 2334633 - RNA, 12 nt, Human
ccccacacuccu

SEQ ID NO: 2334634 - RNA, 12 nt, Human
ccccacccucau

SEQ ID NO: 2334635 - RNA, 15 nt, Human
ccccacccucccugg

SEQ ID NO: 2334636 - RNA, 16 nt, Human
ccccacccucccugga

SEQ ID NO: 2334637 - RNA, 18 nt, Human
ccccacccucccuggagu

SEQ ID NO: 2334638 - RNA, 12 nt, Human
ccccacccuggg

SEQ ID NO: 2334639 - RNA, 14 nt, Human
ccccacccugggcc

SEQ ID NO: 2334640 - RNA, 15 nt, Human
ccccacccugggccc

SEQ ID NO: 2334641 - RNA, 20 nt, Human
ccccacccugggcccugggc

SEQ ID NO: 2334642 - RNA, 14 nt, Human
ccccacccugggcu

SEQ ID NO: 2334643 - RNA, 15 nt, Human
ccccacccugggcuc

SEQ ID NO: 2334644 - RNA, 16 nt, Human
ccccacccugggcucu

SEQ ID NO: 2334645 - RNA, 13 nt, Human
ccccaaucccagc

SEQ ID NO: 2334646 - RNA, 14 nt, Human
ccccaauuccuugu

SEQ ID NO: 2334647 - RNA, 15 nt, Human
ccccaauaauugcag

SEQ ID NO: 2334648 - RNA, 16 nt, Human
ccccaaggggcagucu

SEQ ID NO: 2334649 - RNA, 15 nt, Human
ccccaaggggcaguc

SEQ ID NO: 2334650 - RNA, 14 nt, Human
ccccaaggggcagu

SEQ ID NO: 2334651 - RNA, 14 nt, Human
cccauuccucaccu

SEQ ID NO: 2334652 - RNA, 22 nt, Human
ccccaaggggcagucuggaggg

SEQ ID NO: 2334653 - RNA, 18 nt, Human
ccccaaggggcagucugg

SEQ ID NO: 2334654 - RNA, 15 nt, Human
ccccacacucacucc

SEQ ID NO: 2334655 - RNA, 16 nt, Human
ccccacaccucaguuc

SEQ ID NO: 2334656 - RNA, 14 nt, Human
ccccacaccucagu

SEQ ID NO: 2334657 - RNA, 14 nt, Human
ccccacaccaggcc

SEQ ID NO: 2334658 - RNA, 15 nt, Human
ccccaauuccuugua

SEQ ID NO: 2334659 - RNA, 11 nt, Human
ccccacacaca

SEQ ID NO: 2334660 - RNA, 14 nt, Human
ccccacacacacac

SEQ ID NO: 2334661 - RNA, 12 nt, Human
ccccacacacac

SEQ ID NO: 2334662 - RNA, 21 nt, Human
cccauucauuccauucuggaa

SEQ ID NO: 2334663 - RNA, 22 nt, Human
cccauggacacuccagugccag

SEQ ID NO: 2334664 - RNA, 13 nt, Human
cccauuccugaag

SEQ ID NO: 2334665 - RNA, 12 nt, Human
cccauuccugaa

SEQ ID NO: 2334666 - RNA, 18 nt, Human
cccauucauuccauucug

SEQ ID NO: 2334667 - RNA, 22 nt, Human
cccauucauuccauucuggaag

SEQ ID NO: 2334668 - RNA, 13 nt, Human
cccaugccugucc

SEQ ID NO: 2334669 - RNA, 14 nt, Human
ccccuccacuguca

SEQ ID NO: 2334670 - RNA, 17 nt, Human
cccuguauauagcccag

SEQ ID NO: 2334671 - RNA, 18 nt, Human
cccuguauauagcccagc

SEQ ID NO: 2334672 - RNA, 15 nt, Human
cccuguauauagccc

SEQ ID NO: 2334673 - RNA, 15 nt, Human
cccuggugcugccac

SEQ ID NO: 2334674 - RNA, 14 nt, Human
cccugucaccaagc

SEQ ID NO: 2334675 - RNA, 19 nt, Human
cccugucaccaagcucaca

SEQ ID NO: 2334676 - RNA, 20 nt, Human
cccuguauuuucuuucucua

SEQ ID NO: 2334677 - RNA, 14 nt, Human
cccuguauggcacu

SEQ ID NO: 2334678 - RNA, 21 nt, Human
cccugucagugcagcccgugu

SEQ ID NO: 2334679 - RNA, 17 nt, Human
cccugucagugcagccc

SEQ ID NO: 2334680 - RNA, 14 nt, Human
cccuguccaaacug

SEQ ID NO: 2334681 - RNA, 14 nt, Human
cccugucagugcag

SEQ ID NO: 2334682 - RNA, 22 nt, Human
cccugucagugcagcccgugug

SEQ ID NO: 2334683 - RNA, 14 nt, Human
cccuguuccccaga

SEQ ID NO: 2334684 - RNA, 17 nt, Human
cccuguuccccagagaa

SEQ ID NO: 2334685 - RNA, 16 nt, Human
cccuguuccccagaga

SEQ ID NO: 2334686 - RNA, 13 nt, Human
cccuguucuggca

SEQ ID NO: 2334687 - RNA, 14 nt, Human
cccuguucuggcag

SEQ ID NO: 2334688 - RNA, 20 nt, Human
cccuguuuucugagcccggg

SEQ ID NO: 2334689 - RNA, 22 nt, Human
cccuguuuucugagcccgggcu

SEQ ID NO: 2334690 - RNA, 23 nt, Human
cccuguuuucugagcccgggcug

SEQ ID NO: 2334691 - RNA, 14 nt, Human
cccuuaaaauagaa

SEQ ID NO: 2334692 - RNA, 14 nt, Human
cccuguuuucugag

SEQ ID NO: 2334693 - RNA, 15 nt, Human
cccuguuuucugagc

SEQ ID NO: 2334694 - RNA, 16 nt, Human
cccuguuuucugagcc

SEQ ID NO: 2334695 - RNA, 17 nt, Human
cccuguuuucugagccc

SEQ ID NO: 2334696 - RNA, 18 nt, Human
cccuguuuucugagcccg

SEQ ID NO: 2334697 - RNA, 14 nt, Human
cccuguuuuauacu

SEQ ID NO: 2334698 - RNA, 20 nt, Human
cccuguugacgaagucucuu

SEQ ID NO: 2334699 - RNA, 19 nt, Human
cccuguuuguuucugaaag

SEQ ID NO: 2334700 - RNA, 17 nt, Human
cccuuaccugccaggaa

SEQ ID NO: 2334701 - RNA, 20 nt, Human
cccuuaccugccaggaagcc

SEQ ID NO: 2334702 - RNA, 23 nt, Human
cccuuaccugccaggaagccagc

SEQ ID NO: 2334703 - RNA, 23 nt, Human
cccuggggccuggaccugccucc

SEQ ID NO: 2334704 - RNA, 18 nt, Human
cccuggggccuggaccug

SEQ ID NO: 2334705 - RNA, 21 nt, Human
cccuggggccuggaccugccu

SEQ ID NO: 2334706 - RNA, 13 nt, Human
cccuggugcugcc

SEQ ID NO: 2334707 - RNA, 14 nt, Human
cccuggugcugcca

SEQ ID NO: 2334708 - RNA, 21 nt, Human
cccuggugaccagcaccaucu

SEQ ID NO: 2334709 - RNA, 13 nt, Human
cccuggggccugg

SEQ ID NO: 2334710 - RNA, 20 nt, Human
cccuggggacagcaagggcu

SEQ ID NO: 2334711 - RNA, 14 nt, Human
cccuggggccugga

SEQ ID NO: 2334712 - RNA, 17 nt, Human
cccuggggccuggaccu

SEQ ID NO: 2334713 - RNA, 13 nt, Human
cccugguggcagu

SEQ ID NO: 2334714 - RNA, 21 nt, Human
cccugguggcagcucaccucu

SEQ ID NO: 2334715 - RNA, 21 nt, Human
cccuguagagugggagcugag

SEQ ID NO: 2334716 - RNA, 14 nt, Human
cccugguggcagug

SEQ ID NO: 2334717 - RNA, 13 nt, Human
cccugggcugaga

SEQ ID NO: 2334718 - RNA, 13 nt, Human
cccugggcuggaa

SEQ ID NO: 2334719 - RNA, 14 nt, Human
cccugggcuggaau

SEQ ID NO: 2334720 - RNA, 15 nt, Human
cccugggcugugcua

SEQ ID NO: 2334721 - RNA, 17 nt, Human
cccugggcuuggccugc

SEQ ID NO: 2334722 - RNA, 17 nt, Human
cccuggggacagcaagg

SEQ ID NO: 2334723 - RNA, 22 nt, Human
cccugggcuuggccugcuguga

SEQ ID NO: 2334724 - RNA, 19 nt, Human
cccuggggacagcaagggc

SEQ ID NO: 2334725 - RNA, 18 nt, Human
cccugggcuuggccugcu

SEQ ID NO: 2334726 - RNA, 19 nt, Human
cccugggcuuggccugcug

SEQ ID NO: 2334727 - RNA, 20 nt, Human
cccugggcuuggccugcugu

SEQ ID NO: 2334728 - RNA, 21 nt, Human
cccugggcuuggccugcugug

SEQ ID NO: 2334729 - RNA, 17 nt, Human
cccugcuucuccagccu

SEQ ID NO: 2334730 - RNA, 18 nt, Human
cccugcuucuccagccug

SEQ ID NO: 2334731 - RNA, 21 nt, Human
cccugcuucuccagccuggac

SEQ ID NO: 2334732 - RNA, 23 nt, Human
cccugcuucuccagccuggaccc

SEQ ID NO: 2334733 - RNA, 16 nt, Human
cccugcuuccaggaaa

SEQ ID NO: 2334734 - RNA, 11 nt, Human
cccugcuucuc

SEQ ID NO: 2334735 - RNA, 12 nt, Human
cccugcuucucc

SEQ ID NO: 2334736 - RNA, 15 nt, Human
cccugcuucuccagc

SEQ ID NO: 2334737 - RNA, 16 nt, Human
cccugcuucuccagcc

SEQ ID NO: 2334738 - RNA, 14 nt, Human
cccugcuuccaccu

SEQ ID NO: 2334739 - RNA, 15 nt, Human
cccugcuuccaccuc

SEQ ID NO: 2334740 - RNA, 17 nt, Human
cccugcuuccaccucac

SEQ ID NO: 2334741 - RNA, 18 nt, Human
cccugcuuccaccucacc

SEQ ID NO: 2334742 - RNA, 21 nt, Human
cccugcuuccaccucacccca

SEQ ID NO: 2334743 - RNA, 14 nt, Human
cccugcuuccagga

SEQ ID NO: 2334744 - RNA, 15 nt, Human
cccugcuuccaggaa

SEQ ID NO: 2334745 - RNA, 23 nt, Human
cccugcuguccccucuugcccca

SEQ ID NO: 2334746 - RNA, 21 nt, Human
cccugcuucaauacccaaauc

SEQ ID NO: 2334747 - RNA, 16 nt, Human
cccugcuguccccucu

SEQ ID NO: 2334748 - RNA, 17 nt, Human
cccugcuguccccucuu

SEQ ID NO: 2334749 - RNA, 18 nt, Human
cccugcuguccccucuug

SEQ ID NO: 2334750 - RNA, 19 nt, Human
cccugcuguccccucuugc

SEQ ID NO: 2334751 - RNA, 17 nt, Human
cccugcuggccgccuca

SEQ ID NO: 2334752 - RNA, 12 nt, Human
cccugcuguccc

SEQ ID NO: 2334753 - RNA, 13 nt, Human
cccugcugucccc

SEQ ID NO: 2334754 - RNA, 17 nt, Human
cccugcugcugacccag

SEQ ID NO: 2334755 - RNA, 12 nt, Human
cccugcuggccg

SEQ ID NO: 2334756 - RNA, 13 nt, Human
cccugcuggccgc

SEQ ID NO: 2334757 - RNA, 15 nt, Human
cccugcuggccgccu

SEQ ID NO: 2334758 - RNA, 13 nt, Human
cccuuccacugag

SEQ ID NO: 2334759 - RNA, 17 nt, Human
cccuucacuucugacca

SEQ ID NO: 2334760 - RNA, 17 nt, Human
cccuuccacacccccac

SEQ ID NO: 2334761 - RNA, 16 nt, Human
cccuuccacugagggc

SEQ ID NO: 2334762 - RNA, 20 nt, Human
cccuuccaugucgccucugc

SEQ ID NO: 2334763 - RNA, 12 nt, Human
cccuuccaugga

SEQ ID NO: 2334764 - RNA, 22 nt, Human
cccuucacuucugaccacacuu

SEQ ID NO: 2334765 - RNA, 17 nt, Human
cccuucacugccuuugc

SEQ ID NO: 2334766 - RNA, 18 nt, Human
cccuucacugccuuugcu

SEQ ID NO: 2334767 - RNA, 16 nt, Human
cccuucacaguguuuc

SEQ ID NO: 2334768 - RNA, 20 nt, Human
cccuucacaaagcccaaggg

SEQ ID NO: 2334769 - RNA, 15 nt, Human
cccuucacauaguuu

SEQ ID NO: 2334770 - RNA, 18 nt, Human
cccuucaaccauucccca

SEQ ID NO: 2334771 - RNA, 18 nt, Human
cccuucacaaagcccaag

SEQ ID NO: 2334772 - RNA, 13 nt, Human
cccuucacaaagc

SEQ ID NO: 2334773 - RNA, 12 nt, Human
cccuuauuuuca

SEQ ID NO: 2334774 - RNA, 14 nt, Human
cccuucaaccauuc

SEQ ID NO: 2334775 - RNA, 12 nt, Human
cccuuauuuccu

SEQ ID NO: 2334776 - RNA, 16 nt, Human
cccuuauuacacggaa

SEQ ID NO: 2334777 - RNA, 20 nt, Human
cccuuauuacacggaaaacg

SEQ ID NO: 2334778 - RNA, 20 nt, Human
cccuuaucugugcucaggac

SEQ ID NO: 2334779 - RNA, 16 nt, Human
cccuuaucugugcuca

SEQ ID NO: 2334780 - RNA, 23 nt, Human
cccuuagcagggaaacagcuaau

SEQ ID NO: 2334781 - RNA, 14 nt, Human
cccuuagcccccac

SEQ ID NO: 2334782 - RNA, 19 nt, Human
cccuuagcccccacccacu

SEQ ID NO: 2334783 - RNA, 21 nt, Human
cccuuagcccccacccacuuc

SEQ ID NO: 2334784 - RNA, 14 nt, Human
cccuuagccucccu

SEQ ID NO: 2334785 - RNA, 22 nt, Human
cccuuagcccccacccacuucc

SEQ ID NO: 2334786 - RNA, 17 nt, Human
cccuuagccucccugaa

SEQ ID NO: 2334787 - RNA, 15 nt, Human
cccuuauccaggacu

SEQ ID NO: 2334788 - RNA, 16 nt, Human
cccuuauccaggacuc

SEQ ID NO: 2334789 - RNA, 15 nt, Human
cccuuaucaccagcu

SEQ ID NO: 2334790 - RNA, 12 nt, Human
cccuuauccagg

SEQ ID NO: 2334791 - RNA, 13 nt, Human
cccuuauccagga

SEQ ID NO: 2334792 - RNA, 14 nt, Human
cccuuauccaggac

SEQ ID NO: 2334793 - RNA, 14 nt, Human
cccuuagcagggaa

SEQ ID NO: 2334794 - RNA, 13 nt, Human
cccuuaccuuccc

SEQ ID NO: 2334795 - RNA, 20 nt, Human
cccuuagaaguuuguuguga

SEQ ID NO: 2334796 - RNA, 15 nt, Human
cccuuacgugagucc

SEQ ID NO: 2334797 - RNA, 17 nt, Human
cccuuacgugaguccug

SEQ ID NO: 2334798 - RNA, 22 nt, Human
cccuugaggaaacaacagcuuu

SEQ ID NO: 2334799 - RNA, 18 nt, Human
cccuugagcuccccaaaa

SEQ ID NO: 2334800 - RNA, 19 nt, Human
cccuugagaccucagccau

SEQ ID NO: 2334801 - RNA, 18 nt, Human
cccuugagaccucagcca

SEQ ID NO: 2334802 - RNA, 17 nt, Human
cccuugagaccucagcc

SEQ ID NO: 2334803 - RNA, 17 nt, Human
cccuugagcccucuaug

SEQ ID NO: 2334804 - RNA, 20 nt, Human
cccuugagaccucagccaug

SEQ ID NO: 2334805 - RNA, 16 nt, Human
cccuugagaccucagc

SEQ ID NO: 2334806 - RNA, 15 nt, Human
cccuugagaccucag

SEQ ID NO: 2334807 - RNA, 14 nt, Human
cccuugagaccuca

SEQ ID NO: 2334808 - RNA, 13 nt, Human
cccuugagaccuc

SEQ ID NO: 2334809 - RNA, 17 nt, Human
cccuucccuugagcccu

SEQ ID NO: 2334810 - RNA, 16 nt, Human
cccuucccugucccuc

SEQ ID NO: 2334811 - RNA, 14 nt, Human
cccuugagaaaccu

SEQ ID NO: 2334812 - RNA, 22 nt, Human
cccuugagaaaccuuauuguac

SEQ ID NO: 2334813 - RNA, 19 nt, Human
cccuuccccucccuggcuc

SEQ ID NO: 2334814 - RNA, 17 nt, Human
cccuuccccucccuggc

SEQ ID NO: 2334815 - RNA, 16 nt, Human
cccuuccccucccugg

SEQ ID NO: 2334816 - RNA, 15 nt, Human
cccuuccccucccug

SEQ ID NO: 2334817 - RNA, 14 nt, Human
cccuuccccucccu

SEQ ID NO: 2334818 - RNA, 12 nt, Human
cccuuccccucc

SEQ ID NO: 2334819 - RNA, 14 nt, Human
cccuuccccgaggg

SEQ ID NO: 2334820 - RNA, 17 nt, Human
cccuuccccgagggaug

SEQ ID NO: 2334821 - RNA, 13 nt, Human
cccuucccugcaa

SEQ ID NO: 2334822 - RNA, 13 nt, Human
cccuucccugucc

SEQ ID NO: 2334823 - RNA, 14 nt, Human
cccuucccuguccc

SEQ ID NO: 2334824 - RNA, 15 nt, Human
cccuucccugucccu

SEQ ID NO: 2334825 - RNA, 15 nt, Human
cccuucccugcaaac

SEQ ID NO: 2334826 - RNA, 13 nt, Human
cccuucccucacc

SEQ ID NO: 2334827 - RNA, 13 nt, Human
cccuuccccuccu

SEQ ID NO: 2334828 - RNA, 22 nt, Human
cccuuccccucccuggcuccca

SEQ ID NO: 2334829 - RNA, 21 nt, Human
cccuuccccuacccccuccuc

SEQ ID NO: 2334830 - RNA, 19 nt, Human
cccuugcucuccccugccc

SEQ ID NO: 2334831 - RNA, 13 nt, Human
cccuuggaaaccu

SEQ ID NO: 2334832 - RNA, 17 nt, Human
cccuuggaaaccugccc

SEQ ID NO: 2334833 - RNA, 18 nt, Human
cccuugcucuccccugcc

SEQ ID NO: 2334834 - RNA, 13 nt, Human
cccuugcccugac

SEQ ID NO: 2334835 - RNA, 12 nt, Human
cccuugcccuga

SEQ ID NO: 2334836 - RNA, 12 nt, Human
cccuugccuccc

SEQ ID NO: 2334837 - RNA, 20 nt, Human
cccuugccuccccauuuccc

SEQ ID NO: 2334838 - RNA, 23 nt, Human
cccuugccuccccauuucccauc

SEQ ID NO: 2334839 - RNA, 13 nt, Human
cccuugccucccc

SEQ ID NO: 2334840 - RNA, 15 nt, Human
cccuugccuccccau

SEQ ID NO: 2334841 - RNA, 18 nt, Human
cccuugccuccccauuuc

SEQ ID NO: 2334842 - RNA, 19 nt, Human
cccuugccuccccauuucc

SEQ ID NO: 2334843 - RNA, 13 nt, Human
cccuugccagaca

SEQ ID NO: 2334844 - RNA, 20 nt, Human
cccuugagcuccccaaaaac

SEQ ID NO: 2334845 - RNA, 15 nt, Human
cccuugccagacaug

SEQ ID NO: 2334846 - RNA, 12 nt, Human
cccuugcccagg

SEQ ID NO: 2334847 - RNA, 20 nt, Human
cccuugcccagggcucagcc

SEQ ID NO: 2334848 - RNA, 19 nt, Human
cccuugcccagggcucagc

SEQ ID NO: 2334849 - RNA, 15 nt, Human
cccuugcccagggcu

SEQ ID NO: 2334850 - RNA, 14 nt, Human
cccuugcccagggc

SEQ ID NO: 2334851 - RNA, 22 nt, Human
cccuugcccagggcucagccug

SEQ ID NO: 2334852 - RNA, 21 nt, Human
cccuugcccagggcucagccu

SEQ ID NO: 2334853 - RNA, 23 nt, Human
cccuugcccagggcucagccugg

SEQ ID NO: 2334854 - RNA, 19 nt, Human
cccugcuccagaagauagc

SEQ ID NO: 2334855 - RNA, 17 nt, Human
cccugcucccucccauc

SEQ ID NO: 2334856 - RNA, 16 nt, Human
cccugcucaguaaagc

SEQ ID NO: 2334857 - RNA, 21 nt, Human
cccugcuccacgucugcgccg

SEQ ID NO: 2334858 - RNA, 21 nt, Human
cccugcgggucacaggaggga

SEQ ID NO: 2334859 - RNA, 19 nt, Human
cccugcgggucacaggagg

SEQ ID NO: 2334860 - RNA, 17 nt, Human
cccugcgguagauggga

SEQ ID NO: 2334861 - RNA, 22 nt, Human
cccugcggccccgucuguggcu

SEQ ID NO: 2334862 - RNA, 15 nt, Human
cccugcguggggaca

SEQ ID NO: 2334863 - RNA, 22 nt, Human
cccugcgggugaacaaagcagc

SEQ ID NO: 2334864 - RNA, 20 nt, Human
cccugcgaaggggcccuggu

SEQ ID NO: 2334865 - RNA, 19 nt, Human
cccugcgaaggggcccugg

SEQ ID NO: 2334866 - RNA, 21 nt, Human
cccugcgaaggggcccugguc

SEQ ID NO: 2334867 - RNA, 17 nt, Human
cccugcgaaggggcccu

SEQ ID NO: 2334868 - RNA, 22 nt, Human
cccugccuuaucuugcacccca

SEQ ID NO: 2334869 - RNA, 13 nt, Human
cccugccugguca

SEQ ID NO: 2334870 - RNA, 15 nt, Human
cccugccucucugca

SEQ ID NO: 2334871 - RNA, 22 nt, Human
cccugcucuccgaccagacacc

SEQ ID NO: 2334872 - RNA, 21 nt, Human
cccugcugagucccaggcuga

SEQ ID NO: 2334873 - RNA, 22 nt, Human
cccugcuccucccuggcugccc

SEQ ID NO: 2334874 - RNA, 21 nt, Human
cccugcucuccgaccagacac

SEQ ID NO: 2334875 - RNA, 13 nt, Human
cccugcuccuccc

SEQ ID NO: 2334876 - RNA, 15 nt, Human
cccugcuccucccug

SEQ ID NO: 2334877 - RNA, 16 nt, Human
cccugcuccucccugg

SEQ ID NO: 2334878 - RNA, 17 nt, Human
cccugcuccucccuggc

SEQ ID NO: 2334879 - RNA, 18 nt, Human
cccugcuccucccuggcu

SEQ ID NO: 2334880 - RNA, 19 nt, Human
cccugcuccucccuggcug

SEQ ID NO: 2334881 - RNA, 20 nt, Human
cccugcuccucccuggcugc

SEQ ID NO: 2334882 - RNA, 12 nt, Human
cccugcugccuc

SEQ ID NO: 2334883 - RNA, 11 nt, Human
cccugcugccu

SEQ ID NO: 2334884 - RNA, 23 nt, Human
cccugcugccgccucccagccug

SEQ ID NO: 2334885 - RNA, 22 nt, Human
cccugcugccgccucccagccu

SEQ ID NO: 2334886 - RNA, 20 nt, Human
cccugcugccgccucccagc

SEQ ID NO: 2334887 - RNA, 16 nt, Human
cccugcugccucccca

SEQ ID NO: 2334888 - RNA, 14 nt, Human
cccugcugccuccc

SEQ ID NO: 2334889 - RNA, 19 nt, Human
cccugcugccgccucccag

SEQ ID NO: 2334890 - RNA, 16 nt, Human
cccugcugcaggggcu

SEQ ID NO: 2334891 - RNA, 19 nt, Human
cccugcugcaggggcucug

SEQ ID NO: 2334892 - RNA, 21 nt, Human
cccugcugcaggggcucugga

SEQ ID NO: 2334893 - RNA, 22 nt, Human
cccugcugcaggggcucuggag

SEQ ID NO: 2334894 - RNA, 23 nt, Human
cccugcugagucccaggcugagc

SEQ ID NO: 2334895 - RNA, 21 nt, Human
cccugcuccucccuggcugcc

SEQ ID NO: 2334896 - RNA, 13 nt, Human
cccugcugcaggg

SEQ ID NO: 2334897 - RNA, 15 nt, Human
cccugcugcaggggc

SEQ ID NO: 2334898 - RNA, 22 nt, Human
cccugccuccacccucugagcu

SEQ ID NO: 2334899 - RNA, 16 nt, Human
cccugccuccacccuc

SEQ ID NO: 2334900 - RNA, 19 nt, Human
cccugccuccacccucuga

SEQ ID NO: 2334901 - RNA, 20 nt, Human
cccugccuccacccucugag

SEQ ID NO: 2334902 - RNA, 21 nt, Human
cccugccuccacccucugagc

SEQ ID NO: 2334903 - RNA, 12 nt, Human
cccugccuccac

SEQ ID NO: 2334904 - RNA, 14 nt, Human
cccugccuccaccc

SEQ ID NO: 2334905 - RNA, 15 nt, Human
cccugccuccacccu

SEQ ID NO: 2334906 - RNA, 14 nt, Human
cccugccgccucaa

SEQ ID NO: 2334907 - RNA, 13 nt, Human
cccugccgccuca

SEQ ID NO: 2334908 - RNA, 21 nt, Human
cccugcaucugaccagcagcg

SEQ ID NO: 2334909 - RNA, 13 nt, Human
cccugccggccgg

SEQ ID NO: 2334910 - RNA, 12 nt, Human
cccugcaucccc

SEQ ID NO: 2334911 - RNA, 19 nt, Human
cccugcaucugaccagcag

SEQ ID NO: 2334912 - RNA, 18 nt, Human
cccugcaucugaccagca

SEQ ID NO: 2334913 - RNA, 16 nt, Human
cccugcaucugaccag

SEQ ID NO: 2334914 - RNA, 13 nt, Human
cccugcauccccu

SEQ ID NO: 2334915 - RNA, 13 nt, Human
cccugccucucug

SEQ ID NO: 2334916 - RNA, 14 nt, Human
cccugccucucugc

SEQ ID NO: 2334917 - RNA, 11 nt, Human
cccugccuccu

SEQ ID NO: 2334918 - RNA, 22 nt, Human
cccugccucucaucaacugaau

SEQ ID NO: 2334919 - RNA, 19 nt, Human
cccugaggagccaggccgg

SEQ ID NO: 2334920 - RNA, 14 nt, Human
cccugaaaacccag

SEQ ID NO: 2334921 - RNA, 17 nt, Human
cccugaggcaggucccc

SEQ ID NO: 2334922 - RNA, 12 nt, Human
cccugaggccca

SEQ ID NO: 2334923 - RNA, 20 nt, Human
cccugaggcagguccccaga

SEQ ID NO: 2334924 - RNA, 18 nt, Human
cccugaggcaggucccca

SEQ ID NO: 2334925 - RNA, 21 nt, Human
cccugaggcagguccccagac

SEQ ID NO: 2334926 - RNA, 16 nt, Human
cccuggugcugccaca

SEQ ID NO: 2334927 - RNA, 23 nt, Human
cccucccucuuucccucccuucc

SEQ ID NO: 2334928 - RNA, 13 nt, Human
cccucccucagcc

SEQ ID NO: 2334929 - RNA, 16 nt, Human
cccucccggcauggga

SEQ ID NO: 2334930 - RNA, 16 nt, Human
cccucccgccccuucc

SEQ ID NO: 2334931 - RNA, 23 nt, Human
cccucccgccccuucccacucac

SEQ ID NO: 2334932 - RNA, 12 nt, Human
cccucccugcug

SEQ ID NO: 2334933 - RNA, 13 nt, Human
cccucccugcugu

SEQ ID NO: 2334934 - RNA, 14 nt, Human
cccucccugcuguc

SEQ ID NO: 2334935 - RNA, 15 nt, Human
cccucccugcugucc

SEQ ID NO: 2334936 - RNA, 17 nt, Human
cccucccugcugucccc

SEQ ID NO: 2334937 - RNA, 19 nt, Human
cccucccugcuguccccuc

SEQ ID NO: 2334938 - RNA, 16 nt, Human
cccucccucagccccu

SEQ ID NO: 2334939 - RNA, 22 nt, Human
cccucccgucuacucauucccc

SEQ ID NO: 2334940 - RNA, 14 nt, Human
cccucccugccccu

SEQ ID NO: 2334941 - RNA, 14 nt, Human
cccucccuggcucc

SEQ ID NO: 2334942 - RNA, 17 nt, Human
cccucccuggccuguuc

SEQ ID NO: 2334943 - RNA, 15 nt, Human
cccucccuggccugu

SEQ ID NO: 2334944 - RNA, 14 nt, Human
cccucccugcuuca

SEQ ID NO: 2334945 - RNA, 12 nt, Human
cccucccuggag

SEQ ID NO: 2334946 - RNA, 13 nt, Human
cccucccuggagu

SEQ ID NO: 2334947 - RNA, 14 nt, Human
cccucccuggagug

SEQ ID NO: 2334948 - RNA, 19 nt, Human
cccucccuggcucccauga

SEQ ID NO: 2334949 - RNA, 16 nt, Human
cccucccuggcuccca

SEQ ID NO: 2334950 - RNA, 13 nt, Human
cccucgugccagu

SEQ ID NO: 2334951 - RNA, 14 nt, Human
cccucgugccaguc

SEQ ID NO: 2334952 - RNA, 16 nt, Human
cccucgugccagucgc

SEQ ID NO: 2334953 - RNA, 13 nt, Human
cccucguggccag

SEQ ID NO: 2334954 - RNA, 14 nt, Human
cccucguggccagc

SEQ ID NO: 2334955 - RNA, 15 nt, Human
cccucguggccagcc

SEQ ID NO: 2334956 - RNA, 22 nt, Human
cccucgugccagucgcgcugcc

SEQ ID NO: 2334957 - RNA, 23 nt, Human
cccucgugccagucgcgcugccu

SEQ ID NO: 2334958 - RNA, 16 nt, Human
cccuccccugcccuag

SEQ ID NO: 2334959 - RNA, 13 nt, Human
cccuccccugcug

SEQ ID NO: 2334960 - RNA, 14 nt, Human
cccuccccugcugc

SEQ ID NO: 2334961 - RNA, 14 nt, Human
cccuccccugcccu

SEQ ID NO: 2334962 - RNA, 13 nt, Human
cccuccccugccc

SEQ ID NO: 2334963 - RNA, 16 nt, Human
cccuccccugcugcag

SEQ ID NO: 2334964 - RNA, 15 nt, Human
cccuccccuggggac

SEQ ID NO: 2334965 - RNA, 14 nt, Human
cccucccgccccuu

SEQ ID NO: 2334966 - RNA, 15 nt, Human
cccucccgccccuuc

SEQ ID NO: 2334967 - RNA, 12 nt, Human
cccucccagcug

SEQ ID NO: 2334968 - RNA, 19 nt, Human
cccucccaccucugugacc

SEQ ID NO: 2334969 - RNA, 13 nt, Human
cccucccaccucu

SEQ ID NO: 2334970 - RNA, 14 nt, Human
cccucccaccucug

SEQ ID NO: 2334971 - RNA, 15 nt, Human
cccucccaccucugu

SEQ ID NO: 2334972 - RNA, 17 nt, Human
cccucccaccucuguga

SEQ ID NO: 2334973 - RNA, 13 nt, Human
cccuccccugcca

SEQ ID NO: 2334974 - RNA, 24 nt, Human
cccuccccucucuugcacccgccu

SEQ ID NO: 2334975 - RNA, 13 nt, Human
cccucccagcuga

SEQ ID NO: 2334976 - RNA, 17 nt, Human
cccucccagcugacagu

SEQ ID NO: 2334977 - RNA, 20 nt, Human
cccucccagcugacaguccu

SEQ ID NO: 2334978 - RNA, 13 nt, Human
cccucccaccccc

SEQ ID NO: 2334979 - RNA, 12 nt, Human
cccucccacccc

SEQ ID NO: 2334980 - RNA, 14 nt, Human
cccucccacccacc

SEQ ID NO: 2334981 - RNA, 15 nt, Human
cccucccacccaccg

SEQ ID NO: 2334982 - RNA, 17 nt, Human
cccucccaccacagcag

SEQ ID NO: 2334983 - RNA, 12 nt, Human
cccucccaccca

SEQ ID NO: 2334984 - RNA, 14 nt, Human
cccucccaccacag

SEQ ID NO: 2334985 - RNA, 12 nt, Human
cccucccaccac

SEQ ID NO: 2334986 - RNA, 14 nt, Human
cccucccacagcgc

SEQ ID NO: 2334987 - RNA, 14 nt, Human
cccgcucagcccuc

SEQ ID NO: 2334988 - RNA, 12 nt, Human
cccucccacagc

SEQ ID NO: 2334989 - RNA, 12 nt, Human
cccgcucagccc

SEQ ID NO: 2334990 - RNA, 13 nt, Human
cccgcucagcccu

SEQ ID NO: 2334991 - RNA, 15 nt, Human
cccgcucagcccucc

SEQ ID NO: 2334992 - RNA, 13 nt, Human
cccucugccuguc

SEQ ID NO: 2334993 - RNA, 15 nt, Human
cccucugccccaucc

SEQ ID NO: 2334994 - RNA, 13 nt, Human
cccucugggcacu

SEQ ID NO: 2334995 - RNA, 16 nt, Human
cccucuggcccugccu

SEQ ID NO: 2334996 - RNA, 22 nt, Human
cccucuggcuccagcuggccgg

SEQ ID NO: 2334997 - RNA, 21 nt, Human
cccucugccugaaccuuccau

SEQ ID NO: 2334998 - RNA, 18 nt, Human
cccucugccccauccucc

SEQ ID NO: 2334999 - RNA, 12 nt, Human
cccucuggcucc

SEQ ID NO: 2335000 - RNA, 17 nt, Human
cccucuggcuccagcug

SEQ ID NO: 2335001 - RNA, 16 nt, Human
cccucuggcuccagcu

SEQ ID NO: 2335002 - RNA, 20 nt, Human
cccucuguguauuugcuuuu

SEQ ID NO: 2335003 - RNA, 21 nt, Human
cccucuguucugcacacagca

SEQ ID NO: 2335004 - RNA, 20 nt, Human
cccucuguucugcacacagc

SEQ ID NO: 2335005 - RNA, 11 nt, Human
cccucuuccau

SEQ ID NO: 2335006 - RNA, 18 nt, Human
cccucuguugccaggcua

SEQ ID NO: 2335007 - RNA, 20 nt, Human
cccucuguuucucuuuccuu

SEQ ID NO: 2335008 - RNA, 13 nt, Human
cccucuuccauca

SEQ ID NO: 2335009 - RNA, 20 nt, Human
cccucuuucccucccuuccu

SEQ ID NO: 2335010 - RNA, 17 nt, Human
cccucuuucccucccuu

SEQ ID NO: 2335011 - RNA, 17 nt, Human
cccucuuuggcuccccu

SEQ ID NO: 2335012 - RNA, 19 nt, Human
cccucuuuggcuccccugu

SEQ ID NO: 2335013 - RNA, 20 nt, Human
cccucuuuggcuccccugua

SEQ ID NO: 2335014 - RNA, 21 nt, Human
cccucuuuggcuccccuguac

SEQ ID NO: 2335015 - RNA, 16 nt, Human
cccucuugccccccac

SEQ ID NO: 2335016 - RNA, 23 nt, Human
cccucuugccccaacccccagca

SEQ ID NO: 2335017 - RNA, 22 nt, Human
cccucuugccccccaccccagc

SEQ ID NO: 2335018 - RNA, 18 nt, Human
cccucuuggucuucccag

SEQ ID NO: 2335019 - RNA, 12 nt, Human
cccucuuucccu

SEQ ID NO: 2335020 - RNA, 15 nt, Human
cccucuucucaagug

SEQ ID NO: 2335021 - RNA, 16 nt, Human
cccucuucucaagugc

SEQ ID NO: 2335022 - RNA, 20 nt, Human
cccucuucucaagugccuua

SEQ ID NO: 2335023 - RNA, 22 nt, Human
cccucuugacccaucucccccu

SEQ ID NO: 2335024 - RNA, 19 nt, Human
cccucuugacccaucuccc

SEQ ID NO: 2335025 - RNA, 12 nt, Human
cccucuugcccc

SEQ ID NO: 2335026 - RNA, 13 nt, Human
cccucuugcccca

SEQ ID NO: 2335027 - RNA, 18 nt, Human
cccucuugccccaacccc

SEQ ID NO: 2335028 - RNA, 19 nt, Human
cccucuugccccaaccccc

SEQ ID NO: 2335029 - RNA, 22 nt, Human
cccucuugccccaacccccagc

SEQ ID NO: 2335030 - RNA, 11 nt, Human
cccucucccug

SEQ ID NO: 2335031 - RNA, 19 nt, Human
cccucuccccccccccucc

SEQ ID NO: 2335032 - RNA, 21 nt, Human
cccucuccccccccccuccaa

SEQ ID NO: 2335033 - RNA, 11 nt, Human
cccucuccugc

SEQ ID NO: 2335034 - RNA, 13 nt, Human
cccucuccgagcu

SEQ ID NO: 2335035 - RNA, 16 nt, Human
cccucguggccuuccc

SEQ ID NO: 2335036 - RNA, 15 nt, Human
cccucguggccuucc

SEQ ID NO: 2335037 - RNA, 18 nt, Human
cccucgugguccccaaca

SEQ ID NO: 2335038 - RNA, 20 nt, Human
cccucgugguccccaacagc

SEQ ID NO: 2335039 - RNA, 16 nt, Human
cccucguggccagccc

SEQ ID NO: 2335040 - RNA, 17 nt, Human
cccucguggccagcccg

SEQ ID NO: 2335041 - RNA, 19 nt, Human
cccucguggccagcccggc

SEQ ID NO: 2335042 - RNA, 20 nt, Human
cccucguggccagcccggcu

SEQ ID NO: 2335043 - RNA, 22 nt, Human
cccucucaggcaugccugugug

SEQ ID NO: 2335044 - RNA, 21 nt, Human
cccucucaggugaccaaaauc

SEQ ID NO: 2335045 - RNA, 12 nt, Human
cccucccugggu

SEQ ID NO: 2335046 - RNA, 23 nt, Human
cccucgugguccccaacagcgac

SEQ ID NO: 2335047 - RNA, 16 nt, Human
cccucuaaagcaauaa

SEQ ID NO: 2335048 - RNA, 13 nt, Human
cccucucccagga

SEQ ID NO: 2335049 - RNA, 18 nt, Human
cccucuccauaaccccac

SEQ ID NO: 2335050 - RNA, 11 nt, Human
cccucugccca

SEQ ID NO: 2335051 - RNA, 14 nt, Human
cccucuccuuccug

SEQ ID NO: 2335052 - RNA, 15 nt, Human
cccucugcccacucc

SEQ ID NO: 2335053 - RNA, 18 nt, Human
cccucugcccacucccug

SEQ ID NO: 2335054 - RNA, 19 nt, Human
cccucugcccacucccugc

SEQ ID NO: 2335055 - RNA, 17 nt, Human
cccucuccuuccugugu

SEQ ID NO: 2335056 - RNA, 19 nt, Human
cccucugccaccagagacc

SEQ ID NO: 2335057 - RNA, 12 nt, Human
cccucugcccag

SEQ ID NO: 2335058 - RNA, 13 nt, Human
cccucugcccagc

SEQ ID NO: 2335059 - RNA, 14 nt, Human
cccucugcccagcu

SEQ ID NO: 2335060 - RNA, 15 nt, Human
cccucugcccagcuu

SEQ ID NO: 2335061 - RNA, 16 nt, Human
cccucugcccagcuug

SEQ ID NO: 2335062 - RNA, 14 nt, Human
cccucugcccugcg

SEQ ID NO: 2335063 - RNA, 13 nt, Human
cccucugcccugc

SEQ ID NO: 2335064 - RNA, 12 nt, Human
cccucugcccug

SEQ ID NO: 2335065 - RNA, 13 nt, Human
cccucugccccau

SEQ ID NO: 2335066 - RNA, 23 nt, Human
cccucugcccagcuugggcccag

SEQ ID NO: 2335067 - RNA, 18 nt, Human
cccucugcccagcuuggg

SEQ ID NO: 2335068 - RNA, 19 nt, Human
cccucugcccagcuugggc

SEQ ID NO: 2335069 - RNA, 22 nt, Human
ccgggcaugguggcgcaagccu

SEQ ID NO: 2335070 - RNA, 13 nt, Human
ccgggccacagag

SEQ ID NO: 2335071 - RNA, 22 nt, Human
ccgggcacucagaagacacuga

SEQ ID NO: 2335072 - RNA, 23 nt, Human
ccggcucgagcaguccugccuca

SEQ ID NO: 2335073 - RNA, 16 nt, Human
ccggcuccugugcuuu

SEQ ID NO: 2335074 - RNA, 19 nt, Human
ccggcucccaccgaggcgc

SEQ ID NO: 2335075 - RNA, 12 nt, Human
ccggagggcccu

SEQ ID NO: 2335076 - RNA, 16 nt, Human
ccggcuccaggcuccu

SEQ ID NO: 2335077 - RNA, 21 nt, Human
ccggcuccaggcuccuuuagc

SEQ ID NO: 2335078 - RNA, 19 nt, Human
ccggggcuggcggcuacuc

SEQ ID NO: 2335079 - RNA, 13 nt, Human
ccggggcuggguu

SEQ ID NO: 2335080 - RNA, 15 nt, Human
ccggggcuggguugg

SEQ ID NO: 2335081 - RNA, 12 nt, Human
ccgggguccugu

SEQ ID NO: 2335082 - RNA, 22 nt, Human
ccgggggcagcucuggaggggg

SEQ ID NO: 2335083 - RNA, 21 nt, Human
ccgggguccuguggcaggcag

SEQ ID NO: 2335084 - RNA, 18 nt, Human
ccgugaggccagagacac

SEQ ID NO: 2335085 - RNA, 20 nt, Human
ccggggugcccacaggccgc

SEQ ID NO: 2335086 - RNA, 23 nt, Human
ccgggguccuguggcaggcagcg

SEQ ID NO: 2335087 - RNA, 21 nt, Human
ccgggguggagcaugggccug

SEQ ID NO: 2335088 - RNA, 18 nt, Human
ccgggcucugccucccau

SEQ ID NO: 2335089 - RNA, 13 nt, Human
ccgggcucugccu

SEQ ID NO: 2335090 - RNA, 14 nt, Human
ccgggcucugccuc

SEQ ID NO: 2335091 - RNA, 15 nt, Human
ccgggcucugccucc

SEQ ID NO: 2335092 - RNA, 14 nt, Human
ccgccugguacuca

SEQ ID NO: 2335093 - RNA, 14 nt, Human
ccgcucccaguguc

SEQ ID NO: 2335094 - RNA, 21 nt, Human
ccgccuggcagaacugagcuc

SEQ ID NO: 2335095 - RNA, 16 nt, Human
ccgccuggcagaacug

SEQ ID NO: 2335096 - RNA, 12 nt, Human
ccgccuggcaga

SEQ ID NO: 2335097 - RNA, 22 nt, Human
ccgccuggaugcggauggccgg

SEQ ID NO: 2335098 - RNA, 14 nt, Human
ccgccugcccucau

SEQ ID NO: 2335099 - RNA, 16 nt, Human
ccgccugcccucaugg

SEQ ID NO: 2335100 - RNA, 16 nt, Human
ccgcuccccagcccag

SEQ ID NO: 2335101 - RNA, 15 nt, Human
ccgcucggaggcccc

SEQ ID NO: 2335102 - RNA, 16 nt, Human
ccgcucggaggcccca

SEQ ID NO: 2335103 - RNA, 18 nt, Human
ccgcucggaggccccaaa

SEQ ID NO: 2335104 - RNA, 17 nt, Human
ccgcuccugucugccag

SEQ ID NO: 2335105 - RNA, 15 nt, Human
ccgcuccugucugcc

SEQ ID NO: 2335106 - RNA, 14 nt, Human
ccgcuccugucugc

SEQ ID NO: 2335107 - RNA, 15 nt, Human
ccgcuccccagccca

SEQ ID NO: 2335108 - RNA, 14 nt, Human
ccgcuccccagccc

SEQ ID NO: 2335109 - RNA, 13 nt, Human
ccgcuccccagcc

SEQ ID NO: 2335110 - RNA, 12 nt, Human
ccgcuccccagc

SEQ ID NO: 2335111 - RNA, 15 nt, Human
ccgcucccagugucu

SEQ ID NO: 2335112 - RNA, 20 nt, Human
ccgcucccagugucuuccug

SEQ ID NO: 2335113 - RNA, 23 nt, Human
ccgccuccccacggccgcuccag

SEQ ID NO: 2335114 - RNA, 14 nt, Human
ccgccucgcccacc

SEQ ID NO: 2335115 - RNA, 15 nt, Human
ccgccucgcccaccg

SEQ ID NO: 2335116 - RNA, 17 nt, Human
ccgccucgcccaccgca

SEQ ID NO: 2335117 - RNA, 18 nt, Human
ccgccucgcccaccgcau

SEQ ID NO: 2335118 - RNA, 19 nt, Human
ccgccucgcccaccgcaug

SEQ ID NO: 2335119 - RNA, 15 nt, Human
ccgccucccagccug

SEQ ID NO: 2335120 - RNA, 23 nt, Human
ccgccucaaugugguugcaaggc

SEQ ID NO: 2335121 - RNA, 18 nt, Human
ccgccucacccccucggg

SEQ ID NO: 2335122 - RNA, 17 nt, Human
ccgccuccuacagccca

SEQ ID NO: 2335123 - RNA, 11 nt, Human
ccgccucugcu

SEQ ID NO: 2335124 - RNA, 20 nt, Human
ccgccucucccgucagggcc

SEQ ID NO: 2335125 - RNA, 21 nt, Human
ccgccucgcccaccgcaugcc

SEQ ID NO: 2335126 - RNA, 13 nt, Human
ccgccucucccgu

SEQ ID NO: 2335127 - RNA, 14 nt, Human
ccgccucugcuggc

SEQ ID NO: 2335128 - RNA, 16 nt, Human
ccgccugaaucauucu

SEQ ID NO: 2335129 - RNA, 11 nt, Human
ccgccugccag

SEQ ID NO: 2335130 - RNA, 22 nt, Human
ccgccugccaguccuagcugca

SEQ ID NO: 2335131 - RNA, 14 nt, Human
ccgccugccagucc

SEQ ID NO: 2335132 - RNA, 15 nt, Human
ccgccugccaguccu

SEQ ID NO: 2335133 - RNA, 21 nt, Human
ccgccugccaguccuagcugc

SEQ ID NO: 2335134 - RNA, 22 nt, Human
ccgccugcccgucucucuccca

SEQ ID NO: 2335135 - RNA, 19 nt, Human
ccgcugccuaaguggcugc

SEQ ID NO: 2335136 - RNA, 11 nt, Human
ccgcugcugcu

SEQ ID NO: 2335137 - RNA, 14 nt, Human
ccgcugcugcugcu

SEQ ID NO: 2335138 - RNA, 16 nt, Human
ccgcugcugcugcugc

SEQ ID NO: 2335139 - RNA, 20 nt, Human
ccgcugccuaaguggcugcu

SEQ ID NO: 2335140 - RNA, 23 nt, Human
ccgcugcccggcgcccucugucc

SEQ ID NO: 2335141 - RNA, 18 nt, Human
ccgcucuacaucuucugc

SEQ ID NO: 2335142 - RNA, 19 nt, Human
ccgcucuacaucuucugcc

SEQ ID NO: 2335143 - RNA, 20 nt, Human
ccgcucggaggccccaaagg

SEQ ID NO: 2335144 - RNA, 21 nt, Human
ccgcucggaggccccaaagga

SEQ ID NO: 2335145 - RNA, 22 nt, Human
ccgcucggaggccccaaaggaa

SEQ ID NO: 2335146 - RNA, 23 nt, Human
ccgcucggaggccccaaaggaaa

SEQ ID NO: 2335147 - RNA, 14 nt, Human
ccgcugggcugagc

SEQ ID NO: 2335148 - RNA, 19 nt, Human
ccgcugggcugagccccua

SEQ ID NO: 2335149 - RNA, 21 nt, Human
ccgcugggcugagccccuacc

SEQ ID NO: 2335150 - RNA, 11 nt, Human
ccgcuggaggu

SEQ ID NO: 2335151 - RNA, 19 nt, Human
ccgcuggagguggggccug

SEQ ID NO: 2335152 - RNA, 11 nt, Human
ccgcuggggcc

SEQ ID NO: 2335153 - RNA, 22 nt, Human
ccggagcuaacacuggccccua

SEQ ID NO: 2335154 - RNA, 20 nt, Human
ccggagcuaacacuggcccc

SEQ ID NO: 2335155 - RNA, 19 nt, Human
ccggagcuaacacuggccc

SEQ ID NO: 2335156 - RNA, 17 nt, Human
ccggagcuaacacuggc

SEQ ID NO: 2335157 - RNA, 16 nt, Human
ccggagcuaacacugg

SEQ ID NO: 2335158 - RNA, 14 nt, Human
ccgcuggggccagu

SEQ ID NO: 2335159 - RNA, 15 nt, Human
ccggaggggccuggc

SEQ ID NO: 2335160 - RNA, 16 nt, Human
ccggaggggccuggca

SEQ ID NO: 2335161 - RNA, 21 nt, Human
ccggagcuuucaaagaaggaa

SEQ ID NO: 2335162 - RNA, 15 nt, Human
ccggagcuuucaaag

SEQ ID NO: 2335163 - RNA, 14 nt, Human
ccggaggggccugg

SEQ ID NO: 2335164 - RNA, 19 nt, Human
ccgagucucuucuccacug

SEQ ID NO: 2335165 - RNA, 20 nt, Human
ccgagucucuucuccacugg

SEQ ID NO: 2335166 - RNA, 23 nt, Human
ccgcacugggcuuggggaccaga

SEQ ID NO: 2335167 - RNA, 16 nt, Human
ccgcagaagccucccc

SEQ ID NO: 2335168 - RNA, 20 nt, Human
ccgcagaagccuccccagcu

SEQ ID NO: 2335169 - RNA, 22 nt, Human
ccgcagaagccuccccagcuca

SEQ ID NO: 2335170 - RNA, 15 nt, Human
ccgaguccaagcugg

SEQ ID NO: 2335171 - RNA, 14 nt, Human
ccgcagaagcagac

SEQ ID NO: 2335172 - RNA, 14 nt, Human
ccgccucccagccu

SEQ ID NO: 2335173 - RNA, 13 nt, Human
ccgccgcuuuucu

SEQ ID NO: 2335174 - RNA, 18 nt, Human
ccgccgcuuuucuccucu

SEQ ID NO: 2335175 - RNA, 14 nt, Human
ccgccgccucgccc

SEQ ID NO: 2335176 - RNA, 15 nt, Human
ccgccgccucgccca

SEQ ID NO: 2335177 - RNA, 16 nt, Human
ccgccgccucgcccac

SEQ ID NO: 2335178 - RNA, 17 nt, Human
ccgccgccucgcccacc

SEQ ID NO: 2335179 - RNA, 20 nt, Human
ccgccgacuuuguacccccc

SEQ ID NO: 2335180 - RNA, 15 nt, Human
ccgcagacaccuugg

SEQ ID NO: 2335181 - RNA, 16 nt, Human
ccgcagacaccuugga

SEQ ID NO: 2335182 - RNA, 14 nt, Human
ccgcagacaccuug

SEQ ID NO: 2335183 - RNA, 14 nt, Human
ccgaguagcuggga

SEQ ID NO: 2335184 - RNA, 16 nt, Human
ccgaguagcugggacu

SEQ ID NO: 2335185 - RNA, 14 nt, Human
ccgagucucuucuc

SEQ ID NO: 2335186 - RNA, 20 nt, Human
ccgaguagcugagauuauag

SEQ ID NO: 2335187 - RNA, 16 nt, Human
ccgagucucuucucca

SEQ ID NO: 2335188 - RNA, 18 nt, Human
ccgagucucuucuccacu

SEQ ID NO: 2335189 - RNA, 23 nt, Human
ccgaggguccuggcuccugaggg

SEQ ID NO: 2335190 - RNA, 21 nt, Human
ccgaggguccuggcuccugag

SEQ ID NO: 2335191 - RNA, 19 nt, Human
ccgaggguccuggcuccug

SEQ ID NO: 2335192 - RNA, 18 nt, Human
ccgaggacccagacccag

SEQ ID NO: 2335193 - RNA, 16 nt, Human
ccgaggacccagaccc

SEQ ID NO: 2335194 - RNA, 17 nt, Human
ccgaggacccagaccca

SEQ ID NO: 2335195 - RNA, 17 nt, Human
ccgaggguccuggcucc

SEQ ID NO: 2335196 - RNA, 19 nt, Human
ccgaggacgcucccugcuc

SEQ ID NO: 2335197 - RNA, 20 nt, Human
ccgagcuggugcauuacaga

SEQ ID NO: 2335198 - RNA, 17 nt, Human
ccgagcuggugcauuac

SEQ ID NO: 2335199 - RNA, 16 nt, Human
ccgagcuggugcauua

SEQ ID NO: 2335200 - RNA, 14 nt, Human
ccgaggaaacucag

SEQ ID NO: 2335201 - RNA, 13 nt, Human
ccgaggacccaga

SEQ ID NO: 2335202 - RNA, 15 nt, Human
ccgaggacccagacc

SEQ ID NO: 2335203 - RNA, 19 nt, Human
ccgagcuuugaaaauucag

SEQ ID NO: 2335204 - RNA, 20 nt, Human
ccgagagccugcucccccac

SEQ ID NO: 2335205 - RNA, 13 nt, Human
ccgagagggagag

SEQ ID NO: 2335206 - RNA, 15 nt, Human
ccgagaggugggcca

SEQ ID NO: 2335207 - RNA, 19 nt, Human
ccgagaggugggccagucu

SEQ ID NO: 2335208 - RNA, 21 nt, Human
ccgagaggugggccagucugu

SEQ ID NO: 2335209 - RNA, 15 nt, Human
ccgagagccugcucc

SEQ ID NO: 2335210 - RNA, 14 nt, Human
ccgagagccugcuc

SEQ ID NO: 2335211 - RNA, 23 nt, Human
ccgacugcacagcggccccugca

SEQ ID NO: 2335212 - RNA, 13 nt, Human
ccgagagccugcu

SEQ ID NO: 2335213 - RNA, 16 nt, Human
ccgacugcuuuggacc

SEQ ID NO: 2335214 - RNA, 17 nt, Human
ccgacugcuuuggaccu

SEQ ID NO: 2335215 - RNA, 22 nt, Human
ccgagaguagccgagagccugc

SEQ ID NO: 2335216 - RNA, 21 nt, Human
ccgagaguagccgagagccug

SEQ ID NO: 2335217 - RNA, 20 nt, Human
ccgagaguagccgagagccu

SEQ ID NO: 2335218 - RNA, 16 nt, Human
ccgagaguagccgaga

SEQ ID NO: 2335219 - RNA, 21 nt, Human
ccgagaucacgccacugcacu

SEQ ID NO: 2335220 - RNA, 19 nt, Human
ccgagauugcaccacugca

SEQ ID NO: 2335221 - RNA, 15 nt, Human
ccgagauugcaccac

SEQ ID NO: 2335222 - RNA, 21 nt, Human
ccgagcugggggccaugagcu

SEQ ID NO: 2335223 - RNA, 19 nt, Human
ccgagcugggggccaugag

SEQ ID NO: 2335224 - RNA, 18 nt, Human
ccgagcugggggccauga

SEQ ID NO: 2335225 - RNA, 16 nt, Human
ccgagcugggggccau

SEQ ID NO: 2335226 - RNA, 11 nt, Human
ccgagcugggg

SEQ ID NO: 2335227 - RNA, 23 nt, Human
ccgagcucguguauccuggggcu

SEQ ID NO: 2335228 - RNA, 15 nt, Human
ccgagcaaagaucaa

SEQ ID NO: 2335229 - RNA, 21 nt, Human
ccgagauugcaccacugcacu

SEQ ID NO: 2335230 - RNA, 23 nt, Human
ccgaccucguccucccccugcca

SEQ ID NO: 2335231 - RNA, 22 nt, Human
cccuuggaaaccugcccugccu

SEQ ID NO: 2335232 - RNA, 18 nt, Human
cccuuggaaaccugcccu

SEQ ID NO: 2335233 - RNA, 19 nt, Human
cccuuggaaaccugcccug

SEQ ID NO: 2335234 - RNA, 23 nt, Human
ccgacggugggcauuugugaggc

SEQ ID NO: 2335235 - RNA, 14 nt, Human
ccgacggagccggg

SEQ ID NO: 2335236 - RNA, 16 nt, Human
ccgacgcgucuccugu

SEQ ID NO: 2335237 - RNA, 17 nt, Human
ccgacgcgucuccuguu

SEQ ID NO: 2335238 - RNA, 20 nt, Human
ccgacuccuggguugagcug

SEQ ID NO: 2335239 - RNA, 14 nt, Human
ccgacugcuuugga

SEQ ID NO: 2335240 - RNA, 23 nt, Human
cccuuggaaaccugcccugccug

SEQ ID NO: 2335241 - RNA, 20 nt, Human
ccgcucuacaucuucugccu

SEQ ID NO: 2335242 - RNA, 18 nt, Human
ccuaggccucagccagag

SEQ ID NO: 2335243 - RNA, 20 nt, Human
ccuaggccucagccagagaa

SEQ ID NO: 2335244 - RNA, 19 nt, Human
ccuaggccucagccagaga

SEQ ID NO: 2335245 - RNA, 14 nt, Human
ccuaggcgggcggu

SEQ ID NO: 2335246 - RNA, 18 nt, Human
ccuaggugacagagugag

SEQ ID NO: 2335247 - RNA, 16 nt, Human
ccuaguccagugaccu

SEQ ID NO: 2335248 - RNA, 19 nt, Human
ccuaguaagugccuuccau

SEQ ID NO: 2335249 - RNA, 15 nt, Human
ccuaguaagugccuu

SEQ ID NO: 2335250 - RNA, 16 nt, Human
ccuaguaagugccuuc

SEQ ID NO: 2335251 - RNA, 18 nt, Human
ccuaguaagugccuucca

SEQ ID NO: 2335252 - RNA, 14 nt, Human
ccuaggccucagcc

SEQ ID NO: 2335253 - RNA, 20 nt, Human
ccuaggccacuccuccaaag

SEQ ID NO: 2335254 - RNA, 19 nt, Human
ccuaggccacuccuccaaa

SEQ ID NO: 2335255 - RNA, 18 nt, Human
ccuaggccacuccuccaa

SEQ ID NO: 2335256 - RNA, 17 nt, Human
ccuaggccacuccucca

SEQ ID NO: 2335257 - RNA, 16 nt, Human
ccuaggccacuccucc

SEQ ID NO: 2335258 - RNA, 15 nt, Human
ccuaggccacuccuc

SEQ ID NO: 2335259 - RNA, 14 nt, Human
ccuaggccacuccu

SEQ ID NO: 2335260 - RNA, 13 nt, Human
ccuacugaaugcu

SEQ ID NO: 2335261 - RNA, 23 nt, Human
ccuaggccacaccaucuccuuuc

SEQ ID NO: 2335262 - RNA, 23 nt, Human
ccuaggcauuugcugaauacaga

SEQ ID NO: 2335263 - RNA, 16 nt, Human
ccuacaguguacaguc

SEQ ID NO: 2335264 - RNA, 20 nt, Human
ccuacaguguacagucuugu

SEQ ID NO: 2335265 - RNA, 21 nt, Human
ccuacaguugaaaaacagcug

SEQ ID NO: 2335266 - RNA, 17 nt, Human
ccuaccgaaaccuugcc

SEQ ID NO: 2335267 - RNA, 16 nt, Human
ccuaccgagucucuuc

SEQ ID NO: 2335268 - RNA, 17 nt, Human
ccuaccgagucucuucu

SEQ ID NO: 2335269 - RNA, 18 nt, Human
ccuacuacaucgcccucc

SEQ ID NO: 2335270 - RNA, 17 nt, Human
ccuacuacaucgcccuc

SEQ ID NO: 2335271 - RNA, 21 nt, Human
ccuacgucaaacaugaagugu

SEQ ID NO: 2335272 - RNA, 20 nt, Human
ccuacuacaucgcccuccac

SEQ ID NO: 2335273 - RNA, 16 nt, Human
ccuacuccaaaauguu

SEQ ID NO: 2335274 - RNA, 20 nt, Human
ccuacgucaaacaugaagug

SEQ ID NO: 2335275 - RNA, 20 nt, Human
ccuaccgaaaccuugccuuu

SEQ ID NO: 2335276 - RNA, 21 nt, Human
ccuaccgagucucuucuccac

SEQ ID NO: 2335277 - RNA, 19 nt, Human
ccuaccgagucucuucucc

SEQ ID NO: 2335278 - RNA, 20 nt, Human
ccuaccgagucucuucucca

SEQ ID NO: 2335279 - RNA, 15 nt, Human
ccuacaguguacagu

SEQ ID NO: 2335280 - RNA, 18 nt, Human
ccuacaggagugagcacu

SEQ ID NO: 2335281 - RNA, 15 nt, Human
ccuaacgaaguaucc

SEQ ID NO: 2335282 - RNA, 12 nt, Human
ccuaaccccuuu

SEQ ID NO: 2335283 - RNA, 15 nt, Human
ccuaaccccuuuccu

SEQ ID NO: 2335284 - RNA, 19 nt, Human
ccguugucucccuggcccu

SEQ ID NO: 2335285 - RNA, 20 nt, Human
ccguugucucccuggcccuc

SEQ ID NO: 2335286 - RNA, 21 nt, Human
ccguugucucccuggcccuca

SEQ ID NO: 2335287 - RNA, 12 nt, Human
ccguuguuuacu

SEQ ID NO: 2335288 - RNA, 20 nt, Human
ccguuggggauuggggaaga

SEQ ID NO: 2335289 - RNA, 14 nt, Human
ccguugucucccug

SEQ ID NO: 2335290 - RNA, 18 nt, Human
ccguugucucccuggccc

SEQ ID NO: 2335291 - RNA, 23 nt, Human
ccguuggaaacauaaccauuaca

SEQ ID NO: 2335292 - RNA, 11 nt, Human
ccguuggccac

SEQ ID NO: 2335293 - RNA, 20 nt, Human
ccguugggccccagccuucu

SEQ ID NO: 2335294 - RNA, 19 nt, Human
ccguugauguuggcuggga

SEQ ID NO: 2335295 - RNA, 15 nt, Human
ccguucugcuggccu

SEQ ID NO: 2335296 - RNA, 18 nt, Human
ccguucugcuggccugga

SEQ ID NO: 2335297 - RNA, 23 nt, Human
ccguucugcuggccuggaucucc

SEQ ID NO: 2335298 - RNA, 18 nt, Human
ccguugauguuggcuggg

SEQ ID NO: 2335299 - RNA, 14 nt, Human
ccguggcugcggca

SEQ ID NO: 2335300 - RNA, 22 nt, Human
ccguggccccagccuggcccag

SEQ ID NO: 2335301 - RNA, 11 nt, Human
ccguggcuucc

SEQ ID NO: 2335302 - RNA, 21 nt, Human
ccguuauuauaauuguaucag

SEQ ID NO: 2335303 - RNA, 20 nt, Human
ccguuauuauaauuguauca

SEQ ID NO: 2335304 - RNA, 14 nt, Human
ccguucacauuuuu

SEQ ID NO: 2335305 - RNA, 19 nt, Human
ccgugcagacuggagggga

SEQ ID NO: 2335306 - RNA, 17 nt, Human
ccgugcagacuggaggg

SEQ ID NO: 2335307 - RNA, 19 nt, Human
ccgugcagcuucuguccug

SEQ ID NO: 2335308 - RNA, 18 nt, Human
ccgugcagcuucuguccu

SEQ ID NO: 2335309 - RNA, 12 nt, Human
ccgugcccaggg

SEQ ID NO: 2335310 - RNA, 20 nt, Human
ccgugcccaggggcccacag

SEQ ID NO: 2335311 - RNA, 15 nt, Human
ccgugccccgccucc

SEQ ID NO: 2335312 - RNA, 19 nt, Human
ccguggccccagccuggcc

SEQ ID NO: 2335313 - RNA, 20 nt, Human
ccguggccccagccuggccc

SEQ ID NO: 2335314 - RNA, 21 nt, Human
ccguggccccagccuggccca

SEQ ID NO: 2335315 - RNA, 23 nt, Human
ccguggccccagccuggcccagc

SEQ ID NO: 2335316 - RNA, 14 nt, Human
ccgugcagacugga

SEQ ID NO: 2335317 - RNA, 13 nt, Human
ccgugcagacugg

SEQ ID NO: 2335318 - RNA, 23 nt, Human
ccgugauguaggguaaggugccu

SEQ ID NO: 2335319 - RNA, 17 nt, Human
ccgugaugcucaggcuu

SEQ ID NO: 2335320 - RNA, 18 nt, Human
ccgugaguucucagggcu

SEQ ID NO: 2335321 - RNA, 19 nt, Human
ccgugaguucucagggcuc

SEQ ID NO: 2335322 - RNA, 20 nt, Human
ccgugaguucucagggcucc

SEQ ID NO: 2335323 - RNA, 23 nt, Human
ccgugaguucucagggcuccugc

SEQ ID NO: 2335324 - RNA, 22 nt, Human
ccgggucaucuguaccucugcc

SEQ ID NO: 2335325 - RNA, 14 nt, Human
ccgugaguucucag

SEQ ID NO: 2335326 - RNA, 16 nt, Human
ccgugaguucucaggg

SEQ ID NO: 2335327 - RNA, 17 nt, Human
ccgugaguucucagggc

SEQ ID NO: 2335328 - RNA, 14 nt, Human
ccguggcuucccgc

SEQ ID NO: 2335329 - RNA, 18 nt, Human
ccuagucucccucacagc

SEQ ID NO: 2335330 - RNA, 15 nt, Human
ccacuggaagggcag

SEQ ID NO: 2335331 - RNA, 16 nt, Human
ccacugcugcuucucc

SEQ ID NO: 2335332 - RNA, 19 nt, Human
ccacugcugcuucuccaug

SEQ ID NO: 2335333 - RNA, 22 nt, Human
ccacugcuuuuggucuguguga

SEQ ID NO: 2335334 - RNA, 20 nt, Human
ccacugcuuuuggucugugu

SEQ ID NO: 2335335 - RNA, 21 nt, Human
ccacugccuucgauacaccgg

SEQ ID NO: 2335336 - RNA, 11 nt, Human
ccacugcucug

SEQ ID NO: 2335337 - RNA, 12 nt, Human
ccacugcucugg

SEQ ID NO: 2335338 - RNA, 13 nt, Human
ccacugcucuggu

SEQ ID NO: 2335339 - RNA, 15 nt, Human
ccacugcucugguua

SEQ ID NO: 2335340 - RNA, 18 nt, Human
ccacugggguccagggag

SEQ ID NO: 2335341 - RNA, 19 nt, Human
ccacugggguccagggagc

SEQ ID NO: 2335342 - RNA, 22 nt, Human
ccacugggguccagggagcagg

SEQ ID NO: 2335343 - RNA, 23 nt, Human
ccacuggugacaugucuuuucuu

SEQ ID NO: 2335344 - RNA, 22 nt, Human
ccacugucacuguuucucugcu

SEQ ID NO: 2335345 - RNA, 19 nt, Human
ccacugucacuguuucucu

SEQ ID NO: 2335346 - RNA, 14 nt, Human
ccacuguaaaauga

SEQ ID NO: 2335347 - RNA, 17 nt, Human
ccacugucacccuccac

SEQ ID NO: 2335348 - RNA, 15 nt, Human
ccacugguucuucuu

SEQ ID NO: 2335349 - RNA, 24 nt, Human
ccacugucacuguuucucugcugu

SEQ ID NO: 2335350 - RNA, 23 nt, Human
ccacugucacuguuucucugcug

SEQ ID NO: 2335351 - RNA, 11 nt, Human
ccacuguccug

SEQ ID NO: 2335352 - RNA, 12 nt, Human
ccacuguccugg

SEQ ID NO: 2335353 - RNA, 13 nt, Human
ccacuguccuggg

SEQ ID NO: 2335354 - RNA, 21 nt, Human
ccacuguccugggccugcaga

SEQ ID NO: 2335355 - RNA, 20 nt, Human
ccacuguccugggccugcag

SEQ ID NO: 2335356 - RNA, 19 nt, Human
ccacuguccugggccugca

SEQ ID NO: 2335357 - RNA, 15 nt, Human
ccacuguccugggcc

SEQ ID NO: 2335358 - RNA, 15 nt, Human
ccacugugaagagaa

SEQ ID NO: 2335359 - RNA, 14 nt, Human
ccacugugaagaga

SEQ ID NO: 2335360 - RNA, 19 nt, Human
ccacugcauaccaaccugg

SEQ ID NO: 2335361 - RNA, 23 nt, Human
ccacugccacacgucugacccuc

SEQ ID NO: 2335362 - RNA, 13 nt, Human
ccacugccucuuc

SEQ ID NO: 2335363 - RNA, 16 nt, Human
ccacugccugcccacc

SEQ ID NO: 2335364 - RNA, 15 nt, Human
ccacugccugcccac

SEQ ID NO: 2335365 - RNA, 14 nt, Human
ccacugccugccca

SEQ ID NO: 2335366 - RNA, 13 nt, Human
ccacugccugccc

SEQ ID NO: 2335367 - RNA, 23 nt, Human
ccacugccugcccacccguggag

SEQ ID NO: 2335368 - RNA, 17 nt, Human
ccacugccugcccaccc

SEQ ID NO: 2335369 - RNA, 12 nt, Human
ccacugccuucg

SEQ ID NO: 2335370 - RNA, 12 nt, Human
ccacugccugcc

SEQ ID NO: 2335371 - RNA, 11 nt, Human
ccacugccugc

SEQ ID NO: 2335372 - RNA, 16 nt, Human
ccacugccucuuccuc

SEQ ID NO: 2335373 - RNA, 18 nt, Human
ccacugcauaccaaccug

SEQ ID NO: 2335374 - RNA, 21 nt, Human
ccaccuucccagcucucccuc

SEQ ID NO: 2335375 - RNA, 14 nt, Human
ccaccuugcgggga

SEQ ID NO: 2335376 - RNA, 14 nt, Human
ccaccuucccaugc

SEQ ID NO: 2335377 - RNA, 19 nt, Human
ccaccuucccagcucuccc

SEQ ID NO: 2335378 - RNA, 16 nt, Human
ccaccuucccagcucu

SEQ ID NO: 2335379 - RNA, 15 nt, Human
ccaccuucccagcuc

SEQ ID NO: 2335380 - RNA, 14 nt, Human
ccaccuucccagcu

SEQ ID NO: 2335381 - RNA, 13 nt, Human
ccaccuucccagc

SEQ ID NO: 2335382 - RNA, 12 nt, Human
ccaccuucccag

SEQ ID NO: 2335383 - RNA, 11 nt, Human
ccaccuuccca

SEQ ID NO: 2335384 - RNA, 23 nt, Human
ccacugcaucguuucaucuucca

SEQ ID NO: 2335385 - RNA, 21 nt, Human
ccacugcaucguuucaucuuc

SEQ ID NO: 2335386 - RNA, 15 nt, Human
ccagaaccuguccuu

SEQ ID NO: 2335387 - RNA, 17 nt, Human
ccagaacaguuuguaca

SEQ ID NO: 2335388 - RNA, 18 nt, Human
ccagaacguggcucugcu

SEQ ID NO: 2335389 - RNA, 19 nt, Human
ccagaacguggcucugcug

SEQ ID NO: 2335390 - RNA, 19 nt, Human
ccagaacucacuggggccu

SEQ ID NO: 2335391 - RNA, 20 nt, Human
ccagaacguggcucugcugg

SEQ ID NO: 2335392 - RNA, 21 nt, Human
ccagaacguggcucugcuggc

SEQ ID NO: 2335393 - RNA, 12 nt, Human
ccagaacuggac

SEQ ID NO: 2335394 - RNA, 15 nt, Human
ccagaagcccagaau

SEQ ID NO: 2335395 - RNA, 22 nt, Human
ccagaagaaaauagugguguga

SEQ ID NO: 2335396 - RNA, 16 nt, Human
ccagaaaaccccagca

SEQ ID NO: 2335397 - RNA, 14 nt, Human
ccagaaaaggacag

SEQ ID NO: 2335398 - RNA, 15 nt, Human
ccagaaaaccccagc

SEQ ID NO: 2335399 - RNA, 19 nt, Human
ccagaaaaaaaaaaacuua

SEQ ID NO: 2335400 - RNA, 14 nt, Human
ccagaaccuguccu

SEQ ID NO: 2335401 - RNA, 15 nt, Human
ccagaaaaggacaga

SEQ ID NO: 2335402 - RNA, 16 nt, Human
ccagaaaaggacagaa

SEQ ID NO: 2335403 - RNA, 18 nt, Human
ccagaaaccuuuguuugc

SEQ ID NO: 2335404 - RNA, 19 nt, Human
ccacugugccaugugccag

SEQ ID NO: 2335405 - RNA, 14 nt, Human
ccacugucuucuuc

SEQ ID NO: 2335406 - RNA, 14 nt, Human
ccacuguccugggc

SEQ ID NO: 2335407 - RNA, 15 nt, Human
ccacuguccugggcg

SEQ ID NO: 2335408 - RNA, 16 nt, Human
ccacuguccugggcgc

SEQ ID NO: 2335409 - RNA, 22 nt, Human
ccacuguccugggcgcccugga

SEQ ID NO: 2335410 - RNA, 15 nt, Human
ccacugugccaugug

SEQ ID NO: 2335411 - RNA, 16 nt, Human
ccacugugccaugugc

SEQ ID NO: 2335412 - RNA, 16 nt, Human
ccacuuaaaaaauguc

SEQ ID NO: 2335413 - RNA, 12 nt, Human
ccacuuuuuaac

SEQ ID NO: 2335414 - RNA, 14 nt, Human
ccacuguuaucaaa

SEQ ID NO: 2335415 - RNA, 12 nt, Human
ccacuguguaua

SEQ ID NO: 2335416 - RNA, 17 nt, Human
ccacugugcugaauucu

SEQ ID NO: 2335417 - RNA, 19 nt, Human
ccacugugcugaauucugc

SEQ ID NO: 2335418 - RNA, 21 nt, Human
ccagaaugcuguacaucuauu

SEQ ID NO: 2335419 - RNA, 12 nt, Human
ccagaaggcagg

SEQ ID NO: 2335420 - RNA, 16 nt, Human
ccagaagcuuccauag

SEQ ID NO: 2335421 - RNA, 15 nt, Human
ccagaagggggccau

SEQ ID NO: 2335422 - RNA, 22 nt, Human
ccagaaggcauaucagucucug

SEQ ID NO: 2335423 - RNA, 14 nt, Human
ccagaagggguuug

SEQ ID NO: 2335424 - RNA, 20 nt, Human
ccagaagccucuggcuagag

SEQ ID NO: 2335425 - RNA, 19 nt, Human
ccagaagccucuggcuaga

SEQ ID NO: 2335426 - RNA, 16 nt, Human
ccagaagccucuggcu

SEQ ID NO: 2335427 - RNA, 15 nt, Human
ccagaagccucuggc

SEQ ID NO: 2335428 - RNA, 20 nt, Human
ccagaagcugagcaccaggg

SEQ ID NO: 2335429 - RNA, 15 nt, Human
ccagaagcuuccaua

SEQ ID NO: 2335430 - RNA, 22 nt, Human
ccagaauaaguuauugcaguuu

SEQ ID NO: 2335431 - RNA, 23 nt, Human
ccagaauaaguuauugcaguuua

SEQ ID NO: 2335432 - RNA, 20 nt, Human
ccagaagucaagcccagcca

SEQ ID NO: 2335433 - RNA, 15 nt, Human
ccagaauaaguuauu

SEQ ID NO: 2335434 - RNA, 19 nt, Human
ccagaauaaguuauugcag

SEQ ID NO: 2335435 - RNA, 21 nt, Human
ccagaauaaguuauugcaguu

SEQ ID NO: 2335436 - RNA, 16 nt, Human
ccagaaucuaaagcca

SEQ ID NO: 2335437 - RNA, 12 nt, Human
ccagaaucaaag

SEQ ID NO: 2335438 - RNA, 15 nt, Human
ccagaaugaggcugc

SEQ ID NO: 2335439 - RNA, 19 nt, Human
ccagacacaggcccucccu

SEQ ID NO: 2335440 - RNA, 17 nt, Human
ccagaaugcuguacauc

SEQ ID NO: 2335441 - RNA, 16 nt, Human
ccagaaugcuguacau

SEQ ID NO: 2335442 - RNA, 18 nt, Human
ccagagaguggcuccucc

SEQ ID NO: 2335443 - RNA, 22 nt, Human
ccagagaguggcuccucccggu

SEQ ID NO: 2335444 - RNA, 13 nt, Human
ccagagauccaaa

SEQ ID NO: 2335445 - RNA, 15 nt, Human
ccagagaguccucug

SEQ ID NO: 2335446 - RNA, 17 nt, Human
ccagagaguccucugga

SEQ ID NO: 2335447 - RNA, 18 nt, Human
ccagagaguccucuggau

SEQ ID NO: 2335448 - RNA, 21 nt, Human
ccagagcauuuccaacaccac

SEQ ID NO: 2335449 - RNA, 22 nt, Human
ccagagcauuuccaacaccaca

SEQ ID NO: 2335450 - RNA, 23 nt, Human
ccagagcauuuccaacaccacag

SEQ ID NO: 2335451 - RNA, 23 nt, Human
ccagagccaggggggugaggagc

SEQ ID NO: 2335452 - RNA, 22 nt, Human
ccagagccaggggggugaggag

SEQ ID NO: 2335453 - RNA, 12 nt, Human
ccagagccaggg

SEQ ID NO: 2335454 - RNA, 11 nt, Human
ccagagccagg

SEQ ID NO: 2335455 - RNA, 14 nt, Human
ccagagaguggcuc

SEQ ID NO: 2335456 - RNA, 15 nt, Human
ccagagaguggcucc

SEQ ID NO: 2335457 - RNA, 16 nt, Human
ccagagaguggcuccu

SEQ ID NO: 2335458 - RNA, 14 nt, Human
ccagacccggcugc

SEQ ID NO: 2335459 - RNA, 15 nt, Human
ccagacccggcugcg

SEQ ID NO: 2335460 - RNA, 20 nt, Human
ccagacagcucccucugccu

SEQ ID NO: 2335461 - RNA, 13 nt, Human
ccagacagcuccc

SEQ ID NO: 2335462 - RNA, 17 nt, Human
ccagacagccuguaucu

SEQ ID NO: 2335463 - RNA, 15 nt, Human
ccagacacaggcccu

SEQ ID NO: 2335464 - RNA, 10 nt, Human
ccagacaccc

SEQ ID NO: 2335465 - RNA, 13 nt, Human
ccagacacccagg

SEQ ID NO: 2335466 - RNA, 22 nt, Human
ccagacacauguccaagaagcc

SEQ ID NO: 2335467 - RNA, 17 nt, Human
ccagacacauguccaag

SEQ ID NO: 2335468 - RNA, 20 nt, Human
ccagacacauguccaagaag

SEQ ID NO: 2335469 - RNA, 23 nt, Human
ccagacauguggugggacaggga

SEQ ID NO: 2335470 - RNA, 19 nt, Human
ccagacauguggugggaca

SEQ ID NO: 2335471 - RNA, 24 nt, Human
ccagaccccuggcuuuucacugcu

SEQ ID NO: 2335472 - RNA, 18 nt, Human
ccagaccccuggcuuuuc

SEQ ID NO: 2335473 - RNA, 14 nt, Human
ccagacaucaacag

SEQ ID NO: 2335474 - RNA, 20 nt, Human
ccagacaugccacaaggacu

SEQ ID NO: 2335475 - RNA, 14 nt, Human
ccagacaugccaca

SEQ ID NO: 2335476 - RNA, 16 nt, Human
ccaccucucccugacc

SEQ ID NO: 2335477 - RNA, 17 nt, Human
ccaccucucccugaccc

SEQ ID NO: 2335478 - RNA, 18 nt, Human
ccaccucucccugacccu

SEQ ID NO: 2335479 - RNA, 14 nt, Human
ccaccucucuccuu

SEQ ID NO: 2335480 - RNA, 17 nt, Human
ccaccucucuccuuugc

SEQ ID NO: 2335481 - RNA, 15 nt, Human
ccaccucucuuuuuc

SEQ ID NO: 2335482 - RNA, 19 nt, Human
ccaccucucuccuuugcug

SEQ ID NO: 2335483 - RNA, 24 nt, Human
ccaccucucuccuuugcugaggcc

SEQ ID NO: 2335484 - RNA, 10 nt, Human
ccaccucugc

SEQ ID NO: 2335485 - RNA, 11 nt, Human
ccaccucugcg

SEQ ID NO: 2335486 - RNA, 13 nt, Human
ccaccucugcgga

SEQ ID NO: 2335487 - RNA, 18 nt, Human
ccaccucugcggacccca

SEQ ID NO: 2335488 - RNA, 19 nt, Human
ccaccucucucacuccuug

SEQ ID NO: 2335489 - RNA, 20 nt, Human
ccaccucucucacuccuuga

SEQ ID NO: 2335490 - RNA, 14 nt, Human
ccaccucucucacu

SEQ ID NO: 2335491 - RNA, 16 nt, Human
ccaccucucucacucc

SEQ ID NO: 2335492 - RNA, 12 nt, Human
ccaccucuccaa

SEQ ID NO: 2335493 - RNA, 13 nt, Human
ccaccucuccaag

SEQ ID NO: 2335494 - RNA, 14 nt, Human
ccaccucuccaagg

SEQ ID NO: 2335495 - RNA, 15 nt, Human
ccaccucuccaaggg

SEQ ID NO: 2335496 - RNA, 16 nt, Human
ccaccucuccaagggc

SEQ ID NO: 2335497 - RNA, 17 nt, Human
ccaccucuccaagggcu

SEQ ID NO: 2335498 - RNA, 17 nt, Human
ccaccucuccccaccuu

SEQ ID NO: 2335499 - RNA, 12 nt, Human
ccaccucucccu

SEQ ID NO: 2335500 - RNA, 13 nt, Human
ccaccucucccuc

SEQ ID NO: 2335501 - RNA, 11 nt, Human
ccacccugcuc

SEQ ID NO: 2335502 - RNA, 12 nt, Human
ccacccugcucu

SEQ ID NO: 2335503 - RNA, 12 nt, Human
ccaccuccuucu

SEQ ID NO: 2335504 - RNA, 13 nt, Human
ccaccuccuucuc

SEQ ID NO: 2335505 - RNA, 17 nt, Human
ccaccuccuucucuguc

SEQ ID NO: 2335506 - RNA, 18 nt, Human
ccaccuccuucucugucu

SEQ ID NO: 2335507 - RNA, 18 nt, Human
ccaccucccugccuccag

SEQ ID NO: 2335508 - RNA, 16 nt, Human
ccaccucccugccucc

SEQ ID NO: 2335509 - RNA, 14 nt, Human
ccaccucccugccu

SEQ ID NO: 2335510 - RNA, 15 nt, Human
ccaccugcugagaga

SEQ ID NO: 2335511 - RNA, 23 nt, Human
ccaccucuucucuuccuguaaca

SEQ ID NO: 2335512 - RNA, 19 nt, Human
ccaccucuucucuuccugu

SEQ ID NO: 2335513 - RNA, 20 nt, Human
ccaccucuucucuuccugua

SEQ ID NO: 2335514 - RNA, 23 nt, Human
ccaccugcugagagacccaagga

SEQ ID NO: 2335515 - RNA, 22 nt, Human
ccaccugcugagagacccaagg

SEQ ID NO: 2335516 - RNA, 12 nt, Human
ccaccuggccac

SEQ ID NO: 2335517 - RNA, 13 nt, Human
ccaccuggccacc

SEQ ID NO: 2335518 - RNA, 12 nt, Human
ccaccugccagg

SEQ ID NO: 2335519 - RNA, 15 nt, Human
ccaccugccagggac

SEQ ID NO: 2335520 - RNA, 16 nt, Human
ccaccucuucucuucc

SEQ ID NO: 2335521 - RNA, 18 nt, Human
ccaccucuucucuuccug

SEQ ID NO: 2335522 - RNA, 19 nt, Human
ccaccucugugaccucagg

SEQ ID NO: 2335523 - RNA, 22 nt, Human
ccaccucugugaccucaggcac

SEQ ID NO: 2335524 - RNA, 23 nt, Human
ccaccucugugaccucaggcacu

SEQ ID NO: 2335525 - RNA, 22 nt, Human
ccaccucugcggaccccagcug

SEQ ID NO: 2335526 - RNA, 19 nt, Human
ccaccucugcggaccccag

SEQ ID NO: 2335527 - RNA, 20 nt, Human
ccaccucugcggaccccagc

SEQ ID NO: 2335528 - RNA, 15 nt, Human
ccaccucugugaccu

SEQ ID NO: 2335529 - RNA, 17 nt, Human
ccaccucugugaccuca

SEQ ID NO: 2335530 - RNA, 18 nt, Human
ccaccucugugaccucag

SEQ ID NO: 2335531 - RNA, 13 nt, Human
ccaccugccaggg

SEQ ID NO: 2335532 - RNA, 14 nt, Human
ccaccugccaggga

SEQ ID NO: 2335533 - RNA, 12 nt, Human
ccaccuggcccc

SEQ ID NO: 2335534 - RNA, 18 nt, Human
ccaccuggccaccugagg

SEQ ID NO: 2335535 - RNA, 14 nt, Human
ccaccuggccaccu

SEQ ID NO: 2335536 - RNA, 15 nt, Human
ccaccuggccaccug

SEQ ID NO: 2335537 - RNA, 22 nt, Human
ccaccuggccccaugucucuca

SEQ ID NO: 2335538 - RNA, 21 nt, Human
ccaccuggccccaugucucuc

SEQ ID NO: 2335539 - RNA, 13 nt, Human
ccaccuggccucu

SEQ ID NO: 2335540 - RNA, 18 nt, Human
ccaccuggccucugcacu

SEQ ID NO: 2335541 - RNA, 20 nt, Human
ccaccuggccucugcacucc

SEQ ID NO: 2335542 - RNA, 20 nt, Human
ccaccuucaauuccugggcc

SEQ ID NO: 2335543 - RNA, 19 nt, Human
ccaccuucaauuccugggc

SEQ ID NO: 2335544 - RNA, 18 nt, Human
ccaccuucaauuccuggg

SEQ ID NO: 2335545 - RNA, 14 nt, Human
ccaccugucuucaa

SEQ ID NO: 2335546 - RNA, 17 nt, Human
ccaccuucaauuccugg

SEQ ID NO: 2335547 - RNA, 16 nt, Human
ccaccuggggcaguca

SEQ ID NO: 2335548 - RNA, 15 nt, Human
ccaccuggggcaguc

SEQ ID NO: 2335549 - RNA, 20 nt, Human
ccaccuggggcagucaccug

SEQ ID NO: 2335550 - RNA, 14 nt, Human
ccaccuggggcagu

SEQ ID NO: 2335551 - RNA, 22 nt, Human
ccaccugggcauauccaccacc

SEQ ID NO: 2335552 - RNA, 19 nt, Human
ccacccccuucucugcucc

SEQ ID NO: 2335553 - RNA, 18 nt, Human
ccacccccuucucugcuc

SEQ ID NO: 2335554 - RNA, 13 nt, Human
ccacccccuucuc

SEQ ID NO: 2335555 - RNA, 22 nt, Human
ccacccccuucagugcccacca

SEQ ID NO: 2335556 - RNA, 20 nt, Human
ccacccccuucagugcccac

SEQ ID NO: 2335557 - RNA, 18 nt, Human
ccacccccuucagugccc

SEQ ID NO: 2335558 - RNA, 17 nt, Human
ccacccccuucagugcc

SEQ ID NO: 2335559 - RNA, 12 nt, Human
ccacccccuuca

SEQ ID NO: 2335560 - RNA, 18 nt, Human
ccacccccugcccugcac

SEQ ID NO: 2335561 - RNA, 16 nt, Human
ccacccccugcccugc

SEQ ID NO: 2335562 - RNA, 17 nt, Human
ccacccccugcccugca

SEQ ID NO: 2335563 - RNA, 22 nt, Human
ccacccccucccuggccuguuc

SEQ ID NO: 2335564 - RNA, 13 nt, Human
ccacccccugccc

SEQ ID NO: 2335565 - RNA, 14 nt, Human
ccacccccugcccu

SEQ ID NO: 2335566 - RNA, 15 nt, Human
ccacccccugcccug

SEQ ID NO: 2335567 - RNA, 19 nt, Human
ccacccccuccccagggga

SEQ ID NO: 2335568 - RNA, 18 nt, Human
ccacccccuccccagggg

SEQ ID NO: 2335569 - RNA, 17 nt, Human
ccacccccuccccaggg

SEQ ID NO: 2335570 - RNA, 16 nt, Human
ccacccccuccccagg

SEQ ID NO: 2335571 - RNA, 13 nt, Human
ccaccccccucau

SEQ ID NO: 2335572 - RNA, 12 nt, Human
ccacccccucaa

SEQ ID NO: 2335573 - RNA, 14 nt, Human
ccacccccucaagc

SEQ ID NO: 2335574 - RNA, 15 nt, Human
ccacccccucaagcc

SEQ ID NO: 2335575 - RNA, 21 nt, Human
ccaccccccagaaccuguccu

SEQ ID NO: 2335576 - RNA, 22 nt, Human
ccaccccccagaaccuguccuu

SEQ ID NO: 2335577 - RNA, 15 nt, Human
ccacccccagcugcu

SEQ ID NO: 2335578 - RNA, 18 nt, Human
ccaccccccacucugugc

SEQ ID NO: 2335579 - RNA, 19 nt, Human
ccacccccaggaccccuga

SEQ ID NO: 2335580 - RNA, 18 nt, Human
ccacccccaggaccccug

SEQ ID NO: 2335581 - RNA, 16 nt, Human
ccacccccaggacccc

SEQ ID NO: 2335582 - RNA, 19 nt, Human
ccacccccacccaagggcc

SEQ ID NO: 2335583 - RNA, 15 nt, Human
ccacccccaccccca

SEQ ID NO: 2335584 - RNA, 13 nt, Human
ccacccccagcuc

SEQ ID NO: 2335585 - RNA, 16 nt, Human
ccacccccagcucaau

SEQ ID NO: 2335586 - RNA, 16 nt, Human
ccaccccuuccccacu

SEQ ID NO: 2335587 - RNA, 13 nt, Human
ccaccccuuccug

SEQ ID NO: 2335588 - RNA, 15 nt, Human
ccaccccuuccccac

SEQ ID NO: 2335589 - RNA, 13 nt, Human
ccaccccuucccc

SEQ ID NO: 2335590 - RNA, 13 nt, Human
ccaccccugugcu

SEQ ID NO: 2335591 - RNA, 14 nt, Human
ccaccccugugcuc

SEQ ID NO: 2335592 - RNA, 15 nt, Human
ccaccccugugcucc

SEQ ID NO: 2335593 - RNA, 14 nt, Human
ccaccccuuccugu

SEQ ID NO: 2335594 - RNA, 15 nt, Human
ccaccccuuccuguc

SEQ ID NO: 2335595 - RNA, 13 nt, Human
ccaccccuugcuc

SEQ ID NO: 2335596 - RNA, 16 nt, Human
ccacccucccuggagu

SEQ ID NO: 2335597 - RNA, 17 nt, Human
ccacccucccuggagug

SEQ ID NO: 2335598 - RNA, 12 nt, Human
ccacccuccugu

SEQ ID NO: 2335599 - RNA, 13 nt, Human
ccacccuccuguc

SEQ ID NO: 2335600 - RNA, 16 nt, Human
ccaccccuccuuccuu

SEQ ID NO: 2335601 - RNA, 15 nt, Human
ccaccccuccuuccu

SEQ ID NO: 2335602 - RNA, 14 nt, Human
ccaccccuccccau

SEQ ID NO: 2335603 - RNA, 13 nt, Human
ccaccccugcccc

SEQ ID NO: 2335604 - RNA, 22 nt, Human
ccaccccugcccccagccccgg

SEQ ID NO: 2335605 - RNA, 12 nt, Human
ccaccccugccu

SEQ ID NO: 2335606 - RNA, 14 nt, Human
ccaccccugccucc

SEQ ID NO: 2335607 - RNA, 20 nt, Human
ccaccccugggggcucucau

SEQ ID NO: 2335608 - RNA, 12 nt, Human
ccaccccugugc

SEQ ID NO: 2335609 - RNA, 17 nt, Human
ccaccccugggggcucu

SEQ ID NO: 2335610 - RNA, 15 nt, Human
ccaccccugccucca

SEQ ID NO: 2335611 - RNA, 16 nt, Human
ccaccccugccuccac

SEQ ID NO: 2335612 - RNA, 18 nt, Human
ccaccccugccuccaccc

SEQ ID NO: 2335613 - RNA, 22 nt, Human
ccaccccugccuccacccucug

SEQ ID NO: 2335614 - RNA, 14 nt, Human
ccacccuccuuuca

SEQ ID NO: 2335615 - RNA, 14 nt, Human
ccacccuccugucu

SEQ ID NO: 2335616 - RNA, 15 nt, Human
ccacccuccugucuu

SEQ ID NO: 2335617 - RNA, 17 nt, Human
ccacccuccugucuucc

SEQ ID NO: 2335618 - RNA, 19 nt, Human
ccacccuccugucuuccca

SEQ ID NO: 2335619 - RNA, 20 nt, Human
ccacccuccugucuucccag

SEQ ID NO: 2335620 - RNA, 21 nt, Human
ccacccuccugucuucccagg

SEQ ID NO: 2335621 - RNA, 22 nt, Human
ccacccuccugucuucccaggg

SEQ ID NO: 2335622 - RNA, 23 nt, Human
ccacccuccugucuucccagggu

SEQ ID NO: 2335623 - RNA, 12 nt, Human
ccagcuccucau

SEQ ID NO: 2335624 - RNA, 20 nt, Human
ccagcuccggccuguccucc

SEQ ID NO: 2335625 - RNA, 23 nt, Human
ccagcuccucauccagggcucug

SEQ ID NO: 2335626 - RNA, 14 nt, Human
ccagcuccucccuu

SEQ ID NO: 2335627 - RNA, 20 nt, Human
ccagcuccucccuuguucuc

SEQ ID NO: 2335628 - RNA, 19 nt, Human
ccagcuccggccuguccuc

SEQ ID NO: 2335629 - RNA, 18 nt, Human
ccagcuccggccuguccu

SEQ ID NO: 2335630 - RNA, 20 nt, Human
ccagccuuugaucagguggg

SEQ ID NO: 2335631 - RNA, 16 nt, Human
ccagcucccucuauuu

SEQ ID NO: 2335632 - RNA, 13 nt, Human
ccagcgagcccug

SEQ ID NO: 2335633 - RNA, 16 nt, Human
ccagccugggcgacag

SEQ ID NO: 2335634 - RNA, 13 nt, Human
ccagccugggguc

SEQ ID NO: 2335635 - RNA, 19 nt, Human
ccagccugucccauggaca

SEQ ID NO: 2335636 - RNA, 23 nt, Human
ccagccugucccauggacacucc

SEQ ID NO: 2335637 - RNA, 14 nt, Human
ccagccuguuggac

SEQ ID NO: 2335638 - RNA, 20 nt, Human
ccagccuguuggacccgcuc

SEQ ID NO: 2335639 - RNA, 15 nt, Human
ccagccuuccucugc

SEQ ID NO: 2335640 - RNA, 16 nt, Human
ccagccuuccucugca

SEQ ID NO: 2335641 - RNA, 20 nt, Human
ccagccuuccucugcagcug

SEQ ID NO: 2335642 - RNA, 21 nt, Human
ccagccuuucucccaggccag

SEQ ID NO: 2335643 - RNA, 20 nt, Human
ccagccuuucucccaggcca

SEQ ID NO: 2335644 - RNA, 19 nt, Human
ccagccuuucucccaggcc

SEQ ID NO: 2335645 - RNA, 18 nt, Human
ccagccuuucucccaggc

SEQ ID NO: 2335646 - RNA, 15 nt, Human
ccagccuuucuccca

SEQ ID NO: 2335647 - RNA, 18 nt, Human
ccagccuuggcaucuaga

SEQ ID NO: 2335648 - RNA, 23 nt, Human
ccagccuugaccauucuccaccu

SEQ ID NO: 2335649 - RNA, 19 nt, Human
ccagccugggcgacagagc

SEQ ID NO: 2335650 - RNA, 13 nt, Human
ccagccuggguga

SEQ ID NO: 2335651 - RNA, 23 nt, Human
ccagccugggcagccaggcugcc

SEQ ID NO: 2335652 - RNA, 22 nt, Human
ccagccugggcagccaggcugc

SEQ ID NO: 2335653 - RNA, 18 nt, Human
ccagccugggcagccagg

SEQ ID NO: 2335654 - RNA, 16 nt, Human
ccagccugggcagcca

SEQ ID NO: 2335655 - RNA, 19 nt, Human
ccagccugggcaacagagc

SEQ ID NO: 2335656 - RNA, 18 nt, Human
ccagccuggcuucuggag

SEQ ID NO: 2335657 - RNA, 17 nt, Human
ccagccuggcuucugga

SEQ ID NO: 2335658 - RNA, 15 nt, Human
ccagccuggcuucug

SEQ ID NO: 2335659 - RNA, 13 nt, Human
ccagccuggcuuc

SEQ ID NO: 2335660 - RNA, 20 nt, Human
ccagccuggcuucuggagcc

SEQ ID NO: 2335661 - RNA, 19 nt, Human
ccagccuggcuucuggagc

SEQ ID NO: 2335662 - RNA, 21 nt, Human
ccagccuggcuucuggagccc

SEQ ID NO: 2335663 - RNA, 12 nt, Human
ccagccuggcuc

SEQ ID NO: 2335664 - RNA, 21 nt, Human
ccagccuggcucccacaggca

SEQ ID NO: 2335665 - RNA, 23 nt, Human
ccagccuggcucccacaggcagc

SEQ ID NO: 2335666 - RNA, 17 nt, Human
ccagccuaagaugaaga

SEQ ID NO: 2335667 - RNA, 19 nt, Human
ccagccugagcgacaguga

SEQ ID NO: 2335668 - RNA, 10 nt, Human
ccagccugcc

SEQ ID NO: 2335669 - RNA, 20 nt, Human
ccagccugccuggcaggcug

SEQ ID NO: 2335670 - RNA, 21 nt, Human
ccagccugccuggcaggcugu

SEQ ID NO: 2335671 - RNA, 20 nt, Human
ccagccgugaugcucaggcu

SEQ ID NO: 2335672 - RNA, 21 nt, Human
ccagccgugaugcucaggcuu

SEQ ID NO: 2335673 - RNA, 23 nt, Human
ccagccgugaugcucaggcuuga

SEQ ID NO: 2335674 - RNA, 16 nt, Human
ccagccugccuggcag

SEQ ID NO: 2335675 - RNA, 18 nt, Human
ccagccugccuggcaggc

SEQ ID NO: 2335676 - RNA, 19 nt, Human
ccagccugccuggcaggcu

SEQ ID NO: 2335677 - RNA, 19 nt, Human
ccagccauuaccauggaga

SEQ ID NO: 2335678 - RNA, 12 nt, Human
ccagcccaaguc

SEQ ID NO: 2335679 - RNA, 13 nt, Human
ccagcccaagucc

SEQ ID NO: 2335680 - RNA, 21 nt, Human
ccagccauuaccauggagaca

SEQ ID NO: 2335681 - RNA, 18 nt, Human
ccagccaugucugcauuu

SEQ ID NO: 2335682 - RNA, 17 nt, Human
ccagccaugucugcauu

SEQ ID NO: 2335683 - RNA, 16 nt, Human
ccagccaugucugcau

SEQ ID NO: 2335684 - RNA, 14 nt, Human
ccagccaugucugc

SEQ ID NO: 2335685 - RNA, 19 nt, Human
ccagccaucugcccagggg

SEQ ID NO: 2335686 - RNA, 20 nt, Human
ccagccaucugcccaggggu

SEQ ID NO: 2335687 - RNA, 21 nt, Human
ccagccaucugcccaggggug

SEQ ID NO: 2335688 - RNA, 18 nt, Human
ccagccaucaaaaugcuu

SEQ ID NO: 2335689 - RNA, 16 nt, Human
ccagccaucaaaaugc

SEQ ID NO: 2335690 - RNA, 20 nt, Human
ccagcagggucuuuucaucu

SEQ ID NO: 2335691 - RNA, 21 nt, Human
ccagcagggucuuuucaucug

SEQ ID NO: 2335692 - RNA, 22 nt, Human
ccagcagggucuuuucaucugg

SEQ ID NO: 2335693 - RNA, 23 nt, Human
ccagcagggucuuuucaucuggg

SEQ ID NO: 2335694 - RNA, 16 nt, Human
ccagccaucugcccag

SEQ ID NO: 2335695 - RNA, 17 nt, Human
ccagccaucugcccagg

SEQ ID NO: 2335696 - RNA, 18 nt, Human
ccagccaucugcccaggg

SEQ ID NO: 2335697 - RNA, 15 nt, Human
ccagccaucugccca

SEQ ID NO: 2335698 - RNA, 22 nt, Human
ccagccauacuuaucucucugu

SEQ ID NO: 2335699 - RNA, 19 nt, Human
ccagcaggcucucaggcca

SEQ ID NO: 2335700 - RNA, 20 nt, Human
ccagcaggcucucaggccag

SEQ ID NO: 2335701 - RNA, 21 nt, Human
ccagcaggcucucaggccagc

SEQ ID NO: 2335702 - RNA, 23 nt, Human
ccagcaggcucucaggccagcug

SEQ ID NO: 2335703 - RNA, 16 nt, Human
ccagcccagcccagcu

SEQ ID NO: 2335704 - RNA, 13 nt, Human
ccagcccagggcu

SEQ ID NO: 2335705 - RNA, 14 nt, Human
ccagcccagggcuc

SEQ ID NO: 2335706 - RNA, 15 nt, Human
ccagcccagggcucc

SEQ ID NO: 2335707 - RNA, 13 nt, Human
ccagcccagcugg

SEQ ID NO: 2335708 - RNA, 14 nt, Human
ccagcccagcccag

SEQ ID NO: 2335709 - RNA, 12 nt, Human
ccagcccagccc

SEQ ID NO: 2335710 - RNA, 15 nt, Human
ccagcccagauguuu

SEQ ID NO: 2335711 - RNA, 14 nt, Human
ccagcccagauguu

SEQ ID NO: 2335712 - RNA, 23 nt, Human
ccagcccagagacauacuugaag

SEQ ID NO: 2335713 - RNA, 22 nt, Human
ccagcccagagacauacuugaa

SEQ ID NO: 2335714 - RNA, 14 nt, Human
ccagcccagagaca

SEQ ID NO: 2335715 - RNA, 13 nt, Human
ccagcccagagac

SEQ ID NO: 2335716 - RNA, 12 nt, Human
ccagcccagaga

SEQ ID NO: 2335717 - RNA, 11 nt, Human
ccagcccagag

SEQ ID NO: 2335718 - RNA, 16 nt, Human
ccagcccacuucugcc

SEQ ID NO: 2335719 - RNA, 17 nt, Human
ccagcccacuucugcca

SEQ ID NO: 2335720 - RNA, 22 nt, Human
ccagcccacccuccugucuucc

SEQ ID NO: 2335721 - RNA, 18 nt, Human
ccagcccacccuccuguc

SEQ ID NO: 2335722 - RNA, 19 nt, Human
ccagcccacccuccugucu

SEQ ID NO: 2335723 - RNA, 13 nt, Human
ccagcccacccuc

SEQ ID NO: 2335724 - RNA, 14 nt, Human
ccagcccacccucc

SEQ ID NO: 2335725 - RNA, 14 nt, Human
ccagcccaagucca

SEQ ID NO: 2335726 - RNA, 21 nt, Human
ccagcccaggguucccccagc

SEQ ID NO: 2335727 - RNA, 18 nt, Human
ccagcccaggguuccccc

SEQ ID NO: 2335728 - RNA, 14 nt, Human
ccagcccagggugg

SEQ ID NO: 2335729 - RNA, 12 nt, Human
ccagcccagggu

SEQ ID NO: 2335730 - RNA, 18 nt, Human
ccagcccagcccagcugg

SEQ ID NO: 2335731 - RNA, 21 nt, Human
ccagcccagggcuccugcacu

SEQ ID NO: 2335732 - RNA, 17 nt, Human
ccagcccagggcuccug

SEQ ID NO: 2335733 - RNA, 19 nt, Human
ccagcccagggcuccugca

SEQ ID NO: 2335734 - RNA, 21 nt, Human
ccagcccauucucucuccugu

SEQ ID NO: 2335735 - RNA, 19 nt, Human
ccagcccauucucucuccu

SEQ ID NO: 2335736 - RNA, 17 nt, Human
ccagcccauucucucuc

SEQ ID NO: 2335737 - RNA, 22 nt, Human
ccagcccauucucucuccuguc

SEQ ID NO: 2335738 - RNA, 19 nt, Human
ccagccccaaaacucuccu

SEQ ID NO: 2335739 - RNA, 18 nt, Human
ccagcccugaguuccuag

SEQ ID NO: 2335740 - RNA, 14 nt, Human
ccagcccugaguuc

SEQ ID NO: 2335741 - RNA, 11 nt, Human
ccagcccugcu

SEQ ID NO: 2335742 - RNA, 13 nt, Human
ccagcccugcugg

SEQ ID NO: 2335743 - RNA, 14 nt, Human
ccagcccugcuggc

SEQ ID NO: 2335744 - RNA, 15 nt, Human
ccagcccugcuggcc

SEQ ID NO: 2335745 - RNA, 24 nt, Human
ccagcccugcuggccgccucaccc

SEQ ID NO: 2335746 - RNA, 16 nt, Human
ccagcccugcuggccg

SEQ ID NO: 2335747 - RNA, 18 nt, Human
ccagcccugcuggccgcc

SEQ ID NO: 2335748 - RNA, 21 nt, Human
ccagcccugcuggccgccuca

SEQ ID NO: 2335749 - RNA, 13 nt, Human
ccagcccuggcuc

SEQ ID NO: 2335750 - RNA, 17 nt, Human
ccagcccuggcucugca

SEQ ID NO: 2335751 - RNA, 14 nt, Human
ccagcccuggcuga

SEQ ID NO: 2335752 - RNA, 17 nt, Human
ccagcccuggcugaagg

SEQ ID NO: 2335753 - RNA, 18 nt, Human
ccagcccuggcugaagga

SEQ ID NO: 2335754 - RNA, 23 nt, Human
ccagccgccauugccaccaggag

SEQ ID NO: 2335755 - RNA, 20 nt, Human
ccagccgccauugccaccag

SEQ ID NO: 2335756 - RNA, 16 nt, Human
ccagccgcucggaggc

SEQ ID NO: 2335757 - RNA, 19 nt, Human
ccagccgcucggaggcccc

SEQ ID NO: 2335758 - RNA, 23 nt, Human
ccagccgcugcccggcgcccucu

SEQ ID NO: 2335759 - RNA, 14 nt, Human
ccagccgcugcccg

SEQ ID NO: 2335760 - RNA, 16 nt, Human
ccagccgcugcccggc

SEQ ID NO: 2335761 - RNA, 23 nt, Human
ccagccggccucucuggccuccc

SEQ ID NO: 2335762 - RNA, 22 nt, Human
ccagccgguaccugggaagggg

SEQ ID NO: 2335763 - RNA, 18 nt, Human
ccagccgugaugcucagg

SEQ ID NO: 2335764 - RNA, 19 nt, Human
ccagccgugaugcucaggc

SEQ ID NO: 2335765 - RNA, 13 nt, Human
ccagccggcaugg

SEQ ID NO: 2335766 - RNA, 14 nt, Human
ccagccggcauggc

SEQ ID NO: 2335767 - RNA, 13 nt, Human
ccagccggccucu

SEQ ID NO: 2335768 - RNA, 14 nt, Human
ccagccggccucuc

SEQ ID NO: 2335769 - RNA, 20 nt, Human
ccagccggccucucuggccu

SEQ ID NO: 2335770 - RNA, 22 nt, Human
ccagccggccucucuggccucc

SEQ ID NO: 2335771 - RNA, 17 nt, Human
ccagccgagauagccaa

SEQ ID NO: 2335772 - RNA, 21 nt, Human
ccagcccuggcugaaggacug

SEQ ID NO: 2335773 - RNA, 13 nt, Human
ccagcccuggucu

SEQ ID NO: 2335774 - RNA, 20 nt, Human
ccagcccuggucucagcagc

SEQ ID NO: 2335775 - RNA, 20 nt, Human
ccagccgagauagccaaggc

SEQ ID NO: 2335776 - RNA, 22 nt, Human
ccagccgagauagccaaggcca

SEQ ID NO: 2335777 - RNA, 13 nt, Human
ccagauuuacacu

SEQ ID NO: 2335778 - RNA, 21 nt, Human
ccagauuugcuaauuuauccu

SEQ ID NO: 2335779 - RNA, 18 nt, Human
ccagauuuugcuguauau

SEQ ID NO: 2335780 - RNA, 19 nt, Human
ccagauuuacacugggaga

SEQ ID NO: 2335781 - RNA, 24 nt, Human
ccagauuuuuuacagcugccugca

SEQ ID NO: 2335782 - RNA, 15 nt, Human
ccagauuuugcugua

SEQ ID NO: 2335783 - RNA, 16 nt, Human
ccagauuuuuacacau

SEQ ID NO: 2335784 - RNA, 21 nt, Human
ccagcaaagagugggcugcau

SEQ ID NO: 2335785 - RNA, 15 nt, Human
ccagcaaaagguugu

SEQ ID NO: 2335786 - RNA, 13 nt, Human
ccagcaaagcccc

SEQ ID NO: 2335787 - RNA, 14 nt, Human
ccagcaaagcccca

SEQ ID NO: 2335788 - RNA, 19 nt, Human
ccagcaaagccccaugcug

SEQ ID NO: 2335789 - RNA, 21 nt, Human
ccagcaaagccccaugcugga

SEQ ID NO: 2335790 - RNA, 22 nt, Human
ccagcaaagccccaugcuggag

SEQ ID NO: 2335791 - RNA, 15 nt, Human
ccagcaacacaagcu

SEQ ID NO: 2335792 - RNA, 15 nt, Human
ccagcaacccuccua

SEQ ID NO: 2335793 - RNA, 17 nt, Human
ccagcaacccuccuauc

SEQ ID NO: 2335794 - RNA, 16 nt, Human
ccagcacacagggcag

SEQ ID NO: 2335795 - RNA, 13 nt, Human
ccagcacaugaaa

SEQ ID NO: 2335796 - RNA, 19 nt, Human
ccagcaccaacaccacggu

SEQ ID NO: 2335797 - RNA, 13 nt, Human
ccagcacagcuug

SEQ ID NO: 2335798 - RNA, 17 nt, Human
ccagcacagcuugaccu

SEQ ID NO: 2335799 - RNA, 17 nt, Human
ccagcaagugagagcug

SEQ ID NO: 2335800 - RNA, 21 nt, Human
ccagcaacacaagcuggaagc

SEQ ID NO: 2335801 - RNA, 18 nt, Human
ccagcaagugagagcugg

SEQ ID NO: 2335802 - RNA, 19 nt, Human
ccagcaagugagagcuggg

SEQ ID NO: 2335803 - RNA, 17 nt, Human
ccagcacuaaagcagug

SEQ ID NO: 2335804 - RNA, 15 nt, Human
ccagcaccuggcauc

SEQ ID NO: 2335805 - RNA, 16 nt, Human
ccagcaggcucucagg

SEQ ID NO: 2335806 - RNA, 17 nt, Human
ccagcaggcucucaggc

SEQ ID NO: 2335807 - RNA, 18 nt, Human
ccagcaggcucucaggcc

SEQ ID NO: 2335808 - RNA, 18 nt, Human
ccagcacccagcaacucc

SEQ ID NO: 2335809 - RNA, 17 nt, Human
ccagcacccgggcucag

SEQ ID NO: 2335810 - RNA, 14 nt, Human
ccagcacccgggcu

SEQ ID NO: 2335811 - RNA, 14 nt, Human
ccagcacccagcaa

SEQ ID NO: 2335812 - RNA, 22 nt, Human
ccagcaccauccgccagggccc

SEQ ID NO: 2335813 - RNA, 23 nt, Human
ccagcacccgggcucagggacca

SEQ ID NO: 2335814 - RNA, 18 nt, Human
ccagcacccgggcucagg

SEQ ID NO: 2335815 - RNA, 20 nt, Human
ccagcacccgggcucaggga

SEQ ID NO: 2335816 - RNA, 17 nt, Human
ccagcaccaucucuccu

SEQ ID NO: 2335817 - RNA, 18 nt, Human
ccagcaccaucucuccuc

SEQ ID NO: 2335818 - RNA, 19 nt, Human
ccagagccccacacggagg

SEQ ID NO: 2335819 - RNA, 18 nt, Human
ccagagccccacacggag

SEQ ID NO: 2335820 - RNA, 14 nt, Human
ccagagccccacac

SEQ ID NO: 2335821 - RNA, 16 nt, Human
ccagagcccagcucca

SEQ ID NO: 2335822 - RNA, 15 nt, Human
ccagagccauggacu

SEQ ID NO: 2335823 - RNA, 13 nt, Human
ccagagccaugga

SEQ ID NO: 2335824 - RNA, 21 nt, Human
ccagagccauggacucuacac

SEQ ID NO: 2335825 - RNA, 18 nt, Human
ccagagcccagcuccaag

SEQ ID NO: 2335826 - RNA, 17 nt, Human
ccagagcccagcuccaa

SEQ ID NO: 2335827 - RNA, 14 nt, Human
ccagagcccaccuu

SEQ ID NO: 2335828 - RNA, 14 nt, Human
ccagauugcaacag

SEQ ID NO: 2335829 - RNA, 16 nt, Human
ccagauugcaacaggc

SEQ ID NO: 2335830 - RNA, 21 nt, Human
ccagagcgccccucccuagug

SEQ ID NO: 2335831 - RNA, 19 nt, Human
ccagagcgugggagacggu

SEQ ID NO: 2335832 - RNA, 13 nt, Human
ccagauugacgac

SEQ ID NO: 2335833 - RNA, 23 nt, Human
ccagauugcaacaggcugggcuu

SEQ ID NO: 2335834 - RNA, 16 nt, Human
ccagauuggcucacac

SEQ ID NO: 2335835 - RNA, 21 nt, Human
ccagauugacgacaagugcug

SEQ ID NO: 2335836 - RNA, 18 nt, Human
ccagauugacgacaagug

SEQ ID NO: 2335837 - RNA, 19 nt, Human
ccagauugacgacaagugc

SEQ ID NO: 2335838 - RNA, 18 nt, Human
ccagauugcaacaggcug

SEQ ID NO: 2335839 - RNA, 22 nt, Human
ccagauugcaacaggcugggcu

SEQ ID NO: 2335840 - RNA, 18 nt, Human
ccagauuucacucuccuu

SEQ ID NO: 2335841 - RNA, 19 nt, Human
ccagauuucacucuccuug

SEQ ID NO: 2335842 - RNA, 15 nt, Human
ccagauuucacucuc

SEQ ID NO: 2335843 - RNA, 19 nt, Human
ccagauuggcucacacuga

SEQ ID NO: 2335844 - RNA, 20 nt, Human
ccagauuggcucacacugag

SEQ ID NO: 2335845 - RNA, 21 nt, Human
ccagauuggcucacacugaga

SEQ ID NO: 2335846 - RNA, 22 nt, Human
ccagauuggcucacacugagaa

SEQ ID NO: 2335847 - RNA, 23 nt, Human
cccacagacucaaaugcucagac

SEQ ID NO: 2335848 - RNA, 13 nt, Human
cccacagacucaa

SEQ ID NO: 2335849 - RNA, 11 nt, Human
cccacagccca

SEQ ID NO: 2335850 - RNA, 15 nt, Human
cccacagcccacguc

SEQ ID NO: 2335851 - RNA, 13 nt, Human
cccacagcgcugg

SEQ ID NO: 2335852 - RNA, 18 nt, Human
cccacagcccacguccug

SEQ ID NO: 2335853 - RNA, 19 nt, Human
cccacagcccacguccugu

SEQ ID NO: 2335854 - RNA, 22 nt, Human
cccacagcccacguccugucag

SEQ ID NO: 2335855 - RNA, 17 nt, Human
cccacaggaucagucug

SEQ ID NO: 2335856 - RNA, 13 nt, Human
cccacaggaucag

SEQ ID NO: 2335857 - RNA, 19 nt, Human
cccacauagugaugguucc

SEQ ID NO: 2335858 - RNA, 20 nt, Human
cccacaucccaggcuucacc

SEQ ID NO: 2335859 - RNA, 13 nt, Human
cccacaucccagg

SEQ ID NO: 2335860 - RNA, 14 nt, Human
cccacaucccaggc

SEQ ID NO: 2335861 - RNA, 16 nt, Human
cccacaucccaggcuu

SEQ ID NO: 2335862 - RNA, 14 nt, Human
cccacaggcagcuu

SEQ ID NO: 2335863 - RNA, 12 nt, Human
cccacaggcagc

SEQ ID NO: 2335864 - RNA, 13 nt, Human
cccacaggcagcu

SEQ ID NO: 2335865 - RNA, 22 nt, Human
cccacagugacucgggcuccug

SEQ ID NO: 2335866 - RNA, 23 nt, Human
cccacagugacucgggcuccugu

SEQ ID NO: 2335867 - RNA, 15 nt, Human
cccacagugcugucu

SEQ ID NO: 2335868 - RNA, 16 nt, Human
cccacaggcccuuccu

SEQ ID NO: 2335869 - RNA, 18 nt, Human
cccacaggcccuuccucu

SEQ ID NO: 2335870 - RNA, 19 nt, Human
cccaagugggggcagaggg

SEQ ID NO: 2335871 - RNA, 14 nt, Human
cccaagugggggca

SEQ ID NO: 2335872 - RNA, 16 nt, Human
cccaaguggcagagcu

SEQ ID NO: 2335873 - RNA, 18 nt, Human
cccaagugccagucuugu

SEQ ID NO: 2335874 - RNA, 15 nt, Human
cccaagugccagucu

SEQ ID NO: 2335875 - RNA, 23 nt, Human
cccaaguccugaagaggcgggcc

SEQ ID NO: 2335876 - RNA, 23 nt, Human
cccaagucccuguuuucugagcc

SEQ ID NO: 2335877 - RNA, 13 nt, Human
cccaaguccugaa

SEQ ID NO: 2335878 - RNA, 16 nt, Human
cccaaguccugaagag

SEQ ID NO: 2335879 - RNA, 17 nt, Human
cccaaguccugaagagg

SEQ ID NO: 2335880 - RNA, 17 nt, Human
cccacacuuguuccagc

SEQ ID NO: 2335881 - RNA, 22 nt, Human
cccacacuggggugccgccugc

SEQ ID NO: 2335882 - RNA, 11 nt, Human
cccacacuccu

SEQ ID NO: 2335883 - RNA, 14 nt, Human
cccacacuccuaca

SEQ ID NO: 2335884 - RNA, 19 nt, Human
cccacacuggggugccgcc

SEQ ID NO: 2335885 - RNA, 21 nt, Human
cccacagaaagacugagcuca

SEQ ID NO: 2335886 - RNA, 19 nt, Human
cccacacuuguuccagcuc

SEQ ID NO: 2335887 - RNA, 23 nt, Human
cccacagaaagacugagcucaag

SEQ ID NO: 2335888 - RNA, 19 nt, Human
cccacacuugagaggauga

SEQ ID NO: 2335889 - RNA, 18 nt, Human
cccaagucccuguuuucu

SEQ ID NO: 2335890 - RNA, 20 nt, Human
cccaaguccaaauguuuaca

SEQ ID NO: 2335891 - RNA, 12 nt, Human
cccaaguccaaa

SEQ ID NO: 2335892 - RNA, 23 nt, Human
cccaagguuuaaacuucucugaa

SEQ ID NO: 2335893 - RNA, 22 nt, Human
cccaaguagggggucuaaaauu

SEQ ID NO: 2335894 - RNA, 21 nt, Human
cccaaggggcagucuggaggg

SEQ ID NO: 2335895 - RNA, 15 nt, Human
cccaaggggcagucu

SEQ ID NO: 2335896 - RNA, 21 nt, Human
cccaagggcaaaauucccagg

SEQ ID NO: 2335897 - RNA, 22 nt, Human
cccaagggcaaaauucccaggg

SEQ ID NO: 2335898 - RNA, 16 nt, Human
cccaagggccuggccu

SEQ ID NO: 2335899 - RNA, 23 nt, Human
cccaagggaucugguccuaccca

SEQ ID NO: 2335900 - RNA, 19 nt, Human
cccaagggcaaaauuccca

SEQ ID NO: 2335901 - RNA, 11 nt, Human
ccauuuuuccu

SEQ ID NO: 2335902 - RNA, 17 nt, Human
ccauuuuuuaaggaaac

SEQ ID NO: 2335903 - RNA, 19 nt, Human
ccauuuuuuaaggaaacaa

SEQ ID NO: 2335904 - RNA, 12 nt, Human
ccauuuuuuccu

SEQ ID NO: 2335905 - RNA, 19 nt, Human
ccauuuugcccuuccauag

SEQ ID NO: 2335906 - RNA, 13 nt, Human
ccauuuugugaau

SEQ ID NO: 2335907 - RNA, 14 nt, Human
ccauuuugugaaug

SEQ ID NO: 2335908 - RNA, 12 nt, Human
ccauuuugugaa

SEQ ID NO: 2335909 - RNA, 21 nt, Human
ccauuuuguauuuuacuaaua

SEQ ID NO: 2335910 - RNA, 16 nt, Human
ccauuuugcccuucca

SEQ ID NO: 2335911 - RNA, 21 nt, Human
ccauuuugcaaaauuuccagu

SEQ ID NO: 2335912 - RNA, 17 nt, Human
ccauuuugcaaaauuuc

SEQ ID NO: 2335913 - RNA, 14 nt, Human
ccauuuugcaaaau

SEQ ID NO: 2335914 - RNA, 12 nt, Human
ccauuuucugug

SEQ ID NO: 2335915 - RNA, 13 nt, Human
ccauuuucugugg

SEQ ID NO: 2335916 - RNA, 20 nt, Human
ccauuuugcugucccuuuuc

SEQ ID NO: 2335917 - RNA, 14 nt, Human
cccaacccccaccc

SEQ ID NO: 2335918 - RNA, 22 nt, Human
cccaaccccagccgcucggagg

SEQ ID NO: 2335919 - RNA, 12 nt, Human
cccaacccccag

SEQ ID NO: 2335920 - RNA, 13 nt, Human
cccaacccccacc

SEQ ID NO: 2335921 - RNA, 12 nt, Human
cccaacccccac

SEQ ID NO: 2335922 - RNA, 13 nt, Human
cccaacccccagc

SEQ ID NO: 2335923 - RNA, 14 nt, Human
cccaacccccagca

SEQ ID NO: 2335924 - RNA, 15 nt, Human
cccaacccccagcac

SEQ ID NO: 2335925 - RNA, 12 nt, Human
cccaaccccuga

SEQ ID NO: 2335926 - RNA, 13 nt, Human
cccaaccccugag

SEQ ID NO: 2335927 - RNA, 14 nt, Human
cccaaccccugagg

SEQ ID NO: 2335928 - RNA, 15 nt, Human
cccaaccccugagga

SEQ ID NO: 2335929 - RNA, 16 nt, Human
cccaaccccugaggaa

SEQ ID NO: 2335930 - RNA, 12 nt, Human
cccaagggccug

SEQ ID NO: 2335931 - RNA, 14 nt, Human
cccaagggccuggc

SEQ ID NO: 2335932 - RNA, 12 nt, Human
cccaaccccagc

SEQ ID NO: 2335933 - RNA, 19 nt, Human
cccaacagugugaaguuag

SEQ ID NO: 2335934 - RNA, 18 nt, Human
cccaacaggaggacaauu

SEQ ID NO: 2335935 - RNA, 19 nt, Human
cccaacaggaggacaauuc

SEQ ID NO: 2335936 - RNA, 20 nt, Human
cccaacaggaggacaauuca

SEQ ID NO: 2335937 - RNA, 12 nt, Human
cccaacagugug

SEQ ID NO: 2335938 - RNA, 13 nt, Human
cccaacaguguga

SEQ ID NO: 2335939 - RNA, 14 nt, Human
cccaacagugugaa

SEQ ID NO: 2335940 - RNA, 15 nt, Human
cccaacagugugaag

SEQ ID NO: 2335941 - RNA, 16 nt, Human
cccaacagugugaagu

SEQ ID NO: 2335942 - RNA, 16 nt, Human
cccaacaggaggacaa

SEQ ID NO: 2335943 - RNA, 17 nt, Human
cccaacaggaggacaau

SEQ ID NO: 2335944 - RNA, 22 nt, Human
cccaacacugugcccuggugga

SEQ ID NO: 2335945 - RNA, 19 nt, Human
cccaacagaugcuuuucug

SEQ ID NO: 2335946 - RNA, 19 nt, Human
cccaacagcgacauagccc

SEQ ID NO: 2335947 - RNA, 23 nt, Human
cccaacagcgacauagcccaucc

SEQ ID NO: 2335948 - RNA, 12 nt, Human
cccaacacugug

SEQ ID NO: 2335949 - RNA, 13 nt, Human
cccaacacugugc

SEQ ID NO: 2335950 - RNA, 15 nt, Human
cccaacacugugccc

SEQ ID NO: 2335951 - RNA, 16 nt, Human
cccaacacugugcccu

SEQ ID NO: 2335952 - RNA, 18 nt, Human
cccaacacugugcccugg

SEQ ID NO: 2335953 - RNA, 19 nt, Human
cccaacacugugcccuggu

SEQ ID NO: 2335954 - RNA, 20 nt, Human
cccaacacugugcccuggug

SEQ ID NO: 2335955 - RNA, 21 nt, Human
cccaacacugugcccuggugg

SEQ ID NO: 2335956 - RNA, 13 nt, Human
cccacguccuguc

SEQ ID NO: 2335957 - RNA, 15 nt, Human
cccacguccugucag

SEQ ID NO: 2335958 - RNA, 17 nt, Human
cccacguccugucagug

SEQ ID NO: 2335959 - RNA, 19 nt, Human
cccacggggccucgggacc

SEQ ID NO: 2335960 - RNA, 13 nt, Human
cccacgcuucucu

SEQ ID NO: 2335961 - RNA, 20 nt, Human
cccacggagucguggggugu

SEQ ID NO: 2335962 - RNA, 14 nt, Human
cccacggccgcucc

SEQ ID NO: 2335963 - RNA, 16 nt, Human
cccacggccgcuccag

SEQ ID NO: 2335964 - RNA, 17 nt, Human
cccacggccgcuccagg

SEQ ID NO: 2335965 - RNA, 21 nt, Human
cccacggccgcuccaggggug

SEQ ID NO: 2335966 - RNA, 22 nt, Human
cccagaauaaguuauugcaguu

SEQ ID NO: 2335967 - RNA, 12 nt, Human
cccagaaucaaa

SEQ ID NO: 2335968 - RNA, 16 nt, Human
cccagaaugaggcugc

SEQ ID NO: 2335969 - RNA, 24 nt, Human
cccagaauaaacuggcagcucagc

SEQ ID NO: 2335970 - RNA, 19 nt, Human
cccagaauaaguuauugca

SEQ ID NO: 2335971 - RNA, 15 nt, Human
cccacguucucacac

SEQ ID NO: 2335972 - RNA, 16 nt, Human
cccacguucucacacc

SEQ ID NO: 2335973 - RNA, 22 nt, Human
cccagaauaaacuggcagcuca

SEQ ID NO: 2335974 - RNA, 19 nt, Human
cccacguccugucagugcc

SEQ ID NO: 2335975 - RNA, 22 nt, Human
cccacguccugucagugccgcc

SEQ ID NO: 2335976 - RNA, 12 nt, Human
cccacgugggag

SEQ ID NO: 2335977 - RNA, 17 nt, Human
cccacgcccuccccucc

SEQ ID NO: 2335978 - RNA, 22 nt, Human
cccaccuucaauuccugggccc

SEQ ID NO: 2335979 - RNA, 12 nt, Human
cccaccugucuu

SEQ ID NO: 2335980 - RNA, 17 nt, Human
cccacgcccccacuggu

SEQ ID NO: 2335981 - RNA, 19 nt, Human
cccacgcccccacugguga

SEQ ID NO: 2335982 - RNA, 15 nt, Human
cccaccuuggcucaa

SEQ ID NO: 2335983 - RNA, 22 nt, Human
cccaccuuggcucaaguccucu

SEQ ID NO: 2335984 - RNA, 14 nt, Human
cccaccuuggcugc

SEQ ID NO: 2335985 - RNA, 15 nt, Human
cccaccuuggcugca

SEQ ID NO: 2335986 - RNA, 20 nt, Human
cccaccugguggccucugcc

SEQ ID NO: 2335987 - RNA, 13 nt, Human
cccaccugggacc

SEQ ID NO: 2335988 - RNA, 22 nt, Human
cccaccucuccccaccuuaccc

SEQ ID NO: 2335989 - RNA, 19 nt, Human
cccaccucucucacuccuu

SEQ ID NO: 2335990 - RNA, 21 nt, Human
cccaccuucaauuccugggcc

SEQ ID NO: 2335991 - RNA, 20 nt, Human
cccaccuucaauuccugggc

SEQ ID NO: 2335992 - RNA, 19 nt, Human
cccaccuucaauuccuggg

SEQ ID NO: 2335993 - RNA, 23 nt, Human
cccaccugucaaacaaagccaga

SEQ ID NO: 2335994 - RNA, 22 nt, Human
cccaccugucaaacaaagccag

SEQ ID NO: 2335995 - RNA, 12 nt, Human
cccaccuuggcu

SEQ ID NO: 2335996 - RNA, 21 nt, Human
cccaccucagccucccaaagu

SEQ ID NO: 2335997 - RNA, 13 nt, Human
cccaccucucuca

SEQ ID NO: 2335998 - RNA, 14 nt, Human
cccaccucucucac

SEQ ID NO: 2335999 - RNA, 17 nt, Human
cccaccucucucacucc

SEQ ID NO: 2336000 - RNA, 16 nt, Human
cccaccuaugugccaa

SEQ ID NO: 2336001 - RNA, 19 nt, Human
cccaccgugggcagggagc

SEQ ID NO: 2336002 - RNA, 20 nt, Human
cccaccguggaggaggaagg

SEQ ID NO: 2336003 - RNA, 12 nt, Human
cccaccucagcc

SEQ ID NO: 2336004 - RNA, 14 nt, Human
cccaccucagccuc

SEQ ID NO: 2336005 - RNA, 15 nt, Human
cccaccucagccucc

SEQ ID NO: 2336006 - RNA, 15 nt, Human
cccaccguccgcccu

SEQ ID NO: 2336007 - RNA, 17 nt, Human
cccaccguccgcccugc

SEQ ID NO: 2336008 - RNA, 17 nt, Human
cccaccgugggcaggga

SEQ ID NO: 2336009 - RNA, 15 nt, Human
cccaccgugggcagg

SEQ ID NO: 2336010 - RNA, 19 nt, Human
cccaccguccgcccugcuc

SEQ ID NO: 2336011 - RNA, 21 nt, Human
cccaccguccgcccugcuccu

SEQ ID NO: 2336012 - RNA, 23 nt, Human
cccaccguccgcccugcuccucc

SEQ ID NO: 2336013 - RNA, 19 nt, Human
cccaccguggaggaggaag

SEQ ID NO: 2336014 - RNA, 18 nt, Human
cccacaugaggacaugau

SEQ ID NO: 2336015 - RNA, 13 nt, Human
ccaucucuuccua

SEQ ID NO: 2336016 - RNA, 21 nt, Human
ccaucucuuccuacccaacca

SEQ ID NO: 2336017 - RNA, 12 nt, Human
ccaucugugaau

SEQ ID NO: 2336018 - RNA, 22 nt, Human
ccaucugugggcacgcuguggg

SEQ ID NO: 2336019 - RNA, 14 nt, Human
ccaucugucccugc

SEQ ID NO: 2336020 - RNA, 16 nt, Human
ccaucugugcacgcag

SEQ ID NO: 2336021 - RNA, 15 nt, Human
ccaucugugaauaag

SEQ ID NO: 2336022 - RNA, 14 nt, Human
ccaucugugaauaa

SEQ ID NO: 2336023 - RNA, 20 nt, Human
ccaucucucuacuccuaccu

SEQ ID NO: 2336024 - RNA, 13 nt, Human
ccaucucucuggc

SEQ ID NO: 2336025 - RNA, 14 nt, Human
ccaucucucuggcc

SEQ ID NO: 2336026 - RNA, 16 nt, Human
ccaucucucuggcccu

SEQ ID NO: 2336027 - RNA, 18 nt, Human
ccaucucugauuuucaaa

SEQ ID NO: 2336028 - RNA, 23 nt, Human
ccaucucugauuuucaaagcuuu

SEQ ID NO: 2336029 - RNA, 12 nt, Human
ccaucucuggau

SEQ ID NO: 2336030 - RNA, 15 nt, Human
ccaucucuggaugcc

SEQ ID NO: 2336031 - RNA, 18 nt, Human
ccaucucuggaugccuga

SEQ ID NO: 2336032 - RNA, 22 nt, Human
ccaucucuggaugccugauugc

SEQ ID NO: 2336033 - RNA, 19 nt, Human
ccaucuguuuggugggggu

SEQ ID NO: 2336034 - RNA, 15 nt, Human
ccaucuuaguuugga

SEQ ID NO: 2336035 - RNA, 15 nt, Human
ccaucuucagcuucu

SEQ ID NO: 2336036 - RNA, 14 nt, Human
ccaucuuccaggug

SEQ ID NO: 2336037 - RNA, 13 nt, Human
ccaucuucccagc

SEQ ID NO: 2336038 - RNA, 15 nt, Human
ccaucuuccaggugg

SEQ ID NO: 2336039 - RNA, 16 nt, Human
ccaucuuccagguggg

SEQ ID NO: 2336040 - RNA, 12 nt, Human
ccaugugugugc

SEQ ID NO: 2336041 - RNA, 10 nt, Human
ccaugugugu

SEQ ID NO: 2336042 - RNA, 15 nt, Human
ccauguguggacuca

SEQ ID NO: 2336043 - RNA, 18 nt, Human
ccaugugugagugugugc

SEQ ID NO: 2336044 - RNA, 17 nt, Human
ccaugugugagugugug

SEQ ID NO: 2336045 - RNA, 11 nt, Human
ccaugugugag

SEQ ID NO: 2336046 - RNA, 17 nt, Human
ccauguguccugguucc

SEQ ID NO: 2336047 - RNA, 13 nt, Human
ccaucuugguaaa

SEQ ID NO: 2336048 - RNA, 14 nt, Human
ccauguguccuggu

SEQ ID NO: 2336049 - RNA, 20 nt, Human
ccaucuugcuucccuaaucu

SEQ ID NO: 2336050 - RNA, 21 nt, Human
ccaucuugcuucccuaaucua

SEQ ID NO: 2336051 - RNA, 19 nt, Human
ccaugugugugcaagugug

SEQ ID NO: 2336052 - RNA, 18 nt, Human
ccauguuaguuuuuacuu

SEQ ID NO: 2336053 - RNA, 22 nt, Human
ccauguuaauuucaugugucaa

SEQ ID NO: 2336054 - RNA, 18 nt, Human
ccauguuccaauaaacag

SEQ ID NO: 2336055 - RNA, 22 nt, Human
ccauguucacaccgcugcacuc

SEQ ID NO: 2336056 - RNA, 17 nt, Human
ccauguuccaauaaaca

SEQ ID NO: 2336057 - RNA, 23 nt, Human
ccauguucuauuucagugccaau

SEQ ID NO: 2336058 - RNA, 18 nt, Human
ccauguuuuguuuacggu

SEQ ID NO: 2336059 - RNA, 13 nt, Human
ccauguugcugcc

SEQ ID NO: 2336060 - RNA, 14 nt, Human
ccauguugcugcca

SEQ ID NO: 2336061 - RNA, 15 nt, Human
ccauuaaaacugaag

SEQ ID NO: 2336062 - RNA, 20 nt, Human
ccauuaaaacugaagucuga

SEQ ID NO: 2336063 - RNA, 21 nt, Human
ccauuaaaacugaagucugaa

SEQ ID NO: 2336064 - RNA, 23 nt, Human
ccauuaaaacugaagucugaaau

SEQ ID NO: 2336065 - RNA, 14 nt, Human
ccauuaccauggag

SEQ ID NO: 2336066 - RNA, 12 nt, Human
ccauuacccuca

SEQ ID NO: 2336067 - RNA, 23 nt, Human
ccauuagaagauauuagucuugg

SEQ ID NO: 2336068 - RNA, 22 nt, Human
ccauuaaagucgagcuuuucua

SEQ ID NO: 2336069 - RNA, 15 nt, Human
ccauuaaaguucuca

SEQ ID NO: 2336070 - RNA, 22 nt, Human
ccauuaaaacugaagucugaaa

SEQ ID NO: 2336071 - RNA, 17 nt, Human
ccauucugaccauuuca

SEQ ID NO: 2336072 - RNA, 20 nt, Human
ccauucugacucgguuucuc

SEQ ID NO: 2336073 - RNA, 15 nt, Human
ccauucugccugccc

SEQ ID NO: 2336074 - RNA, 20 nt, Human
ccauucugccuccauucuga

SEQ ID NO: 2336075 - RNA, 15 nt, Human
ccauuugaaagaaag

SEQ ID NO: 2336076 - RNA, 20 nt, Human
ccauuugcagaguccugcac

SEQ ID NO: 2336077 - RNA, 18 nt, Human
ccauuuuagucacuuuuu

SEQ ID NO: 2336078 - RNA, 19 nt, Human
ccauuuuagucacuuuuuu

SEQ ID NO: 2336079 - RNA, 16 nt, Human
ccauuugcuuuuucac

SEQ ID NO: 2336080 - RNA, 13 nt, Human
ccauuugcuccuu

SEQ ID NO: 2336081 - RNA, 21 nt, Human
ccauuugcguuccaugaugcu

SEQ ID NO: 2336082 - RNA, 24 nt, Human
ccauuccugguacccagccaucug

SEQ ID NO: 2336083 - RNA, 14 nt, Human
ccauucuacacaga

SEQ ID NO: 2336084 - RNA, 17 nt, Human
ccauuaugaagaagaga

SEQ ID NO: 2336085 - RNA, 14 nt, Human
ccauuaucccugaa

SEQ ID NO: 2336086 - RNA, 21 nt, Human
ccauuaucccugaaucccccu

SEQ ID NO: 2336087 - RNA, 14 nt, Human
ccauuaucaugugu

SEQ ID NO: 2336088 - RNA, 15 nt, Human
ccauuaucaugugua

SEQ ID NO: 2336089 - RNA, 16 nt, Human
ccauuaucauguguaa

SEQ ID NO: 2336090 - RNA, 16 nt, Human
ccauuagagucagccu

SEQ ID NO: 2336091 - RNA, 19 nt, Human
ccauuagcuuucaauuccg

SEQ ID NO: 2336092 - RNA, 15 nt, Human
ccauguugcugccaa

SEQ ID NO: 2336093 - RNA, 13 nt, Human
ccauuaucaugug

SEQ ID NO: 2336094 - RNA, 22 nt, Human
ccauuaggacaaucaguccccu

SEQ ID NO: 2336095 - RNA, 17 nt, Human
ccauucucaagcccugc

SEQ ID NO: 2336096 - RNA, 18 nt, Human
ccauucucaagcccugca

SEQ ID NO: 2336097 - RNA, 18 nt, Human
ccauucuccacagcaacc

SEQ ID NO: 2336098 - RNA, 16 nt, Human
ccauucuccacagcaa

SEQ ID NO: 2336099 - RNA, 15 nt, Human
ccauucuccacagca

SEQ ID NO: 2336100 - RNA, 13 nt, Human
ccauucuccacag

SEQ ID NO: 2336101 - RNA, 23 nt, Human
ccauucucccagguaccagcugc

SEQ ID NO: 2336102 - RNA, 14 nt, Human
ccauucucucuccu

SEQ ID NO: 2336103 - RNA, 16 nt, Human
ccauucugaccauuuc

SEQ ID NO: 2336104 - RNA, 20 nt, Human
ccauucucucuccuguccaa

SEQ ID NO: 2336105 - RNA, 19 nt, Human
ccauucucucuccugucca

SEQ ID NO: 2336106 - RNA, 16 nt, Human
ccauucucucuccugu

SEQ ID NO: 2336107 - RNA, 12 nt, Human
ccauucugacuc

SEQ ID NO: 2336108 - RNA, 13 nt, Human
ccauucugacucg

SEQ ID NO: 2336109 - RNA, 23 nt, Human
cccaagugggggcagagggcaga

SEQ ID NO: 2336110 - RNA, 14 nt, Human
ccagugcaacacug

SEQ ID NO: 2336111 - RNA, 21 nt, Human
ccagugaugcuaaagguugua

SEQ ID NO: 2336112 - RNA, 14 nt, Human
ccagugcaacagca

SEQ ID NO: 2336113 - RNA, 15 nt, Human
ccagugcaacagcac

SEQ ID NO: 2336114 - RNA, 18 nt, Human
ccagugcaacagcacugg

SEQ ID NO: 2336115 - RNA, 19 nt, Human
ccagugagcacucccaagu

SEQ ID NO: 2336116 - RNA, 20 nt, Human
ccagugagcacucccaaguc

SEQ ID NO: 2336117 - RNA, 14 nt, Human
ccagugcacccacu

SEQ ID NO: 2336118 - RNA, 19 nt, Human
ccagugcccaaagucugug

SEQ ID NO: 2336119 - RNA, 22 nt, Human
ccagugcccaaagucuguguga

SEQ ID NO: 2336120 - RNA, 23 nt, Human
ccaguggccucaacccucccuca

SEQ ID NO: 2336121 - RNA, 17 nt, Human
ccaguggccucaacccu

SEQ ID NO: 2336122 - RNA, 16 nt, Human
ccaguggccucaaccc

SEQ ID NO: 2336123 - RNA, 21 nt, Human
ccaguggccacucagcuuccu

SEQ ID NO: 2336124 - RNA, 15 nt, Human
ccaguggccacucag

SEQ ID NO: 2336125 - RNA, 16 nt, Human
ccaguggccacucagc

SEQ ID NO: 2336126 - RNA, 17 nt, Human
ccaguggccacucagcu

SEQ ID NO: 2336127 - RNA, 24 nt, Human
ccaguggccucaacccucccucag

SEQ ID NO: 2336128 - RNA, 13 nt, Human
ccaguggcugcug

SEQ ID NO: 2336129 - RNA, 14 nt, Human
ccaguggcugcugc

SEQ ID NO: 2336130 - RNA, 15 nt, Human
ccaguggcugcugcc

SEQ ID NO: 2336131 - RNA, 16 nt, Human
ccaguggcugcugccc

SEQ ID NO: 2336132 - RNA, 17 nt, Human
ccaguggcugcugccca

SEQ ID NO: 2336133 - RNA, 18 nt, Human
ccaguggcugcugcccag

SEQ ID NO: 2336134 - RNA, 13 nt, Human
ccagugucuuccu

SEQ ID NO: 2336135 - RNA, 14 nt, Human
ccagugucuuccug

SEQ ID NO: 2336136 - RNA, 15 nt, Human
ccagugucuuccugu

SEQ ID NO: 2336137 - RNA, 16 nt, Human
ccagugucuuccugug

SEQ ID NO: 2336138 - RNA, 17 nt, Human
ccagugucuuccugugg

SEQ ID NO: 2336139 - RNA, 23 nt, Human
ccagugacacuucagagagcugg

SEQ ID NO: 2336140 - RNA, 20 nt, Human
ccagugacacuucagagagc

SEQ ID NO: 2336141 - RNA, 19 nt, Human
ccagugacacuucagagag

SEQ ID NO: 2336142 - RNA, 16 nt, Human
ccagugacacuucaga

SEQ ID NO: 2336143 - RNA, 15 nt, Human
ccagugacagacagg

SEQ ID NO: 2336144 - RNA, 17 nt, Human
ccagugacagacaggcu

SEQ ID NO: 2336145 - RNA, 24 nt, Human
ccagugacacuucagagagcuggu

SEQ ID NO: 2336146 - RNA, 21 nt, Human
ccagugacagacaggcucuua

SEQ ID NO: 2336147 - RNA, 18 nt, Human
ccagugacagacaggcuc

SEQ ID NO: 2336148 - RNA, 19 nt, Human
ccagugacagacaggcucu

SEQ ID NO: 2336149 - RNA, 11 nt, Human
ccagugacacu

SEQ ID NO: 2336150 - RNA, 23 nt, Human
ccagugaauucuugaaggaaaau

SEQ ID NO: 2336151 - RNA, 12 nt, Human
ccagguuuuuca

SEQ ID NO: 2336152 - RNA, 23 nt, Human
ccaguaaaugggggugcauuuga

SEQ ID NO: 2336153 - RNA, 15 nt, Human
ccagugaccugagga

SEQ ID NO: 2336154 - RNA, 19 nt, Human
ccagugaccugaggaagcg

SEQ ID NO: 2336155 - RNA, 18 nt, Human
ccagugaccugcugggua

SEQ ID NO: 2336156 - RNA, 18 nt, Human
ccagugaccugaggaagc

SEQ ID NO: 2336157 - RNA, 17 nt, Human
ccagugaccugaggaag

SEQ ID NO: 2336158 - RNA, 20 nt, Human
ccagugaccugcuggguaaa

SEQ ID NO: 2336159 - RNA, 22 nt, Human
ccagugaccugcuggguaaacu

SEQ ID NO: 2336160 - RNA, 16 nt, Human
ccagugacuccaggag

SEQ ID NO: 2336161 - RNA, 13 nt, Human
ccagugagaugca

SEQ ID NO: 2336162 - RNA, 14 nt, Human
ccagugagaugcau

SEQ ID NO: 2336163 - RNA, 17 nt, Human
ccagugagaugcauucu

SEQ ID NO: 2336164 - RNA, 21 nt, Human
ccagugagaugcauucuuggu

SEQ ID NO: 2336165 - RNA, 16 nt, Human
ccagugagcacuccca

SEQ ID NO: 2336166 - RNA, 18 nt, Human
ccagugagcacucccaag

SEQ ID NO: 2336167 - RNA, 12 nt, Human
ccagugacucca

SEQ ID NO: 2336168 - RNA, 13 nt, Human
ccagugacuccag

SEQ ID NO: 2336169 - RNA, 15 nt, Human
ccagugacuccagga

SEQ ID NO: 2336170 - RNA, 17 nt, Human
ccagugacuuuuucuaa

SEQ ID NO: 2336171 - RNA, 14 nt, Human
ccaggugcaguggc

SEQ ID NO: 2336172 - RNA, 13 nt, Human
ccaggugccaguu

SEQ ID NO: 2336173 - RNA, 12 nt, Human
ccaggugccagu

SEQ ID NO: 2336174 - RNA, 22 nt, Human
ccaggugcaguggcucacgccu

SEQ ID NO: 2336175 - RNA, 17 nt, Human
ccagguaucuccaggau

SEQ ID NO: 2336176 - RNA, 21 nt, Human
ccaggugcuaggaacacuccu

SEQ ID NO: 2336177 - RNA, 16 nt, Human
ccagguggccacucca

SEQ ID NO: 2336178 - RNA, 21 nt, Human
ccagguggccacuccagaccc

SEQ ID NO: 2336179 - RNA, 14 nt, Human
ccagguagaacaca

SEQ ID NO: 2336180 - RNA, 16 nt, Human
ccagguaucuccagga

SEQ ID NO: 2336181 - RNA, 18 nt, Human
ccagguaucuccaggauu

SEQ ID NO: 2336182 - RNA, 15 nt, Human
ccagguaucuccagg

SEQ ID NO: 2336183 - RNA, 19 nt, Human
ccaggugcacagacguccc

SEQ ID NO: 2336184 - RNA, 13 nt, Human
ccaggugcacaga

SEQ ID NO: 2336185 - RNA, 16 nt, Human
ccaggugcacagacgu

SEQ ID NO: 2336186 - RNA, 13 nt, Human
ccagguuuaagcu

SEQ ID NO: 2336187 - RNA, 16 nt, Human
ccagguuucuaugugu

SEQ ID NO: 2336188 - RNA, 23 nt, Human
ccagguggcugacccagucccug

SEQ ID NO: 2336189 - RNA, 22 nt, Human
ccagguggcugacccagucccu

SEQ ID NO: 2336190 - RNA, 21 nt, Human
ccagguggcugacccaguccc

SEQ ID NO: 2336191 - RNA, 20 nt, Human
ccagguggcugacccagucc

SEQ ID NO: 2336192 - RNA, 19 nt, Human
ccagguggcugacccaguc

SEQ ID NO: 2336193 - RNA, 17 nt, Human
ccagguggcugacccag

SEQ ID NO: 2336194 - RNA, 16 nt, Human
ccagguggcugaccca

SEQ ID NO: 2336195 - RNA, 19 nt, Human
ccaggugggcgggcagcac

SEQ ID NO: 2336196 - RNA, 20 nt, Human
ccaggugggcgggcagcaca

SEQ ID NO: 2336197 - RNA, 22 nt, Human
ccaggugggcgggcagcacagc

SEQ ID NO: 2336198 - RNA, 23 nt, Human
ccaggugggcgggcagcacagca

SEQ ID NO: 2336199 - RNA, 22 nt, Human
ccaguaaaugggggugcauuug

SEQ ID NO: 2336200 - RNA, 21 nt, Human
ccaguaaaugggggugcauuu

SEQ ID NO: 2336201 - RNA, 20 nt, Human
ccagguuuucugggugucca

SEQ ID NO: 2336202 - RNA, 16 nt, Human
ccagguuuucugggug

SEQ ID NO: 2336203 - RNA, 19 nt, Human
ccagguuuucugggugucc

SEQ ID NO: 2336204 - RNA, 16 nt, Human
ccagguuuagacagua

SEQ ID NO: 2336205 - RNA, 17 nt, Human
ccagguuucuggucucu

SEQ ID NO: 2336206 - RNA, 22 nt, Human
ccagguuucuggucucuaggcu

SEQ ID NO: 2336207 - RNA, 20 nt, Human
ccaguaaaugggggugcauu

SEQ ID NO: 2336208 - RNA, 22 nt, Human
ccaucuaugucccuugcuguga

SEQ ID NO: 2336209 - RNA, 20 nt, Human
ccaucuaugucccuugcugu

SEQ ID NO: 2336210 - RNA, 12 nt, Human
ccauccuggccc

SEQ ID NO: 2336211 - RNA, 13 nt, Human
ccaucuaccuucc

SEQ ID NO: 2336212 - RNA, 14 nt, Human
ccaucuaccuucca

SEQ ID NO: 2336213 - RNA, 16 nt, Human
ccauccugcagccucc

SEQ ID NO: 2336214 - RNA, 18 nt, Human
ccauccugcagccuccuc

SEQ ID NO: 2336215 - RNA, 21 nt, Human
ccauccugcagccuccuccug

SEQ ID NO: 2336216 - RNA, 22 nt, Human
ccauccugcagccuccuccuga

SEQ ID NO: 2336217 - RNA, 13 nt, Human
ccauccuggccca

SEQ ID NO: 2336218 - RNA, 20 nt, Human
ccauccugaggcuccacuug

SEQ ID NO: 2336219 - RNA, 14 nt, Human
ccaucaugucccca

SEQ ID NO: 2336220 - RNA, 15 nt, Human
ccauccugcagccuc

SEQ ID NO: 2336221 - RNA, 14 nt, Human
ccaucauugaaauc

SEQ ID NO: 2336222 - RNA, 16 nt, Human
ccaucauugaaaucuu

SEQ ID NO: 2336223 - RNA, 17 nt, Human
ccaucauugaaaucuuu

SEQ ID NO: 2336224 - RNA, 18 nt, Human
ccauccugaggcuccacu

SEQ ID NO: 2336225 - RNA, 23 nt, Human
ccaucucucccuccccugccauu

SEQ ID NO: 2336226 - RNA, 17 nt, Human
ccaucucucccuccccu

SEQ ID NO: 2336227 - RNA, 15 nt, Human
ccaucucuccuccuu

SEQ ID NO: 2336228 - RNA, 20 nt, Human
ccaucucacacaugagcauc

SEQ ID NO: 2336229 - RNA, 21 nt, Human
ccaucucacacaugagcauca

SEQ ID NO: 2336230 - RNA, 14 nt, Human
ccaucucacacaug

SEQ ID NO: 2336231 - RNA, 15 nt, Human
ccaucucacacauga

SEQ ID NO: 2336232 - RNA, 17 nt, Human
ccaucucacacaugagc

SEQ ID NO: 2336233 - RNA, 18 nt, Human
ccaucucacacaugagca

SEQ ID NO: 2336234 - RNA, 12 nt, Human
ccaucaugucug

SEQ ID NO: 2336235 - RNA, 13 nt, Human
ccaucauccuacu

SEQ ID NO: 2336236 - RNA, 13 nt, Human
ccaucaucuccug

SEQ ID NO: 2336237 - RNA, 13 nt, Human
ccaucaugucugg

SEQ ID NO: 2336238 - RNA, 12 nt, Human
ccaucauugaaa

SEQ ID NO: 2336239 - RNA, 16 nt, Human
ccaucaagccaccaac

SEQ ID NO: 2336240 - RNA, 15 nt, Human
ccaucaucccagcug

SEQ ID NO: 2336241 - RNA, 16 nt, Human
ccaucaucccagcugc

SEQ ID NO: 2336242 - RNA, 13 nt, Human
ccaucaagccacc

SEQ ID NO: 2336243 - RNA, 14 nt, Human
ccaucaagccacca

SEQ ID NO: 2336244 - RNA, 22 nt, Human
ccauauggauuuucuauuguua

SEQ ID NO: 2336245 - RNA, 15 nt, Human
ccauaugccugggca

SEQ ID NO: 2336246 - RNA, 14 nt, Human
ccauauguuacacu

SEQ ID NO: 2336247 - RNA, 12 nt, Human
ccauaugugcuu

SEQ ID NO: 2336248 - RNA, 12 nt, Human
ccaucaagccac

SEQ ID NO: 2336249 - RNA, 22 nt, Human
ccagugugggaaugcggcaaga

SEQ ID NO: 2336250 - RNA, 12 nt, Human
ccaguguggaac

SEQ ID NO: 2336251 - RNA, 22 nt, Human
ccagugugaucccaagugccag

SEQ ID NO: 2336252 - RNA, 15 nt, Human
ccagugugaucccaa

SEQ ID NO: 2336253 - RNA, 13 nt, Human
ccauaugccuggg

SEQ ID NO: 2336254 - RNA, 14 nt, Human
ccagugugacaagg

SEQ ID NO: 2336255 - RNA, 23 nt, Human
ccagugugacaaggauugcuacu

SEQ ID NO: 2336256 - RNA, 22 nt, Human
ccagggagcuugaaaguuuuca

SEQ ID NO: 2336257 - RNA, 23 nt, Human
ccagggagcggaaagcagcucaa

SEQ ID NO: 2336258 - RNA, 20 nt, Human
ccagggagcggaaagcagcu

SEQ ID NO: 2336259 - RNA, 19 nt, Human
ccagggagcggaaagcagc

SEQ ID NO: 2336260 - RNA, 18 nt, Human
ccagggagcggaaagcag

SEQ ID NO: 2336261 - RNA, 13 nt, Human
ccagggagucccc

SEQ ID NO: 2336262 - RNA, 23 nt, Human
ccagggaugccaucugugggcac

SEQ ID NO: 2336263 - RNA, 16 nt, Human
ccagggaguccccucc

SEQ ID NO: 2336264 - RNA, 17 nt, Human
ccagggaguccccuccc

SEQ ID NO: 2336265 - RNA, 22 nt, Human
ccagggagccuuugguucuggc

SEQ ID NO: 2336266 - RNA, 18 nt, Human
ccaggcugggcaaggagg

SEQ ID NO: 2336267 - RNA, 20 nt, Human
ccaggcugggcaaggaggcc

SEQ ID NO: 2336268 - RNA, 16 nt, Human
ccaggcuucacccuga

SEQ ID NO: 2336269 - RNA, 18 nt, Human
ccaggcuucacccugaau

SEQ ID NO: 2336270 - RNA, 17 nt, Human
ccagggcccaggcaaau

SEQ ID NO: 2336271 - RNA, 18 nt, Human
ccagggcccugagcucgg

SEQ ID NO: 2336272 - RNA, 15 nt, Human
ccagggcccugagcu

SEQ ID NO: 2336273 - RNA, 17 nt, Human
ccagggcccccaucuca

SEQ ID NO: 2336274 - RNA, 21 nt, Human
ccagggccccucacccugccu

SEQ ID NO: 2336275 - RNA, 22 nt, Human
ccagggccccucacccugccuu

SEQ ID NO: 2336276 - RNA, 18 nt, Human
ccagggccugagccaagc

SEQ ID NO: 2336277 - RNA, 23 nt, Human
ccagggucuucccuaccucaggc

SEQ ID NO: 2336278 - RNA, 14 nt, Human
ccagggugagagcu

SEQ ID NO: 2336279 - RNA, 14 nt, Human
ccagggucuucccu

SEQ ID NO: 2336280 - RNA, 15 nt, Human
ccagggcccugcaga

SEQ ID NO: 2336281 - RNA, 14 nt, Human
ccagggcccugcag

SEQ ID NO: 2336282 - RNA, 16 nt, Human
ccagggccugagccug

SEQ ID NO: 2336283 - RNA, 14 nt, Human
ccagggccugagcc

SEQ ID NO: 2336284 - RNA, 23 nt, Human
ccagggccugcaggaccugccug

SEQ ID NO: 2336285 - RNA, 19 nt, Human
ccagggccugagccuggcc

SEQ ID NO: 2336286 - RNA, 18 nt, Human
ccagggccugagccuggc

SEQ ID NO: 2336287 - RNA, 17 nt, Human
ccagggccugagccugg

SEQ ID NO: 2336288 - RNA, 14 nt, Human
ccagggugugugcu

SEQ ID NO: 2336289 - RNA, 22 nt, Human
ccaggguggacuuagaaagcag

SEQ ID NO: 2336290 - RNA, 19 nt, Human
ccaggguguggcccugcca

SEQ ID NO: 2336291 - RNA, 21 nt, Human
ccaggguguggcccugccauc

SEQ ID NO: 2336292 - RNA, 20 nt, Human
ccagguagaggguguguaag

SEQ ID NO: 2336293 - RNA, 15 nt, Human
ccagggugagagcug

SEQ ID NO: 2336294 - RNA, 16 nt, Human
ccagggugagagcugc

SEQ ID NO: 2336295 - RNA, 17 nt, Human
ccagggugagagcugcu

SEQ ID NO: 2336296 - RNA, 22 nt, Human
ccagggugagagcugcucugga

SEQ ID NO: 2336297 - RNA, 23 nt, Human
ccagggugagagcugcucuggaa

SEQ ID NO: 2336298 - RNA, 20 nt, Human
ccaggguggacuuagaaagc

SEQ ID NO: 2336299 - RNA, 21 nt, Human
ccaggguggacuuagaaagca

SEQ ID NO: 2336300 - RNA, 14 nt, Human
ccaggcuggucuca

SEQ ID NO: 2336301 - RNA, 21 nt, Human
ccaggcuuagucacugagaca

SEQ ID NO: 2336302 - RNA, 22 nt, Human
ccaggcuuagucacugagacag

SEQ ID NO: 2336303 - RNA, 23 nt, Human
ccaggcuuagucacugagacagc

SEQ ID NO: 2336304 - RNA, 21 nt, Human
ccaggcugggucgcccuggac

SEQ ID NO: 2336305 - RNA, 22 nt, Human
ccaggcugggucgcccuggacu

SEQ ID NO: 2336306 - RNA, 23 nt, Human
ccaggcugggucgcccuggacug

SEQ ID NO: 2336307 - RNA, 24 nt, Human
ccaggcugggucgcccuggacugu

SEQ ID NO: 2336308 - RNA, 12 nt, Human
ccaggcuggguc

SEQ ID NO: 2336309 - RNA, 16 nt, Human
ccaggcugggucgccc

SEQ ID NO: 2336310 - RNA, 15 nt, Human
ccaggcccucugccc

SEQ ID NO: 2336311 - RNA, 23 nt, Human
ccaggcugggagagccuuccagg

SEQ ID NO: 2336312 - RNA, 21 nt, Human
ccagcucuagacaacccugca

SEQ ID NO: 2336313 - RNA, 19 nt, Human
ccagcucuagacaacccug

SEQ ID NO: 2336314 - RNA, 21 nt, Human
ccaggccacaagacccuugug

SEQ ID NO: 2336315 - RNA, 20 nt, Human
ccaggaggccagccuugacc

SEQ ID NO: 2336316 - RNA, 16 nt, Human
ccaggccacuggcccc

SEQ ID NO: 2336317 - RNA, 16 nt, Human
ccaggccaccucccca

SEQ ID NO: 2336318 - RNA, 17 nt, Human
ccaggccaccuccccag

SEQ ID NO: 2336319 - RNA, 19 nt, Human
ccaggccacauggggcugg

SEQ ID NO: 2336320 - RNA, 12 nt, Human
ccaggccaccag

SEQ ID NO: 2336321 - RNA, 13 nt, Human
ccaggccaccucc

SEQ ID NO: 2336322 - RNA, 14 nt, Human
ccaggccaccagga

SEQ ID NO: 2336323 - RNA, 15 nt, Human
ccaggccaccaggau

SEQ ID NO: 2336324 - RNA, 22 nt, Human
ccagcucuagacaacccugcaa

SEQ ID NO: 2336325 - RNA, 18 nt, Human
ccagcucuagacaacccu

SEQ ID NO: 2336326 - RNA, 17 nt, Human
ccagcucuagacaaccc

SEQ ID NO: 2336327 - RNA, 20 nt, Human
ccagcuccuccgugcuuccu

SEQ ID NO: 2336328 - RNA, 14 nt, Human
ccagcuccuucgcu

SEQ ID NO: 2336329 - RNA, 15 nt, Human
ccaggaggccagccu

SEQ ID NO: 2336330 - RNA, 18 nt, Human
ccaggaggccagccuuga

SEQ ID NO: 2336331 - RNA, 12 nt, Human
ccaggccagagg

SEQ ID NO: 2336332 - RNA, 14 nt, Human
ccaggccccugcca

SEQ ID NO: 2336333 - RNA, 15 nt, Human
ccaggccccugccac

SEQ ID NO: 2336334 - RNA, 16 nt, Human
ccaggccccugccacc

SEQ ID NO: 2336335 - RNA, 13 nt, Human
ccaggcccucugc

SEQ ID NO: 2336336 - RNA, 14 nt, Human
ccaggcccucugcc

SEQ ID NO: 2336337 - RNA, 23 nt, Human
ccaggccacuggccccugagauc

SEQ ID NO: 2336338 - RNA, 21 nt, Human
ccaggccaccuccccagcauu

SEQ ID NO: 2336339 - RNA, 16 nt, Human
ccaggccaccuccaga

SEQ ID NO: 2336340 - RNA, 21 nt, Human
ccaggcccggggcuggcggcu

SEQ ID NO: 2336341 - RNA, 12 nt, Human
cuggucugaggg

SEQ ID NO: 2336342 - RNA, 12 nt, Human
cuggucucuggu

SEQ ID NO: 2336343 - RNA, 20 nt, Human
cuggucucuaggcuggggaa

SEQ ID NO: 2336344 - RNA, 18 nt, Human
cuggucuuauuuguaaag

SEQ ID NO: 2336345 - RNA, 14 nt, Human
cuggucucuaggcu

SEQ ID NO: 2336346 - RNA, 16 nt, Human
cuggucucuaggcugg

SEQ ID NO: 2336347 - RNA, 14 nt, Human
cuggucucuccuug

SEQ ID NO: 2336348 - RNA, 17 nt, Human
cuggucucuaggcuggg

SEQ ID NO: 2336349 - RNA, 18 nt, Human
cuggucucuaggcugggg

SEQ ID NO: 2336350 - RNA, 21 nt, Human
cuggucucgaacuccugaccu

SEQ ID NO: 2336351 - RNA, 23 nt, Human
cuggugaccuuccaagagccuga

SEQ ID NO: 2336352 - RNA, 22 nt, Human
cuggugaccuuccaagagccug

SEQ ID NO: 2336353 - RNA, 16 nt, Human
cuggucuucuuugggu

SEQ ID NO: 2336354 - RNA, 22 nt, Human
cuggucuguagaagagggauaa

SEQ ID NO: 2336355 - RNA, 16 nt, Human
cuggucugggugcccc

SEQ ID NO: 2336356 - RNA, 23 nt, Human
cuggugaccccuuuucagcuucu

SEQ ID NO: 2336357 - RNA, 14 nt, Human
cuggucuguaggga

SEQ ID NO: 2336358 - RNA, 23 nt, Human
cuguaaaugguguacauaaugua

SEQ ID NO: 2336359 - RNA, 17 nt, Human
cuguaacacaagccaca

SEQ ID NO: 2336360 - RNA, 18 nt, Human
cuguaacacaagccacag

SEQ ID NO: 2336361 - RNA, 19 nt, Human
cuguaacacaagccacaga

SEQ ID NO: 2336362 - RNA, 20 nt, Human
cuguaacacaagccacagaa

SEQ ID NO: 2336363 - RNA, 18 nt, Human
cuguaaaugguguacaua

SEQ ID NO: 2336364 - RNA, 21 nt, Human
cuguaaaugguguacauaaug

SEQ ID NO: 2336365 - RNA, 17 nt, Human
cuguaaaugguguacau

SEQ ID NO: 2336366 - RNA, 15 nt, Human
cuguaaaaacugugg

SEQ ID NO: 2336367 - RNA, 21 nt, Human
cuguaaaaagagagaaaacuu

SEQ ID NO: 2336368 - RNA, 19 nt, Human
cuguaaaaaaaaaaaaguu

SEQ ID NO: 2336369 - RNA, 22 nt, Human
cuguaagaagagacugggaaga

SEQ ID NO: 2336370 - RNA, 20 nt, Human
cuguaagaagagacugggaa

SEQ ID NO: 2336371 - RNA, 17 nt, Human
cuguaagaagagacugg

SEQ ID NO: 2336372 - RNA, 23 nt, Human
cuguaagaagagacugggaagau

SEQ ID NO: 2336373 - RNA, 21 nt, Human
cuguaagacucauucccuaga

SEQ ID NO: 2336374 - RNA, 20 nt, Human
cuguaagaaaauaucacuug

SEQ ID NO: 2336375 - RNA, 21 nt, Human
cuguaacacaagccacagaag

SEQ ID NO: 2336376 - RNA, 22 nt, Human
cuguaacacaagccacagaagc

SEQ ID NO: 2336377 - RNA, 15 nt, Human
cuguaacacagcuga

SEQ ID NO: 2336378 - RNA, 21 nt, Human
cuguaacacagcugagagacu

SEQ ID NO: 2336379 - RNA, 15 nt, Human
cuguagagugggagc

SEQ ID NO: 2336380 - RNA, 20 nt, Human
cuguagcagugagaaaaagc

SEQ ID NO: 2336381 - RNA, 21 nt, Human
cuguagcagugagaaaaagcu

SEQ ID NO: 2336382 - RNA, 12 nt, Human
cuguagcaucuu

SEQ ID NO: 2336383 - RNA, 16 nt, Human
cuguagcacuuacugg

SEQ ID NO: 2336384 - RNA, 15 nt, Human
cuguagauucugugg

SEQ ID NO: 2336385 - RNA, 20 nt, Human
cuguagauucuguggaacaa

SEQ ID NO: 2336386 - RNA, 13 nt, Human
cuguagauucugu

SEQ ID NO: 2336387 - RNA, 17 nt, Human
cuguacuugaugacaga

SEQ ID NO: 2336388 - RNA, 22 nt, Human
cuguacuucacugucaggaaga

SEQ ID NO: 2336389 - RNA, 20 nt, Human
cuguacuucaaguuaaagug

SEQ ID NO: 2336390 - RNA, 14 nt, Human
cuguacuucacugu

SEQ ID NO: 2336391 - RNA, 17 nt, Human
cuguacuucacugucag

SEQ ID NO: 2336392 - RNA, 16 nt, Human
cuguacuugcucuuga

SEQ ID NO: 2336393 - RNA, 19 nt, Human
cuguacuugcucuugaugc

SEQ ID NO: 2336394 - RNA, 20 nt, Human
cuguacuugcucuugaugcc

SEQ ID NO: 2336395 - RNA, 14 nt, Human
cugguuuuucaguu

SEQ ID NO: 2336396 - RNA, 15 nt, Human
cugguuuuucaguuu

SEQ ID NO: 2336397 - RNA, 16 nt, Human
cugguuuuucaguuuu

SEQ ID NO: 2336398 - RNA, 21 nt, Human
cugguuuuguaagaugcuggg

SEQ ID NO: 2336399 - RNA, 22 nt, Human
cugguuuuguaagaugcugggu

SEQ ID NO: 2336400 - RNA, 20 nt, Human
cugguuuuuaaccauugucu

SEQ ID NO: 2336401 - RNA, 15 nt, Human
cugguuuuuguagcc

SEQ ID NO: 2336402 - RNA, 18 nt, Human
cugguuuuccuaaaugca

SEQ ID NO: 2336403 - RNA, 13 nt, Human
cugguuuuaacaa

SEQ ID NO: 2336404 - RNA, 20 nt, Human
cugguuuucuggaugguucc

SEQ ID NO: 2336405 - RNA, 13 nt, Human
cugguuuugcuau

SEQ ID NO: 2336406 - RNA, 14 nt, Human
cugguuuugcuauu

SEQ ID NO: 2336407 - RNA, 13 nt, Human
cugguuuuguaag

SEQ ID NO: 2336408 - RNA, 15 nt, Human
cugguuuuguaagau

SEQ ID NO: 2336409 - RNA, 19 nt, Human
cugguuuuguaagaugcug

SEQ ID NO: 2336410 - RNA, 20 nt, Human
cugguuuuguaagaugcugg

SEQ ID NO: 2336411 - RNA, 13 nt, Human
cugucuaaaaaac

SEQ ID NO: 2336412 - RNA, 15 nt, Human
cugucuaaccuguga

SEQ ID NO: 2336413 - RNA, 22 nt, Human
cugucuaaugaaaccugugucu

SEQ ID NO: 2336414 - RNA, 16 nt, Human
cugucuaaccugugac

SEQ ID NO: 2336415 - RNA, 17 nt, Human
cugucuaaccugugacc

SEQ ID NO: 2336416 - RNA, 13 nt, Human
cugucuaacugcu

SEQ ID NO: 2336417 - RNA, 15 nt, Human
cuguccuucucucac

SEQ ID NO: 2336418 - RNA, 14 nt, Human
cuguccuucagaug

SEQ ID NO: 2336419 - RNA, 16 nt, Human
cuguccuucagaugga

SEQ ID NO: 2336420 - RNA, 19 nt, Human
cuguccuuacccaucugca

SEQ ID NO: 2336421 - RNA, 17 nt, Human
cuguccuuacccaucug

SEQ ID NO: 2336422 - RNA, 12 nt, Human
cuguccuuaccc

SEQ ID NO: 2336423 - RNA, 18 nt, Human
cuguccuguguagugauu

SEQ ID NO: 2336424 - RNA, 20 nt, Human
cuguccuucucucaccuccu

SEQ ID NO: 2336425 - RNA, 23 nt, Human
cuguccuucucucaccuccuaaa

SEQ ID NO: 2336426 - RNA, 16 nt, Human
cuguccuugcacacuc

SEQ ID NO: 2336427 - RNA, 17 nt, Human
cuguccuucagauggaa

SEQ ID NO: 2336428 - RNA, 15 nt, Human
cugucagugcagccc

SEQ ID NO: 2336429 - RNA, 18 nt, Human
cugucagucacagccacc

SEQ ID NO: 2336430 - RNA, 19 nt, Human
cugucagugcagcccgugu

SEQ ID NO: 2336431 - RNA, 18 nt, Human
cugucagugcagcccgug

SEQ ID NO: 2336432 - RNA, 14 nt, Human
cugucaucugugca

SEQ ID NO: 2336433 - RNA, 15 nt, Human
cugucaucugugcac

SEQ ID NO: 2336434 - RNA, 14 nt, Human
cugucagugccgcc

SEQ ID NO: 2336435 - RNA, 15 nt, Human
cugucaugaacaugu

SEQ ID NO: 2336436 - RNA, 21 nt, Human
cugucaucugugcacugccca

SEQ ID NO: 2336437 - RNA, 14 nt, Human
cugucauuugagca

SEQ ID NO: 2336438 - RNA, 18 nt, Human
cugucaugccccccucaa

SEQ ID NO: 2336439 - RNA, 16 nt, Human
cugucauucagaaaaa

SEQ ID NO: 2336440 - RNA, 19 nt, Human
cugucaugaacauguuccu

SEQ ID NO: 2336441 - RNA, 20 nt, Human
cugucaugaacauguuccug

SEQ ID NO: 2336442 - RNA, 13 nt, Human
cugucaugccccc

SEQ ID NO: 2336443 - RNA, 17 nt, Human
cugucaugccccccuca

SEQ ID NO: 2336444 - RNA, 13 nt, Human
cuguccugggagu

SEQ ID NO: 2336445 - RNA, 14 nt, Human
cuguccugggagug

SEQ ID NO: 2336446 - RNA, 20 nt, Human
cuguccugggagugagcugg

SEQ ID NO: 2336447 - RNA, 23 nt, Human
cugucauucccaccacccugagg

SEQ ID NO: 2336448 - RNA, 17 nt, Human
cuguagcauuacagugg

SEQ ID NO: 2336449 - RNA, 19 nt, Human
cuguagcaucuucuggagu

SEQ ID NO: 2336450 - RNA, 20 nt, Human
cuguagcaucuucuggaguc

SEQ ID NO: 2336451 - RNA, 15 nt, Human
cuguagcaucuucug

SEQ ID NO: 2336452 - RNA, 16 nt, Human
cuguagcaucuucugg

SEQ ID NO: 2336453 - RNA, 17 nt, Human
cuguagcaucuucugga

SEQ ID NO: 2336454 - RNA, 18 nt, Human
cuguagcaucuucuggag

SEQ ID NO: 2336455 - RNA, 18 nt, Human
cuguagcauuacaguggg

SEQ ID NO: 2336456 - RNA, 16 nt, Human
cuguagcccacucugc

SEQ ID NO: 2336457 - RNA, 21 nt, Human
cuguagcccacucugcucgcc

SEQ ID NO: 2336458 - RNA, 20 nt, Human
cuguagcccacucugcucgc

SEQ ID NO: 2336459 - RNA, 13 nt, Human
cuguagccuucug

SEQ ID NO: 2336460 - RNA, 18 nt, Human
cuguagcuuguucccugu

SEQ ID NO: 2336461 - RNA, 16 nt, Human
cugucaguaugacauu

SEQ ID NO: 2336462 - RNA, 17 nt, Human
cugucagucacagccac

SEQ ID NO: 2336463 - RNA, 15 nt, Human
cugucagucacagcc

SEQ ID NO: 2336464 - RNA, 14 nt, Human
cugucagucacagc

SEQ ID NO: 2336465 - RNA, 13 nt, Human
cugucagucacag

SEQ ID NO: 2336466 - RNA, 18 nt, Human
cuguaggaagguuaaugu

SEQ ID NO: 2336467 - RNA, 13 nt, Human
cugucaggaagaa

SEQ ID NO: 2336468 - RNA, 14 nt, Human
cugucaggaagaaa

SEQ ID NO: 2336469 - RNA, 17 nt, Human
cugucaggaagaaauca

SEQ ID NO: 2336470 - RNA, 18 nt, Human
cugucaggaagaaaucac

SEQ ID NO: 2336471 - RNA, 16 nt, Human
cugucaggagagcagc

SEQ ID NO: 2336472 - RNA, 14 nt, Human
cuuaaacaaaugua

SEQ ID NO: 2336473 - RNA, 14 nt, Human
cuuaaacagggcau

SEQ ID NO: 2336474 - RNA, 22 nt, Human
cuuaaacagggcaucuccagga

SEQ ID NO: 2336475 - RNA, 13 nt, Human
cuuaaaauagaaa

SEQ ID NO: 2336476 - RNA, 22 nt, Human
cuuaaaauagcaacacucuaua

SEQ ID NO: 2336477 - RNA, 18 nt, Human
cuuaaaauagaaauaagu

SEQ ID NO: 2336478 - RNA, 23 nt, Human
cuuaaacuguguggacugugaug

SEQ ID NO: 2336479 - RNA, 15 nt, Human
cuuaaacugugugga

SEQ ID NO: 2336480 - RNA, 14 nt, Human
cuuaaacugugugg

SEQ ID NO: 2336481 - RNA, 18 nt, Human
cuuaaagaaaacccaccc

SEQ ID NO: 2336482 - RNA, 12 nt, Human
cuuaaagaaagu

SEQ ID NO: 2336483 - RNA, 21 nt, Human
cuuaaagaaagucgaauuaau

SEQ ID NO: 2336484 - RNA, 14 nt, Human
cuuaaaccugggag

SEQ ID NO: 2336485 - RNA, 15 nt, Human
cuuaaaccuucaguu

SEQ ID NO: 2336486 - RNA, 23 nt, Human
cuuaaaccuucaguuaugauuuu

SEQ ID NO: 2336487 - RNA, 19 nt, Human
cuuaaauaaugugaaacug

SEQ ID NO: 2336488 - RNA, 16 nt, Human
cuuaaauaaugugaaa

SEQ ID NO: 2336489 - RNA, 14 nt, Human
cuuaaauaauguga

SEQ ID NO: 2336490 - RNA, 13 nt, Human
cuuaaauaaugug

SEQ ID NO: 2336491 - RNA, 17 nt, Human
cuguuguuauggaaacu

SEQ ID NO: 2336492 - RNA, 13 nt, Human
cuguuguuguuaa

SEQ ID NO: 2336493 - RNA, 12 nt, Human
cuuaaaaauggu

SEQ ID NO: 2336494 - RNA, 20 nt, Human
cuuaaaaaugguuuaaaugg

SEQ ID NO: 2336495 - RNA, 13 nt, Human
cuuaaaaaugguu

SEQ ID NO: 2336496 - RNA, 15 nt, Human
cuuaaaaccaaagag

SEQ ID NO: 2336497 - RNA, 21 nt, Human
cuuaaaaccaaagagggcuuc

SEQ ID NO: 2336498 - RNA, 23 nt, Human
cuguuguuguuaaugaaaauguc

SEQ ID NO: 2336499 - RNA, 14 nt, Human
cuuaaaaccaaaga

SEQ ID NO: 2336500 - RNA, 22 nt, Human
cuguuguuguuaaugaaaaugu

SEQ ID NO: 2336501 - RNA, 17 nt, Human
cuguuguuguuaaugaa

SEQ ID NO: 2336502 - RNA, 13 nt, Human
cuuaaaauaacuu

SEQ ID NO: 2336503 - RNA, 19 nt, Human
cuuaaaauaacuuauauca

SEQ ID NO: 2336504 - RNA, 18 nt, Human
cuguugcccaggcuggcg

SEQ ID NO: 2336505 - RNA, 14 nt, Human
cuguugccucaucu

SEQ ID NO: 2336506 - RNA, 12 nt, Human
cuguugccucau

SEQ ID NO: 2336507 - RNA, 12 nt, Human
cuguugcuaagc

SEQ ID NO: 2336508 - RNA, 23 nt, Human
cuguugcguaacuggcuguguuc

SEQ ID NO: 2336509 - RNA, 21 nt, Human
cuguugcuaagccccagcaag

SEQ ID NO: 2336510 - RNA, 22 nt, Human
cuguugcuaagccccagcaagc

SEQ ID NO: 2336511 - RNA, 23 nt, Human
cuguugcuaagccccagcaagca

SEQ ID NO: 2336512 - RNA, 18 nt, Human
cuguugcguaacuggcug

SEQ ID NO: 2336513 - RNA, 11 nt, Human
cuguugcucaa

SEQ ID NO: 2336514 - RNA, 12 nt, Human
cuguuggccagu

SEQ ID NO: 2336515 - RNA, 15 nt, Human
cuguuggcaggcugg

SEQ ID NO: 2336516 - RNA, 16 nt, Human
cuguuggcaggcuggc

SEQ ID NO: 2336517 - RNA, 18 nt, Human
cuguuggcaggcuggcca

SEQ ID NO: 2336518 - RNA, 19 nt, Human
cuguuggcaggcuggccag

SEQ ID NO: 2336519 - RNA, 21 nt, Human
cuguuggcacucacagaccug

SEQ ID NO: 2336520 - RNA, 22 nt, Human
cuguuggcacucacagaccugg

SEQ ID NO: 2336521 - RNA, 23 nt, Human
cuguuggcacucacagaccugga

SEQ ID NO: 2336522 - RNA, 16 nt, Human
cuguugcugaauaggc

SEQ ID NO: 2336523 - RNA, 15 nt, Human
cuguugcugaauagg

SEQ ID NO: 2336524 - RNA, 21 nt, Human
cuguugcucaaaucuauucag

SEQ ID NO: 2336525 - RNA, 22 nt, Human
cuguugcucaaaucuauucaga

SEQ ID NO: 2336526 - RNA, 17 nt, Human
cuguugucccucugcua

SEQ ID NO: 2336527 - RNA, 17 nt, Human
cuguugucauugcuguu

SEQ ID NO: 2336528 - RNA, 16 nt, Human
cuguuguccuauggga

SEQ ID NO: 2336529 - RNA, 14 nt, Human
cuguuggcagugag

SEQ ID NO: 2336530 - RNA, 21 nt, Human
cuguuggcagugagugagccu

SEQ ID NO: 2336531 - RNA, 22 nt, Human
cuguuggcagugagugagccug

SEQ ID NO: 2336532 - RNA, 15 nt, Human
cuguugucauugcug

SEQ ID NO: 2336533 - RNA, 15 nt, Human
cuguuggccagugug

SEQ ID NO: 2336534 - RNA, 22 nt, Human
cuguuguguacguggagaggga

SEQ ID NO: 2336535 - RNA, 20 nt, Human
cuguugugaccugaaguuca

SEQ ID NO: 2336536 - RNA, 21 nt, Human
cuguuguguauagaugcaaga

SEQ ID NO: 2336537 - RNA, 19 nt, Human
cuguugugaccugaaguuc

SEQ ID NO: 2336538 - RNA, 20 nt, Human
cuguuguccuccccuugggc

SEQ ID NO: 2336539 - RNA, 14 nt, Human
cuguuguccucccc

SEQ ID NO: 2336540 - RNA, 15 nt, Human
cuguuguccuccccu

SEQ ID NO: 2336541 - RNA, 13 nt, Human
cuguuauccaugg

SEQ ID NO: 2336542 - RNA, 14 nt, Human
cuguuaugcuguga

SEQ ID NO: 2336543 - RNA, 18 nt, Human
cuguucacccacagggcu

SEQ ID NO: 2336544 - RNA, 14 nt, Human
cuguucacccacag

SEQ ID NO: 2336545 - RNA, 12 nt, Human
cuguucacccac

SEQ ID NO: 2336546 - RNA, 22 nt, Human
cuguucacagccagacuggcac

SEQ ID NO: 2336547 - RNA, 15 nt, Human
cuguucagcuccagc

SEQ ID NO: 2336548 - RNA, 13 nt, Human
cuguucacucuac

SEQ ID NO: 2336549 - RNA, 19 nt, Human
cuguuaucccugccugguc

SEQ ID NO: 2336550 - RNA, 19 nt, Human
cuguuaucaaaacuuucuu

SEQ ID NO: 2336551 - RNA, 22 nt, Human
cuguuauauaaaugguuaaaag

SEQ ID NO: 2336552 - RNA, 19 nt, Human
cuguucacagccagacugg

SEQ ID NO: 2336553 - RNA, 19 nt, Human
cuguuaugcugugacacau

SEQ ID NO: 2336554 - RNA, 12 nt, Human
cuguucagcugg

SEQ ID NO: 2336555 - RNA, 16 nt, Human
cuguucagcuccagcu

SEQ ID NO: 2336556 - RNA, 18 nt, Human
cuguucagcuccagcuca

SEQ ID NO: 2336557 - RNA, 19 nt, Human
cuguucagcuccagcucac

SEQ ID NO: 2336558 - RNA, 22 nt, Human
cuguucagcuccagcucaccag

SEQ ID NO: 2336559 - RNA, 13 nt, Human
cuguuagcagaca

SEQ ID NO: 2336560 - RNA, 19 nt, Human
cugugucccaugacccacc

SEQ ID NO: 2336561 - RNA, 15 nt, Human
cuguuacuuaccuaa

SEQ ID NO: 2336562 - RNA, 19 nt, Human
cuguuacuuaccuaaacag

SEQ ID NO: 2336563 - RNA, 18 nt, Human
cuguuacuugaaauacca

SEQ ID NO: 2336564 - RNA, 21 nt, Human
cuguuacuugaaauaccagug

SEQ ID NO: 2336565 - RNA, 16 nt, Human
cuguuagcuguuauuu

SEQ ID NO: 2336566 - RNA, 15 nt, Human
cuguuagcuguuauu

SEQ ID NO: 2336567 - RNA, 17 nt, Human
cuguuagccauguggcu

SEQ ID NO: 2336568 - RNA, 15 nt, Human
cuguuagcagacagg

SEQ ID NO: 2336569 - RNA, 13 nt, Human
cuguuauauaaau

SEQ ID NO: 2336570 - RNA, 15 nt, Human
cuguuauauaaaugg

SEQ ID NO: 2336571 - RNA, 14 nt, Human
cuguuauauaaaug

SEQ ID NO: 2336572 - RNA, 17 nt, Human
cuguuacugucuucagu

SEQ ID NO: 2336573 - RNA, 22 nt, Human
cuguguccaugcgcucagggcc

SEQ ID NO: 2336574 - RNA, 23 nt, Human
cuguguccaugcgcucagggcca

SEQ ID NO: 2336575 - RNA, 13 nt, Human
cugugucccauga

SEQ ID NO: 2336576 - RNA, 15 nt, Human
cugugucccaugacc

SEQ ID NO: 2336577 - RNA, 17 nt, Human
cugugucccaugaccca

SEQ ID NO: 2336578 - RNA, 13 nt, Human
cuguguccaugcg

SEQ ID NO: 2336579 - RNA, 18 nt, Human
cuguguccaugcgcucag

SEQ ID NO: 2336580 - RNA, 19 nt, Human
cuguguccaugcgcucagg

SEQ ID NO: 2336581 - RNA, 21 nt, Human
cuguguccaugcgcucagggc

SEQ ID NO: 2336582 - RNA, 22 nt, Human
cugugucagguggggcagcuug

SEQ ID NO: 2336583 - RNA, 16 nt, Human
cuguguauuugcuuuu

SEQ ID NO: 2336584 - RNA, 14 nt, Human
cuguguauuugcuu

SEQ ID NO: 2336585 - RNA, 15 nt, Human
cuguguauuugcuuu

SEQ ID NO: 2336586 - RNA, 16 nt, Human
cuguguauucauugaa

SEQ ID NO: 2336587 - RNA, 15 nt, Human
cuguguauuccaaga

SEQ ID NO: 2336588 - RNA, 19 nt, Human
cuguguauuccaagacaug

SEQ ID NO: 2336589 - RNA, 21 nt, Human
cugugagauuuugcuuuucca

SEQ ID NO: 2336590 - RNA, 19 nt, Human
cugugagcaucacaguuuu

SEQ ID NO: 2336591 - RNA, 14 nt, Human
cugugagcccagcu

SEQ ID NO: 2336592 - RNA, 18 nt, Human
cugugcucuggacaggca

SEQ ID NO: 2336593 - RNA, 19 nt, Human
cugugcucuggacaggcau

SEQ ID NO: 2336594 - RNA, 19 nt, Human
cugugaauuuguguaagga

SEQ ID NO: 2336595 - RNA, 15 nt, Human
cugugacaggcagca

SEQ ID NO: 2336596 - RNA, 18 nt, Human
cugugacaggcagcagag

SEQ ID NO: 2336597 - RNA, 22 nt, Human
cugugaacgauuuagaaagaag

SEQ ID NO: 2336598 - RNA, 18 nt, Human
cugugaaucaccuagggg

SEQ ID NO: 2336599 - RNA, 15 nt, Human
cugugaaugccacug

SEQ ID NO: 2336600 - RNA, 16 nt, Human
cugugaaugccacugc

SEQ ID NO: 2336601 - RNA, 15 nt, Human
cugugaauucagauu

SEQ ID NO: 2336602 - RNA, 14 nt, Human
cugugaauucagau

SEQ ID NO: 2336603 - RNA, 20 nt, Human
cugugaaugccacugccuuc

SEQ ID NO: 2336604 - RNA, 21 nt, Human
cugugaaugccacugccuucg

SEQ ID NO: 2336605 - RNA, 15 nt, Human
cugugagcaagaagu

SEQ ID NO: 2336606 - RNA, 16 nt, Human
cugugagcaucacagu

SEQ ID NO: 2336607 - RNA, 16 nt, Human
cugugacaggcagcag

SEQ ID NO: 2336608 - RNA, 17 nt, Human
cugugacaggcagcaga

SEQ ID NO: 2336609 - RNA, 13 nt, Human
cugugagauuuug

SEQ ID NO: 2336610 - RNA, 23 nt, Human
cugugagaugcuagaacucccuu

SEQ ID NO: 2336611 - RNA, 17 nt, Human
cugugcucuggacaggc

SEQ ID NO: 2336612 - RNA, 15 nt, Human
cugugcucuggacag

SEQ ID NO: 2336613 - RNA, 18 nt, Human
cugugaacgauuuagaaa

SEQ ID NO: 2336614 - RNA, 16 nt, Human
cugugaacugaacucu

SEQ ID NO: 2336615 - RNA, 15 nt, Human
cugugaacugaacuc

SEQ ID NO: 2336616 - RNA, 13 nt, Human
cugugaacugaac

SEQ ID NO: 2336617 - RNA, 18 nt, Human
cugugaaguuuacauugu

SEQ ID NO: 2336618 - RNA, 23 nt, Human
cugugaaguuuacauuguaaaua

SEQ ID NO: 2336619 - RNA, 21 nt, Human
cugcccuucaccccaguggcc

SEQ ID NO: 2336620 - RNA, 16 nt, Human
cugcccuucaccccag

SEQ ID NO: 2336621 - RNA, 17 nt, Human
cugcccuucaccccagu

SEQ ID NO: 2336622 - RNA, 22 nt, Human
cugcccuuaccugccaggaagc

SEQ ID NO: 2336623 - RNA, 23 nt, Human
cugcccuuaccugccaggaagcc

SEQ ID NO: 2336624 - RNA, 11 nt, Human
cugcccugugg

SEQ ID NO: 2336625 - RNA, 12 nt, Human
cugcccuguggg

SEQ ID NO: 2336626 - RNA, 20 nt, Human
cugcccugguuuccugcccu

SEQ ID NO: 2336627 - RNA, 19 nt, Human
cugcccuuaccugccagga

SEQ ID NO: 2336628 - RNA, 23 nt, Human
cugcccuggugcugccacacuuc

SEQ ID NO: 2336629 - RNA, 17 nt, Human
cugcccugguuuccugc

SEQ ID NO: 2336630 - RNA, 19 nt, Human
cugcccugguuuccugccc

SEQ ID NO: 2336631 - RNA, 18 nt, Human
cugcccugguuuccugcc

SEQ ID NO: 2336632 - RNA, 21 nt, Human
cugcccugguuuccugcccug

SEQ ID NO: 2336633 - RNA, 24 nt, Human
cugcccugugaguacuacaguccu

SEQ ID NO: 2336634 - RNA, 15 nt, Human
cugcccugguccagg

SEQ ID NO: 2336635 - RNA, 14 nt, Human
cugcccugguccag

SEQ ID NO: 2336636 - RNA, 24 nt, Human
cugcccugggauguccacagaugc

SEQ ID NO: 2336637 - RNA, 20 nt, Human
cugcccccuucucccacacu

SEQ ID NO: 2336638 - RNA, 19 nt, Human
cugcccccuucucccacac

SEQ ID NO: 2336639 - RNA, 21 nt, Human
cugcccugguccagggaagcu

SEQ ID NO: 2336640 - RNA, 20 nt, Human
cugcccugguccagggaagc

SEQ ID NO: 2336641 - RNA, 12 nt, Human
cugcccuggugc

SEQ ID NO: 2336642 - RNA, 13 nt, Human
cugcccuggugcu

SEQ ID NO: 2336643 - RNA, 14 nt, Human
cugcccuggugcug

SEQ ID NO: 2336644 - RNA, 23 nt, Human
cugcccugguccagggaagcugg

SEQ ID NO: 2336645 - RNA, 15 nt, Human
cugcccuggugcugc

SEQ ID NO: 2336646 - RNA, 18 nt, Human
cugcccccuucucccaca

SEQ ID NO: 2336647 - RNA, 17 nt, Human
cugcccccuucucccac

SEQ ID NO: 2336648 - RNA, 16 nt, Human
cugcccccuucuccca

SEQ ID NO: 2336649 - RNA, 14 nt, Human
cugcccccuucucc

SEQ ID NO: 2336650 - RNA, 22 nt, Human
cugcccccugguggacaguccu

SEQ ID NO: 2336651 - RNA, 14 nt, Human
cugcccccuggugg

SEQ ID NO: 2336652 - RNA, 13 nt, Human
cugcccccuggug

SEQ ID NO: 2336653 - RNA, 12 nt, Human
cugcccccuggu

SEQ ID NO: 2336654 - RNA, 15 nt, Human
cugcccccugcuggc

SEQ ID NO: 2336655 - RNA, 17 nt, Human
cugcccccugcuggcuc

SEQ ID NO: 2336656 - RNA, 19 nt, Human
cugcccccugcuggcucuu

SEQ ID NO: 2336657 - RNA, 16 nt, Human
cugcccccugaaacuu

SEQ ID NO: 2336658 - RNA, 17 nt, Human
cugcccccugaaacuua

SEQ ID NO: 2336659 - RNA, 18 nt, Human
cugcccccugaaacuuau

SEQ ID NO: 2336660 - RNA, 20 nt, Human
cugcccccugaaacuuauuu

SEQ ID NO: 2336661 - RNA, 14 nt, Human
cugcccccugcugg

SEQ ID NO: 2336662 - RNA, 18 nt, Human
cugcugagggaccagcca

SEQ ID NO: 2336663 - RNA, 22 nt, Human
cugcugagagacccaaggagga

SEQ ID NO: 2336664 - RNA, 21 nt, Human
cugcugagagacccaaggagg

SEQ ID NO: 2336665 - RNA, 16 nt, Human
cugcugagagacccaa

SEQ ID NO: 2336666 - RNA, 15 nt, Human
cugcugagagaccca

SEQ ID NO: 2336667 - RNA, 17 nt, Human
cugcugagggaccagcc

SEQ ID NO: 2336668 - RNA, 22 nt, Human
cugcuacucuguuccuucacau

SEQ ID NO: 2336669 - RNA, 18 nt, Human
cugcuacucuguuccuuc

SEQ ID NO: 2336670 - RNA, 17 nt, Human
cugcuacucuguuccuu

SEQ ID NO: 2336671 - RNA, 21 nt, Human
cugcuacguuccuauugucau

SEQ ID NO: 2336672 - RNA, 20 nt, Human
cugcuacguuccuauuguca

SEQ ID NO: 2336673 - RNA, 18 nt, Human
cugcuaccucacuggggu

SEQ ID NO: 2336674 - RNA, 22 nt, Human
cugcuagcacuuggagccaagg

SEQ ID NO: 2336675 - RNA, 16 nt, Human
cugcuagagccagcaa

SEQ ID NO: 2336676 - RNA, 21 nt, Human
cugcuagcacuuggagccaag

SEQ ID NO: 2336677 - RNA, 14 nt, Human
cugcuagcacuugg

SEQ ID NO: 2336678 - RNA, 18 nt, Human
cugcuacuguaauuuuau

SEQ ID NO: 2336679 - RNA, 17 nt, Human
cugcuacuggcaaaagg

SEQ ID NO: 2336680 - RNA, 20 nt, Human
cugccuguucagcuccagcu

SEQ ID NO: 2336681 - RNA, 23 nt, Human
cugccuguucagcuccagcucac

SEQ ID NO: 2336682 - RNA, 13 nt, Human
cugccugucuccu

SEQ ID NO: 2336683 - RNA, 15 nt, Human
cugccugucugaagc

SEQ ID NO: 2336684 - RNA, 15 nt, Human
cugccuguucccauu

SEQ ID NO: 2336685 - RNA, 19 nt, Human
cugccuguucccauucuug

SEQ ID NO: 2336686 - RNA, 15 nt, Human
cugccugucugucuc

SEQ ID NO: 2336687 - RNA, 23 nt, Human
cugcugaaugauuuccaaagaga

SEQ ID NO: 2336688 - RNA, 22 nt, Human
cugcugaaugauuuccaaagag

SEQ ID NO: 2336689 - RNA, 16 nt, Human
cugcugaauaauaaac

SEQ ID NO: 2336690 - RNA, 15 nt, Human
cugcucaauacaucu

SEQ ID NO: 2336691 - RNA, 17 nt, Human
cugcugaauuuucacau

SEQ ID NO: 2336692 - RNA, 14 nt, Human
cugcugaauuuuca

SEQ ID NO: 2336693 - RNA, 15 nt, Human
cugcugaauuuucac

SEQ ID NO: 2336694 - RNA, 24 nt, Human
cugcugaaggcucgagcaugccug

SEQ ID NO: 2336695 - RNA, 23 nt, Human
cugcugaaggcucgagcaugccu

SEQ ID NO: 2336696 - RNA, 18 nt, Human
cugcugaaggcucgagca

SEQ ID NO: 2336697 - RNA, 16 nt, Human
cugcuauccugccaaa

SEQ ID NO: 2336698 - RNA, 17 nt, Human
cugcuaucaaagagguu

SEQ ID NO: 2336699 - RNA, 20 nt, Human
cugcucaagaagacauggag

SEQ ID NO: 2336700 - RNA, 23 nt, Human
cugcucaagaagacauggagacu

SEQ ID NO: 2336701 - RNA, 22 nt, Human
cugccucucaucaacugaauga

SEQ ID NO: 2336702 - RNA, 17 nt, Human
cugccucgggaaccuca

SEQ ID NO: 2336703 - RNA, 19 nt, Human
cugccucgaaacacagaaa

SEQ ID NO: 2336704 - RNA, 19 nt, Human
cugccucgaacuggcugca

SEQ ID NO: 2336705 - RNA, 18 nt, Human
cugccucgaaacacagaa

SEQ ID NO: 2336706 - RNA, 15 nt, Human
cugccucgaaacaca

SEQ ID NO: 2336707 - RNA, 20 nt, Human
cugccucgaacuggcugcaa

SEQ ID NO: 2336708 - RNA, 21 nt, Human
cugccuguaguuaggaaauaa

SEQ ID NO: 2336709 - RNA, 20 nt, Human
cugccuguaguuaggaaaua

SEQ ID NO: 2336710 - RNA, 19 nt, Human
cugccuguaguuaggaaau

SEQ ID NO: 2336711 - RNA, 18 nt, Human
cugccuguaguuaggaaa

SEQ ID NO: 2336712 - RNA, 17 nt, Human
cugccuguaguuaggaa

SEQ ID NO: 2336713 - RNA, 22 nt, Human
cugccuguaguuaggaaauaaa

SEQ ID NO: 2336714 - RNA, 18 nt, Human
cugccugucccucucagg

SEQ ID NO: 2336715 - RNA, 16 nt, Human
cugccugucccucuca

SEQ ID NO: 2336716 - RNA, 12 nt, Human
cugccugucucc

SEQ ID NO: 2336717 - RNA, 23 nt, Human
cugccugucccucucaggcaugc

SEQ ID NO: 2336718 - RNA, 20 nt, Human
cugccugucccucucaggca

SEQ ID NO: 2336719 - RNA, 19 nt, Human
cugccugucccucucaggc

SEQ ID NO: 2336720 - RNA, 13 nt, Human
cugccugucuguc

SEQ ID NO: 2336721 - RNA, 14 nt, Human
cugccucgaacugg

SEQ ID NO: 2336722 - RNA, 23 nt, Human
cugccuccuuugugaggaagccg

SEQ ID NO: 2336723 - RNA, 17 nt, Human
cugccuccuuugugagg

SEQ ID NO: 2336724 - RNA, 21 nt, Human
cugccuccuuugugaggaagc

SEQ ID NO: 2336725 - RNA, 19 nt, Human
cugccuccugccugccccu

SEQ ID NO: 2336726 - RNA, 15 nt, Human
cugccuccugccugc

SEQ ID NO: 2336727 - RNA, 16 nt, Human
cugccuccugccugcc

SEQ ID NO: 2336728 - RNA, 17 nt, Human
cugccuccugccugccc

SEQ ID NO: 2336729 - RNA, 14 nt, Human
cugccuccuuugug

SEQ ID NO: 2336730 - RNA, 13 nt, Human
cugccuccugccu

SEQ ID NO: 2336731 - RNA, 12 nt, Human
cugccuccugcc

SEQ ID NO: 2336732 - RNA, 18 nt, Human
cuggaugcagccucacag

SEQ ID NO: 2336733 - RNA, 15 nt, Human
cuggaugcagccuca

SEQ ID NO: 2336734 - RNA, 23 nt, Human
cuggauccuagccuuauccucug

SEQ ID NO: 2336735 - RNA, 19 nt, Human
cuggauccaucaggccacu

SEQ ID NO: 2336736 - RNA, 15 nt, Human
cuggauccugaaaua

SEQ ID NO: 2336737 - RNA, 15 nt, Human
cuggaucuccccacu

SEQ ID NO: 2336738 - RNA, 19 nt, Human
cuggauccuagccuuaucc

SEQ ID NO: 2336739 - RNA, 20 nt, Human
cuggaucuccauucucucag

SEQ ID NO: 2336740 - RNA, 16 nt, Human
cuggaugcagccucac

SEQ ID NO: 2336741 - RNA, 17 nt, Human
cuggaugcagccucaca

SEQ ID NO: 2336742 - RNA, 16 nt, Human
cuggaaaccacagucc

SEQ ID NO: 2336743 - RNA, 20 nt, Human
cuggaaaauuccuauugauu

SEQ ID NO: 2336744 - RNA, 22 nt, Human
cuggaaaagggucuugggaaau

SEQ ID NO: 2336745 - RNA, 15 nt, Human
cuggaaaagaggagu

SEQ ID NO: 2336746 - RNA, 19 nt, Human
cuggaaaagggucuuggga

SEQ ID NO: 2336747 - RNA, 18 nt, Human
cuggaaaaugugacccag

SEQ ID NO: 2336748 - RNA, 23 nt, Human
cuggaaaaguauguuagugcaaa

SEQ ID NO: 2336749 - RNA, 22 nt, Human
cugcuuccaccucaccccacuu

SEQ ID NO: 2336750 - RNA, 14 nt, Human
cuggaaaagaggag

SEQ ID NO: 2336751 - RNA, 23 nt, Human
cugcuucagccucccgaguagcu

SEQ ID NO: 2336752 - RNA, 19 nt, Human
cugcuucaguguauggaaa

SEQ ID NO: 2336753 - RNA, 21 nt, Human
cugcuucaguguauggaaaua

SEQ ID NO: 2336754 - RNA, 12 nt, Human
cugcuucagugg

SEQ ID NO: 2336755 - RNA, 15 nt, Human
cugcuucaugacauu

SEQ ID NO: 2336756 - RNA, 14 nt, Human
cugcuuccagugag

SEQ ID NO: 2336757 - RNA, 24 nt, Human
cugcuuccaauuuucuggaauaca

SEQ ID NO: 2336758 - RNA, 21 nt, Human
cugcuucaugcucagcccuga

SEQ ID NO: 2336759 - RNA, 16 nt, Human
cugcuuccaccucacc

SEQ ID NO: 2336760 - RNA, 17 nt, Human
cugcuuccaccucaccc

SEQ ID NO: 2336761 - RNA, 18 nt, Human
cugcuuccaccucacccc

SEQ ID NO: 2336762 - RNA, 19 nt, Human
cugcuuccaccucacccca

SEQ ID NO: 2336763 - RNA, 20 nt, Human
cugcuuccaccucaccccac

SEQ ID NO: 2336764 - RNA, 20 nt, Human
cugcuucaaggauccugagc

SEQ ID NO: 2336765 - RNA, 19 nt, Human
cugcuucaaggauccugag

SEQ ID NO: 2336766 - RNA, 14 nt, Human
cugcuucaaggauc

SEQ ID NO: 2336767 - RNA, 16 nt, Human
cugcuucaaggauccu

SEQ ID NO: 2336768 - RNA, 22 nt, Human
cuggacuccucuguccaggcac

SEQ ID NO: 2336769 - RNA, 23 nt, Human
cuggacuccucuguccaggcacu

SEQ ID NO: 2336770 - RNA, 17 nt, Human
cuggacucucagucucu

SEQ ID NO: 2336771 - RNA, 14 nt, Human
cuggacucucaguc

SEQ ID NO: 2336772 - RNA, 21 nt, Human
cuggagaaaauggacguguua

SEQ ID NO: 2336773 - RNA, 21 nt, Human
cuggacucucagucucugagc

SEQ ID NO: 2336774 - RNA, 20 nt, Human
cuggacucucagucucugag

SEQ ID NO: 2336775 - RNA, 19 nt, Human
cuggacucucagucucuga

SEQ ID NO: 2336776 - RNA, 18 nt, Human
cuggacucucagucucug

SEQ ID NO: 2336777 - RNA, 22 nt, Human
cuggaaaggcucagucucagga

SEQ ID NO: 2336778 - RNA, 21 nt, Human
cuggaaaggcucagucucagg

SEQ ID NO: 2336779 - RNA, 20 nt, Human
cuggaaaggcucagucucag

SEQ ID NO: 2336780 - RNA, 17 nt, Human
cuggaaaggcucagucu

SEQ ID NO: 2336781 - RNA, 15 nt, Human
cuggaaaggcucagu

SEQ ID NO: 2336782 - RNA, 14 nt, Human
cuggaaaggcucag

SEQ ID NO: 2336783 - RNA, 13 nt, Human
cuggaaaggcuca

SEQ ID NO: 2336784 - RNA, 23 nt, Human
cuggaaaggcucagucucaggag

SEQ ID NO: 2336785 - RNA, 13 nt, Human
cuggaaaggggag

SEQ ID NO: 2336786 - RNA, 15 nt, Human
cuggaaaggggagag

SEQ ID NO: 2336787 - RNA, 16 nt, Human
cuggaaaggggagagc

SEQ ID NO: 2336788 - RNA, 17 nt, Human
cuggaaaggggagagcc

SEQ ID NO: 2336789 - RNA, 18 nt, Human
cuggaaaggggagagccu

SEQ ID NO: 2336790 - RNA, 19 nt, Human
cuggaaaggggagagccug

SEQ ID NO: 2336791 - RNA, 20 nt, Human
cuggacuccucuguccaggc

SEQ ID NO: 2336792 - RNA, 19 nt, Human
cuggaaaggggggagcugg

SEQ ID NO: 2336793 - RNA, 20 nt, Human
cuggaaaggggggagcuggg

SEQ ID NO: 2336794 - RNA, 20 nt, Human
cuggaaaggggagagccugc

SEQ ID NO: 2336795 - RNA, 21 nt, Human
cuggaaaggggagagccugcu

SEQ ID NO: 2336796 - RNA, 22 nt, Human
cuggaaaggggagagccugcug

SEQ ID NO: 2336797 - RNA, 23 nt, Human
cuggaaaggggagagccugcugg

SEQ ID NO: 2336798 - RNA, 14 nt, Human
cuggagaacuagag

SEQ ID NO: 2336799 - RNA, 15 nt, Human
cuggagaacuagaga

SEQ ID NO: 2336800 - RNA, 23 nt, Human
cuggacucucagucucugagcag

SEQ ID NO: 2336801 - RNA, 23 nt, Human
cuggaaaggggggagcuggggaa

SEQ ID NO: 2336802 - RNA, 13 nt, Human
cuggagaacuaga

SEQ ID NO: 2336803 - RNA, 23 nt, Human
cuggaguggccacuaagcagagg

SEQ ID NO: 2336804 - RNA, 19 nt, Human
cuggagugguguucagcca

SEQ ID NO: 2336805 - RNA, 14 nt, Human
cuggaguggccacu

SEQ ID NO: 2336806 - RNA, 13 nt, Human
cuggaguggccac

SEQ ID NO: 2336807 - RNA, 24 nt, Human
cuggaguggccacuaagcagagga

SEQ ID NO: 2336808 - RNA, 19 nt, Human
cuggagaagacccuccccg

SEQ ID NO: 2336809 - RNA, 19 nt, Human
cuggagaacuagaaccugg

SEQ ID NO: 2336810 - RNA, 22 nt, Human
cuggagaacuagaaccuggagg

SEQ ID NO: 2336811 - RNA, 23 nt, Human
cuggagaacuagaaccuggaggg

SEQ ID NO: 2336812 - RNA, 12 nt, Human
cuggagaagaga

SEQ ID NO: 2336813 - RNA, 14 nt, Human
cuggagaagagagg

SEQ ID NO: 2336814 - RNA, 15 nt, Human
cuggagaagagagga

SEQ ID NO: 2336815 - RNA, 21 nt, Human
cuggaucaguccuuugaucag

SEQ ID NO: 2336816 - RNA, 20 nt, Human
cuggaucaguccuuugauca

SEQ ID NO: 2336817 - RNA, 17 nt, Human
cuggaucaguccuuuga

SEQ ID NO: 2336818 - RNA, 13 nt, Human
cuggaucaguccu

SEQ ID NO: 2336819 - RNA, 17 nt, Human
cuggauccaucaggcca

SEQ ID NO: 2336820 - RNA, 18 nt, Human
cuggaguguggcugagga

SEQ ID NO: 2336821 - RNA, 19 nt, Human
cuggaguguggcugaggag

SEQ ID NO: 2336822 - RNA, 20 nt, Human
cuggaguguggcugaggagg

SEQ ID NO: 2336823 - RNA, 21 nt, Human
cuggaguguggcugaggaggc

SEQ ID NO: 2336824 - RNA, 22 nt, Human
cuggaguguggcugaggaggcc

SEQ ID NO: 2336825 - RNA, 16 nt, Human
cuggaguuacauuaau

SEQ ID NO: 2336826 - RNA, 22 nt, Human
cuggaguuacauuaauguuaau

SEQ ID NO: 2336827 - RNA, 12 nt, Human
cuggcagcucuc

SEQ ID NO: 2336828 - RNA, 22 nt, Human
cuggcccgucauguuccucaaa

SEQ ID NO: 2336829 - RNA, 15 nt, Human
cuggcccgugacaga

SEQ ID NO: 2336830 - RNA, 13 nt, Human
cuggcagcucucc

SEQ ID NO: 2336831 - RNA, 16 nt, Human
cuggcccgugacagac

SEQ ID NO: 2336832 - RNA, 18 nt, Human
cuggcccgugacagacuc

SEQ ID NO: 2336833 - RNA, 19 nt, Human
cuggcccgugacagacucc

SEQ ID NO: 2336834 - RNA, 23 nt, Human
cuggcccgugacagacuccugag

SEQ ID NO: 2336835 - RNA, 17 nt, Human
cuggcccucaccccugc

SEQ ID NO: 2336836 - RNA, 24 nt, Human
cuggcccucaaggccucccacagu

SEQ ID NO: 2336837 - RNA, 22 nt, Human
cuggcccucaaggccucccaca

SEQ ID NO: 2336838 - RNA, 23 nt, Human
cuggcccucaaggccucccacag

SEQ ID NO: 2336839 - RNA, 17 nt, Human
cuggcccucaaggccuc

SEQ ID NO: 2336840 - RNA, 18 nt, Human
cuggcccucaaggccucc

SEQ ID NO: 2336841 - RNA, 19 nt, Human
cuggcccucaaggccuccc

SEQ ID NO: 2336842 - RNA, 21 nt, Human
cuggcccucaaggccucccac

SEQ ID NO: 2336843 - RNA, 23 nt, Human
cuggcccuaugcuuccggccucc

SEQ ID NO: 2336844 - RNA, 16 nt, Human
cuggcccucaaggccu

SEQ ID NO: 2336845 - RNA, 17 nt, Human
cuggcagccgugccuuc

SEQ ID NO: 2336846 - RNA, 18 nt, Human
cuggcagccgugccuuca

SEQ ID NO: 2336847 - RNA, 16 nt, Human
cuggcagcucagagag

SEQ ID NO: 2336848 - RNA, 17 nt, Human
cuggcagcucagagagg

SEQ ID NO: 2336849 - RNA, 19 nt, Human
cuggcagcucagagagggu

SEQ ID NO: 2336850 - RNA, 23 nt, Human
cuggcccucaccccugcccuggg

SEQ ID NO: 2336851 - RNA, 22 nt, Human
cuggcccucaccccugcccugg

SEQ ID NO: 2336852 - RNA, 21 nt, Human
cuggcccucaccccugcccug

SEQ ID NO: 2336853 - RNA, 19 nt, Human
cuggcccucaccccugccc

SEQ ID NO: 2336854 - RNA, 16 nt, Human
cuggcccucaguuucc

SEQ ID NO: 2336855 - RNA, 23 nt, Human
cuggccgaguccaagcugggaga

SEQ ID NO: 2336856 - RNA, 20 nt, Human
cuggccgaguccaagcuggg

SEQ ID NO: 2336857 - RNA, 18 nt, Human
cuggccgaguccaagcug

SEQ ID NO: 2336858 - RNA, 17 nt, Human
cuggccgaguccaagcu

SEQ ID NO: 2336859 - RNA, 16 nt, Human
cuggccgaguccaagc

SEQ ID NO: 2336860 - RNA, 13 nt, Human
cuggccgcccccu

SEQ ID NO: 2336861 - RNA, 14 nt, Human
cuggccgcccccug

SEQ ID NO: 2336862 - RNA, 22 nt, Human
cuggccgcccccugccccccag

SEQ ID NO: 2336863 - RNA, 18 nt, Human
cuggccgcgccaaauaau

SEQ ID NO: 2336864 - RNA, 14 nt, Human
cuggccgccucacc

SEQ ID NO: 2336865 - RNA, 16 nt, Human
cuggccgccucacccc

SEQ ID NO: 2336866 - RNA, 18 nt, Human
cuggccgccucacccccu

SEQ ID NO: 2336867 - RNA, 19 nt, Human
cuggccgccucacccccuc

SEQ ID NO: 2336868 - RNA, 22 nt, Human
cuggcucccacaggcccuuccu

SEQ ID NO: 2336869 - RNA, 19 nt, Human
cuggcucccacaggcccuu

SEQ ID NO: 2336870 - RNA, 18 nt, Human
cuggcucccacaggcccu

SEQ ID NO: 2336871 - RNA, 21 nt, Human
cuggccggagcaaacucugcu

SEQ ID NO: 2336872 - RNA, 22 nt, Human
cuggccggagcaaacucugcug

SEQ ID NO: 2336873 - RNA, 18 nt, Human
cuggccggagucagugcc

SEQ ID NO: 2336874 - RNA, 23 nt, Human
cuggccggagucagugccagguc

SEQ ID NO: 2336875 - RNA, 18 nt, Human
cuggccggcaaccccagu

SEQ ID NO: 2336876 - RNA, 17 nt, Human
cugggacuacaggcacc

SEQ ID NO: 2336877 - RNA, 22 nt, Human
cuggcucccucuuggucuuccc

SEQ ID NO: 2336878 - RNA, 21 nt, Human
cugggacuacaggcacccacc

SEQ ID NO: 2336879 - RNA, 17 nt, Human
cugggacuacaggugug

SEQ ID NO: 2336880 - RNA, 14 nt, Human
cuggcucccucuug

SEQ ID NO: 2336881 - RNA, 13 nt, Human
cuggcucuuccag

SEQ ID NO: 2336882 - RNA, 14 nt, Human
cuggcucuuccagg

SEQ ID NO: 2336883 - RNA, 15 nt, Human
cuggcucuuccaggc

SEQ ID NO: 2336884 - RNA, 20 nt, Human
cuggcagaguugaagacaga

SEQ ID NO: 2336885 - RNA, 21 nt, Human
cuggcagaguugaagacagag

SEQ ID NO: 2336886 - RNA, 13 nt, Human
cuggcagccgugc

SEQ ID NO: 2336887 - RNA, 23 nt, Human
cuggcagccccuguucuggcaga

SEQ ID NO: 2336888 - RNA, 22 nt, Human
cuggcagaguugaagacagagc

SEQ ID NO: 2336889 - RNA, 16 nt, Human
cuuuuauuguauaaac

SEQ ID NO: 2336890 - RNA, 13 nt, Human
cuuuuauuguaua

SEQ ID NO: 2336891 - RNA, 19 nt, Human
cuuuuauuguauaaacuau

SEQ ID NO: 2336892 - RNA, 18 nt, Human
cuuuuaugugaaacaugu

SEQ ID NO: 2336893 - RNA, 19 nt, Human
cuuuuaugugaaacauguu

SEQ ID NO: 2336894 - RNA, 18 nt, Human
cuuuuauugacacagaaa

SEQ ID NO: 2336895 - RNA, 17 nt, Human
cuuuuauugacacagaa

SEQ ID NO: 2336896 - RNA, 19 nt, Human
cuuuuauuaaugcacuuuc

SEQ ID NO: 2336897 - RNA, 18 nt, Human
cuuuuauguuauuuauau

SEQ ID NO: 2336898 - RNA, 17 nt, Human
cuuuuauucauuugagu

SEQ ID NO: 2336899 - RNA, 14 nt, Human
cuuuuauuaaugca

SEQ ID NO: 2336900 - RNA, 16 nt, Human
cuuuuauuaaugcacu

SEQ ID NO: 2336901 - RNA, 20 nt, Human
cuuuuauguuauuuauauau

SEQ ID NO: 2336902 - RNA, 12 nt, Human
gaaacaaagaag

SEQ ID NO: 2336903 - RNA, 21 nt, Human
gaaaagagauauuuuaaaaug

SEQ ID NO: 2336904 - RNA, 13 nt, Human
gaaacaaagaagg

SEQ ID NO: 2336905 - RNA, 14 nt, Human
gaaaauuuuaaaaa

SEQ ID NO: 2336906 - RNA, 18 nt, Human
gaaaauuuugauguuuua

SEQ ID NO: 2336907 - RNA, 23 nt, Human
gaaacaaaaacacuaaaaauaaa

SEQ ID NO: 2336908 - RNA, 19 nt, Human
gaaacaaaaacacuaaaaa

SEQ ID NO: 2336909 - RNA, 14 nt, Human
gaaacaaaaacacu

SEQ ID NO: 2336910 - RNA, 20 nt, Human
gaaaagcggacaucagcugg

SEQ ID NO: 2336911 - RNA, 15 nt, Human
gaaaagccucugugu

SEQ ID NO: 2336912 - RNA, 21 nt, Human
gaaaauguugagaaucccaaa

SEQ ID NO: 2336913 - RNA, 14 nt, Human
gaaaauuaacauga

SEQ ID NO: 2336914 - RNA, 15 nt, Human
gaaaauuaacacugc

SEQ ID NO: 2336915 - RNA, 13 nt, Human
gaaaauuaacacu

SEQ ID NO: 2336916 - RNA, 20 nt, Human
gaaaauguuuuucugccagg

SEQ ID NO: 2336917 - RNA, 18 nt, Human
gaaaauuaggauuucaug

SEQ ID NO: 2336918 - RNA, 22 nt, Human
gaaaauuaggauuucaugauuu

SEQ ID NO: 2336919 - RNA, 18 nt, Human
gaaaagcggacaucagcu

SEQ ID NO: 2336920 - RNA, 13 nt, Human
gaaaagccucugu

SEQ ID NO: 2336921 - RNA, 14 nt, Human
gaaaagccucugug

SEQ ID NO: 2336922 - RNA, 21 nt, Human
gaaaagccucugugucacugg

SEQ ID NO: 2336923 - RNA, 20 nt, Human
gaaaagcagcccuuggccag

SEQ ID NO: 2336924 - RNA, 17 nt, Human
gaaaagcagcucucccc

SEQ ID NO: 2336925 - RNA, 14 nt, Human
gaaaagcagcucuc

SEQ ID NO: 2336926 - RNA, 17 nt, Human
gaaaagcaccugccgac

SEQ ID NO: 2336927 - RNA, 19 nt, Human
gaaaagcagcccuuggcca

SEQ ID NO: 2336928 - RNA, 16 nt, Human
gaaaagcaccugccga

SEQ ID NO: 2336929 - RNA, 19 nt, Human
gaaaagagauauuuuaaaa

SEQ ID NO: 2336930 - RNA, 15 nt, Human
gaaaagagauauuuu

SEQ ID NO: 2336931 - RNA, 16 nt, Human
gaaaacuucuuuuaaa

SEQ ID NO: 2336932 - RNA, 16 nt, Human
gaaaacuuauuugagu

SEQ ID NO: 2336933 - RNA, 21 nt, Human
gaaaagacuccaaagaaaugu

SEQ ID NO: 2336934 - RNA, 20 nt, Human
gaaaagacuccaaagaaaug

SEQ ID NO: 2336935 - RNA, 16 nt, Human
gaaaacugaaaaucua

SEQ ID NO: 2336936 - RNA, 17 nt, Human
gaaaacucauuacuuuu

SEQ ID NO: 2336937 - RNA, 20 nt, Human
gaaaacuccuuuagcaggug

SEQ ID NO: 2336938 - RNA, 19 nt, Human
gaaaaaaugauguucauuu

SEQ ID NO: 2336939 - RNA, 14 nt, Human
gaaaaaauguugga

SEQ ID NO: 2336940 - RNA, 18 nt, Human
gaaaaaauguuggauuua

SEQ ID NO: 2336941 - RNA, 21 nt, Human
gaaaaaauguuggauuuauaa

SEQ ID NO: 2336942 - RNA, 19 nt, Human
gaaaacugcaacuuguaaa

SEQ ID NO: 2336943 - RNA, 16 nt, Human
gaaaacugacagagga

SEQ ID NO: 2336944 - RNA, 20 nt, Human
gaaaacugaaaaucuaauau

SEQ ID NO: 2336945 - RNA, 18 nt, Human
gaaaacugaaaaucuaau

SEQ ID NO: 2336946 - RNA, 23 nt, Human
gaaaacuuaugaccucuuccuuu

SEQ ID NO: 2336947 - RNA, 14 nt, Human
gaaaacuuauuuga

SEQ ID NO: 2336948 - RNA, 15 nt, Human
gaaaacuuauuugag

SEQ ID NO: 2336949 - RNA, 15 nt, Human
cuuuuuuuuguaugu

SEQ ID NO: 2336950 - RNA, 21 nt, Human
cuuuuuuuuuuuuuuugacaa

SEQ ID NO: 2336951 - RNA, 13 nt, Human
gaaaaaaaaagaa

SEQ ID NO: 2336952 - RNA, 12 nt, Human
gaaaaaaaaaga

SEQ ID NO: 2336953 - RNA, 20 nt, Human
gaaaaaaaaaaugcugaaca

SEQ ID NO: 2336954 - RNA, 19 nt, Human
gaaaaaaaaaaugcugaac

SEQ ID NO: 2336955 - RNA, 18 nt, Human
gaaaaaaaaaaugcugaa

SEQ ID NO: 2336956 - RNA, 15 nt, Human
cuuuuuuuuuccaaa

SEQ ID NO: 2336957 - RNA, 19 nt, Human
gaaaaaauauuuuccugcc

SEQ ID NO: 2336958 - RNA, 14 nt, Human
gaaaaaauauauau

SEQ ID NO: 2336959 - RNA, 14 nt, Human
gaaaaaauacauuu

SEQ ID NO: 2336960 - RNA, 13 nt, Human
gaaaaaauacauu

SEQ ID NO: 2336961 - RNA, 10 nt, Human
gaaaaaauac

SEQ ID NO: 2336962 - RNA, 17 nt, Human
gaaaaaauacauuuuau

SEQ ID NO: 2336963 - RNA, 15 nt, Human
gaaaaaauacauuuu

SEQ ID NO: 2336964 - RNA, 18 nt, Human
gaaaaaaaaagaaaaaag

SEQ ID NO: 2336965 - RNA, 17 nt, Human
gaaaaaaaaagaaaaaa

SEQ ID NO: 2336966 - RNA, 16 nt, Human
gaaaaaaaaagaaaaa

SEQ ID NO: 2336967 - RNA, 15 nt, Human
gaaaaaaaaagaaaa

SEQ ID NO: 2336968 - RNA, 14 nt, Human
cuuuuguguacagu

SEQ ID NO: 2336969 - RNA, 23 nt, Human
cuuuuguguacaguguguaaagu

SEQ ID NO: 2336970 - RNA, 18 nt, Human
cuuuugugcauuaucuag

SEQ ID NO: 2336971 - RNA, 14 nt, Human
cuuuugugcauuau

SEQ ID NO: 2336972 - RNA, 14 nt, Human
cuuuuuuuuaaguu

SEQ ID NO: 2336973 - RNA, 21 nt, Human
cuuuuuuuuccccccuagaaa

SEQ ID NO: 2336974 - RNA, 17 nt, Human
cuuuuuuuuaaugugcu

SEQ ID NO: 2336975 - RNA, 18 nt, Human
cuuuuuuuuaaugugcug

SEQ ID NO: 2336976 - RNA, 15 nt, Human
cuuuuuuuucuuuaa

SEQ ID NO: 2336977 - RNA, 14 nt, Human
cuuuuuuuucuuua

SEQ ID NO: 2336978 - RNA, 22 nt, Human
cuuuugcucuuagcugucugcu

SEQ ID NO: 2336979 - RNA, 14 nt, Human
cuuuugcuuuauuc

SEQ ID NO: 2336980 - RNA, 11 nt, Human
cuuuugcuuuu

SEQ ID NO: 2336981 - RNA, 18 nt, Human
cuuuugccguuauuaaaa

SEQ ID NO: 2336982 - RNA, 20 nt, Human
cuuuugguaaagacuggcuu

SEQ ID NO: 2336983 - RNA, 21 nt, Human
cuuuugguaaagacuggcuuu

SEQ ID NO: 2336984 - RNA, 17 nt, Human
cuuuugcuuuuggcaaa

SEQ ID NO: 2336985 - RNA, 15 nt, Human
cuuuugcuuuuggca

SEQ ID NO: 2336986 - RNA, 15 nt, Human
cuuuuggucugugug

SEQ ID NO: 2336987 - RNA, 16 nt, Human
cuuuuggucuguguga

SEQ ID NO: 2336988 - RNA, 17 nt, Human
cuuuugucuaugggacu

SEQ ID NO: 2336989 - RNA, 14 nt, Human
cuuuugucccagaa

SEQ ID NO: 2336990 - RNA, 14 nt, Human
cuuuuguauaguug

SEQ ID NO: 2336991 - RNA, 13 nt, Human
cuuuuguauguaa

SEQ ID NO: 2336992 - RNA, 15 nt, Human
cuuuuguauguaaau

SEQ ID NO: 2336993 - RNA, 16 nt, Human
cuuuuguauguaaaug

SEQ ID NO: 2336994 - RNA, 17 nt, Human
cuuuuguauguaaaugu

SEQ ID NO: 2336995 - RNA, 18 nt, Human
cuuuuguauguaaaugug

SEQ ID NO: 2336996 - RNA, 20 nt, Human
cuuuuguauguaaaugugca

SEQ ID NO: 2336997 - RNA, 21 nt, Human
cuuuuguauguaaaugugcau

SEQ ID NO: 2336998 - RNA, 23 nt, Human
cuuuuguauguaaaugugcauuc

SEQ ID NO: 2336999 - RNA, 22 nt, Human
gaacaagucccuguaauuguug

SEQ ID NO: 2337000 - RNA, 21 nt, Human
gaacaaggcaaggcugucaau

SEQ ID NO: 2337001 - RNA, 14 nt, Human
gaacaaggcaaggc

SEQ ID NO: 2337002 - RNA, 15 nt, Human
gaacaaggcaaggcu

SEQ ID NO: 2337003 - RNA, 17 nt, Human
gaacaaggcaaggcugu

SEQ ID NO: 2337004 - RNA, 18 nt, Human
gaacaaggcaaggcuguc

SEQ ID NO: 2337005 - RNA, 16 nt, Human
gaacaagcauucuccu

SEQ ID NO: 2337006 - RNA, 13 nt, Human
gaacaagccuaaa

SEQ ID NO: 2337007 - RNA, 21 nt, Human
gaacaacuaggcuucagcaua

SEQ ID NO: 2337008 - RNA, 19 nt, Human
gaacaacuaggcuucagca

SEQ ID NO: 2337009 - RNA, 15 nt, Human
gaacaacuacuguga

SEQ ID NO: 2337010 - RNA, 23 nt, Human
gaacaaauuuacagagacagaaa

SEQ ID NO: 2337011 - RNA, 19 nt, Human
gaaauuuuuauuaaauuau

SEQ ID NO: 2337012 - RNA, 19 nt, Human
gaaaugaauaauuucccaa

SEQ ID NO: 2337013 - RNA, 17 nt, Human
gaaauuuuuauuuuucu

SEQ ID NO: 2337014 - RNA, 18 nt, Human
gaaaugaauaauuuccca

SEQ ID NO: 2337015 - RNA, 14 nt, Human
gaaaugaauaauuu

SEQ ID NO: 2337016 - RNA, 20 nt, Human
gaaauuuuucagaugcuucu

SEQ ID NO: 2337017 - RNA, 17 nt, Human
gaaauuuuucagaugcu

SEQ ID NO: 2337018 - RNA, 22 nt, Human
gaaauuuuucagaugcuucugg

SEQ ID NO: 2337019 - RNA, 18 nt, Human
gaacaaauuuacagagac

SEQ ID NO: 2337020 - RNA, 17 nt, Human
gaacaaauuuacagaga

SEQ ID NO: 2337021 - RNA, 18 nt, Human
gaaaugaaagcagggacu

SEQ ID NO: 2337022 - RNA, 18 nt, Human
gaaauuuuuauuaaauua

SEQ ID NO: 2337023 - RNA, 13 nt, Human
gaaaugaauaauu

SEQ ID NO: 2337024 - RNA, 15 nt, Human
gaaaucacagaauca

SEQ ID NO: 2337025 - RNA, 16 nt, Human
gaaaucacagaaucau

SEQ ID NO: 2337026 - RNA, 23 nt, Human
gaaaucaaauaugcaaagcacug

SEQ ID NO: 2337027 - RNA, 17 nt, Human
gaaaucaccgaaaacgu

SEQ ID NO: 2337028 - RNA, 17 nt, Human
gaaaugaaagcagggac

SEQ ID NO: 2337029 - RNA, 16 nt, Human
gaaagguuuacauugu

SEQ ID NO: 2337030 - RNA, 20 nt, Human
gaaagguuugagaagcacug

SEQ ID NO: 2337031 - RNA, 21 nt, Human
gaaaguacuucuccacccugc

SEQ ID NO: 2337032 - RNA, 19 nt, Human
gaaauauuuauuuuuuuaa

SEQ ID NO: 2337033 - RNA, 17 nt, Human
gaaaucaaauaugcaaa

SEQ ID NO: 2337034 - RNA, 21 nt, Human
gaaaucaaauaugcaaagcac

SEQ ID NO: 2337035 - RNA, 19 nt, Human
gaaaucaaagagagaaaau

SEQ ID NO: 2337036 - RNA, 16 nt, Human
gaaaucaaauaugcaa

SEQ ID NO: 2337037 - RNA, 16 nt, Human
gaaagacagcuucuca

SEQ ID NO: 2337038 - RNA, 17 nt, Human
gaaagacagcuucucau

SEQ ID NO: 2337039 - RNA, 16 nt, Human
gaaagaccauuuuucc

SEQ ID NO: 2337040 - RNA, 22 nt, Human
gaaagacauccauaaagaagca

SEQ ID NO: 2337041 - RNA, 21 nt, Human
gaaagacauccauaaagaagc

SEQ ID NO: 2337042 - RNA, 23 nt, Human
gaaagacauccauaaagaagcaa

SEQ ID NO: 2337043 - RNA, 21 nt, Human
gaaagacggauugcauuagaa

SEQ ID NO: 2337044 - RNA, 18 nt, Human
gaaagacuaucuaaaugu

SEQ ID NO: 2337045 - RNA, 14 nt, Human
gaaagguuuacauu

SEQ ID NO: 2337046 - RNA, 14 nt, Human
gaaagguucugccc

SEQ ID NO: 2337047 - RNA, 15 nt, Human
gaaagguucugcccg

SEQ ID NO: 2337048 - RNA, 19 nt, Human
gaaaggcuccaggagcagc

SEQ ID NO: 2337049 - RNA, 17 nt, Human
gaaaggcuccaggagca

SEQ ID NO: 2337050 - RNA, 18 nt, Human
gaaaggcuccaggagcag

SEQ ID NO: 2337051 - RNA, 16 nt, Human
gaaagaaggcaaaguc

SEQ ID NO: 2337052 - RNA, 16 nt, Human
gaaagaaugaaagagu

SEQ ID NO: 2337053 - RNA, 19 nt, Human
gaaagaaugaaagaguaaa

SEQ ID NO: 2337054 - RNA, 14 nt, Human
gaaagacagagcug

SEQ ID NO: 2337055 - RNA, 16 nt, Human
gaaagacagagcuggg

SEQ ID NO: 2337056 - RNA, 11 nt, Human
gaaagaaggaa

SEQ ID NO: 2337057 - RNA, 15 nt, Human
gaaagaagagacagg

SEQ ID NO: 2337058 - RNA, 19 nt, Human
gaaagaagagccggagccu

SEQ ID NO: 2337059 - RNA, 11 nt, Human
gaaagaagaga

SEQ ID NO: 2337060 - RNA, 18 nt, Human
gaaagaaguggggacaga

SEQ ID NO: 2337061 - RNA, 11 nt, Human
gaaacuuggau

SEQ ID NO: 2337062 - RNA, 12 nt, Human
gaaacuuggcuc

SEQ ID NO: 2337063 - RNA, 22 nt, Human
gaaacuguucccaccugcugga

SEQ ID NO: 2337064 - RNA, 21 nt, Human
gaaacuguucccaccugcugg

SEQ ID NO: 2337065 - RNA, 20 nt, Human
gaaacuguucccaccugcug

SEQ ID NO: 2337066 - RNA, 23 nt, Human
gaaacuguugccagagauggagg

SEQ ID NO: 2337067 - RNA, 21 nt, Human
gaaacuguugccagagaugga

SEQ ID NO: 2337068 - RNA, 17 nt, Human
gaaacuguugccagaga

SEQ ID NO: 2337069 - RNA, 15 nt, Human
gaaacuguugccaga

SEQ ID NO: 2337070 - RNA, 15 nt, Human
gaaacuuacacacaa

SEQ ID NO: 2337071 - RNA, 14 nt, Human
gaaacuuacacaca

SEQ ID NO: 2337072 - RNA, 21 nt, Human
gaaacuuauuuuuuucugauu

SEQ ID NO: 2337073 - RNA, 19 nt, Human
gaaacuuauuuuuuucuga

SEQ ID NO: 2337074 - RNA, 20 nt, Human
gaaacuuauuuuuuucugau

SEQ ID NO: 2337075 - RNA, 11 nt, Human
gaaacuuauuu

SEQ ID NO: 2337076 - RNA, 12 nt, Human
gaaacuuauuuu

SEQ ID NO: 2337077 - RNA, 17 nt, Human
gaaacuuauuuuuuucu

SEQ ID NO: 2337078 - RNA, 23 nt, Human
gaaacuucagcgguuuauauaag

SEQ ID NO: 2337079 - RNA, 23 nt, Human
cuugccgcgucgcccucccaggc

SEQ ID NO: 2337080 - RNA, 18 nt, Human
cuugccucaaugccagua

SEQ ID NO: 2337081 - RNA, 19 nt, Human
cuugccgucuaccugaggg

SEQ ID NO: 2337082 - RNA, 21 nt, Human
cuugccgcgucgcccucccag

SEQ ID NO: 2337083 - RNA, 18 nt, Human
cuugccgcgucgcccucc

SEQ ID NO: 2337084 - RNA, 23 nt, Human
cuugccgaaccaggagcugcuca

SEQ ID NO: 2337085 - RNA, 18 nt, Human
cuugccgucuaccugagg

SEQ ID NO: 2337086 - RNA, 23 nt, Human
cuugcccuucccugucccucuaa

SEQ ID NO: 2337087 - RNA, 15 nt, Human
cuugcccuugcccug

SEQ ID NO: 2337088 - RNA, 17 nt, Human
cuugcccuugcccugac

SEQ ID NO: 2337089 - RNA, 22 nt, Human
cuugauucugcaguaaaucuuu

SEQ ID NO: 2337090 - RNA, 21 nt, Human
cuugauucugcaguaaaucuu

SEQ ID NO: 2337091 - RNA, 19 nt, Human
cuugauucauaaugacuua

SEQ ID NO: 2337092 - RNA, 13 nt, Human
cuugauucugcag

SEQ ID NO: 2337093 - RNA, 20 nt, Human
cuugauucugcaguaaaucu

SEQ ID NO: 2337094 - RNA, 17 nt, Human
cuugauucugcaguaaa

SEQ ID NO: 2337095 - RNA, 15 nt, Human
cuugaugugccauuu

SEQ ID NO: 2337096 - RNA, 22 nt, Human
cuugaugugccauuuuaaaaaa

SEQ ID NO: 2337097 - RNA, 12 nt, Human
cuugaugugccu

SEQ ID NO: 2337098 - RNA, 22 nt, Human
cuugauguggugaggcaggcuu

SEQ ID NO: 2337099 - RNA, 15 nt, Human
cuugauguguuaucu

SEQ ID NO: 2337100 - RNA, 21 nt, Human
cuugauggcuccgaacacccu

SEQ ID NO: 2337101 - RNA, 15 nt, Human
cuugccuccugugua

SEQ ID NO: 2337102 - RNA, 12 nt, Human
cuugccuccugu

SEQ ID NO: 2337103 - RNA, 15 nt, Human
cuugccucggcuccu

SEQ ID NO: 2337104 - RNA, 16 nt, Human
cuugccucggcuccug

SEQ ID NO: 2337105 - RNA, 20 nt, Human
cuugccuccccauuucccau

SEQ ID NO: 2337106 - RNA, 12 nt, Human
cuugccuccugg

SEQ ID NO: 2337107 - RNA, 13 nt, Human
cuugccuccugga

SEQ ID NO: 2337108 - RNA, 12 nt, Human
cuugccucccca

SEQ ID NO: 2337109 - RNA, 16 nt, Human
cuugcccuugcccuga

SEQ ID NO: 2337110 - RNA, 14 nt, Human
cuugccuccccauu

SEQ ID NO: 2337111 - RNA, 15 nt, Human
cuuggauuguccccg

SEQ ID NO: 2337112 - RNA, 17 nt, Human
cuugccucggcuccugc

SEQ ID NO: 2337113 - RNA, 18 nt, Human
cuugccucggcuccugcu

SEQ ID NO: 2337114 - RNA, 19 nt, Human
cuugccucggcuccugcug

SEQ ID NO: 2337115 - RNA, 20 nt, Human
cuugccucggcuccugcugc

SEQ ID NO: 2337116 - RNA, 21 nt, Human
cuugccucggcuccugcugca

SEQ ID NO: 2337117 - RNA, 22 nt, Human
cuugccucggcuccugcugcac

SEQ ID NO: 2337118 - RNA, 23 nt, Human
cuugccucggcuccugcugcacc

SEQ ID NO: 2337119 - RNA, 13 nt, Human
cuugccucucugu

SEQ ID NO: 2337120 - RNA, 22 nt, Human
cuuggauuguccccgacccuug

SEQ ID NO: 2337121 - RNA, 17 nt, Human
cuugccucuguccccuu

SEQ ID NO: 2337122 - RNA, 18 nt, Human
cuuggauuguccccgacc

SEQ ID NO: 2337123 - RNA, 20 nt, Human
cuuggauuguccccgacccu

SEQ ID NO: 2337124 - RNA, 14 nt, Human
cuugccucucuguu

SEQ ID NO: 2337125 - RNA, 18 nt, Human
cuuggcccgcacagagcu

SEQ ID NO: 2337126 - RNA, 23 nt, Human
cuuggcgcugccccuggcagccc

SEQ ID NO: 2337127 - RNA, 14 nt, Human
cuuggcggcagcag

SEQ ID NO: 2337128 - RNA, 15 nt, Human
cuuggcggcagcagc

SEQ ID NO: 2337129 - RNA, 17 nt, Human
cuuggcggcagcagcca

SEQ ID NO: 2337130 - RNA, 18 nt, Human
cuuggcggcagcagccau

SEQ ID NO: 2337131 - RNA, 19 nt, Human
cuuggcggcagcagccauc

SEQ ID NO: 2337132 - RNA, 21 nt, Human
cuuggcgcugccccuggcagc

SEQ ID NO: 2337133 - RNA, 22 nt, Human
cuuggcgcugccccuggcagcc

SEQ ID NO: 2337134 - RNA, 15 nt, Human
cuugguccugcugca

SEQ ID NO: 2337135 - RNA, 16 nt, Human
cuugguccugcugcag

SEQ ID NO: 2337136 - RNA, 17 nt, Human
cuugguccugcugcagu

SEQ ID NO: 2337137 - RNA, 18 nt, Human
cuugguccugcugcaguu

SEQ ID NO: 2337138 - RNA, 20 nt, Human
cuugguccugcugcaguugc

SEQ ID NO: 2337139 - RNA, 20 nt, Human
cuugucucccagcucagggc

SEQ ID NO: 2337140 - RNA, 15 nt, Human
cuugguugaggaaac

SEQ ID NO: 2337141 - RNA, 14 nt, Human
cuugguugaggaaa

SEQ ID NO: 2337142 - RNA, 16 nt, Human
cuugguugaggaaaca

SEQ ID NO: 2337143 - RNA, 14 nt, Human
cuugguuggcuggc

SEQ ID NO: 2337144 - RNA, 17 nt, Human
cuugguucccuugugug

SEQ ID NO: 2337145 - RNA, 19 nt, Human
cuugguucccccacugauc

SEQ ID NO: 2337146 - RNA, 16 nt, Human
cuugguucccccacug

SEQ ID NO: 2337147 - RNA, 14 nt, Human
cuugucuuguucac

SEQ ID NO: 2337148 - RNA, 20 nt, Human
cuugucuuuggacccugagg

SEQ ID NO: 2337149 - RNA, 13 nt, Human
cuugucucugggc

SEQ ID NO: 2337150 - RNA, 14 nt, Human
cuugucucugggcu

SEQ ID NO: 2337151 - RNA, 12 nt, Human
cuugucugagau

SEQ ID NO: 2337152 - RNA, 23 nt, Human
cuugucugauuggcucacccaag

SEQ ID NO: 2337153 - RNA, 13 nt, Human
cuugucuguagau

SEQ ID NO: 2337154 - RNA, 20 nt, Human
cuuggucugauuucaggaua

SEQ ID NO: 2337155 - RNA, 19 nt, Human
cuuggugugacccucugaa

SEQ ID NO: 2337156 - RNA, 14 nt, Human
cuugguucauaaau

SEQ ID NO: 2337157 - RNA, 21 nt, Human
cuugguuauuuguuuaccacu

SEQ ID NO: 2337158 - RNA, 16 nt, Human
cuugguucauaaauga

SEQ ID NO: 2337159 - RNA, 22 nt, Human
cuugguccugcugcaguugcca

SEQ ID NO: 2337160 - RNA, 23 nt, Human
cuuggucucagugucaaugcagc

SEQ ID NO: 2337161 - RNA, 20 nt, Human
cuugguucccauuugcuccu

SEQ ID NO: 2337162 - RNA, 20 nt, Human
cuugguuccagccugccacu

SEQ ID NO: 2337163 - RNA, 13 nt, Human
cuugguuccccca

SEQ ID NO: 2337164 - RNA, 17 nt, Human
cuugguucauaaaugaa

SEQ ID NO: 2337165 - RNA, 22 nt, Human
cuugguucauaaaugaauuuua

SEQ ID NO: 2337166 - RNA, 16 nt, Human
cuugguucccauuugc

SEQ ID NO: 2337167 - RNA, 19 nt, Human
cuugguuccagccugccac

SEQ ID NO: 2337168 - RNA, 17 nt, Human
cuugguuccagccugcc

SEQ ID NO: 2337169 - RNA, 12 nt, Human
cuuuaaugcauc

SEQ ID NO: 2337170 - RNA, 14 nt, Human
cuuuaaugcaucua

SEQ ID NO: 2337171 - RNA, 13 nt, Human
cuuuaaugcaucu

SEQ ID NO: 2337172 - RNA, 19 nt, Human
cuuuaagcagcucuugcua

SEQ ID NO: 2337173 - RNA, 12 nt, Human
cuuuaaggaaaa

SEQ ID NO: 2337174 - RNA, 21 nt, Human
cuuuaagcagcucuugcuaau

SEQ ID NO: 2337175 - RNA, 23 nt, Human
cuuuaagacauacuccuuccauc

SEQ ID NO: 2337176 - RNA, 15 nt, Human
cuuuaagacugagca

SEQ ID NO: 2337177 - RNA, 14 nt, Human
cuuuaagaggacau

SEQ ID NO: 2337178 - RNA, 19 nt, Human
cuuuaagcacuacauaaac

SEQ ID NO: 2337179 - RNA, 20 nt, Human
cuuuaagcacuacauaaacu

SEQ ID NO: 2337180 - RNA, 14 nt, Human
cuuuaagcagcucu

SEQ ID NO: 2337181 - RNA, 16 nt, Human
cuuuaagcagcucuug

SEQ ID NO: 2337182 - RNA, 17 nt, Human
cuuuaagcagcucuugc

SEQ ID NO: 2337183 - RNA, 18 nt, Human
cuuuaagcagcucuugcu

SEQ ID NO: 2337184 - RNA, 14 nt, Human
cuuuaagacauacu

SEQ ID NO: 2337185 - RNA, 19 nt, Human
cuuuaacuuaauugcuaug

SEQ ID NO: 2337186 - RNA, 21 nt, Human
cuugucuuuggacccugaggc

SEQ ID NO: 2337187 - RNA, 22 nt, Human
cuugucuuuggacccugaggcc

SEQ ID NO: 2337188 - RNA, 22 nt, Human
cuuuaaugucacaggcaggucc

SEQ ID NO: 2337189 - RNA, 12 nt, Human
cuuuaaugcuuu

SEQ ID NO: 2337190 - RNA, 23 nt, Human
cuuuaaugcaucuagauuaugga

SEQ ID NO: 2337191 - RNA, 14 nt, Human
cuuucaauaggaaa

SEQ ID NO: 2337192 - RNA, 15 nt, Human
cuuucaauaggaaaa

SEQ ID NO: 2337193 - RNA, 17 nt, Human
cuuuaaugucacaggca

SEQ ID NO: 2337194 - RNA, 18 nt, Human
cuuuaaugucacaggcag

SEQ ID NO: 2337195 - RNA, 19 nt, Human
cuuuaaugucacaggcagg

SEQ ID NO: 2337196 - RNA, 20 nt, Human
cuuuaaugucacaggcaggu

SEQ ID NO: 2337197 - RNA, 16 nt, Human
cuuucacauagauguc

SEQ ID NO: 2337198 - RNA, 17 nt, Human
cuuucacauagagauca

SEQ ID NO: 2337199 - RNA, 15 nt, Human
cuuucaccccagggc

SEQ ID NO: 2337200 - RNA, 21 nt, Human
cuuucaccccagggccugagc

SEQ ID NO: 2337201 - RNA, 16 nt, Human
cuuucaccccagggcc

SEQ ID NO: 2337202 - RNA, 23 nt, Human
cuuucacacuuccaccagccugc

SEQ ID NO: 2337203 - RNA, 15 nt, Human
cuuucacagcuccuc

SEQ ID NO: 2337204 - RNA, 18 nt, Human
cuuucacagcuccuccca

SEQ ID NO: 2337205 - RNA, 21 nt, Human
cuuucacacuuccaccagccu

SEQ ID NO: 2337206 - RNA, 20 nt, Human
cuuucacacuuccaccagcc

SEQ ID NO: 2337207 - RNA, 19 nt, Human
cuuucacacuuccaccagc

SEQ ID NO: 2337208 - RNA, 16 nt, Human
cuuucacacuuccacc

SEQ ID NO: 2337209 - RNA, 13 nt, Human
cuuucacagcucc

SEQ ID NO: 2337210 - RNA, 14 nt, Human
cuuucacagcuccu

SEQ ID NO: 2337211 - RNA, 15 nt, Human
cuuucacacuuccac

SEQ ID NO: 2337212 - RNA, 14 nt, Human
cuuucacacuucca

SEQ ID NO: 2337213 - RNA, 16 nt, Human
cuuucacaaccuucug

SEQ ID NO: 2337214 - RNA, 18 nt, Human
cuuucaauaggaaaaacu

SEQ ID NO: 2337215 - RNA, 17 nt, Human
cuuucaauaggaaaaac

SEQ ID NO: 2337216 - RNA, 21 nt, Human
cuuccaugagaacagcagggu

SEQ ID NO: 2337217 - RNA, 15 nt, Human
cuuccauguggagaa

SEQ ID NO: 2337218 - RNA, 18 nt, Human
cuuccauguggagaaagg

SEQ ID NO: 2337219 - RNA, 18 nt, Human
cuuccaucuuuccugaug

SEQ ID NO: 2337220 - RNA, 22 nt, Human
cuuccaucuuuccugauggcag

SEQ ID NO: 2337221 - RNA, 12 nt, Human
cuuccauuuaua

SEQ ID NO: 2337222 - RNA, 17 nt, Human
cuuccaugagaacagca

SEQ ID NO: 2337223 - RNA, 13 nt, Human
cuuccauuugcaa

SEQ ID NO: 2337224 - RNA, 16 nt, Human
cuuccauuugugugug

SEQ ID NO: 2337225 - RNA, 14 nt, Human
cuuccauuugcaag

SEQ ID NO: 2337226 - RNA, 14 nt, Human
cuucccaaaggacu

SEQ ID NO: 2337227 - RNA, 21 nt, Human
cuucccaaaggacuccaccca

SEQ ID NO: 2337228 - RNA, 18 nt, Human
cuucccaaaggacuccac

SEQ ID NO: 2337229 - RNA, 19 nt, Human
cuucccaaaggacuccacc

SEQ ID NO: 2337230 - RNA, 14 nt, Human
cuuacaugcauuug

SEQ ID NO: 2337231 - RNA, 21 nt, Human
cuuccauaugaccucaugcau

SEQ ID NO: 2337232 - RNA, 20 nt, Human
cuuacauuagcaguuugcuu

SEQ ID NO: 2337233 - RNA, 12 nt, Human
cuuccaucaugu

SEQ ID NO: 2337234 - RNA, 13 nt, Human
cuuccaucauguc

SEQ ID NO: 2337235 - RNA, 17 nt, Human
cuuccaucaugucccca

SEQ ID NO: 2337236 - RNA, 14 nt, Human
cuuccaucaugucc

SEQ ID NO: 2337237 - RNA, 14 nt, Human
cuuccaucccagag

SEQ ID NO: 2337238 - RNA, 14 nt, Human
cuuccaucccagga

SEQ ID NO: 2337239 - RNA, 17 nt, Human
cuuccaucccaggacac

SEQ ID NO: 2337240 - RNA, 16 nt, Human
cuuccaucccuacccc

SEQ ID NO: 2337241 - RNA, 15 nt, Human
cuuccaucccuaccc

SEQ ID NO: 2337242 - RNA, 14 nt, Human
cuuccaucccuacc

SEQ ID NO: 2337243 - RNA, 12 nt, Human
cuuccaucccua

SEQ ID NO: 2337244 - RNA, 19 nt, Human
cuuccaucccuacccccua

SEQ ID NO: 2337245 - RNA, 17 nt, Human
cuuccaucccuaccccc

SEQ ID NO: 2337246 - RNA, 15 nt, Human
cuuccaucucgccac

SEQ ID NO: 2337247 - RNA, 22 nt, Human
cuuccaucccaggacaccacac

SEQ ID NO: 2337248 - RNA, 21 nt, Human
cuuacauguuuucuuugcuuu

SEQ ID NO: 2337249 - RNA, 14 nt, Human
cuuacauguuuucu

SEQ ID NO: 2337250 - RNA, 19 nt, Human
cuuacaugcauuacugcau

SEQ ID NO: 2337251 - RNA, 18 nt, Human
cuuacaugcauuacugca

SEQ ID NO: 2337252 - RNA, 16 nt, Human
cuuacauaauuuuuua

SEQ ID NO: 2337253 - RNA, 12 nt, Human
cuuacaugauuc

SEQ ID NO: 2337254 - RNA, 22 nt, Human
cuuacauaauuuuuuauucaag

SEQ ID NO: 2337255 - RNA, 22 nt, Human
cuuacagcuggguggcacugcc

SEQ ID NO: 2337256 - RNA, 22 nt, Human
cuuaaagaaagucgaauuaaua

SEQ ID NO: 2337257 - RNA, 23 nt, Human
cuuacagcuggguggcacugcca

SEQ ID NO: 2337258 - RNA, 16 nt, Human
cuuacaguaggagccc

SEQ ID NO: 2337259 - RNA, 23 nt, Human
cuuacaguaggagcccagcucug

SEQ ID NO: 2337260 - RNA, 23 nt, Human
cuuacagugagggcuauacaugg

SEQ ID NO: 2337261 - RNA, 18 nt, Human
cuuacaguuuuaaauucu

SEQ ID NO: 2337262 - RNA, 12 nt, Human
cuucuucucccc

SEQ ID NO: 2337263 - RNA, 13 nt, Human
cuucuucuccccc

SEQ ID NO: 2337264 - RNA, 12 nt, Human
cuucuucuccua

SEQ ID NO: 2337265 - RNA, 19 nt, Human
cuucuucuccuauguguaa

SEQ ID NO: 2337266 - RNA, 18 nt, Human
cuucuucuccuaugugua

SEQ ID NO: 2337267 - RNA, 14 nt, Human
cuucuucuucagaa

SEQ ID NO: 2337268 - RNA, 15 nt, Human
cuucuucuuucuaca

SEQ ID NO: 2337269 - RNA, 13 nt, Human
cuucuucuucaga

SEQ ID NO: 2337270 - RNA, 18 nt, Human
cuucuucuuuuugcuguu

SEQ ID NO: 2337271 - RNA, 21 nt, Human
cuucuucuuuugagcaacuuu

SEQ ID NO: 2337272 - RNA, 17 nt, Human
cuucuucuuuuugcugu

SEQ ID NO: 2337273 - RNA, 22 nt, Human
cuucuugaaauuuuaaccuaug

SEQ ID NO: 2337274 - RNA, 19 nt, Human
cuucuugaacacucaugcu

SEQ ID NO: 2337275 - RNA, 20 nt, Human
cuucuugaacacucaugcug

SEQ ID NO: 2337276 - RNA, 12 nt, Human
cuucuugaaggu

SEQ ID NO: 2337277 - RNA, 21 nt, Human
cuucuugaacacucaugcuga

SEQ ID NO: 2337278 - RNA, 22 nt, Human
cuucuugaacacucaugcugaa

SEQ ID NO: 2337279 - RNA, 21 nt, Human
cuucuucggggaacuccugga

SEQ ID NO: 2337280 - RNA, 13 nt, Human
cuucuucucaggc

SEQ ID NO: 2337281 - RNA, 14 nt, Human
cuucuuauucucac

SEQ ID NO: 2337282 - RNA, 22 nt, Human
cuucuuauggaauugauuugca

SEQ ID NO: 2337283 - RNA, 23 nt, Human
cuucuuauggaauugauuugcau

SEQ ID NO: 2337284 - RNA, 19 nt, Human
cuucuuauggaauugauuu

SEQ ID NO: 2337285 - RNA, 16 nt, Human
cuucuuauacauuuga

SEQ ID NO: 2337286 - RNA, 13 nt, Human
cuucuuauacauu

SEQ ID NO: 2337287 - RNA, 15 nt, Human
cuucuuacaugcauu

SEQ ID NO: 2337288 - RNA, 23 nt, Human
cuucugaacuuggcgcugccccu

SEQ ID NO: 2337289 - RNA, 18 nt, Human
cuucugacccaugcugcc

SEQ ID NO: 2337290 - RNA, 16 nt, Human
cuucugacccaugcug

SEQ ID NO: 2337291 - RNA, 17 nt, Human
cuucugacccaugcugc

SEQ ID NO: 2337292 - RNA, 18 nt, Human
cuuccucccucccucuuu

SEQ ID NO: 2337293 - RNA, 14 nt, Human
cuuccucccucccu

SEQ ID NO: 2337294 - RNA, 13 nt, Human
cuuccucccuccc

SEQ ID NO: 2337295 - RNA, 12 nt, Human
cuuccucccucc

SEQ ID NO: 2337296 - RNA, 16 nt, Human
cuuccucuccacugcc

SEQ ID NO: 2337297 - RNA, 17 nt, Human
cuuccucuccacugccu

SEQ ID NO: 2337298 - RNA, 19 nt, Human
cuuccucuccacugccuuc

SEQ ID NO: 2337299 - RNA, 21 nt, Human
cuuccucuccacugccuucga

SEQ ID NO: 2337300 - RNA, 11 nt, Human
cuuccucugcu

SEQ ID NO: 2337301 - RNA, 15 nt, Human
cuuccucccucauuc

SEQ ID NO: 2337302 - RNA, 14 nt, Human
cuuccucugcagcu

SEQ ID NO: 2337303 - RNA, 19 nt, Human
cuuccucugcagcugaccu

SEQ ID NO: 2337304 - RNA, 12 nt, Human
cuuccucugcug

SEQ ID NO: 2337305 - RNA, 13 nt, Human
cuuccucugcuga

SEQ ID NO: 2337306 - RNA, 20 nt, Human
cuuccucugcagcugaccuc

SEQ ID NO: 2337307 - RNA, 22 nt, Human
cuuccucugcagcugaccucug

SEQ ID NO: 2337308 - RNA, 17 nt, Human
cuucuaauauuuauugc

SEQ ID NO: 2337309 - RNA, 20 nt, Human
cuucuaauauuuauugcuuu

SEQ ID NO: 2337310 - RNA, 21 nt, Human
cuucuaauauuuauugcuuua

SEQ ID NO: 2337311 - RNA, 15 nt, Human
cuucuaucccaggag

SEQ ID NO: 2337312 - RNA, 23 nt, Human
cuucuauggacugguuguugcca

SEQ ID NO: 2337313 - RNA, 18 nt, Human
cuucuauuagccagucuu

SEQ ID NO: 2337314 - RNA, 19 nt, Human
cuucuauuauagccacauc

SEQ ID NO: 2337315 - RNA, 22 nt, Human
cuucucugacuucugccuggag

SEQ ID NO: 2337316 - RNA, 18 nt, Human
cuucuacugagccuucag

SEQ ID NO: 2337317 - RNA, 15 nt, Human
cuucuaccugccacu

SEQ ID NO: 2337318 - RNA, 16 nt, Human
cuucuaccugccacuc

SEQ ID NO: 2337319 - RNA, 17 nt, Human
cuucuaccugccacuca

SEQ ID NO: 2337320 - RNA, 17 nt, Human
cuucuaccuuaaaaugu

SEQ ID NO: 2337321 - RNA, 12 nt, Human
cuucuaccugcc

SEQ ID NO: 2337322 - RNA, 13 nt, Human
cuucuaccugcca

SEQ ID NO: 2337323 - RNA, 14 nt, Human
cuucuaccugccac

SEQ ID NO: 2337324 - RNA, 23 nt, Human
cuucuaccugccacucacacagc

SEQ ID NO: 2337325 - RNA, 17 nt, Human
cuucuaccaugaacaga

SEQ ID NO: 2337326 - RNA, 17 nt, Human
cuucuaccucuuggcug

SEQ ID NO: 2337327 - RNA, 16 nt, Human
cuucucugcuccacca

SEQ ID NO: 2337328 - RNA, 15 nt, Human
cuucucugcuccacc

SEQ ID NO: 2337329 - RNA, 14 nt, Human
cuucucugcuccac

SEQ ID NO: 2337330 - RNA, 13 nt, Human
cuucucugcucca

SEQ ID NO: 2337331 - RNA, 12 nt, Human
cuucucugcucc

SEQ ID NO: 2337332 - RNA, 11 nt, Human
cuucucugcuc

SEQ ID NO: 2337333 - RNA, 13 nt, Human
cuucucugucuca

SEQ ID NO: 2337334 - RNA, 21 nt, Human
cuucucuggagccaaguccag

SEQ ID NO: 2337335 - RNA, 22 nt, Human
cuucucuggagccaaguccaga

SEQ ID NO: 2337336 - RNA, 22 nt, Human
cuucucugcuccaccacauccu

SEQ ID NO: 2337337 - RNA, 21 nt, Human
cuucucugcuccaccacaucc

SEQ ID NO: 2337338 - RNA, 12 nt, Human
cuucucugcugc

SEQ ID NO: 2337339 - RNA, 19 nt, Human
cuucucuggaaagggggga

SEQ ID NO: 2337340 - RNA, 20 nt, Human
cuucucuggagccaagucca

SEQ ID NO: 2337341 - RNA, 19 nt, Human
cuucugaacuuggcgcugc

SEQ ID NO: 2337342 - RNA, 22 nt, Human
cuucugaacucaaacugaggaa

SEQ ID NO: 2337343 - RNA, 18 nt, Human
cuucugaacucaaacuga

SEQ ID NO: 2337344 - RNA, 17 nt, Human
cuucugaacucaaacug

SEQ ID NO: 2337345 - RNA, 15 nt, Human
cuucugacccaugcu

SEQ ID NO: 2337346 - RNA, 22 nt, Human
cuucugaacuuggcgcugcccc

SEQ ID NO: 2337347 - RNA, 17 nt, Human
gagcuguuuauggccuc

SEQ ID NO: 2337348 - RNA, 16 nt, Human
gagcuguuuauggccu

SEQ ID NO: 2337349 - RNA, 17 nt, Human
gagcuguuuacuaggga

SEQ ID NO: 2337350 - RNA, 22 nt, Human
gagcuguucacagccagacugg

SEQ ID NO: 2337351 - RNA, 18 nt, Human
gagcuguuuauggccuca

SEQ ID NO: 2337352 - RNA, 16 nt, Human
gagcuguugccucagu

SEQ ID NO: 2337353 - RNA, 13 nt, Human
gagcuggccccgc

SEQ ID NO: 2337354 - RNA, 14 nt, Human
gagcuggccccgcc

SEQ ID NO: 2337355 - RNA, 16 nt, Human
gagcuggccccgccgc

SEQ ID NO: 2337356 - RNA, 17 nt, Human
gagcuggccccgccgcc

SEQ ID NO: 2337357 - RNA, 23 nt, Human
gagcuggccgcgccaaauaaugu

SEQ ID NO: 2337358 - RNA, 20 nt, Human
gagcuggcaaagguggcucu

SEQ ID NO: 2337359 - RNA, 17 nt, Human
gagcuggccgugggccu

SEQ ID NO: 2337360 - RNA, 19 nt, Human
gagcuggccgugggccugg

SEQ ID NO: 2337361 - RNA, 20 nt, Human
gagcuggccgugggccuggg

SEQ ID NO: 2337362 - RNA, 16 nt, Human
gagcuggcgucugucu

SEQ ID NO: 2337363 - RNA, 12 nt, Human
gagcuggcucug

SEQ ID NO: 2337364 - RNA, 20 nt, Human
gagcuguucacagccagacu

SEQ ID NO: 2337365 - RNA, 13 nt, Human
gagcccugguggc

SEQ ID NO: 2337366 - RNA, 14 nt, Human
gagcccugguggca

SEQ ID NO: 2337367 - RNA, 23 nt, Human
gagcccuggcaggaugacccugc

SEQ ID NO: 2337368 - RNA, 13 nt, Human
gagcccuggcagg

SEQ ID NO: 2337369 - RNA, 14 nt, Human
gagcuggagccugg

SEQ ID NO: 2337370 - RNA, 15 nt, Human
gagcuggagccuggu

SEQ ID NO: 2337371 - RNA, 20 nt, Human
gagcuggagccuggugcccu

SEQ ID NO: 2337372 - RNA, 12 nt, Human
gagcuggagccu

SEQ ID NO: 2337373 - RNA, 16 nt, Human
gagccccacacggagg

SEQ ID NO: 2337374 - RNA, 12 nt, Human
gagccccacacu

SEQ ID NO: 2337375 - RNA, 14 nt, Human
gagccccacacgga

SEQ ID NO: 2337376 - RNA, 21 nt, Human
gagccccaaguccugaagagg

SEQ ID NO: 2337377 - RNA, 11 nt, Human
gagccccaagu

SEQ ID NO: 2337378 - RNA, 13 nt, Human
gagccccaagucc

SEQ ID NO: 2337379 - RNA, 15 nt, Human
gagccccaaguccug

SEQ ID NO: 2337380 - RNA, 17 nt, Human
gagccccaaguccugaa

SEQ ID NO: 2337381 - RNA, 22 nt, Human
gagccccacacuggggugccgc

SEQ ID NO: 2337382 - RNA, 13 nt, Human
gagccccgaggcc

SEQ ID NO: 2337383 - RNA, 14 nt, Human
gagccccgaggccu

SEQ ID NO: 2337384 - RNA, 23 nt, Human
gagccccgcagaccuccccagcc

SEQ ID NO: 2337385 - RNA, 15 nt, Human
gagccccuaccccac

SEQ ID NO: 2337386 - RNA, 17 nt, Human
gagccccuaccccacac

SEQ ID NO: 2337387 - RNA, 20 nt, Human
gagccccuaccccacaccag

SEQ ID NO: 2337388 - RNA, 12 nt, Human
gagccccugggu

SEQ ID NO: 2337389 - RNA, 13 nt, Human
gagccccugggug

SEQ ID NO: 2337390 - RNA, 14 nt, Human
gagccccugggugg

SEQ ID NO: 2337391 - RNA, 19 nt, Human
gagccccuggguggguggu

SEQ ID NO: 2337392 - RNA, 12 nt, Human
gagccccugguc

SEQ ID NO: 2337393 - RNA, 13 nt, Human
gagccccgcagac

SEQ ID NO: 2337394 - RNA, 18 nt, Human
gagccccgcagaccuccc

SEQ ID NO: 2337395 - RNA, 22 nt, Human
gagccccgcagaccuccccagc

SEQ ID NO: 2337396 - RNA, 17 nt, Human
gagccccgaggccuucu

SEQ ID NO: 2337397 - RNA, 12 nt, Human
gagcccugggag

SEQ ID NO: 2337398 - RNA, 15 nt, Human
gagcccucagaaccc

SEQ ID NO: 2337399 - RNA, 22 nt, Human
gagccccugucuagagagggag

SEQ ID NO: 2337400 - RNA, 21 nt, Human
gagccccugucuagagaggga

SEQ ID NO: 2337401 - RNA, 11 nt, Human
gagccccuucc

SEQ ID NO: 2337402 - RNA, 13 nt, Human
gagccccuuccuu

SEQ ID NO: 2337403 - RNA, 20 nt, Human
gagccccugucuagagaggg

SEQ ID NO: 2337404 - RNA, 20 nt, Human
gagccccugguccugagggu

SEQ ID NO: 2337405 - RNA, 13 nt, Human
gagccccuggucc

SEQ ID NO: 2337406 - RNA, 14 nt, Human
gagccccugguccu

SEQ ID NO: 2337407 - RNA, 21 nt, Human
gagccccuucugcucagcucu

SEQ ID NO: 2337408 - RNA, 20 nt, Human
gagccccuucugcucagcuc

SEQ ID NO: 2337409 - RNA, 17 nt, Human
gagccccuucugcucag

SEQ ID NO: 2337410 - RNA, 19 nt, Human
gagccccuuccuugcucug

SEQ ID NO: 2337411 - RNA, 21 nt, Human
gagccccuuccuugcucugca

SEQ ID NO: 2337412 - RNA, 16 nt, Human
gagcccugggaggcuc

SEQ ID NO: 2337413 - RNA, 18 nt, Human
gagcccugggaggcucug

SEQ ID NO: 2337414 - RNA, 19 nt, Human
gagcccugggaggcucugg

SEQ ID NO: 2337415 - RNA, 20 nt, Human
gagcccugggaggcucugga

SEQ ID NO: 2337416 - RNA, 18 nt, Human
gagcaucucuugaggcca

SEQ ID NO: 2337417 - RNA, 17 nt, Human
gagcauccaccuccuuc

SEQ ID NO: 2337418 - RNA, 18 nt, Human
gagcauccaccuccuucu

SEQ ID NO: 2337419 - RNA, 13 nt, Human
gagcaucaggcca

SEQ ID NO: 2337420 - RNA, 15 nt, Human
gagcaucaggccagg

SEQ ID NO: 2337421 - RNA, 16 nt, Human
gagcaucaggccaggc

SEQ ID NO: 2337422 - RNA, 23 nt, Human
gagcaucucuugaggccaggagu

SEQ ID NO: 2337423 - RNA, 22 nt, Human
gagcaucucuugaggccaggag

SEQ ID NO: 2337424 - RNA, 20 nt, Human
gagcaucucuugaggccagg

SEQ ID NO: 2337425 - RNA, 19 nt, Human
gagcaucucuugaggccag

SEQ ID NO: 2337426 - RNA, 13 nt, Human
gagcaugccugga

SEQ ID NO: 2337427 - RNA, 13 nt, Human
gagcaucugacuc

SEQ ID NO: 2337428 - RNA, 21 nt, Human
gagcaugccuggauggggcug

SEQ ID NO: 2337429 - RNA, 20 nt, Human
gagcaguccugccucagccu

SEQ ID NO: 2337430 - RNA, 16 nt, Human
gagcaguccugccuca

SEQ ID NO: 2337431 - RNA, 17 nt, Human
gagcaguaucaugaagc

SEQ ID NO: 2337432 - RNA, 14 nt, Human
gagcaucaggccag

SEQ ID NO: 2337433 - RNA, 16 nt, Human
gagcaggggcagggug

SEQ ID NO: 2337434 - RNA, 15 nt, Human
gagcaggggcgugga

SEQ ID NO: 2337435 - RNA, 20 nt, Human
gagcagggguccuuggugug

SEQ ID NO: 2337436 - RNA, 16 nt, Human
gagcaguaucaugaag

SEQ ID NO: 2337437 - RNA, 16 nt, Human
gagcagggugcugugg

SEQ ID NO: 2337438 - RNA, 16 nt, Human
gagcaggguguuggga

SEQ ID NO: 2337439 - RNA, 14 nt, Human
gagcagucaggaaa

SEQ ID NO: 2337440 - RNA, 13 nt, Human
gagcaggggcagg

SEQ ID NO: 2337441 - RNA, 13 nt, Human
gaggggcagcccu

SEQ ID NO: 2337442 - RNA, 18 nt, Human
gaggggcagaacagccgc

SEQ ID NO: 2337443 - RNA, 16 nt, Human
gaggggcagcccuugc

SEQ ID NO: 2337444 - RNA, 14 nt, Human
gaggggcagcccuu

SEQ ID NO: 2337445 - RNA, 15 nt, Human
gaggggcagcccuug

SEQ ID NO: 2337446 - RNA, 15 nt, Human
gagggcccuaccuga

SEQ ID NO: 2337447 - RNA, 22 nt, Human
gagggccccucugcccagcuug

SEQ ID NO: 2337448 - RNA, 17 nt, Human
gagggcccugagcugag

SEQ ID NO: 2337449 - RNA, 12 nt, Human
gagggcccuggu

SEQ ID NO: 2337450 - RNA, 22 nt, Human
gagggcccugguguuucuagca

SEQ ID NO: 2337451 - RNA, 16 nt, Human
gagggccgagugagag

SEQ ID NO: 2337452 - RNA, 17 nt, Human
gagggccguaccccacc

SEQ ID NO: 2337453 - RNA, 14 nt, Human
gagggccugcaagg

SEQ ID NO: 2337454 - RNA, 17 nt, Human
gagggccugcaagggag

SEQ ID NO: 2337455 - RNA, 21 nt, Human
gagggccugcaagggagugag

SEQ ID NO: 2337456 - RNA, 21 nt, Human
gaggggacgcugguagagaug

SEQ ID NO: 2337457 - RNA, 12 nt, Human
gaggggagaagc

SEQ ID NO: 2337458 - RNA, 21 nt, Human
gaggggaggaucacuggagcc

SEQ ID NO: 2337459 - RNA, 11 nt, Human
gaggggagggg

SEQ ID NO: 2337460 - RNA, 22 nt, Human
gaggggacuauuuaugaaggca

SEQ ID NO: 2337461 - RNA, 12 nt, Human
gagggccugggc

SEQ ID NO: 2337462 - RNA, 22 nt, Human
gagggccugaggucuggcugcu

SEQ ID NO: 2337463 - RNA, 21 nt, Human
gagggccguaccccacccuca

SEQ ID NO: 2337464 - RNA, 15 nt, Human
gagggccugaggucu

SEQ ID NO: 2337465 - RNA, 22 nt, Human
gagggccucaaaggcccgcucu

SEQ ID NO: 2337466 - RNA, 18 nt, Human
gagggccguaccccaccc

SEQ ID NO: 2337467 - RNA, 20 nt, Human
gagggccguaccccacccuc

SEQ ID NO: 2337468 - RNA, 16 nt, Human
gagggcccaggcaggc

SEQ ID NO: 2337469 - RNA, 13 nt, Human
gagggcccaggca

SEQ ID NO: 2337470 - RNA, 15 nt, Human
gagggcccagagcag

SEQ ID NO: 2337471 - RNA, 16 nt, Human
gagggcccagagcagg

SEQ ID NO: 2337472 - RNA, 18 nt, Human
gagggcccagagcaggaa

SEQ ID NO: 2337473 - RNA, 20 nt, Human
gagggcccagagcaggaagc

SEQ ID NO: 2337474 - RNA, 22 nt, Human
gagggcccagagcaggaagcau

SEQ ID NO: 2337475 - RNA, 11 nt, Human
gagggccccuc

SEQ ID NO: 2337476 - RNA, 12 nt, Human
gagggccccucu

SEQ ID NO: 2337477 - RNA, 15 nt, Human
gagggccccucugcc

SEQ ID NO: 2337478 - RNA, 16 nt, Human
gagggccccucugccc

SEQ ID NO: 2337479 - RNA, 17 nt, Human
gagggccccucugccca

SEQ ID NO: 2337480 - RNA, 18 nt, Human
gagggccccucugcccag

SEQ ID NO: 2337481 - RNA, 20 nt, Human
gagggccccucugcccagcu

SEQ ID NO: 2337482 - RNA, 14 nt, Human
gaggcugaggcaga

SEQ ID NO: 2337483 - RNA, 16 nt, Human
gaggcugagacaggag

SEQ ID NO: 2337484 - RNA, 13 nt, Human
gagggcccagagc

SEQ ID NO: 2337485 - RNA, 14 nt, Human
gagggcccagagca

SEQ ID NO: 2337486 - RNA, 13 nt, Human
gaggcugaggcag

SEQ ID NO: 2337487 - RNA, 12 nt, Human
gaggcugaggca

SEQ ID NO: 2337488 - RNA, 16 nt, Human
gaggcucuuucugggc

SEQ ID NO: 2337489 - RNA, 12 nt, Human
gaggccaaggug

SEQ ID NO: 2337490 - RNA, 14 nt, Human
gaggcugagacagg

SEQ ID NO: 2337491 - RNA, 16 nt, Human
gaggcugaggcaagag

SEQ ID NO: 2337492 - RNA, 20 nt, Human
gaggcugaaagaggccaaug

SEQ ID NO: 2337493 - RNA, 20 nt, Human
gaggcucuggagcccacugu

SEQ ID NO: 2337494 - RNA, 18 nt, Human
gaggcugagaugggagaa

SEQ ID NO: 2337495 - RNA, 17 nt, Human
gaggcuccacuuggucu

SEQ ID NO: 2337496 - RNA, 19 nt, Human
gaggcauuuguuugaacug

SEQ ID NO: 2337497 - RNA, 22 nt, Human
gaggcaugugaugagaggaaau

SEQ ID NO: 2337498 - RNA, 20 nt, Human
gaggcaugugaugagaggaa

SEQ ID NO: 2337499 - RNA, 21 nt, Human
gaggcaugugaugagaggaaa

SEQ ID NO: 2337500 - RNA, 21 nt, Human
gaggcauuuguuugaacugau

SEQ ID NO: 2337501 - RNA, 15 nt, Human
gaggcuccacuuggu

SEQ ID NO: 2337502 - RNA, 23 nt, Human
gaggacuguugacauccaagcuu

SEQ ID NO: 2337503 - RNA, 14 nt, Human
gaggacuugugucu

SEQ ID NO: 2337504 - RNA, 17 nt, Human
gaggacuugugucucug

SEQ ID NO: 2337505 - RNA, 16 nt, Human
gaggacuugugucucu

SEQ ID NO: 2337506 - RNA, 16 nt, Human
gaggacuuuucuuugu

SEQ ID NO: 2337507 - RNA, 20 nt, Human
gaggacuuuucuuuguggcu

SEQ ID NO: 2337508 - RNA, 23 nt, Human
gaggacuuuucuuuguggcuucc

SEQ ID NO: 2337509 - RNA, 15 nt, Human
gaggacgugggcggc

SEQ ID NO: 2337510 - RNA, 17 nt, Human
gaggacggugcaaccca

SEQ ID NO: 2337511 - RNA, 20 nt, Human
gaggacggugcaacccaagg

SEQ ID NO: 2337512 - RNA, 16 nt, Human
gaggacggugcaaccc

SEQ ID NO: 2337513 - RNA, 16 nt, Human
gaggacgugggcggca

SEQ ID NO: 2337514 - RNA, 18 nt, Human
gaggacgugggcggcaga

SEQ ID NO: 2337515 - RNA, 20 nt, Human
gaggacgugggcggcagaga

SEQ ID NO: 2337516 - RNA, 22 nt, Human
gaggacgugggcggcagagagg

SEQ ID NO: 2337517 - RNA, 23 nt, Human
gaggacugccccgugcagacugg

SEQ ID NO: 2337518 - RNA, 20 nt, Human
gaggacuguagggagggcgg

SEQ ID NO: 2337519 - RNA, 21 nt, Human
gaggacuguagggagggcggc

SEQ ID NO: 2337520 - RNA, 13 nt, Human
gaggacuguauuu

SEQ ID NO: 2337521 - RNA, 18 nt, Human
gaggacuguauuugugac

SEQ ID NO: 2337522 - RNA, 16 nt, Human
gaggacuagaaccugg

SEQ ID NO: 2337523 - RNA, 18 nt, Human
gaggacuagaaccuggag

SEQ ID NO: 2337524 - RNA, 18 nt, Human
gaggacucacuugcccac

SEQ ID NO: 2337525 - RNA, 18 nt, Human
gaggacaugauggagcgc

SEQ ID NO: 2337526 - RNA, 20 nt, Human
gaggacauaaugggguccug

SEQ ID NO: 2337527 - RNA, 21 nt, Human
gaggacauguuuuuguuuucu

SEQ ID NO: 2337528 - RNA, 22 nt, Human
gaggacaguauuuguggggagg

SEQ ID NO: 2337529 - RNA, 22 nt, Human
gaggaccacuccuguacacuga

SEQ ID NO: 2337530 - RNA, 13 nt, Human
gaggaccacuccu

SEQ ID NO: 2337531 - RNA, 13 nt, Human
gaggacccagacc

SEQ ID NO: 2337532 - RNA, 19 nt, Human
gaggaccagggcagggcca

SEQ ID NO: 2337533 - RNA, 14 nt, Human
gaggacccagaccc

SEQ ID NO: 2337534 - RNA, 16 nt, Human
gaggacccagacccag

SEQ ID NO: 2337535 - RNA, 20 nt, Human
gaggacgcucucuggccuuc

SEQ ID NO: 2337536 - RNA, 21 nt, Human
gaggacgcucucuggccuucg

SEQ ID NO: 2337537 - RNA, 22 nt, Human
gaggcagggucucacucugucg

SEQ ID NO: 2337538 - RNA, 15 nt, Human
gaggagcagugcagg

SEQ ID NO: 2337539 - RNA, 17 nt, Human
gaggcaucgcaauguaa

SEQ ID NO: 2337540 - RNA, 13 nt, Human
gaggcauggcccu

SEQ ID NO: 2337541 - RNA, 14 nt, Human
gaggcauggcccug

SEQ ID NO: 2337542 - RNA, 15 nt, Human
gaggcauggcccugg

SEQ ID NO: 2337543 - RNA, 17 nt, Human
gaggcauggcccugggg

SEQ ID NO: 2337544 - RNA, 18 nt, Human
gaggcauggcccuggggu

SEQ ID NO: 2337545 - RNA, 19 nt, Human
gaggcagggucucacucug

SEQ ID NO: 2337546 - RNA, 20 nt, Human
gaggcagggucucacucugu

SEQ ID NO: 2337547 - RNA, 13 nt, Human
gaggagaggagag

SEQ ID NO: 2337548 - RNA, 17 nt, Human
gaggagagccagagaag

SEQ ID NO: 2337549 - RNA, 22 nt, Human
gaggagagccagagaagugaca

SEQ ID NO: 2337550 - RNA, 23 nt, Human
gaggagagccagagaagugacag

SEQ ID NO: 2337551 - RNA, 14 nt, Human
gaggagaggagaga

SEQ ID NO: 2337552 - RNA, 16 nt, Human
gaggagaggagagagg

SEQ ID NO: 2337553 - RNA, 17 nt, Human
gaggagaggagagaggc

SEQ ID NO: 2337554 - RNA, 12 nt, Human
gaggagagaggc

SEQ ID NO: 2337555 - RNA, 13 nt, Human
gaggagagaggca

SEQ ID NO: 2337556 - RNA, 14 nt, Human
gaggagagaggcag

SEQ ID NO: 2337557 - RNA, 15 nt, Human
gaggagagaggcaga

SEQ ID NO: 2337558 - RNA, 17 nt, Human
gaggagagaggcagaga

SEQ ID NO: 2337559 - RNA, 16 nt, Human
gaggagagaggcagag

SEQ ID NO: 2337560 - RNA, 13 nt, Human
gaggagagccaga

SEQ ID NO: 2337561 - RNA, 18 nt, Human
gaggcagggucucacucu

SEQ ID NO: 2337562 - RNA, 17 nt, Human
gaggagaugcuccuugg

SEQ ID NO: 2337563 - RNA, 16 nt, Human
gaggagcaaaggcuga

SEQ ID NO: 2337564 - RNA, 20 nt, Human
gaggagaggggaagggccag

SEQ ID NO: 2337565 - RNA, 14 nt, Human
gaggagagucccag

SEQ ID NO: 2337566 - RNA, 15 nt, Human
gaggagagucccaga

SEQ ID NO: 2337567 - RNA, 17 nt, Human
gaggagagucccagagc

SEQ ID NO: 2337568 - RNA, 22 nt, Human
gaggagaagaauuuucagaccc

SEQ ID NO: 2337569 - RNA, 15 nt, Human
gaggagacauuggcu

SEQ ID NO: 2337570 - RNA, 22 nt, Human
gaggagacuagauuuaugaaua

SEQ ID NO: 2337571 - RNA, 20 nt, Human
gaggagaagaauuuucagac

SEQ ID NO: 2337572 - RNA, 12 nt, Human
gaggagaagaau

SEQ ID NO: 2337573 - RNA, 9 nt, Human
gaggagaaa

SEQ ID NO: 2337574 - RNA, 13 nt, Human
gaggagaaacaca

SEQ ID NO: 2337575 - RNA, 22 nt, Human
gaggacuugugucucugugcuu

SEQ ID NO: 2337576 - RNA, 18 nt, Human
gaggacuugugucucugu

SEQ ID NO: 2337577 - RNA, 14 nt, Human
gaggagaaacugga

SEQ ID NO: 2337578 - RNA, 12 nt, Human
gaggagaaacug

SEQ ID NO: 2337579 - RNA, 12 nt, Human
gaggagagagga

SEQ ID NO: 2337580 - RNA, 12 nt, Human
gaggagagaaga

SEQ ID NO: 2337581 - RNA, 13 nt, Human
gaggagagaagaa

SEQ ID NO: 2337582 - RNA, 14 nt, Human
gaggagagaagaau

SEQ ID NO: 2337583 - RNA, 15 nt, Human
gaggagagaagaaug

SEQ ID NO: 2337584 - RNA, 21 nt, Human
gaggagagaagaaugagccua

SEQ ID NO: 2337585 - RNA, 20 nt, Human
gaggagagagcagcuucugc

SEQ ID NO: 2337586 - RNA, 21 nt, Human
gaggagagagcagcuucugcc

SEQ ID NO: 2337587 - RNA, 11 nt, Human
gaggagagagg

SEQ ID NO: 2337588 - RNA, 14 nt, Human
gaggagagaggacc

SEQ ID NO: 2337589 - RNA, 15 nt, Human
gaggagagaggaccc

SEQ ID NO: 2337590 - RNA, 22 nt, Human
gagaagugccccugcugccucc

SEQ ID NO: 2337591 - RNA, 20 nt, Human
gagaagugccccugcugccu

SEQ ID NO: 2337592 - RNA, 17 nt, Human
gagaagugccccugcug

SEQ ID NO: 2337593 - RNA, 16 nt, Human
gagaagugccccugcu

SEQ ID NO: 2337594 - RNA, 15 nt, Human
gagaagugccccugc

SEQ ID NO: 2337595 - RNA, 15 nt, Human
gagaagguccuuaau

SEQ ID NO: 2337596 - RNA, 23 nt, Human
gagaagguggguuuucaucaaga

SEQ ID NO: 2337597 - RNA, 16 nt, Human
gagaaguauacauaag

SEQ ID NO: 2337598 - RNA, 13 nt, Human
gagaaggcaggaa

SEQ ID NO: 2337599 - RNA, 12 nt, Human
gagaaggcagga

SEQ ID NO: 2337600 - RNA, 12 nt, Human
gagaaggcagcc

SEQ ID NO: 2337601 - RNA, 16 nt, Human
gagaaggcagccacca

SEQ ID NO: 2337602 - RNA, 17 nt, Human
gagaaggaucuagaaug

SEQ ID NO: 2337603 - RNA, 15 nt, Human
gagaaggagagaaag

SEQ ID NO: 2337604 - RNA, 11 nt, Human
gagaaggcagc

SEQ ID NO: 2337605 - RNA, 15 nt, Human
gagaagggauggagg

SEQ ID NO: 2337606 - RNA, 23 nt, Human
gagaaggcaggaauguguggcag

SEQ ID NO: 2337607 - RNA, 15 nt, Human
gagaaggggaggagg

SEQ ID NO: 2337608 - RNA, 23 nt, Human
gagaaggacccggaggggccugg

SEQ ID NO: 2337609 - RNA, 11 nt, Human
gagaaggagcc

SEQ ID NO: 2337610 - RNA, 12 nt, Human
gagaaggagaga

SEQ ID NO: 2337611 - RNA, 14 nt, Human
gagaaggagagaaa

SEQ ID NO: 2337612 - RNA, 18 nt, Human
gagaccuaccucagguug

SEQ ID NO: 2337613 - RNA, 21 nt, Human
gagaccuaccucagguugcug

SEQ ID NO: 2337614 - RNA, 23 nt, Human
gagaccuaccucagguugcuggu

SEQ ID NO: 2337615 - RNA, 14 nt, Human
gagacggaguccca

SEQ ID NO: 2337616 - RNA, 16 nt, Human
gagaccguccucaccc

SEQ ID NO: 2337617 - RNA, 22 nt, Human
gagaccguccucaccccugucc

SEQ ID NO: 2337618 - RNA, 14 nt, Human
gagaccuaccucag

SEQ ID NO: 2337619 - RNA, 16 nt, Human
gagaccuaccucaggu

SEQ ID NO: 2337620 - RNA, 17 nt, Human
gagaccuaccucagguu

SEQ ID NO: 2337621 - RNA, 20 nt, Human
gagaccgggguauccugggg

SEQ ID NO: 2337622 - RNA, 13 nt, Human
gagaccguccuca

SEQ ID NO: 2337623 - RNA, 14 nt, Human
gagaccguccucac

SEQ ID NO: 2337624 - RNA, 15 nt, Human
gagaccguccucacc

SEQ ID NO: 2337625 - RNA, 16 nt, Human
gagacggagucccacc

SEQ ID NO: 2337626 - RNA, 19 nt, Human
gagacggagucccaccuug

SEQ ID NO: 2337627 - RNA, 19 nt, Human
gagaccuggcacuggaugc

SEQ ID NO: 2337628 - RNA, 16 nt, Human
gagacgggaccgggcc

SEQ ID NO: 2337629 - RNA, 18 nt, Human
gagacgggggcagagagg

SEQ ID NO: 2337630 - RNA, 23 nt, Human
gagaagugccccugcugccuccc

SEQ ID NO: 2337631 - RNA, 16 nt, Human
gagaaguuucuggccc

SEQ ID NO: 2337632 - RNA, 17 nt, Human
gagaaguuucuggcccu

SEQ ID NO: 2337633 - RNA, 21 nt, Human
gagaaguuucuggcccuggcu

SEQ ID NO: 2337634 - RNA, 17 nt, Human
gagaaguuuuguacaga

SEQ ID NO: 2337635 - RNA, 18 nt, Human
gagaaguuuuguacagag

SEQ ID NO: 2337636 - RNA, 19 nt, Human
gagaaguuuuguacagaga

SEQ ID NO: 2337637 - RNA, 18 nt, Human
gagaauaggcagccccca

SEQ ID NO: 2337638 - RNA, 18 nt, Human
gagaauaagagaaagaaa

SEQ ID NO: 2337639 - RNA, 16 nt, Human
gagaaguuuuguuuuu

SEQ ID NO: 2337640 - RNA, 22 nt, Human
gagaauaagagaaagaaaauga

SEQ ID NO: 2337641 - RNA, 23 nt, Human
gagaauauuagcuuuacuguuug

SEQ ID NO: 2337642 - RNA, 20 nt, Human
gagaauaagagagucauaaa

SEQ ID NO: 2337643 - RNA, 12 nt, Human
gagaauauauac

SEQ ID NO: 2337644 - RNA, 21 nt, Human
gagaauauuuuaaguauugca

SEQ ID NO: 2337645 - RNA, 14 nt, Human
gagaauauauacau

SEQ ID NO: 2337646 - RNA, 19 nt, Human
gagaauauuuuaaguauug

SEQ ID NO: 2337647 - RNA, 20 nt, Human
gagaaucccacuuucuauag

SEQ ID NO: 2337648 - RNA, 21 nt, Human
gagaaucuacccccagaucca

SEQ ID NO: 2337649 - RNA, 22 nt, Human
gagaaucuauauuuaacaagau

SEQ ID NO: 2337650 - RNA, 15 nt, Human
gagaaucuauauuua

SEQ ID NO: 2337651 - RNA, 15 nt, Human
gagaaugaaagggcc

SEQ ID NO: 2337652 - RNA, 23 nt, Human
gagaaugaaagggcccagagagg

SEQ ID NO: 2337653 - RNA, 19 nt, Human
gagaaucuuuauugagaaa

SEQ ID NO: 2337654 - RNA, 13 nt, Human
gagaaucuuuauu

SEQ ID NO: 2337655 - RNA, 16 nt, Human
gagaccgagccucugu

SEQ ID NO: 2337656 - RNA, 14 nt, Human
gagaccgagugaac

SEQ ID NO: 2337657 - RNA, 15 nt, Human
gagaccgagugaacc

SEQ ID NO: 2337658 - RNA, 17 nt, Human
gagaaaaagcuccuguc

SEQ ID NO: 2337659 - RNA, 19 nt, Human
gagaaaaagcuccuguccu

SEQ ID NO: 2337660 - RNA, 15 nt, Human
gagaaaacagaccua

SEQ ID NO: 2337661 - RNA, 19 nt, Human
gacuuuuuuuuuuuauaau

SEQ ID NO: 2337662 - RNA, 11 nt, Human
gagaaaaacaa

SEQ ID NO: 2337663 - RNA, 16 nt, Human
gacuuuuugcauuuaa

SEQ ID NO: 2337664 - RNA, 20 nt, Human
gacuuuuccaacccucauca

SEQ ID NO: 2337665 - RNA, 12 nt, Human
gacuuuguucac

SEQ ID NO: 2337666 - RNA, 18 nt, Human
gacuuuuauuuccaguga

SEQ ID NO: 2337667 - RNA, 14 nt, Human
gacuuuuccaaccc

SEQ ID NO: 2337668 - RNA, 19 nt, Human
gacuuuuccaacccucauc

SEQ ID NO: 2337669 - RNA, 22 nt, Human
gacuuuuuauggcacuaguauu

SEQ ID NO: 2337670 - RNA, 16 nt, Human
gagacuccuaggcagg

SEQ ID NO: 2337671 - RNA, 16 nt, Human
gagagcgccugccccu

SEQ ID NO: 2337672 - RNA, 22 nt, Human
gagagcgccugccccucccaga

SEQ ID NO: 2337673 - RNA, 14 nt, Human
gagagcggucucag

SEQ ID NO: 2337674 - RNA, 21 nt, Human
gagagcggucucaggcuggug

SEQ ID NO: 2337675 - RNA, 21 nt, Human
gagagcgugcuccagccuggc

SEQ ID NO: 2337676 - RNA, 22 nt, Human
gagagcgugcuccagccuggcu

SEQ ID NO: 2337677 - RNA, 23 nt, Human
gagagcgugcuccagccuggcuc

SEQ ID NO: 2337678 - RNA, 19 nt, Human
gagagcuagaacccggcag

SEQ ID NO: 2337679 - RNA, 20 nt, Human
gagagcuagaacccggcagg

SEQ ID NO: 2337680 - RNA, 17 nt, Human
gagagcuagaaccuaga

SEQ ID NO: 2337681 - RNA, 16 nt, Human
gagagcuagaaccugg

SEQ ID NO: 2337682 - RNA, 18 nt, Human
gagagcuagaaccuggag

SEQ ID NO: 2337683 - RNA, 19 nt, Human
gagagcuagaaccuggaga

SEQ ID NO: 2337684 - RNA, 18 nt, Human
gagagccuuccaggggug

SEQ ID NO: 2337685 - RNA, 20 nt, Human
gagagccuuccagggguggg

SEQ ID NO: 2337686 - RNA, 21 nt, Human
gagagcuagcagcagggaggg

SEQ ID NO: 2337687 - RNA, 15 nt, Human
gagagcuagcagcag

SEQ ID NO: 2337688 - RNA, 13 nt, Human
gagagcugggugu

SEQ ID NO: 2337689 - RNA, 13 nt, Human
gagagcuggagcc

SEQ ID NO: 2337690 - RNA, 20 nt, Human
gagagcuagaaccuggagag

SEQ ID NO: 2337691 - RNA, 19 nt, Human
gagagcuagaaccuggagg

SEQ ID NO: 2337692 - RNA, 21 nt, Human
gagacucagggccccagcacu

SEQ ID NO: 2337693 - RNA, 17 nt, Human
gagacucagggccccag

SEQ ID NO: 2337694 - RNA, 16 nt, Human
gagacguguacauagu

SEQ ID NO: 2337695 - RNA, 16 nt, Human
gagacuccaugagaag

SEQ ID NO: 2337696 - RNA, 18 nt, Human
gagacuccgucucaagga

SEQ ID NO: 2337697 - RNA, 14 nt, Human
gagacucagacagg

SEQ ID NO: 2337698 - RNA, 15 nt, Human
gagacucagagggag

SEQ ID NO: 2337699 - RNA, 15 nt, Human
gagacggucgagcag

SEQ ID NO: 2337700 - RNA, 18 nt, Human
gagacgggugggcggcug

SEQ ID NO: 2337701 - RNA, 15 nt, Human
gagacguguacauag

SEQ ID NO: 2337702 - RNA, 13 nt, Human
gagacuccugcag

SEQ ID NO: 2337703 - RNA, 14 nt, Human
gagacuccugcagg

SEQ ID NO: 2337704 - RNA, 15 nt, Human
gagagccuuccaggg

SEQ ID NO: 2337705 - RNA, 16 nt, Human
gagagccuuccagggg

SEQ ID NO: 2337706 - RNA, 20 nt, Human
gagaggaugagagcccagag

SEQ ID NO: 2337707 - RNA, 12 nt, Human
gagaggccauga

SEQ ID NO: 2337708 - RNA, 16 nt, Human
gagaggcccucuggag

SEQ ID NO: 2337709 - RNA, 14 nt, Human
gagaggccaggugc

SEQ ID NO: 2337710 - RNA, 21 nt, Human
gagaggccaggugcagguugg

SEQ ID NO: 2337711 - RNA, 15 nt, Human
gagaggccuuuugga

SEQ ID NO: 2337712 - RNA, 23 nt, Human
gagaggcccucuggaguggccac

SEQ ID NO: 2337713 - RNA, 20 nt, Human
gagaggcccucuggaguggc

SEQ ID NO: 2337714 - RNA, 10 nt, Human
gagagggaga

SEQ ID NO: 2337715 - RNA, 14 nt, Human
gagagggagaagaa

SEQ ID NO: 2337716 - RNA, 15 nt, Human
gagagggagaagaag

SEQ ID NO: 2337717 - RNA, 23 nt, Human
gagagggagaagaagucagagag

SEQ ID NO: 2337718 - RNA, 12 nt, Human
gagaggcuggga

SEQ ID NO: 2337719 - RNA, 18 nt, Human
gagaggccuuuuggaaug

SEQ ID NO: 2337720 - RNA, 14 nt, Human
gagaggcaaugauu

SEQ ID NO: 2337721 - RNA, 15 nt, Human
gagaggcaauggcca

SEQ ID NO: 2337722 - RNA, 18 nt, Human
gagaggaugagagcccag

SEQ ID NO: 2337723 - RNA, 19 nt, Human
gagaggaugagagcccaga

SEQ ID NO: 2337724 - RNA, 21 nt, Human
gagaggaugagagcccagagg

SEQ ID NO: 2337725 - RNA, 17 nt, Human
gagaggaguucaaugau

SEQ ID NO: 2337726 - RNA, 18 nt, Human
gagaggaguucaaugauc

SEQ ID NO: 2337727 - RNA, 19 nt, Human
gagaggaguucaaugaucu

SEQ ID NO: 2337728 - RNA, 12 nt, Human
gagaggaugaau

SEQ ID NO: 2337729 - RNA, 14 nt, Human
gagaggaugaaugu

SEQ ID NO: 2337730 - RNA, 21 nt, Human
gagaggaugaauguaugugca

SEQ ID NO: 2337731 - RNA, 14 nt, Human
gagaggaugagagc

SEQ ID NO: 2337732 - RNA, 16 nt, Human
gagaggaugagagccc

SEQ ID NO: 2337733 - RNA, 19 nt, Human
gagaggagcgggaccugug

SEQ ID NO: 2337734 - RNA, 21 nt, Human
gagaggagcgggaccuguggc

SEQ ID NO: 2337735 - RNA, 22 nt, Human
gagaggagcgggaccuguggcu

SEQ ID NO: 2337736 - RNA, 13 nt, Human
gagaggaguucaa

SEQ ID NO: 2337737 - RNA, 13 nt, Human
gagaggaggcaac

SEQ ID NO: 2337738 - RNA, 15 nt, Human
gagaggaguucaaug

SEQ ID NO: 2337739 - RNA, 16 nt, Human
gagaggaguucaauga

SEQ ID NO: 2337740 - RNA, 18 nt, Human
gagaggagagaggcagag

SEQ ID NO: 2337741 - RNA, 19 nt, Human
gagaggagagaggcagaga

SEQ ID NO: 2337742 - RNA, 13 nt, Human
gagaggagagcca

SEQ ID NO: 2337743 - RNA, 15 nt, Human
gagaggagagccaga

SEQ ID NO: 2337744 - RNA, 16 nt, Human
gagaggagagccagag

SEQ ID NO: 2337745 - RNA, 19 nt, Human
gagaggagagccagagaag

SEQ ID NO: 2337746 - RNA, 18 nt, Human
gagaggagaggagagagg

SEQ ID NO: 2337747 - RNA, 16 nt, Human
gagaggacgugggcgg

SEQ ID NO: 2337748 - RNA, 17 nt, Human
gagaggacgugggcggc

SEQ ID NO: 2337749 - RNA, 10 nt, Human
gagaggacag

SEQ ID NO: 2337750 - RNA, 15 nt, Human
gagaggacagcuuga

SEQ ID NO: 2337751 - RNA, 18 nt, Human
gagaggacagcuugagcc

SEQ ID NO: 2337752 - RNA, 15 nt, Human
gagaggagaaacaca

SEQ ID NO: 2337753 - RNA, 14 nt, Human
gagaggagaaacac

SEQ ID NO: 2337754 - RNA, 20 nt, Human
gagaggacuguagggagggc

SEQ ID NO: 2337755 - RNA, 11 nt, Human
gagaggagaga

SEQ ID NO: 2337756 - RNA, 12 nt, Human
gagaggagagag

SEQ ID NO: 2337757 - RNA, 15 nt, Human
gagaggagagaggca

SEQ ID NO: 2337758 - RNA, 19 nt, Human
gagaggaaugccuguguga

SEQ ID NO: 2337759 - RNA, 20 nt, Human
gagaggaaauauugcugggg

SEQ ID NO: 2337760 - RNA, 21 nt, Human
gagaggaaauauugcuggggu

SEQ ID NO: 2337761 - RNA, 23 nt, Human
gagagcuuucuguccuuuuggca

SEQ ID NO: 2337762 - RNA, 20 nt, Human
gagaggaaaaguaaggugca

SEQ ID NO: 2337763 - RNA, 16 nt, Human
gagagcuuaaugauaa

SEQ ID NO: 2337764 - RNA, 15 nt, Human
gagaggacccccuga

SEQ ID NO: 2337765 - RNA, 18 nt, Human
gagagcuguucccaaauu

SEQ ID NO: 2337766 - RNA, 23 nt, Human
gagagcuggggaagcuucuuaaa

SEQ ID NO: 2337767 - RNA, 17 nt, Human
gagagcuggugcccgga

SEQ ID NO: 2337768 - RNA, 22 nt, Human
gagagcuucuguugcugccuca

SEQ ID NO: 2337769 - RNA, 12 nt, Human
gagaggaaauca

SEQ ID NO: 2337770 - RNA, 14 nt, Human
gagagcuggugccc

SEQ ID NO: 2337771 - RNA, 13 nt, Human
gagagcuggugcc

SEQ ID NO: 2337772 - RNA, 14 nt, Human
gagagcuggggaag

SEQ ID NO: 2337773 - RNA, 21 nt, Human
gagagcuggagccuggugccc

SEQ ID NO: 2337774 - RNA, 14 nt, Human
gagagcuggagccu

SEQ ID NO: 2337775 - RNA, 16 nt, Human
gagagcuggagccugg

SEQ ID NO: 2337776 - RNA, 20 nt, Human
gagagcugggugucaagagg

SEQ ID NO: 2337777 - RNA, 17 nt, Human
gagauuggacggccuga

SEQ ID NO: 2337778 - RNA, 21 nt, Human
gagauugugccacuucacucc

SEQ ID NO: 2337779 - RNA, 23 nt, Human
gagauuguuguuugccauacuuu

SEQ ID NO: 2337780 - RNA, 14 nt, Human
gagauuggaaggaa

SEQ ID NO: 2337781 - RNA, 21 nt, Human
gagauugugccccugcacucc

SEQ ID NO: 2337782 - RNA, 23 nt, Human
gagaugccuccaccgcugccuaa

SEQ ID NO: 2337783 - RNA, 22 nt, Human
gagaugccuccaccgcugccua

SEQ ID NO: 2337784 - RNA, 18 nt, Human
gagagggaggcaagcccu

SEQ ID NO: 2337785 - RNA, 14 nt, Human
gagagggagagaga

SEQ ID NO: 2337786 - RNA, 16 nt, Human
gagaugcuagaacucc

SEQ ID NO: 2337787 - RNA, 20 nt, Human
gagaugcuagaacucccuuu

SEQ ID NO: 2337788 - RNA, 15 nt, Human
gagaugcuggagaag

SEQ ID NO: 2337789 - RNA, 16 nt, Human
gagaugcuggagaaga

SEQ ID NO: 2337790 - RNA, 18 nt, Human
gagaugcuggagaagaga

SEQ ID NO: 2337791 - RNA, 22 nt, Human
gagaugucuucguacaguucuu

SEQ ID NO: 2337792 - RNA, 14 nt, Human
gagaugugcaccca

SEQ ID NO: 2337793 - RNA, 14 nt, Human
gagauucagacugu

SEQ ID NO: 2337794 - RNA, 15 nt, Human
gagauuauguucuuu

SEQ ID NO: 2337795 - RNA, 15 nt, Human
gagauuaccuccuga

SEQ ID NO: 2337796 - RNA, 16 nt, Human
gagauuagagggaggu

SEQ ID NO: 2337797 - RNA, 14 nt, Human
gagauguuuuagag

SEQ ID NO: 2337798 - RNA, 14 nt, Human
gagauguuuuuaaa

SEQ ID NO: 2337799 - RNA, 17 nt, Human
gagauguuuuuaaaagu

SEQ ID NO: 2337800 - RNA, 18 nt, Human
gagauguuuuuaaaaguu

SEQ ID NO: 2337801 - RNA, 19 nt, Human
gagauguuuuuaaaaguuu

SEQ ID NO: 2337802 - RNA, 21 nt, Human
gagauguuuuuaaaaguuuca

SEQ ID NO: 2337803 - RNA, 11 nt, Human
gaccccuccuc

SEQ ID NO: 2337804 - RNA, 12 nt, Human
gaccccuccuca

SEQ ID NO: 2337805 - RNA, 13 nt, Human
gaccccuccucac

SEQ ID NO: 2337806 - RNA, 14 nt, Human
gaccccuccucacu

SEQ ID NO: 2337807 - RNA, 15 nt, Human
gaccccuccucacug

SEQ ID NO: 2337808 - RNA, 18 nt, Human
gacccggaggggccuggc

SEQ ID NO: 2337809 - RNA, 19 nt, Human
gacccggaggggccuggca

SEQ ID NO: 2337810 - RNA, 20 nt, Human
gacccggaggggccuggcag

SEQ ID NO: 2337811 - RNA, 23 nt, Human
gacccggaggccacaugaguccc

SEQ ID NO: 2337812 - RNA, 15 nt, Human
gacccggaggccaca

SEQ ID NO: 2337813 - RNA, 17 nt, Human
gacccggaggccacaug

SEQ ID NO: 2337814 - RNA, 15 nt, Human
gaccccucuggccag

SEQ ID NO: 2337815 - RNA, 13 nt, Human
gaccccucuggcc

SEQ ID NO: 2337816 - RNA, 13 nt, Human
gaccccuccuccc

SEQ ID NO: 2337817 - RNA, 14 nt, Human
gaccccuccucccu

SEQ ID NO: 2337818 - RNA, 16 nt, Human
gaccccugagcuugca

SEQ ID NO: 2337819 - RNA, 17 nt, Human
gaccccuccucacuggc

SEQ ID NO: 2337820 - RNA, 19 nt, Human
gaccccuccucacuggcca

SEQ ID NO: 2337821 - RNA, 23 nt, Human
gaccccuccucacuggccauccc

SEQ ID NO: 2337822 - RNA, 12 nt, Human
gaccccuccucc

SEQ ID NO: 2337823 - RNA, 16 nt, Human
gaccccuccucccuuu

SEQ ID NO: 2337824 - RNA, 23 nt, Human
gacccggagcuaacacuggcccc

SEQ ID NO: 2337825 - RNA, 11 nt, Human
gacccggaggc

SEQ ID NO: 2337826 - RNA, 13 nt, Human
gacccggaggcca

SEQ ID NO: 2337827 - RNA, 14 nt, Human
gacccggaggccac

SEQ ID NO: 2337828 - RNA, 17 nt, Human
gacccggaggggccugg

SEQ ID NO: 2337829 - RNA, 18 nt, Human
gaccccucuggccaggau

SEQ ID NO: 2337830 - RNA, 16 nt, Human
gaccccucuggccagg

SEQ ID NO: 2337831 - RNA, 20 nt, Human
gaccccucuggccaggaugg

SEQ ID NO: 2337832 - RNA, 22 nt, Human
gacccggagcuaacacuggccc

SEQ ID NO: 2337833 - RNA, 19 nt, Human
gaccucaggugagaagcag

SEQ ID NO: 2337834 - RNA, 18 nt, Human
gaccucaggugagaagca

SEQ ID NO: 2337835 - RNA, 23 nt, Human
gaccucagguaaucgaccugccu

SEQ ID NO: 2337836 - RNA, 22 nt, Human
gaccucagguaaucgaccugcc

SEQ ID NO: 2337837 - RNA, 19 nt, Human
gaccucaggccugggggcu

SEQ ID NO: 2337838 - RNA, 21 nt, Human
gaccucaggugagaagcagag

SEQ ID NO: 2337839 - RNA, 19 nt, Human
gaccucaggugauccaccc

SEQ ID NO: 2337840 - RNA, 20 nt, Human
gaccucaggugauccaccca

SEQ ID NO: 2337841 - RNA, 21 nt, Human
gaccucaggugauccacccac

SEQ ID NO: 2337842 - RNA, 14 nt, Human
gacccucugccacc

SEQ ID NO: 2337843 - RNA, 20 nt, Human
gacccucugaaugguccagg

SEQ ID NO: 2337844 - RNA, 23 nt, Human
gacccucugaaugguccaggguu

SEQ ID NO: 2337845 - RNA, 17 nt, Human
gacccucuccaccccau

SEQ ID NO: 2337846 - RNA, 15 nt, Human
gacccucugaauggu

SEQ ID NO: 2337847 - RNA, 16 nt, Human
gacccucuccacccca

SEQ ID NO: 2337848 - RNA, 15 nt, Human
gacccucuccacccc

SEQ ID NO: 2337849 - RNA, 14 nt, Human
gaccucaggccugg

SEQ ID NO: 2337850 - RNA, 16 nt, Human
gacccugaaggggcca

SEQ ID NO: 2337851 - RNA, 20 nt, Human
gacccucugccaccagagac

SEQ ID NO: 2337852 - RNA, 15 nt, Human
gacccucugccacca

SEQ ID NO: 2337853 - RNA, 16 nt, Human
gacccucugccaccag

SEQ ID NO: 2337854 - RNA, 20 nt, Human
gaccucaguuuuaucauuuu

SEQ ID NO: 2337855 - RNA, 21 nt, Human
gaccucaguuuuaucauuuuc

SEQ ID NO: 2337856 - RNA, 10 nt, Human
gaccucauca

SEQ ID NO: 2337857 - RNA, 13 nt, Human
gaccucaucagga

SEQ ID NO: 2337858 - RNA, 22 nt, Human
gaccucaugcaucuccaccugc

SEQ ID NO: 2337859 - RNA, 19 nt, Human
gaccucaucaggaugaacc

SEQ ID NO: 2337860 - RNA, 23 nt, Human
gaccucaucaggaugaacccagg

SEQ ID NO: 2337861 - RNA, 17 nt, Human
gaccucaugcaucucca

SEQ ID NO: 2337862 - RNA, 21 nt, Human
gaccucaugcaucuccaccug

SEQ ID NO: 2337863 - RNA, 16 nt, Human
gaccuccccugaggcu

SEQ ID NO: 2337864 - RNA, 14 nt, Human
gaccucccagcccu

SEQ ID NO: 2337865 - RNA, 15 nt, Human
gaccucccagcccua

SEQ ID NO: 2337866 - RNA, 21 nt, Human
gaccucccagcccuauggaug

SEQ ID NO: 2337867 - RNA, 22 nt, Human
gaccucccagcccuauggaugu

SEQ ID NO: 2337868 - RNA, 23 nt, Human
gaccucccagcccuauggaugug

SEQ ID NO: 2337869 - RNA, 22 nt, Human
gaccucugcagcaauaaagcag

SEQ ID NO: 2337870 - RNA, 18 nt, Human
gaccucugcagcaauaaa

SEQ ID NO: 2337871 - RNA, 16 nt, Human
gaccucugcagcaaua

SEQ ID NO: 2337872 - RNA, 17 nt, Human
gaccuccuaacaaguag

SEQ ID NO: 2337873 - RNA, 13 nt, Human
gaccuccccagcc

SEQ ID NO: 2337874 - RNA, 14 nt, Human
gaccuccccagccc

SEQ ID NO: 2337875 - RNA, 16 nt, Human
gaccuccccagccccu

SEQ ID NO: 2337876 - RNA, 12 nt, Human
gaccuccugccu

SEQ ID NO: 2337877 - RNA, 14 nt, Human
gaccuccugccucc

SEQ ID NO: 2337878 - RNA, 21 nt, Human
gaccucgagcagaugaugcca

SEQ ID NO: 2337879 - RNA, 13 nt, Human
gaccucguccucc

SEQ ID NO: 2337880 - RNA, 14 nt, Human
gacgccaccauucc

SEQ ID NO: 2337881 - RNA, 15 nt, Human
gacgccaccauuccu

SEQ ID NO: 2337882 - RNA, 16 nt, Human
gacgccaccauuccug

SEQ ID NO: 2337883 - RNA, 12 nt, Human
gacgccacccag

SEQ ID NO: 2337884 - RNA, 13 nt, Human
gaccucugccuga

SEQ ID NO: 2337885 - RNA, 12 nt, Human
gacgccauccca

SEQ ID NO: 2337886 - RNA, 13 nt, Human
gacgccaucccag

SEQ ID NO: 2337887 - RNA, 19 nt, Human
gacgccaucccagccccaa

SEQ ID NO: 2337888 - RNA, 21 nt, Human
gacgccggggacagaggccug

SEQ ID NO: 2337889 - RNA, 14 nt, Human
gacgccugaggaac

SEQ ID NO: 2337890 - RNA, 17 nt, Human
gacgccugagcucacuc

SEQ ID NO: 2337891 - RNA, 18 nt, Human
gacgccugcccuccccag

SEQ ID NO: 2337892 - RNA, 13 nt, Human
gacgccugaggaa

SEQ ID NO: 2337893 - RNA, 22 nt, Human
gacgccggggacagaggccugc

SEQ ID NO: 2337894 - RNA, 13 nt, Human
gacgccugagcuc

SEQ ID NO: 2337895 - RNA, 15 nt, Human
gacgccaucccagcc

SEQ ID NO: 2337896 - RNA, 13 nt, Human
gacgccacccagc

SEQ ID NO: 2337897 - RNA, 14 nt, Human
gacgccacccagca

SEQ ID NO: 2337898 - RNA, 21 nt, Human
gacgccaucccagccccaaug

SEQ ID NO: 2337899 - RNA, 15 nt, Human
gacgcugugcugccc

SEQ ID NO: 2337900 - RNA, 17 nt, Human
gacgcucccugcuccac

SEQ ID NO: 2337901 - RNA, 18 nt, Human
gacgcugugcugcccugc

SEQ ID NO: 2337902 - RNA, 16 nt, Human
gacgcugugcugcccu

SEQ ID NO: 2337903 - RNA, 17 nt, Human
gacgcugugcugcccug

SEQ ID NO: 2337904 - RNA, 22 nt, Human
gacgcuacccgggaagggggcu

SEQ ID NO: 2337905 - RNA, 23 nt, Human
gacgccugcccuccccagagcac

SEQ ID NO: 2337906 - RNA, 20 nt, Human
gacgccugcccuccccagag

SEQ ID NO: 2337907 - RNA, 22 nt, Human
gacgccugcccuccccagagca

SEQ ID NO: 2337908 - RNA, 23 nt, Human
gacgcuacccgggaagggggcug

SEQ ID NO: 2337909 - RNA, 14 nt, Human
gacgcucucuggcc

SEQ ID NO: 2337910 - RNA, 19 nt, Human
gacacugguauuccugccu

SEQ ID NO: 2337911 - RNA, 22 nt, Human
gacacuggcugccagcuauuuu

SEQ ID NO: 2337912 - RNA, 20 nt, Human
gacacugguauuccugccuc

SEQ ID NO: 2337913 - RNA, 23 nt, Human
gacacugguuuacacuuuaugcc

SEQ ID NO: 2337914 - RNA, 19 nt, Human
gacacugguuuacacuuua

SEQ ID NO: 2337915 - RNA, 23 nt, Human
gacacuggcucauauuccugcag

SEQ ID NO: 2337916 - RNA, 17 nt, Human
gacacuggcugccagcu

SEQ ID NO: 2337917 - RNA, 15 nt, Human
gacacuggccccuca

SEQ ID NO: 2337918 - RNA, 23 nt, Human
gacacuucagagagcugguaguu

SEQ ID NO: 2337919 - RNA, 20 nt, Human
gacacuucagagagcuggua

SEQ ID NO: 2337920 - RNA, 19 nt, Human
gacacuucagagagcuggu

SEQ ID NO: 2337921 - RNA, 18 nt, Human
gacacuucagagagcugg

SEQ ID NO: 2337922 - RNA, 17 nt, Human
gacacuucagagagcug

SEQ ID NO: 2337923 - RNA, 15 nt, Human
gacacuucagagagc

SEQ ID NO: 2337924 - RNA, 21 nt, Human
gacacuucccucuguuucucu

SEQ ID NO: 2337925 - RNA, 12 nt, Human
gacacuuccugc

SEQ ID NO: 2337926 - RNA, 13 nt, Human
gacacuuccugcc

SEQ ID NO: 2337927 - RNA, 17 nt, Human
gacacuucccucuguuu

SEQ ID NO: 2337928 - RNA, 18 nt, Human
gacacuucccucuguuuc

SEQ ID NO: 2337929 - RNA, 19 nt, Human
gacacuucccucuguuucu

SEQ ID NO: 2337930 - RNA, 20 nt, Human
gacacuucccucuguuucuc

SEQ ID NO: 2337931 - RNA, 16 nt, Human
gacacugcggggcuug

SEQ ID NO: 2337932 - RNA, 12 nt, Human
gacacuggcaug

SEQ ID NO: 2337933 - RNA, 22 nt, Human
gacacugcggggcuuggcugag

SEQ ID NO: 2337934 - RNA, 13 nt, Human
gacacuggccccu

SEQ ID NO: 2337935 - RNA, 14 nt, Human
gacacuggccccuc

SEQ ID NO: 2337936 - RNA, 19 nt, Human
gacacugcggggcuuggcu

SEQ ID NO: 2337937 - RNA, 20 nt, Human
gacacugcggggcuuggcug

SEQ ID NO: 2337938 - RNA, 16 nt, Human
gacagcuccuucuguc

SEQ ID NO: 2337939 - RNA, 16 nt, Human
gacagcccgggcucug

SEQ ID NO: 2337940 - RNA, 17 nt, Human
gacagcuccuucugucc

SEQ ID NO: 2337941 - RNA, 18 nt, Human
gacagcuccuucuguccu

SEQ ID NO: 2337942 - RNA, 15 nt, Human
gacacuugccuucuu

SEQ ID NO: 2337943 - RNA, 22 nt, Human
gacacuugccuucuucacccag

SEQ ID NO: 2337944 - RNA, 14 nt, Human
gacacuuccugccu

SEQ ID NO: 2337945 - RNA, 15 nt, Human
gacacuuccugccua

SEQ ID NO: 2337946 - RNA, 14 nt, Human
gacacuugucccca

SEQ ID NO: 2337947 - RNA, 23 nt, Human
gacacuugccuucuucacccagc

SEQ ID NO: 2337948 - RNA, 23 nt, Human
gacacuuuaauuaccaaccuguu

SEQ ID NO: 2337949 - RNA, 21 nt, Human
gacacuuugaaauguguuucu

SEQ ID NO: 2337950 - RNA, 22 nt, Human
gacacuuugaaauguguuucug

SEQ ID NO: 2337951 - RNA, 15 nt, Human
gacacuuugaaaugu

SEQ ID NO: 2337952 - RNA, 18 nt, Human
gacacuuugaaauguguu

SEQ ID NO: 2337953 - RNA, 19 nt, Human
gacacuuugaaauguguuu

SEQ ID NO: 2337954 - RNA, 20 nt, Human
gacacuuugaaauguguuuc

SEQ ID NO: 2337955 - RNA, 14 nt, Human
gacagcccgggcuc

SEQ ID NO: 2337956 - RNA, 15 nt, Human
gacagccccacccug

SEQ ID NO: 2337957 - RNA, 14 nt, Human
gacagccccacccu

SEQ ID NO: 2337958 - RNA, 14 nt, Human
gacagccccagagc

SEQ ID NO: 2337959 - RNA, 16 nt, Human
gacagccccagagcag

SEQ ID NO: 2337960 - RNA, 17 nt, Human
gacagccccagagcagg

SEQ ID NO: 2337961 - RNA, 23 nt, Human
gacauguggaaagugaauuugaa

SEQ ID NO: 2337962 - RNA, 19 nt, Human
gacauguggaaagugaauu

SEQ ID NO: 2337963 - RNA, 18 nt, Human
gacauguggaaagugaau

SEQ ID NO: 2337964 - RNA, 13 nt, Human
gacauguggaaag

SEQ ID NO: 2337965 - RNA, 16 nt, Human
gacaugugacauuuau

SEQ ID NO: 2337966 - RNA, 20 nt, Human
gacaugugacauuuauauau

SEQ ID NO: 2337967 - RNA, 15 nt, Human
gacaguccucuccac

SEQ ID NO: 2337968 - RNA, 17 nt, Human
gacaguccagccuggag

SEQ ID NO: 2337969 - RNA, 19 nt, Human
gacaguccagccuggagau

SEQ ID NO: 2337970 - RNA, 12 nt, Human
gacaugugacau

SEQ ID NO: 2337971 - RNA, 16 nt, Human
gacaguccucuccacc

SEQ ID NO: 2337972 - RNA, 23 nt, Human
gacaugugaaaccuuuuuuaaga

SEQ ID NO: 2337973 - RNA, 22 nt, Human
gacauguggugggacagggacc

SEQ ID NO: 2337974 - RNA, 16 nt, Human
gacauguggugggaca

SEQ ID NO: 2337975 - RNA, 14 nt, Human
gacaugugguggga

SEQ ID NO: 2337976 - RNA, 17 nt, Human
gacauguggggccaggu

SEQ ID NO: 2337977 - RNA, 23 nt, Human
gacauguuuuagacaaauacuca

SEQ ID NO: 2337978 - RNA, 15 nt, Human
gacauguuauauauu

SEQ ID NO: 2337979 - RNA, 18 nt, Human
gacauguuauauauuuuu

SEQ ID NO: 2337980 - RNA, 17 nt, Human
gacauguuuuccgugaa

SEQ ID NO: 2337981 - RNA, 14 nt, Human
gacauguuuugaua

SEQ ID NO: 2337982 - RNA, 16 nt, Human
gacauguuuugauaaa

SEQ ID NO: 2337983 - RNA, 14 nt, Human
gacagucccugcca

SEQ ID NO: 2337984 - RNA, 15 nt, Human
gacagucccugccaa

SEQ ID NO: 2337985 - RNA, 16 nt, Human
gacagucccugccaau

SEQ ID NO: 2337986 - RNA, 20 nt, Human
gacagucccugccaauggac

SEQ ID NO: 2337987 - RNA, 19 nt, Human
gacagcuccuucuguccua

SEQ ID NO: 2337988 - RNA, 12 nt, Human
gacagcucugca

SEQ ID NO: 2337989 - RNA, 15 nt, Human
gacagcucugccugu

SEQ ID NO: 2337990 - RNA, 20 nt, Human
gacagccccagagcagggug

SEQ ID NO: 2337991 - RNA, 18 nt, Human
gacagccccagagcaggg

SEQ ID NO: 2337992 - RNA, 19 nt, Human
gacagccccagagcagggu

SEQ ID NO: 2337993 - RNA, 10 nt, Human
gacagcucuu

SEQ ID NO: 2337994 - RNA, 12 nt, Human
gacagucccugc

SEQ ID NO: 2337995 - RNA, 15 nt, Human
gacaguccagccugg

SEQ ID NO: 2337996 - RNA, 16 nt, Human
gacaguccagccugga

SEQ ID NO: 2337997 - RNA, 11 nt, Human
gacagcucuua

SEQ ID NO: 2337998 - RNA, 18 nt, Human
gacagucaccucauggaa

SEQ ID NO: 2337999 - RNA, 17 nt, Human
gacauuuugccaaaauu

SEQ ID NO: 2338000 - RNA, 17 nt, Human
gacauugcggacagcca

SEQ ID NO: 2338001 - RNA, 23 nt, Human
gacauugcggacagccacggcca

SEQ ID NO: 2338002 - RNA, 21 nt, Human
gacauugcguuugaccuuuua

SEQ ID NO: 2338003 - RNA, 14 nt, Human
gacauugcguuuga

SEQ ID NO: 2338004 - RNA, 18 nt, Human
gacauguuuuuguuuucu

SEQ ID NO: 2338005 - RNA, 14 nt, Human
gacauguuuuuguu

SEQ ID NO: 2338006 - RNA, 20 nt, Human
gacauguuuugauaaaguag

SEQ ID NO: 2338007 - RNA, 23 nt, Human
gacauguuuugauaaaguaguaa

SEQ ID NO: 2338008 - RNA, 23 nt, Human
gacauuggcaccuaauccaggca

SEQ ID NO: 2338009 - RNA, 12 nt, Human
gacauugcuaag

SEQ ID NO: 2338010 - RNA, 18 nt, Human
gacauugcuaagaugcuc

SEQ ID NO: 2338011 - RNA, 15 nt, Human
gacauuuucuucaga

SEQ ID NO: 2338012 - RNA, 15 nt, Human
gacauuuugccaaaa

SEQ ID NO: 2338013 - RNA, 23 nt, Human
gacauugcuuuacugucaaaaua

SEQ ID NO: 2338014 - RNA, 22 nt, Human
gacauuugggagacaugugaca

SEQ ID NO: 2338015 - RNA, 23 nt, Human
gacauuugggagacaugugacau

SEQ ID NO: 2338016 - RNA, 14 nt, Human
gaaugaauggcuaa

SEQ ID NO: 2338017 - RNA, 22 nt, Human
gaauauugcugauggugcaaug

SEQ ID NO: 2338018 - RNA, 23 nt, Human
gaauauugcugauggugcaauga

SEQ ID NO: 2338019 - RNA, 22 nt, Human
gaauauugcuuuggucauauga

SEQ ID NO: 2338020 - RNA, 24 nt, Human
gaauauugcugauggugcaaugac

SEQ ID NO: 2338021 - RNA, 22 nt, Human
gaauauacagcaggugcucaau

SEQ ID NO: 2338022 - RNA, 21 nt, Human
gaauauaccccuuaguguuug

SEQ ID NO: 2338023 - RNA, 15 nt, Human
gaauauauaaccagu

SEQ ID NO: 2338024 - RNA, 12 nt, Human
gaauauauuaua

SEQ ID NO: 2338025 - RNA, 11 nt, Human
gaauauauuau

SEQ ID NO: 2338026 - RNA, 23 nt, Human
gaauauauggcagaguuguaaau

SEQ ID NO: 2338027 - RNA, 15 nt, Human
gaauauauggcagag

SEQ ID NO: 2338028 - RNA, 20 nt, Human
gaauauauggcagaguugua

SEQ ID NO: 2338029 - RNA, 21 nt, Human
gaauauauggcagaguuguaa

SEQ ID NO: 2338030 - RNA, 22 nt, Human
gaauauauggcagaguuguaaa

SEQ ID NO: 2338031 - RNA, 19 nt, Human
gaauaugauuaguaaagaa

SEQ ID NO: 2338032 - RNA, 17 nt, Human
gaauaugggagaaauag

SEQ ID NO: 2338033 - RNA, 17 nt, Human
gaauaugacggaagaac

SEQ ID NO: 2338034 - RNA, 15 nt, Human
gaauaugacggaaga

SEQ ID NO: 2338035 - RNA, 14 nt, Human
gaauaugacagcug

SEQ ID NO: 2338036 - RNA, 22 nt, Human
gaauaugaacggugagcauugu

SEQ ID NO: 2338037 - RNA, 19 nt, Human
gaauaugagcuuuauguaa

SEQ ID NO: 2338038 - RNA, 19 nt, Human
gaauaugacggaagaacau

SEQ ID NO: 2338039 - RNA, 14 nt, Human
gaauaucugggauu

SEQ ID NO: 2338040 - RNA, 22 nt, Human
gaauauccccucccagucaccu

SEQ ID NO: 2338041 - RNA, 17 nt, Human
gaauauccccucccagu

SEQ ID NO: 2338042 - RNA, 16 nt, Human
gaauauccaugaccua

SEQ ID NO: 2338043 - RNA, 18 nt, Human
gaauaugauuaguaaaga

SEQ ID NO: 2338044 - RNA, 15 nt, Human
gaauauucaggacuu

SEQ ID NO: 2338045 - RNA, 18 nt, Human
gaauaugggagaaauagu

SEQ ID NO: 2338046 - RNA, 18 nt, Human
gaauauucccaagcccau

SEQ ID NO: 2338047 - RNA, 11 nt, Human
gaauauugcug

SEQ ID NO: 2338048 - RNA, 12 nt, Human
gaauauugcuga

SEQ ID NO: 2338049 - RNA, 13 nt, Human
gaauauugcugau

SEQ ID NO: 2338050 - RNA, 18 nt, Human
gaauuaaguuagggaaug

SEQ ID NO: 2338051 - RNA, 21 nt, Human
gaauuaaguuagggaauggca

SEQ ID NO: 2338052 - RNA, 21 nt, Human
gaauuaauaucccuacaugua

SEQ ID NO: 2338053 - RNA, 15 nt, Human
gaauuaaguuaucuu

SEQ ID NO: 2338054 - RNA, 20 nt, Human
gaauuaaguuaucuuuaaaa

SEQ ID NO: 2338055 - RNA, 17 nt, Human
gaauuaacuccauucca

SEQ ID NO: 2338056 - RNA, 22 nt, Human
gaauuaaccuggugcuggauau

SEQ ID NO: 2338057 - RNA, 19 nt, Human
gaauuaaccuggugcugga

SEQ ID NO: 2338058 - RNA, 18 nt, Human
gaauuaaccuggugcugg

SEQ ID NO: 2338059 - RNA, 16 nt, Human
gaauuaaccuggugcu

SEQ ID NO: 2338060 - RNA, 15 nt, Human
gaauuaaccuggugc

SEQ ID NO: 2338061 - RNA, 13 nt, Human
gaauuaaauuuaa

SEQ ID NO: 2338062 - RNA, 19 nt, Human
gaauuaaugacagagccag

SEQ ID NO: 2338063 - RNA, 21 nt, Human
gaauuacauguaaaacauuau

SEQ ID NO: 2338064 - RNA, 22 nt, Human
gaauuaauaucccuacauguau

SEQ ID NO: 2338065 - RNA, 15 nt, Human
gaauuaauagcuuuu

SEQ ID NO: 2338066 - RNA, 21 nt, Human
gaauuaaucaucuauaaagaa

SEQ ID NO: 2338067 - RNA, 13 nt, Human
gaauuacauuugu

SEQ ID NO: 2338068 - RNA, 22 nt, Human
gaauuacauguaaaacauuauc

SEQ ID NO: 2338069 - RNA, 20 nt, Human
gaauuacauuuguauaaaau

SEQ ID NO: 2338070 - RNA, 15 nt, Human
gaauuacauuuguau

SEQ ID NO: 2338071 - RNA, 18 nt, Human
gaauuacauuuguauaaa

SEQ ID NO: 2338072 - RNA, 21 nt, Human
gaauuaaauuaggaauaaaua

SEQ ID NO: 2338073 - RNA, 20 nt, Human
gaauuaaauuaggaauaaau

SEQ ID NO: 2338074 - RNA, 20 nt, Human
gaauuaaauaaacccuuccu

SEQ ID NO: 2338075 - RNA, 12 nt, Human
gaauuaaauaaa

SEQ ID NO: 2338076 - RNA, 22 nt, Human
gaauuaaaguggaccaauaggg

SEQ ID NO: 2338077 - RNA, 15 nt, Human
gaauuaacacaugau

SEQ ID NO: 2338078 - RNA, 14 nt, Human
gaauuaacacauga

SEQ ID NO: 2338079 - RNA, 16 nt, Human
gaauguuuuaaauucu

SEQ ID NO: 2338080 - RNA, 15 nt, Human
gaauguuuuaaauuc

SEQ ID NO: 2338081 - RNA, 14 nt, Human
gaauguuugucuca

SEQ ID NO: 2338082 - RNA, 18 nt, Human
gaauguuugccucugccu

SEQ ID NO: 2338083 - RNA, 19 nt, Human
gaauguuugccucugccuc

SEQ ID NO: 2338084 - RNA, 22 nt, Human
gaaugauuuccaaagagaaaaa

SEQ ID NO: 2338085 - RNA, 14 nt, Human
gaaugauuuuuaga

SEQ ID NO: 2338086 - RNA, 16 nt, Human
gaaugauuuuuagaug

SEQ ID NO: 2338087 - RNA, 15 nt, Human
gaauguuugccucug

SEQ ID NO: 2338088 - RNA, 19 nt, Human
gaaugcacaaacagaggcc

SEQ ID NO: 2338089 - RNA, 16 nt, Human
gaauguuugccucugc

SEQ ID NO: 2338090 - RNA, 17 nt, Human
gaauguuugccucugcc

SEQ ID NO: 2338091 - RNA, 20 nt, Human
gaaugauuuccaaagagaaa

SEQ ID NO: 2338092 - RNA, 16 nt, Human
gaaugauuuccaaaga

SEQ ID NO: 2338093 - RNA, 14 nt, Human
gaaugauuucaugc

SEQ ID NO: 2338094 - RNA, 23 nt, Human
gaaugauucuaauuuuuaagcaa

SEQ ID NO: 2338095 - RNA, 13 nt, Human
gaaugaugaagcu

SEQ ID NO: 2338096 - RNA, 18 nt, Human
gaaugcacaaacagaggc

SEQ ID NO: 2338097 - RNA, 15 nt, Human
gaaugauucaguguu

SEQ ID NO: 2338098 - RNA, 18 nt, Human
gaaugaucuuucuuuccu

SEQ ID NO: 2338099 - RNA, 17 nt, Human
gaaugaucucuucuuuu

SEQ ID NO: 2338100 - RNA, 22 nt, Human
gaaugauuaugaauuacauuug

SEQ ID NO: 2338101 - RNA, 20 nt, Human
gaaugaugauccuaggcauu

SEQ ID NO: 2338102 - RNA, 14 nt, Human
gaaugaugccauga

SEQ ID NO: 2338103 - RNA, 14 nt, Human
gaaugauuaauuaa

SEQ ID NO: 2338104 - RNA, 14 nt, Human
gaaugauuaugaau

SEQ ID NO: 2338105 - RNA, 22 nt, Human
gaaugaggugggagguggaaga

SEQ ID NO: 2338106 - RNA, 16 nt, Human
gaaugaucucuucuuu

SEQ ID NO: 2338107 - RNA, 20 nt, Human
gaaugaauggcuaagcaaaa

SEQ ID NO: 2338108 - RNA, 15 nt, Human
gaaugaauggcuaag

SEQ ID NO: 2338109 - RNA, 22 nt, Human
gacaaagaugauuuaaaaggga

SEQ ID NO: 2338110 - RNA, 21 nt, Human
gacaaagacaaauucuguuuc

SEQ ID NO: 2338111 - RNA, 14 nt, Human
gacaaagacaaauu

SEQ ID NO: 2338112 - RNA, 19 nt, Human
gacaaacugcauauguacu

SEQ ID NO: 2338113 - RNA, 17 nt, Human
gacaaacugccaguuuu

SEQ ID NO: 2338114 - RNA, 20 nt, Human
gacaaacugccaguuuuguu

SEQ ID NO: 2338115 - RNA, 20 nt, Human
gacaaagccaaacucugcca

SEQ ID NO: 2338116 - RNA, 23 nt, Human
gacaaagaugauuuaaaagggaa

SEQ ID NO: 2338117 - RNA, 23 nt, Human
gacaaagcuuggaagagccugca

SEQ ID NO: 2338118 - RNA, 17 nt, Human
gacaaaggacauuuguu

SEQ ID NO: 2338119 - RNA, 13 nt, Human
gacaaaggcaagc

SEQ ID NO: 2338120 - RNA, 15 nt, Human
gacaaaccagaagca

SEQ ID NO: 2338121 - RNA, 14 nt, Human
gacaaacagcucag

SEQ ID NO: 2338122 - RNA, 22 nt, Human
gacaaacaccucccaggagaca

SEQ ID NO: 2338123 - RNA, 17 nt, Human
gacaaacaccucccagg

SEQ ID NO: 2338124 - RNA, 19 nt, Human
gacaaacaccucccaggag

SEQ ID NO: 2338125 - RNA, 20 nt, Human
gacaaaaacagccucacaga

SEQ ID NO: 2338126 - RNA, 18 nt, Human
gacaaaaacagccucaca

SEQ ID NO: 2338127 - RNA, 17 nt, Human
gacaaaaacagccucac

SEQ ID NO: 2338128 - RNA, 16 nt, Human
gacaaaaacagccuca

SEQ ID NO: 2338129 - RNA, 22 nt, Human
gaauuuuuuuuuccuagcccuc

SEQ ID NO: 2338130 - RNA, 22 nt, Human
gaauuuuuuucaucuucucugg

SEQ ID NO: 2338131 - RNA, 16 nt, Human
gaauuaguccuugcuu

SEQ ID NO: 2338132 - RNA, 18 nt, Human
gaauuaguccuugcuugg

SEQ ID NO: 2338133 - RNA, 18 nt, Human
gaauuagaaacauaaaua

SEQ ID NO: 2338134 - RNA, 22 nt, Human
gaauuaccuuagauuagcucug

SEQ ID NO: 2338135 - RNA, 16 nt, Human
gaauuuuuuucaucuu

SEQ ID NO: 2338136 - RNA, 20 nt, Human
gaauuuuuuucaucuucucu

SEQ ID NO: 2338137 - RNA, 22 nt, Human
gaauucaaacuggggccuccag

SEQ ID NO: 2338138 - RNA, 21 nt, Human
gaauucaaacuggggccucca

SEQ ID NO: 2338139 - RNA, 18 nt, Human
gaauucaaacuggggccu

SEQ ID NO: 2338140 - RNA, 16 nt, Human
gaauucaaacuggggc

SEQ ID NO: 2338141 - RNA, 18 nt, Human
gaauuauuuuaaaagaua

SEQ ID NO: 2338142 - RNA, 16 nt, Human
gaauuauuuuaaaaga

SEQ ID NO: 2338143 - RNA, 13 nt, Human
gaauuauuuuaaa

SEQ ID NO: 2338144 - RNA, 23 nt, Human
gacaaaguuacugauucacugca

SEQ ID NO: 2338145 - RNA, 18 nt, Human
gacaaagguuuuccucuu

SEQ ID NO: 2338146 - RNA, 17 nt, Human
gacaaauacucaugugu

SEQ ID NO: 2338147 - RNA, 18 nt, Human
gacaaauacucaugugua

SEQ ID NO: 2338148 - RNA, 19 nt, Human
gacaaauacucauguguau

SEQ ID NO: 2338149 - RNA, 15 nt, Human
gacaaagucaagcca

SEQ ID NO: 2338150 - RNA, 21 nt, Human
gacacagaaaauguugagaau

SEQ ID NO: 2338151 - RNA, 19 nt, Human
gacacagaaaauguugaga

SEQ ID NO: 2338152 - RNA, 15 nt, Human
gacaaaucaaagcag

SEQ ID NO: 2338153 - RNA, 20 nt, Human
gacaaauacucauguguaug

SEQ ID NO: 2338154 - RNA, 12 nt, Human
gacacagcucuu

SEQ ID NO: 2338155 - RNA, 15 nt, Human
gacacagaugaaaca

SEQ ID NO: 2338156 - RNA, 11 nt, Human
gacacagcagc

SEQ ID NO: 2338157 - RNA, 15 nt, Human
gacacagcagcuuca

SEQ ID NO: 2338158 - RNA, 18 nt, Human
gacacagcagcuucacca

SEQ ID NO: 2338159 - RNA, 19 nt, Human
gacacagcagcuucaccag

SEQ ID NO: 2338160 - RNA, 20 nt, Human
gacacagcagcuucaccaga

SEQ ID NO: 2338161 - RNA, 21 nt, Human
gacacagcagcuucaccagag

SEQ ID NO: 2338162 - RNA, 19 nt, Human
gacacagcucuucuccagg

SEQ ID NO: 2338163 - RNA, 20 nt, Human
gacacagcucuucuccaggc

SEQ ID NO: 2338164 - RNA, 21 nt, Human
gacacagcucuucuccaggcu

SEQ ID NO: 2338165 - RNA, 22 nt, Human
gacacagcagcuucaccagagc

SEQ ID NO: 2338166 - RNA, 23 nt, Human
gacacagcagcuucaccagagca

SEQ ID NO: 2338167 - RNA, 22 nt, Human
gauggaaaaaccacccccaaau

SEQ ID NO: 2338168 - RNA, 15 nt, Human
gauggaaaaggaaga

SEQ ID NO: 2338169 - RNA, 17 nt, Human
gauggaaaaggaagacu

SEQ ID NO: 2338170 - RNA, 17 nt, Human
gauggaaccgcaggaag

SEQ ID NO: 2338171 - RNA, 22 nt, Human
gauggaacccuuuuggcccccg

SEQ ID NO: 2338172 - RNA, 20 nt, Human
gauggaacccuuuuggcccc

SEQ ID NO: 2338173 - RNA, 21 nt, Human
gauggaacaggcucagaucuc

SEQ ID NO: 2338174 - RNA, 17 nt, Human
gauggaacacggccaca

SEQ ID NO: 2338175 - RNA, 24 nt, Human
gaugcuugccuagggccuggucca

SEQ ID NO: 2338176 - RNA, 15 nt, Human
gaugcuucugggaga

SEQ ID NO: 2338177 - RNA, 22 nt, Human
gaugauuucuugaaaagggugu

SEQ ID NO: 2338178 - RNA, 14 nt, Human
gaugauuuuuguca

SEQ ID NO: 2338179 - RNA, 21 nt, Human
gaugcuucuucagagacuccu

SEQ ID NO: 2338180 - RNA, 17 nt, Human
gaugcuucuucagagac

SEQ ID NO: 2338181 - RNA, 20 nt, Human
gaugcuucuucagagacucc

SEQ ID NO: 2338182 - RNA, 19 nt, Human
gaugaucagcuguuuguca

SEQ ID NO: 2338183 - RNA, 23 nt, Human
gaugauccaugaguuugcccugg

SEQ ID NO: 2338184 - RNA, 22 nt, Human
gaugauccaugaguuugcccug

SEQ ID NO: 2338185 - RNA, 20 nt, Human
gaugaucagcuguuugucau

SEQ ID NO: 2338186 - RNA, 14 nt, Human
gaugauccuaggca

SEQ ID NO: 2338187 - RNA, 13 nt, Human
gaugauccuaggc

SEQ ID NO: 2338188 - RNA, 17 nt, Human
gaugauuuaaaagggaa

SEQ ID NO: 2338189 - RNA, 21 nt, Human
gaugauccggauuuaauuuga

SEQ ID NO: 2338190 - RNA, 16 nt, Human
gaugauccggauuuaa

SEQ ID NO: 2338191 - RNA, 22 nt, Human
gaugauuggaggggggaggugg

SEQ ID NO: 2338192 - RNA, 19 nt, Human
gaucugaacagaaauacca

SEQ ID NO: 2338193 - RNA, 12 nt, Human
gaucugaacaga

SEQ ID NO: 2338194 - RNA, 19 nt, Human
gaucugacaugauuccuuc

SEQ ID NO: 2338195 - RNA, 17 nt, Human
gaucugacaugauuccu

SEQ ID NO: 2338196 - RNA, 19 nt, Human
gaucucuugagccugggag

SEQ ID NO: 2338197 - RNA, 14 nt, Human
gaucugagaaucuu

SEQ ID NO: 2338198 - RNA, 22 nt, Human
gaucugacaugauuccuuccug

SEQ ID NO: 2338199 - RNA, 21 nt, Human
gaucugacaugauuccuuccu

SEQ ID NO: 2338200 - RNA, 15 nt, Human
gaucugagaaucuuu

SEQ ID NO: 2338201 - RNA, 18 nt, Human
gaucugagaaucuuuauu

SEQ ID NO: 2338202 - RNA, 17 nt, Human
gaucugaugcaagcaag

SEQ ID NO: 2338203 - RNA, 15 nt, Human
gaucugagucccagg

SEQ ID NO: 2338204 - RNA, 23 nt, Human
gaucucugcaggaaauggcugug

SEQ ID NO: 2338205 - RNA, 18 nt, Human
gaucucuugagccuggga

SEQ ID NO: 2338206 - RNA, 12 nt, Human
gaucucugcagg

SEQ ID NO: 2338207 - RNA, 23 nt, Human
gaucucucaggagcacaggcagc

SEQ ID NO: 2338208 - RNA, 17 nt, Human
gaucucucaggagcaca

SEQ ID NO: 2338209 - RNA, 18 nt, Human
gaucucucaggagcacag

SEQ ID NO: 2338210 - RNA, 19 nt, Human
gaucucucaggagcacagg

SEQ ID NO: 2338211 - RNA, 20 nt, Human
gaucucucaggagcacaggc

SEQ ID NO: 2338212 - RNA, 21 nt, Human
gaucucucaggagcacaggca

SEQ ID NO: 2338213 - RNA, 22 nt, Human
gaucucucaggagcacaggcag

SEQ ID NO: 2338214 - RNA, 24 nt, Human
gaucucucaggagcacaggcagcu

SEQ ID NO: 2338215 - RNA, 19 nt, Human
gauccaccugucucagccu

SEQ ID NO: 2338216 - RNA, 18 nt, Human
gauccaccugucucagcc

SEQ ID NO: 2338217 - RNA, 14 nt, Human
gauccaccugucuc

SEQ ID NO: 2338218 - RNA, 23 nt, Human
gauccagcccugaguuccuagcc

SEQ ID NO: 2338219 - RNA, 12 nt, Human
gauccagccugg

SEQ ID NO: 2338220 - RNA, 14 nt, Human
gauccagagcacag

SEQ ID NO: 2338221 - RNA, 19 nt, Human
gaucccagcucacgucaca

SEQ ID NO: 2338222 - RNA, 17 nt, Human
gaucccagcucacguca

SEQ ID NO: 2338223 - RNA, 17 nt, Human
gauccagccucuccccu

SEQ ID NO: 2338224 - RNA, 22 nt, Human
gaucccaccccauuuucugugg

SEQ ID NO: 2338225 - RNA, 15 nt, Human
gaucucuaacuucac

SEQ ID NO: 2338226 - RNA, 12 nt, Human
gaucucucagga

SEQ ID NO: 2338227 - RNA, 13 nt, Human
gaucucucaggag

SEQ ID NO: 2338228 - RNA, 14 nt, Human
gaucucucaggagc

SEQ ID NO: 2338229 - RNA, 16 nt, Human
gaucucucaggagcac

SEQ ID NO: 2338230 - RNA, 24 nt, Human
gaucccaucuugauaagaccacca

SEQ ID NO: 2338231 - RNA, 23 nt, Human
gaucccaggggcccaaggcggcc

SEQ ID NO: 2338232 - RNA, 21 nt, Human
gaucuggaaccucagccuggc

SEQ ID NO: 2338233 - RNA, 20 nt, Human
gaucuggaaccucagccugg

SEQ ID NO: 2338234 - RNA, 19 nt, Human
gaucuggaaccucagccug

SEQ ID NO: 2338235 - RNA, 18 nt, Human
gaucuggaaccucagccu

SEQ ID NO: 2338236 - RNA, 17 nt, Human
gaucuggaaccucagcc

SEQ ID NO: 2338237 - RNA, 16 nt, Human
gaucuggaaccucagc

SEQ ID NO: 2338238 - RNA, 12 nt, Human
gaucuggaaccu

SEQ ID NO: 2338239 - RNA, 20 nt, Human
gaucuggaacccagacucag

SEQ ID NO: 2338240 - RNA, 18 nt, Human
gaucuggaacccagacuc

SEQ ID NO: 2338241 - RNA, 17 nt, Human
gaucuggaacccagacu

SEQ ID NO: 2338242 - RNA, 16 nt, Human
gaucuggaacccagac

SEQ ID NO: 2338243 - RNA, 15 nt, Human
gaucuggaacccaga

SEQ ID NO: 2338244 - RNA, 14 nt, Human
gaucugccccuccc

SEQ ID NO: 2338245 - RNA, 20 nt, Human
gaucugccccucccugcuuc

SEQ ID NO: 2338246 - RNA, 14 nt, Human
gaucuggaacccag

SEQ ID NO: 2338247 - RNA, 12 nt, Human
gaucuggaaccc

SEQ ID NO: 2338248 - RNA, 13 nt, Human
gaucugccccucc

SEQ ID NO: 2338249 - RNA, 20 nt, Human
gaucugcagggggugugucu

SEQ ID NO: 2338250 - RNA, 17 nt, Human
gauacugucucuuucau

SEQ ID NO: 2338251 - RNA, 16 nt, Human
gauacuguaacacuuu

SEQ ID NO: 2338252 - RNA, 19 nt, Human
gauacuggaaguuuugcau

SEQ ID NO: 2338253 - RNA, 16 nt, Human
gauacuggaaguuuug

SEQ ID NO: 2338254 - RNA, 20 nt, Human
gauacuggaaguuuugcauu

SEQ ID NO: 2338255 - RNA, 21 nt, Human
gauacuguaucaugacaaaga

SEQ ID NO: 2338256 - RNA, 17 nt, Human
gauacuguaucaugaca

SEQ ID NO: 2338257 - RNA, 14 nt, Human
gauacuggaaguuu

SEQ ID NO: 2338258 - RNA, 23 nt, Human
gauacugcuacuguaauuuuaua

SEQ ID NO: 2338259 - RNA, 21 nt, Human
gauacugcgacuuucugccug

SEQ ID NO: 2338260 - RNA, 23 nt, Human
gauacugcgacuuucugccugga

SEQ ID NO: 2338261 - RNA, 17 nt, Human
gauacugcgacuuucug

SEQ ID NO: 2338262 - RNA, 18 nt, Human
gauacugcgacuuucugc

SEQ ID NO: 2338263 - RNA, 19 nt, Human
gauacugcgacuuucugcc

SEQ ID NO: 2338264 - RNA, 20 nt, Human
gauacugcgacuuucugccu

SEQ ID NO: 2338265 - RNA, 17 nt, Human
gauacucugucagaugg

SEQ ID NO: 2338266 - RNA, 13 nt, Human
gauacucugucag

SEQ ID NO: 2338267 - RNA, 20 nt, Human
gauaccagguugaaagaccu

SEQ ID NO: 2338268 - RNA, 17 nt, Human
gauaccagguugaaaga

SEQ ID NO: 2338269 - RNA, 12 nt, Human
gauaccagcccc

SEQ ID NO: 2338270 - RNA, 18 nt, Human
gauaccauauacagcuca

SEQ ID NO: 2338271 - RNA, 15 nt, Human
gauacugcccggggc

SEQ ID NO: 2338272 - RNA, 18 nt, Human
gauacugcagggccagga

SEQ ID NO: 2338273 - RNA, 21 nt, Human
gauacugcagggccaggacug

SEQ ID NO: 2338274 - RNA, 16 nt, Human
gauacaguuacucaga

SEQ ID NO: 2338275 - RNA, 23 nt, Human
gauacaguuacucagaauucucu

SEQ ID NO: 2338276 - RNA, 19 nt, Human
gauacaguuacucagaauu

SEQ ID NO: 2338277 - RNA, 15 nt, Human
gauaccagcgaggag

SEQ ID NO: 2338278 - RNA, 22 nt, Human
gauaccagcgaggaggcuccag

SEQ ID NO: 2338279 - RNA, 13 nt, Human
gauaccagcugga

SEQ ID NO: 2338280 - RNA, 12 nt, Human
gauacaugugcc

SEQ ID NO: 2338281 - RNA, 21 nt, Human
gauacauacaccagcauuccu

SEQ ID NO: 2338282 - RNA, 23 nt, Human
gauacauccaaagcagacagcuc

SEQ ID NO: 2338283 - RNA, 21 nt, Human
gauacauccaaagcagacagc

SEQ ID NO: 2338284 - RNA, 20 nt, Human
gauacauccaaagcagacag

SEQ ID NO: 2338285 - RNA, 17 nt, Human
gauacauccaaagcaga

SEQ ID NO: 2338286 - RNA, 20 nt, Human
gauacauaugaguguggaag

SEQ ID NO: 2338287 - RNA, 18 nt, Human
gauacauaugagugugga

SEQ ID NO: 2338288 - RNA, 18 nt, Human
gauacagucccuaaagaa

SEQ ID NO: 2338289 - RNA, 19 nt, Human
gauacagucccuaaagaaa

SEQ ID NO: 2338290 - RNA, 21 nt, Human
gauauuuuaccucuuauugca

SEQ ID NO: 2338291 - RNA, 22 nt, Human
gauauuucccuccccuggggac

SEQ ID NO: 2338292 - RNA, 20 nt, Human
gauauuuucaaauuguaucu

SEQ ID NO: 2338293 - RNA, 19 nt, Human
gauauuuucaaauuguauc

SEQ ID NO: 2338294 - RNA, 18 nt, Human
gauauuuucaaauuguau

SEQ ID NO: 2338295 - RNA, 12 nt, Human
gauauuuucaaa

SEQ ID NO: 2338296 - RNA, 19 nt, Human
gauauuuucaacgcagccc

SEQ ID NO: 2338297 - RNA, 23 nt, Human
gauauuuauauuuuuauuuuauu

SEQ ID NO: 2338298 - RNA, 16 nt, Human
gauauuuauauauauu

SEQ ID NO: 2338299 - RNA, 16 nt, Human
gauauugugaaguaca

SEQ ID NO: 2338300 - RNA, 13 nt, Human
gauauuuauauau

SEQ ID NO: 2338301 - RNA, 17 nt, Human
gauauugugaaguacau

SEQ ID NO: 2338302 - RNA, 19 nt, Human
gauauuuauggggggagaa

SEQ ID NO: 2338303 - RNA, 23 nt, Human
gauauuucuauuuccuggaaugg

SEQ ID NO: 2338304 - RNA, 13 nt, Human
gauacuuuacaug

SEQ ID NO: 2338305 - RNA, 18 nt, Human
gauacuuugauauuuuca

SEQ ID NO: 2338306 - RNA, 22 nt, Human
gauacuguaacacuuuacaaug

SEQ ID NO: 2338307 - RNA, 16 nt, Human
gauagaagaacugcaa

SEQ ID NO: 2338308 - RNA, 14 nt, Human
gauagaagaacugc

SEQ ID NO: 2338309 - RNA, 20 nt, Human
gauagaaauaaauagcuaua

SEQ ID NO: 2338310 - RNA, 16 nt, Human
gauagaaauaaauagc

SEQ ID NO: 2338311 - RNA, 14 nt, Human
gauagaaauaaaua

SEQ ID NO: 2338312 - RNA, 17 nt, Human
gaucaaaggcacacagc

SEQ ID NO: 2338313 - RNA, 14 nt, Human
gaucaaauacuuua

SEQ ID NO: 2338314 - RNA, 16 nt, Human
gaucaaauacuuuaaa

SEQ ID NO: 2338315 - RNA, 17 nt, Human
gaucaaauacuuuaaag

SEQ ID NO: 2338316 - RNA, 19 nt, Human
gaucaaauacuuuaaagga

SEQ ID NO: 2338317 - RNA, 22 nt, Human
gaucaaaccccgaccaccugcc

SEQ ID NO: 2338318 - RNA, 22 nt, Human
gaucaaaauaaaaagugacaca

SEQ ID NO: 2338319 - RNA, 23 nt, Human
gaucaaaagguuaauaaaguaau

SEQ ID NO: 2338320 - RNA, 20 nt, Human
gauauuuucuuccaagcaaa

SEQ ID NO: 2338321 - RNA, 17 nt, Human
gaucaaaauaaaaagug

SEQ ID NO: 2338322 - RNA, 20 nt, Human
gaucaaaauaaaaagugaca

SEQ ID NO: 2338323 - RNA, 20 nt, Human
gaucaaaagguuaauaaagu

SEQ ID NO: 2338324 - RNA, 15 nt, Human
gauauuuugcuuugu

SEQ ID NO: 2338325 - RNA, 17 nt, Human
gauauuuuuuucuuuuc

SEQ ID NO: 2338326 - RNA, 21 nt, Human
gauauuuucaacgcagcccug

SEQ ID NO: 2338327 - RNA, 22 nt, Human
gauauuuucaacgcagcccugc

SEQ ID NO: 2338328 - RNA, 23 nt, Human
gauauuuucaacgcagcccugcu

SEQ ID NO: 2338329 - RNA, 21 nt, Human
gauauuuucugugccugaaua

SEQ ID NO: 2338330 - RNA, 15 nt, Human
gauauuuucugugcc

SEQ ID NO: 2338331 - RNA, 19 nt, Human
gauccacacacagaggaag

SEQ ID NO: 2338332 - RNA, 17 nt, Human
gauccacacacagagga

SEQ ID NO: 2338333 - RNA, 16 nt, Human
gauccacacacagagg

SEQ ID NO: 2338334 - RNA, 18 nt, Human
gauccacacacagaggaa

SEQ ID NO: 2338335 - RNA, 22 nt, Human
gauccacccaccucagccuccc

SEQ ID NO: 2338336 - RNA, 20 nt, Human
gauccacccaccucagccuc

SEQ ID NO: 2338337 - RNA, 21 nt, Human
gauccacccaccucagccucc

SEQ ID NO: 2338338 - RNA, 15 nt, Human
gauccacacacagag

SEQ ID NO: 2338339 - RNA, 14 nt, Human
gauccacacacaga

SEQ ID NO: 2338340 - RNA, 19 nt, Human
gauccaaguuuacucaacc

SEQ ID NO: 2338341 - RNA, 18 nt, Human
gaucaaccagcuaagaaa

SEQ ID NO: 2338342 - RNA, 21 nt, Human
gauccaagcuggucccacuca

SEQ ID NO: 2338343 - RNA, 18 nt, Human
gauccacccaccucagcc

SEQ ID NO: 2338344 - RNA, 19 nt, Human
gauccacccaccucagccu

SEQ ID NO: 2338345 - RNA, 23 nt, Human
gaucaaauucauuuuuuucacug

SEQ ID NO: 2338346 - RNA, 14 nt, Human
gaucaacaucuuuu

SEQ ID NO: 2338347 - RNA, 16 nt, Human
gaucaacaucuuuucu

SEQ ID NO: 2338348 - RNA, 17 nt, Human
gaucaacaucuuuucuu

SEQ ID NO: 2338349 - RNA, 20 nt, Human
gaucaacaucuuuucuugcc

SEQ ID NO: 2338350 - RNA, 13 nt, Human
gauccaaaagaag

SEQ ID NO: 2338351 - RNA, 23 nt, Human
gaucauuuucuuaucuucugcaa

SEQ ID NO: 2338352 - RNA, 22 nt, Human
gauccaaaagaagcccccagcu

SEQ ID NO: 2338353 - RNA, 20 nt, Human
gauccaaaagaagcccccag

SEQ ID NO: 2338354 - RNA, 19 nt, Human
gauccaaaagaagccccca

SEQ ID NO: 2338355 - RNA, 16 nt, Human
gauccaaaagaagccc

SEQ ID NO: 2338356 - RNA, 23 nt, Human
gauccaaaagaagcccccagcua

SEQ ID NO: 2338357 - RNA, 20 nt, Human
gauccaacuaaugccuuacu

SEQ ID NO: 2338358 - RNA, 19 nt, Human
gauccaacuaaugccuuac

SEQ ID NO: 2338359 - RNA, 12 nt, Human
gauccaagcugg

SEQ ID NO: 2338360 - RNA, 16 nt, Human
gauccaagcugguccc

SEQ ID NO: 2338361 - RNA, 17 nt, Human
gauccaagcugguccca

SEQ ID NO: 2338362 - RNA, 19 nt, Human
gauccaagcuggucccacu

SEQ ID NO: 2338363 - RNA, 12 nt, Human
gauucuucugcu

SEQ ID NO: 2338364 - RNA, 13 nt, Human
gauucuucugcuu

SEQ ID NO: 2338365 - RNA, 15 nt, Human
gauucuucugcuuca

SEQ ID NO: 2338366 - RNA, 19 nt, Human
gauuuaauaaaauaauucu

SEQ ID NO: 2338367 - RNA, 22 nt, Human
gauuuaauaaaauaauucuaaa

SEQ ID NO: 2338368 - RNA, 19 nt, Human
gauuuaacagaaauguaca

SEQ ID NO: 2338369 - RNA, 14 nt, Human
gauuuaauaguguu

SEQ ID NO: 2338370 - RNA, 23 nt, Human
gauuuaauaaaauaauucuaaag

SEQ ID NO: 2338371 - RNA, 15 nt, Human
gauuuaauaguguua

SEQ ID NO: 2338372 - RNA, 16 nt, Human
gauuuaauaguguuaa

SEQ ID NO: 2338373 - RNA, 17 nt, Human
gauuuaauaguguuaau

SEQ ID NO: 2338374 - RNA, 18 nt, Human
gauuuaauaguguuaauc

SEQ ID NO: 2338375 - RNA, 19 nt, Human
gauuuaauaguguuaauca

SEQ ID NO: 2338376 - RNA, 20 nt, Human
gauuuaauaguguuaaucaa

SEQ ID NO: 2338377 - RNA, 23 nt, Human
gauuuaauaguguuaaucaauuu

SEQ ID NO: 2338378 - RNA, 21 nt, Human
gauuuaauaguguuaaucaau

SEQ ID NO: 2338379 - RNA, 22 nt, Human
gauuuaauaguguuaaucaauu

SEQ ID NO: 2338380 - RNA, 21 nt, Human
gauuuaauuaaucaugaaugu

SEQ ID NO: 2338381 - RNA, 20 nt, Human
gauucuucugcuucagccuc

SEQ ID NO: 2338382 - RNA, 16 nt, Human
gauuuaacagaaaugu

SEQ ID NO: 2338383 - RNA, 18 nt, Human
gauuuaacagaaauguac

SEQ ID NO: 2338384 - RNA, 17 nt, Human
gauuuaacagaaaugua

SEQ ID NO: 2338385 - RNA, 15 nt, Human
gauuucaagccugcc

SEQ ID NO: 2338386 - RNA, 21 nt, Human
gauuuuuuuuuccuucagugc

SEQ ID NO: 2338387 - RNA, 14 nt, Human
gcaaaaaggcagga

SEQ ID NO: 2338388 - RNA, 22 nt, Human
gcaaaagaugcuucucacugcc

SEQ ID NO: 2338389 - RNA, 23 nt, Human
gcaaaaauauuuauaaaacuucu

SEQ ID NO: 2338390 - RNA, 14 nt, Human
gcaaaaauauuuau

SEQ ID NO: 2338391 - RNA, 21 nt, Human
gcaaaaggaucuuuguggcca

SEQ ID NO: 2338392 - RNA, 20 nt, Human
gcaaaaggaucuuuguggcc

SEQ ID NO: 2338393 - RNA, 17 nt, Human
gcaaaagaugcuucuca

SEQ ID NO: 2338394 - RNA, 13 nt, Human
gcaaaaagcaaaa

SEQ ID NO: 2338395 - RNA, 22 nt, Human
gauuuauuucaucauauuauac

SEQ ID NO: 2338396 - RNA, 18 nt, Human
gauuuauuucaucauauu

SEQ ID NO: 2338397 - RNA, 11 nt, Human
gauuucacucu

SEQ ID NO: 2338398 - RNA, 16 nt, Human
gauuuacacugggaga

SEQ ID NO: 2338399 - RNA, 19 nt, Human
gauuuacagccucacuuga

SEQ ID NO: 2338400 - RNA, 19 nt, Human
gauuuaauuugauaucaca

SEQ ID NO: 2338401 - RNA, 23 nt, Human
gauuuaauuugauaucacagucu

SEQ ID NO: 2338402 - RNA, 12 nt, Human
gauuuaauucuc

SEQ ID NO: 2338403 - RNA, 13 nt, Human
gauuuaauucucu

SEQ ID NO: 2338404 - RNA, 15 nt, Human
gauuuaauucucuug

SEQ ID NO: 2338405 - RNA, 16 nt, Human
gauuuuuuuuuccuuc

SEQ ID NO: 2338406 - RNA, 12 nt, Human
gauuucacucuc

SEQ ID NO: 2338407 - RNA, 17 nt, Human
gauuuuuuuuuccuuca

SEQ ID NO: 2338408 - RNA, 18 nt, Human
gauuuuuuuuuccuucag

SEQ ID NO: 2338409 - RNA, 21 nt, Human
gauggaaguugcagugagcug

SEQ ID NO: 2338410 - RNA, 15 nt, Human
gauggaagcuuccag

SEQ ID NO: 2338411 - RNA, 22 nt, Human
gauggaaccgcaggaagcugcu

SEQ ID NO: 2338412 - RNA, 20 nt, Human
gauggaaccgcaggaagcug

SEQ ID NO: 2338413 - RNA, 19 nt, Human
gauggaaccgcaggaagcu

SEQ ID NO: 2338414 - RNA, 18 nt, Human
gauggaaccgcaggaagc

SEQ ID NO: 2338415 - RNA, 13 nt, Human
gauggaaugaugg

SEQ ID NO: 2338416 - RNA, 16 nt, Human
gcaagugagagcuggg

SEQ ID NO: 2338417 - RNA, 15 nt, Human
gcaagugagagcugg

SEQ ID NO: 2338418 - RNA, 14 nt, Human
gcaaccaguuggcu

SEQ ID NO: 2338419 - RNA, 16 nt, Human
gcaaccaguuggcuag

SEQ ID NO: 2338420 - RNA, 18 nt, Human
gcaaccaguuggcuaggg

SEQ ID NO: 2338421 - RNA, 20 nt, Human
gcaaccacaggcagcauuua

SEQ ID NO: 2338422 - RNA, 14 nt, Human
gcaaccacuaagaa

SEQ ID NO: 2338423 - RNA, 14 nt, Human
gcaacccccagccu

SEQ ID NO: 2338424 - RNA, 16 nt, Human
gcaacccaaggacuga

SEQ ID NO: 2338425 - RNA, 19 nt, Human
gcaaccccaggcugaagca

SEQ ID NO: 2338426 - RNA, 20 nt, Human
gcaacccaaggacugaggga

SEQ ID NO: 2338427 - RNA, 14 nt, Human
gcaacccacgugua

SEQ ID NO: 2338428 - RNA, 15 nt, Human
gcaacccccagccug

SEQ ID NO: 2338429 - RNA, 16 nt, Human
gcaacccccagccugc

SEQ ID NO: 2338430 - RNA, 19 nt, Human
gcaaccuccgccucuuggg

SEQ ID NO: 2338431 - RNA, 16 nt, Human
gcaaccccaguucugc

SEQ ID NO: 2338432 - RNA, 18 nt, Human
gcaaccccaguucugcuc

SEQ ID NO: 2338433 - RNA, 19 nt, Human
gcaaccccaguucugcucc

SEQ ID NO: 2338434 - RNA, 20 nt, Human
gcaaccccaguucugcuccu

SEQ ID NO: 2338435 - RNA, 14 nt, Human
gcaaccugggucca

SEQ ID NO: 2338436 - RNA, 18 nt, Human
gcaaccuggguccaaaua

SEQ ID NO: 2338437 - RNA, 19 nt, Human
gcaaccuggguccaaauaa

SEQ ID NO: 2338438 - RNA, 20 nt, Human
gcaaccuucgccaccugggu

SEQ ID NO: 2338439 - RNA, 20 nt, Human
gcaaccuccgccucuugggu

SEQ ID NO: 2338440 - RNA, 23 nt, Human
gcaaccucuuggccugaucagac

SEQ ID NO: 2338441 - RNA, 16 nt, Human
gcaaccucuuggccug

SEQ ID NO: 2338442 - RNA, 21 nt, Human
gcaaccccaguucugcuccuc

SEQ ID NO: 2338443 - RNA, 22 nt, Human
gcaaccccaguucugcuccucu

SEQ ID NO: 2338444 - RNA, 24 nt, Human
gcaaccccaguucugcuccucucc

SEQ ID NO: 2338445 - RNA, 18 nt, Human
gcaacaucuagcaaaugu

SEQ ID NO: 2338446 - RNA, 13 nt, Human
gcaaccaccacca

SEQ ID NO: 2338447 - RNA, 16 nt, Human
gcaaccaccaccaacc

SEQ ID NO: 2338448 - RNA, 18 nt, Human
gcaaccaccaccaaccac

SEQ ID NO: 2338449 - RNA, 17 nt, Human
gcaacaguagcauagga

SEQ ID NO: 2338450 - RNA, 20 nt, Human
gcaacagguuuuauaauuuu

SEQ ID NO: 2338451 - RNA, 13 nt, Human
gcaacagguuuua

SEQ ID NO: 2338452 - RNA, 17 nt, Human
gcaacauccaaaauagu

SEQ ID NO: 2338453 - RNA, 13 nt, Human
gcaacauccaaaa

SEQ ID NO: 2338454 - RNA, 22 nt, Human
gcaacaggguauggacuaucug

SEQ ID NO: 2338455 - RNA, 18 nt, Human
gcaacaggaaucaagagc

SEQ ID NO: 2338456 - RNA, 21 nt, Human
gcaacaggaaucaagagcugc

SEQ ID NO: 2338457 - RNA, 13 nt, Human
gcaacagcacugg

SEQ ID NO: 2338458 - RNA, 18 nt, Human
gcaacagcacuggcucuc

SEQ ID NO: 2338459 - RNA, 20 nt, Human
gcaacagcacuggcucucuc

SEQ ID NO: 2338460 - RNA, 17 nt, Human
gcaacagcauaacaagg

SEQ ID NO: 2338461 - RNA, 16 nt, Human
gcaacaggcugggcuu

SEQ ID NO: 2338462 - RNA, 19 nt, Human
gcaacaggcugggcuucag

SEQ ID NO: 2338463 - RNA, 20 nt, Human
gcaaaagguucacuaaagca

SEQ ID NO: 2338464 - RNA, 21 nt, Human
gcaaaagguucacuaaagcag

SEQ ID NO: 2338465 - RNA, 23 nt, Human
gcaaaaggaucuuuguggccaag

SEQ ID NO: 2338466 - RNA, 17 nt, Human
gcaaaagggugucugag

SEQ ID NO: 2338467 - RNA, 18 nt, Human
gcaaaaguucugacuuga

SEQ ID NO: 2338468 - RNA, 19 nt, Human
gcaaaaguucugacuugac

SEQ ID NO: 2338469 - RNA, 15 nt, Human
gcaaaauaauuuuaa

SEQ ID NO: 2338470 - RNA, 13 nt, Human
gcaaaauaauuuu

SEQ ID NO: 2338471 - RNA, 13 nt, Human
gcaaaauagcauu

SEQ ID NO: 2338472 - RNA, 20 nt, Human
gcaaaauaauuuuaaacaaa

SEQ ID NO: 2338473 - RNA, 13 nt, Human
gcaaaaucaugga

SEQ ID NO: 2338474 - RNA, 20 nt, Human
gcaaaaucauggaaugguua

SEQ ID NO: 2338475 - RNA, 23 nt, Human
gcaaaaucauuuuauaugucaaa

SEQ ID NO: 2338476 - RNA, 17 nt, Human
gcaaaaugaggaaugua

SEQ ID NO: 2338477 - RNA, 13 nt, Human
gcaaaaugugaau

SEQ ID NO: 2338478 - RNA, 14 nt, Human
gcaacaggcugggc

SEQ ID NO: 2338479 - RNA, 15 nt, Human
gcaacaggcugggcu

SEQ ID NO: 2338480 - RNA, 13 nt, Human
gcaacaggcuggg

SEQ ID NO: 2338481 - RNA, 16 nt, Human
gcaaaauucccaggga

SEQ ID NO: 2338482 - RNA, 19 nt, Human
gcaacagcaaaucacgacc

SEQ ID NO: 2338483 - RNA, 18 nt, Human
gcauccaguaucuugaag

SEQ ID NO: 2338484 - RNA, 21 nt, Human
gcauccauuccucagggacag

SEQ ID NO: 2338485 - RNA, 18 nt, Human
gcauccauuccucaggga

SEQ ID NO: 2338486 - RNA, 16 nt, Human
gcauccauuccucagg

SEQ ID NO: 2338487 - RNA, 15 nt, Human
gcauccauuccucag

SEQ ID NO: 2338488 - RNA, 14 nt, Human
gcauccauuccuca

SEQ ID NO: 2338489 - RNA, 12 nt, Human
gcauccauuccu

SEQ ID NO: 2338490 - RNA, 17 nt, Human
gcauccauguguggacu

SEQ ID NO: 2338491 - RNA, 14 nt, Human
gcauccaguaucuu

SEQ ID NO: 2338492 - RNA, 17 nt, Human
gcauccaguaucuugaa

SEQ ID NO: 2338493 - RNA, 11 nt, Human
gcauccuaguc

SEQ ID NO: 2338494 - RNA, 23 nt, Human
gcauccuagucucuaucauuaaa

SEQ ID NO: 2338495 - RNA, 19 nt, Human
gcauccguaguucccugaa

SEQ ID NO: 2338496 - RNA, 18 nt, Human
gcauccguaguucccuga

SEQ ID NO: 2338497 - RNA, 14 nt, Human
gcauccuccaagaa

SEQ ID NO: 2338498 - RNA, 15 nt, Human
gcauccuccaagaau

SEQ ID NO: 2338499 - RNA, 19 nt, Human
gcauccuccaagaaucuau

SEQ ID NO: 2338500 - RNA, 18 nt, Human
gcauccuccacaauagca

SEQ ID NO: 2338501 - RNA, 17 nt, Human
gcauccguaguucccug

SEQ ID NO: 2338502 - RNA, 22 nt, Human
gcaucccuugaccaggccuggg

SEQ ID NO: 2338503 - RNA, 20 nt, Human
gcaucccuugaccaggccug

SEQ ID NO: 2338504 - RNA, 18 nt, Human
gcaucccuugaccaggcc

SEQ ID NO: 2338505 - RNA, 20 nt, Human
gcaucccaguggccucaacc

SEQ ID NO: 2338506 - RNA, 23 nt, Human
gcaucccaguggccucaacccuc

SEQ ID NO: 2338507 - RNA, 17 nt, Human
gcaucccaguggccuca

SEQ ID NO: 2338508 - RNA, 16 nt, Human
gcaucccaguggccuc

SEQ ID NO: 2338509 - RNA, 15 nt, Human
gcaucccaguggccu

SEQ ID NO: 2338510 - RNA, 14 nt, Human
gcaucccaguggcc

SEQ ID NO: 2338511 - RNA, 21 nt, Human
gcaucccaggggaccacaccu

SEQ ID NO: 2338512 - RNA, 19 nt, Human
gcaucccaggggaccacac

SEQ ID NO: 2338513 - RNA, 16 nt, Human
gcaucccaggggacca

SEQ ID NO: 2338514 - RNA, 15 nt, Human
gcaucccaggggacc

SEQ ID NO: 2338515 - RNA, 14 nt, Human
gcaucccaggggac

SEQ ID NO: 2338516 - RNA, 13 nt, Human
gcaucccagggga

SEQ ID NO: 2338517 - RNA, 19 nt, Human
gcauccccuuggcugugag

SEQ ID NO: 2338518 - RNA, 21 nt, Human
gcauccccuuggcugugaggc

SEQ ID NO: 2338519 - RNA, 20 nt, Human
gcauccccuuggcugugagg

SEQ ID NO: 2338520 - RNA, 18 nt, Human
gcaucccugaggagccag

SEQ ID NO: 2338521 - RNA, 20 nt, Human
gcauguguauuuccagugca

SEQ ID NO: 2338522 - RNA, 12 nt, Human
gcauguguauuu

SEQ ID NO: 2338523 - RNA, 16 nt, Human
gcauguggccuguggc

SEQ ID NO: 2338524 - RNA, 15 nt, Human
gcauuuacuuugugu

SEQ ID NO: 2338525 - RNA, 22 nt, Human
gcauuuaaaagauacaguuacu

SEQ ID NO: 2338526 - RNA, 18 nt, Human
gcauuuaaaagauacagu

SEQ ID NO: 2338527 - RNA, 17 nt, Human
gcauuuaaaagauacag

SEQ ID NO: 2338528 - RNA, 16 nt, Human
gcauuuaaaagauaca

SEQ ID NO: 2338529 - RNA, 16 nt, Human
gcauugugggaagggg

SEQ ID NO: 2338530 - RNA, 18 nt, Human
gcauugugggaaggggag

SEQ ID NO: 2338531 - RNA, 15 nt, Human
gcauguaaacacgcc

SEQ ID NO: 2338532 - RNA, 19 nt, Human
gcauguaaacacgccugca

SEQ ID NO: 2338533 - RNA, 17 nt, Human
gcauguaaacacgccug

SEQ ID NO: 2338534 - RNA, 19 nt, Human
gcaugugaugagaggaaau

SEQ ID NO: 2338535 - RNA, 18 nt, Human
gcaugugaugagaggaaa

SEQ ID NO: 2338536 - RNA, 11 nt, Human
gcauguacagu

SEQ ID NO: 2338537 - RNA, 21 nt, Human
gcaugugaugagaggaaauca

SEQ ID NO: 2338538 - RNA, 13 nt, Human
gcauguacagugu

SEQ ID NO: 2338539 - RNA, 20 nt, Human
gcauguacaguguucuguuu

SEQ ID NO: 2338540 - RNA, 12 nt, Human
gcauguggccug

SEQ ID NO: 2338541 - RNA, 17 nt, Human
gcauguggccuguggcc

SEQ ID NO: 2338542 - RNA, 13 nt, Human
gcauugugggaag

SEQ ID NO: 2338543 - RNA, 15 nt, Human
gcauugugggaaggg

SEQ ID NO: 2338544 - RNA, 15 nt, Human
gcaugguggcaccag

SEQ ID NO: 2338545 - RNA, 23 nt, Human
gcauggugccccaggaccagcuc

SEQ ID NO: 2338546 - RNA, 21 nt, Human
gcauggugccccaggaccagc

SEQ ID NO: 2338547 - RNA, 20 nt, Human
gcauggugccccaggaccag

SEQ ID NO: 2338548 - RNA, 19 nt, Human
gcaugguggcgcaagccug

SEQ ID NO: 2338549 - RNA, 15 nt, Human
gcauggugccccagg

SEQ ID NO: 2338550 - RNA, 13 nt, Human
gcauggugcaguu

SEQ ID NO: 2338551 - RNA, 19 nt, Human
gcauggugccccaggacca

SEQ ID NO: 2338552 - RNA, 18 nt, Human
gcauggugccccaggacc

SEQ ID NO: 2338553 - RNA, 17 nt, Human
gcauggugccccaggac

SEQ ID NO: 2338554 - RNA, 16 nt, Human
gcauggugccccagga

SEQ ID NO: 2338555 - RNA, 20 nt, Human
gcaugggaaagccaccucuc

SEQ ID NO: 2338556 - RNA, 15 nt, Human
gcauggggugggccu

SEQ ID NO: 2338557 - RNA, 18 nt, Human
gcauggggugggccucug

SEQ ID NO: 2338558 - RNA, 21 nt, Human
gcaugggugaagggagagcca

SEQ ID NO: 2338559 - RNA, 19 nt, Human
gcauggggugggccucugg

SEQ ID NO: 2338560 - RNA, 15 nt, Human
gcauggucacacacu

SEQ ID NO: 2338561 - RNA, 18 nt, Human
gcauggucacacacugau

SEQ ID NO: 2338562 - RNA, 22 nt, Human
gcauggcuccagucugcugccc

SEQ ID NO: 2338563 - RNA, 15 nt, Human
gcauggcugugagga

SEQ ID NO: 2338564 - RNA, 21 nt, Human
gcauggcuccagucugcugcc

SEQ ID NO: 2338565 - RNA, 15 nt, Human
gcauggcuccagucu

SEQ ID NO: 2338566 - RNA, 18 nt, Human
gcaugggaaagccaccuc

SEQ ID NO: 2338567 - RNA, 19 nt, Human
gcaugggaaagccaccucu

SEQ ID NO: 2338568 - RNA, 21 nt, Human
gcauggcugccaaugggagcu

SEQ ID NO: 2338569 - RNA, 13 nt, Human
gcauccuggcacc

SEQ ID NO: 2338570 - RNA, 17 nt, Human
gcauccuccgccucccg

SEQ ID NO: 2338571 - RNA, 21 nt, Human
gcauccugccuuagagccagg

SEQ ID NO: 2338572 - RNA, 23 nt, Human
gcauccugccuuagagccaggca

SEQ ID NO: 2338573 - RNA, 14 nt, Human
gcauggcuccaguc

SEQ ID NO: 2338574 - RNA, 13 nt, Human
gcauggcuccagu

SEQ ID NO: 2338575 - RNA, 18 nt, Human
gcauggcuccagaaaugu

SEQ ID NO: 2338576 - RNA, 19 nt, Human
gcauggcuccagaaauguc

SEQ ID NO: 2338577 - RNA, 22 nt, Human
gcauggcccuggggucccacga

SEQ ID NO: 2338578 - RNA, 17 nt, Human
gcauggcuccagaaaug

SEQ ID NO: 2338579 - RNA, 16 nt, Human
gcauggcccugggguc

SEQ ID NO: 2338580 - RNA, 17 nt, Human
gcauggcccuggggucc

SEQ ID NO: 2338581 - RNA, 23 nt, Human
gcaucuagaggcuuccuucauuu

SEQ ID NO: 2338582 - RNA, 22 nt, Human
gcaucuagaggcuuccuucauu

SEQ ID NO: 2338583 - RNA, 13 nt, Human
gcaucguggagac

SEQ ID NO: 2338584 - RNA, 21 nt, Human
gcaucuagaggcuuccuucau

SEQ ID NO: 2338585 - RNA, 20 nt, Human
gcaucuagcaugucgucaaa

SEQ ID NO: 2338586 - RNA, 18 nt, Human
gcauacguacacauuuua

SEQ ID NO: 2338587 - RNA, 14 nt, Human
gcaguuuaucauuc

SEQ ID NO: 2338588 - RNA, 13 nt, Human
gcaguugugucag

SEQ ID NO: 2338589 - RNA, 15 nt, Human
gcauacguacacauu

SEQ ID NO: 2338590 - RNA, 17 nt, Human
gcauacguacacauuuu

SEQ ID NO: 2338591 - RNA, 16 nt, Human
gcauacguacacauuu

SEQ ID NO: 2338592 - RNA, 22 nt, Human
gcaguuggccagagagccuggu

SEQ ID NO: 2338593 - RNA, 14 nt, Human
gcaguuggccagag

SEQ ID NO: 2338594 - RNA, 22 nt, Human
gcaguuguugcccacagcugua

SEQ ID NO: 2338595 - RNA, 21 nt, Human
gcagugaugcuggaugcuccu

SEQ ID NO: 2338596 - RNA, 22 nt, Human
gcagugauauggcagaagacac

SEQ ID NO: 2338597 - RNA, 20 nt, Human
gcagugaguuacagcgagag

SEQ ID NO: 2338598 - RNA, 16 nt, Human
gcagugauauggcaga

SEQ ID NO: 2338599 - RNA, 19 nt, Human
gcagugauauggcagaaga

SEQ ID NO: 2338600 - RNA, 21 nt, Human
gcagugauauggcagaagaca

SEQ ID NO: 2338601 - RNA, 13 nt, Human
gcagugaugucac

SEQ ID NO: 2338602 - RNA, 12 nt, Human
gcagcucucccc

SEQ ID NO: 2338603 - RNA, 20 nt, Human
gcagcucuggacagccccac

SEQ ID NO: 2338604 - RNA, 14 nt, Human
gcagcucuugcccu

SEQ ID NO: 2338605 - RNA, 15 nt, Human
gcagcucuugcccuu

SEQ ID NO: 2338606 - RNA, 16 nt, Human
gcagcucuugcccuuc

SEQ ID NO: 2338607 - RNA, 17 nt, Human
gcagcucuugcccuucc

SEQ ID NO: 2338608 - RNA, 18 nt, Human
gcagcucuugcccuuccc

SEQ ID NO: 2338609 - RNA, 19 nt, Human
gcagcucuugcccuucccu

SEQ ID NO: 2338610 - RNA, 20 nt, Human
gcagcucuugcccuucccug

SEQ ID NO: 2338611 - RNA, 23 nt, Human
gcagcucuugcccuucccugucc

SEQ ID NO: 2338612 - RNA, 18 nt, Human
gcagcugaaauaugcugg

SEQ ID NO: 2338613 - RNA, 13 nt, Human
gcagcucuugcua

SEQ ID NO: 2338614 - RNA, 22 nt, Human
gcagcucuugcuaaucaguguc

SEQ ID NO: 2338615 - RNA, 19 nt, Human
gcagcugaaauaugcuggc

SEQ ID NO: 2338616 - RNA, 22 nt, Human
gcagcugaaauaugcuggcugg

SEQ ID NO: 2338617 - RNA, 14 nt, Human
gcagcugaccucug

SEQ ID NO: 2338618 - RNA, 23 nt, Human
gcagcucuugcuaaucagugucu

SEQ ID NO: 2338619 - RNA, 16 nt, Human
gcagucuacccaccuc

SEQ ID NO: 2338620 - RNA, 20 nt, Human
gcagucuauauguuuguaua

SEQ ID NO: 2338621 - RNA, 16 nt, Human
gcagucgugccugugu

SEQ ID NO: 2338622 - RNA, 17 nt, Human
gcagucgugccuguguc

SEQ ID NO: 2338623 - RNA, 18 nt, Human
gcagucgugccugugucc

SEQ ID NO: 2338624 - RNA, 19 nt, Human
gcagucgugccugugucca

SEQ ID NO: 2338625 - RNA, 18 nt, Human
gcagcugauuuuaacaau

SEQ ID NO: 2338626 - RNA, 17 nt, Human
gcagcugauuuuaacaa

SEQ ID NO: 2338627 - RNA, 15 nt, Human
gcagcugauuuuaac

SEQ ID NO: 2338628 - RNA, 14 nt, Human
gcagcugauuuuaa

SEQ ID NO: 2338629 - RNA, 15 nt, Human
gcagcugccagagaa

SEQ ID NO: 2338630 - RNA, 14 nt, Human
gcagcugccagaga

SEQ ID NO: 2338631 - RNA, 16 nt, Human
gcagcugauacaaauu

SEQ ID NO: 2338632 - RNA, 21 nt, Human
gcagcugauguuggaagagaa

SEQ ID NO: 2338633 - RNA, 16 nt, Human
gcagucuggaggggca

SEQ ID NO: 2338634 - RNA, 19 nt, Human
gcagucuggcugagcccug

SEQ ID NO: 2338635 - RNA, 15 nt, Human
gcagucuggaggggc

SEQ ID NO: 2338636 - RNA, 14 nt, Human
gcagucuggagggg

SEQ ID NO: 2338637 - RNA, 13 nt, Human
gcagucuggaggg

SEQ ID NO: 2338638 - RNA, 12 nt, Human
gcagucuggagg

SEQ ID NO: 2338639 - RNA, 21 nt, Human
gcagugaaaacaagugcuggc

SEQ ID NO: 2338640 - RNA, 18 nt, Human
gcagucucggguggcuag

SEQ ID NO: 2338641 - RNA, 17 nt, Human
gcagucugauccaggag

SEQ ID NO: 2338642 - RNA, 20 nt, Human
gcagugagccaagauugcgc

SEQ ID NO: 2338643 - RNA, 14 nt, Human
gcagugagcugaga

SEQ ID NO: 2338644 - RNA, 21 nt, Human
gcagugagccgcaucuucucc

SEQ ID NO: 2338645 - RNA, 14 nt, Human
gcagugagcggaga

SEQ ID NO: 2338646 - RNA, 18 nt, Human
gcagugagucucuucaga

SEQ ID NO: 2338647 - RNA, 15 nt, Human
gcagugagugagccu

SEQ ID NO: 2338648 - RNA, 17 nt, Human
gcagugagugagccugg

SEQ ID NO: 2338649 - RNA, 18 nt, Human
gcagugagugagccuggc

SEQ ID NO: 2338650 - RNA, 19 nt, Human
gcagugagugagccuggcu

SEQ ID NO: 2338651 - RNA, 20 nt, Human
gcagugagugagccuggcuc

SEQ ID NO: 2338652 - RNA, 21 nt, Human
gcagugagugagccuggcucu

SEQ ID NO: 2338653 - RNA, 19 nt, Human
gcagugaguuacagcgaga

SEQ ID NO: 2338654 - RNA, 20 nt, Human
gcagugagaaaaagcuccug

SEQ ID NO: 2338655 - RNA, 18 nt, Human
gcagugacgugcaccugu

SEQ ID NO: 2338656 - RNA, 14 nt, Human
gcagugaauuguga

SEQ ID NO: 2338657 - RNA, 18 nt, Human
gcagugaaagacaagcug

SEQ ID NO: 2338658 - RNA, 20 nt, Human
gcagugaaugauucaguguu

SEQ ID NO: 2338659 - RNA, 21 nt, Human
gcagugaauugugaccaaguu

SEQ ID NO: 2338660 - RNA, 21 nt, Human
gcagugagaaaaagcuccugu

SEQ ID NO: 2338661 - RNA, 23 nt, Human
gcagugagaaaaagcuccugucc

SEQ ID NO: 2338662 - RNA, 22 nt, Human
gcagugagaaaaagcuccuguc

SEQ ID NO: 2338663 - RNA, 20 nt, Human
gcacucagaagacacugaug

SEQ ID NO: 2338664 - RNA, 18 nt, Human
gcaagugagagcugggug

SEQ ID NO: 2338665 - RNA, 19 nt, Human
gcaagugagagcugggugu

SEQ ID NO: 2338666 - RNA, 20 nt, Human
gcagaaagcaaaauuauguu

SEQ ID NO: 2338667 - RNA, 23 nt, Human
gcagaaagcaaaugugaccugug

SEQ ID NO: 2338668 - RNA, 16 nt, Human
gcagaaaauugccuaa

SEQ ID NO: 2338669 - RNA, 14 nt, Human
gcagaaaauugcac

SEQ ID NO: 2338670 - RNA, 20 nt, Human
gcagaaaagcaccugccgac

SEQ ID NO: 2338671 - RNA, 22 nt, Human
gcagaaaaucuuuuacuagugu

SEQ ID NO: 2338672 - RNA, 21 nt, Human
gcagaaaagcaccugccgacc

SEQ ID NO: 2338673 - RNA, 13 nt, Human
gcagaacagugau

SEQ ID NO: 2338674 - RNA, 12 nt, Human
gcagaacaguga

SEQ ID NO: 2338675 - RNA, 12 nt, Human
gcacuccagccu

SEQ ID NO: 2338676 - RNA, 16 nt, Human
gcacuuuuuaauucac

SEQ ID NO: 2338677 - RNA, 20 nt, Human
gcacuuuuuaauucaccaaa

SEQ ID NO: 2338678 - RNA, 14 nt, Human
gcacuuuuucauuu

SEQ ID NO: 2338679 - RNA, 20 nt, Human
gcacuuuuucauuugccuau

SEQ ID NO: 2338680 - RNA, 22 nt, Human
gcacuuuguucuggcucuucca

SEQ ID NO: 2338681 - RNA, 18 nt, Human
gcagaaaagcaccugccg

SEQ ID NO: 2338682 - RNA, 17 nt, Human
gcagaaaagcaccugcc

SEQ ID NO: 2338683 - RNA, 16 nt, Human
gcagaaaagcaccugc

SEQ ID NO: 2338684 - RNA, 15 nt, Human
gcagaaaagcaccug

SEQ ID NO: 2338685 - RNA, 18 nt, Human
gcagaaaaaugucauuga

SEQ ID NO: 2338686 - RNA, 12 nt, Human
gcagaaaacauu

SEQ ID NO: 2338687 - RNA, 13 nt, Human
gcagaaaacauug

SEQ ID NO: 2338688 - RNA, 14 nt, Human
gcagaaaacauugu

SEQ ID NO: 2338689 - RNA, 15 nt, Human
gcagaaaacauuguu

SEQ ID NO: 2338690 - RNA, 14 nt, Human
gcacuccagccugg

SEQ ID NO: 2338691 - RNA, 13 nt, Human
gcacuccccugcu

SEQ ID NO: 2338692 - RNA, 14 nt, Human
gcacuccccugcug

SEQ ID NO: 2338693 - RNA, 12 nt, Human
gcacuccccugc

SEQ ID NO: 2338694 - RNA, 15 nt, Human
gcacuccccugcugg

SEQ ID NO: 2338695 - RNA, 18 nt, Human
gcacuuuguucuggcucu

SEQ ID NO: 2338696 - RNA, 19 nt, Human
gcacuuuguucuggcucuu

SEQ ID NO: 2338697 - RNA, 21 nt, Human
gcagaggcuggaggcagggcc

SEQ ID NO: 2338698 - RNA, 19 nt, Human
gcagaggcuggaggcaggg

SEQ ID NO: 2338699 - RNA, 11 nt, Human
gcagaggcugg

SEQ ID NO: 2338700 - RNA, 15 nt, Human
gcagaggccagaggc

SEQ ID NO: 2338701 - RNA, 19 nt, Human
gcagagggcagaggcugga

SEQ ID NO: 2338702 - RNA, 18 nt, Human
gcagagggcagaggcugg

SEQ ID NO: 2338703 - RNA, 16 nt, Human
gcagagggcagaggcu

SEQ ID NO: 2338704 - RNA, 22 nt, Human
gcagaggcuggaggcagggccu

SEQ ID NO: 2338705 - RNA, 14 nt, Human
gcagagggcacaga

SEQ ID NO: 2338706 - RNA, 21 nt, Human
gcagcagugagucucuucaga

SEQ ID NO: 2338707 - RNA, 17 nt, Human
gcagcagugagucucuu

SEQ ID NO: 2338708 - RNA, 18 nt, Human
gcagcagugaaaacaagu

SEQ ID NO: 2338709 - RNA, 21 nt, Human
gcagcagugaaaacaagugcu

SEQ ID NO: 2338710 - RNA, 20 nt, Human
gcagcagguggcagaauggg

SEQ ID NO: 2338711 - RNA, 14 nt, Human
gcagcagugaaaac

SEQ ID NO: 2338712 - RNA, 15 nt, Human
gcagcagugaaaaca

SEQ ID NO: 2338713 - RNA, 16 nt, Human
gcagcagugaaaacaa

SEQ ID NO: 2338714 - RNA, 11 nt, Human
gcagaggggca

SEQ ID NO: 2338715 - RNA, 14 nt, Human
gcagcauaugagga

SEQ ID NO: 2338716 - RNA, 15 nt, Human
gcagcauaaaggccu

SEQ ID NO: 2338717 - RNA, 12 nt, Human
gcagcauaaagg

SEQ ID NO: 2338718 - RNA, 23 nt, Human
gcagcagugugaggccagggcag

SEQ ID NO: 2338719 - RNA, 22 nt, Human
gcagcagugugaggccagggca

SEQ ID NO: 2338720 - RNA, 21 nt, Human
gcagcagugugaggccagggc

SEQ ID NO: 2338721 - RNA, 20 nt, Human
gcagcagugugaggccaggg

SEQ ID NO: 2338722 - RNA, 19 nt, Human
gcagcagugugaggccagg

SEQ ID NO: 2338723 - RNA, 15 nt, Human
gcagcagugugaggc

SEQ ID NO: 2338724 - RNA, 17 nt, Human
gcagcaugaccugugac

SEQ ID NO: 2338725 - RNA, 21 nt, Human
gcagcaucuucaaacauguac

SEQ ID NO: 2338726 - RNA, 20 nt, Human
gcagcauguugcugaggagu

SEQ ID NO: 2338727 - RNA, 21 nt, Human
gcagccaaacccaugaggcaa

SEQ ID NO: 2338728 - RNA, 19 nt, Human
gcagcaucuucacuucuaa

SEQ ID NO: 2338729 - RNA, 15 nt, Human
gcagcaucuucaaac

SEQ ID NO: 2338730 - RNA, 15 nt, Human
gcagcaucugcuaau

SEQ ID NO: 2338731 - RNA, 20 nt, Human
gcagccaagcuccuugggag

SEQ ID NO: 2338732 - RNA, 12 nt, Human
gcagccaaggcc

SEQ ID NO: 2338733 - RNA, 21 nt, Human
gcagccaaggccgaagcucug

SEQ ID NO: 2338734 - RNA, 22 nt, Human
gcagccaaggccgaagcucugg

SEQ ID NO: 2338735 - RNA, 17 nt, Human
gcagccaagcuccuugg

SEQ ID NO: 2338736 - RNA, 13 nt, Human
gcagccaagcucc

SEQ ID NO: 2338737 - RNA, 22 nt, Human
gcagcauguugcugaggaguga

SEQ ID NO: 2338738 - RNA, 23 nt, Human
gcagccaaggccgaagcucuggc

SEQ ID NO: 2338739 - RNA, 12 nt, Human
gcagccaaggga

SEQ ID NO: 2338740 - RNA, 17 nt, Human
gcagcauauucaggaag

SEQ ID NO: 2338741 - RNA, 18 nt, Human
gcagcauauucaggaagc

SEQ ID NO: 2338742 - RNA, 19 nt, Human
gcagcauauucaggaagcu

SEQ ID NO: 2338743 - RNA, 23 nt, Human
gcagcauauucaggaagcucagg

SEQ ID NO: 2338744 - RNA, 12 nt, Human
gcagaggcagcg

SEQ ID NO: 2338745 - RNA, 15 nt, Human
gcagaggaggggccg

SEQ ID NO: 2338746 - RNA, 12 nt, Human
gcagaggcacug

SEQ ID NO: 2338747 - RNA, 12 nt, Human
gcagaggccaga

SEQ ID NO: 2338748 - RNA, 21 nt, Human
gcagaggaggggccgcugcca

SEQ ID NO: 2338749 - RNA, 14 nt, Human
gcagaggaggggcc

SEQ ID NO: 2338750 - RNA, 12 nt, Human
gcagaggagggg

SEQ ID NO: 2338751 - RNA, 21 nt, Human
gcagaggaaagcaaaggagau

SEQ ID NO: 2338752 - RNA, 22 nt, Human
gcagagcuucuuccaggugccc

SEQ ID NO: 2338753 - RNA, 16 nt, Human
gcagagcuucuuccag

SEQ ID NO: 2338754 - RNA, 17 nt, Human
gcagagcuuggacugga

SEQ ID NO: 2338755 - RNA, 11 nt, Human
gcagaggacag

SEQ ID NO: 2338756 - RNA, 13 nt, Human
gcagaggaaagca

SEQ ID NO: 2338757 - RNA, 14 nt, Human
gcagaggaaagcaa

SEQ ID NO: 2338758 - RNA, 18 nt, Human
gcagaggaaagcaaagga

SEQ ID NO: 2338759 - RNA, 20 nt, Human
gcagaggaaagcaaaggaga

SEQ ID NO: 2338760 - RNA, 18 nt, Human
gcagaacugagcuccucu

SEQ ID NO: 2338761 - RNA, 19 nt, Human
gcagagcugcgggcugggu

SEQ ID NO: 2338762 - RNA, 17 nt, Human
gcagagcugcgggcugg

SEQ ID NO: 2338763 - RNA, 12 nt, Human
gcagagcuggcu

SEQ ID NO: 2338764 - RNA, 13 nt, Human
gcagagcuggcuc

SEQ ID NO: 2338765 - RNA, 14 nt, Human
gcagagcuggcucu

SEQ ID NO: 2338766 - RNA, 15 nt, Human
gcagagcuggcucug

SEQ ID NO: 2338767 - RNA, 17 nt, Human
gcagagcuggcucugag

SEQ ID NO: 2338768 - RNA, 23 nt, Human
gcagagcuggcucugagcgccuc

SEQ ID NO: 2338769 - RNA, 23 nt, Human
gcagaacagccgcuccugucugc

SEQ ID NO: 2338770 - RNA, 21 nt, Human
gcagaacguauugguccagcu

SEQ ID NO: 2338771 - RNA, 24 nt, Human
gcagaacggagccccaggccucug

SEQ ID NO: 2338772 - RNA, 13 nt, Human
gcagaacggagcc

SEQ ID NO: 2338773 - RNA, 16 nt, Human
gcagaacugagcuccu

SEQ ID NO: 2338774 - RNA, 14 nt, Human
gcagaacugagcuc

SEQ ID NO: 2338775 - RNA, 21 nt, Human
gcagaacuaaacucauuuaua

SEQ ID NO: 2338776 - RNA, 19 nt, Human
gcagaacuaaacucauuua

SEQ ID NO: 2338777 - RNA, 22 nt, Human
gcagaacagugauuaccaggga

SEQ ID NO: 2338778 - RNA, 18 nt, Human
gcagaacagugauuacca

SEQ ID NO: 2338779 - RNA, 14 nt, Human
gcagcucaucucug

SEQ ID NO: 2338780 - RNA, 14 nt, Human
gcagcucuccaguc

SEQ ID NO: 2338781 - RNA, 15 nt, Human
gcagcucuccaguca

SEQ ID NO: 2338782 - RNA, 21 nt, Human
gcagcucuccagucaggaggc

SEQ ID NO: 2338783 - RNA, 19 nt, Human
gcagcucaucucuguccca

SEQ ID NO: 2338784 - RNA, 21 nt, Human
gcagcucaucucugucccacu

SEQ ID NO: 2338785 - RNA, 18 nt, Human
gcagcccaccccucaaca

SEQ ID NO: 2338786 - RNA, 23 nt, Human
gcagccagcccagcccagcuggu

SEQ ID NO: 2338787 - RNA, 21 nt, Human
gcagccagcccagcccagcug

SEQ ID NO: 2338788 - RNA, 13 nt, Human
gcagccagcucuc

SEQ ID NO: 2338789 - RNA, 17 nt, Human
gcagccagcccagccca

SEQ ID NO: 2338790 - RNA, 16 nt, Human
gcagccagcccagccc

SEQ ID NO: 2338791 - RNA, 15 nt, Human
gcagccagcccagcc

SEQ ID NO: 2338792 - RNA, 13 nt, Human
gcagccagcccag

SEQ ID NO: 2338793 - RNA, 15 nt, Human
gcagccacauuccug

SEQ ID NO: 2338794 - RNA, 17 nt, Human
gcagccaggcugccaag

SEQ ID NO: 2338795 - RNA, 14 nt, Human
gcagccaggcugcc

SEQ ID NO: 2338796 - RNA, 13 nt, Human
gcagccaggcugc

SEQ ID NO: 2338797 - RNA, 12 nt, Human
gcagccaggcug

SEQ ID NO: 2338798 - RNA, 18 nt, Human
gcagccagcucucagcca

SEQ ID NO: 2338799 - RNA, 17 nt, Human
gcagccagcucucagcc

SEQ ID NO: 2338800 - RNA, 16 nt, Human
gcagccagcucucagc

SEQ ID NO: 2338801 - RNA, 15 nt, Human
gcagccagcucucag

SEQ ID NO: 2338802 - RNA, 20 nt, Human
gcagccaggccacuggcccc

SEQ ID NO: 2338803 - RNA, 11 nt, Human
gcccccugccc

SEQ ID NO: 2338804 - RNA, 12 nt, Human
gccccugcuggu

SEQ ID NO: 2338805 - RNA, 17 nt, Human
gcccccucugcccugcg

SEQ ID NO: 2338806 - RNA, 18 nt, Human
gcccccugaaacuuauuu

SEQ ID NO: 2338807 - RNA, 15 nt, Human
gccccugcugguuca

SEQ ID NO: 2338808 - RNA, 16 nt, Human
gccccugcugguucag

SEQ ID NO: 2338809 - RNA, 12 nt, Human
gccccuggcagc

SEQ ID NO: 2338810 - RNA, 15 nt, Human
gccccuggcagcccc

SEQ ID NO: 2338811 - RNA, 18 nt, Human
gcccccagcuguggguac

SEQ ID NO: 2338812 - RNA, 14 nt, Human
gcccccagcuggcc

SEQ ID NO: 2338813 - RNA, 15 nt, Human
gcccccagcuggccc

SEQ ID NO: 2338814 - RNA, 12 nt, Human
gcccccaggacu

SEQ ID NO: 2338815 - RNA, 23 nt, Human
gcccccagcuaagaaccuggaac

SEQ ID NO: 2338816 - RNA, 12 nt, Human
gcccccagcugg

SEQ ID NO: 2338817 - RNA, 13 nt, Human
gcccccagcuggc

SEQ ID NO: 2338818 - RNA, 22 nt, Human
gcccccagcuaagaaccuggaa

SEQ ID NO: 2338819 - RNA, 21 nt, Human
gcccccagcuaagaaccugga

SEQ ID NO: 2338820 - RNA, 16 nt, Human
gcccccucugcccugc

SEQ ID NO: 2338821 - RNA, 15 nt, Human
gcccccucugcccug

SEQ ID NO: 2338822 - RNA, 13 nt, Human
gcccccaggacug

SEQ ID NO: 2338823 - RNA, 14 nt, Human
gcccccaggacugg

SEQ ID NO: 2338824 - RNA, 15 nt, Human
gcccccaggacuggg

SEQ ID NO: 2338825 - RNA, 16 nt, Human
gcccccaggacugggc

SEQ ID NO: 2338826 - RNA, 15 nt, Human
gcccccagcuaagaa

SEQ ID NO: 2338827 - RNA, 20 nt, Human
gcccccagccccggggugag

SEQ ID NO: 2338828 - RNA, 21 nt, Human
gcccccagccccggggugagu

SEQ ID NO: 2338829 - RNA, 18 nt, Human
gcccccagagcgccccuc

SEQ ID NO: 2338830 - RNA, 17 nt, Human
gcccccagcccagggcu

SEQ ID NO: 2338831 - RNA, 18 nt, Human
gcccccagcccagggcuc

SEQ ID NO: 2338832 - RNA, 21 nt, Human
gcccccagcccagggcuccug

SEQ ID NO: 2338833 - RNA, 22 nt, Human
gcccccagcccagggcuccugc

SEQ ID NO: 2338834 - RNA, 12 nt, Human
gcccccagacgc

SEQ ID NO: 2338835 - RNA, 22 nt, Human
gccccacccagaugggggaaag

SEQ ID NO: 2338836 - RNA, 17 nt, Human
gcccccacuugccucuu

SEQ ID NO: 2338837 - RNA, 21 nt, Human
gcccccacuugccucuuccuu

SEQ ID NO: 2338838 - RNA, 15 nt, Human
gccccacccaggagg

SEQ ID NO: 2338839 - RNA, 12 nt, Human
gccccacccagg

SEQ ID NO: 2338840 - RNA, 14 nt, Human
gcccccacuugccu

SEQ ID NO: 2338841 - RNA, 16 nt, Human
gcccccacuugccucu

SEQ ID NO: 2338842 - RNA, 11 nt, Human
gccccacccag

SEQ ID NO: 2338843 - RNA, 12 nt, Human
gccccacccaga

SEQ ID NO: 2338844 - RNA, 13 nt, Human
gccccacccagau

SEQ ID NO: 2338845 - RNA, 23 nt, Human
gccccaccaccuaggccacuccu

SEQ ID NO: 2338846 - RNA, 20 nt, Human
gccccaccaccuaggccacu

SEQ ID NO: 2338847 - RNA, 18 nt, Human
gccccaccaccuaggcca

SEQ ID NO: 2338848 - RNA, 15 nt, Human
gccccaccaccuagg

SEQ ID NO: 2338849 - RNA, 14 nt, Human
gccccaccaccuag

SEQ ID NO: 2338850 - RNA, 13 nt, Human
gccccaccaccua

SEQ ID NO: 2338851 - RNA, 11 nt, Human
gccccaccacc

SEQ ID NO: 2338852 - RNA, 18 nt, Human
gccccacagcccacgucc

SEQ ID NO: 2338853 - RNA, 14 nt, Human
gccccacagcccac

SEQ ID NO: 2338854 - RNA, 17 nt, Human
gccccacagcccacguc

SEQ ID NO: 2338855 - RNA, 23 nt, Human
gccccacagcccacguccuguca

SEQ ID NO: 2338856 - RNA, 18 nt, Human
gccccaacuccuggaagc

SEQ ID NO: 2338857 - RNA, 13 nt, Human
gccccacagccca

SEQ ID NO: 2338858 - RNA, 17 nt, Human
gccccaacuccuggaag

SEQ ID NO: 2338859 - RNA, 16 nt, Human
gccccaacuccuggaa

SEQ ID NO: 2338860 - RNA, 15 nt, Human
gccccaacuccugga

SEQ ID NO: 2338861 - RNA, 14 nt, Human
gccccaacuccugg

SEQ ID NO: 2338862 - RNA, 14 nt, Human
gccccaaccugcug

SEQ ID NO: 2338863 - RNA, 15 nt, Human
gccccaaccugcuga

SEQ ID NO: 2338864 - RNA, 14 nt, Human
gccccaacccccag

SEQ ID NO: 2338865 - RNA, 16 nt, Human
gccccaacccccagca

SEQ ID NO: 2338866 - RNA, 17 nt, Human
gccccaacccccagcac

SEQ ID NO: 2338867 - RNA, 19 nt, Human
gccccaacccccagcaccc

SEQ ID NO: 2338868 - RNA, 13 nt, Human
gccccaaccugcu

SEQ ID NO: 2338869 - RNA, 20 nt, Human
gccccaaaacucuccucugc

SEQ ID NO: 2338870 - RNA, 20 nt, Human
gccccaaacgggcugcccug

SEQ ID NO: 2338871 - RNA, 14 nt, Human
gccccaaaggaaaa

SEQ ID NO: 2338872 - RNA, 20 nt, Human
gccccaaaggaaaaagcaca

SEQ ID NO: 2338873 - RNA, 18 nt, Human
gccccaaacaaauaugca

SEQ ID NO: 2338874 - RNA, 19 nt, Human
gccccaaacaaauaugcaa

SEQ ID NO: 2338875 - RNA, 17 nt, Human
gccccaaacaaauaugc

SEQ ID NO: 2338876 - RNA, 21 nt, Human
gccccaaaacucuccucugcu

SEQ ID NO: 2338877 - RNA, 11 nt, Human
gccccaaaagg

SEQ ID NO: 2338878 - RNA, 15 nt, Human
gcccaggauggcuuu

SEQ ID NO: 2338879 - RNA, 11 nt, Human
gcccaggcagg

SEQ ID NO: 2338880 - RNA, 15 nt, Human
gcccaggagagccag

SEQ ID NO: 2338881 - RNA, 13 nt, Human
gcccaggaccagc

SEQ ID NO: 2338882 - RNA, 14 nt, Human
gcccaggaccagcu

SEQ ID NO: 2338883 - RNA, 15 nt, Human
gcccaggaccagcug

SEQ ID NO: 2338884 - RNA, 16 nt, Human
gcccaggaccagcugg

SEQ ID NO: 2338885 - RNA, 17 nt, Human
gcccaggaccagcuggg

SEQ ID NO: 2338886 - RNA, 18 nt, Human
gcccaggaccagcugggg

SEQ ID NO: 2338887 - RNA, 19 nt, Human
gcccaggaccagcuggggc

SEQ ID NO: 2338888 - RNA, 18 nt, Human
gcccaggaccaucauccu

SEQ ID NO: 2338889 - RNA, 18 nt, Human
gcccaggacggggccggc

SEQ ID NO: 2338890 - RNA, 19 nt, Human
gcccaggacggggccggcc

SEQ ID NO: 2338891 - RNA, 20 nt, Human
gcccaggacggggccggcca

SEQ ID NO: 2338892 - RNA, 21 nt, Human
gcccaggacggggccggccag

SEQ ID NO: 2338893 - RNA, 18 nt, Human
gcccaggagagccagccc

SEQ ID NO: 2338894 - RNA, 22 nt, Human
gcccaggagagagaaagccagg

SEQ ID NO: 2338895 - RNA, 23 nt, Human
gcccaggagagagaaagccaggc

SEQ ID NO: 2338896 - RNA, 15 nt, Human
gcccaggagagagaa

SEQ ID NO: 2338897 - RNA, 16 nt, Human
gcccaggagagagaaa

SEQ ID NO: 2338898 - RNA, 17 nt, Human
gcccaggagagagaaag

SEQ ID NO: 2338899 - RNA, 20 nt, Human
gcccaggagagagaaagcca

SEQ ID NO: 2338900 - RNA, 11 nt, Human
gcccaggagac

SEQ ID NO: 2338901 - RNA, 10 nt, Human
gcccaggaga

SEQ ID NO: 2338902 - RNA, 23 nt, Human
gcccaggacggggccggccaggu

SEQ ID NO: 2338903 - RNA, 12 nt, Human
gcccaggagaga

SEQ ID NO: 2338904 - RNA, 13 nt, Human
gcccaggagagag

SEQ ID NO: 2338905 - RNA, 14 nt, Human
gcccaggagagaga

SEQ ID NO: 2338906 - RNA, 14 nt, Human
gcccaggcaggcca

SEQ ID NO: 2338907 - RNA, 13 nt, Human
gcccaggccaucu

SEQ ID NO: 2338908 - RNA, 18 nt, Human
gcccaggccaucuuccag

SEQ ID NO: 2338909 - RNA, 19 nt, Human
gcccaggccaucuuccagg

SEQ ID NO: 2338910 - RNA, 22 nt, Human
gcccaggccaucuuccaggugg

SEQ ID NO: 2338911 - RNA, 11 nt, Human
gcccaggcccc

SEQ ID NO: 2338912 - RNA, 12 nt, Human
gcccaggccccu

SEQ ID NO: 2338913 - RNA, 20 nt, Human
gcccaggccccugccacccu

SEQ ID NO: 2338914 - RNA, 21 nt, Human
gcccaggccccugccacccug

SEQ ID NO: 2338915 - RNA, 23 nt, Human
gcccaggccaucuuccagguggg

SEQ ID NO: 2338916 - RNA, 18 nt, Human
gcccaggccccugccacc

SEQ ID NO: 2338917 - RNA, 22 nt, Human
gcccaggccccugccacccugg

SEQ ID NO: 2338918 - RNA, 16 nt, Human
gcauuuaauguagcca

SEQ ID NO: 2338919 - RNA, 19 nt, Human
gcauuuaauguagccaugg

SEQ ID NO: 2338920 - RNA, 17 nt, Human
gcauuuacuuugaauuu

SEQ ID NO: 2338921 - RNA, 16 nt, Human
gccauuaccauggaga

SEQ ID NO: 2338922 - RNA, 13 nt, Human
gccauuaccaugg

SEQ ID NO: 2338923 - RNA, 18 nt, Human
gcauuuacuuuguguuca

SEQ ID NO: 2338924 - RNA, 12 nt, Human
gcauuuagaugu

SEQ ID NO: 2338925 - RNA, 19 nt, Human
gcauuuaggccaugggaca

SEQ ID NO: 2338926 - RNA, 13 nt, Human
gcauuuagaugua

SEQ ID NO: 2338927 - RNA, 18 nt, Human
gccauuaccauggagaca

SEQ ID NO: 2338928 - RNA, 22 nt, Human
gccauuaucccugaaucccccu

SEQ ID NO: 2338929 - RNA, 19 nt, Human
gccauugccaccaggagaa

SEQ ID NO: 2338930 - RNA, 18 nt, Human
gccauugccaccaggaga

SEQ ID NO: 2338931 - RNA, 17 nt, Human
gccauugccaccaggag

SEQ ID NO: 2338932 - RNA, 21 nt, Human
gccauugcacuccagccuggg

SEQ ID NO: 2338933 - RNA, 19 nt, Human
gccauugcacuccagccug

SEQ ID NO: 2338934 - RNA, 18 nt, Human
gccauugcacuccagccu

SEQ ID NO: 2338935 - RNA, 15 nt, Human
gccauugcacuccag

SEQ ID NO: 2338936 - RNA, 14 nt, Human
gccauugcacucca

SEQ ID NO: 2338937 - RNA, 17 nt, Human
gccauugacuucuuccc

SEQ ID NO: 2338938 - RNA, 15 nt, Human
gcccacgcccccacu

SEQ ID NO: 2338939 - RNA, 16 nt, Human
gcccacgcccccacug

SEQ ID NO: 2338940 - RNA, 17 nt, Human
gcccacgcccccacugg

SEQ ID NO: 2338941 - RNA, 21 nt, Human
gcccacgcccccacuggugac

SEQ ID NO: 2338942 - RNA, 23 nt, Human
gcccacgcuggagugcagugagc

SEQ ID NO: 2338943 - RNA, 20 nt, Human
gccauuggcuauuuaaaacu

SEQ ID NO: 2338944 - RNA, 21 nt, Human
gccauugucuucggaaaccuu

SEQ ID NO: 2338945 - RNA, 22 nt, Human
gccauugucuucggaaaccuug

SEQ ID NO: 2338946 - RNA, 19 nt, Human
gcccacgcuggagugcagu

SEQ ID NO: 2338947 - RNA, 21 nt, Human
gcccacgcuggagugcaguga

SEQ ID NO: 2338948 - RNA, 15 nt, Human
gcccacuguacuugc

SEQ ID NO: 2338949 - RNA, 20 nt, Human
gcccacuguacuugcucuug

SEQ ID NO: 2338950 - RNA, 22 nt, Human
gcccacuguacuugcucuugau

SEQ ID NO: 2338951 - RNA, 23 nt, Human
gcccacugcccacccccucaagc

SEQ ID NO: 2338952 - RNA, 20 nt, Human
gcccacugcccacccccuca

SEQ ID NO: 2338953 - RNA, 15 nt, Human
gcccacuguccuggg

SEQ ID NO: 2338954 - RNA, 13 nt, Human
gcccacuguccug

SEQ ID NO: 2338955 - RNA, 14 nt, Human
gcccacuguccugg

SEQ ID NO: 2338956 - RNA, 13 nt, Human
gcccacuucugcc

SEQ ID NO: 2338957 - RNA, 13 nt, Human
gcccacuucaggg

SEQ ID NO: 2338958 - RNA, 23 nt, Human
gcccacuucaggguucuccucuc

SEQ ID NO: 2338959 - RNA, 24 nt, Human
gcccacuguccugggccugcagaa

SEQ ID NO: 2338960 - RNA, 16 nt, Human
gcccacuguccugggc

SEQ ID NO: 2338961 - RNA, 17 nt, Human
gcccacuguccugggcg

SEQ ID NO: 2338962 - RNA, 23 nt, Human
gcccacuguccugggcgcccugg

SEQ ID NO: 2338963 - RNA, 19 nt, Human
gcccacuguccugggcgcc

SEQ ID NO: 2338964 - RNA, 21 nt, Human
gcccacuguccugggcgcccu

SEQ ID NO: 2338965 - RNA, 23 nt, Human
gcccacuguccugggccugcaga

SEQ ID NO: 2338966 - RNA, 21 nt, Human
gcccacuguccugggccugca

SEQ ID NO: 2338967 - RNA, 18 nt, Human
gcccacuguccugggccu

SEQ ID NO: 2338968 - RNA, 17 nt, Human
gcccacuguccugggcc

SEQ ID NO: 2338969 - RNA, 24 nt, Human
gcccaggaaaggcuccaggagcag

SEQ ID NO: 2338970 - RNA, 22 nt, Human
gcccaggaaaggcuccaggagc

SEQ ID NO: 2338971 - RNA, 23 nt, Human
gcccaggaaaggcuccaggagca

SEQ ID NO: 2338972 - RNA, 19 nt, Human
gccucaugcuaagacucag

SEQ ID NO: 2338973 - RNA, 13 nt, Human
gccucauguggcu

SEQ ID NO: 2338974 - RNA, 14 nt, Human
gccucauguggcug

SEQ ID NO: 2338975 - RNA, 22 nt, Human
gccucauguccacugguucuuc

SEQ ID NO: 2338976 - RNA, 18 nt, Human
gccuccaccgcugccuaa

SEQ ID NO: 2338977 - RNA, 12 nt, Human
gccuccacuccc

SEQ ID NO: 2338978 - RNA, 12 nt, Human
gccuccaccgcu

SEQ ID NO: 2338979 - RNA, 22 nt, Human
gccuccacccucugagcuuugc

SEQ ID NO: 2338980 - RNA, 16 nt, Human
gccuccacccucugag

SEQ ID NO: 2338981 - RNA, 17 nt, Human
gccuccacccucugagc

SEQ ID NO: 2338982 - RNA, 18 nt, Human
gccuccacccucugagcu

SEQ ID NO: 2338983 - RNA, 19 nt, Human
gccuccacccucugagcuu

SEQ ID NO: 2338984 - RNA, 18 nt, Human
gccuccaccccccagaac

SEQ ID NO: 2338985 - RNA, 12 nt, Human
gccuccacccuc

SEQ ID NO: 2338986 - RNA, 14 nt, Human
gccuccacccucug

SEQ ID NO: 2338987 - RNA, 15 nt, Human
gccuccacccucuga

SEQ ID NO: 2338988 - RNA, 18 nt, Human
gccuccaccaccacuggc

SEQ ID NO: 2338989 - RNA, 20 nt, Human
gccuccaccaccacuggcca

SEQ ID NO: 2338990 - RNA, 21 nt, Human
gccuccaccaccacuggccac

SEQ ID NO: 2338991 - RNA, 23 nt, Human
gccuccaccaccacuggccacca

SEQ ID NO: 2338992 - RNA, 22 nt, Human
gccucaucuauaacaugcauuu

SEQ ID NO: 2338993 - RNA, 17 nt, Human
gccucauguggcuggaa

SEQ ID NO: 2338994 - RNA, 15 nt, Human
gccucauguggcugg

SEQ ID NO: 2338995 - RNA, 16 nt, Human
gccucauguggcugga

SEQ ID NO: 2338996 - RNA, 12 nt, Human
gccuccaccacc

SEQ ID NO: 2338997 - RNA, 14 nt, Human
gccuccaccaccac

SEQ ID NO: 2338998 - RNA, 15 nt, Human
gccuccaccaccacu

SEQ ID NO: 2338999 - RNA, 16 nt, Human
gccuccaccaccacug

SEQ ID NO: 2339000 - RNA, 15 nt, Human
gccuccauccugagg

SEQ ID NO: 2339001 - RNA, 14 nt, Human
gccuccauccugag

SEQ ID NO: 2339002 - RNA, 13 nt, Human
gccuccauccuga

SEQ ID NO: 2339003 - RNA, 12 nt, Human
gccuccagaacu

SEQ ID NO: 2339004 - RNA, 21 nt, Human
gccuccacucccacuucccug

SEQ ID NO: 2339005 - RNA, 22 nt, Human
gccuccacucccacuucccuga

SEQ ID NO: 2339006 - RNA, 14 nt, Human
gccuccacucccac

SEQ ID NO: 2339007 - RNA, 15 nt, Human
gccuccacucccacu

SEQ ID NO: 2339008 - RNA, 16 nt, Human
gccuccacucccacuu

SEQ ID NO: 2339009 - RNA, 18 nt, Human
gccuccacucccacuucc

SEQ ID NO: 2339010 - RNA, 16 nt, Human
gccuccucuguccagg

SEQ ID NO: 2339011 - RNA, 13 nt, Human
gccuccucugucc

SEQ ID NO: 2339012 - RNA, 21 nt, Human
gccuccucugucugcccuuca

SEQ ID NO: 2339013 - RNA, 17 nt, Human
gccuccucuggacggca

SEQ ID NO: 2339014 - RNA, 23 nt, Human
gccuccucucucaguuuuuauau

SEQ ID NO: 2339015 - RNA, 17 nt, Human
gccuccagaacucacug

SEQ ID NO: 2339016 - RNA, 19 nt, Human
gccuccugaguagcuggga

SEQ ID NO: 2339017 - RNA, 20 nt, Human
gccuccucuggacggcaggc

SEQ ID NO: 2339018 - RNA, 17 nt, Human
gccuccucugucugccc

SEQ ID NO: 2339019 - RNA, 19 nt, Human
gccuccucugucugcccuu

SEQ ID NO: 2339020 - RNA, 16 nt, Human
gccuccugaccugagg

SEQ ID NO: 2339021 - RNA, 17 nt, Human
gccuccugaccugaggc

SEQ ID NO: 2339022 - RNA, 21 nt, Human
gccuccugaccugaggcuccu

SEQ ID NO: 2339023 - RNA, 23 nt, Human
gccuccugaguagcugggacuac

SEQ ID NO: 2339024 - RNA, 12 nt, Human
gccuccugccca

SEQ ID NO: 2339025 - RNA, 14 nt, Human
gccucugggacugg

SEQ ID NO: 2339026 - RNA, 16 nt, Human
gccucgaaacacagaa

SEQ ID NO: 2339027 - RNA, 15 nt, Human
gccuccugcccaguc

SEQ ID NO: 2339028 - RNA, 17 nt, Human
gccuccugcccaguccc

SEQ ID NO: 2339029 - RNA, 16 nt, Human
gccucgaacuggcugc

SEQ ID NO: 2339030 - RNA, 13 nt, Human
gccucgaacuggc

SEQ ID NO: 2339031 - RNA, 22 nt, Human
gccuccuuugugaggaagccgc

SEQ ID NO: 2339032 - RNA, 19 nt, Human
gccuagcauacguacacau

SEQ ID NO: 2339033 - RNA, 12 nt, Human
gccuagcauacg

SEQ ID NO: 2339034 - RNA, 23 nt, Human
gccuagauccacacacagaggaa

SEQ ID NO: 2339035 - RNA, 20 nt, Human
gccuagauccacacacagag

SEQ ID NO: 2339036 - RNA, 17 nt, Human
gccuagauccacacaca

SEQ ID NO: 2339037 - RNA, 22 nt, Human
gccuaaucccugggcauugcuu

SEQ ID NO: 2339038 - RNA, 22 nt, Human
gccuacagcuuugaucccugac

SEQ ID NO: 2339039 - RNA, 23 nt, Human
gccuacagcuuugaucccugaca

SEQ ID NO: 2339040 - RNA, 17 nt, Human
gccuacaggagugagca

SEQ ID NO: 2339041 - RNA, 17 nt, Human
gccgcgucgcccuccca

SEQ ID NO: 2339042 - RNA, 17 nt, Human
gcccuucccugucccuc

SEQ ID NO: 2339043 - RNA, 13 nt, Human
gcccuuccucucc

SEQ ID NO: 2339044 - RNA, 22 nt, Human
gcccuuccucuccacccuccca

SEQ ID NO: 2339045 - RNA, 23 nt, Human
gcccuuccucuccacccucccag

SEQ ID NO: 2339046 - RNA, 14 nt, Human
gcccuuccucucca

SEQ ID NO: 2339047 - RNA, 15 nt, Human
gcccuuccucuccac

SEQ ID NO: 2339048 - RNA, 18 nt, Human
gccgcuagaggccugagg

SEQ ID NO: 2339049 - RNA, 19 nt, Human
gccgcuagaggccugagga

SEQ ID NO: 2339050 - RNA, 18 nt, Human
gccgcuagaugggcaugg

SEQ ID NO: 2339051 - RNA, 23 nt, Human
gccgcuagaugggcauggggugg

SEQ ID NO: 2339052 - RNA, 13 nt, Human
gccgcuagaggcc

SEQ ID NO: 2339053 - RNA, 15 nt, Human
gccgcuagaggccug

SEQ ID NO: 2339054 - RNA, 16 nt, Human
gccgcuagaggccuga

SEQ ID NO: 2339055 - RNA, 17 nt, Human
gccgcuagaggccugag

SEQ ID NO: 2339056 - RNA, 22 nt, Human
gcccuuccaugucgccucugca

SEQ ID NO: 2339057 - RNA, 12 nt, Human
gcccuucccacu

SEQ ID NO: 2339058 - RNA, 16 nt, Human
gcccuucccacuggag

SEQ ID NO: 2339059 - RNA, 12 nt, Human
gcccuucccugu

SEQ ID NO: 2339060 - RNA, 13 nt, Human
gcccuucccuguc

SEQ ID NO: 2339061 - RNA, 12 nt, Human
gcccuuccucuc

SEQ ID NO: 2339062 - RNA, 15 nt, Human
gcccuucccuguccc

SEQ ID NO: 2339063 - RNA, 16 nt, Human
gcccuucccugucccu

SEQ ID NO: 2339064 - RNA, 18 nt, Human
gcccuucccugucccucu

SEQ ID NO: 2339065 - RNA, 16 nt, Human
gcccuucacaguguuu

SEQ ID NO: 2339066 - RNA, 15 nt, Human
gcccuucaccccagu

SEQ ID NO: 2339067 - RNA, 21 nt, Human
gcccuucaccccaguggccac

SEQ ID NO: 2339068 - RNA, 19 nt, Human
gcccuucacugccuuugcu

SEQ ID NO: 2339069 - RNA, 20 nt, Human
gcccuucacugccuuugcuc

SEQ ID NO: 2339070 - RNA, 12 nt, Human
gcccuuccaugu

SEQ ID NO: 2339071 - RNA, 21 nt, Human
gcccuuccaugucgccucugc

SEQ ID NO: 2339072 - RNA, 23 nt, Human
gccuaaucccugggcauugcuuu

SEQ ID NO: 2339073 - RNA, 16 nt, Human
gccuaaucccugggca

SEQ ID NO: 2339074 - RNA, 14 nt, Human
gccuaaucccuggg

SEQ ID NO: 2339075 - RNA, 16 nt, Human
gccuacaggagugagc

SEQ ID NO: 2339076 - RNA, 22 nt, Human
gccggcacccacaagugccacu

SEQ ID NO: 2339077 - RNA, 21 nt, Human
gccggcacagggucugcucuu

SEQ ID NO: 2339078 - RNA, 13 nt, Human
gccggcacagggu

SEQ ID NO: 2339079 - RNA, 19 nt, Human
gccggcaaccccaguucug

SEQ ID NO: 2339080 - RNA, 20 nt, Human
gccggcaaccccaguucugc

SEQ ID NO: 2339081 - RNA, 21 nt, Human
gccggcaaccccaguucugcu

SEQ ID NO: 2339082 - RNA, 23 nt, Human
gccggcaaccccaguucugcucc

SEQ ID NO: 2339083 - RNA, 19 nt, Human
gccgcuccugucugccagc

SEQ ID NO: 2339084 - RNA, 15 nt, Human
gccgcuccugucugc

SEQ ID NO: 2339085 - RNA, 12 nt, Human
gccgcuccaggg

SEQ ID NO: 2339086 - RNA, 21 nt, Human
gccgcuccugucugccagcca

SEQ ID NO: 2339087 - RNA, 20 nt, Human
gccgcuccugucugccagcc

SEQ ID NO: 2339088 - RNA, 22 nt, Human
gccgcuccugucugccagccag

SEQ ID NO: 2339089 - RNA, 15 nt, Human
gccgcuccaggggug

SEQ ID NO: 2339090 - RNA, 21 nt, Human
gccggaguccacucccagugc

SEQ ID NO: 2339091 - RNA, 15 nt, Human
gccggaugugcuuuu

SEQ ID NO: 2339092 - RNA, 16 nt, Human
gccggaugugcuuuuc

SEQ ID NO: 2339093 - RNA, 21 nt, Human
gccggcaaaacuuuggcacug

SEQ ID NO: 2339094 - RNA, 11 nt, Human
gccggcaaccc

SEQ ID NO: 2339095 - RNA, 18 nt, Human
gccggcaaccccaguucu

SEQ ID NO: 2339096 - RNA, 16 nt, Human
gccggaguccacuccc

SEQ ID NO: 2339097 - RNA, 19 nt, Human
gccggaguccacucccagu

SEQ ID NO: 2339098 - RNA, 15 nt, Human
gccggagucagugcc

SEQ ID NO: 2339099 - RNA, 16 nt, Human
gccggagucagugcca

SEQ ID NO: 2339100 - RNA, 23 nt, Human
gcccuguggaagggacuaggagc

SEQ ID NO: 2339101 - RNA, 17 nt, Human
gcccuguggaagggacu

SEQ ID NO: 2339102 - RNA, 21 nt, Human
gcccuguggaugagcccucag

SEQ ID NO: 2339103 - RNA, 16 nt, Human
gcccuguggaagggac

SEQ ID NO: 2339104 - RNA, 22 nt, Human
gcccugcuccucccuggcugcc

SEQ ID NO: 2339105 - RNA, 23 nt, Human
gcccugcuccucccuggcugccc

SEQ ID NO: 2339106 - RNA, 17 nt, Human
gcccugcuccucccugg

SEQ ID NO: 2339107 - RNA, 18 nt, Human
gcccugcuccucccuggc

SEQ ID NO: 2339108 - RNA, 19 nt, Human
gcccugcuccucccuggcu

SEQ ID NO: 2339109 - RNA, 21 nt, Human
gcccugcuccucccuggcugc

SEQ ID NO: 2339110 - RNA, 20 nt, Human
gcccugcgggucacaggagg

SEQ ID NO: 2339111 - RNA, 15 nt, Human
gcccugcggccccgu

SEQ ID NO: 2339112 - RNA, 18 nt, Human
gcccugcgguagauggga

SEQ ID NO: 2339113 - RNA, 14 nt, Human
gcccugcuccuccc

SEQ ID NO: 2339114 - RNA, 15 nt, Human
gcccugcuccucccu

SEQ ID NO: 2339115 - RNA, 16 nt, Human
gcccugcuccucccug

SEQ ID NO: 2339116 - RNA, 14 nt, Human
gcccugcccaccug

SEQ ID NO: 2339117 - RNA, 15 nt, Human
gcccugcccaccugg

SEQ ID NO: 2339118 - RNA, 18 nt, Human
gcccugccaucuucccag

SEQ ID NO: 2339119 - RNA, 19 nt, Human
gcccugccaucuucccagc

SEQ ID NO: 2339120 - RNA, 19 nt, Human
gcccugccugagggccccu

SEQ ID NO: 2339121 - RNA, 20 nt, Human
gcccugccugagggccccuc

SEQ ID NO: 2339122 - RNA, 22 nt, Human
gcccugccugagggccccucug

SEQ ID NO: 2339123 - RNA, 23 nt, Human
gcccugccugagggccccucugc

SEQ ID NO: 2339124 - RNA, 21 nt, Human
gcccugugggcccccaaaugg

SEQ ID NO: 2339125 - RNA, 22 nt, Human
gcccuguggaugagcccucaga

SEQ ID NO: 2339126 - RNA, 14 nt, Human
gcccuuaccuuccc

SEQ ID NO: 2339127 - RNA, 23 nt, Human
gcccuuaccugccaggaagccag

SEQ ID NO: 2339128 - RNA, 20 nt, Human
gcccuuaucugugcucagga

SEQ ID NO: 2339129 - RNA, 19 nt, Human
gcccuuaucugugcucagg

SEQ ID NO: 2339130 - RNA, 20 nt, Human
gcccuuauuuucaagaaacu

SEQ ID NO: 2339131 - RNA, 18 nt, Human
gcccuuauuuucaagaaa

SEQ ID NO: 2339132 - RNA, 17 nt, Human
gcccuuauuuucaagaa

SEQ ID NO: 2339133 - RNA, 13 nt, Human
gcccuuaccuucc

SEQ ID NO: 2339134 - RNA, 16 nt, Human
gcccugugggccccca

SEQ ID NO: 2339135 - RNA, 17 nt, Human
gcccugugggcccccaa

SEQ ID NO: 2339136 - RNA, 21 nt, Human
gcccuuaccugccaggaagcc

SEQ ID NO: 2339137 - RNA, 22 nt, Human
gcccuuaccugccaggaagcca

SEQ ID NO: 2339138 - RNA, 16 nt, Human
gcccgucuucagccua

SEQ ID NO: 2339139 - RNA, 15 nt, Human
gcccgucuucagccu

SEQ ID NO: 2339140 - RNA, 14 nt, Human
gcccgucuucagcc

SEQ ID NO: 2339141 - RNA, 15 nt, Human
gcccgucucucuccc

SEQ ID NO: 2339142 - RNA, 16 nt, Human
gcccgucucucuccca

SEQ ID NO: 2339143 - RNA, 14 nt, Human
gcccgucucagugu

SEQ ID NO: 2339144 - RNA, 14 nt, Human
gcccguccugccug

SEQ ID NO: 2339145 - RNA, 13 nt, Human
gcccgucucucuc

SEQ ID NO: 2339146 - RNA, 19 nt, Human
gcccgucucucucccaugg

SEQ ID NO: 2339147 - RNA, 18 nt, Human
gcccgucuucagccuagc

SEQ ID NO: 2339148 - RNA, 17 nt, Human
gcccgucuucagccuag

SEQ ID NO: 2339149 - RNA, 19 nt, Human
gcccgugacagacuccuga

SEQ ID NO: 2339150 - RNA, 17 nt, Human
gcccgucucucucccau

SEQ ID NO: 2339151 - RNA, 13 nt, Human
gcccgugacagac

SEQ ID NO: 2339152 - RNA, 13 nt, Human
gcccccugccccc

SEQ ID NO: 2339153 - RNA, 15 nt, Human
gcccguccugccugu

SEQ ID NO: 2339154 - RNA, 16 nt, Human
gcccguccugccugug

SEQ ID NO: 2339155 - RNA, 17 nt, Human
gcccguccugccugugg

SEQ ID NO: 2339156 - RNA, 18 nt, Human
gcccguccugccuguggc

SEQ ID NO: 2339157 - RNA, 13 nt, Human
gcccgucucagug

SEQ ID NO: 2339158 - RNA, 16 nt, Human
gccccuggcagccccu

SEQ ID NO: 2339159 - RNA, 17 nt, Human
gccccuggcagccccug

SEQ ID NO: 2339160 - RNA, 11 nt, Human
gcccugccacu

SEQ ID NO: 2339161 - RNA, 12 nt, Human
gcccugccacuc

SEQ ID NO: 2339162 - RNA, 13 nt, Human
gcccugccacuca

SEQ ID NO: 2339163 - RNA, 19 nt, Human
gcccugccacucacuaggc

SEQ ID NO: 2339164 - RNA, 20 nt, Human
gcccugccacucacuaggcc

SEQ ID NO: 2339165 - RNA, 21 nt, Human
gcccugccacucacuaggccc

SEQ ID NO: 2339166 - RNA, 18 nt, Human
gcgggagcgguggcccug

SEQ ID NO: 2339167 - RNA, 21 nt, Human
gcgggagcgguggcccugucc

SEQ ID NO: 2339168 - RNA, 13 nt, Human
gcguggacucugc

SEQ ID NO: 2339169 - RNA, 14 nt, Human
gcguggacucugca

SEQ ID NO: 2339170 - RNA, 21 nt, Human
gcgugcucaguucagaaucac

SEQ ID NO: 2339171 - RNA, 18 nt, Human
gcgugcuccagccuggcu

SEQ ID NO: 2339172 - RNA, 19 nt, Human
gcgugcuccagccuggcuc

SEQ ID NO: 2339173 - RNA, 14 nt, Human
gcguggacaggugu

SEQ ID NO: 2339174 - RNA, 19 nt, Human
gcgggaauggcagcugcca

SEQ ID NO: 2339175 - RNA, 14 nt, Human
gcgggacccaggca

SEQ ID NO: 2339176 - RNA, 20 nt, Human
gcgggaccgguacagaaagg

SEQ ID NO: 2339177 - RNA, 19 nt, Human
gcgggaccgguacagaaag

SEQ ID NO: 2339178 - RNA, 14 nt, Human
gcgggaccuguggc

SEQ ID NO: 2339179 - RNA, 15 nt, Human
gcgggaccuguggcu

SEQ ID NO: 2339180 - RNA, 23 nt, Human
gcgggacgagacccuacaggaga

SEQ ID NO: 2339181 - RNA, 21 nt, Human
gcgggacgucccugcccaugu

SEQ ID NO: 2339182 - RNA, 21 nt, Human
gcgggagccaugcgcccccuc

SEQ ID NO: 2339183 - RNA, 14 nt, Human
gcgggaaggagggu

SEQ ID NO: 2339184 - RNA, 13 nt, Human
gcgggaaggaggg

SEQ ID NO: 2339185 - RNA, 14 nt, Human
gcgggaaaagcagc

SEQ ID NO: 2339186 - RNA, 23 nt, Human
gcgggaaaagcagcccuuggcca

SEQ ID NO: 2339187 - RNA, 17 nt, Human
gcgggaaagccagugac

SEQ ID NO: 2339188 - RNA, 22 nt, Human
gcggcugugcagccuguccugg

SEQ ID NO: 2339189 - RNA, 15 nt, Human
gcggcuggcagccca

SEQ ID NO: 2339190 - RNA, 16 nt, Human
gcggcuggacuuggag

SEQ ID NO: 2339191 - RNA, 16 nt, Human
gcuaaggcguggagcu

SEQ ID NO: 2339192 - RNA, 17 nt, Human
gcuaaggcguggagcug

SEQ ID NO: 2339193 - RNA, 18 nt, Human
gcuaaggcguggagcugc

SEQ ID NO: 2339194 - RNA, 22 nt, Human
gcguuagaaugaggaggaagga

SEQ ID NO: 2339195 - RNA, 16 nt, Human
gcguuacuaauuggcc

SEQ ID NO: 2339196 - RNA, 18 nt, Human
gcguuagaaugaggagga

SEQ ID NO: 2339197 - RNA, 22 nt, Human
gcguuauuggucggcagccuuc

SEQ ID NO: 2339198 - RNA, 17 nt, Human
gcguuccaugaugcugg

SEQ ID NO: 2339199 - RNA, 18 nt, Human
gcguuccaugaugcuggg

SEQ ID NO: 2339200 - RNA, 19 nt, Human
gcguggagggcguggaggg

SEQ ID NO: 2339201 - RNA, 16 nt, Human
gcguggagcugccuga

SEQ ID NO: 2339202 - RNA, 18 nt, Human
gcguggagggcguggagg

SEQ ID NO: 2339203 - RNA, 22 nt, Human
gcguuaaaggcucgauuuugua

SEQ ID NO: 2339204 - RNA, 14 nt, Human
gcguguuugcacgu

SEQ ID NO: 2339205 - RNA, 15 nt, Human
gcguguuugcacguu

SEQ ID NO: 2339206 - RNA, 17 nt, Human
gcguggacucugcacau

SEQ ID NO: 2339207 - RNA, 18 nt, Human
gcguggacucugcacaug

SEQ ID NO: 2339208 - RNA, 12 nt, Human
gcguggagcugc

SEQ ID NO: 2339209 - RNA, 15 nt, Human
gcguggagcugccug

SEQ ID NO: 2339210 - RNA, 18 nt, Human
gcggcggagcuggccccg

SEQ ID NO: 2339211 - RNA, 20 nt, Human
gcggcggagcuggccccgcc

SEQ ID NO: 2339212 - RNA, 16 nt, Human
gcggcggagcuggccc

SEQ ID NO: 2339213 - RNA, 20 nt, Human
gcggccagccccggcccugg

SEQ ID NO: 2339214 - RNA, 16 nt, Human
gcggccuuuggcuuca

SEQ ID NO: 2339215 - RNA, 11 nt, Human
gcggccagccc

SEQ ID NO: 2339216 - RNA, 13 nt, Human
gcggccagccccg

SEQ ID NO: 2339217 - RNA, 17 nt, Human
gcggccagccccggccc

SEQ ID NO: 2339218 - RNA, 18 nt, Human
gcggccagccccggcccu

SEQ ID NO: 2339219 - RNA, 19 nt, Human
gcggccagccccggcccug

SEQ ID NO: 2339220 - RNA, 21 nt, Human
gcggccagccccggcccuggg

SEQ ID NO: 2339221 - RNA, 16 nt, Human
gcggcauuaaagccau

SEQ ID NO: 2339222 - RNA, 19 nt, Human
gcggcaggggccuggagau

SEQ ID NO: 2339223 - RNA, 15 nt, Human
gcggcaggggccugg

SEQ ID NO: 2339224 - RNA, 16 nt, Human
gcggcaggggccugga

SEQ ID NO: 2339225 - RNA, 20 nt, Human
gcggcuacucagcagcccuc

SEQ ID NO: 2339226 - RNA, 19 nt, Human
gcggcuacucagcagcccu

SEQ ID NO: 2339227 - RNA, 13 nt, Human
gcggcuacucagc

SEQ ID NO: 2339228 - RNA, 22 nt, Human
gcggcuacucagcagcccuccu

SEQ ID NO: 2339229 - RNA, 21 nt, Human
gcggcuacucagcagcccucc

SEQ ID NO: 2339230 - RNA, 23 nt, Human
gcggcugagucaugaucucccug

SEQ ID NO: 2339231 - RNA, 17 nt, Human
gcggcugcugugugccu

SEQ ID NO: 2339232 - RNA, 22 nt, Human
gcggcugagucaugaucucccu

SEQ ID NO: 2339233 - RNA, 23 nt, Human
gcggcugagagccccagcugaca

SEQ ID NO: 2339234 - RNA, 15 nt, Human
gcggcuggacuugga

SEQ ID NO: 2339235 - RNA, 12 nt, Human
gcggcugagagc

SEQ ID NO: 2339236 - RNA, 16 nt, Human
gcggcugagagcccca

SEQ ID NO: 2339237 - RNA, 18 nt, Human
gcggcugagagccccagc

SEQ ID NO: 2339238 - RNA, 21 nt, Human
gcggcugagagccccagcuga

SEQ ID NO: 2339239 - RNA, 22 nt, Human
gcggcugagagccccagcugac

SEQ ID NO: 2339240 - RNA, 12 nt, Human
gcggcagagagg

SEQ ID NO: 2339241 - RNA, 14 nt, Human
gcggcagcagccau

SEQ ID NO: 2339242 - RNA, 12 nt, Human
gcggcacagccu

SEQ ID NO: 2339243 - RNA, 17 nt, Human
gcggcagcagccaucau

SEQ ID NO: 2339244 - RNA, 13 nt, Human
gcggauggccgga

SEQ ID NO: 2339245 - RNA, 16 nt, Human
gcgcaggcuggcccug

SEQ ID NO: 2339246 - RNA, 15 nt, Human
gcgcaggcuggcccu

SEQ ID NO: 2339247 - RNA, 22 nt, Human
gcgcaagccuguaaucccagcu

SEQ ID NO: 2339248 - RNA, 21 nt, Human
gcgcaagccuguaaucccagc

SEQ ID NO: 2339249 - RNA, 14 nt, Human
gcgcaggcuggccc

SEQ ID NO: 2339250 - RNA, 21 nt, Human
gcgcagcauauucaggaagcu

SEQ ID NO: 2339251 - RNA, 23 nt, Human
gcgcaagccuguaaucccagcua

SEQ ID NO: 2339252 - RNA, 13 nt, Human
gcgcaagccugua

SEQ ID NO: 2339253 - RNA, 12 nt, Human
gcgcaagccugu

SEQ ID NO: 2339254 - RNA, 23 nt, Human
gcgauucuucugcuucagccucc

SEQ ID NO: 2339255 - RNA, 15 nt, Human
gccuugaagccacug

SEQ ID NO: 2339256 - RNA, 22 nt, Human
gccuucuuugcuugccucucug

SEQ ID NO: 2339257 - RNA, 17 nt, Human
gccuugaauauccccuc

SEQ ID NO: 2339258 - RNA, 14 nt, Human
gccuugaagccacu

SEQ ID NO: 2339259 - RNA, 19 nt, Human
gccuugaaccacuucccuc

SEQ ID NO: 2339260 - RNA, 23 nt, Human
gccuugaacuuugaccucugcag

SEQ ID NO: 2339261 - RNA, 16 nt, Human
gccuugaccauucucc

SEQ ID NO: 2339262 - RNA, 21 nt, Human
gccuugaccauucuccaccug

SEQ ID NO: 2339263 - RNA, 22 nt, Human
gccuugaccauucuccaccugc

SEQ ID NO: 2339264 - RNA, 22 nt, Human
gcgauucuucugcuucagccuc

SEQ ID NO: 2339265 - RNA, 12 nt, Human
gccuugccagag

SEQ ID NO: 2339266 - RNA, 21 nt, Human
gccuugcagcacucacacagg

SEQ ID NO: 2339267 - RNA, 23 nt, Human
gccuugcagcacucacacaggac

SEQ ID NO: 2339268 - RNA, 17 nt, Human
gcgauucuucugcuuca

SEQ ID NO: 2339269 - RNA, 21 nt, Human
gccuugaauauccccucccag

SEQ ID NO: 2339270 - RNA, 22 nt, Human
gccuugaauauccccucccagu

SEQ ID NO: 2339271 - RNA, 23 nt, Human
gccuugaccauucuccaccugcc

SEQ ID NO: 2339272 - RNA, 23 nt, Human
gccuucuuauucucacuccacca

SEQ ID NO: 2339273 - RNA, 15 nt, Human
gccuucuucacccag

SEQ ID NO: 2339274 - RNA, 21 nt, Human
gccuucuuauucucacuccac

SEQ ID NO: 2339275 - RNA, 20 nt, Human
gccuucuuauucucacucca

SEQ ID NO: 2339276 - RNA, 17 nt, Human
gccuucuucacccagcu

SEQ ID NO: 2339277 - RNA, 14 nt, Human
gccuucuuccaucc

SEQ ID NO: 2339278 - RNA, 17 nt, Human
gccuucuuccaucccag

SEQ ID NO: 2339279 - RNA, 19 nt, Human
gccuucuuauucucacucc

SEQ ID NO: 2339280 - RNA, 18 nt, Human
gccuucuguccugguguc

SEQ ID NO: 2339281 - RNA, 18 nt, Human
gccuucuuauucucacuc

SEQ ID NO: 2339282 - RNA, 21 nt, Human
gccuucuggauucuuggcccg

SEQ ID NO: 2339283 - RNA, 16 nt, Human
gccuucuguccuggug

SEQ ID NO: 2339284 - RNA, 14 nt, Human
gccuucucuguuca

SEQ ID NO: 2339285 - RNA, 17 nt, Human
gccuucucccccccggg

SEQ ID NO: 2339286 - RNA, 23 nt, Human
gccuucucccccccggggcuggg

SEQ ID NO: 2339287 - RNA, 13 nt, Human
gccuucuccuccc

SEQ ID NO: 2339288 - RNA, 14 nt, Human
gccuucuccucccc

SEQ ID NO: 2339289 - RNA, 16 nt, Human
gccuucucuguucauu

SEQ ID NO: 2339290 - RNA, 19 nt, Human
gccuucugaggacauucca

SEQ ID NO: 2339291 - RNA, 19 nt, Human
gccuucuggauucuuggcc

SEQ ID NO: 2339292 - RNA, 23 nt, Human
gccuucuucggggaacuccugga

SEQ ID NO: 2339293 - RNA, 22 nt, Human
gccuucuucggggaacuccugg

SEQ ID NO: 2339294 - RNA, 20 nt, Human
gccuucuuccaucccaggac

SEQ ID NO: 2339295 - RNA, 22 nt, Human
gccuucuuccaucccaggacac

SEQ ID NO: 2339296 - RNA, 11 nt, Human
gccuucuucuu

SEQ ID NO: 2339297 - RNA, 17 nt, Human
gccuucuucuuuuugcu

SEQ ID NO: 2339298 - RNA, 18 nt, Human
gccuucuucuuuuugcug

SEQ ID NO: 2339299 - RNA, 20 nt, Human
gccuucuucuuuuugcuguu

SEQ ID NO: 2339300 - RNA, 21 nt, Human
gccuucuucuuuuugcuguug

SEQ ID NO: 2339301 - RNA, 15 nt, Human
gccuucuuugcuugc

SEQ ID NO: 2339302 - RNA, 15 nt, Human
gccuucuuuugauua

SEQ ID NO: 2339303 - RNA, 14 nt, Human
gccuugaacuuuga

SEQ ID NO: 2339304 - RNA, 18 nt, Human
gccuugaaccacuucccu

SEQ ID NO: 2339305 - RNA, 22 nt, Human
gccuucuuuugauuauguuuuu

SEQ ID NO: 2339306 - RNA, 18 nt, Human
gccuucuuugcuugccuc

SEQ ID NO: 2339307 - RNA, 19 nt, Human
gccuucuuugcuugccucu

SEQ ID NO: 2339308 - RNA, 15 nt, Human
gccuucucugaagga

SEQ ID NO: 2339309 - RNA, 16 nt, Human
gccuucucugaaggac

SEQ ID NO: 2339310 - RNA, 17 nt, Human
gccuguggccugugucc

SEQ ID NO: 2339311 - RNA, 19 nt, Human
gccuucgucuuucccaugg

SEQ ID NO: 2339312 - RNA, 15 nt, Human
gccuucuaaaggugu

SEQ ID NO: 2339313 - RNA, 17 nt, Human
gccuucucaugauccaa

SEQ ID NO: 2339314 - RNA, 15 nt, Human
gccuguucagcucca

SEQ ID NO: 2339315 - RNA, 14 nt, Human
gccuguucagcucc

SEQ ID NO: 2339316 - RNA, 14 nt, Human
gccuguggccugug

SEQ ID NO: 2339317 - RNA, 16 nt, Human
gccuguggccuguguc

SEQ ID NO: 2339318 - RNA, 16 nt, Human
gccuguucagcuccag

SEQ ID NO: 2339319 - RNA, 17 nt, Human
gccuguucagcuccagc

SEQ ID NO: 2339320 - RNA, 23 nt, Human
gccugugcugcccgucuucagcc

SEQ ID NO: 2339321 - RNA, 16 nt, Human
gccugugcugcccguc

SEQ ID NO: 2339322 - RNA, 24 nt, Human
gccuguggaaucuggagugagggg

SEQ ID NO: 2339323 - RNA, 22 nt, Human
gccuguggcaucuuugccuugg

SEQ ID NO: 2339324 - RNA, 19 nt, Human
gccuguggaaucuggagug

SEQ ID NO: 2339325 - RNA, 19 nt, Human
gccugugccucugggacug

SEQ ID NO: 2339326 - RNA, 15 nt, Human
gccugugcugcccgu

SEQ ID NO: 2339327 - RNA, 14 nt, Human
gccugugcugcccg

SEQ ID NO: 2339328 - RNA, 12 nt, Human
gccugggcaaga

SEQ ID NO: 2339329 - RNA, 20 nt, Human
gccugggcaacacagcgaga

SEQ ID NO: 2339330 - RNA, 20 nt, Human
gccugggcaacagagcaaga

SEQ ID NO: 2339331 - RNA, 19 nt, Human
gccugggcaacagagcaag

SEQ ID NO: 2339332 - RNA, 16 nt, Human
gccugggcaacagagc

SEQ ID NO: 2339333 - RNA, 11 nt, Human
gccugggcaga

SEQ ID NO: 2339334 - RNA, 13 nt, Human
gccuggcuucugg

SEQ ID NO: 2339335 - RNA, 13 nt, Human
gccuggcuucucc

SEQ ID NO: 2339336 - RNA, 16 nt, Human
gccuggcuucuccuuu

SEQ ID NO: 2339337 - RNA, 23 nt, Human
gccugggaucccucauccucaua

SEQ ID NO: 2339338 - RNA, 20 nt, Human
gccuccugcccaguccccca

SEQ ID NO: 2339339 - RNA, 12 nt, Human
gccucuggguca

SEQ ID NO: 2339340 - RNA, 22 nt, Human
gccucugggucagugguccaca

SEQ ID NO: 2339341 - RNA, 13 nt, Human
gccucugggucag

SEQ ID NO: 2339342 - RNA, 17 nt, Human
gccucuggucugggugc

SEQ ID NO: 2339343 - RNA, 20 nt, Human
gccucugucacugcaggcac

SEQ ID NO: 2339344 - RNA, 23 nt, Human
gccucugguuuggggcgaggcag

SEQ ID NO: 2339345 - RNA, 15 nt, Human
gccucuguccccuuc

SEQ ID NO: 2339346 - RNA, 18 nt, Human
gccucuguccccuucucu

SEQ ID NO: 2339347 - RNA, 19 nt, Human
gccucuguccccuucucuc

SEQ ID NO: 2339348 - RNA, 20 nt, Human
gccucuguccccuucucuca

SEQ ID NO: 2339349 - RNA, 21 nt, Human
gccucuguccccuucucucau

SEQ ID NO: 2339350 - RNA, 22 nt, Human
gccucuguccccuucucucauc

SEQ ID NO: 2339351 - RNA, 16 nt, Human
gccuggcuccguccag

SEQ ID NO: 2339352 - RNA, 10 nt, Human
gccuggcucu

SEQ ID NO: 2339353 - RNA, 19 nt, Human
gccuggcucuugugcugga

SEQ ID NO: 2339354 - RNA, 21 nt, Human
gccuggcucuugugcuggaug

SEQ ID NO: 2339355 - RNA, 23 nt, Human
gccuggcuccaaacccucgaggc

SEQ ID NO: 2339356 - RNA, 19 nt, Human
gccuggcucccacaggcag

SEQ ID NO: 2339357 - RNA, 20 nt, Human
gccuggcucccacaggcagc

SEQ ID NO: 2339358 - RNA, 23 nt, Human
gccuggcucccacaggcagcuuu

SEQ ID NO: 2339359 - RNA, 21 nt, Human
gccuggcucccacaggcagcu

SEQ ID NO: 2339360 - RNA, 22 nt, Human
gccuggcucccacaggcagcuu

SEQ ID NO: 2339361 - RNA, 18 nt, Human
gcucaggggcguguggcu

SEQ ID NO: 2339362 - RNA, 20 nt, Human
gcucagggccuggcucaggu

SEQ ID NO: 2339363 - RNA, 17 nt, Human
gcucaggaggcuuggaa

SEQ ID NO: 2339364 - RNA, 16 nt, Human
gcucaggaggcuugga

SEQ ID NO: 2339365 - RNA, 13 nt, Human
gcucaggaguuug

SEQ ID NO: 2339366 - RNA, 18 nt, Human
gcucagggccuggcucag

SEQ ID NO: 2339367 - RNA, 19 nt, Human
gcucagggccuggcucagg

SEQ ID NO: 2339368 - RNA, 15 nt, Human
gcucaggaggcuugg

SEQ ID NO: 2339369 - RNA, 13 nt, Human
gcucaggaggcuu

SEQ ID NO: 2339370 - RNA, 18 nt, Human
gcucagagaugugcaccc

SEQ ID NO: 2339371 - RNA, 23 nt, Human
gcucaggagcccugggaggcucu

SEQ ID NO: 2339372 - RNA, 22 nt, Human
gcucaggagcccugggaggcuc

SEQ ID NO: 2339373 - RNA, 22 nt, Human
gcucacugccaggccagccucc

SEQ ID NO: 2339374 - RNA, 17 nt, Human
gcucacuguggugucug

SEQ ID NO: 2339375 - RNA, 21 nt, Human
gcucacugcuaagaauauuug

SEQ ID NO: 2339376 - RNA, 19 nt, Human
gcucacuguggugucugug

SEQ ID NO: 2339377 - RNA, 18 nt, Human
gcucacuguggugucugu

SEQ ID NO: 2339378 - RNA, 23 nt, Human
gcucacuucugggcuucaucugg

SEQ ID NO: 2339379 - RNA, 15 nt, Human
gcucacuucugggcu

SEQ ID NO: 2339380 - RNA, 23 nt, Human
gcucaaaucuauucagacaagca

SEQ ID NO: 2339381 - RNA, 12 nt, Human
gcucaaccuaac

SEQ ID NO: 2339382 - RNA, 21 nt, Human
gcucaagaagacauggagacu

SEQ ID NO: 2339383 - RNA, 15 nt, Human
gcucaagcagcgacc

SEQ ID NO: 2339384 - RNA, 21 nt, Human
gcucaagcagcgaccgccccc

SEQ ID NO: 2339385 - RNA, 22 nt, Human
gcucaagcagcgaccgcccccu

SEQ ID NO: 2339386 - RNA, 23 nt, Human
gcucaagcagcgaccgcccccuc

SEQ ID NO: 2339387 - RNA, 19 nt, Human
gcucaagcaggaaguucaa

SEQ ID NO: 2339388 - RNA, 23 nt, Human
gcucacugccaggccagccuccg

SEQ ID NO: 2339389 - RNA, 21 nt, Human
gcucagaaggcucuucugacu

SEQ ID NO: 2339390 - RNA, 18 nt, Human
gcucagaaguuucuucuu

SEQ ID NO: 2339391 - RNA, 15 nt, Human
gcucagaauccaagu

SEQ ID NO: 2339392 - RNA, 18 nt, Human
gcucagaauccaagugaa

SEQ ID NO: 2339393 - RNA, 22 nt, Human
gcucagaauccaagugaacacu

SEQ ID NO: 2339394 - RNA, 16 nt, Human
gcucagagcaguguuu

SEQ ID NO: 2339395 - RNA, 21 nt, Human
gcucagaggcgcacugugacc

SEQ ID NO: 2339396 - RNA, 20 nt, Human
gcucagaggcgcacugugac

SEQ ID NO: 2339397 - RNA, 19 nt, Human
gcucagaggcgcacuguga

SEQ ID NO: 2339398 - RNA, 18 nt, Human
gcucagaggcgcacugug

SEQ ID NO: 2339399 - RNA, 18 nt, Human
gcuaagugauccucccac

SEQ ID NO: 2339400 - RNA, 22 nt, Human
gcuaagugauccucccaccuca

SEQ ID NO: 2339401 - RNA, 22 nt, Human
gcuaaggcguggagcugccuga

SEQ ID NO: 2339402 - RNA, 20 nt, Human
gcuaaggcguggagcugccu

SEQ ID NO: 2339403 - RNA, 21 nt, Human
gcuaaggcguggagcugccug

SEQ ID NO: 2339404 - RNA, 13 nt, Human
gcuaagugaaaag

SEQ ID NO: 2339405 - RNA, 17 nt, Human
gcuaaguauuucccagc

SEQ ID NO: 2339406 - RNA, 18 nt, Human
gcuaagugaaaaggucau

SEQ ID NO: 2339407 - RNA, 19 nt, Human
gcuauguuuugacauuuuu

SEQ ID NO: 2339408 - RNA, 14 nt, Human
gcuaguugggcuuc

SEQ ID NO: 2339409 - RNA, 16 nt, Human
gcuaguugggcuuccu

SEQ ID NO: 2339410 - RNA, 14 nt, Human
gcuaggguggcccu

SEQ ID NO: 2339411 - RNA, 18 nt, Human
gcuagggaaacuucccgu

SEQ ID NO: 2339412 - RNA, 14 nt, Human
gcuaggggagcagg

SEQ ID NO: 2339413 - RNA, 14 nt, Human
gcuaggugggccag

SEQ ID NO: 2339414 - RNA, 15 nt, Human
gcuaggguggcccuu

SEQ ID NO: 2339415 - RNA, 19 nt, Human
gcuaggugggccagccccu

SEQ ID NO: 2339416 - RNA, 18 nt, Human
gcuaggugggccagcccc

SEQ ID NO: 2339417 - RNA, 17 nt, Human
gcuaggugggccagccc

SEQ ID NO: 2339418 - RNA, 21 nt, Human
gcuaggugggccagccccucc

SEQ ID NO: 2339419 - RNA, 20 nt, Human
gcuaggugggccagccccuc

SEQ ID NO: 2339420 - RNA, 21 nt, Human
gcucaaaggcacagugaaggc

SEQ ID NO: 2339421 - RNA, 14 nt, Human
gcucaaaucuauuc

SEQ ID NO: 2339422 - RNA, 17 nt, Human
gcucaaaucuauucaga

SEQ ID NO: 2339423 - RNA, 18 nt, Human
gcucaaaucuauucagac

SEQ ID NO: 2339424 - RNA, 20 nt, Human
gcucaaaucuauucagacaa

SEQ ID NO: 2339425 - RNA, 22 nt, Human
gcucaaaucuauucagacaagc

SEQ ID NO: 2339426 - RNA, 16 nt, Human
gcucaaaggcacagug

SEQ ID NO: 2339427 - RNA, 14 nt, Human
gcucaaaggcacag

SEQ ID NO: 2339428 - RNA, 12 nt, Human
gcucaaaggcac

SEQ ID NO: 2339429 - RNA, 21 nt, Human
gcuauuagccaggaucauggu

SEQ ID NO: 2339430 - RNA, 18 nt, Human
gcuauuuccauuccagaa

SEQ ID NO: 2339431 - RNA, 18 nt, Human
gcuauucaguaauaacuc

SEQ ID NO: 2339432 - RNA, 21 nt, Human
gcuauuauuuucacuguagaa

SEQ ID NO: 2339433 - RNA, 18 nt, Human
gcuauuauuuucacugua

SEQ ID NO: 2339434 - RNA, 17 nt, Human
gcuauuauuuucacugu

SEQ ID NO: 2339435 - RNA, 18 nt, Human
gcuauuagccaggaucau

SEQ ID NO: 2339436 - RNA, 19 nt, Human
gcuauuagccaggaucaug

SEQ ID NO: 2339437 - RNA, 23 nt, Human
gcuauuacuaaggaguaaucugu

SEQ ID NO: 2339438 - RNA, 15 nt, Human
gcuauuacugucugg

SEQ ID NO: 2339439 - RNA, 13 nt, Human
gcuauuagccagg

SEQ ID NO: 2339440 - RNA, 17 nt, Human
gcuauuagccaggauca

SEQ ID NO: 2339441 - RNA, 22 nt, Human
gcuaggaccccuccaugugggc

SEQ ID NO: 2339442 - RNA, 17 nt, Human
gcuagggaaacuucccg

SEQ ID NO: 2339443 - RNA, 21 nt, Human
gcuaggcgagugccaggacuc

SEQ ID NO: 2339444 - RNA, 20 nt, Human
gcuaggaccccuccaugugg

SEQ ID NO: 2339445 - RNA, 18 nt, Human
gcuaggaaugaaauccug

SEQ ID NO: 2339446 - RNA, 13 nt, Human
gcuaggaaugaaa

SEQ ID NO: 2339447 - RNA, 12 nt, Human
gcuaggaaugaa

SEQ ID NO: 2339448 - RNA, 21 nt, Human
gcuaggaauuguguuuauaau

SEQ ID NO: 2339449 - RNA, 15 nt, Human
gcuuuugcuggucac

SEQ ID NO: 2339450 - RNA, 18 nt, Human
gcuuuucuguauuuuauu

SEQ ID NO: 2339451 - RNA, 18 nt, Human
gcuuuucugucucugccu

SEQ ID NO: 2339452 - RNA, 19 nt, Human
gcuuuugcuggucacugcc

SEQ ID NO: 2339453 - RNA, 21 nt, Human
gcuuuugcuggucacugccau

SEQ ID NO: 2339454 - RNA, 22 nt, Human
gcuuuugcuggucacugccaug

SEQ ID NO: 2339455 - RNA, 17 nt, Human
gcuuuucugcccuggcu

SEQ ID NO: 2339456 - RNA, 18 nt, Human
gcuuuucugcccuggcug

SEQ ID NO: 2339457 - RNA, 19 nt, Human
gcuuuucugcccuggcugc

SEQ ID NO: 2339458 - RNA, 22 nt, Human
gcuuuucugcccuggcugcugc

SEQ ID NO: 2339459 - RNA, 14 nt, Human
gcuuuucuguauuu

SEQ ID NO: 2339460 - RNA, 17 nt, Human
gcuuuucuuucuaccaa

SEQ ID NO: 2339461 - RNA, 13 nt, Human
gcuuuugaaaucu

SEQ ID NO: 2339462 - RNA, 19 nt, Human
gcuuuucccuaagccaagg

SEQ ID NO: 2339463 - RNA, 18 nt, Human
gcuuuuccccggucccuu

SEQ ID NO: 2339464 - RNA, 16 nt, Human
gcuuuucccaaaagcc

SEQ ID NO: 2339465 - RNA, 20 nt, Human
gcuuuucccuuuuuuuaagu

SEQ ID NO: 2339466 - RNA, 22 nt, Human
gcuuuuccccggucccuugaga

SEQ ID NO: 2339467 - RNA, 22 nt, Human
gcuuuuccuauuuguuuucaug

SEQ ID NO: 2339468 - RNA, 15 nt, Human
gcuuuuccucccuug

SEQ ID NO: 2339469 - RNA, 22 nt, Human
gcuuuuccucaaagggagagag

SEQ ID NO: 2339470 - RNA, 21 nt, Human
gcuuuucccuuuuuuuaagua

SEQ ID NO: 2339471 - RNA, 11 nt, Human
gcuuuuggcaa

SEQ ID NO: 2339472 - RNA, 15 nt, Human
gcuuuuuaauauuga

SEQ ID NO: 2339473 - RNA, 19 nt, Human
gcuuuugugcauuaucuag

SEQ ID NO: 2339474 - RNA, 13 nt, Human
gcuuuugugcauu

SEQ ID NO: 2339475 - RNA, 15 nt, Human
gcuuuuuuuuucucu

SEQ ID NO: 2339476 - RNA, 24 nt, Human
gcuuuuuuuuucucuuucucuccu

SEQ ID NO: 2339477 - RNA, 16 nt, Human
ggaaaaaauaacaaug

SEQ ID NO: 2339478 - RNA, 13 nt, Human
ggaaacagaggcu

SEQ ID NO: 2339479 - RNA, 19 nt, Human
ggaaaaaaaucguccaggg

SEQ ID NO: 2339480 - RNA, 14 nt, Human
ggaaaaaaaugacu

SEQ ID NO: 2339481 - RNA, 20 nt, Human
ggaaacagcuaaugggacac

SEQ ID NO: 2339482 - RNA, 15 nt, Human
ggaaacaggaccaca

SEQ ID NO: 2339483 - RNA, 15 nt, Human
ggaaaaaagagaagu

SEQ ID NO: 2339484 - RNA, 15 nt, Human
ggaaaccacagcugc

SEQ ID NO: 2339485 - RNA, 16 nt, Human
ggaaaccacagcugcu

SEQ ID NO: 2339486 - RNA, 15 nt, Human
ggaaacccagcucug

SEQ ID NO: 2339487 - RNA, 17 nt, Human
ggaaacuggaugagguc

SEQ ID NO: 2339488 - RNA, 17 nt, Human
ggaaacucuuaucucag

SEQ ID NO: 2339489 - RNA, 18 nt, Human
ggaaacuggguuccugca

SEQ ID NO: 2339490 - RNA, 13 nt, Human
ggaaacugccagc

SEQ ID NO: 2339491 - RNA, 21 nt, Human
ggaaacucaccugcuggcccc

SEQ ID NO: 2339492 - RNA, 18 nt, Human
ggaaacuccacaucugcc

SEQ ID NO: 2339493 - RNA, 22 nt, Human
ggaaacucaccugcuggccccu

SEQ ID NO: 2339494 - RNA, 20 nt, Human
ggaaacuccacaucugccuu

SEQ ID NO: 2339495 - RNA, 21 nt, Human
ggaaacuccacaucugccuua

SEQ ID NO: 2339496 - RNA, 21 nt, Human
ggaaacuaggugcauauuuau

SEQ ID NO: 2339497 - RNA, 18 nt, Human
ggaaaccacagcugcugg

SEQ ID NO: 2339498 - RNA, 19 nt, Human
ggaaaccacagcugcugga

SEQ ID NO: 2339499 - RNA, 21 nt, Human
ggaaaccacagcugcuggaga

SEQ ID NO: 2339500 - RNA, 21 nt, Human
ggaaaggaguagaaaaagcag

SEQ ID NO: 2339501 - RNA, 12 nt, Human
ggaaaggaauug

SEQ ID NO: 2339502 - RNA, 15 nt, Human
ggaaaggagaggaaa

SEQ ID NO: 2339503 - RNA, 16 nt, Human
ggaaaggauauuuucu

SEQ ID NO: 2339504 - RNA, 18 nt, Human
ggaaaggcaaaugcccaa

SEQ ID NO: 2339505 - RNA, 20 nt, Human
ggaaaggcaaaugcccaagg

SEQ ID NO: 2339506 - RNA, 18 nt, Human
ggaaaggccagcuggcag

SEQ ID NO: 2339507 - RNA, 15 nt, Human
ggaaaggccagcugg

SEQ ID NO: 2339508 - RNA, 16 nt, Human
ggaaagccucugcugc

SEQ ID NO: 2339509 - RNA, 14 nt, Human
ggaaagccucugcu

SEQ ID NO: 2339510 - RNA, 23 nt, Human
ggaaagcucagcuacugauuuuu

SEQ ID NO: 2339511 - RNA, 18 nt, Human
ggaaagcuccuagcagag

SEQ ID NO: 2339512 - RNA, 24 nt, Human
ggaaaggaagugggacuggcacua

SEQ ID NO: 2339513 - RNA, 13 nt, Human
ggaaagccucugc

SEQ ID NO: 2339514 - RNA, 21 nt, Human
ggaaagccagugacuccagga

SEQ ID NO: 2339515 - RNA, 18 nt, Human
ggaaagccagugacucca

SEQ ID NO: 2339516 - RNA, 19 nt, Human
ggaaagccagugacuccag

SEQ ID NO: 2339517 - RNA, 19 nt, Human
ggaaagcaucaccucaggc

SEQ ID NO: 2339518 - RNA, 18 nt, Human
ggaaagcaucaccucagg

SEQ ID NO: 2339519 - RNA, 18 nt, Human
ggaaagccaccucucccu

SEQ ID NO: 2339520 - RNA, 21 nt, Human
ggaaagcagguggcaucucua

SEQ ID NO: 2339521 - RNA, 20 nt, Human
ggaaagccaccucucccuca

SEQ ID NO: 2339522 - RNA, 23 nt, Human
ggaaagccaccucucccucaaca

SEQ ID NO: 2339523 - RNA, 19 nt, Human
ggaaagcagcucaaaggca

SEQ ID NO: 2339524 - RNA, 15 nt, Human
ggaaagcagcucaaa

SEQ ID NO: 2339525 - RNA, 16 nt, Human
ggaaagcacagguggg

SEQ ID NO: 2339526 - RNA, 17 nt, Human
ggaaagcacaggugggc

SEQ ID NO: 2339527 - RNA, 22 nt, Human
ggaaagcagcucaaaggcacag

SEQ ID NO: 2339528 - RNA, 19 nt, Human
ggaaagcagguggcaucuc

SEQ ID NO: 2339529 - RNA, 11 nt, Human
ggaaagcaggu

SEQ ID NO: 2339530 - RNA, 14 nt, Human
ggaaagcagcucaa

SEQ ID NO: 2339531 - RNA, 18 nt, Human
ggaaagaagagccggagc

SEQ ID NO: 2339532 - RNA, 15 nt, Human
ggaaagaagagccgg

SEQ ID NO: 2339533 - RNA, 22 nt, Human
ggaaagacauccauaaagaagc

SEQ ID NO: 2339534 - RNA, 16 nt, Human
ggaaagaaagaaggaa

SEQ ID NO: 2339535 - RNA, 15 nt, Human
ggaaagaaaguugca

SEQ ID NO: 2339536 - RNA, 17 nt, Human
ggaaacuguugccagag

SEQ ID NO: 2339537 - RNA, 12 nt, Human
ggaaacugaaug

SEQ ID NO: 2339538 - RNA, 18 nt, Human
ggaaacuguugccagaga

SEQ ID NO: 2339539 - RNA, 20 nt, Human
ggaaagacuuuuccaacccu

SEQ ID NO: 2339540 - RNA, 14 nt, Human
ggaaagaggcucug

SEQ ID NO: 2339541 - RNA, 15 nt, Human
ggaaagcaauaaaug

SEQ ID NO: 2339542 - RNA, 19 nt, Human
ggaaagcaaaggagauugg

SEQ ID NO: 2339543 - RNA, 16 nt, Human
ggaaagaguaggaaga

SEQ ID NO: 2339544 - RNA, 17 nt, Human
ggaaagaguaggaagac

SEQ ID NO: 2339545 - RNA, 21 nt, Human
gcuuugcuuaugguaauaaaa

SEQ ID NO: 2339546 - RNA, 18 nt, Human
gcuuugcuuucugcucag

SEQ ID NO: 2339547 - RNA, 19 nt, Human
gcuuugcuuucugcucagc

SEQ ID NO: 2339548 - RNA, 24 nt, Human
gcuuugccuuccacgcugucucca

SEQ ID NO: 2339549 - RNA, 18 nt, Human
gcuuugccuuccacgcug

SEQ ID NO: 2339550 - RNA, 13 nt, Human
gcuuugccuucca

SEQ ID NO: 2339551 - RNA, 22 nt, Human
gcuuugccuuccacgcugucuc

SEQ ID NO: 2339552 - RNA, 12 nt, Human
gcuuugcucugc

SEQ ID NO: 2339553 - RNA, 16 nt, Human
gcuuugcuaccaaagc

SEQ ID NO: 2339554 - RNA, 19 nt, Human
gcuuugcugcugaaggcuc

SEQ ID NO: 2339555 - RNA, 18 nt, Human
gcuuugcugcugaaggcu

SEQ ID NO: 2339556 - RNA, 12 nt, Human
gcuuugcugcug

SEQ ID NO: 2339557 - RNA, 16 nt, Human
gcuuugcugcuacagg

SEQ ID NO: 2339558 - RNA, 13 nt, Human
gcuuugcucugcc

SEQ ID NO: 2339559 - RNA, 12 nt, Human
gcuuugcugcua

SEQ ID NO: 2339560 - RNA, 15 nt, Human
gcuuugcugcuacag

SEQ ID NO: 2339561 - RNA, 12 nt, Human
gcuuugcccagc

SEQ ID NO: 2339562 - RNA, 22 nt, Human
gcuuugcccaacaccagccccu

SEQ ID NO: 2339563 - RNA, 23 nt, Human
gcuuugcccaacaccagccccug

SEQ ID NO: 2339564 - RNA, 20 nt, Human
gcuuugcccaacaccagccc

SEQ ID NO: 2339565 - RNA, 19 nt, Human
gcuuugccagcugcugcug

SEQ ID NO: 2339566 - RNA, 21 nt, Human
gcuuugcauuuuaaaaaugaa

SEQ ID NO: 2339567 - RNA, 14 nt, Human
gcuuugccagcugc

SEQ ID NO: 2339568 - RNA, 15 nt, Human
gcuuugccagcugcu

SEQ ID NO: 2339569 - RNA, 18 nt, Human
gcuuugccagcugcugcu

SEQ ID NO: 2339570 - RNA, 21 nt, Human
gcuuugauuaauccagaauaa

SEQ ID NO: 2339571 - RNA, 20 nt, Human
gcuuugauucauaguaacuu

SEQ ID NO: 2339572 - RNA, 15 nt, Human
gcuuugauucauagu

SEQ ID NO: 2339573 - RNA, 22 nt, Human
gcuuugcauuccuacaaagaug

SEQ ID NO: 2339574 - RNA, 20 nt, Human
gcuuugcauuccuacaaaga

SEQ ID NO: 2339575 - RNA, 20 nt, Human
gcuuugcauguuccacuaac

SEQ ID NO: 2339576 - RNA, 23 nt, Human
gcuuugcauguuccacuaacccc

SEQ ID NO: 2339577 - RNA, 12 nt, Human
gcuuugcaguga

SEQ ID NO: 2339578 - RNA, 17 nt, Human
gcuuugcauguuccacu

SEQ ID NO: 2339579 - RNA, 18 nt, Human
gcuuugcauguuccacua

SEQ ID NO: 2339580 - RNA, 23 nt, Human
gcuuucuacccagcgagcccugg

SEQ ID NO: 2339581 - RNA, 12 nt, Human
gcuuugauucau

SEQ ID NO: 2339582 - RNA, 18 nt, Human
gcuuugauuaauccagaa

SEQ ID NO: 2339583 - RNA, 23 nt, Human
gcuuuccuuuuuuaaaaaugcaa

SEQ ID NO: 2339584 - RNA, 19 nt, Human
gcuuucgucuccagccccu

SEQ ID NO: 2339585 - RNA, 17 nt, Human
gcuuuccuuuuuuaaaa

SEQ ID NO: 2339586 - RNA, 13 nt, Human
gcuuucuacccag

SEQ ID NO: 2339587 - RNA, 16 nt, Human
gcuuucgaacugcuag

SEQ ID NO: 2339588 - RNA, 19 nt, Human
gcuuucuacccagcgagcc

SEQ ID NO: 2339589 - RNA, 22 nt, Human
gcuuucuacccagcgagcccug

SEQ ID NO: 2339590 - RNA, 23 nt, Human
gcuugggcuuccauuugugugug

SEQ ID NO: 2339591 - RNA, 11 nt, Human
gcuuuccugaa

SEQ ID NO: 2339592 - RNA, 22 nt, Human
gcuuggggaccagagcugccac

SEQ ID NO: 2339593 - RNA, 19 nt, Human
gcuuuccugccccaggccu

SEQ ID NO: 2339594 - RNA, 14 nt, Human
gcuuuccugcccca

SEQ ID NO: 2339595 - RNA, 17 nt, Human
gcuuuccugccccaggc

SEQ ID NO: 2339596 - RNA, 22 nt, Human
gcuuuccugaauccaaacuaau

SEQ ID NO: 2339597 - RNA, 12 nt, Human
gcuuuccugaau

SEQ ID NO: 2339598 - RNA, 11 nt, Human
gcuuuccugcc

SEQ ID NO: 2339599 - RNA, 12 nt, Human
gcuuuccugccc

SEQ ID NO: 2339600 - RNA, 17 nt, Human
gcuuggggaccagagcu

SEQ ID NO: 2339601 - RNA, 18 nt, Human
gcuuggggaccagagcug

SEQ ID NO: 2339602 - RNA, 20 nt, Human
gcuuggggaccagagcugcc

SEQ ID NO: 2339603 - RNA, 21 nt, Human
gcuuggggaccagagcugcca

SEQ ID NO: 2339604 - RNA, 16 nt, Human
gcuuaagcagaagcau

SEQ ID NO: 2339605 - RNA, 16 nt, Human
gcuucuucagagacuc

SEQ ID NO: 2339606 - RNA, 20 nt, Human
gcuuaagaaaucuaguauuu

SEQ ID NO: 2339607 - RNA, 15 nt, Human
gcuuaagcagaagca

SEQ ID NO: 2339608 - RNA, 17 nt, Human
gcuuaacuucacauauu

SEQ ID NO: 2339609 - RNA, 22 nt, Human
gcuguuuauggccucagcugcc

SEQ ID NO: 2339610 - RNA, 17 nt, Human
gcuguuuauggccucag

SEQ ID NO: 2339611 - RNA, 23 nt, Human
gcuguuuauggccucagcugccu

SEQ ID NO: 2339612 - RNA, 16 nt, Human
gcuguuuauggccuca

SEQ ID NO: 2339613 - RNA, 15 nt, Human
gcuguuuauggccuc

SEQ ID NO: 2339614 - RNA, 14 nt, Human
gcuguuuauggccu

SEQ ID NO: 2339615 - RNA, 15 nt, Human
gcuguuuacuaggga

SEQ ID NO: 2339616 - RNA, 11 nt, Human
gcuguuuccuu

SEQ ID NO: 2339617 - RNA, 13 nt, Human
gcuguuugaggau

SEQ ID NO: 2339618 - RNA, 13 nt, Human
gcuguuuccauag

SEQ ID NO: 2339619 - RNA, 16 nt, Human
gcuguuuauuuuauau

SEQ ID NO: 2339620 - RNA, 16 nt, Human
gcuuaacuucacauau

SEQ ID NO: 2339621 - RNA, 19 nt, Human
gcuucuucagagacuccug

SEQ ID NO: 2339622 - RNA, 21 nt, Human
gcuucuucagagacuccugca

SEQ ID NO: 2339623 - RNA, 16 nt, Human
gcuugaccgugaggcc

SEQ ID NO: 2339624 - RNA, 23 nt, Human
gcuucuucagagacuccugcagg

SEQ ID NO: 2339625 - RNA, 17 nt, Human
gcuugaccgugaggcca

SEQ ID NO: 2339626 - RNA, 18 nt, Human
gcuugaccgugaggccag

SEQ ID NO: 2339627 - RNA, 19 nt, Human
gcuugaccgugaggccaga

SEQ ID NO: 2339628 - RNA, 23 nt, Human
gcuugggcuucauccuccucaga

SEQ ID NO: 2339629 - RNA, 16 nt, Human
gcuuggggaccagagc

SEQ ID NO: 2339630 - RNA, 19 nt, Human
ggaaaggcucagucucagg

SEQ ID NO: 2339631 - RNA, 18 nt, Human
ggaaaucucaccccaucc

SEQ ID NO: 2339632 - RNA, 12 nt, Human
ggaaaggcucag

SEQ ID NO: 2339633 - RNA, 22 nt, Human
ggaaaggccagcuggcagcaga

SEQ ID NO: 2339634 - RNA, 20 nt, Human
ggaaaggccagcuggcagca

SEQ ID NO: 2339635 - RNA, 16 nt, Human
ggaaauccaggguggu

SEQ ID NO: 2339636 - RNA, 23 nt, Human
ggaaaucaccgaaaacguggcug

SEQ ID NO: 2339637 - RNA, 19 nt, Human
ggaaaucaggguuaguauu

SEQ ID NO: 2339638 - RNA, 21 nt, Human
ggaagccagcaggcucucagg

SEQ ID NO: 2339639 - RNA, 16 nt, Human
ggaagccagcuuuccc

SEQ ID NO: 2339640 - RNA, 20 nt, Human
ggaagccggaggguguuuau

SEQ ID NO: 2339641 - RNA, 18 nt, Human
ggaagccgcuggggccag

SEQ ID NO: 2339642 - RNA, 22 nt, Human
ggaagccagcaggcucucaggc

SEQ ID NO: 2339643 - RNA, 23 nt, Human
ggaagccagcaggcucucaggcc

SEQ ID NO: 2339644 - RNA, 13 nt, Human
ggacacagcucuu

SEQ ID NO: 2339645 - RNA, 12 nt, Human
ggacacacuaau

SEQ ID NO: 2339646 - RNA, 16 nt, Human
ggacacagaugaaaca

SEQ ID NO: 2339647 - RNA, 13 nt, Human
ggacaccaggagu

SEQ ID NO: 2339648 - RNA, 20 nt, Human
ggacaccagccaggcucugu

SEQ ID NO: 2339649 - RNA, 22 nt, Human
ggacaccagccaggcucugugc

SEQ ID NO: 2339650 - RNA, 12 nt, Human
ggacacccugug

SEQ ID NO: 2339651 - RNA, 21 nt, Human
ggacacauucaacccuggaga

SEQ ID NO: 2339652 - RNA, 22 nt, Human
ggacacauucaacccuggagag

SEQ ID NO: 2339653 - RNA, 17 nt, Human
ggacaccacacccagcc

SEQ ID NO: 2339654 - RNA, 18 nt, Human
ggacaccacacccagccu

SEQ ID NO: 2339655 - RNA, 19 nt, Human
ggacaccacacccagccuc

SEQ ID NO: 2339656 - RNA, 20 nt, Human
ggacaccacacccagccuca

SEQ ID NO: 2339657 - RNA, 21 nt, Human
ggacaccacacccagccucag

SEQ ID NO: 2339658 - RNA, 22 nt, Human
ggacaccacacccagccucagu

SEQ ID NO: 2339659 - RNA, 13 nt, Human
ggacaccagccag

SEQ ID NO: 2339660 - RNA, 14 nt, Human
ggacaccagccagg

SEQ ID NO: 2339661 - RNA, 16 nt, Human
ggacaccagccaggcu

SEQ ID NO: 2339662 - RNA, 17 nt, Human
ggacaccagccaggcuc

SEQ ID NO: 2339663 - RNA, 18 nt, Human
ggacaccagccaggcucu

SEQ ID NO: 2339664 - RNA, 19 nt, Human
ggacaccagccaggcucug

SEQ ID NO: 2339665 - RNA, 18 nt, Human
ggaaugaagcuuguguau

SEQ ID NO: 2339666 - RNA, 21 nt, Human
ggaaugaggcuugcugagagg

SEQ ID NO: 2339667 - RNA, 16 nt, Human
ggacaauucaugaacu

SEQ ID NO: 2339668 - RNA, 21 nt, Human
ggaaugaggugggagguggaa

SEQ ID NO: 2339669 - RNA, 21 nt, Human
ggacacacaaggugcaaauca

SEQ ID NO: 2339670 - RNA, 20 nt, Human
ggaaugaggcuugcugagag

SEQ ID NO: 2339671 - RNA, 13 nt, Human
ggacacacaaggu

SEQ ID NO: 2339672 - RNA, 12 nt, Human
ggacacagcucu

SEQ ID NO: 2339673 - RNA, 16 nt, Human
ggaaucaagagcugcc

SEQ ID NO: 2339674 - RNA, 15 nt, Human
ggaauauuugaaucu

SEQ ID NO: 2339675 - RNA, 20 nt, Human
ggaauauuugaaucuugucu

SEQ ID NO: 2339676 - RNA, 22 nt, Human
ggaaucaagaugucagacuggc

SEQ ID NO: 2339677 - RNA, 12 nt, Human
ggaaucaagauu

SEQ ID NO: 2339678 - RNA, 17 nt, Human
ggaaucaagagcugccc

SEQ ID NO: 2339679 - RNA, 19 nt, Human
ggaaucaagagcugcccuc

SEQ ID NO: 2339680 - RNA, 23 nt, Human
ggaaucaagagcugcccuccuug

SEQ ID NO: 2339681 - RNA, 18 nt, Human
ggaaugaagcaaugcuuc

SEQ ID NO: 2339682 - RNA, 15 nt, Human
ggaaucacucuugug

SEQ ID NO: 2339683 - RNA, 12 nt, Human
ggaaugaagcuu

SEQ ID NO: 2339684 - RNA, 15 nt, Human
ggaaugaagcuugug

SEQ ID NO: 2339685 - RNA, 16 nt, Human
ggaaugaagcuugugu

SEQ ID NO: 2339686 - RNA, 19 nt, Human
ggaaugaaugucaguguga

SEQ ID NO: 2339687 - RNA, 23 nt, Human
ggaagcgaugaauuuggagacuc

SEQ ID NO: 2339688 - RNA, 14 nt, Human
ggaagccugcaguc

SEQ ID NO: 2339689 - RNA, 16 nt, Human
ggaagccgugcccugc

SEQ ID NO: 2339690 - RNA, 16 nt, Human
ggaagccggcggccca

SEQ ID NO: 2339691 - RNA, 20 nt, Human
ggaagccggcggcccaagcc

SEQ ID NO: 2339692 - RNA, 20 nt, Human
ggaagccgugcucgccccag

SEQ ID NO: 2339693 - RNA, 16 nt, Human
ggaagcucagggccug

SEQ ID NO: 2339694 - RNA, 17 nt, Human
ggaagcucagggccugg

SEQ ID NO: 2339695 - RNA, 22 nt, Human
ggaagcggagguugcagggagc

SEQ ID NO: 2339696 - RNA, 15 nt, Human
ggaauaauagaagaa

SEQ ID NO: 2339697 - RNA, 22 nt, Human
ggaauaaugggcuuagagcagu

SEQ ID NO: 2339698 - RNA, 21 nt, Human
ggaauaauuauuuauuuaaua

SEQ ID NO: 2339699 - RNA, 13 nt, Human
ggaauaauuauuu

SEQ ID NO: 2339700 - RNA, 15 nt, Human
ggaauacaauguaau

SEQ ID NO: 2339701 - RNA, 15 nt, Human
ggaauaccugucccc

SEQ ID NO: 2339702 - RNA, 20 nt, Human
ggaagcggagguugcaggga

SEQ ID NO: 2339703 - RNA, 20 nt, Human
ggaagcgcgagggccucaaa

SEQ ID NO: 2339704 - RNA, 22 nt, Human
ggaagcucagggccuggcucag

SEQ ID NO: 2339705 - RNA, 21 nt, Human
ggaagcucagggccuggcuca

SEQ ID NO: 2339706 - RNA, 17 nt, Human
ggaauaguauccuccag

SEQ ID NO: 2339707 - RNA, 18 nt, Human
ggaauaguauccuccagg

SEQ ID NO: 2339708 - RNA, 19 nt, Human
ggaauaguauccuccaggu

SEQ ID NO: 2339709 - RNA, 17 nt, Human
ggaauacuuuuuguuau

SEQ ID NO: 2339710 - RNA, 12 nt, Human
ggaauacagugu

SEQ ID NO: 2339711 - RNA, 18 nt, Human
ggaauacuagggagaagg

SEQ ID NO: 2339712 - RNA, 12 nt, Human
ggaauacuuuuu

SEQ ID NO: 2339713 - RNA, 16 nt, Human
ggaauaccuguccccc

SEQ ID NO: 2339714 - RNA, 19 nt, Human
ggaauaccugucccccuga

SEQ ID NO: 2339715 - RNA, 23 nt, Human
ggaauauaaggaaagcaauaaau

SEQ ID NO: 2339716 - RNA, 17 nt, Human
ggaauaguugagcccca

SEQ ID NO: 2339717 - RNA, 20 nt, Human
ggaauaguugagccccaagu

SEQ ID NO: 2339718 - RNA, 20 nt, Human
ggaauaguauccuccagguu

SEQ ID NO: 2339719 - RNA, 21 nt, Human
ggaauaguauccuccagguuu

SEQ ID NO: 2339720 - RNA, 22 nt, Human
ggaauaguauccuccagguuuu

SEQ ID NO: 2339721 - RNA, 16 nt, Human
ggaauaguugagcccc

SEQ ID NO: 2339722 - RNA, 16 nt, Human
ggaauauauaaccagu

SEQ ID NO: 2339723 - RNA, 22 nt, Human
ggaauauuccccuaucucuaga

SEQ ID NO: 2339724 - RNA, 11 nt, Human
ggaauauuuga

SEQ ID NO: 2339725 - RNA, 13 nt, Human
ggaauauuugaau

SEQ ID NO: 2339726 - RNA, 14 nt, Human
ggaauauuugaauc

SEQ ID NO: 2339727 - RNA, 13 nt, Human
ggaauaugagcuu

SEQ ID NO: 2339728 - RNA, 13 nt, Human
ggaauaguuuuuu

SEQ ID NO: 2339729 - RNA, 17 nt, Human
ggaauaugggagaaaua

SEQ ID NO: 2339730 - RNA, 15 nt, Human
ggacacccccucgcu

SEQ ID NO: 2339731 - RNA, 19 nt, Human
ggacaccccuuauccagga

SEQ ID NO: 2339732 - RNA, 20 nt, Human
ggacaccccuuauccaggac

SEQ ID NO: 2339733 - RNA, 15 nt, Human
ggacaccgggccagu

SEQ ID NO: 2339734 - RNA, 13 nt, Human
ggacacccuguga

SEQ ID NO: 2339735 - RNA, 23 nt, Human
ggacacccugugauggggcccug

SEQ ID NO: 2339736 - RNA, 11 nt, Human
ggacaggcccg

SEQ ID NO: 2339737 - RNA, 21 nt, Human
ggacaccccuuauccaggacu

SEQ ID NO: 2339738 - RNA, 23 nt, Human
ggacaggcauguucucugaggac

SEQ ID NO: 2339739 - RNA, 15 nt, Human
ggacaccugcccugc

SEQ ID NO: 2339740 - RNA, 14 nt, Human
ggacaccugcccug

SEQ ID NO: 2339741 - RNA, 22 nt, Human
ggacaggcccggcgcgguggcu

SEQ ID NO: 2339742 - RNA, 13 nt, Human
ggacaggcuggcu

SEQ ID NO: 2339743 - RNA, 17 nt, Human
ggacagggaggugaccc

SEQ ID NO: 2339744 - RNA, 20 nt, Human
ggacaggugugccgacagaa

SEQ ID NO: 2339745 - RNA, 18 nt, Human
ggacaguauuugugggga

SEQ ID NO: 2339746 - RNA, 17 nt, Human
ggacaggggcaggagga

SEQ ID NO: 2339747 - RNA, 20 nt, Human
ggacagggcuggcccagccc

SEQ ID NO: 2339748 - RNA, 21 nt, Human
ggacagggcuggcccagcccu

SEQ ID NO: 2339749 - RNA, 22 nt, Human
ggacagggcuggcccagcccug

SEQ ID NO: 2339750 - RNA, 23 nt, Human
ggacagggcuggcccagcccugc

SEQ ID NO: 2339751 - RNA, 15 nt, Human
ggacagggcauggcc

SEQ ID NO: 2339752 - RNA, 23 nt, Human
ggacaggcuggcuccagaugcag

SEQ ID NO: 2339753 - RNA, 15 nt, Human
ggacaggcuggcucc

SEQ ID NO: 2339754 - RNA, 22 nt, Human
ggacagggcauggccagguggc

SEQ ID NO: 2339755 - RNA, 22 nt, Human
ggacagggaugagcauggagcu

SEQ ID NO: 2339756 - RNA, 15 nt, Human
ggacagggcuggccc

SEQ ID NO: 2339757 - RNA, 16 nt, Human
ggacagggcuggccca

SEQ ID NO: 2339758 - RNA, 18 nt, Human
ggacagggcuggcccagc

SEQ ID NO: 2339759 - RNA, 14 nt, Human
ggacagggucccug

SEQ ID NO: 2339760 - RNA, 19 nt, Human
ggacaguauuuguggggag

SEQ ID NO: 2339761 - RNA, 21 nt, Human
ggacagucaccucauggaauu

SEQ ID NO: 2339762 - RNA, 17 nt, Human
ggacagucaccucaugg

SEQ ID NO: 2339763 - RNA, 18 nt, Human
ggacagucaccucaugga

SEQ ID NO: 2339764 - RNA, 23 nt, Human
ggacagugcuucagccugaggcu

SEQ ID NO: 2339765 - RNA, 22 nt, Human
ggacagugcuucagccugaggc

SEQ ID NO: 2339766 - RNA, 21 nt, Human
ggacagugcuucagccugagg

SEQ ID NO: 2339767 - RNA, 20 nt, Human
ggacagugcuucagccugag

SEQ ID NO: 2339768 - RNA, 19 nt, Human
ggacagugcuucagccuga

SEQ ID NO: 2339769 - RNA, 18 nt, Human
ggacagugcuucagccug

SEQ ID NO: 2339770 - RNA, 16 nt, Human
ggacaguccugggaga

SEQ ID NO: 2339771 - RNA, 15 nt, Human
ggacaguccugggag

SEQ ID NO: 2339772 - RNA, 14 nt, Human
ggacaguccuggga

SEQ ID NO: 2339773 - RNA, 13 nt, Human
ggacaguccuggg

SEQ ID NO: 2339774 - RNA, 17 nt, Human
ggacagugcuucagccu

SEQ ID NO: 2339775 - RNA, 16 nt, Human
ggacagugcuucagcc

SEQ ID NO: 2339776 - RNA, 19 nt, Human
ggacaguccugggagaacc

SEQ ID NO: 2339777 - RNA, 14 nt, Human
ggacagugcuucag

SEQ ID NO: 2339778 - RNA, 22 nt, Human
ggacaguugcuuuucagcaugg

SEQ ID NO: 2339779 - RNA, 18 nt, Human
ggacauagcgaauacaaa

SEQ ID NO: 2339780 - RNA, 15 nt, Human
ggacauagagaggga

SEQ ID NO: 2339781 - RNA, 20 nt, Human
ggacauagagagggagaaga

SEQ ID NO: 2339782 - RNA, 23 nt, Human
ggacauaaugggguccuggccau

SEQ ID NO: 2339783 - RNA, 19 nt, Human
ggacauaaugggguccugg

SEQ ID NO: 2339784 - RNA, 20 nt, Human
ggacauccccccgccaaaag

SEQ ID NO: 2339785 - RNA, 14 nt, Human
ggacaucagcuggu

SEQ ID NO: 2339786 - RNA, 22 nt, Human
ggacauagagagggagaagaag

SEQ ID NO: 2339787 - RNA, 13 nt, Human
ggacauccuccuc

SEQ ID NO: 2339788 - RNA, 14 nt, Human
ggacauauucauuu

SEQ ID NO: 2339789 - RNA, 14 nt, Human
ggacauggacaagg

SEQ ID NO: 2339790 - RNA, 13 nt, Human
ggacauggacaag

SEQ ID NO: 2339791 - RNA, 14 nt, Human
ggacauccucuucu

SEQ ID NO: 2339792 - RNA, 16 nt, Human
ggacauccuccuccca

SEQ ID NO: 2339793 - RNA, 16 nt, Human
ggacaugcgguagcca

SEQ ID NO: 2339794 - RNA, 15 nt, Human
ggacaucucuuugaa

SEQ ID NO: 2339795 - RNA, 16 nt, Human
ggacaugcugaagcca

SEQ ID NO: 2339796 - RNA, 19 nt, Human
ggacaugcugaagccaaag

SEQ ID NO: 2339797 - RNA, 21 nt, Human
ggacaugcgguagccagcaca

SEQ ID NO: 2339798 - RNA, 19 nt, Human
ggacaugcgguagccagca

SEQ ID NO: 2339799 - RNA, 14 nt, Human
gcugcaaggccuuu

SEQ ID NO: 2339800 - RNA, 16 nt, Human
gcugcaaggccuuucu

SEQ ID NO: 2339801 - RNA, 20 nt, Human
gcugcaagugacaucucuuu

SEQ ID NO: 2339802 - RNA, 21 nt, Human
gcugcaagguuuaggcuggug

SEQ ID NO: 2339803 - RNA, 19 nt, Human
gcugcaagguuuaggcugg

SEQ ID NO: 2339804 - RNA, 12 nt, Human
gcugcaagguuu

SEQ ID NO: 2339805 - RNA, 23 nt, Human
gcugcaagguggcuccagcacca

SEQ ID NO: 2339806 - RNA, 19 nt, Human
gcugcaaggccuuucugug

SEQ ID NO: 2339807 - RNA, 22 nt, Human
gcugcaagguggcuccagcacc

SEQ ID NO: 2339808 - RNA, 17 nt, Human
gcugcacagggcagcug

SEQ ID NO: 2339809 - RNA, 18 nt, Human
gcugcacagggcagcugg

SEQ ID NO: 2339810 - RNA, 19 nt, Human
gcugcacagggcagcuggg

SEQ ID NO: 2339811 - RNA, 20 nt, Human
gcugcacagggcagcugggc

SEQ ID NO: 2339812 - RNA, 21 nt, Human
gcugcacagggcagcugggcc

SEQ ID NO: 2339813 - RNA, 23 nt, Human
gcugcacagggcagcugggccca

SEQ ID NO: 2339814 - RNA, 13 nt, Human
gcugcaccaaccc

SEQ ID NO: 2339815 - RNA, 16 nt, Human
gcugcaccaacccagc

SEQ ID NO: 2339816 - RNA, 17 nt, Human
gcugcaccaacccagcc

SEQ ID NO: 2339817 - RNA, 18 nt, Human
gcugcaccaacccagccg

SEQ ID NO: 2339818 - RNA, 19 nt, Human
gcugcaccaacccagccgc

SEQ ID NO: 2339819 - RNA, 21 nt, Human
gcugcaccaacccagccgcug

SEQ ID NO: 2339820 - RNA, 19 nt, Human
gcugcacccucaggcaggu

SEQ ID NO: 2339821 - RNA, 18 nt, Human
gcugcacccucaggcagg

SEQ ID NO: 2339822 - RNA, 13 nt, Human
gcugcaccggcug

SEQ ID NO: 2339823 - RNA, 20 nt, Human
gcugcaccaacccagccgcu

SEQ ID NO: 2339824 - RNA, 22 nt, Human
gcugcagaggggcaggcccugc

SEQ ID NO: 2339825 - RNA, 23 nt, Human
gcugcagaggggcaggcccugca

SEQ ID NO: 2339826 - RNA, 14 nt, Human
gcugcccccggccc

SEQ ID NO: 2339827 - RNA, 18 nt, Human
gcugcccccggcccccug

SEQ ID NO: 2339828 - RNA, 19 nt, Human
gcugcccccggcccccugg

SEQ ID NO: 2339829 - RNA, 20 nt, Human
gcugcccccaccccggggac

SEQ ID NO: 2339830 - RNA, 20 nt, Human
gcugcccccggcccccuggu

SEQ ID NO: 2339831 - RNA, 23 nt, Human
gcugcccccggcccccuggucuc

SEQ ID NO: 2339832 - RNA, 22 nt, Human
gcugccccucaucucucugccc

SEQ ID NO: 2339833 - RNA, 23 nt, Human
gcugcagccaggccacuggcccc

SEQ ID NO: 2339834 - RNA, 12 nt, Human
gcugcagcaugu

SEQ ID NO: 2339835 - RNA, 22 nt, Human
gcugcagcauguugcugaggag

SEQ ID NO: 2339836 - RNA, 15 nt, Human
gcugcccccaccccg

SEQ ID NO: 2339837 - RNA, 17 nt, Human
gcugcagauuugggcug

SEQ ID NO: 2339838 - RNA, 18 nt, Human
gcugcagauuugggcugg

SEQ ID NO: 2339839 - RNA, 21 nt, Human
gcugcagauuugggcuggaac

SEQ ID NO: 2339840 - RNA, 14 nt, Human
gcugcagcagaggc

SEQ ID NO: 2339841 - RNA, 16 nt, Human
gcugcagcagaggcac

SEQ ID NO: 2339842 - RNA, 15 nt, Human
gcugcagccaggcca

SEQ ID NO: 2339843 - RNA, 18 nt, Human
gcugcagcagaggcacug

SEQ ID NO: 2339844 - RNA, 12 nt, Human
gcugcagcagcg

SEQ ID NO: 2339845 - RNA, 20 nt, Human
gcugcagcagcgguggccuc

SEQ ID NO: 2339846 - RNA, 21 nt, Human
gcugcagcagcgguggccucu

SEQ ID NO: 2339847 - RNA, 17 nt, Human
gcugccccuggcucuga

SEQ ID NO: 2339848 - RNA, 13 nt, Human
gcugcccgcuccc

SEQ ID NO: 2339849 - RNA, 12 nt, Human
gcugcccgcucc

SEQ ID NO: 2339850 - RNA, 20 nt, Human
gcugccccuggcagccccug

SEQ ID NO: 2339851 - RNA, 18 nt, Human
gcugccccuggcagcccc

SEQ ID NO: 2339852 - RNA, 19 nt, Human
gcugccccuggcagccccu

SEQ ID NO: 2339853 - RNA, 20 nt, Human
gcugcccgucuucagccuag

SEQ ID NO: 2339854 - RNA, 19 nt, Human
gcugcccgucuucagccua

SEQ ID NO: 2339855 - RNA, 16 nt, Human
gcugcccgucuucagc

SEQ ID NO: 2339856 - RNA, 20 nt, Human
gcugcccggcgcccucuguc

SEQ ID NO: 2339857 - RNA, 23 nt, Human
gcugcccggcgcccucuguccug

SEQ ID NO: 2339858 - RNA, 14 nt, Human
gcugcccgcuccca

SEQ ID NO: 2339859 - RNA, 15 nt, Human
gcugcccgcucccag

SEQ ID NO: 2339860 - RNA, 16 nt, Human
gcugcccgcucccagu

SEQ ID NO: 2339861 - RNA, 19 nt, Human
gcugcccgcucccaguguc

SEQ ID NO: 2339862 - RNA, 20 nt, Human
gcugcccgcucccagugucu

SEQ ID NO: 2339863 - RNA, 17 nt, Human
gcugcccggcgcccucu

SEQ ID NO: 2339864 - RNA, 18 nt, Human
gcugcccggcgcccucug

SEQ ID NO: 2339865 - RNA, 19 nt, Human
gcugcccggcgcccucugu

SEQ ID NO: 2339866 - RNA, 21 nt, Human
gcugcccgucuucagccuagc

SEQ ID NO: 2339867 - RNA, 15 nt, Human
gcugcccuaggcucc

SEQ ID NO: 2339868 - RNA, 15 nt, Human
gcugcccuccauccc

SEQ ID NO: 2339869 - RNA, 16 nt, Human
gcugcccuaggcuccg

SEQ ID NO: 2339870 - RNA, 14 nt, Human
gcugcccuccaucc

SEQ ID NO: 2339871 - RNA, 21 nt, Human
gcugcccuccaucccgacaug

SEQ ID NO: 2339872 - RNA, 19 nt, Human
gcugcccuccaucccgaca

SEQ ID NO: 2339873 - RNA, 12 nt, Human
gcugccucacuu

SEQ ID NO: 2339874 - RNA, 19 nt, Human
gcugccuguaguuaggaaa

SEQ ID NO: 2339875 - RNA, 16 nt, Human
gcugccuguaguuagg

SEQ ID NO: 2339876 - RNA, 15 nt, Human
gcugccuguaguuag

SEQ ID NO: 2339877 - RNA, 13 nt, Human
gcugccuguaguu

SEQ ID NO: 2339878 - RNA, 12 nt, Human
gcugccuguagu

SEQ ID NO: 2339879 - RNA, 22 nt, Human
gcugccugggcuguuggcacuc

SEQ ID NO: 2339880 - RNA, 23 nt, Human
gcugccugggcuguuggcacuca

SEQ ID NO: 2339881 - RNA, 14 nt, Human
gcugccugggcugu

SEQ ID NO: 2339882 - RNA, 16 nt, Human
gcugccugggcuguug

SEQ ID NO: 2339883 - RNA, 18 nt, Human
gcugccugggcuguuggc

SEQ ID NO: 2339884 - RNA, 19 nt, Human
gcugccugggcuguuggca

SEQ ID NO: 2339885 - RNA, 13 nt, Human
gcugccugcccac

SEQ ID NO: 2339886 - RNA, 12 nt, Human
gcugccugggcu

SEQ ID NO: 2339887 - RNA, 13 nt, Human
gcugccugggcug

SEQ ID NO: 2339888 - RNA, 21 nt, Human
gcugccugggaucccucaucc

SEQ ID NO: 2339889 - RNA, 17 nt, Human
gcugccuguucagcucc

SEQ ID NO: 2339890 - RNA, 20 nt, Human
gcugccuguaguuaggaaau

SEQ ID NO: 2339891 - RNA, 13 nt, Human
gcugccugugugg

SEQ ID NO: 2339892 - RNA, 23 nt, Human
gcugcucuugaacuccugaccuc

SEQ ID NO: 2339893 - RNA, 12 nt, Human
gcugccuguuca

SEQ ID NO: 2339894 - RNA, 13 nt, Human
gcugccuguucag

SEQ ID NO: 2339895 - RNA, 16 nt, Human
gcugccucucccauca

SEQ ID NO: 2339896 - RNA, 18 nt, Human
gcugccucucgguggcca

SEQ ID NO: 2339897 - RNA, 21 nt, Human
gcugccucuaccugacacucc

SEQ ID NO: 2339898 - RNA, 13 nt, Human
gcugccucuucug

SEQ ID NO: 2339899 - RNA, 20 nt, Human
gcugccugggaucccucauc

SEQ ID NO: 2339900 - RNA, 20 nt, Human
gcugccuccccaacccugcc

SEQ ID NO: 2339901 - RNA, 19 nt, Human
gcugccuccccaacccugc

SEQ ID NO: 2339902 - RNA, 17 nt, Human
gcugccuccccaacccu

SEQ ID NO: 2339903 - RNA, 15 nt, Human
gcugccuccccaacc

SEQ ID NO: 2339904 - RNA, 23 nt, Human
gcugccuccccaacccugccccu

SEQ ID NO: 2339905 - RNA, 21 nt, Human
gcugccuccccaacccugccc

SEQ ID NO: 2339906 - RNA, 21 nt, Human
gcugccuccccucuccuuccu

SEQ ID NO: 2339907 - RNA, 13 nt, Human
gcugccuccccaa

SEQ ID NO: 2339908 - RNA, 20 nt, Human
gcugccuccacucccacuuc

SEQ ID NO: 2339909 - RNA, 21 nt, Human
gcugccuccacucccacuucc

SEQ ID NO: 2339910 - RNA, 15 nt, Human
gcugccuccacuccc

SEQ ID NO: 2339911 - RNA, 16 nt, Human
gcugccuccacuccca

SEQ ID NO: 2339912 - RNA, 17 nt, Human
gcugccuccacucccac

SEQ ID NO: 2339913 - RNA, 18 nt, Human
gcugccuccacucccacu

SEQ ID NO: 2339914 - RNA, 13 nt, Human
gcugccucaugcu

SEQ ID NO: 2339915 - RNA, 21 nt, Human
gcugccucauuuagagaggaa

SEQ ID NO: 2339916 - RNA, 14 nt, Human
gcugccucauuuag

SEQ ID NO: 2339917 - RNA, 12 nt, Human
gcugccuccacu

SEQ ID NO: 2339918 - RNA, 14 nt, Human
gcugccuccacucc

SEQ ID NO: 2339919 - RNA, 14 nt, Human
gcugaggcaauucu

SEQ ID NO: 2339920 - RNA, 20 nt, Human
gcugaggauuucaagccugc

SEQ ID NO: 2339921 - RNA, 19 nt, Human
gcugaggauuucaagccug

SEQ ID NO: 2339922 - RNA, 18 nt, Human
gcugaggauuucaagccu

SEQ ID NO: 2339923 - RNA, 18 nt, Human
gcugaggagugaggaaua

SEQ ID NO: 2339924 - RNA, 21 nt, Human
gcugaggaggccuccaucuca

SEQ ID NO: 2339925 - RNA, 16 nt, Human
gcugaggagugaggaa

SEQ ID NO: 2339926 - RNA, 12 nt, Human
gcugagcccugg

SEQ ID NO: 2339927 - RNA, 11 nt, Human
gcugagcccug

SEQ ID NO: 2339928 - RNA, 23 nt, Human
gcugagccccugucuagagaggg

SEQ ID NO: 2339929 - RNA, 22 nt, Human
gcugagccccugucuagagagg

SEQ ID NO: 2339930 - RNA, 15 nt, Human
gcugagccccugucu

SEQ ID NO: 2339931 - RNA, 13 nt, Human
gcugagccccugu

SEQ ID NO: 2339932 - RNA, 15 nt, Human
gcugaggcaauucua

SEQ ID NO: 2339933 - RNA, 15 nt, Human
gcugaggcagaagaa

SEQ ID NO: 2339934 - RNA, 13 nt, Human
gcugaggcagaag

SEQ ID NO: 2339935 - RNA, 13 nt, Human
gcugaggcagcag

SEQ ID NO: 2339936 - RNA, 15 nt, Human
gcugaggcaggagga

SEQ ID NO: 2339937 - RNA, 16 nt, Human
gcugaggcagaagaau

SEQ ID NO: 2339938 - RNA, 23 nt, Human
gcugaggcagcagugugaggcca

SEQ ID NO: 2339939 - RNA, 17 nt, Human
gcugaggucucuugagg

SEQ ID NO: 2339940 - RNA, 22 nt, Human
gcugaggccccuucuagguggc

SEQ ID NO: 2339941 - RNA, 14 nt, Human
gcugaggugggagg

SEQ ID NO: 2339942 - RNA, 23 nt, Human
gcugagggugagugggugaauaa

SEQ ID NO: 2339943 - RNA, 21 nt, Human
gcugaggccacacucagcaca

SEQ ID NO: 2339944 - RNA, 19 nt, Human
gcugaggccacacucagca

SEQ ID NO: 2339945 - RNA, 22 nt, Human
gcugaggccggaugcgguggcu

SEQ ID NO: 2339946 - RNA, 17 nt, Human
gcugagcaccaggggau

SEQ ID NO: 2339947 - RNA, 14 nt, Human
gcugagccccuacc

SEQ ID NO: 2339948 - RNA, 17 nt, Human
gcugagccccuacccca

SEQ ID NO: 2339949 - RNA, 20 nt, Human
gcugagccccuaccccacac

SEQ ID NO: 2339950 - RNA, 21 nt, Human
gcugagccccuaccccacacc

SEQ ID NO: 2339951 - RNA, 13 nt, Human
gcugagaggggcu

SEQ ID NO: 2339952 - RNA, 22 nt, Human
gcugagaggcagacuucccuga

SEQ ID NO: 2339953 - RNA, 16 nt, Human
gcugagaggagagaga

SEQ ID NO: 2339954 - RNA, 23 nt, Human
gcugguagagauggaggaggagg

SEQ ID NO: 2339955 - RNA, 21 nt, Human
gcugguagagauggaggagga

SEQ ID NO: 2339956 - RNA, 13 nt, Human
gcugguagcucag

SEQ ID NO: 2339957 - RNA, 14 nt, Human
gcugguagcucagg

SEQ ID NO: 2339958 - RNA, 15 nt, Human
gcugguagcucaggu

SEQ ID NO: 2339959 - RNA, 16 nt, Human
gcugguagcucaggug

SEQ ID NO: 2339960 - RNA, 19 nt, Human
gcugguagcucaggugggc

SEQ ID NO: 2339961 - RNA, 13 nt, Human
gcugguaguuagu

SEQ ID NO: 2339962 - RNA, 19 nt, Human
gcugguaggcauuccagcu

SEQ ID NO: 2339963 - RNA, 19 nt, Human
gcugguaggcuccugccag

SEQ ID NO: 2339964 - RNA, 18 nt, Human
gcugguagagauggagga

SEQ ID NO: 2339965 - RNA, 17 nt, Human
gcugguagagauggagg

SEQ ID NO: 2339966 - RNA, 15 nt, Human
gcugguagagaugga

SEQ ID NO: 2339967 - RNA, 14 nt, Human
gcugguagagaugg

SEQ ID NO: 2339968 - RNA, 23 nt, Human
gcugguaauuuguaucugaagga

SEQ ID NO: 2339969 - RNA, 16 nt, Human
gcugguaacaguucau

SEQ ID NO: 2339970 - RNA, 22 nt, Human
gcugguaacaguucauguuugc

SEQ ID NO: 2339971 - RNA, 14 nt, Human
gcugguaaacuauu

SEQ ID NO: 2339972 - RNA, 15 nt, Human
gcugguaaacuauuu

SEQ ID NO: 2339973 - RNA, 13 nt, Human
gcugguaacaguu

SEQ ID NO: 2339974 - RNA, 17 nt, Human
gcuggguuggugcacag

SEQ ID NO: 2339975 - RNA, 20 nt, Human
gcuggguucuacccaggugc

SEQ ID NO: 2339976 - RNA, 21 nt, Human
gcuggguucuacccaggugcu

SEQ ID NO: 2339977 - RNA, 22 nt, Human
gcugggguggggaccucaggcc

SEQ ID NO: 2339978 - RNA, 23 nt, Human
gcugggguggggaccucaggccu

SEQ ID NO: 2339979 - RNA, 18 nt, Human
gcuggguucuacccaggu

SEQ ID NO: 2339980 - RNA, 17 nt, Human
gcuggguucuacccagg

SEQ ID NO: 2339981 - RNA, 13 nt, Human
gcugggccccagc

SEQ ID NO: 2339982 - RNA, 14 nt, Human
gcugggcccagaag

SEQ ID NO: 2339983 - RNA, 19 nt, Human
gcugggcccaacccugucu

SEQ ID NO: 2339984 - RNA, 20 nt, Human
gcugggcccaacccugucug

SEQ ID NO: 2339985 - RNA, 19 nt, Human
gcugggcaguuuuucugua

SEQ ID NO: 2339986 - RNA, 14 nt, Human
gcugggcagguugg

SEQ ID NO: 2339987 - RNA, 20 nt, Human
gcugggaauaagugccagga

SEQ ID NO: 2339988 - RNA, 19 nt, Human
gcugggaacugcagaccug

SEQ ID NO: 2339989 - RNA, 14 nt, Human
gcugggcaguuuuu

SEQ ID NO: 2339990 - RNA, 19 nt, Human
gcuggcugcccagaccccu

SEQ ID NO: 2339991 - RNA, 16 nt, Human
gcugggaacucaccug

SEQ ID NO: 2339992 - RNA, 18 nt, Human
gcugggaacucaccuggg

SEQ ID NO: 2339993 - RNA, 21 nt, Human
gcugggaacucaccuggggcu

SEQ ID NO: 2339994 - RNA, 23 nt, Human
gcugggaacucaccuggggcugc

SEQ ID NO: 2339995 - RNA, 15 nt, Human
gcugggaacugcaga

SEQ ID NO: 2339996 - RNA, 20 nt, Human
gcuggcuguuggcugggggc

SEQ ID NO: 2339997 - RNA, 23 nt, Human
gcuggcuguuggcugggggccuc

SEQ ID NO: 2339998 - RNA, 14 nt, Human
gcugggccccagcc

SEQ ID NO: 2339999 - RNA, 15 nt, Human
gcugggccccagccc

SEQ ID NO: 2340000 - RNA, 16 nt, Human
gcugggccccagccca

SEQ ID NO: 2340001 - RNA, 17 nt, Human
gcugggccccagcccac

SEQ ID NO: 2340002 - RNA, 19 nt, Human
gcugggccccagcccaccc

SEQ ID NO: 2340003 - RNA, 20 nt, Human
gcugggccccagcccacccu

SEQ ID NO: 2340004 - RNA, 21 nt, Human
gcugggccccagcccacccuc

SEQ ID NO: 2340005 - RNA, 12 nt, Human
gcugggccccug

SEQ ID NO: 2340006 - RNA, 13 nt, Human
gcugggccccugc

SEQ ID NO: 2340007 - RNA, 14 nt, Human
gcugggccccugcc

SEQ ID NO: 2340008 - RNA, 18 nt, Human
gcugggccccugccucuc

SEQ ID NO: 2340009 - RNA, 20 nt, Human
gcugggccccugccucucug

SEQ ID NO: 2340010 - RNA, 24 nt, Human
gcugggccccagcccacccuccug

SEQ ID NO: 2340011 - RNA, 17 nt, Human
gcugggguggggaccuc

SEQ ID NO: 2340012 - RNA, 19 nt, Human
gcugggguggggaccucag

SEQ ID NO: 2340013 - RNA, 14 nt, Human
gcugcucuggaaaa

SEQ ID NO: 2340014 - RNA, 18 nt, Human
gcugcucuggaauuugca

SEQ ID NO: 2340015 - RNA, 13 nt, Human
gcugcugaaacaa

SEQ ID NO: 2340016 - RNA, 12 nt, Human
gcugcugaaggc

SEQ ID NO: 2340017 - RNA, 23 nt, Human
gcugcugaagcugccugcuuuuc

SEQ ID NO: 2340018 - RNA, 15 nt, Human
gcugcugaagaugaa

SEQ ID NO: 2340019 - RNA, 13 nt, Human
gcugcugaagcug

SEQ ID NO: 2340020 - RNA, 16 nt, Human
gcugcugaagcugccu

SEQ ID NO: 2340021 - RNA, 20 nt, Human
gcugcugaagcugccugcuu

SEQ ID NO: 2340022 - RNA, 13 nt, Human
gcuggacuuggag

SEQ ID NO: 2340023 - RNA, 14 nt, Human
gcuggcgugcagug

SEQ ID NO: 2340024 - RNA, 18 nt, Human
gcuggagacuccuaggca

SEQ ID NO: 2340025 - RNA, 20 nt, Human
gcuggagacuccuaggcagg

SEQ ID NO: 2340026 - RNA, 21 nt, Human
gcuggagaccaugcagagcgc

SEQ ID NO: 2340027 - RNA, 22 nt, Human
gcuggagaccaugcagagcgcc

SEQ ID NO: 2340028 - RNA, 18 nt, Human
gcuggagacgggugggcg

SEQ ID NO: 2340029 - RNA, 13 nt, Human
gcuggagacuccu

SEQ ID NO: 2340030 - RNA, 12 nt, Human
gcuggagaagag

SEQ ID NO: 2340031 - RNA, 13 nt, Human
gcuggagaagaga

SEQ ID NO: 2340032 - RNA, 14 nt, Human
gcuggagaagagag

SEQ ID NO: 2340033 - RNA, 15 nt, Human
gcuggagaagagagg

SEQ ID NO: 2340034 - RNA, 16 nt, Human
gcuggagaagagagga

SEQ ID NO: 2340035 - RNA, 17 nt, Human
gcuggagaagagaggag

SEQ ID NO: 2340036 - RNA, 18 nt, Human
gcuggagaagagaggaga

SEQ ID NO: 2340037 - RNA, 20 nt, Human
gcuggagaagagaggagagg

SEQ ID NO: 2340038 - RNA, 21 nt, Human
gcuggagaagagaggagagga

SEQ ID NO: 2340039 - RNA, 12 nt, Human
gcuggagaagcu

SEQ ID NO: 2340040 - RNA, 16 nt, Human
gcuggagaagcucacc

SEQ ID NO: 2340041 - RNA, 15 nt, Human
gcuggagaccaugca

SEQ ID NO: 2340042 - RNA, 17 nt, Human
gcuggagaccaugcaga

SEQ ID NO: 2340043 - RNA, 20 nt, Human
gcuggagaccaugcagagcg

SEQ ID NO: 2340044 - RNA, 15 nt, Human
gcuggcgugcagugg

SEQ ID NO: 2340045 - RNA, 18 nt, Human
gcuggcgugcaguggugc

SEQ ID NO: 2340046 - RNA, 21 nt, Human
gcuggcggcuacucagcagcc

SEQ ID NO: 2340047 - RNA, 14 nt, Human
gcuggcucuucugc

SEQ ID NO: 2340048 - RNA, 16 nt, Human
gcuggcucuucugccc

SEQ ID NO: 2340049 - RNA, 18 nt, Human
gcuggcucuucugcccaa

SEQ ID NO: 2340050 - RNA, 13 nt, Human
gcuggcucuucug

SEQ ID NO: 2340051 - RNA, 16 nt, Human
gcuggcucugagcgcc

SEQ ID NO: 2340052 - RNA, 21 nt, Human
gcuggagacuccuaggcagga

SEQ ID NO: 2340053 - RNA, 13 nt, Human
gcuggcucugagc

SEQ ID NO: 2340054 - RNA, 18 nt, Human
gcuggcuguuggcugggg

SEQ ID NO: 2340055 - RNA, 19 nt, Human
gcuggcuguuggcuggggg

SEQ ID NO: 2340056 - RNA, 14 nt, Human
gcuggcugccuuag

SEQ ID NO: 2340057 - RNA, 20 nt, Human
gcuggcugccuuagaaccuu

SEQ ID NO: 2340058 - RNA, 14 nt, Human
gcuggcugcaguga

SEQ ID NO: 2340059 - RNA, 13 nt, Human
gcuggcugcagug

SEQ ID NO: 2340060 - RNA, 11 nt, Human
gcuggcugccu

SEQ ID NO: 2340061 - RNA, 21 nt, Human
gcugugcgcugacaaccaccg

SEQ ID NO: 2340062 - RNA, 16 nt, Human
gcugugccucugccug

SEQ ID NO: 2340063 - RNA, 14 nt, Human
gcugugccucugcc

SEQ ID NO: 2340064 - RNA, 15 nt, Human
gcugugccucugccu

SEQ ID NO: 2340065 - RNA, 16 nt, Human
gcugugcuaugaauuu

SEQ ID NO: 2340066 - RNA, 15 nt, Human
gcugugcuaugaauu

SEQ ID NO: 2340067 - RNA, 14 nt, Human
gcugugcuaugaau

SEQ ID NO: 2340068 - RNA, 16 nt, Human
gcugugcggaucucug

SEQ ID NO: 2340069 - RNA, 13 nt, Human
gcugugcucugga

SEQ ID NO: 2340070 - RNA, 18 nt, Human
gcugugcucuggacaggc

SEQ ID NO: 2340071 - RNA, 18 nt, Human
gcugugcggaucucugga

SEQ ID NO: 2340072 - RNA, 14 nt, Human
gcugugcugcccug

SEQ ID NO: 2340073 - RNA, 15 nt, Human
gcugugcucuggaca

SEQ ID NO: 2340074 - RNA, 16 nt, Human
gcugugcucuggacag

SEQ ID NO: 2340075 - RNA, 15 nt, Human
gcuguuggcuggggg

SEQ ID NO: 2340076 - RNA, 17 nt, Human
gcugugcugcccugccc

SEQ ID NO: 2340077 - RNA, 15 nt, Human
gcugugcugcccugc

SEQ ID NO: 2340078 - RNA, 16 nt, Human
gcugugcugcccugcc

SEQ ID NO: 2340079 - RNA, 16 nt, Human
gcuguuggcugggggc

SEQ ID NO: 2340080 - RNA, 20 nt, Human
gcuguuggcugggggccuca

SEQ ID NO: 2340081 - RNA, 21 nt, Human
gcuguuuaaauguuuuucuau

SEQ ID NO: 2340082 - RNA, 13 nt, Human
gcuguaggugugc

SEQ ID NO: 2340083 - RNA, 20 nt, Human
gcuguaguagcccuuucugu

SEQ ID NO: 2340084 - RNA, 20 nt, Human
gcuguaguccucauaaaaag

SEQ ID NO: 2340085 - RNA, 21 nt, Human
gcuguaguagcccuuucugug

SEQ ID NO: 2340086 - RNA, 14 nt, Human
gcuguauaaaauca

SEQ ID NO: 2340087 - RNA, 18 nt, Human
gcuguauaaaaucagcca

SEQ ID NO: 2340088 - RNA, 17 nt, Human
gcuguaucccaugagcc

SEQ ID NO: 2340089 - RNA, 19 nt, Human
gcuguaucccaugagccuc

SEQ ID NO: 2340090 - RNA, 22 nt, Human
gcugugaguguaagugugagua

SEQ ID NO: 2340091 - RNA, 18 nt, Human
gcugugaguguaagugug

SEQ ID NO: 2340092 - RNA, 18 nt, Human
gcugugaggcuguccugu

SEQ ID NO: 2340093 - RNA, 12 nt, Human
gcugugaggcug

SEQ ID NO: 2340094 - RNA, 13 nt, Human
gcugugaggcugu

SEQ ID NO: 2340095 - RNA, 17 nt, Human
gcugugagccuuggcug

SEQ ID NO: 2340096 - RNA, 16 nt, Human
gcugugaggccccugg

SEQ ID NO: 2340097 - RNA, 18 nt, Human
gcugugaggccccuggac

SEQ ID NO: 2340098 - RNA, 22 nt, Human
gcugugaggccccuggacaagc

SEQ ID NO: 2340099 - RNA, 14 nt, Human
gcugugaggcuguc

SEQ ID NO: 2340100 - RNA, 15 nt, Human
gcugugaggcugucc

SEQ ID NO: 2340101 - RNA, 16 nt, Human
gcugugaggcuguccu

SEQ ID NO: 2340102 - RNA, 17 nt, Human
gcugugaggcuguccug

SEQ ID NO: 2340103 - RNA, 14 nt, Human
gcugugagccuugg

SEQ ID NO: 2340104 - RNA, 20 nt, Human
gcuguauaaaaucagccaau

SEQ ID NO: 2340105 - RNA, 22 nt, Human
gcuguauaaaaucagccaauua

SEQ ID NO: 2340106 - RNA, 21 nt, Human
gcuguauuuuaaaagaaugau

SEQ ID NO: 2340107 - RNA, 20 nt, Human
gcuguauuuuaaaagaauga

SEQ ID NO: 2340108 - RNA, 18 nt, Human
gcuguauuuuaaaagaau

SEQ ID NO: 2340109 - RNA, 23 nt, Human
ggcaucacagggcagagccggga

SEQ ID NO: 2340110 - RNA, 22 nt, Human
ggcaucacagggcagagccggg

SEQ ID NO: 2340111 - RNA, 23 nt, Human
ggcaucaccuuaggcagggaagu

SEQ ID NO: 2340112 - RNA, 13 nt, Human
ggcaucagcuggc

SEQ ID NO: 2340113 - RNA, 16 nt, Human
ggcaucagcuggcguc

SEQ ID NO: 2340114 - RNA, 18 nt, Human
ggcaucagucccuaugua

SEQ ID NO: 2340115 - RNA, 20 nt, Human
ggcaucaccuuaggcaggga

SEQ ID NO: 2340116 - RNA, 18 nt, Human
ggcaucaccuuaggcagg

SEQ ID NO: 2340117 - RNA, 21 nt, Human
ggcaucacaugcucaaugacu

SEQ ID NO: 2340118 - RNA, 14 nt, Human
ggcaucuccugugc

SEQ ID NO: 2340119 - RNA, 16 nt, Human
ggcaucuccaggaagg

SEQ ID NO: 2340120 - RNA, 11 nt, Human
ggcauuuccua

SEQ ID NO: 2340121 - RNA, 12 nt, Human
ggcaucuccagg

SEQ ID NO: 2340122 - RNA, 13 nt, Human
ggcaucuccagga

SEQ ID NO: 2340123 - RNA, 14 nt, Human
ggcaucuccaggaa

SEQ ID NO: 2340124 - RNA, 15 nt, Human
ggcaucuccaggaag

SEQ ID NO: 2340125 - RNA, 19 nt, Human
ggcauccuucugccuuuuu

SEQ ID NO: 2340126 - RNA, 21 nt, Human
ggcaucuagagcuugaugcca

SEQ ID NO: 2340127 - RNA, 22 nt, Human
ggcaucuagagcuugaugccag

SEQ ID NO: 2340128 - RNA, 14 nt, Human
ggcauuugcugaau

SEQ ID NO: 2340129 - RNA, 23 nt, Human
ggcaucaugcaucuuacugaagg

SEQ ID NO: 2340130 - RNA, 16 nt, Human
ggcauccuucugccuu

SEQ ID NO: 2340131 - RNA, 20 nt, Human
ggcaucgcaauguaagacuc

SEQ ID NO: 2340132 - RNA, 18 nt, Human
ggcaucgcaccauucuga

SEQ ID NO: 2340133 - RNA, 21 nt, Human
ggcaucgcaccauucugacuc

SEQ ID NO: 2340134 - RNA, 18 nt, Human
ggccagacaugccacaag

SEQ ID NO: 2340135 - RNA, 13 nt, Human
ggccaaggagcug

SEQ ID NO: 2340136 - RNA, 17 nt, Human
ggccagagacacaagcc

SEQ ID NO: 2340137 - RNA, 17 nt, Human
ggccaaggacugccgac

SEQ ID NO: 2340138 - RNA, 15 nt, Human
ggccaaggacugccg

SEQ ID NO: 2340139 - RNA, 13 nt, Human
ggccaaggacugc

SEQ ID NO: 2340140 - RNA, 11 nt, Human
ggccaaggacu

SEQ ID NO: 2340141 - RNA, 14 nt, Human
ggccaagcagggag

SEQ ID NO: 2340142 - RNA, 17 nt, Human
ggccagagggagugaca

SEQ ID NO: 2340143 - RNA, 19 nt, Human
ggccagagggagugacaga

SEQ ID NO: 2340144 - RNA, 21 nt, Human
ggccagagagccuggugcugc

SEQ ID NO: 2340145 - RNA, 18 nt, Human
ggccagagagccuggugc

SEQ ID NO: 2340146 - RNA, 19 nt, Human
ggccagaggcccccagccc

SEQ ID NO: 2340147 - RNA, 21 nt, Human
ggccagaggcccccagcccag

SEQ ID NO: 2340148 - RNA, 18 nt, Human
ggccagagacacaagccu

SEQ ID NO: 2340149 - RNA, 23 nt, Human
ggccaacccuucuccucuuguaa

SEQ ID NO: 2340150 - RNA, 19 nt, Human
ggccaaaggaagcacaugc

SEQ ID NO: 2340151 - RNA, 13 nt, Human
ggccaagaggcug

SEQ ID NO: 2340152 - RNA, 15 nt, Human
ggccaagacuuggca

SEQ ID NO: 2340153 - RNA, 23 nt, Human
ggccaagacuuggcaacagaagc

SEQ ID NO: 2340154 - RNA, 21 nt, Human
ggccaacuugagggcccagag

SEQ ID NO: 2340155 - RNA, 22 nt, Human
ggccaacuugagggcccagagc

SEQ ID NO: 2340156 - RNA, 23 nt, Human
ggccaacuugagggcccagagca

SEQ ID NO: 2340157 - RNA, 13 nt, Human
ggccaaaggaagc

SEQ ID NO: 2340158 - RNA, 17 nt, Human
ggcauuuguuugaacug

SEQ ID NO: 2340159 - RNA, 14 nt, Human
ggccaaaggaagca

SEQ ID NO: 2340160 - RNA, 16 nt, Human
ggccaaaggaagcaca

SEQ ID NO: 2340161 - RNA, 13 nt, Human
ggcaggggugggg

SEQ ID NO: 2340162 - RNA, 14 nt, Human
ggcagggguggggg

SEQ ID NO: 2340163 - RNA, 16 nt, Human
ggcaggggugggggug

SEQ ID NO: 2340164 - RNA, 12 nt, Human
ggcaggggcgga

SEQ ID NO: 2340165 - RNA, 14 nt, Human
ggcaggggccugga

SEQ ID NO: 2340166 - RNA, 16 nt, Human
ggcaggggccuggaga

SEQ ID NO: 2340167 - RNA, 17 nt, Human
ggcaggggccuggagau

SEQ ID NO: 2340168 - RNA, 18 nt, Human
ggcagggccaacccuucu

SEQ ID NO: 2340169 - RNA, 15 nt, Human
ggcagggcaucuccu

SEQ ID NO: 2340170 - RNA, 17 nt, Human
ggcagggccagggggug

SEQ ID NO: 2340171 - RNA, 16 nt, Human
ggcagggccccaggca

SEQ ID NO: 2340172 - RNA, 19 nt, Human
ggcagggccuagcugcuac

SEQ ID NO: 2340173 - RNA, 22 nt, Human
ggcagggagcggccggccagcc

SEQ ID NO: 2340174 - RNA, 10 nt, Human
ggcagggagg

SEQ ID NO: 2340175 - RNA, 18 nt, Human
ggcagggagggccugggc

SEQ ID NO: 2340176 - RNA, 17 nt, Human
ggcagggagggccuggg

SEQ ID NO: 2340177 - RNA, 13 nt, Human
ggcagggagggga

SEQ ID NO: 2340178 - RNA, 15 nt, Human
ggcagggauuugagg

SEQ ID NO: 2340179 - RNA, 20 nt, Human
ggcagggagggccugggccc

SEQ ID NO: 2340180 - RNA, 19 nt, Human
ggcagggagggccugggcc

SEQ ID NO: 2340181 - RNA, 23 nt, Human
ggcagggaaggggaggcagccgg

SEQ ID NO: 2340182 - RNA, 14 nt, Human
ggcagggaccacac

SEQ ID NO: 2340183 - RNA, 18 nt, Human
ggcagggaaaggcucuga

SEQ ID NO: 2340184 - RNA, 22 nt, Human
ggcaggcugucuggccaggccu

SEQ ID NO: 2340185 - RNA, 15 nt, Human
ggcaggaugacccug

SEQ ID NO: 2340186 - RNA, 14 nt, Human
ggcaggagggcccu

SEQ ID NO: 2340187 - RNA, 16 nt, Human
ggcaggcacagcacag

SEQ ID NO: 2340188 - RNA, 13 nt, Human
ggcaggcacagca

SEQ ID NO: 2340189 - RNA, 19 nt, Human
ggcaggauggccuggccag

SEQ ID NO: 2340190 - RNA, 15 nt, Human
ggcaggauggccugg

SEQ ID NO: 2340191 - RNA, 16 nt, Human
ggcaggauggccuggc

SEQ ID NO: 2340192 - RNA, 24 nt, Human
ggcaggaggauugcuugagcccag

SEQ ID NO: 2340193 - RNA, 14 nt, Human
ggcagcgccaggcu

SEQ ID NO: 2340194 - RNA, 18 nt, Human
ggcagcgccaagcaaccu

SEQ ID NO: 2340195 - RNA, 23 nt, Human
ggcagcgccaagcaaccuggguc

SEQ ID NO: 2340196 - RNA, 18 nt, Human
ggcaggaggaucacuuga

SEQ ID NO: 2340197 - RNA, 15 nt, Human
ggcagcgccaagcaa

SEQ ID NO: 2340198 - RNA, 20 nt, Human
ggcagccuggacauagagag

SEQ ID NO: 2340199 - RNA, 19 nt, Human
ggcagcauagcaagacaca

SEQ ID NO: 2340200 - RNA, 17 nt, Human
ggcagcauagcaagaca

SEQ ID NO: 2340201 - RNA, 18 nt, Human
ggcagccaaacccaugag

SEQ ID NO: 2340202 - RNA, 16 nt, Human
ggcagccaaacccaug

SEQ ID NO: 2340203 - RNA, 20 nt, Human
ggcagccaaacccaugaggc

SEQ ID NO: 2340204 - RNA, 19 nt, Human
ggcagccaaacccaugagg

SEQ ID NO: 2340205 - RNA, 22 nt, Human
ggcagcagugugaggccagggc

SEQ ID NO: 2340206 - RNA, 14 nt, Human
ggcacugcugugcu

SEQ ID NO: 2340207 - RNA, 16 nt, Human
ggcacugcugugcugu

SEQ ID NO: 2340208 - RNA, 20 nt, Human
ggcacugcuuccagugaggc

SEQ ID NO: 2340209 - RNA, 13 nt, Human
ggcagccaggcca

SEQ ID NO: 2340210 - RNA, 22 nt, Human
ggcagccccauucugccugccc

SEQ ID NO: 2340211 - RNA, 11 nt, Human
ggcagccugga

SEQ ID NO: 2340212 - RNA, 16 nt, Human
ggcagccucuucaaaa

SEQ ID NO: 2340213 - RNA, 16 nt, Human
ggcagccccauucugc

SEQ ID NO: 2340214 - RNA, 20 nt, Human
ggcagccccauucugccugc

SEQ ID NO: 2340215 - RNA, 21 nt, Human
ggcagccccauucugccugcc

SEQ ID NO: 2340216 - RNA, 12 nt, Human
ggcacacgccuc

SEQ ID NO: 2340217 - RNA, 15 nt, Human
ggcacacgccuccca

SEQ ID NO: 2340218 - RNA, 17 nt, Human
ggcacacgccucccacu

SEQ ID NO: 2340219 - RNA, 18 nt, Human
ggcacacgccucccacug

SEQ ID NO: 2340220 - RNA, 19 nt, Human
ggcacacgccucccacugg

SEQ ID NO: 2340221 - RNA, 14 nt, Human
ggcacauggaggag

SEQ ID NO: 2340222 - RNA, 18 nt, Human
ggcacauccuaugcaaua

SEQ ID NO: 2340223 - RNA, 21 nt, Human
ggcacauccuaugcaauauau

SEQ ID NO: 2340224 - RNA, 18 nt, Human
ggcacaucagcacgauuu

SEQ ID NO: 2340225 - RNA, 20 nt, Human
ggcacauuuccccagaccug

SEQ ID NO: 2340226 - RNA, 16 nt, Human
ggcacauuuccccaga

SEQ ID NO: 2340227 - RNA, 19 nt, Human
ggcacaugcugagucuccc

SEQ ID NO: 2340228 - RNA, 18 nt, Human
ggcacauuuaagagacag

SEQ ID NO: 2340229 - RNA, 22 nt, Human
ggcaccacugcacuccagccug

SEQ ID NO: 2340230 - RNA, 16 nt, Human
ggcaccaaagccacca

SEQ ID NO: 2340231 - RNA, 21 nt, Human
ggcacauuuccccagaccuga

SEQ ID NO: 2340232 - RNA, 16 nt, Human
ggcacugcuuccagug

SEQ ID NO: 2340233 - RNA, 12 nt, Human
ggcacugcuggg

SEQ ID NO: 2340234 - RNA, 14 nt, Human
ggcacugcugggug

SEQ ID NO: 2340235 - RNA, 15 nt, Human
ggcacugcugggugg

SEQ ID NO: 2340236 - RNA, 16 nt, Human
ggcacugcuggguggc

SEQ ID NO: 2340237 - RNA, 19 nt, Human
ggcacugcuggguggccca

SEQ ID NO: 2340238 - RNA, 20 nt, Human
ggcacugcuggguggcccau

SEQ ID NO: 2340239 - RNA, 21 nt, Human
ggcacugcuggguggcccauc

SEQ ID NO: 2340240 - RNA, 22 nt, Human
ggcacugcuggguggcccaucc

SEQ ID NO: 2340241 - RNA, 18 nt, Human
ggcacaccgggcacucag

SEQ ID NO: 2340242 - RNA, 13 nt, Human
ggcacacacugug

SEQ ID NO: 2340243 - RNA, 21 nt, Human
ggcacacacugugcuuucuau

SEQ ID NO: 2340244 - RNA, 14 nt, Human
ggauuuuugucuug

SEQ ID NO: 2340245 - RNA, 16 nt, Human
ggauuuuugucuugug

SEQ ID NO: 2340246 - RNA, 15 nt, Human
ggcaaaaaggcagga

SEQ ID NO: 2340247 - RNA, 13 nt, Human
ggauuucucccag

SEQ ID NO: 2340248 - RNA, 13 nt, Human
ggauuugaagcaa

SEQ ID NO: 2340249 - RNA, 21 nt, Human
ggauuugaggagcagcuucag

SEQ ID NO: 2340250 - RNA, 23 nt, Human
ggauuuccugcuuugggaagccg

SEQ ID NO: 2340251 - RNA, 19 nt, Human
ggauuuccagccagggcug

SEQ ID NO: 2340252 - RNA, 14 nt, Human
ggauuucguggguc

SEQ ID NO: 2340253 - RNA, 20 nt, Human
ggauuucaugauuucauuuc

SEQ ID NO: 2340254 - RNA, 14 nt, Human
ggauuuauuuuucc

SEQ ID NO: 2340255 - RNA, 16 nt, Human
ggauuuauaaaugcua

SEQ ID NO: 2340256 - RNA, 18 nt, Human
ggauuuauaaaugcuauu

SEQ ID NO: 2340257 - RNA, 15 nt, Human
ggcaaaaaaauuaaa

SEQ ID NO: 2340258 - RNA, 12 nt, Human
ggcaaaacucua

SEQ ID NO: 2340259 - RNA, 23 nt, Human
ggcaaaaggaucuuuguggccaa

SEQ ID NO: 2340260 - RNA, 18 nt, Human
ggcaaaacuuuggcacug

SEQ ID NO: 2340261 - RNA, 15 nt, Human
ggaguggccacagaa

SEQ ID NO: 2340262 - RNA, 15 nt, Human
ggaguggggcaguag

SEQ ID NO: 2340263 - RNA, 18 nt, Human
ggagugggacagagucug

SEQ ID NO: 2340264 - RNA, 12 nt, Human
ggagugggacag

SEQ ID NO: 2340265 - RNA, 22 nt, Human
ggagugggcccaaugcacuuug

SEQ ID NO: 2340266 - RNA, 16 nt, Human
ggaguggccacagaaa

SEQ ID NO: 2340267 - RNA, 12 nt, Human
ggagugggccca

SEQ ID NO: 2340268 - RNA, 20 nt, Human
ggaguguaugacugcacaug

SEQ ID NO: 2340269 - RNA, 17 nt, Human
ggagugggacagagucu

SEQ ID NO: 2340270 - RNA, 16 nt, Human
ggaguggggcaguaga

SEQ ID NO: 2340271 - RNA, 17 nt, Human
ggaguguguauuguucc

SEQ ID NO: 2340272 - RNA, 16 nt, Human
ggaguguguauuguuc

SEQ ID NO: 2340273 - RNA, 22 nt, Human
ggaguguggcugaggaggccuc

SEQ ID NO: 2340274 - RNA, 22 nt, Human
ggaguguguaauuuaaaauugu

SEQ ID NO: 2340275 - RNA, 11 nt, Human
ggaguguguaa

SEQ ID NO: 2340276 - RNA, 19 nt, Human
ggaguguguauuguuccca

SEQ ID NO: 2340277 - RNA, 18 nt, Human
ggaguguguauuguuccc

SEQ ID NO: 2340278 - RNA, 20 nt, Human
ggaguguuccccuuccacug

SEQ ID NO: 2340279 - RNA, 12 nt, Human
ggaguguucccc

SEQ ID NO: 2340280 - RNA, 15 nt, Human
ggaguuaagaccugg

SEQ ID NO: 2340281 - RNA, 18 nt, Human
ggaguuaagaccuggcag

SEQ ID NO: 2340282 - RNA, 16 nt, Human
ggaguuaagaccuggc

SEQ ID NO: 2340283 - RNA, 21 nt, Human
ggaguuagaggccagccuggc

SEQ ID NO: 2340284 - RNA, 19 nt, Human
ggaguuagaggccagccug

SEQ ID NO: 2340285 - RNA, 18 nt, Human
ggaguuagaggccagccu

SEQ ID NO: 2340286 - RNA, 16 nt, Human
ggaguuagaggccagc

SEQ ID NO: 2340287 - RNA, 15 nt, Human
ggaguuagaggccag

SEQ ID NO: 2340288 - RNA, 22 nt, Human
ggaguuacauuaauguuaauuc

SEQ ID NO: 2340289 - RNA, 23 nt, Human
ggaguuaagaccuggcagcucug

SEQ ID NO: 2340290 - RNA, 12 nt, Human
ggaguucaauga

SEQ ID NO: 2340291 - RNA, 13 nt, Human
ggaguucaaugau

SEQ ID NO: 2340292 - RNA, 12 nt, Human
ggaguuaucuaa

SEQ ID NO: 2340293 - RNA, 24 nt, Human
ggaucucauuggacccuuccaugg

SEQ ID NO: 2340294 - RNA, 17 nt, Human
ggaucucauuggacccu

SEQ ID NO: 2340295 - RNA, 10 nt, Human
ggaucucagg

SEQ ID NO: 2340296 - RNA, 18 nt, Human
ggaucuaccagcauaaau

SEQ ID NO: 2340297 - RNA, 13 nt, Human
ggaucuaccagca

SEQ ID NO: 2340298 - RNA, 12 nt, Human
ggaucuaccagc

SEQ ID NO: 2340299 - RNA, 23 nt, Human
ggaucggaggcuugucagagcug

SEQ ID NO: 2340300 - RNA, 19 nt, Human
ggaucggaggcuugucaga

SEQ ID NO: 2340301 - RNA, 18 nt, Human
ggaguucgagaccagccu

SEQ ID NO: 2340302 - RNA, 14 nt, Human
ggaguuccaugaag

SEQ ID NO: 2340303 - RNA, 15 nt, Human
ggaguuccaugaaga

SEQ ID NO: 2340304 - RNA, 19 nt, Human
ggaguuccaugaagaccac

SEQ ID NO: 2340305 - RNA, 21 nt, Human
ggaucucucaggagcacaggc

SEQ ID NO: 2340306 - RNA, 22 nt, Human
ggaucucucaggagcacaggca

SEQ ID NO: 2340307 - RNA, 21 nt, Human
ggaucuuuggacagaagcagc

SEQ ID NO: 2340308 - RNA, 16 nt, Human
ggaucuugcauuccca

SEQ ID NO: 2340309 - RNA, 14 nt, Human
ggaucuccccacuc

SEQ ID NO: 2340310 - RNA, 16 nt, Human
ggaucucucaggagca

SEQ ID NO: 2340311 - RNA, 13 nt, Human
ggaucucucagga

SEQ ID NO: 2340312 - RNA, 13 nt, Human
ggaucucaggggc

SEQ ID NO: 2340313 - RNA, 13 nt, Human
ggaucuccaagga

SEQ ID NO: 2340314 - RNA, 14 nt, Human
ggaucuccaaggac

SEQ ID NO: 2340315 - RNA, 21 nt, Human
ggaucuccaaggaccagguua

SEQ ID NO: 2340316 - RNA, 18 nt, Human
ggaucucuugagccuggg

SEQ ID NO: 2340317 - RNA, 20 nt, Human
ggaguucaaugaucuagguu

SEQ ID NO: 2340318 - RNA, 20 nt, Human
ggaguucaguggugugaucu

SEQ ID NO: 2340319 - RNA, 14 nt, Human
ggaguucaaugauc

SEQ ID NO: 2340320 - RNA, 15 nt, Human
ggaguucaaugaucu

SEQ ID NO: 2340321 - RNA, 16 nt, Human
ggaguucaaugaucua

SEQ ID NO: 2340322 - RNA, 17 nt, Human
ggaguucaaugaucuag

SEQ ID NO: 2340323 - RNA, 16 nt, Human
ggaguucaucuugaau

SEQ ID NO: 2340324 - RNA, 15 nt, Human
ggauccugagccaga

SEQ ID NO: 2340325 - RNA, 16 nt, Human
ggauccugagccagau

SEQ ID NO: 2340326 - RNA, 18 nt, Human
ggauccugagccagauuu

SEQ ID NO: 2340327 - RNA, 19 nt, Human
ggauccugagccagauuuc

SEQ ID NO: 2340328 - RNA, 20 nt, Human
ggauccugagccagauuuca

SEQ ID NO: 2340329 - RNA, 23 nt, Human
ggauccugagccagauuucacuc

SEQ ID NO: 2340330 - RNA, 15 nt, Human
ggaucuuuguggcca

SEQ ID NO: 2340331 - RNA, 17 nt, Human
ggaucuugcauucccag

SEQ ID NO: 2340332 - RNA, 22 nt, Human
ggaucuugcauucccagugguc

SEQ ID NO: 2340333 - RNA, 22 nt, Human
ggaucuuuggacagaagcagcu

SEQ ID NO: 2340334 - RNA, 14 nt, Human
ggaugaaaaaauaa

SEQ ID NO: 2340335 - RNA, 23 nt, Human
ggaugggggaacucagauccagg

SEQ ID NO: 2340336 - RNA, 20 nt, Human
ggaugggggaaauggugccu

SEQ ID NO: 2340337 - RNA, 22 nt, Human
ggaugggggcuggccucuggcu

SEQ ID NO: 2340338 - RNA, 22 nt, Human
ggaugggggaacucagauccag

SEQ ID NO: 2340339 - RNA, 21 nt, Human
ggaugggggaacucagaucca

SEQ ID NO: 2340340 - RNA, 17 nt, Human
ggaucuuuguggccaag

SEQ ID NO: 2340341 - RNA, 16 nt, Human
ggaucuuuguggccaa

SEQ ID NO: 2340342 - RNA, 18 nt, Human
ggaugaaauaacuccuuc

SEQ ID NO: 2340343 - RNA, 17 nt, Human
ggaugaaauuuucuaga

SEQ ID NO: 2340344 - RNA, 17 nt, Human
ggaugggggaacucaga

SEQ ID NO: 2340345 - RNA, 15 nt, Human
ggaugggggaacuca

SEQ ID NO: 2340346 - RNA, 16 nt, Human
ggaugguccuggggcu

SEQ ID NO: 2340347 - RNA, 14 nt, Human
ggaugguccugggg

SEQ ID NO: 2340348 - RNA, 23 nt, Human
ggaugguacuagggggaagugac

SEQ ID NO: 2340349 - RNA, 22 nt, Human
ggaugguccuggggcucugugc

SEQ ID NO: 2340350 - RNA, 20 nt, Human
ggaugguccuggggcucugu

SEQ ID NO: 2340351 - RNA, 13 nt, Human
ggauggugcccug

SEQ ID NO: 2340352 - RNA, 14 nt, Human
ggauuguaguccca

SEQ ID NO: 2340353 - RNA, 13 nt, Human
ggauuguccccga

SEQ ID NO: 2340354 - RNA, 15 nt, Human
ggauuguuccuguca

SEQ ID NO: 2340355 - RNA, 12 nt, Human
ggauuuaacaga

SEQ ID NO: 2340356 - RNA, 16 nt, Human
ggauuguccccgaccc

SEQ ID NO: 2340357 - RNA, 20 nt, Human
ggauuguccccgacccuugc

SEQ ID NO: 2340358 - RNA, 17 nt, Human
ggauuuaacagaaaugu

SEQ ID NO: 2340359 - RNA, 16 nt, Human
ggauuuaacagaaaug

SEQ ID NO: 2340360 - RNA, 22 nt, Human
ggauuuaacagaaauguacagc

SEQ ID NO: 2340361 - RNA, 21 nt, Human
ggauuuaacagucauuuaaaa

SEQ ID NO: 2340362 - RNA, 16 nt, Human
ggauuuaauuugauau

SEQ ID NO: 2340363 - RNA, 22 nt, Human
ggaggcuugucagagcugggag

SEQ ID NO: 2340364 - RNA, 20 nt, Human
ggaggcuugucagagcuggg

SEQ ID NO: 2340365 - RNA, 19 nt, Human
ggaggcuugucagagcugg

SEQ ID NO: 2340366 - RNA, 18 nt, Human
ggaggcuugucagagcug

SEQ ID NO: 2340367 - RNA, 17 nt, Human
ggaggcuugucagagcu

SEQ ID NO: 2340368 - RNA, 16 nt, Human
ggaggcuugucagagc

SEQ ID NO: 2340369 - RNA, 16 nt, Human
ggaggcuugggaccgc

SEQ ID NO: 2340370 - RNA, 15 nt, Human
ggaggcuuccugcgu

SEQ ID NO: 2340371 - RNA, 15 nt, Human
ggaggcuggcugggg

SEQ ID NO: 2340372 - RNA, 16 nt, Human
ggaggcuggcuggggc

SEQ ID NO: 2340373 - RNA, 13 nt, Human
ggaggcuggcagg

SEQ ID NO: 2340374 - RNA, 22 nt, Human
ggaggcugcccccggcccccug

SEQ ID NO: 2340375 - RNA, 12 nt, Human
ggaggcugcccc

SEQ ID NO: 2340376 - RNA, 13 nt, Human
ggaggcugccccc

SEQ ID NO: 2340377 - RNA, 17 nt, Human
ggaggcugcccccggcc

SEQ ID NO: 2340378 - RNA, 21 nt, Human
ggaggcugcccccggcccccu

SEQ ID NO: 2340379 - RNA, 14 nt, Human
ggagggucaggaag

SEQ ID NO: 2340380 - RNA, 18 nt, Human
ggagggggcuugaagcca

SEQ ID NO: 2340381 - RNA, 21 nt, Human
ggagggggcuugaagccaaag

SEQ ID NO: 2340382 - RNA, 12 nt, Human
ggaggggggagc

SEQ ID NO: 2340383 - RNA, 15 nt, Human
ggaggggggagccau

SEQ ID NO: 2340384 - RNA, 14 nt, Human
ggaggggggaggug

SEQ ID NO: 2340385 - RNA, 16 nt, Human
ggagggggcuugaagc

SEQ ID NO: 2340386 - RNA, 14 nt, Human
ggagggggauccga

SEQ ID NO: 2340387 - RNA, 13 nt, Human
ggaggggggaggu

SEQ ID NO: 2340388 - RNA, 20 nt, Human
ggaggcuaaagcccagagac

SEQ ID NO: 2340389 - RNA, 20 nt, Human
ggaggcggagaguacaguga

SEQ ID NO: 2340390 - RNA, 21 nt, Human
ggaggcucacccccuucucca

SEQ ID NO: 2340391 - RNA, 20 nt, Human
ggaggcggagcuugcaguga

SEQ ID NO: 2340392 - RNA, 20 nt, Human
ggaggcggauguugaaguga

SEQ ID NO: 2340393 - RNA, 19 nt, Human
ggaggcggacguuccagcc

SEQ ID NO: 2340394 - RNA, 22 nt, Human
ggaggcggacguuccagccggc

SEQ ID NO: 2340395 - RNA, 12 nt, Human
ggaggcggagag

SEQ ID NO: 2340396 - RNA, 10 nt, Human
ggaggcugcc

SEQ ID NO: 2340397 - RNA, 15 nt, Human
ggaggcucagguccc

SEQ ID NO: 2340398 - RNA, 15 nt, Human
ggaggcuccagaggg

SEQ ID NO: 2340399 - RNA, 18 nt, Human
ggaggcuccagagggcac

SEQ ID NO: 2340400 - RNA, 16 nt, Human
ggaggcuccagagggc

SEQ ID NO: 2340401 - RNA, 14 nt, Human
ggaggugucaggcu

SEQ ID NO: 2340402 - RNA, 15 nt, Human
ggaggugucaggcug

SEQ ID NO: 2340403 - RNA, 16 nt, Human
ggaggugucaggcugc

SEQ ID NO: 2340404 - RNA, 13 nt, Human
ggagguggcuggg

SEQ ID NO: 2340405 - RNA, 18 nt, Human
ggagguggcuauggccac

SEQ ID NO: 2340406 - RNA, 17 nt, Human
ggagguggggaugagaa

SEQ ID NO: 2340407 - RNA, 16 nt, Human
ggaggugggagcagga

SEQ ID NO: 2340408 - RNA, 19 nt, Human
ggaggugggagcaggagau

SEQ ID NO: 2340409 - RNA, 22 nt, Human
ggaggugggauccuccaggugc

SEQ ID NO: 2340410 - RNA, 23 nt, Human
ggaggugggauccuccaggugca

SEQ ID NO: 2340411 - RNA, 16 nt, Human
ggagggucaggaagga

SEQ ID NO: 2340412 - RNA, 15 nt, Human
ggagggucaggaagg

SEQ ID NO: 2340413 - RNA, 14 nt, Human
ggagggucccaagc

SEQ ID NO: 2340414 - RNA, 20 nt, Human
ggagggucccaagcugggcc

SEQ ID NO: 2340415 - RNA, 15 nt, Human
ggaggguggcaggug

SEQ ID NO: 2340416 - RNA, 21 nt, Human
ggagggucccaagcugggccc

SEQ ID NO: 2340417 - RNA, 21 nt, Human
ggagggugacgggggugaacu

SEQ ID NO: 2340418 - RNA, 17 nt, Human
ggagguggcagcccugu

SEQ ID NO: 2340419 - RNA, 15 nt, Human
ggagguggcagcccu

SEQ ID NO: 2340420 - RNA, 19 nt, Human
ggagggugggagagcccag

SEQ ID NO: 2340421 - RNA, 22 nt, Human
ggagguaaggaauaccuguccc

SEQ ID NO: 2340422 - RNA, 17 nt, Human
ggccucccacagacuca

SEQ ID NO: 2340423 - RNA, 11 nt, Human
ggccucccaca

SEQ ID NO: 2340424 - RNA, 13 nt, Human
ggccucccacagu

SEQ ID NO: 2340425 - RNA, 14 nt, Human
ggccucccacagug

SEQ ID NO: 2340426 - RNA, 15 nt, Human
ggccucccacaguga

SEQ ID NO: 2340427 - RNA, 11 nt, Human
ggccucccacc

SEQ ID NO: 2340428 - RNA, 12 nt, Human
ggccucccaccc

SEQ ID NO: 2340429 - RNA, 13 nt, Human
ggccucccacccg

SEQ ID NO: 2340430 - RNA, 16 nt, Human
ggccucccacagacuc

SEQ ID NO: 2340431 - RNA, 14 nt, Human
ggccucccacagac

SEQ ID NO: 2340432 - RNA, 22 nt, Human
ggccucaguggacuuuccaccc

SEQ ID NO: 2340433 - RNA, 20 nt, Human
ggccucaguggacuuuccac

SEQ ID NO: 2340434 - RNA, 14 nt, Human
ggccucauguggcu

SEQ ID NO: 2340435 - RNA, 23 nt, Human
ggccucccaacucaccccagccc

SEQ ID NO: 2340436 - RNA, 20 nt, Human
ggccucccaacucaccccag

SEQ ID NO: 2340437 - RNA, 22 nt, Human
ggccucccaacucaccccagcc

SEQ ID NO: 2340438 - RNA, 13 nt, Human
ggccucagugcca

SEQ ID NO: 2340439 - RNA, 17 nt, Human
ggccucccaacucaccc

SEQ ID NO: 2340440 - RNA, 18 nt, Human
ggccucccaacucacccc

SEQ ID NO: 2340441 - RNA, 19 nt, Human
ggccucccaacucacccca

SEQ ID NO: 2340442 - RNA, 16 nt, Human
ggccucagcugccuca

SEQ ID NO: 2340443 - RNA, 15 nt, Human
ggccucagcugccuc

SEQ ID NO: 2340444 - RNA, 13 nt, Human
ggccucagcugcc

SEQ ID NO: 2340445 - RNA, 16 nt, Human
ggccgcuagaugggca

SEQ ID NO: 2340446 - RNA, 19 nt, Human
ggccgcuagaugggcaugg

SEQ ID NO: 2340447 - RNA, 13 nt, Human
ggccgcuagaggc

SEQ ID NO: 2340448 - RNA, 14 nt, Human
ggccgcuagaggcc

SEQ ID NO: 2340449 - RNA, 15 nt, Human
ggccgcuagaggccu

SEQ ID NO: 2340450 - RNA, 17 nt, Human
ggccgcuagaggccuga

SEQ ID NO: 2340451 - RNA, 18 nt, Human
ggccgcuagaggccugag

SEQ ID NO: 2340452 - RNA, 19 nt, Human
ggccgcuagaggccugagg

SEQ ID NO: 2340453 - RNA, 20 nt, Human
ggccgcuagaggccugagga

SEQ ID NO: 2340454 - RNA, 21 nt, Human
ggccgcuagaggccugaggau

SEQ ID NO: 2340455 - RNA, 22 nt, Human
ggccucagcugccucacuuccu

SEQ ID NO: 2340456 - RNA, 17 nt, Human
ggccucagcugccucac

SEQ ID NO: 2340457 - RNA, 17 nt, Human
ggccucagguuugccug

SEQ ID NO: 2340458 - RNA, 11 nt, Human
ggccucagucu

SEQ ID NO: 2340459 - RNA, 20 nt, Human
ggccucagucucccuucucc

SEQ ID NO: 2340460 - RNA, 22 nt, Human
ggcccucaccccugcccuggga

SEQ ID NO: 2340461 - RNA, 21 nt, Human
ggcccucaccccugcccuggg

SEQ ID NO: 2340462 - RNA, 20 nt, Human
ggcccucaccccugcccugg

SEQ ID NO: 2340463 - RNA, 18 nt, Human
ggcccucaccccugcccu

SEQ ID NO: 2340464 - RNA, 15 nt, Human
ggcccucaccccugc

SEQ ID NO: 2340465 - RNA, 20 nt, Human
ggcccucaaggccucccaca

SEQ ID NO: 2340466 - RNA, 23 nt, Human
ggcccucaaggccucccacagug

SEQ ID NO: 2340467 - RNA, 16 nt, Human
ggccgcccccugcccc

SEQ ID NO: 2340468 - RNA, 18 nt, Human
ggccgcccccugcccccc

SEQ ID NO: 2340469 - RNA, 19 nt, Human
ggccgcccccugcccccca

SEQ ID NO: 2340470 - RNA, 22 nt, Human
ggccgcccccugccccccagcc

SEQ ID NO: 2340471 - RNA, 12 nt, Human
ggccgccucacc

SEQ ID NO: 2340472 - RNA, 13 nt, Human
ggccgccucaccc

SEQ ID NO: 2340473 - RNA, 14 nt, Human
ggccgccgccucuu

SEQ ID NO: 2340474 - RNA, 14 nt, Human
ggccgccucacccc

SEQ ID NO: 2340475 - RNA, 22 nt, Human
ggccgcgccaaauaaugucucu

SEQ ID NO: 2340476 - RNA, 18 nt, Human
ggccccagccuggcccag

SEQ ID NO: 2340477 - RNA, 13 nt, Human
ggcccgugacaga

SEQ ID NO: 2340478 - RNA, 16 nt, Human
ggccccagccuggccc

SEQ ID NO: 2340479 - RNA, 17 nt, Human
ggccccagccuggccca

SEQ ID NO: 2340480 - RNA, 16 nt, Human
ggcccguugaggauga

SEQ ID NO: 2340481 - RNA, 20 nt, Human
ggcccguugaggaugaggcc

SEQ ID NO: 2340482 - RNA, 22 nt, Human
ggcccguugaggaugaggccgc

SEQ ID NO: 2340483 - RNA, 17 nt, Human
ggcccguugucucccug

SEQ ID NO: 2340484 - RNA, 15 nt, Human
ggcccgucauguucc

SEQ ID NO: 2340485 - RNA, 21 nt, Human
ggccccugccucucugcaggu

SEQ ID NO: 2340486 - RNA, 16 nt, Human
ggcccuaccagcgccc

SEQ ID NO: 2340487 - RNA, 21 nt, Human
ggcccuaccagcgcccgcugg

SEQ ID NO: 2340488 - RNA, 22 nt, Human
ggcccuaccagcgcccgcuggg

SEQ ID NO: 2340489 - RNA, 16 nt, Human
ggcccucaaggccucc

SEQ ID NO: 2340490 - RNA, 18 nt, Human
ggcccucaaggccuccca

SEQ ID NO: 2340491 - RNA, 19 nt, Human
ggcccucaaggccucccac

SEQ ID NO: 2340492 - RNA, 18 nt, Human
ggcccguugucucccugg

SEQ ID NO: 2340493 - RNA, 19 nt, Human
ggcccguugucucccuggc

SEQ ID NO: 2340494 - RNA, 20 nt, Human
ggcccguugucucccuggcc

SEQ ID NO: 2340495 - RNA, 21 nt, Human
ggcccguugucucccuggccc

SEQ ID NO: 2340496 - RNA, 22 nt, Human
ggcccguugucucccuggcccu

SEQ ID NO: 2340497 - RNA, 23 nt, Human
ggcccguugucucccuggcccuc

SEQ ID NO: 2340498 - RNA, 24 nt, Human
ggcccguugucucccuggcccuca

SEQ ID NO: 2340499 - RNA, 13 nt, Human
ggccccugccucu

SEQ ID NO: 2340500 - RNA, 12 nt, Human
ggccccagccug

SEQ ID NO: 2340501 - RNA, 13 nt, Human
ggccccagccugg

SEQ ID NO: 2340502 - RNA, 14 nt, Human
ggccccagccuggc

SEQ ID NO: 2340503 - RNA, 15 nt, Human
ggccccagccuggcc

SEQ ID NO: 2340504 - RNA, 17 nt, Human
ggccccugccucucugc

SEQ ID NO: 2340505 - RNA, 18 nt, Human
ggccccugccucucugca

SEQ ID NO: 2340506 - RNA, 19 nt, Human
ggccccugccucucugcag

SEQ ID NO: 2340507 - RNA, 21 nt, Human
ggccccagcacuaaagcagug

SEQ ID NO: 2340508 - RNA, 11 nt, Human
ggccccagcca

SEQ ID NO: 2340509 - RNA, 16 nt, Human
ggccccagcacuaaag

SEQ ID NO: 2340510 - RNA, 13 nt, Human
ggccccagcacua

SEQ ID NO: 2340511 - RNA, 18 nt, Human
ggccccagcacagcuuga

SEQ ID NO: 2340512 - RNA, 13 nt, Human
ggccccagccucc

SEQ ID NO: 2340513 - RNA, 19 nt, Human
ggccccagcccacccuccu

SEQ ID NO: 2340514 - RNA, 11 nt, Human
ggccccagccu

SEQ ID NO: 2340515 - RNA, 23 nt, Human
ggccccagcccacccuccugucu

SEQ ID NO: 2340516 - RNA, 12 nt, Human
ggccccagccag

SEQ ID NO: 2340517 - RNA, 13 nt, Human
ggccccagccaga

SEQ ID NO: 2340518 - RNA, 21 nt, Human
ggccccagccagaguuccugc

SEQ ID NO: 2340519 - RNA, 12 nt, Human
ggccccagccca

SEQ ID NO: 2340520 - RNA, 13 nt, Human
ggccccagcccac

SEQ ID NO: 2340521 - RNA, 14 nt, Human
ggccccagcccacc

SEQ ID NO: 2340522 - RNA, 15 nt, Human
ggccccagcccaccc

SEQ ID NO: 2340523 - RNA, 16 nt, Human
ggccccagcccacccu

SEQ ID NO: 2340524 - RNA, 18 nt, Human
ggccagauccagccuggg

SEQ ID NO: 2340525 - RNA, 17 nt, Human
ggccagauccagccugg

SEQ ID NO: 2340526 - RNA, 22 nt, Human
ggccagagggagugacagaggc

SEQ ID NO: 2340527 - RNA, 11 nt, Human
ggccagaggcu

SEQ ID NO: 2340528 - RNA, 22 nt, Human
ggccagaggcccccagcccagg

SEQ ID NO: 2340529 - RNA, 15 nt, Human
ggccagaugcaccag

SEQ ID NO: 2340530 - RNA, 16 nt, Human
ggccagaugcaccagc

SEQ ID NO: 2340531 - RNA, 21 nt, Human
ggcgaucgcggcggagcuggc

SEQ ID NO: 2340532 - RNA, 16 nt, Human
ggcgagugccaggacu

SEQ ID NO: 2340533 - RNA, 14 nt, Human
ggcgcaagccugua

SEQ ID NO: 2340534 - RNA, 21 nt, Human
ggcgucuguucccccuucaca

SEQ ID NO: 2340535 - RNA, 16 nt, Human
ggcgugagaccugccc

SEQ ID NO: 2340536 - RNA, 14 nt, Human
ggcgugagaccugc

SEQ ID NO: 2340537 - RNA, 15 nt, Human
ggcgugacucaccca

SEQ ID NO: 2340538 - RNA, 22 nt, Human
ggcgcaagccuguaaucccagc

SEQ ID NO: 2340539 - RNA, 15 nt, Human
ggcgugaggauggga

SEQ ID NO: 2340540 - RNA, 12 nt, Human
ggcgugaucucg

SEQ ID NO: 2340541 - RNA, 18 nt, Human
ggcgugagaccugccccu

SEQ ID NO: 2340542 - RNA, 17 nt, Human
ggcgugagaccugcccc

SEQ ID NO: 2340543 - RNA, 17 nt, Human
ggcgugacucacccaag

SEQ ID NO: 2340544 - RNA, 11 nt, Human
ggcguuucuuu

SEQ ID NO: 2340545 - RNA, 21 nt, Human
ggcuaaacauccaauauuuuc

SEQ ID NO: 2340546 - RNA, 15 nt, Human
ggcuaacuggaagca

SEQ ID NO: 2340547 - RNA, 19 nt, Human
ggcuaagagcuagcgcugc

SEQ ID NO: 2340548 - RNA, 17 nt, Human
ggcuaacuauauuugcu

SEQ ID NO: 2340549 - RNA, 20 nt, Human
ggcuaagcuucacuguaaaa

SEQ ID NO: 2340550 - RNA, 17 nt, Human
ggccuuccccagccucu

SEQ ID NO: 2340551 - RNA, 15 nt, Human
ggccuuccccagccu

SEQ ID NO: 2340552 - RNA, 16 nt, Human
ggccuucggccuccau

SEQ ID NO: 2340553 - RNA, 22 nt, Human
ggccuucggccuccauccugag

SEQ ID NO: 2340554 - RNA, 18 nt, Human
ggccuucggccuccaucc

SEQ ID NO: 2340555 - RNA, 22 nt, Human
ggcgauccaccugucucagccu

SEQ ID NO: 2340556 - RNA, 18 nt, Human
ggcgauccaccugucuca

SEQ ID NO: 2340557 - RNA, 17 nt, Human
ggcgauccaccugucuc

SEQ ID NO: 2340558 - RNA, 20 nt, Human
ggcgaucacaacgugcauug

SEQ ID NO: 2340559 - RNA, 16 nt, Human
ggcgagucacugccuc

SEQ ID NO: 2340560 - RNA, 21 nt, Human
ggcgaggggaggguggcaggu

SEQ ID NO: 2340561 - RNA, 19 nt, Human
ggcgaggcagaggacagau

SEQ ID NO: 2340562 - RNA, 15 nt, Human
ggcgagucacugccu

SEQ ID NO: 2340563 - RNA, 15 nt, Human
ggcgagugccaggac

SEQ ID NO: 2340564 - RNA, 18 nt, Human
ggcgaucacaacgugcau

SEQ ID NO: 2340565 - RNA, 16 nt, Human
ggccuuccccagccuc

SEQ ID NO: 2340566 - RNA, 13 nt, Human
ggccuuccugccc

SEQ ID NO: 2340567 - RNA, 14 nt, Human
ggccuuccugcccu

SEQ ID NO: 2340568 - RNA, 14 nt, Human
ggcgagaggagggg

SEQ ID NO: 2340569 - RNA, 15 nt, Human
ggcgagaggaggggc

SEQ ID NO: 2340570 - RNA, 21 nt, Human
ggcgagcccuguggaugagcc

SEQ ID NO: 2340571 - RNA, 11 nt, Human
ggcgaggcaga

SEQ ID NO: 2340572 - RNA, 12 nt, Human
ggcgaggcagag

SEQ ID NO: 2340573 - RNA, 13 nt, Human
ggcgaggcagagg

SEQ ID NO: 2340574 - RNA, 15 nt, Human
ggcgaggcagaggac

SEQ ID NO: 2340575 - RNA, 18 nt, Human
ggcuagaggccagcccca

SEQ ID NO: 2340576 - RNA, 14 nt, Human
ggcuagaaucugga

SEQ ID NO: 2340577 - RNA, 16 nt, Human
ggcuagaaucuggaga

SEQ ID NO: 2340578 - RNA, 16 nt, Human
ggcuagaggccagccc

SEQ ID NO: 2340579 - RNA, 20 nt, Human
ggcuagaggccagccccacc

SEQ ID NO: 2340580 - RNA, 22 nt, Human
ggcuagaaucuggagagcuaga

SEQ ID NO: 2340581 - RNA, 19 nt, Human
ggcucacuauggugccaau

SEQ ID NO: 2340582 - RNA, 16 nt, Human
ggcuagagguucaaag

SEQ ID NO: 2340583 - RNA, 18 nt, Human
ggcuacugcagcuuuaca

SEQ ID NO: 2340584 - RNA, 23 nt, Human
ggcuacugcagcuuuacaugcaa

SEQ ID NO: 2340585 - RNA, 21 nt, Human
ggcuagaaccaagaagggcua

SEQ ID NO: 2340586 - RNA, 21 nt, Human
ggcuagaaccuagaagggcua

SEQ ID NO: 2340587 - RNA, 16 nt, Human
ggcuagaaccuggaga

SEQ ID NO: 2340588 - RNA, 22 nt, Human
ggcuagaaccuggagagcuaga

SEQ ID NO: 2340589 - RNA, 16 nt, Human
ggcuagaaccuggagg

SEQ ID NO: 2340590 - RNA, 18 nt, Human
ggcuagaaccuggagggc

SEQ ID NO: 2340591 - RNA, 14 nt, Human
ggcuagaaccuggc

SEQ ID NO: 2340592 - RNA, 22 nt, Human
ggcuagaaccuguagagcuaga

SEQ ID NO: 2340593 - RNA, 15 nt, Human
ggcuagaacuggaga

SEQ ID NO: 2340594 - RNA, 18 nt, Human
ggcuagaauauccuacuu

SEQ ID NO: 2340595 - RNA, 13 nt, Human
ggcuagaaucugg

SEQ ID NO: 2340596 - RNA, 21 nt, Human
ggcuacucagcagcccuccuc

SEQ ID NO: 2340597 - RNA, 20 nt, Human
ggcuacucagcagcccuccu

SEQ ID NO: 2340598 - RNA, 18 nt, Human
ggcuacucagcagcccuc

SEQ ID NO: 2340599 - RNA, 17 nt, Human
ggcuacucagcagcccu

SEQ ID NO: 2340600 - RNA, 19 nt, Human
ggcuacucuccucggcccc

SEQ ID NO: 2340601 - RNA, 15 nt, Human
ggcuacugcagcuuu

SEQ ID NO: 2340602 - RNA, 12 nt, Human
ggcuacccuccc

SEQ ID NO: 2340603 - RNA, 19 nt, Human
ggcuacccugagcugaggc

SEQ ID NO: 2340604 - RNA, 15 nt, Human
ggcuacucagcagcc

SEQ ID NO: 2340605 - RNA, 16 nt, Human
ggcuacucagcagccc

SEQ ID NO: 2340606 - RNA, 14 nt, Human
ggcuaccuuuguau

SEQ ID NO: 2340607 - RNA, 16 nt, Human
ggcuaauguacugcau

SEQ ID NO: 2340608 - RNA, 20 nt, Human
ggcuaagugauccucccacc

SEQ ID NO: 2340609 - RNA, 19 nt, Human
ggcuaaggcguggagcugc

SEQ ID NO: 2340610 - RNA, 22 nt, Human
ggcuaaggcguggagcugccug

SEQ ID NO: 2340611 - RNA, 15 nt, Human
ggcuaauuaaauaaa

SEQ ID NO: 2340612 - RNA, 19 nt, Human
ggcuaagaguguccuagga

SEQ ID NO: 2340613 - RNA, 14 nt, Human
ggcuaacuggaagc

SEQ ID NO: 2340614 - RNA, 20 nt, Human
ggcuaagagcuagcgcugcc

SEQ ID NO: 2340615 - RNA, 18 nt, Human
ggcuaauuuuuguuuugu

SEQ ID NO: 2340616 - RNA, 19 nt, Human
ggcuaauucccagagugug

SEQ ID NO: 2340617 - RNA, 23 nt, Human
ggcuaauucccagagugugaaac

SEQ ID NO: 2340618 - RNA, 23 nt, Human
ggcuacaccuuagccugcccucc

SEQ ID NO: 2340619 - RNA, 15 nt, Human
ggcuacacagggaug

SEQ ID NO: 2340620 - RNA, 22 nt, Human
ggcuacaccuuagccugcccuc

SEQ ID NO: 2340621 - RNA, 13 nt, Human
ggcuaauuuuugu

SEQ ID NO: 2340622 - RNA, 23 nt, Human
ggcuacaauuuucucccaggaag

SEQ ID NO: 2340623 - RNA, 12 nt, Human
ggcuacacaggg

SEQ ID NO: 2340624 - RNA, 13 nt, Human
ggcuaccuuugua

SEQ ID NO: 2340625 - RNA, 12 nt, Human
ggccuggcacag

SEQ ID NO: 2340626 - RNA, 22 nt, Human
ggccuggcacagugucugggcu

SEQ ID NO: 2340627 - RNA, 14 nt, Human
ggccuggcagccgu

SEQ ID NO: 2340628 - RNA, 15 nt, Human
ggccuggcagccgug

SEQ ID NO: 2340629 - RNA, 12 nt, Human
ggccuggccaga

SEQ ID NO: 2340630 - RNA, 15 nt, Human
ggccuggccagaugc

SEQ ID NO: 2340631 - RNA, 16 nt, Human
ggccuggccagaugca

SEQ ID NO: 2340632 - RNA, 21 nt, Human
ggccuguuuuagaagguucuc

SEQ ID NO: 2340633 - RNA, 17 nt, Human
ggccuggcacaucagaa

SEQ ID NO: 2340634 - RNA, 14 nt, Human
ggccuggccaccuc

SEQ ID NO: 2340635 - RNA, 16 nt, Human
ggccuggccaccucuc

SEQ ID NO: 2340636 - RNA, 17 nt, Human
ggccuggccaccucucu

SEQ ID NO: 2340637 - RNA, 17 nt, Human
ggccuucagggagugag

SEQ ID NO: 2340638 - RNA, 19 nt, Human
ggccugcugggcucuccac

SEQ ID NO: 2340639 - RNA, 17 nt, Human
ggccugcugggcucucc

SEQ ID NO: 2340640 - RNA, 20 nt, Human
ggccuggagauccuccugca

SEQ ID NO: 2340641 - RNA, 15 nt, Human
ggccuggagcaggcc

SEQ ID NO: 2340642 - RNA, 16 nt, Human
ggccuggagcaggccu

SEQ ID NO: 2340643 - RNA, 19 nt, Human
ggccuggagcaggccuugc

SEQ ID NO: 2340644 - RNA, 21 nt, Human
ggccuggagcaggccuugcgc

SEQ ID NO: 2340645 - RNA, 19 nt, Human
ggccuggaggugggguugg

SEQ ID NO: 2340646 - RNA, 21 nt, Human
ggccuggaucuccccacucua

SEQ ID NO: 2340647 - RNA, 16 nt, Human
ggccuggauucauuuc

SEQ ID NO: 2340648 - RNA, 17 nt, Human
ggccuggauucauuucc

SEQ ID NO: 2340649 - RNA, 19 nt, Human
ggccuggauucauuuccug

SEQ ID NO: 2340650 - RNA, 20 nt, Human
ggccuggauucauuuccugc

SEQ ID NO: 2340651 - RNA, 22 nt, Human
ggccuggauucauuuccugccc

SEQ ID NO: 2340652 - RNA, 18 nt, Human
ggccugccuugaagccac

SEQ ID NO: 2340653 - RNA, 11 nt, Human
ggccugccugu

SEQ ID NO: 2340654 - RNA, 18 nt, Human
ggccugccuccagggcug

SEQ ID NO: 2340655 - RNA, 19 nt, Human
ggccugccuccagggcugg

SEQ ID NO: 2340656 - RNA, 20 nt, Human
ggccugccuccagggcugga

SEQ ID NO: 2340657 - RNA, 18 nt, Human
ggccugcuccagaccuga

SEQ ID NO: 2340658 - RNA, 17 nt, Human
ggccugcucccagcagc

SEQ ID NO: 2340659 - RNA, 18 nt, Human
ggccugcucccagcagcc

SEQ ID NO: 2340660 - RNA, 17 nt, Human
ggccugcuccagaccug

SEQ ID NO: 2340661 - RNA, 16 nt, Human
ggccugcuccagaccu

SEQ ID NO: 2340662 - RNA, 15 nt, Human
ggccugcuccagacc

SEQ ID NO: 2340663 - RNA, 14 nt, Human
ggccugcuccagac

SEQ ID NO: 2340664 - RNA, 13 nt, Human
ggccugcuccaga

SEQ ID NO: 2340665 - RNA, 14 nt, Human
ggccugaugcuccc

SEQ ID NO: 2340666 - RNA, 20 nt, Human
ggccugaugcucccuccccu

SEQ ID NO: 2340667 - RNA, 18 nt, Human
ggccugaugcucccuccc

SEQ ID NO: 2340668 - RNA, 17 nt, Human
ggccugaugcucccucc

SEQ ID NO: 2340669 - RNA, 15 nt, Human
ggccugaugcucccu

SEQ ID NO: 2340670 - RNA, 23 nt, Human
ggccugaugcucccuccccugcc

SEQ ID NO: 2340671 - RNA, 22 nt, Human
ggccugaugcucccuccccugc

SEQ ID NO: 2340672 - RNA, 16 nt, Human
ggccugcaagggagug

SEQ ID NO: 2340673 - RNA, 13 nt, Human
ggccugccagacg

SEQ ID NO: 2340674 - RNA, 16 nt, Human
ggccugcccucaggga

SEQ ID NO: 2340675 - RNA, 17 nt, Human
ggccugcccucagggau

SEQ ID NO: 2340676 - RNA, 13 nt, Human
ggccugcacuaau

SEQ ID NO: 2340677 - RNA, 17 nt, Human
ggccugcaggaccugcc

SEQ ID NO: 2340678 - RNA, 21 nt, Human
ggccugcaggaccugccugua

SEQ ID NO: 2340679 - RNA, 20 nt, Human
ggccugcaggaccugccugu

SEQ ID NO: 2340680 - RNA, 14 nt, Human
ggccugcacaguga

SEQ ID NO: 2340681 - RNA, 17 nt, Human
ggccugcacggugggcc

SEQ ID NO: 2340682 - RNA, 19 nt, Human
ggccugcacggugggccuu

SEQ ID NO: 2340683 - RNA, 21 nt, Human
ggccugcacggugggccuugc

SEQ ID NO: 2340684 - RNA, 21 nt, Human
ggcuggccuaggagauaucug

SEQ ID NO: 2340685 - RNA, 12 nt, Human
ggcuggcccagc

SEQ ID NO: 2340686 - RNA, 19 nt, Human
ggcuggccucuggcucuca

SEQ ID NO: 2340687 - RNA, 20 nt, Human
ggcuggccucccaaaugagc

SEQ ID NO: 2340688 - RNA, 17 nt, Human
ggcuggcccugcccugg

SEQ ID NO: 2340689 - RNA, 22 nt, Human
ggcuggccaguccaggcugccg

SEQ ID NO: 2340690 - RNA, 19 nt, Human
ggcuggccagccccacagc

SEQ ID NO: 2340691 - RNA, 13 nt, Human
ggcuggccuggcc

SEQ ID NO: 2340692 - RNA, 14 nt, Human
ggcuggccuggccc

SEQ ID NO: 2340693 - RNA, 15 nt, Human
ggcuggccuggcccc

SEQ ID NO: 2340694 - RNA, 11 nt, Human
aaaaaaagaaa

SEQ ID NO: 2340695 - RNA, 9 nt, Human
aaaaaaaga

SEQ ID NO: 2340696 - RNA, 10 nt, Human
aaaaaaagaa

SEQ ID NO: 2340697 - RNA, 11 nt, Human
aaaaaaagaca

SEQ ID NO: 2340698 - RNA, 13 nt, Human
aaaaaaagacaag

SEQ ID NO: 2340699 - RNA, 14 nt, Human
aaaaaaagaucugu

SEQ ID NO: 2340700 - RNA, 10 nt, Human
aaaaaaagag

SEQ ID NO: 2340701 - RNA, 23 nt, Human
aaaaagauuuucagaaaauauua

SEQ ID NO: 2340702 - RNA, 15 nt, Human
aaaaaacagaggcca

SEQ ID NO: 2340703 - RNA, 9 nt, Human
aaaaaagaa

SEQ ID NO: 2340704 - RNA, 11 nt, Human
aaaaaaauuug

SEQ ID NO: 2340705 - RNA, 19 nt, Human
aaaaaacucgaggacugua

SEQ ID NO: 2340706 - RNA, 13 nt, Human
aaaaagcagcuac

SEQ ID NO: 2340707 - RNA, 21 nt, Human
aaaaagcagcuaccagguguu

SEQ ID NO: 2340708 - RNA, 13 nt, Human
aaaaagauuuguu

SEQ ID NO: 2340709 - RNA, 13 nt, Human
aaaaagcacaaga

SEQ ID NO: 2340710 - RNA, 14 nt, Human
aaaaagcacaagaa

SEQ ID NO: 2340711 - RNA, 15 nt, Human
aaaaagcacaagaag

SEQ ID NO: 2340712 - RNA, 12 nt, Human
aaaaagcaugua

SEQ ID NO: 2340713 - RNA, 14 nt, Human
aaaaagcauguaca

SEQ ID NO: 2340714 - RNA, 15 nt, Human
aaaaagcauguacag

SEQ ID NO: 2340715 - RNA, 17 nt, Human
aaaaagcauguacagug

SEQ ID NO: 2340716 - RNA, 18 nt, Human
aaaaagcauguacagugu

SEQ ID NO: 2340717 - RNA, 21 nt, Human
aaaaagcauguacaguguucu

SEQ ID NO: 2340718 - RNA, 22 nt, Human
aaaaaacugcugacuguuuucu

SEQ ID NO: 2340719 - RNA, 11 nt, Human
aaaaaaauuua

SEQ ID NO: 2340720 - RNA, 13 nt, Human
aaaaaaaugacua

SEQ ID NO: 2340721 - RNA, 13 nt, Human
aaaaaaaugcuga

SEQ ID NO: 2340722 - RNA, 11 nt, Human
aaaaaaaugcc

SEQ ID NO: 2340723 - RNA, 12 nt, Human
aaaaaaaugacu

SEQ ID NO: 2340724 - RNA, 12 nt, Human
aaaaaaaugaca

SEQ ID NO: 2340725 - RNA, 14 nt, Human
aaaaaaaucugcag

SEQ ID NO: 2340726 - RNA, 12 nt, Human
aaaaaaauaaua

SEQ ID NO: 2340727 - RNA, 13 nt, Human
aaaaaaauacuug

SEQ ID NO: 2340728 - RNA, 11 nt, Human
aaaaaaaguua

SEQ ID NO: 2340729 - RNA, 14 nt, Human
aaaaaaaguauuau

SEQ ID NO: 2340730 - RNA, 12 nt, Human
aaaaaaaguauu

SEQ ID NO: 2340731 - RNA, 14 nt, Human
aaaaaggaggaaga

SEQ ID NO: 2340732 - RNA, 20 nt, Human
aaaaagccugcaauuucaua

SEQ ID NO: 2340733 - RNA, 17 nt, Human
aaaaagccuccagucca

SEQ ID NO: 2340734 - RNA, 20 nt, Human
aaaaagcauguacaguguuc

SEQ ID NO: 2340735 - RNA, 12 nt, Human
aaaaaggcagga

SEQ ID NO: 2340736 - RNA, 21 nt, Human
aaaaaggaugcacagaguugu

SEQ ID NO: 2340737 - RNA, 17 nt, Human
aaaaaguuugccagaag

SEQ ID NO: 2340738 - RNA, 14 nt, Human
aaaaaguuuccaua

SEQ ID NO: 2340739 - RNA, 18 nt, Human
aaaaaguuugccagaagu

SEQ ID NO: 2340740 - RNA, 19 nt, Human
aaaaaguuugguucugugu

SEQ ID NO: 2340741 - RNA, 17 nt, Human
aaaaaguuuacaagugu

SEQ ID NO: 2340742 - RNA, 17 nt, Human
aaaaaggcauuguuuga

SEQ ID NO: 2340743 - RNA, 19 nt, Human
aaaaaggcauauugcuuuu

SEQ ID NO: 2340744 - RNA, 14 nt, Human
aaaaauaaaaaaca

SEQ ID NO: 2340745 - RNA, 13 nt, Human
aaaaaguuuguuu

SEQ ID NO: 2340746 - RNA, 16 nt, Human
aaaaaguuuuaguuuu

SEQ ID NO: 2340747 - RNA, 14 nt, Human
ggcuggguuggagg

SEQ ID NO: 2340748 - RNA, 22 nt, Human
ggcuggguucuacccaggugcu

SEQ ID NO: 2340749 - RNA, 17 nt, Human
ggcugguagcucaggug

SEQ ID NO: 2340750 - RNA, 21 nt, Human
ggcugguagcucaggugggcg

SEQ ID NO: 2340751 - RNA, 19 nt, Human
ggcugguaacaguucaugu

SEQ ID NO: 2340752 - RNA, 15 nt, Human
ggcugguagcucagg

SEQ ID NO: 2340753 - RNA, 16 nt, Human
ggcugguagcucaggu

SEQ ID NO: 2340754 - RNA, 22 nt, Human
aaaaauacuugucaauauuuaa

SEQ ID NO: 2340755 - RNA, 15 nt, Human
aaaaauacuugucaa

SEQ ID NO: 2340756 - RNA, 16 nt, Human
ggcuggguuggcgcac

SEQ ID NO: 2340757 - RNA, 19 nt, Human
ggcuggguuggcgcacccu

SEQ ID NO: 2340758 - RNA, 20 nt, Human
ggcuggguuggcgcacccuc

SEQ ID NO: 2340759 - RNA, 11 nt, Human
aaaaauacugc

SEQ ID NO: 2340760 - RNA, 15 nt, Human
aaaaauacauuuuau

SEQ ID NO: 2340761 - RNA, 10 nt, Human
aaaaauacuu

SEQ ID NO: 2340762 - RNA, 19 nt, Human
aaaaauaaucuauuucuau

SEQ ID NO: 2340763 - RNA, 14 nt, Human
aaaaauacauuuua

SEQ ID NO: 2340764 - RNA, 14 nt, Human
aaaaauacaugcau

SEQ ID NO: 2340765 - RNA, 21 nt, Human
aaaaauaaaaacugacuccuu

SEQ ID NO: 2340766 - RNA, 17 nt, Human
aaaaaguuuuauuuuuc

SEQ ID NO: 2340767 - RNA, 23 nt, Human
aaaaaguuuugcccuuuuuaagg

SEQ ID NO: 2340768 - RNA, 14 nt, Human
aaaaauaaaacauu

SEQ ID NO: 2340769 - RNA, 13 nt, Human
aaaaauacaaaaa

SEQ ID NO: 2340770 - RNA, 13 nt, Human
ggcucacugcagc

SEQ ID NO: 2340771 - RNA, 14 nt, Human
ggcucacugcagcc

SEQ ID NO: 2340772 - RNA, 15 nt, Human
ggcucacugcagccu

SEQ ID NO: 2340773 - RNA, 13 nt, Human
ggcuggccacugc

SEQ ID NO: 2340774 - RNA, 14 nt, Human
ggcuggccacugca

SEQ ID NO: 2340775 - RNA, 17 nt, Human
ggcuggccacugcacag

SEQ ID NO: 2340776 - RNA, 19 nt, Human
ggcuggccacugcacagag

SEQ ID NO: 2340777 - RNA, 21 nt, Human
ggcuggccacugcacagagcu

SEQ ID NO: 2340778 - RNA, 14 nt, Human
ggcuggcagguaug

SEQ ID NO: 2340779 - RNA, 19 nt, Human
ggcugccuccacucccacu
